United States Patent 7,750,207 (ZEA MAYS RIBULOSE BISPHOSPHATE CARBOXYLASE ACTIVASE PROMOTER) - sequence listing, part 16

SEQ ID NO: 22124 - DNA, 16359 bp, Zea mays
  misc_feature (10595)..(10595): n is a, c, g, or t
  misc_feature (10647)..(10647): n is a, c, g, or t
cggagtacacggttggtggcgggctatgagccgtgggcggacagggaaacggtggcgacggcacggcagcgggcaaagtacgtgcagtgcaggagtaggtctgcggtgtgcccgcccaccaacgccagtgtggttggtggctagactgacggccgcgccgcgccagccaaagcggggactctggctgtccgcctctcccggttccggactggcagaaaaagttggcaacggcaacgggggggtgcatccattggatctcgcgcaccgcggtcaagtggcgcgaccgcgggagccgttggaacccggggatcggcggatggtggcgacgctgtgtgctgtgcgctcgggacgggacgggacgggacccacacacgcttggaggattttttgaagtggcacgcactagattacgattaacggtggaaccttcgcgccgagctgcctttggtgggttctgccttgccaagcgcaaaagctttcggctgccttgtttacgggcttcacagtggactacaatccgcgtgcatgatgggcttccaaaccgaatgacccaacagttagttggtttgcgtcttcgcgagcgccgccgctctccgcttcaccgaaaggcagacgtgttccacttccacaaaaactgctacggagtattcggcgctctttaacttgacaatcgccactgtcgaatgggctctattggattgagcgtgaaatatagttttgtaataaatactgtaggtttataaaaatgcaaatatccatattgttttcttcttgatcttacagtatcaaatagtagtagtggcacatcatgatcagctgctaacacgtttacatacggtacgcatgttatatatatacaaagcatacgacacgttccctttttttatttctccgtagtgatgtatctagttttttaaaaaacagtaaaattcaattatattctataatccgtttatgagaaagcatgaaaaatgacttttttttaagtcatgagtgcatgacacttgcaaaccttagaatcactagcatatataatacgtactacatttcgaatcttataatcactggcataaatacatactactctatatgtaaacaaaccgagaaaaatacatactccgtcttgcgttgcacactctaggaacattttgggttagcatccaaaaggcagtgaagagtacaaaacggttttggacatgttagtattggggcccaaaactctaggaaccatttggggtaccgaaacttgggttgggcttgggccaactatcagcccagatttctatcaacccaatgaggacatgtttaataatcgaatgaaagacagatgaagacaaaaaaaaaggccgaacatcattgtgtttttttttttttttttcaggaaccatataatcaactttttcacacgaattattaattattttgcagggcactccgtcacaatcaccatcattattgacccgagcaccaatctccatgcaatcgctactactagtggtggatcatcgacaacacctgtgacccggagattaaacacatggcaatcgcaggatggccacatgcagctgcacgcacactgattttgatttgtgtttagatggcggggcctccagctcactcccagatgccgacctccatgaacccgtcctcggtggcgcagccccggaacatgccggtgcagttgaatccgtacgccacctcgccggtgccggagacggcgatgaggccggcgaatccctggtcgaggcgctccttgacgcagtagtcgacggcctgctgcaggggcagtcccttgtactccatgacggcggccacgtcgcgcgcgagcgtgcagcggatgatggcctcgccctcgcccgtgcacgacacggcgcaggcgccgcacgcgtaggtgccggagccgatgagcggcgagtccccgatgcggccggccatcttgttcatgagcccgcccgtggacgtggccgccgcgcaggcccccgtcgcgtccaccaccgcgcaccccaccgtctccggcgcgtacacgctgatgggcagcccgttcatgaccatccccgccttgtgcacgccgccgccgttgctgtccgccgcgcccgccagcgcgctgcacgtgtccgtccccgccagcgggatccggtagtcgaactgcacgcgcgcccacatccgtgcgtggtcagtcaggtcaccacctctggattgatttcggaaacccaaaaggaaaagaaaaaaagttgacaggagtgggtgttgtaggcggacggaaccaaccaggatgctgccggcctccttggcgagcttgagcatgccgacgttgtcatccgtgatgaagtagctgttgtccacggtctccaggccctagagaaaaatagcgaaccaacatcagaacaaaatttcaaaaatgaaaatacaaaaactgttgaaaatccccagctaatctgggccgcgcgcgctcggatcttgccgtgttgttggccacggtggaccacggcgtggcgacagattcgggcgcgaggcggacacgtacagccacaggggccaagtggaggccgatggtccctgcgtggattccgtggatgcggctcgggcctcggcgcccacacgcgcaccaacaacaccagcggccacggcccacgagcttggttaacagagaagcatggcgcgtgaggtgcacagtgggtggagcaggcaggagctgtgctacgttcgcttcaattgccagcttggggtgggggaaccgacccgtcctaggttgtcatgaactgacaaaaccgcccccagctgttccacagctggtcagcagagctcgctctttgtttagtactctgagtgtggaaagaacgtgaggcccgggaggggaggaacagtgagtacactttttctttttctgcttggtaggtaggtgcggttctttggtggacaaacgtgacttggaggagtggcatggtattacgtagcagagcatcctacaaatgaatcttcgtggaatatggtgaacaagaaaaaaaagagagagataggtatcaaatcgtgttacagtacagcgtattgaacttgtaacatgtactgctataattatatatatttttaaacgagaaatggacagctagttttggcgcgggtcccagcagcaaatcacgcagcggttgctttcagctgatgtgaaatcctccgaggaccatggggcggcggcaaaaaagtgggaggcacgtgcacgaacaaacgtaaagcagagtgctaatctagtttctactgctagactaagatgcaacaatatgggctgtctacacatgcaaattaaaggcgaagttgcgtgccttgctgacagaaaacaaacctctcaagagacgtaaacggagctagataagtatcgagcctgtcatgttcaggaggaaacgggatgcaggtgcagccaaaggaaaatcccaaataaagtgaatttcgtcggccaatttcgtggaccagacgctctccttgcactagcactagcagatgtgcagaatcttgctggaaattcacatggccagcgaagattcacctttcaagacacgggtcctgcagccgttctgttgcggcgggaaaaaaacagagagactgtactacgtgccttgcacatgcctgcagacggctgtcctgcacccacgtcacgctcacgggttttcaaccagttctgttttaagttctagcttcaccggttcaccctaatttcgcggtaaattccgtttccgtttatttatccggcattctctcgcgtccttccatttacattttatctccataaaaatggcgtttttttttacttgaagaaatttgtgtttgttagggggtttcgtttgcactgggggagctagctagccatgcacgattcatgcagcgagaaccgagaagagaaacagtgaaggtgacgaggacgcgagattaaccagggaggaattagttgggtcggcgggcgggcggccctcacctgcgcacgggcgaactcctcggcgccgtcgaaggcgaggtacgagtggggcgagttgtccatgacgcggcgcgccagggacacggggttcttgacggtggagacgccggacacggcgccgcagcggcggccgcggccgtccatgatgctggcctccatctccacggtgccggcgcgggtgagcgcggacccgcgccccgagttgaagaaggggtccgtctccagctcgcgcaccacggcctccacgacgtccagcgcctgcgcgcccgcgcgcagcaggtccacgcccacctgcaggcaccgcgccagcacgcgcttcgcctcctcctgccggtgctccgggaggttcgggtccacgcccgcgccgccgtggatggcaatggcccagggcgccatgtcactggtcggcggcggcttgattctctctgtctctatgtgtgcgggcgggcgggcgggctacttgtctctgcttctcgagggatcgatcgatcggtgttccccgtgcgatgcgtgaaattctgtggacgatgtgaggattgagaatgctgggtgggaaggcgggggtatttataggcgtctggcgtctgcggtctgcccttctcgtgctgctgtgctgtggttgtggcctgtgggttgtgctcctgtggcccgccggacgccagggggaattcagctgagttttgagaatctcaagtccgggagcggccgcctggctcccacaggccacagccgccccactggccggtccggcccggtccggagcgaatccttattttaaagggatgcgatctttagtgtataaatgggtataatattaggccatgtgagtaaatcgagttagcgtcattcaagatttcggaagattatattattaaatgtatacaataattaatacatgtgttatacatgtgttgtatatatgtctaggtttataatcatctatattcatgaatatagacataacaatttagagctaaaacgactactatttttagacggctggagtataagcatagtttgataaaaaaactgaacattttagactatctccaccagcttccatatcccatcgcctatctaactatctacttcaaactcatctttttgtagattatacaatatatagtgtaaaatggtactttacgcgctcatatacacgctcttgttacaagtataacctaataatactgcatacaagtgttatattctaacacctaggctaagtttagattgactaaaataaattgccaaacgttaaaaaatagttgctttgggcagagtaatgtcaatgtgtaaatagattagagataatagttagctgctaaattacatgggaacatcctaacaacttagttaatagttctacttctgttattagctacttttagctagacatatccaaacaccccagttaagagcttaaggctaactctaagagagtacttatcacatgcctaagagcatatccaattattagctacttttagctaagtccattgacattttttagttagctaactattatatccggttcattcgttcattcaaacatctcaaaaggctccgtttagtcaggttttgggctgtttatttttcagttcaaaagctaaaaaaaaactagtaaatgggttgtttggtggttacttttaagtaatatatttttgaagcactttagatctatttttgacttttggttttgtaccttttaaaataatcgagataaaaaagctattttgctatcgattcaaaggagataaaaataatagatatttcgccggagcatcgcgtcccgggctcttctccggccacggccacggccacgagtcggccagcagtcagattacagcgcaccggcaagagcgaggcaaagaacagaacaacaaaagcaaggtaggtaagtagaagaccgtgacggtgcccgcggtgtcgccgccgcagaggtaggagcaagggagccccgcgttccgaagcccgtgcccgtggacttgtcgaggtagtacagtgcaggtgcagctgcatctcccgcctgccatccatacagtggatgtggacatgcgcccgcgtcggcacgcagctcctttgaaggtagggttacaggctgttggagataatttctttttttttaatctcaccgaatgtacttaggttgaaagtttattttgggaaacgccgtaaaaaggcattagccggctctctcaagctatcacaggtggtgtttagtttctccatgtcttgcctgacatttcgcttaaaccatgtgccgtgggagctcagccgtgaaaaagaaaatttggcccttggccgtctgtcgagcaaaacaagtcaatggaaggaaagggactcactggctgaggtcagtacaagcgtttttttcgcatgaatttacccccgacagcttaggatccactaaagtacgttgaccacatacacataccgtcaagttatcatgcgataaacaacagtcaacctaaattactctctactcaaagctaactagtgctgcgacctgcgagtaaaagccgctccaattggctggcggcggcagccggcgcacagaccggaatccagagtcgctggcgcagaagatcagcgggcgcgtgcgattctgaggtgaccaaccgaccgacccagcccagcacctagtctcgtgctggaatccacacaagcgaccacgcaagttggaatctgacgcgcactgagactgagctgcggcagcggaatctgtgccccagccggctggtccgccgtgatgcgctaatctcctcggattgcgtgcagattccaccgctgggatcgctgtcaattccacttttctaatttctgtggtgaatctgggtcggcttttcttttattgcggccccgtaacaagggcggcgttaaaatcgttgatttaatctggattggccagtgattctcgttcgcgaaatttggtgagctcgccggaaaacaaagcgaaaacaggtgtgtagtctagcgatataaaagtgaaaattatctaatataaatgacgaattatatacatatatatgttagcataagctaaataagagcttaaaatcaggtatattgacaaaataaataatttaaattaatttaattacacgacaattatattatacttttcatcgcaaaataattatacatattgaactgggctgatacaatgtttgtgcgttgcaacaacatacaatcatatttaattatattagttagatgggctagactctaggacgatatgcgaggaatcaatggcaagccaatgtggtagactctttaaaaattaatatcaaagcgtatatgtgatccacataccatatattaaattaataataacaaatattacattttatcttgaccaaaagacctataaatatataagttgaaaaagagtccacccatttttttaatatctcgttgatcgctcttctccgttagcggggtaacactatgtagaagtgttacgctgcgtgtgactttgtatcgtgttaggcctgaatgatttctttggatgtggcttcttgttttgtcttgtcgtgtttgattagctagggtggtttttatggtccatccataagggttccccctgaaatttcgtagtcctttcatcactgagcacctggagattcgttttacccctcgttttcaactgctagatactttcagaccaaaagcatcccggacgcaattgcatctctttcgaccaacatcacggggcatacacaggcggcattcgacgacgtcaccccaccagtcaccagccaatcggagttagcccaacacgtgaggcttttcctcaaacccgaagtatatgctgctgtcaggatcgtcggcaagttgcaggcgagaaacgcacacaagctatagctaaagctaagtatcgtgctttgtgttaacaaatcagcagtcgtcttagtccggtgcagctaagcagtagttaccaaaaggaaattgcatgcatgcatccttccatcatgtagcgaacaaaaagaagcaatcaaaaggaactctgtggaagaaaaaaaaaattctgacgtacgagcacaaaaggatcatcggctagagtttttctttctagtcgatgatacaaaacaaaacttggattgcatgggcaatgcaagctgtgtgtagtattattgggacgactaagtgagcaagtgctgcctaaaataggctgacattcacatcaagggttaggcagggcgtcacaagttagtactgtaattggtaccttccagtctcctcctatcgatgtgtcccgtcgtgagcgctccaccagcatggagctagcgaacccgtgcagcgcagggagatgtagagtagagctacatgtttttcggtttcttttccagctgtcaacatgttggcacacgacccacgcccaggtccgaggctgccagcggccatggaaatcctacatcctgagagctccgcaggcttcgacacgtcgtggagctactgcgagccctcctcccgcgcaacgatgaggctatagccctgtctgggctttttttaccaaattaacagggctttttttttaccaaattgtgccgcggattacaaaacgcactaactttttaacccacttctataaaaatttgctttagtaaaatcaatcaacatgaaaagaaaatcggttaagtcgtcgtatagtagaaatatatcactttatagatcttgaaccatttagaccacactttattttccttcgcatgtaatcctcacgatactcagattcttcgcatagctccacagccagatactcagaactggtcagtgaaccaaacgacagtcccctacgaggaattagcgactgcatgggagcccaatggtcaagtagaagactatgggataggagtgctttggactgggcacagcacatggacgtgaaaaaaactgagcatgtgacgttcacggctgcgctttacactatacggcgttgagcagcggagaccatacctgtggggagcgggcgggcggtagggcggccgaccggtcgtcgtagcccaggagaagaggacaaattttcgatatttaaccctcattttgtatgcctttctacgtttagcatctagctagcacatttttgaaagcttaactctagtcacggtaattgttttgatttaagggattccattctattcgtttttatctttccaaagtttcttctcactctacccatgccttgaaaaaaacactagaatgcccctccaccaaattggaagagatcacaatttacatgcctagggtaaaattcccaaagtctacaaattactgtaggtgttaagcctagggtcaattttccaaggtctgcaaattagatgtgggaaaaatataaacaaaaagttaaatatcgaaatttcgcgacaaaaaacaaggtggtttttttttacccctcgtccgtctgtcatgctcatgctaggctgctccggccagcatcaaggattcgagatcccctcgctccaccccggtggggtcatcgacgctagacaccactgcttaatgctgggaagagggaggaaaaggtgagaaggagacatgccctctttccatctcctagtagtggtgtgctgcctttgagtcaccttcgcttatcagctgaaccgatcgaggaatcaaaatcctaagatatagtacatagcgaagagtaccataaaaaatggggcatatgcttttttagagacaaaaaaaattagcaactagtatgatcagttaagaaaatgaatagtatacatgtttgtattaccttgattttttatgagatgaaaaaatgattgctgtatcccaaaataattacacttctaagtttgagattataagatcaatgctatcgagaagctacatacataactatattaaaaatataattattgtacttgaaaagaaagaaagtaaaaagagagagagagataaaagacaattaaagttaggttgtcttcatatatagatgtgtatttgttttgttacaaattttaaactcttcaaagtgcacttattgtggcacaaagtgagtataagtactgaagtttatataggattttgtattatcttgaacttattataagactaataaatgacggtacccattcagggatgcttctagacaactagcaactagtaactagtataatcagttaagaaaatgaatagtatacatgaatagtataatcagttaagaaaatgaatagcaactagatggggcatatgatttttttagaaaaaaaaaactagcaactattattgtacttgaaaagaaacaaagtacaaaaaagagagaaagatacaactagagctagggtatatttgttttgtcacaaattttaaactcttaaagtgcacttattgtggccaaaagtgggtgtaagtactgaattttatataggattttgtattctcatgaatttattataagaagaataaatgacgctacccattcagtaatgcttatggacaacactgagctctaacagctcaacctcgatcgtgtttagcaatactgagctctaacagctcaacctctccgagacgctattatacgtaggatacatgtgtgcagactgcagagcgcatatatgtgtgtgaaggtctgcttttttttttctataccgtgtttagagaaaaatgcatcgaaaaaaanactagtctaattttaccttgccatcacaagtcaatcaatagtcttctgggangtggtctcgctttcatgtcatcatatgataccgattatctcgtaaaatgacatgcacggaaaacgcaccgatgccttgtcactgttactaatattggtgaagccagaaagaaactaagaaaaggaacgttgaatatttcagagaaaagaaaacaagaacaggacgctaatttgagatgtatttgaatcactttatatatatagtctgctatatatatatttttaaacatataaaataaaattcgttggagccttttcttataagctaatccctatattttaaaacaattcactaatttaaggcactcttatcataggagtcagtacgacctgcaatcagtcatggttccaaaaatatcacacgtacgttgtggctgtactaatcaggattgccatatatacacatcaaatgaacggtggctcatggcgtcttccctctcaattgtacagtcactgtcattttcttgtgaatcgaaggcgctggacatcgccgcactcgatccaggaccaaccacctgtttcgagcctttacccaatcaatacaccgccagcttgtcagcgataagaacagcgacaaaacaaaacccaccgcgcatcaggcattcagcccccaggtcgctttttttctgaaatactaaaatcatttacgacaaacaaaacggcatttatttgaaaccatacgtataaaatcttttacagaaaaagttaagatgaagataatttgctttatctatttttttttctagaaccgtgaactgagagagcaaggccgtgtttgggatggctttggcgtcacaattgagcgaagagaggccgtgtttttaggaattgcggaccgtagtccatatatttttttctctctcctgggattgggaacatacaggccctacgtgccgcatcttggaatctcgtgtcccaggcactagcgacgagctgggagaaatggccgcgtcgggggcccccggagattcgaatctccgggtggcgaccacgagcaagattgtctgccccgctgccttggaccttggttcattggttgggtgcgcgcacgtgacgtgagtggagagagcacacgacgagctgggtggcgtggagcgggggggctgggcagtggacactgaagtgtgggccgaggcgagttcgcggtttggggggctgacctgtggggccgcgccgcaagaggaaacgagccgccacgcgcagctcaatgcctgccccctagcgtcgcgcaacggaccacgcttcgacggggggcacgggcagtagcagtgacacagtggggtatggcgacagacagcagcccttgagcaactcaggagccagagattacaaccaaactaaatactaggggtttgtaaagtatattttacttgtacgagttggttgttagatagatatttgctcgcgttggaagcatatgcatgcagcttgatttttgtgtgtgtgtgttccaaaccaaaagtacagagtttttggcttgtgatgataccacttgcgaagatcggaacgaagctaaagcctaacaaaaagtactcggtcgtgcgcgcggctgtaatgtaagcatctatcgtgcctaatggagatcctacttctccggagctgaatcatgggagcggagcggctgtcagcaatcaggaaaagggacaggacaaacagccgccagtcggccagtgcaggcgtgacaaatccgagcggttatttaatctgatctcgtcgaattaaaatggggggcaggctgagttggcgccgctgaagaaagtacgtactcccactacaggccggctgctagcagtggtgcgtttcgtttctagtttcagaggactgctgtacctggtggcgggtgcattgaacaccgacgactcatgcaggtgtgtgctcacctctctctgactctctctctctctctctctctctctctctctctctctctctctctctctctctctctctctcttaaggaaaatagttaactgctaaacaacagtagagtagatccaaccatctcagctagtagtgcgtgccgtcgcacagtacttaaattcacccacgtgatcacaatattcaatactgttgtgtcgccgcaagcgttacgtacaggtacagctgacctgatgtctactagtaacgcgcaacagagtttggccataaacaagttgcccgtaaccattggatgggaggtactcccgaggtgaaaccctatacaaaccctgacctgctagtttggtctactctctattcatcgctgattattctatcacctatgcacctatactgtgcactacagtgacagcaccattccttgtacggtaggcggagggagagagagagacacgcatggcacgtgaagggcaggcccgcagagagaccgcggccgtccgttttggcgaggctagcagctagctggccggccgccggcgcgcgcagtgggatccgcgcggccagaactcgcggcgagattcccgtgtcgaggctgcatgtcgatggtgggtttggttggtcctcgcggaaagtcgtgagcgcgattctcgagggaccgatcggcctgtgtgtgtgtgtgttcagtactccttcagtgcccaccactgggcactggtccactgcctagagcccaagatcgtcctggatctcctggtcagtctcgctggccctacggacagatccacggtgaattccaagtttccaacccatagccggctttaccggaacgccctgtgagatcttgctaggttatttacttatttctattctacgtggattcgatcagattgaaaataattatgaatttttttaacttgcttatgatttaaatgcacacaatccatgtgaattgagaacaaaacaagcaaactctcgaattgttactactgtgctggacagccgcagctacctacacgtactgccacgtaacggtaaagcatctcctctgcgcgactgcaatgcgtgctcgagcacggtcaaaatcgtcctgtaattgaaacgccaaaaatgtgttctgttgcttctggatgcattgattttattttctatctagaaatactaaaacgccctgtaattgaaacagaacgagagtgattatataataatatcaaggaaagagaattaagagaatgtgtatcacgtaataaataaatatacgtccaaagactgcccattgtttatctcgtgcaatatatttttgcacgagcaaaacactatctcagctcgagctcgggcagactaatcagggtaggagcaatcaagtatggcaatgtcgtaggtgcccatgcagccgtgctagcttgtctaaagtacagtgcagaaaatagcctagcagtgtccggtccctttcctgagcagaaggccggaaacggtttgaacgtgacacacgttggggcttggaccgggggtttctacatacaacagtactacgtcgtgactcacgacgacacgaacggaggacggccggacgatcgagctgaagctgggtgacgtgtctatgctagctaggcctagcattactaattgtctttctttttctttgccgcaatctggttggcgctaagcacgcttgctcacggtgacgacgcaggagataaggctatcttgcattcttgctagaaggcataacattattatctcttctctctcgcgtacgtacgctaccttgatcagattagcttgagacgcgtaatgagcctggcacctggttgtatatgacgacttgacgcgttctttagctacgacgcaggaagccaggaagtacgcatgcatgcatccattccggattggcttctttaatttctgactccgccgcgcgctgaccgtggccgtgggcccgtggctgcagtgcgctcaggatgccacgcccacgctagagaacgcgctcgatcgccagcttgagggcatcgtctcgtgcgtgcgctgcagcagtggtgccggagggaaaactcgggtgtacgtatgcgtgtacgatttgaggtgccatcgggaaaactggcgactccttccagctagccgcagcacatttttaacaaattgaattgggactgatgagcacgcgcgcgcccgagtttaagcaagcaatggctggatacgtatgcgttgcgtgtacgatttgggtgtcatctgctctgattttgatcttgacgtcatcgtgtctgtgacatcagagatgatccgatcggaggcggctgggggttcggttgctatgctagagtcctgtccagctcattagctcaagcgcctgccttgccttacccacccggcccccgtgatctctaccgcgctagtgctgctgactcaccatcgctcgcctcgcctctgcatgtgaagcacgcgctaccgctgctgactcatcgttgcctcgccactgcatgtgaagcatgacacggcatggtaggggccttttttttggttgatttccggtatggtagctagggggctaggggcaagcagagctggaaaaaaaaatggattctgcaacgccgccaactgggccagtactcagaaccgaccgaaatcatgaaagcccatggtttcaatccaaacgggcttcttcaacttcgggccgaagagtaaggaccatcggcggccccccaccggcaatcgtgctattcagtcggcctggctacgttcctgactgggaaaaaagggttttctccggccgttaccccgaggagccattggcaattttgccattatcatttgtgggcttcgccaagccgtccgccgccactcgaccaccaccgccgccgcggcgccgccgacgccgaccacaaccactcgcggttactaccgcctccgccccccgctgcttctcgtctccgcgcagccgtccgatggccaagcggctcgccggcgccgacaaagaggtagggggcggcgcgccaacagagcagcccaccgggaccgggcaggccgcctcgtttcgctcacccgttccgtctgcgccaggtgctcgtcgaggtggtgaggttcacgcagaagagcggcctgaggggctgtgacggcggctggaaggatttcctggcccggaacgacaggaagtttggcgcgtcggtcagcgaccccaggaagcgctccagggatgtgctgctcgccttcctgcagaccttccccaaggatttccagaaggttggtcactcttttttgtttcttcttcagacttcagttcagcatgcccggcttcactgctagctgctgtggtgtgtaagcggtttcctcccggtctgttttgagagtttaaaccttgctacgttctggttccagtacttcggcaaattagtgaagcgtcataatgaaagaagtgctgttcagcagtatgtggctgatttccccgacgaagtttctccccagcaggtgatgtgtatgctagatcatgcggtttttgtttttagaatttctaagttacattgaaagggttgatgcctgggtgtcaagcatcagttggtcgacagttgtattgatgtacatgctaaatgcagaaacttgttcaactgacggcagagcacccagagtacagaaaacactactgcttcccatcgtaccaggaggtatgaacttttctgtgctgttaatccacgaatgatgattaagccctttttggattgtacactttcgttggtgatcttcctttgatatgtcctgttcatgttttggtgaccaattcttaaaacattggagtccactaatcttcatgatatactacctcatttttgaactaaaacacgacaaa

SEQ ID NO: 22125 - DNA, 1855 bp, Zea mays
  misc_feature (1)..(1): n is a, c, g, or t
ngaaaatgtgggtaatacgggaggtaagggcgggtgagggagcgaggggattagaaatgtgaggaggagggtagggaggggggggcggatttgatgaaggatgtgggtggtaaagagggtgggatgtggcgaagaatattaaggaaggagtatgaccagaggatgaggggggtgggagttgtgacattggggtgtacggggttgggagagggttgggagaggggagtacggtgcgggcgtggttgctgaattgccccaactgacgaaaggggggatttgttgcaaggggattaaatttgggaagcggccagggttttttccaatcaagggcgtggtgaaacgacgggccagtgaattgtaatacggctcaactattagggcgaattgggtaccgggccccccctcggagtttttttttttttttttttcaggaaccatataatcaactttttcacacgaattattaattattttgcagggcactccgtcacaatcaccatcattattgacccgagcaccaatctccatgcaatcgctactactagtggtggatcatcgacaacacctgtgacccggagattaaacacatggcaatcgcaggatggccacatgcagctgcacgcacactgattttgatttgtgtttagatggcggggcctccagctcactcccagatgccgacctccatgaacccgtcctcggtggcgcagccccggaacatgccggtgcagttgaatccgtacgccacctcgccggtgccggagacggcgatgaggccggcgaatccctggtcgaggcgctccttgacgcagtagtcgacggcctgctgcaggggcagtcccttgtactccatgacggcggccacgtcgcgcgcgagcgtgcagcggatgatggcctcgccctcgcccgtgcacgacacggcgcaggcgccgcacgcgtaggtgccggagccgatgagcggcgagtccccgatgcggccggccatcttgttcatgagcccgcccgtggacgtggccgccgcgcaggcccccgacgcgtccaccaccgcgcaccccaccgtctccggcgcgtacacgctgatgggcagcccgttcatgaccatccccgccttgtgcacgccgccgccgttgctgtccgccgcgcccgccagcgcgctgcacgtgtccgtccccgccagcgggatccggtagtcgaacaggatgctgccggcctccttggcgagcttgagcatgccgacgttgtcatccgtgatgaagtagctgttgtccacggtctccaggccctgcgcacgggcgaactcctcggcgccgtcgaaggcgaggtacgagtggggcgagttgtccatgacgcggcgcgccagggacacggggttcttgacggtggagacgccggacacggcgccgcagcggcggccgcggccgtccatgatgctggcctccatctccacggtgccggcgcgggtgagcgcggacccgcgccccgagttgaagaaggggtccgtctccagctcgcgcaccacggcctccacgacgtccagcgcctgcgcgcccgcgcgcagcaggtccacgcccacctgcaggcaccgcgccagcacgcgcttcgcctcctcctgccggtgctccgggaggttcgggtccacgcccgcgccgccgtggatggcaatggcccagggcgccatgtcactggtcggcggcggcttgattctctctgtctctatgtgtgcgggcgggcgggcgggctacttgtctctgcttctcgagggatcgatcgatcggtgttccccgtgcgatgcgtgaaattctgtggacgatgtgaggattttttgattaggatgttctaggtaatggtctcgtgc

SEQ ID NO: 22126 - DNA, 2110 bp, Zea mays
  misc_feature (18)..(18): n is a, c, g, or t
  misc_feature (137)..(137): n is a, c, g, or t
  misc_feature (190)..(190): n is a, c, g, or t
acgtggggcttgcgcttnccgtgggcttccctttggttaggggccccacgaagaataattggggccttggggggttccgataccttggtaaaaaatccggcggtcattcccgagaggttgcttctttacttagctcntaccattcgccaattatttttagcattttagtttccaatctggtagtcatacntatttaggtgtagattgaaacttagccttttgcggtagagatagcaacacttagacaaaacctagtttggcccattctagttttgattatttgcataggttctgctctagggatttaattgtggcctagtttagtaaaagttttagaagtcctaattcaccccccctcttaggcgtcacccgtttcctacaagtggtatcagagcccggtttggctcatttgaaacgctttagcttcaccgctaaaagagtcgacgctttttagaggaagggatggatacccataggccaccacacttcgacggcactaacttcccatattatagtgctagaatggcttgttacctagaggccgttgatctaggtgtttggagagtcactcgtgacgggatgaaacccctcaagaatcccgagaaacccaccacgagtgaggaaaaagaaatccatttaaatgctagagccaaaaattgcttgtatgaatctcttagcatggatattttcaatcaagtatttaccttgaaaactgctaatgagatttggctaaaattgcatgagctccatgacggcacatccaatgtccgtgagcaaaaacattgcctagtcttaaatgagtataattcttttgctatgaaagatgatgagcttgttagagacatgtattctcgtttgaatctaattatcaatgagctcaattctattggcattaataagctaggtgatgcggacattgtgaggaagattatctccctgctaccacaacaaagatatgggagcatcatcaccatccttcacaacatggaggacttgagcaacatgaccccgaccattgtgattgggaaaatcgcggcttttgagatgtcgcgaaaaatgagtcggggagaggagccaacttcctcaaggccatatgcttttgcatgtgatgaaaggaagggcaaaaagaaggctcccactccaagttcctcaagtgaagaagaggaagaagaagaaagtgatgatgatgaagataatcaaccatgcacatcatcctccgaggacgaagaaacaatccgacgcgtcggaaaggtaatgaggatgatccgcaagattaatctaatgggtgtgcccctgcaggtcgaagatcttctctttaacattgacaggaaaaagcaaaggaagagaggatgcttcgcatgtggggagaagggccacttcagggacaactgtccaaatatggccgaacccaaaaaggagaggagcaaaggcaaggcgctaacaagtgttagaacttgggatgactcttcaagtgaagatgaacctccaaggacgcgcagccaccggtcctcatcacgctcatcacggtcatcacacaaatgccttatggcaagaggtaacaaaagcattccatactctagtgatgaaagtggtagtgatgatgaaggagagggaaagccctctgtagatgagcttgcgaatgccgttgaattttttcaagatgtttgcactaaacaaaaagctcaacttaaaaccttgaaaaataagttaattagctcccaaaatgattacaaaggtttgctagaaaaatttgaaacttttgcaaacttaaatagtgagttgtcaaccaaaattgagctattagaatctagtgctccatccactgctaccgatgatggccttattaaaaagaatgaaaaactcaaggctaagttagctagctcccaaaatactattgaaaatttgctagagaaaatggaaattcttagcatacacaacaatgagctaactactaagctagaaaacattggtagcaccccagaagcatctttagttgaaattcctgaaattattaaaaaggatgcttctacttcttgctttgatttaattgatgattctaacccatgcaaccaagttcatgttgagaatattgttgcagaaacatgttcgg

SEQ ID NO: 22127 - DNA, 1177 bp, Zea mays
ggaattcatcgggcgtccaaacaacggcacatctcttgcctcctctttcgcgctgtccggagaggaggggcaggaggaggccgcaccaaatctatctggggatcggagcgcgggcgacaagatgccacgcggcggcaagcccgcggcttcgtcgaagccgaacccgttcgactcggactcggactcggagtccagcaataagccggcgaacaagtccggggcgtcgtcgtaccaggcccccgccgacgccaagaagcggtacaaggacgggttccgggactcgggcgggctggagaaccagtcggtgcaggagctggagcactacgcggcgtacaaggccgaggagacgacggacgcgctcgccggctgcctgcgcatcgccgaggacatcaggcaggacgccagcgacacgctgatcacgctgcacaagcagggggagcagatcagccggacgcacgagaaggccgtcgagatcgaccaggacctcgccaagagcgagaccctcctcgggagcctcggaggcttcttctccaagacgtggaagcccaagaagacgaggcagatcaagggaccagcgcaggtgtcacgagatgactccttcaagaagaaggccagccgcatggagcagagggacaagctgggcctgagcccgcgagggaagcgcgaccctcgccactacgctgaggccaccgacgccatggacaaagtccagatcgagaagaagaagcaggacgacgccctcgacgacctcagcggcgtgctgggccagctcaagggcatggccgtcgacatgggctccgagcttgacaggcaaaacgaagcgctggatcatctgcaaggcgacgtggaggagctcaactccagggtgaagggagcaaaccagcgtgcgcgcaagctcgtcgccaaataggccgcctagctcgaacgtgggagcttgcgcattcctgggtctggtttgcgccacgattcaccctcgccggctgattgcttgctgtaacatgcatgtattcgctctccattgcattgcattgggagcgttttttctgttcaacagagaatgttctttctccttgcattgttcaccaaagttatactatattggccataacgcctaagggaagctgccgctgccagtatcgtttcctgatgagcataacaagaaacgaccgttccaaca

SEQ ID NO: 22128 - DNA, 1961 bp, Zea mays
ctccccaaaattctcatctagtcaccggccattccgttgtgtccataggctgtcagtcacttccagtcctagcccactcctccgatgctccaatcatcaacactctctacctgtgtccgtgtgctcttctcctctgcaccaccaaccaaccagtgctgccctccgccgatccactgacctaccgcgagcgccaatggcgaccgccgcggtcctggccgccacattagcgctgttcctccgcgccgccgccgcaacggccgcgacggctgcggcggaggcggaccggatcggcaggctgccgggccagccgccggtcaacttctccatgtactccggctacgtcaccgtggacgcggcggcggggcgggccctcttctactggttcatcgaggcggccggcgtgcccgcggagtccgcgccgctcgtgctgtggctcaacggcgggcccgggtgctcctccgtcggctacggcgcgtcagaggagctcggcgccttccggatcaacgccgacggcaggacgctctacttgaacccctacccctggaataaagtggcgaacatgctgttcttggactcgccggccggcgtcggctactcatactccaactccacctccgatctgtacactgccggtgacaacaagacagcccatgactcgtacaatttcttggtgaactggctggagcggttcccacaatacaagcatcgcgatttctacatcacaggagagagctacgcaggccactacgtgcctcagttgtctcagctagtctaccggaacaacaaaggcatcgagaagccgatcctaaacttcaaaggcttcatggttggaaatgcggtaattgacgattaccacgacttcatcggcacattcgagtacttgtggacgcacgggctgatctctgacgaaacctacgagaagctgcggcttgcctgccagttcgacgtatctgagcatgcgtcgaaggagtgcaacaaggtcttcgacatcgccgaggccgaggaaggcaatatcgatgcgtacagcatctacacgccgacttgcaagaagacttcactccacaagcgcaggctaatcagaggaagaacgccctggttgcccagagggtacgatccctgcacggagaagtactccacgaagtactacaacctacctgaggtgcagagagctctacacgccaatgtcaccggaataccgtatccctgggtaacctgcagtgacccagtgtatgatttttggaaagattcaccgaggtccatgcttcctatctaccgtgaactcatcgccgcgggcataaggatatgggttttcagtggcgacgctgattccgttgtcccgctcaccgcgacaaggtactccattgacgccctctttctaccgactatcacgaactggtatccttggtacgacgacgaagaggtcggtgggtggtgccaggtgtacgaggggctgacactggtgacggtccgaggcgcagggcacgaggttcccctgcaccggccgcggcagggcctgaagctgttcgagcacttcctgcggggtgagcccatgcccaggcctgtagatagcgtccagtcgttttagaactggttgctgtctccccgcttggtgaaggaggagacctggctgcgctgcgcattcttgttgctgtaaactcatccgtcacactccgttgttaggatagatttgctgaaaatcagaacataatgttgctcgtttcagtgagcagattgggtatttagcaatgtctcgttttgacagtgaaaaaaaaaaaaaaaattgtgctttttttccggtagagggacgttttttttcgtttctgattctgtttttttttgggagggaggtgagatgagatgagatcctgtacagtcagctccgtcactgacgtgaatgaagttacggtgctgcggtcaaagtcatgtcgaaatttagtgcaaacaggatagcccatgatctt

SEQ ID NO: 22129 - DNA, 1256 bp, Zea mays
  misc_feature (1221)..(1244): n is a, c, g, or t
caacaagacagcccatgactcgtacaatttcttggtgaactggctggagcggttcccacaatacaagcatcgcgatttctacatcacaggagagagctacgcagcgcccccgccgtagcctcagttgtctcaactggtctaccggaacaacaaaggcatcgagaagccgatcctaaacttcaaaggcttcatggttggaaatgcggttattgacgattaccacgacttcatcggcacattcgagtacttgtggacgcacgggctgatctctgacgaaacctacgggaagctgcggcttgcctgccagttcgacgtatctgagcatgcgtcgaaggagtgcaacaaggtcttcgacatcgccgcccccgaggccggccgggtcgatgcgtacagcatctacacgccgacttgcaagaagacttactccacaagcgcaggctaatcagaggaagaacgccctggttgcccagagggtacgatccctgcacggagaagtactccacgaagtactacaacttacctgaggtgcagagagctctgcatgccaatgtcaccggaataccgtatccctgggtaacctgcagtgacccagtgtatgatttttggaaagattcaccgaggtccatgcttcctatctaccgtgaactcatcgccgcgggcataaggatatgggttttcagtggcgacgctgattccgttgtcccgctcaccgcgacaaggtactccattgacgccctctttctaccgactatcacgaactggtatccttggtacgacgacgaagaggtcggtgggtggtgccaggtgtacgaggggctgacactggtgacggtccgaggcgcagggcacgaggttcccctgcaccggccgcggcagggcctgaagctgttcgagcacttcctgcggggtgagcccatgcccaggcctgtagatagcgtccagtcgttttagaactggttgctgtctccccgcttggtgaaggaggagacctggctgcgctgcgcattcttgttgctgtaaactcatccgttgccacattttactggccaacgtggtttgcttgttcaataatcaacattaggccagccgtcacactccgctgttaggatagactttgctgaaaatcagaacgtaatgttgctcgtttcagtgagcagattgggtatttagcaatgtctcgttttgacagtaaaaaaaaaaaaaaaaaaaaaaaaaaaagannnnnnnnnnnnnnnnnnnnnnnnggccgcgaattc

SEQ ID NO: 22130 - DNA, 1706 bp, Zea mays
cttgcatgcctgcagcccatgactcgtacaatttcttggtgaactggctggagcggttcccacaatacaagcatcgcgatttctacatcacaggagagagctacgcaggtgaattgctgtcaaaactggccaattcacgatgggcattaaattttgcagatattagcgtcacctagcagtcacatttacactcctggatcctaattcgtcgcactggctgtttcaggccactacgtgcctcagttgtctcaactggtctaccggaacaacaaaggcatcgagaagccgatcctaaacttcaaaggcttcatggtcagaactcagatctttatgaatctgtatcttttactgatgttctgcttgctcgtttctgttcaaatgataggttggaaatgcggttattgacgattaccacgacttcatcggcacattcgagtacttgtggacgcgcgggctgatctctgacgaaacctacgggaagctgcggcttgcctgccagttcgacgtatctgagcatgcgtcgaaggagtgcaacaaggtcttcgacatcgccgaggccgaggaaggcaatatcgatgcgtacagcatctacacgccgacttgcaagaagacttcactccacaagcgcaggctaatcagaggaagaacggtagtacacttgcttcgctaccaacacacgacatttctttgctctgaaactgtagcgcttactgtattgtccacgcttctgaaagtatagtgcttgtgaagcataagagttcaagcacctcctcctgacaccacgcttggttcaaatgtagccctggttgcccagagggtacgatccctgcacggagaagtactccacgaagtactacaacttacctgaggtgcagagagctctgcatgccaatgtcaccggaataccgtatccctgggtaacctgcaggtgtttgttctgctggttttttgtttgtttgtttgtcttgctctcatcacaagtatgtattttcctttgatcgcctcttccttgttagttgcactaaacaaccactggttccttgcagtgacccagtgtatgatttttggaaagattcgccgaggtccatgcttcctatctaccgtgaactcatcgccgcgggcataaggatatgggttttcagtggcgacgctgattccgttgtcccgctcaccgcgacaaggtactccattgacgccctctttctaccgactatcacgaactggtatccttggtacgacgacgaagaggtcggtgggtggtgccaggtgtacgaggggctgacactggtgacggtccgaggcgcagggcacgaggttcccctgcaccggccgcggcagggcctgaagctgttcgagcacttcctgcggggtgagcccatgcccaggcctgtagatagcgtccagtcgttttagaactggttgctgtctccccgcttggtgaaggaggagacctggctgcgcattcttgttgctgtaaactcatccgtcacactccgttgttaggatagatttgctgaaaatcagaacataatgttgctcgtttcagtgagcagattgggtatttagcaatgtctcgttttgacagtgaaccatgcttcagttttttgggattttcccccggtagagggacgtttttttttgtttgggagggagatgagattctgtaaaaaaaaaaaaaaaaaaaaaaaaaaaaaaaaaaactcgca

SEQ ID NO: 22131 - DNA, 2468 bp, Zea mays
ggatccccctgtcactagttataaaaaacaaactctggaacagagcctctacctagaatttgagtgaagctgctttgtagtgcagcagagccataccaaatacgtcctataggacgaaacgttccacctagaatttgagtgaagctgctctttagtcagagccataccaaatatgtcggcgaagctcgaatgtggacgagccagctctacgacgagtcgccacgccaaagtcccgtcgtacgtgtaaagcgtagaggagccttcaagcacgagtaagttttaataaataataataagtaaataagtaatataaatataatgccttgcactgataaactaccagcgccacagatccactattgtccttctgccttaaattactttccttcaaaagacaaggctaacagaaacatctttcaaggttcgagccaaactctactaacatttcaagttagtctctgtataggaaaggccatcatgtgatgatgtgtttgttggaaaaaaatatacaccaagatttatgatatcaacttgcaaaattcagttttctcttatctttgaaagaaacaagatcgaattcttcatcctcctcttcctcataatcatcatcgtcatcctcctcatcaaaattatagtcaccagctctgatcctaccatttacagtatcgtctagcaaacggtgattttcgacatcagtttgtataacttcatgcccatcgtcaccatccacctctccatcatcaggtttcacttccagctgaactggaccattccctaccaaatcattcgcttcttgttcctcttctggtgtcttggcaagcgaaagtaggatattttttgctttctggtctggtgggtatccacgagcttccatttctttgaaccaaatgacagcatttccaaaatccgagttcctgccttgtgcgtccatgatagtggtatatatagtctggttgggttcaacaccctggatccgcattctctcatacacacgcataactttctcaagattatttaactttgaatagcctttcatcagagtgccataaaccacaacgttgggcttcagaccatcctctttaatcctacgaaagaatttctcagctccattcatttcagatgcatttacataagctaagaccatagttgtataagagcaaaggtcaggctcaaccctgtgtcttctcattgccttgaaaactgtattagcctcctctactaatccagatattgcaaatgcatcaagcaaaatgttatatgatttgcgtgtcggcctgactccagcatcaagcatctcttcaaaaaccgccaatgcctcttcttcccttctggctttcccataagctttgatgagcagggaatagctcacaacatctggtttcagaccagctctttgcatctgatcataaatatttgaaacttccttgtattctgtctcaaatgacatcaaactattaaaagtgactgtagatagtggaattcctctctccgacatctgtgcaaatagcttacgagcctgggcatagtcaccagctttcttgtacatataaatcatcatgtgaaacatcttctggtctggtttaaaagaagttcttttttcattaagaaggtcttcaaatatagcttcagcttccttatatttgtcaccctcaactaaagatttcaaaataatttgatatgtcacaggtgatggttgagggcctgatgtttgcatcctacggaatactgcttcagccttacggtactgcttccctcttccataagcctccatcagaccagtctgtgatataacgctaggctggtaacctttcttgttcatgtactttaggaccctttctgccctgctaaaatcccccaactttccataagcggtcacaagcatcaagaagtccatctcactgaagtcccaccaatgctgtgttctgagccattcaagaatctcactgacaatattccactttttcaattgtttgaaccgaataagagtcccaagaataacatcccgtggaagtggccctcgcccgtttcgctgggtcttcagaatgggtacagctgatccctcctgctctatctctctcatcattctcctccagttcatctgctcggtctcatcagcaccatccttgaaaacttcttctttctttttcctttgcataaactttcttgtagctaacatcccatggcaaaccacctcaagcctacagttgctcttgatcttcacattgtatattgataaactagatgatacttttcctttgcagaggctggaggggaaggagagcggagactgtgacccaatcgccgccgactccatagggagcaggaccgcgggagtgagggagggcgcggcagccttatcggcgaggtgaagtgtggagcccgcccgcctccggggtccccctgcttataaacccggtctctccccgttttgcatcttgttggaatgatgacgactcccgccggctcga

SEQ ID NO: 22132 - DNA, 1253 bp, Zea mays
tttttttttttttttttgaacatcttggcaattcttgcattttacatgatagagtataagaataatgttatcgcaatggatcgcatcgtatctgttggaacaatggaccgcaatccgagaccgtcaaagtcaaactgcttctgccggctggcatcgtccgccggataccgacgcgagacagccatccagattctctcatctatgccgtgtcttgtcttctagaacaagatgaatttacagcaaaacacgtgtacaatacaggcgcaacgccgagctcgctcacatcacatcactgctagacagctagagggccatctctgcctgaagcctggtcagctcgctcacatcactgccctgtctagaagacgccgccgccgctttcgccgatggttccacggaccgcctcgccggcggctcaggcagctcgtcctcgatctccccctcctcctcctcctcctcctccagctcttccagctccgcttctagctcgtcctcgtcgaagtcagcggaagcgccaatcggcgtcgcaagtgcctgctgcatctcccgcatgctctccgtctgctcgttcgcctcctcgatcgccttctcgatgtcgtccacgttgactgattgctgcatcgccttgacagcagatgaccccgagcgcagagcgtcgacagtgtccgtggtcgccttggcgctttcgagcattatgatctggtcatggactcgcagctggaaattcgatagctgctcgatctgtgtctcgtacagtttcttcttctttaggcactggattgcggcgttcttgttcttcgcttttgtgtaatccttcgccttctcgatttccgcggaacatttcttctggaggaaacgctccttcttctccagcatctctagagtctcatggagccgatccaacgtcggtatggcagaggaggcagcctccttcttcttcttgctcttagtcttcgtcagcagtctcttcagcatcttcttggcagtcctcgctggttctccctctcgtctgatgatggcctgtgtacgaaggaataggacgagggtgatgaactgggaaatcgacaggcaccagtgaactccggtcccggaagggatcaagcatgaccgcctctccgcacccgcgtgcctaggactgcggatcgccgatgatggggctgcggccgcggatcaggtggcgctgacgacgccgtgagtgaatagaatcggctgcgggctttttcgattaggatgttcaggtaatggtctcgtgc

SEQ ID NO: 22133 - DNA, 1067 bp, Zea mays
aagaataatgttatcgcatcgtatctgttggaacaatggaccgcaatccgagaccgtcaaagtcaaactgcttctgccggctggcatcgtccgccggacaccgacgcgagacagccgtccagattctctcatctatgccgtgtcttgtcttctagaacaagatgaatttacagcaaaacacgtgtgtacaatacaggcgcaacgccgagctcgctcacatcacatcactgctagacagctagagggccatctctgcctgaagcctggtcagctcgctcacatcactgccctgtctagaagacgccgccgccgctttcgccgatggttccacggaccgcctcgccggcggctcaggcagctcgtcctcgatctccccctcctcctcctcctcctcctcctccagctcttccagctccgcttctagctcgtcctcgtcgaagtcagcggaagcgccaatcggcgtcgcaagtgcctgctgcatctcccgcatgctctccgtctgctcgttcgcctcctcgatcgccttctcgatgtcgtccacgttgactgattgctgcatcgccttgacagcagatgaccccgagcgcagagcgtcgacagtgtccgtggtcgccttggcgctttcgagcattatgatctggtcatggactcgcagctggaaattcgatagctgctcgatctgtgtctcgtacagtttcttcttctttaggcactggattgcggcgttcttgttcttcgcttttgtgtaatccttcgccttctcgatttccgcggaacatttcttctggaggaaacgctccttcttctccagcatctctagagtctcatggagccgatccaacgtcggtatggcagaggaggcagcctccttcttcttcttgctcttagtcttcgtcagcagtctcttcagcatcttcttggcagtcctcgctggttctccctctcgtctgatgatggcctgtgtacgaaggaataggacgagggtgatgaactggagacggccttctcgagggagaaagggaaagtgaggggaaaaaaagtcccggcggccgccggcggacccaatg

SEQ ID NO: 22134 - DNA, 2037 bp, Zea mays
ggccgcttttttttttttttttttcagaactaagtcatactgttgctgtatgaccatttcaaatgaatatatttatgtttactttgatgaaaaaagctcaatgttgtgataagatgacctcaaaataactgtatatgtgctcatcagcaagcaatggtgcaaatggggtcgcatctatcacaacgaccactcatggataagcaccaatcaacaaacaaaggcactttgagtgtttcagcatatgtcatcatatgactgtaagttattgccagcaggttttccaatctgcaagcaagctataggagggacagttggagtgtagagctccccaaaagcttgccagcagaatgggttattcaggtggtagtggggtacttgcactggtctgagttgcacaccggtaagagagattcctgaacaaggtaagctgtcactgcatgcaaaatggacaggtttgattgtaaatgttcctctgatattctcatattgaacccctgatactgccactgctgatgtttgatttctgcaagtgcttctgtcacaataaaactgatctatgatgatgggtgtttgaacctctgagacttgtatatttgagaaccttatgtcttgaaccaatcctacaccaccctgccaggtcttgattctgacaccattcatggttctgaacatgttgacatctcttactgtaacatttgatacgcatgcttttgtgttgtctcggcctagtccacctatgctgattccatggcctggtccacaattcacgttatgtatatttatgttgctgcatcctgtctggatggagatgcaatcgtcaccacaagccaggtttgtatgatgaatgctgacatctttggagttctgcaggtgtattccgtcagtgttgagactgttctcaggggaggatatagtcaagtcatggaccatcactccttgacagttgtcaaacttaagatgacactgtgagctgttgacaatagtgataccagccactacaacgttgaaactaccataaaacctcaatgctgtaggtttaatctgtggcattctttcaaactccacatcgtacgtgtcatcatcatcctcgtcttctgtgtctgagtaggtccaccattgttgccctctgccatttataatgccgttcccttgaataaccattccatttagtttggtgaactcgagccactggagcaagcctgaaccccaggatttagcactggttggagctaggattgttccttccagctgaaagacaatattcgatttgcagtaaggcccagagaacgagattggcccaactaggaactctagttctggtggtacgagaactgtacatgccccctttttgcaggcagcagcccacgctccttcaaaagccttagtatcgtctgtaactccgtcacccttggctccaaaatcaaccacattgaatactgcaccctgcgaggtcgctggcggcggctgtgatggctgctgctgacccttcccacagcttggagccggcggctcgggagtggaatgcctgctgccattggcagggcttggcataggagggatgtcaggggcattcgggcttggacttgggcttggttggtaaggattctgatgatttcccttggcagcaccagagcttggtgtcgagctgaccggtggcttcggacctggccggttggcgccgtactgccggcgggagctgctcttctttcccttgtctttcttgagctgggatgagcccggtgagctcctcgacgacctccaatgcttgcctcttcttgcctcgccgacttcaatggtggagcaaagagcaagcaagacaaggagaagcaggaggccgatcccttttgctctaagcttcatccttcagccccgtatatctattgggtcgtgtggagattagagtgtgtactgtgtgctgggtaagctgatagagaatagcgcacgggaggccgggaggcctgtgattgtcccgccgcccccggggtcccaaggggtgaaatagcaaactccagcccggccggcctcgagggtcccaat

SEQ ID NO: 22135 - DNA, 2223 bp, Zea mays
ttttttttttttttttttttgaatatatttatgtttactttgatgaaaagattaaaatgttgtgatatgatgacctcaaaataactgtatatgtgcacatcaacaagcaatggtgcaaatggggtcgcatgtatcacaacgaccactcatggataagcaccaatgaacagacaaaggcactttcagtttctcaacatatgtcgtcatatgactgtaagttattgccagcaggttttccaatctgcaagcaagctatgggagggacggttggagtgtagagctccccaaaagcttgccagcagaatgggttattcaggtggtagtggggtacttgcactggtctgagttgcacaccggtaagagagattcctgaacaaggtaagctgtcactgcatgcaaaatggacaggcttgattgtaaatgttcctctgatattctcgtattgaacccctgatactgccactgctgatgtttgatttctgcaagtgcttctgtcacaataaaactgatctatgataatgggtgtttgaacctctgagacttgtatatttgagaaccttatgtcttgaaccgatcctacgccaccctgccaggtcttgattctgacaccattcatggttctgaacatgttgacatctcttactgtaacatttgatacacatgcttttgtgttgtctcggcctagtccacctatgctgattccatggcctggtccacaattcacgttgtgtatatttatgttgctgcatcctgtctggatggagatgcaatcatcaccacaagccagggttgtatgatgaatgctgacatctttggagttctgcaggtgtattccgtcagtgttgagactcttctcaggggaggatatggtcacatcatggaccatcactccttgacagttgtcgaacttaagatggcactgtgagctgttgacaatagtgataccagacactacaacgttgaaactaccataaaacctcaatgctgtaggtttaatctgtggcattctttgaaactctacatggtacgtgtcatcatcatcctcatcctctgggtctgagtaggtccaccattgttgccctctgccatttataatgccgttcccttgaataactactccatttagtttggtgaactcgagccactggagcaagccagaaccccaggatttagcactgattggagctaggattgttccttccaactgaaagacaatattcggtttgcagtaaggcccagagaacgagattggcccaacaaggaactctagttctggtggtacgagaagtgtagatgccccctgggtgcaggcagcagcccacgctccttgaaaagccttagtatcgtctgtagctccgtcacccttggctccaaaatcaaccacactgaatactgcaccatgctgcgaggaggttgctggtggtggcggctgtgactgtgatggctgctgatgacccttcccgcagcttggaggagtcggcggcttgggagtggaatgggcgctgccattggcaggggggcttggcctcgggatgtcaggggcggcattctggtttcctttgccgccggcaccggagcttggtgtcgagctggccggtggcttcgtacttggccggttgctgccgtattggcggcgggagctggtcttctttcctttgcctttcttcagcagctgagaggaggaggtcctcgtcgacctccaatgccggtctcttcttgcctcgccgacttcaatggtggagcaaagcgcaagcaggacaaggaggagcaggaggccgaggccttttgctcccagcttcatcctcctgtcctgtccgtatctgtgttggctgtgtggagagattagagtgtgtgtattgtgtgctggcctgctgctgctgggtagtagtagtggtagatagagagaatagagcgcgggagggctgtggttgcggggaggggaagggaagagagaaagggggtttaaatagcaaacaccgggagccggccatggtcctcctgttttgtcaggattttaaggtggaattaaaatgaaacgggaaatgattgggaggatatgtgggccccagctctcgtgcacgcaagggagacacgtgtaatcgatcttactacatctacttcctttgttgcgcttgcgctattacacgagaatcagccggtggcgtttctccgtgtttgagggattagccccggcgtgattggttttaattccattcctgttta

SEQ ID NO: 22136 - DNA, 849 bp, Zea mays
  misc_feature (40)..(40): n is a, c, g, or t
  misc_feature (84)..(84): n is a, c, g, or t
agcaagccagaaccccaaggatttagcactgattggagcntaggattgtcctcttcccaactgaaaggacaatattattcggtntgcagtaaggcccagagaacgagattggcccaacaaggaactctagttctggtggtacgagaagtgtagatgccccctgggtgcaggcagcagcccacgctccttgaaaagccttagtatcgtctgtaactccgtcacccttggctccaaaatcaaccacattgaatactgcaccatgctgcgaggaggttgctggtggtggcggctgtgactgtgatggctgctgatgagccttcccgcagcttggaggagtcggcggcttgggagtggaatgggcgctgccattggcaggggggcttggcctcgggatgtgaggggcattcgggcttggttggtacggagtctggtttcctttgccgccggcaccagagctcggtgtcgagctggccggtggcttcggacttggccggttgctgccgtattggcggcgggagctggtcttctttcctttgcctttcttcagcagctgagaggaggaggtcctcgacgacctccaatgccggtctcttcttgcctcgccgacttcaatggtggagcaaagcgcaagcaggacaaggaggagcaggaggccgaggccttttgctcccagcttcatcctcctgtcctgtccgtatctgtgttggctgtgtggagagattagagtgtgtgtattgtgtgctggcctgctgctgctgggtagtagtagtggtagatagagagaatagagcgcgggaggcctgtggttgcagggggaatccccaaattccccgcttatcccccggccgg

SEQ ID NO: 22137 - DNA, 4731 bp, Zea mays
  misc_feature (2587)..(2587): n is a, c, g, or t
gtagtatcagtatttataaacaaattcggtacacatgtaatctcagacaagccaaaaaaaactttcctggggcattattttgttaaaaggttcttagtacaacgcaaatgtgtatagtgtacatgtagcgaacacaatccagcaaaccctaggtcattgcggacataatttttaccgtacaaaaactttcctggagcattattcttgatgattcttgtttctgattgctcccttatcgtcacaaagagtaataccttggtgtaaaaatggtgttgtggtatgcaggcaataatacctctgttttcagttggcatctttgtccgtttcagaactaacgattggcaggttccttctgtattgcggggatgttaatctcctctccaatggcgtcttcctcttgctcacgacgaatctgttcacccccttcctcatcggcattatctcagggaagtcctcgtcgggaatattcgccagctcagagatgtcctttatctgagctgccctcctaaaccatctctcagccttagcttcctcagacatgtctagaggatcaggatccttcacagcagatccttccaagctctttccagtataacctctgttcgagtttcctccataacctgagctgtcaaccgcgtgattagcattcacggaactactgcttctagtggcattgctattgtcagcaaatggaccactctggttattgttgttgttgctgctggcattccatgtatcattgtagttataatcacgattgctgttgcagctggtattgtcgttcctagtacacccgttataggaattgttaccactccaagcattattgttgtcataattagagttgtcactccaggcattgttgctgttattgttatcgctgctccaataaccgttgttgctataacctgagttataataagatcgcttttcagagttagcttcatggtaagtagattcacccctactcccattcatgttcccctcggagttgcctgtgttcccagagccagtatatgcattaccactaggcctaaattcttgagattgtgattgatattgatagtaattcctgttccagttctcattattcaggttaccttttggctgactgcctcctgacataattcctgtgtctgtagtactctctattggcgtatctttcttgccaaagtagccaggaggaaaaggaacaaatgggacaaaatcagaactgtctgcctgctcgagaatactgcgccttttgtactgctgtgatgtcaatgagcgatcttttttcttactaacaacaaatcgattttcacctttccttattggcataatctcaggaaaattttcatcggaaattgcacttggggaatcctttacattgtcaagttctgctactttctcggaccatttctcagcagtatctaatgattccatacttcgcctctcaggtaaaggcactgtattatttgccatagaactgccatcttctacattgtttttttcattctcatttctctgtcgatcattactctctggtttagcaaagagatctgcagacaggggctcaaagggaacagggtcaatgccactgaggtgatctattgatttcttcggagcttccatagttgcatcactagtaacagattgattgtttggggctgcagtaggagctgaactcccaagtatcctgtccaaagtttgacttatctttgggtcggacaatgtgaggatattgttactgctgtactgtacatttgcaagccttctctccagtggtgttttgcgtgtgctaaccacaaacttattcacccccttgcgcataggcataatctcaggaaagtcctcatcttctgctagactacttaagtctgctgaatcatgaagttgagatactttgctcaaccatctctctgccttttcatcattttcagcaagttttctctcaatttcagatttaccaacacttgttgttaccttgagaagctgctgtaccacaccacctaaatcagcaccaacagatgtaggatgcggtgggattgttgctggcctcttgcaatcacattttaagcatgacatattcctcccatagttatagaaatcacaccttaacaaaaggacaaaacaaagtcagctttgtcaaagttatataagattaatacaaaaaaatttagcacttaacatgtcagatcttactgagggcattcccactctccaccagtcaacatcttctttggcctctgctcattgcactcaaggcacctaacgtttcttgcgaagttcatgaagctacatctgcaagttgcagagcaattttcataaaaaatgagttgcagatgaaagaacacacgaagtattttaagagggggaaaacaggtagaaagttaaaaaattagtgtgtcaatagtttaagaggggcagacccagggccacagtctcccacatgagtggggtataggaaagggataaaccgatgcaagtcctcccccgcaaatgcagagaggttgtttcaaacccacgacctgctgactcggtgagacagctctcagcctctcaccacaacaccaggcttgcccttcaatgtgacaataatatcaanttgcaaaaaaaaaaaaaaaggaaacatctgggtacacattctagatgcatcatatctagtagcaaaatgaacaataagctaggtcgatactttgatgcaaggcattgaacggagcacaaatattaaagaaaaagaagaatgttagaagtggcataccttgtgcaaatccaatcacctcgcttcatttcgatattttgccctggaggcctggaaaattgttcatgctgactcgagcaaatttggttgggagttaattccacagaagtggaagactgggaaagagcactaaaactcactaactcaaccatgatatttctcacggccaaatcagtgagttccttgtcttctgagcagatgtcagaagaaccgtatatgtaacttagcagatatcgaacaatatcaacagttccagctctctctgaaacagtgacctggcaaaattttccgatgtttagtgtgttgagctgagcaaggtcatatttactagcccaaactaataatgatgcaacgtgaccgattaacggaagcccaaatgacatacgtcggtttcttccccagcaaggtagcgccgaagccgctgtcctgatgcctccccgtccttgaacagagacggcgccacattgcccaccaggacctccacgtccttcctttgaagcgaactgaacgcacacccgaattagtcagcaagacagcaacaaagagactctcaccccgccaaagcccagtcaggtatccactcaagcgattcactttacctcaggaggtcaggccggtcgcgcgcgaaggcgaggcaggtggagacagcggcctgctccccgtccgacaggacgcatccggacacgagggcgagatcgtcagcggaaaagggcaggccggagccgtatccggtggcggcaagtcggtcgacgaggcgggaccactcggggaaaggcgctcggagcggtggcggcgggcaggccgagctggagccgtgcggaagggaggcggaagcggacgagatgtagagggtacggtgcggggagggtaaggagagcaggaacaggcggcgcgaggccgccgcgggcggggataggaacagcgcggcggcggcggcagtagcgggtcggaggcggagcggggaagaggtgaggaggaaggaggagagcagcttggaggcgccgcccatggcgccggagcagcggaaggagggttttgcgcctccgctcccggcttggggacggccggccggatggggtgtagcaggcgggccgcgcgggtggcacggtgcggcggacggagcttggagagataatatgtcgttgtgatcggacggctagtgttctgtttctgtggtcgccggcaaggtgatggttcgggctggtccttgggcctgtgggctgcagttctaggccgagatcactgtttataggattaaagcctatctagctcgtgtttagtggattgggtcatattatcttagttgttctgttctgtcgtgtcaataatggggtcacatgcttcgtattgttgatggcatcatttattctagctaatgttatgttaatttagtctctccaagaagaataattagagttgttcaataggtcaagtctagatattacaccttaggtattcaaatcttggatgataatactttataaataattaaacaaacttaaatcactatacataaataattcaagagtaaagtacactagcggcccacggactcataaaaccggcaaacaagtccataaactttgtcagctcatgcaaaaccctccaaaaccgggtttgcaaaaccagacgccgacgtggcaatgacatatcggagccatttggggtctccaacttggcatgttgtatcacttgtgtcctcaaacttaaatgctatgtcatctgagtccctgaactttatgagctcagagggtgaatgccatagcgtgtcaatagagaaacttatgtgtataccttcatcattgggggtcgggatggcaacgtgtacatacccgtcaggtagtaccattccatacttgtactcatcaaaaaaaatttacacgtcgggttacccatatatgctcgcaggtataaaatcttacccatagccgtacttgtgcgggtaattttacccgtaaggtaacccatgtccgctaggaaagtcttaa

SEQ ID NO: 22138 - DNA, 1368 bp, Zea mays
tcagacaagccaaaaaaaactttcctggggcattattttgttaaaaggttcttagtacaacgcaaatgtgtatagtgtacatgtagcgaacacaatccagcaaaccctaggtcattgcggacataatttttaccgtacaaaaactttcctggagcattattcttgatgattcttgtttctgattgatcccttatcgtcgcaaagagtaataccttggtgtaaaaatggtgcgtcgcagtacagttaagattgtggtatgcaggcaatcatacctctgttttcagttggcatctttgtccgtttcagaactaacgattggcaggttccttctgtattgcggggatgttaatctcctctccaatggtgtcttcctcttgctcacgacgaatctgttcacccccttcctcatcggcattatctcagggaagtcctcgtcgggaatattcgcaagctcagagatgtcctttatctgagctgccctcctaaaccatctctcagccttagcttcctcagacatgtctagaggatcaggatccttcacagcagatccttccaagctctttccagtataacctctgttcgagtttcctccataacctgagctgtcaaccacgtgattagcattcacataactactgcttctagttacatttctattgtcagcaaattgaccactctggttattgttgttgttgccgctccatgcgctgttgctgctggcattccatgtatcattgtagttataatcacgattgctgttgcaggtccatagtttaccacaacagtatcattttcagatagtgttgcatgattgcggagcgctgtttcgaggactgctctatggttagggagatctgaaaacccacctccttctggcttcaactttgcatatgttcctttgagcaaactggtatatttgacttcaattagagggacctctggggtgtcactcccaaacaggttgttccaaacatgcagcgggagttcagcagagccttcccttgccgtgaattcaagaacaccacaacaggttgtcccagcatcttgttccatagcagcacctgggactgtgtccctaaccttcgacaacctgaagtacatgggacctttatcgagagctccttcatcagacaactccttaaacgaagatggtggcaacttgatcttatccccagggccatcatatcgaagtgcctcaaacatgtgcgagaatgaaatccccttccccagctgcatcacctcttccattgtccggtcagcctatcatcaggagtacaaaagacgattagatgagcatcaggtagcagaacaaaatacaaagaatgcaaccgtcaaaacataatcaatattatggatttattatctgca

SEQ ID NO: 22139 - DNA, 2508 bp, Zea mays
aggccggccgggccgggatacgactctcggcaacggatatctcggctctcgcatcgatgaagaacgtagcaaaatgcgatacctggtgtgaattgcagaatcccgcgaaccatcgagtttttgaacgcaagttgcgcccgaagccttctggcggagggcccgtgagccccggggccgcgccggataaacccgcgctcattcctttttctctcacctaattcccgtcctcgtgtgttcgcgttgctcgcttgggtttggatccgatcgagggctcggcccggcggatgctgtagaggaatggcggaggctgtcgcgtctgcgggcaggctcgccatggactcctcgacctccgtctcgcccggccaggtttctgctattctgggctttctgtgggttttcgcagcatgggcgtatgctgaggttctcttccataggaagaatactgcttctattaaaactagacattcagatgtcaatctagcagtgatggatgacagttcagtcaaagcagaagaccagacaatgttattggaggagggtggccaagcaatggctgcaaagccagcttatacttccctcacatcacaaatactcagacttatattcatggaccagttgcttcttctggagaatcgtttaacactgagggcattatctgaatttggagggtatctactttatttttacatatgtgatcgtacaaacttgcttggagagtctgccaagaattacagccgagatctgttccttttcctctactttcttcttatcattgtagcagctatgacttcctttaaggtccatcaagacaagtcatcattcacaggaaaatctgtactgtacttgaataggcatcaaactgaagaatggaagggttggatgcaggtgctattcttgatgtaccattacttcaatgctaaagaaatctacaatgcaatccgtgtgttcattgctgcatatgtctggatgactggatttggcaatttctcttattattatgtgaggaaggatttcagtcttggaagatttgctcagatgatgtggcgcctcaatttctttgttatattctgctgcattgtcctgaacaatgattatacactctattatatttgtcctatgcacacccttttcaccctcatggtttatggtgctcttggaattctaaacaaatacaacgagattagatcagtgatggcaatgaaatttgttgcttgcttcttggtagttgtcctggtttgggaagttccaggtgtctttgacatagtatggagcccattcacattccttctaggctataccgatccttctaaaccagatcttccccggttgcatgaatggcaattccgatctggactggatcgctacatttggattgtggggatgatatatgcatattaccatccaactgttgagaagtggttggagaagctggaagaaactgaaatgagaaccaaactctatattaagacctcaatagttacagtgtcaatgatggctggttatttgtggtatgaatacatttataagctggataagattacttacaacaagttgcatccatatacatcctggatccccataactgtctacatatgcctacgcaacttcactcaagaattcaggggcttctccctcacactatttgcctggcttggaaagattacactagaaacatacatatctcagttccatatctggctcagatcaagtgtgcccaatggccaaccaaaatggctattgtcaataatcccaaattatccactgctcaatttcatgctgactactgctatatatgttgcggtttcccataggctcttcgaattgactaataccttgaagatggtatttgtaccaaatcgtgacaacaagcgcctctcatacaattttgtggcaggaacagccatttctgctgccctgtactttgtatcgtttgttctaattggcattgcaggatactaggaagtctagttattgcctttttcttttgttcgattagttacaacaaggcctgatctactgatcaagtttaaggcgacacagcacgcagccacgcactgctaaggaacctgcaatttcattcactggagtcaggttttatctgggtttcacggtgaagaaaaaaaattgctgtgcaaggcagaagatctcgaagagtgtaacatatgagtgaaccccaatcccaagaggggatatgataaaaatatctctgtataggcgttggaacacataccgacttaccgagtggtcacgtcgtctgtgaaaatcagattttgttccttgttttgtttaaaagcttgaaatagacagaattgttcctttttttgtttaaagcgtaaaatgcgcccaatggtcccacgcgtttccttctgttagattgaaggtctttgttcgattattttctgtaataatcgttcccatgtggtggattggatgagattgaaagaaaatatgaaaaaaaaacttaggctctgttcgttttaaaaaaaaaaaaaaaaacccccccccccc

SEQ ID NO: 22140 - DNA, 700 bp, Zea mays
gccgggttagattgtaacaactgatattgtctcatttgctttgttaactcctgcagatcaagtgtgcccaatggccaaccaaaacggctattgtcaataatcccaaattatccactgctcaatttcatgctgactactgctatatatgttgcggtttcccataggctcttcgaattgactaataccttgaagatggtatttgtaccaaatcgtgacaacaagcgcctctcatacaattttgtggcaggaacagccatctctgctgccctgtactttgtatcgtttgttctaattggcattgcaggatactaggaagtctagctattgcctttttcttttgttcgattagttacaacaaggcctgatctactgatcaagtttaaggcgacacagcacgcagccacgcactgctaaggaacctgcaatttcattcactggagtcaggttttatctgggtttcacggtgaagaaaaaaaattgctgtgcaaggcagaagatctcgaagagtgtaacatatgagtgaaccccaatcccaagaggggatatgataaaaatatctctgtataggcgttggaacacataccgacttaccgagtggtcacgtcgtctgtgaaaatcagattttgttccttgttttgtttaaaagcttgaaatagacagaattgctcctttctttgtccaaagaaaaaaaaaacaaagc

SEQ ID NO: 22141 - DNA, 2987 bp, Zea mays
ccggctacctgactctttcatttccttctaccgcagcctcagaattcccccctcccccgtagcgaaaccctagccgccacgccaaaaccaaatcccgccgagcccgaaattttccggcgggttccttgccgcgaatcgattgatttcgagcgattcgactcctttgtgatctctcggcggggtagagcgcggtcgaccgtcggccatgtcgaggtgcttcccctacccgccaccggggtacgtgcggaacccagtggccgtggccgagccggagtcgaccgctaaggtttgttgaaccttcggatttacacacgcacgtgccagatcgtttgttcaatctgtaggttttgcgcggatctgtggtttgcgcgtgcgtgatgtgggtattgcccgtgccttgaaagctaaccgagctgaggaagtgtatggatcttgtgtagctgcacgaggtcctccaaatcgattgtaaaatttaagttgtatggccggtaggccaagattgggttattccggttttcgaaaactggtagcatggttatcggggacattgaaagaatggtagaacatcaaattcgattcaaaactgtgctagatttgcatatttagtcgccctaaaattacgtggacgtgggtgatccgaattggttgttgtatgatggttggaagtgactggccaaatttttttgtttctcaaagttttctttgaaaaactgtttgtcgagcgtcaattcgtatttacctgaatttactaattcttaatacagtatgtcgttattttgggctaagcttgtgtaagaagggtcgtttgacattttgtactgcccgggcgcccgctcgagtttctttgttcggagcagcattcaatgctccttttgttgtttgagagaatctgatatttgccatcgtaccgaaagtccgaaaccaactattcaaattgggatttcatttctttttttttctactgtttttagagttctctttttcgctgctgtgctcttgtgcggcacgacgtgcatttctctttttttctttttttttctgatgttactcttctgttgaccaaaggagttcagaattattttggccctgtatatcaatagcaaccaacaccatttattgagcccatttttagttttcttgttctgtagagtatgcattgttgcaggtcttaactgttgtcagggaagtaacgtgttcaacatgattgtaaacgaatacaattctgttgctaactgtgtaatgatgagaaggataattgaataatctttgtgaagtattactgtctgaactgtacgcaaatgctacattcattctttgtgttcgtgtaaatatcattatacataaaaatgctgcattgcattcccgtcgtccgttctaaatcagaactgacgattgctctggtggctgaagctcctgaaagaaaaggaaaaggccgaaaagaagaaagagaaaaggagtgacaggaaagctcccaagcagtgtgagacgtccaaacattcaaagcacagccataagaagagaaagcttgaagatgtcatcaaagctgagcagggtcccaaaagagtacccaaagaatcagttgagcagttggagaagagtggactctcagaagagcatggagctccttcttttgtacatacgatacgtgactctcctgagagctcacaggacagcggcaagagacgaaaggttgtcctgtccagtcctagccaacctaagaatggaaacattcttcgcttcaagattaaaagtagtcaagatccccaatcagctgttctggagaaaccaagggttcttgagcaaccattggtccaacaaatgggatcaggttcatccctgtcgggcaagcaaaattcaatccatcataagatgaatgtgagatctacctctggtcagcggagggtcaatggtgactcccaagcagtacaaaaatgtttgattacagaatccccggcaaagaccatgcagagacttgtcccccagcctgcagctaaggtcacacatcctgttgatccccagtcagctgttaaggtgccagttggaagatcgggcctacctctgaagtcttcgggaagtgtggacccttcgcctgctagagttatgagaagatttgatcctccacctgttaagatgatgtcacagagagttcaccatccagcttccatggtgtcgcagaaagttgatcctccgtttccgaaggtattacataaggaaaccggatctgttgttcgcctaccagaagctacccggcctactgttcttcaaaaacccaaggacttgcctgctatcaagcagcaggatatcaggacctcttcctcaaaagaagagccctgcttctctggtaggaatgcagaagcagttcaagtgcaagatactaagctctcccggtcagacatgaagaaaatccgcaaagctgagaaaaaagataagaagttcagagatctgtttgttacctggaatccggtattgatagagaatgaaggttcagatcttggtgatgaagactggctgttcagcagtaaaaggaactccgatgctatcatggttcaaagcagagctactgatagttcagtgccgatccatccaatggtgcagcagaagccttctttacaacccagggcaacatttttgccggaccttaatatgtaccagctgccatatgtcgtaccattttaaacatctggcgaggtagatgagaattagatgagatgttgggagagagctgtgtggatgtgggagataatgggttccctgccgcagttttccagctttgttccatagtgtttctttgaggccaatagagttctggcagaacttataatgtaatattgattaattatttcgctcatgtatgtaagcagttgaactgcaaaatcttgtttctaggatgttactgttttatgacacgcagtatttgttatattgaccttttgcctcgtttatttcagctgcattaatttcgagataaaaaaaaaaaaaaagcggcc

SEQ ID NO: 22142 - DNA, 1743 bp, Zea mays
  misc_feature (11)..(11): n is a, c, g, or t
ggtaccctccngactcgccgccaagagactctttcatttccttctaccgcagcctcagaattcccccctcccccgtagcgaaaccctagccgccacgccaaaaccaaatcccgccgagcccgaaattttccggcgggttccttgccgcgaatcgattgatttcgagcgattcgactcctttgtgatctctcggcggggtagagcgcggtcgaccgtcggccatgtcgaggtgcttcccctacccgccaccggggtacgtgcggaacccagtggccgtggccgagccggagtcgaccgctaagctcctgaaagaaaaggaaaaggccgaaaagaagaaagagaaaaggagtgacaggaaagctcccaagcagtgtgagacgtccaaacattcaaagcacagccataagaagagaaagcttgaagatgtcatcaaagctgagcagggtcccaaaagagtacccaaagaatcagttgagcagttggagaagagtggactctcagaagagcatggagctccttcttttgtacatacgatacgtgactctcctgagagctcacaggacagcggcaagagacgaaaggttgtcctgtccagtcctagccaacctaagaatggaaacattcttcgcttcaagattaaaagtagtcaagacccccaatcagctgttctggagaaaccaagggttcttgagcaaccattggtccaacaaatgggatcaggttcatccctgtcgggcaagcaaaattcaatccatcataagatgaatgtgagatctacctctggtcagcggagggtcaatggtgactcccaagcagtacaaaaatgtttgattacagaatccccggcaaagaccatgcagagacttgtcccccagcctgcagctaaggtcacacatcctgttgatccccagtcagctgttatggtgccagttggaagatcgggcctacctctgaagtcttcgggaagtgtggacccttcgcctgctagagttatgagaagatttgatcctccacctgttaagatgatgtcacagagagttcaccatccagcttccatggtgtcgcagaaagttgatcctccgtttccgaaggtattacataaggaaaccggatctgttgttcgcctaccagaagctacccggcctactgttcttcaaaaacccaaggacttgcctgctatcaagcagcaggatatcaggacctcttcctcaaaagaagagccctgcttctctggtaggaatgcagaagcagttcaagtgcaagatactaagctctcccggtcagacatgaagaaaatccgcaaagctgagaaaaaagataagaagttcagagatctgtttgttacctggaatccggtattgatagagaatgaaggttcagatcttggtgatgaagactggctgttcagcagtaaaaggaactccgatgctatcatggttcaaagcagagctactgatagttcagtgccgatccatccaatggtgcagcagaagccttctttacaacccagggcaacatttttgccggaccttaatatgtaccagctgccatatgtcgtaccattttaaacatctgtcgaggtagatgagaattagatgagatgttgggagagagctgtgtggatgtgggagataatgggttccctgccgcagttttccagctttccatagtgtttctttgaggccaatagagttctggcagaacttataatgtaatattgattaattaaaaaaaaaaaaaaaa

SEQ ID NO: 22143 - DNA, 1665 bp, Zea mays
tttttttttttttttttggaaattctttagcatctccggtagttagcgtcttagcgatgttacaatctaaaacaaatggtaccgacaccactttttccgacaaaaacttaagcataggaaaagatcataatatggcaatcattgccaatctggttgattccctcacttgtcaaaacacttcaatctaaaagtttcagatggacaatttaagttacactgacttgggcaactgtatgaactccactgcattgttagcggcagaccctctcggactcctgcccatatgaggcccacctatcactccaaaggtctcgaactgccgctgccgagccctagcccgttccttctcctcctcggatttcgttgcgaagcaatgcgggcaagagacgccgtactcccattgaggcgacaccatgtcctcatcgctgactggctgcttacatccgtagcaaagtttgtgggtgccttgggccaatccatgccccaccgagacacgcttgtcaaacacaaagcattcaccctcccacaaactttcggcctttgggatttcctccagatacttcaatatcccgccttccaaatgataaacctctttaaagcccttgccgaggagaaagcttgatgccttctcacatcggataccaccagtgcagtacatagcaactcttggtagctgtttggatttgctggcattaaggtctgctgctggttcaccggttccattatcatctccccctgaccctagggtgcctgattgaaccaattgaaattgatcgtcaacccaagtaggaaactctctgaatgagtttgtacgtggatcgacagctttcttaaactttcctatgcgtatctcatacatgttacgcacatcaatgacgacagtgtctggatcacttatcaagtcattccagtcttttggcttaacatatttcccaacgattttagttggcataacacctgggtctccaaacgtcactatctcctttttcaatttgacacggacatgatcccatcggaatggtgcatcttccccagcaccaacaggggagtgactggtatgtccatgatgtatggcctcatcctctggagtaacaggtgactggatcattctcaatccttttaaacgatcgtcttcttgaataaagtttaagattttgtccacagcaactggggttccacatatactaccattgattccctcaggtgcaaggataatgccacctgaaacacgcagctcctcgcaaagctccttaagcggccgccggaatgcagcatggtcggggaaatcagcgaaccggtagaacgacaccaccaccagctccggggcctctccatacaggatcccatcccccacagccaccgcaaagttccgtccgaccggcggtcggggagcgcgcggggccatgcactcctgcgacatgtggccgaagcggcggcgcggtacgagagtgctcggggcagaggggttggaggatagaaagcaaactggaaggaggagccggtgggcggcgccacatgcggcagctgtggcggcgcggcgggcggcggcggcgagcggtggagctggcagcatcagctcttcgggtgagggaggtgccctaaagtggatgaacctagttgtattttttttttagttttttttctcaccccgatgccggccctcga

SEQ ID NO: 22144 - DNA, 635 bp, Zea mays
ccgaccacaagccacgaacagacctatatatgcatgtcaggtctgcttttctttgtctgctttcgttttggtagcaacaaacggttttctaaacgactttggtaacgagtgtccctatatatgcatgtcagtccctgtatatgcatgtttagcagtttcgaagtccacaaccatagacaagcactcgcatcaactaacaactaaagaataaagtgcagaacacttgatgcaatatttagaccacgaacaaacgcaaggaatttctgatccataacagactgtcttagtaaaaaaaactaaaattactcagtaaacaacaaccgaacgcagagactccaggcggggacactccatgaatctgcctacttggacctctgcctcatctttcggcgcttcctcttaagccgcctcatccgcttcttcttccacttggccctcatcgcggcgggatgactgcctctcggacgggtttggggggaaaccggaagagaggcctgtgatgcgacagcggcggcggccgcggtgcgagctctcgccgcgcttctatataggagagccagtggattaaccctagcaggggtcacagtcttgggccagatcttaagttatcatgggcctcaattattagacaaaag

SEQ ID NO: 22145 - DNA, 534 bp, Zea mays
  misc_feature (6)..(8): n is a, c, g, or t
  misc_feature (75)..(75): n is a, c, g, or t
gacccnnnttttttttttttttttttttttccctttttttttttttttttttttttttttttttttttttttttnttagacaagcgctcgcatcaactaacaactaaagaataaagtgcagaacacttgatgcaatatttagaccacgaacaaacgcaaggaatttctgatccataacagactgtcttagtaaaaaaaactaaaattactcagtaaacaacaaccgaacgcagagagactccaggcggggacactacatgaatctgcctacttggacctctgcctcatctttcggcgcttcctcttaagccgcctcatccgcttcttcttccacttggccctcatcgcggcgggatgactgcctctcggacgggtttgggggaagaccggaagacgggaagagaggcttgtgatgcgacagcggcggccgccgcgcccgcccgcgccgaccccccatataggagagccagtgggttaaccctagcagggataacagtcttgggccagatcttaagttcccggcccggccggcct

SEQ ID NO: 22146 - DNA, 1102 bp, Zea mays
aattcggcacgaggtccacacggagctcctcagtctgcactgtggtaacgctgaggcacgcactgggactgaagctgctgaccagtttgatgttgccattgatgctgcggttgagcgtagaactctggtgtctgtctggtggttacctgaggtacctcaagtactgtatgtgcctgagttttcctagtagtgtgtgtctgcacaggttgagcagcagcttggaacatttgggcctgtctgtgctccagatgacttcggcctcgcatgcagtacatggcagtttggtttgagcgctgctggtcttggactggcaccagttgctgtagaataaggccactgcaactttggaattgcacagcaggagactggacagaatttacttggtgcaatggcacaagggcaatctcattttccctatttatgaaaactgatggagaactacgttcactcttttgtgcggaatcctcatgtactatctgaagtttggtcatttctttctgagtttcagcaagctcctgcctttcctgaacgacctgcacagatttctgaacctctttcacttgcttgtcaaggcactggaagttgagatttgcttcgttatgataatccatcacgtcacttcgtaattctccaatggacctttccagcttatagcaatacaactccaattgcgacagcctaccactgataacttccagcgaattcaacaagttatctgcctgtttcttcatgcagctttctatagcatctgttacgatttctttagagaccttttcttgctcgtggtaattaacaaatgacatcaacagtctgttctccttgtgccggagcgcctggtcgaaggagcagcgtttggggtcgggcgagaggccgaaggcgccggagacggatgcggcggctggccgtgccggggacgccatgcggggcggcggtgctcggcggctgcggtacggtttgtttcctccgggggtggctctgcggtggtcagaggattcgcaagggaagggaagcgaagcgaagcgacgacggaagagggagcctggccggcggcggcgtgcccgaggagtagaagccaagagaaaaagatgagtagaaagctaac

SEQ ID NO: 22147 - DNA, 4727 bp, Zea mays
gatgatacttcgcagcagacagtagtgctagtgcctagtgcatcatgcaatggagctgaaataaaaacagcaaagtactaagatatttcaatgcacagattgctgatacctctttcacttgcttttcaacgcaccggaagttcagatttgcttcgttatgataatccatcacgtcacttcgtaattctccaatggacctttccagtctatagcagtataactccaactgtgacaacctaccgctgataacgtccagtgaattcaacaggttatctgcttgtttcttcatgcagctttctatagcgtgtgttacgatttctttagagatcttctcttgctcatggaaattaacaaatgacatcaacagcctgttctcctggaaatcctgattcattgggataacagacatattagaccacataggatgaacataacagttcagcatataagatgaacaatctctcctgtgtctagttacagagaacagaaacacaacaacttcacgtatcactgcatcaggcgcctaaggaaaaatctcctaattggcatgctaccctagttgtagcaagagccccacgaatttgtataaaaaagtcggccgatacaaacgagaaacctcaactggctaactcgtccactcctttgactccaacgggccagaataaccaggaaaagaaaaggcagaacccaaaccctaggcttcaaaagcggccaacgaagatccatatccgcagtcacacgcaacgcagacgataaccccgcaaccgttggcacaaaccagaacaaggcagcacggtgcacccccatccccggcaacgagcaatgaacgaaccggccgctcctgtcaacgcacccacgcgtcaggcgcggagatctcgcgcgggtagatcgaaaggcgggcgggcgggctcgtaccttgtgccggagcgcctggtcgaaggagcagcgcttggggtcgggcgagaggccgaaggcgccggagacggacgcggcgacgggccgggccggggacgccatgctacgggtcggcggcggtcggcggctgcgctagggtttcctcaggggggaggctctgcggtggtcagaggattcgaacgggaaggggagggaagcgacgacgaaagggaggactggaggaggaggcgtgggcgaggagcggaagccaagagaaaagaagagtaaaagctaaagtagcgttcgaaaaaagcggtgcaaagagccaccacccccaccccacccccgccggccgccgtatttattccgcgcccgcatcgacaatgcagtgcagtcgtcccgccgcgagcggtggagccgtggttgaggggaaagcgaaaagcacggcgccgcggtcacgcgacgcgacccgagcgagggcgcctgcgtgcgcgcctgcctcctgcccgttgcggttggtcaggtcctggaccgtgcgcgttgccgtgcagtggagccgctcgtgatccgcgcgggtcaatgccacttgccacgcgcctggttttattgcaccgcacgcgtgtttcacgacttgcagcgatcgtgtttcacgacttgcgtggacacggcgcccatcaccgtgtcctaatcctaatcccgcgcgacactgtagatcgtactgccagtgcaactggatcctcgggaagacgtgcagtcatactttattctagaatgcaattatttgtgcgacaccgaaatgtatactcgtttgttaaggataatccagcctacgacgacggctacaattgtgtggatcttctagagcgttcaccgttttacgttcttgactccggcagctagctgctgcgtggatctgacctgcactgtttttagggacgacgacgcgttcaaaatagacgggcaggtttggctcgaccaatcgacaagtcaatggtatcttgcttaccaaaacctacccaacttggcaacttgggtcttgggttgagtctcatacatatatggatggactagcactagcctaaagatacactgctgccacgtccacgtttcatctagagcgacacatattttttttctttttggtcataggccggccttttccaaaccccggacgttgatctcccgcccgaaagctgcggctgcgagcgtgcccacggagccgaaatgtactggctcggctcgaagctctgagctgcggataggcacgggggtgaagcgaatctggaggtgagctgtcacgctgacttggattcgggggttggctgccggctggtgacgtcccctccctgccctgccacacaaaaacctggtggtctgtgctgcgcggcgcgggggcgtgggatgtggctggcgacgtcccggtgatccctttcgccgggccggcgttgcggggcggggcgggccacagtgccgcatgctgccaccgcccaccgggagcaggcgaatccatgcacgaaatttgggttctgacccgatctttgtgctctcaacaattacaacttggccaccagaccagcccaccatggcttacgacttgttaactttgtggtgggtactgggtagtccagtcagcgaagttggccgacggtgtacgatggatggccaacatgggctacgccgattgaggcccatcaacacgggagtgggctacggcctgtttgacgtcgcaccacggtccacgacaacctcgtcgtattccgattcggtcggcgcgactcctcaactgaaactgtgtcattgtctgtcagtgctcgccgcgcggatctagggggaggggggccgtgcccggcgcggacgccgggatgccgatctgcgcgccgtcgtccgactcctcggcctcggcctcgtcgggcttgggcgcccgcgtctgggtgctccacgggctagcgctcggcgcggcggccgcggccgctgccgttgcgtacctgtaccggcggccgaccgggttccgcagccgcgcggtggggatcatacccgcgcgcttcgcctccacgcgcttcgagggcaagccgctcgttcccatcctcggcaagcccatgatccaggtccgtctccttcttgctgacttggactcgtcacatctttcagagagagcgaggtgggtgggggatcgtacctgcaactcgcggttaggactgcgaggggaggtcgaatccaattgtgctgtttccgtgtagactgaactgcacagtagctgttctgttgcttaccgaaatgttgtgagccgttatgtcatccagacttgattcctcacagttcaatgagtgttcagcaataaaaaaaagtctggcttgagttcaatgaatttcgatttgatggggtttggacaaggaaaatggtatagctgtcggtcttggccggttctagtttcttgtctgcgattaatccggcaatgtgtataatacctactgcaccttgtgctgacaactttaacctttttatactgaatacagaaccgatgaaagtgtatcgttgccttttctgatttgttttatattttttacttcttgttttcgcgtccagttaaaaatttgtgtatctcctcttacagagaacatgggaaagagttatgctagcttcttcgttggaccatgttggtaagcaagatggctaatagtaattattgattggtttcatttgttaatcatgtccacacttgtgcctcactgcctcccccccagttgtggcaacggatgatgagagaattgcagaatgctgtcgaggatttggagctgatgttataatgacatcagcatcttgcaaaaacggatctgaacgctgctgtgaggcactaaagaagcttgataagcactatgatattgttgtcaatattcaaggagatgagcctctcattgaaccagagataatagatggtgtagttatgtcactgcagcgagctcctgatgcagtcttcagcacagctgttacttcactgaaaccagaagatgcattcgatacaaacagggtgaagtgtgttgtggataatctgggctacgcaatatacttttcaagagggctgattccattcaataaatcagggaacgccaatccaaaatatccatatcttcttcatcttggaatcgcgggctttgattcaaaatttttgaagatatatccagaacttccaccaacaccattacaaatggaagaggacctagagcaactaaaagttcttgaaaatggctataggatgaaggtgatcaaagtggaccatgatgcccatggtgtggatgcacccgaggacgttgagaaaatcgaagcactgatgcgaacgagaaacattcagtagaaaacgaagagaaagcaagtgctttgcattgctatcggcgttggcttggtgggatacttttggttgtgctttcccgtcttctgaatagcatgataccaagtgaagttggtgcatcacttcttgaagttttgtgcttgctaaaacgttcagtgattggatatgtcacttgcattagtcctcaatcagcagttcagcgcgcaggtggattgtatctgtacttcagtagttagtagcattactttcagtcttctttacattgaaaaacaaatcgtttctggagatgaagcaattggacagtgtaaaacaaaaggctaaagacccatccatgccgcgaggcgtgattgatataaggccagactcatcggaactttcattagacttccatttacatgtaataagttttcatatatacaatgttgatgatgtatacaattttaacgacatgacggagattttttttgaaaagtgaaaattggttttaaac

SEQ ID NO: 22148 - DNA, 1414 bp, Zea mays
aactgaaactgtgtcattgtctgtcagtgctcgccgcgcggatctagggggaggggggccgtgcccggcgcggacgccgggatgccgatctgcgcgccgtcgtccgactcctcggcctcggcctcgtcgggcttgggcgcccgcgtctgggtgctccacgggctagcgctcggcgcggcggccgcggccgctgccgttgcgtacctgtaccggcggccgaccgggttccgcagccgcgcggtggggatcatacccgcgcgcttcgcctccacgcgcttcgagggcaagccgctcgttcccatcctcggcaagcccatgatccagagaacatgggaaagagttatgctagcttcttcgttggaccatgttgttgtggcaacggatgatgagagaattgcagaatgctgtcgaggatttggagctgatgttataatgacatcagcatcttgcaaaaacggatctgaacgctgctgtgaggcactaaagaagcttgataagcactatgatattgttgtcaatattcaaggagatgagcctctcattgaaccagagataatagatggtgtagttatgtcactgcagcgagctcctgatgcagtcttcagcacagctgttacttcactgaaaccagaagatgcattcgatacaaacagggtgaagtgtgttgtggataatctgggctacgcaatatacttttcaagagggctgattccattcaataaatcagggaacgccaatccaaaatatccatatcttcttcatcttggaatcgcgggctttgattcaaaatttttgaagatatatccagaacttccaccaacaccattacaaatggaagaggacctagagcaactaaaagttcttgaaaatggctataggatgaaggtgatcaaagtggaccatgatgcccatggtgtggatgcacccgaggacgttgagaaaatcgaagcactgatgcgaacgagaaacattcagtagaaaacgaagagaaagcaagtgctttgcattgctatcggcgttggcttggtgggatacttttggttgtgctttcccgtcttctgaatagcatgataccaagtgaagttggtgcatcacttcttgaagttttgtgcttgctaaaacgttcagtgattggatatgtcacttgcattagtcctcaatcagcagttcagcgcgcaggtggattgtatctgtacttcagtagttagtagcattactttcagtcttctttacattgaaaaacaaatcgtttctggagatgaagcaattggacagtgtaaaacaaaaggctaaagacccatccatgccgcgaggcgtgattgatataaggccagactcatcggaactttcattagacttcaaattacatgtaataagttttcatatatacaatgttgatgatgtatacaatttt

SEQ ID NO: 22149 - DNA, 2549 bp, Zea mays
ggccgccctttttttttttttttttaaacaaaagaaactgtgcatggtatgcactactgagcaacacacaggtttcagcaacataattgaaggttgacactggctccactacaagtgtactagataataatacagacactgcctctggcgacagtcctacactacatagatcctcctctccgggagctccaacgtatatatataaaggctaaaggcgaagaggtccatactgagggcaactgctggcgcttcagcatataaattcatgcacaacccaactggtgacggtttctgcaattggatcccaagccacccggaacaacagccatgagcatgccagaccgcgtgcgcacgtccggcgcttactcgcacttgatggagcggtagatgtggcgcacgaagaagagcgacgcgcggaagccgaccgttcccagcatgaggaagaagccgtagcacacgcaggtcatgtagccgaagaagaaggacgtctgcatgaaccccgacatgtccgaccgcgcgtggtagtagtagatgcagtagaagaatatgaatatgcctgtcgagcctccgcacaggacagatctccaccaccactggtggtcttcgacggcgagctggaagtaggtgagcgccaccgtgacgaaggccgtgacgatgatgaggatgatgaacacgatgaagaggatgctgtagatggtgtaaatcttgtgcccccagatgctcgcgaagatgtagtacagctcgatgtagatcgcgctgaacgggaggaaccccgccatggccatctgagggacggtgctgcggtaccacgggagctgggggatctccctcgggtacttggtcgtgcggcagggggcttggaactcagtgtcgctgttcttcccggctatgccgcccagcacgaggagaggagaggtcacgagcgcccagatgaggatgatgacgatgatggtgccgaaaggcagggctgccgtggcgctgtacgctattgcgactgtgttcaggaagcagaacgtcaggaagagaggtccgcagaataggcagccagtcaataccagattcctgacccagtttgtgccctccagttgcagatagaaagaagtggctgtgtatccagcgataccggacgtgagagcgtagatgacaacgagggcagtgaagagagctccccggttgtatgggtagaagacgccgacaagagcgaggaggaagatgaaaatcgcaagggcgagaagctgagttccagaaccaataattgctgcaaaaacggacttctgtttggggaaacggaatacatcaccgtgaatgtacttccacccagtctcctcttggtcttcaagggactcgtcttcatgagaatacttgatgaagtcgttcttgagaacacgcatcaagatggtggccaggaaaccggtcaggaggagcactgtgacgcacgagttgattatagaaaaccagtggatctctaggtgttgtggcatagaggaagacttggagtacttatccattcttttctcgaaaggaatgtctgtctttttccatgtcgccgaataagagaactctatcggcacttccttgtcctccgtgatatccacggccacatttggatcggtctgtacattgatttctatgacgcggttgtcgttgtacatgatgtcgaagtggatgtgcttgaacagtaggtatttcacgtctccttgctccttgtccttgtccagtttaccgaggaatccccatagtggcaaatcatcgtagtacatctggaagtagtaatccttggcgactgcatcccggagcttggcaacttgctccttcgacaacactttcttgcagagaaccttggagttcctgtcttccttgaagttcaactcgtatggggcatcaaccaaccggtcgccatttagaacctcgccaagagcttcctttttgtcctttggatgttctggtgcacaaaagggtagatcatagtaccgatacgtctcacttggattgtggaaaggcccgaccttgttggcgtagagaggaacatgatccccttccttgtacttatgatcagagccatcagctctggctcccagtgcacaagccaaaactaccacagcaagaacagcacccgcccccgtactcgccatctccgcaagcaccaagatccaaactttccacccggataaagctcaggcgtcaaaatgacgagacactgtcgggagatttcagcgggaaagcgtccaaacggcgccgctcccgcaccgctgcgggggcggctgatttggtgcgaacccgtcgatggggcggcggaattgggtgagaaccgtcgactggggaggggcgcttggggatgcaactgccggggatctgctgggcaaagaagctcgggcagattttgggaggaagaaccggacacgggaggagatgtattgaaagttcaatagtttttatggtttgtctggtcaagcagcttgggaatggagaaatctcttggatctatggaagccgccggccgtgtttctccttttgacttcaggccactcgcgccccccaggccgccggcg

SEQ ID NO: 22150 - DNA, 1815 bp, Zea mays
tttaatccccaaacttcatttctgagctcaattttatctatgaactacatgaaagtggtcgttttagaccttagaatttttttgggctcaacctgatccctcgtcttacgtggcagccacaggtcactgctgtttcgtccattacccattgcctgcactggtgcactcgtccgctgctttcggctggacatcgaccctgtgctgctgtgcacccccatgtcccagctattttcactttcacccgcgcaggtcccagcctcccagttcgacattctgctcatgctagtgccagtgccatggagatggaggctgaggagcaaggataagcgctttgcttttgtctaggaactgaaacgtctattcttttttttgtatgcaaggacaaaatcaataggtgaaagacgaaaatagctattcgcctattccgaccttgtttcttaagcattccattgaaccaaagttacagcagtacgaagtatctgacgaggcagacaacgtgtgcaccgtgaaccacatgcaggataccatcgatcatcgatgtcatggatacacgaattctgaatcagaaccacaattcaggctgacagaggactggattccttgggactgccaacggagagagcgcgactcccggaagcagagtgccggagctcctccaccatcctaaccacctgcgccatcgtcggacgccggtcgggagaccacgccgtgcacgccatggcgatacggagcatctggaccagctcgtcttctatgttgggatacttcatcagctggacgtcaaacacctcagcggtccactcctcgcggaccaccgaatgcacccacctcggtaggtcgacggcgtcgtcctgaccctgtgactgaagcggggccttgcccgtcagcgtctccatgaggaggacgccgaaaccgtacacgtcggacttgtgggtgaacttcctcgattcgaaggtctcctgagctcggtagccagcgacagctcgggaagtggtgatcggaaggctcgtcaacgagctcagcccgtagtctgagacgtaagggttgtggtctccgtcgagcagaacgttggttgacttgatgttgccgtgtgcgagcctggagccgccttctgaatggatgtgctcgaggccgcgtgctgttccgagtataatcttcatccttgtgttccaatctaatggggtcttctcacacacgcccttgatacctgttttgtgatcacttggtgagaaatactatcgatgtaggagtattacataaatattgctgtacgatatatcggaagcaggaatggatgatgcaaggagccacattacgcactcaatagaaggaacctctgagaataaatccaacagagaagataaacatgtacacataggcaaaaagcaattatgtaactctgcaggtaaactaacagtcacctgaatcatgattatacacttgctacttgacaaggatgtcattcctctgacatgtaatttgtccttgctaggcaagcatggacttgtttcatgatattaactcaaaatagttgttaggcacactccctacgagggatgaattattgacaagccaaacttaccactactgagtaaaattatcaaagcataggtttatgaaaaaatgcacttgtatcattaccatatattctagacacaatggttaataagcattgatattctagggagtcatcaggtacggtttgcacagtagaatagacttgtaaataagtaatgaacatgcaacggtgaaggtcattagcataccatgcaacagagctgagaagctgcctctaccaatatactcataaacaac

SEQ ID NO: 22151 - DNA, 1611 bp, Zea mays
ttttttttttttttttgcaaaaacccgaagaaaaccaagttcaatcacatgttcacatgtaccaaccaaaaaatggatcgaattatgggtgaaactaactgttctgaaacacaaaagatgcataatacagaactctttagctcaatagattgggcagtgtccggtgattttccaggacgctgttatctcgtcagtttatcacaggtcaactatctgttgttattgaggccccctgattgaggctaacatgccaatgcactcatctctatagtaagctgagaaagataatcagcaaagggcggccatgtacaaagcaatgtagttcaattctctgccaggcagcagacattagtaaatcgccatcttttcttgtttctgtacactgcaggtaagtgtattatgtacaaaatttcctccgcctaagatccggctccgttacagcttccaaggtttctgccatctgcatttgtttgataactgttgcatgcaataccttctttgtcttctgcagatcaaactcaatggactttatcctgtcaaaagaatcttgtatggcccggtccttgtcctctggaagctctggaggctttttgctcagctgattaaacattgactcaagtcgatcaagacgctccagacaaggatttacacgatcttccttaattgtctgaagatttgccagactactgggtgcagttgcagtatgtgaatgaacattttccgagtgttgtcgtcgacgaatgaagaaccgcaaaaaagagagtacttcaagaaatatagcaacgactcttcttgatatatatttcaagaacccatcatcattgcctacagcatcatttggggcacgctgacctgcgggcgcaagtaaacccccatttatcagggaaccttgttctgtattgacctgcctagtttcatttccagtagagttgtatctaccgttgaatcctacaactttatctgccatacgagacatgccaattgaaccactatatgttgtagatcctgattccctcgcttcctctcgaactggggccaaactaggatattcaacatcttcaggagccacaggggatccaagatcatcaacatctgaacctgattcagcatttgacgtgtcactaattcgttctggtaacttgagagcacgcaatctcatggagcctgtaactgtttcttctatatcagatacttgcccaatttccttcaatgactccatgctatgtacaagcttcatgattgaaggatcgctccaggggcctttgttagacctcaggcaccctccatggttagaacatgtgcacgaaccaccaaagtactctggtaattggcttgcatcaatagcttcaagaagtctgctttgatattttgttcctagaacatgtatcttagatgacgttttggggtcaagaagtcccttaacagtgctccatatcagcttgaaaccaggtcccgcatttacaataaacatttgatgtaatgtctcaggataatagtcaccatctattttttgcatacaacgcaccaaatcccttgcaatcttgctaaagtttttccagcccacaccgtggacatccaatatcgtcgctgtagtatctatatgtcttttgg

SEQ ID NO: 22152 - DNA, 3082 bp, Zea mays
  misc_feature (1490)..(1494): n is a, c, g, or t
  misc_feature (1622)..(1626): n is a, c, g, or t
  misc_feature (2518)..(2540): n is a, c, g, or t
  misc_feature (2610)..(2636): n is a, c, g, or t
  misc_feature (2879)..(2894): n is a, c, g, or t
  misc_feature (3050)..(3055): n is a, c, g, or t
caacttttaactgcactaagagggtattttaatgtactaaaactaatagttaggtactaaaattagccgagatatcaaaacggtctaactaatagttaagctattagctacttttaacagattagataatagttagctagttatttgttttagtgttaatttcactaacaatttttagtcaactaactattatctttagcattcaaacaccctctaactagtacgaacttgataccgtattaaattgcatgcttttaactaattcaacctaaagacgtgggcaattcactttatttgaacgcccccctcatgttaagttaaaaagctttaccatattaagttgtcaaccagctttacctaaaaacttaagccgatgggaagaggtggatgattataacactaatatatatatttgttgtattgaattttcagacatggttatcattgatggtgagaagctgatggaagagactccagcagaagatccacctgtgaccgatcaggaacgcacgggtaaatcagaattccaagagcagcaagtggacgatgaggagaagtgtttagcaaccctggaggaaccgccgatcattccacgcgtccgattggtcttgtttcaatggtaaccgagcagccatctgaggacgatggaggtgtcaattttcaggatggtggaggttccagtgcggctctgttggacaagaatgctggtgaagagatagaattggtggccggcgttcgggctctgcaggtaccattgacaggcaacggaagtgatgccagccatgaaagtgaaatgagaaagttcaatgaagtactaactgtcagagagaaaaacagtgaggttgatacacaagaagtcagtaaggagatggaacacactgatattgctgagttgcaggctgacattgtggatgaggcagcttttctggattgctcgagtattgtcaacctggttgctggagaggagaccgaggtggtcaatactgaagatggtcttggctgtgaggaggatggtgatgttgacaaagtgctgcatgactctgtggatgacaccattcttattgattgctcaattgagaaggcaggaaacgtcacacgtgagatgcctgagaaccaagctgcattggatgaggatgttgataaaccgaatgaagtggtcatcggtgacatgccccaagacacagtgacagataaagttgttcaggaggaaagggaagtactgataactgatgagatgcagcaggggacagctggaatgcatgatgagatcaagtagtcactgctgacaacctgctggaacaagtgacagatcgtgaaattactgtggaggagaacacgacactgatagttggtgagaggcaacagagcacggatgcaatggatgaggatgttgtagaggaccactctgaaactgatggtgctcattccaatgaacacattgaagcggtaactactgacaaagttccagaactcaagctgattgaagatannnnngttcaatctgatcatgcagttgctgctgacaacctaccagaacaagtgagagattgtgaaaattccaatgaacacattgaagcggtaactactgacaaagttccagaactcaagctgattgaagatannnnngttcaatctgatcatgcagttgctgctgacaacctaccagaacaagtgagagattgtgaaattaccatggagaccgcatcactgatagttgatgagaagcaacagatcatggttacagtggatggagatcttgtcaaggccgggtctgaaaccgagtatgttcatcctgatgaacagatggaagtggtaactgctgaagaagtgctagaggacacagggataactgttgaagatgttgaggagaagcaaaagagcacagttacagtggataaagatgtcgttgatgatcattttttcaaaactgatgatgttcatgccgatgaacagatggaagcgtcaactactgatgaagtaccagagctcacagaggcagattacgaagttgttgaggagaagcaacagagcacatatacaatgaatggaggcattgaggatgatcatttcaaaacccatgttgctcatgctgatgaaaagaaggaagttgttgctactgatgtgccagaagtcacagggacggtcggtgaaattgaggagaagacatcagttacaatggatggagatgttgtctttgatcatgcagatggacagaaggaagtgatagttactgaagtgccagatgaagtcacagtgactggcgatgaaggtgttgagagaaaagcagctgtgattactgaggccataccagatcacgggactgccccaagtatcgcacatacaatgaatgggtgtgtcaaggaaacccattttggtgatggcaatgagcagaagaaagtaatcactgctgacataatctcgataccacaagatgattgtgtccggaaggagaatgcatccagcatagatgtcgcagagaacagcagtgagaagaacactactgaacccatggcggtgnnnnnnnnnnnnnnnnnnnnnnngaccaagaaacccgtggatctgtttgcgcttagcctagggaagcttaaagccaagatcaaggataggctnnnnnnnnnnnnnnnnnnnnnnnnnnngaggctggcgcttgccagggtggacgagaacgtttgccgatcgatcccacgcaaaggggcgggtagggcagcagcggaacctgaatctgcaacaacactaacccagggaagaagctggctctgaagtgtgtgtgtgcgcgtccatctagcacagtagcatcatgcacctgtggtgaaaccatggtttctcctcatttacccgtcggctaggcatctaacttatgtgtgatttgcgtgttcgcnnnnnnnnnnnnnnnnttggagatgaggcctaaaccgattcggctgtgttttatcaggtccaatcgtaggtcccagtcccagtacccagcattgttttggcctgtgtgtgaggcctgcttgtgtgtcggttgacttgtcttatttggaactcgttgagaaagcctgcttgcnnnnnnatatctcgtgcaataacaaagtagtgt

SEQ ID NO: 22153 - DNA, 4988 bp, Zea mays
  misc_feature (377)..(377): n is a, c, g, or t
ttgcgaggggtggtactcggtaaagccgctgattccaatagtgtatggtttactatatatagcaagaggtgtgtgtactgatcaagatcagctctcaagcttcataattaaggcagcatgttagagtaacttgtgcagtgagaggaaaaagctagagtcaggtagagaacttctttcactcttacaagtggggctcttgcattgataggtcagtacagcttataataaagttaccatttactcacttttgtttcaaactattaagacacatttaggtttttctagatttataacttttgctacgtagctagctagctagatacgtctatgaagctagctgacatcactgttatatatatgataggaaaacaggaaanatgctgccattattatattatgcagtgtagttttgaaaaggacgaaaaccgataaagatggagatgatgttaatcataacagaagcagatgccaactagttttggctgcgagatgttaaccgcactacctggaggggaacaaagtgcatgtgccatgcataaagtgaggattacgcgcagttaattagggcatgttcaatctagacgctttgaaacaatttttcaaatacaagagactgcactatacaactctaagtctacagataataaatgtcaccaagactatatagaaagtcgtgtagagacgggctcttcgcgaatagtctatctcttaattttttttcacttaacccactagagacccctcaataaacttctcatttaattgggttgtgcatgctcttatagtacaaaaagaaatgtgtagtgtggtcctaatccattggtgatggtgcgtgattatatgataattagtttaagcagcaacgttacatgacaattgacagatgtagacacaatggccaatgccagggacaagcaagttgcaacttgccacctccctcccatccatcgtccaacttcatccttggactttgccaattctttcctcttttcatgtacctgcttgctgcccctgttcccaattctagggaggattagtattatatattaggggtgtttggtttctatagatcaattttagtctatccattttattctactttaattcctaaattgacaaatacggaaactatggactaaaaattgtccctctattttattctattttagtaactaaattgacaaatacggaaactataaaattgtccctctattctattctattttagtccctaaagtgctagaataaaattgatggattaaaaattagttcttagaaaccaaagaccccttatttacgagatgatttggtccactattgcatgtagtgcagatctatcttgaggtgaggttatttgatacaagctaggtggatatacatacgctcctaccaaggttttagcttggtgtgagtgcacaaggaattatagcaagtaagaacacattcctttctatggtacttcatctgtcctagtatataagtcgtaactatctctgatttaaatattaagaaatatatttaattctctctatattattgaatcgatgtatgtatacatagaaagagcacaccttatatttgggactaagaacaaaaaaatgttacaacttacattatgggacggagggattacatgcttgcaaggagcttgcacgctgattaacatccgtttagggccggctggataatacatattaaacagtgaattcgtttcttgcgctcttcttcttcaatcttcagatgtggcatgtcaagtgcattatataccaccatctgtttcagaagtggaattagctgtgctaaactatatataatcttggggggtttagggtatgctatgttgttacggagtatttgttcgatctaaccaccatgcatgagtggactcgtagcctgtttttgtggtttttttttttgagagagagagagagagactttatacaagatgcaatactagtgagtactaggcaaccatgacattacagagaacatgccagcagcttcatcaacatccaataagaatgggaatgggaatgggacatgtcaaataaactgaagctcagctgtcagacactgtctcttcggatgacgcgccggtgtcgcttggtactggggcgcctgcagcccccccgttgagatcgccggacaggaacagcctcctgctgaacgacccccagtccgcactcctccttatcgcgcgcttcagggtagcatcagggaggaggacatggggcttcacgtcgtcgtccctcggtggatctgccgttggcggtggcaccaccatgatgctcggccacatctcagggcccattcggccgccgggttgctggggcaccctgtccgatggtggctcctggaaccaagccgacttgttctcgtagtagtacgacttggacgcccttctgcgcctgccgccacttcttccatacgatgaagaagccccagggaagccgcccacgcccaggcttgttggtaaatgatgctggtggcctctctctggagcacggccactgcgaaggtagacgtcgcccaatgaaaggtccgtctgggccccgagaaatgaagacttggagcatccagagcacgaagctctaccaaggtaatattcgcccaatgaaaggtccgtttgggcttgggccccgacagatgcagactttgagcatccagagcacgaagctctaccaagataaccaacagcttgcgcaggacccacaagtttcttctgctccttgtcccattgcttagcaaggtcctcgggcatccttgagattgaaaaccgcagccgactgtccctcagcattgcattccagttattcacgccgtacctcctaaccccgatccaaagaaagtccagctcttcttctgaccacggagccgactgcctcttgtaggagtacatgccaagcttttctgtaacttacgagatgtgctggaggcgcctccgagaaacaacttgtcgctcctcagggcagccacactgttgttgtctgtgaaactatccagcctgaggtctagactgaactcaggagccctgtccattattccaaactttacttctgaaggcaagccttttggtcccttcaaactcccggtgttccacggtggacccagatcaaagaaatttgagtatggggcgtgcatggttgagctttcttcatgatgctcttgtttgccacggatggtatctttctcctctgtgaaaaacagcctttcaatcggtcgagacatttgctttcgagcattgacagctagatcctgcaagaaaagataaaagtttcagatcatctgaggcacaaacgtatgcactgttaagatttcttttactgttgtattatgacaaaaggggaaaaactcatttagcgcatggagaatttggacatgtggcaaaacgctaaataaataagcgatgaaaggggtagttctagtatcctcaccagatctggcagcctttgaattgttgagtcatctaaacagagaagtccctgttgtcttaattcagtacagttcaggtcaatcttcccaaaagttcttttgttttgactatggagcccttgatcgagggcctctgaattttcgagctccttgcccctatcatcattatcatcatccaagagaattattggaatattttttgttgaaccttgagattctggaacatcttctgccacagatttattggtccgtttcaaccaactggcatcaactttttgtcttggagactgcagagaagtagtttcccccagtacaatgtcccttcccctgcaaatcaataacttttggcacttcaatagtatttggtgatgttctgttgaagtcctccactggcgtatcttgcccactgacctcttgcacaccagtgaacttcgacattggtgtaacatcatcttccaaggacatcttttggttcgacattggtgtaacatcatcttccagaattatgttttggtttacatctagagcaatctgtggaaccacatgttgaactgaggattttacgacgtgggaactttcttgttcaggtgagtgttcagcttctgtagaaggtccagtatttttcaatctacctaccttatcctcaatatccaaagggtttggagcagtatgttttagtaatgatgtagcatcctgtgatgagcgtggtgggctgcatgtcagtgttgaacactgtttgtcgttgtcaagtgaacaaatttcttctgctggttcatccaaatttgttttcttcttaactcgcctgcgaaaggtgagcagaggactaaacctgctcttacattggccaggggcgacagcattttccatccccgtaggagaatttatttccacaggggcagagatatttgaatcttttggaggtacccaatgtctggttaatcatcctatcagcaagcatgttgccacacagagaacttgaaacaggggtttgactatttgtgccatcaatgcattgtgatttattgctatgtgcctctgcggttgaggcaatagtggcagaacaaatctcaggttgttctttccacggtgatgattcatatagctgatcatgtcctttctctggttcacgttcttctttgatgttttgttgaaacgtggagaaagactgctgcattttaggagtaatatgattatattcatttatcacggcagtctcagcagggccctcaggcttaagttgtagactgctgacagccacattgcttgaggcagcaggagatgagtcaagaactgtgtcgtcttctgtatgggcatgtgtggcagcacgcttcctcttgtatgttatcatgaccttggcggtgctcatcctgataagcacaaatgttatcggaagtaaagcttgccagctgtatcggaaatgttttcaactgctttaacgccccagcttcgccatgtcgatcgtgggcgcgacggcggcgagctgaggagaagggatgcggtgcgacggtggcggtgggactgggacggatggaaggggaccccggccggcctcgagg

SEQ ID NO: 22154 - DNA, 3119 bp, Zea mays
ttgggctattctacagaggaagtaggttcgacctatggttgtaacaggatcacgaaccttggtgagggtggccatggcgtttttctcccggaggcacgggtggcgatctagacttcggatcggttatcattagatcaatgtctttttgggtttttcttagttggctatgtgcattaggcagaggccggaagttctgtaccaaggatttgtatcctgtaatgacttggtattttcaatataagcttcctttatctaaaaagagttgcacggtaaaaaaaaaattcgacacaattagattgccaaaataggttcttcattttacttccgcgttacaaattgtaagtcgttttagctttgtcttaaaccaatcttgtctaattcagattagaattataaaatatatatattaaaataaatgtactataagttatggtgtgtgtctaattaatctagcttaatgctatagatgtttgtgtaatattttttctatgatctcagttaaagctaagggctcatttggtagagctccgctccttaattctctagctccgaaagttgattctttgatagagtgatttcaaataattctctagtagaagtgaatctatctgacgaaaattgtttgacaagtagtgtgtgaagtgattttcgaggagttgcggaaagcagggttttttgggtcccactctctatataaaatattgattagattcactctactcctaccattcgctttcgctaggagtgaagccgcgggagctctgccaaaactcagaacaaagtaaaatgacttgtagtttgcatggaaggagtagataaatgagcataacttatgtcctccgaagtccgaacgggtggttgattaaactcgcatacaacgaagatggacatcaatattttaaccccagtggagccatgcaaccacaccgatggtcccttccaatgcattcaattctggcagtttattttgtttgagctaacagctaagtattgcttgtagctgttctcagaatcacagacatacagctgaacatattcacatggcctagatgagccctttgcttctgaagcaatcgacggccttcctgatgatcgtcgcatcgaaatgaacgaaaccaacgcccaaataggtcaacttcttggaggcctcctttgctctcatgaaccagccttgttttgtcttccttgattctgatgtgaaaataaaaatgttatcaccaaaacaaacatccctgcaatgcaagcttgatgcatcttgtcagaaatggatcgccagtgaactggggattcagcagggcacatatcagcaattctatcggcgaagtcaaccaagcgttccatggacgccaagcacaggtgccgtccgtccctgcgcatatgtgttctcattcaacacaatcgcagattgcgccacatctctgacatgaacctaacctgtgtagagagcgtccaactcaagctccctgcctgcttagcagccctcatccctcctcctatttcagtcaagctctgctctgtaaataatacagcttacagagcaaaacaatgttttacacaactatatgtgtgatcttctggacatagattaagtggtcaatttgcactcttcattgtccattgcatatttgcgattcagttgtgttgttgtacatgacaatgactaacctctcaggagctgcagcagaatattcagactggtggtgtaaaaaaaatgggcccagagtagtccctggatttatcagaaccagcgaattcccacgcagtcttctctgccaaggttttagagacgttgtaacaaagctgcacctcaaggctcaaagtgaatgaatcagcaagtcctacccttccatataagtataaatgaaaagatagacacagacattcatatatatatatatattaactatactactttactggtcttaatattattgatgctgtaacttacaatacttcattattggcagagtttaagaaagggaagacaaacaacctcaaactttaagcagttcacagtaccaacttcttattttcgcgagagtatacagtaccaacgacgaaagaaaatatatcataaatggtcgatgaagcctcgtccaaataaaccggcagcccaactgcgacgacggcgtgcagccggccggcccgacggcaatcagttctggttgtcgtcgtgcggcattgccgcgatctccagctgcctgatgaccgtgccctcgagggactggaggttgcaccgaacgatggtgtccacgaagatgcgcgtctcctcgacggtgttccctggcggcacgtccaccacgtaggactcgacgaccatggtgagcgggcgcccgtcctgcgacggcgccgcctcgtgcacggtggtcacggagcggtagttggccaggcggtggtcgccgcccaggacccggaagctgatcacccgccgctcgtcgtcccggatctcaagccgctcgcggctgctctcggcgggcagcccggacacgagcaggagctcccgcacggaccccacctcggcgccgtcgccgtccacgaggtggcagctcctgatgaagcgcttgtaccgctgcggctggtcgaagcgacgcaccagcgaccacaccgcgtccaccggcgctgcgatggactgcaccatggcggcgcagcattgccccgctgccaccgcgtgctcgtggtgccgcgccacctcgtcgggcacgcccgcgtgacccgcgcacaccgccacggccctcccgttggtggccacacggctgtgctgctgctgtgacgtccttgaggctgcgaacggcattgtcgatctggagctagagcctcgttggtgttcttgatcgatcgagctgtttctctctctcatagatatcacaacaagagggacagtgtgatgcacgacggcagcgacggcggcggcggggaagacaccgaagaccacaggaagtgggtttggtatgtggcagcgatggtcgatgggagaaatggtgagggggtgggtgaattgcgtgaggaaagtgaagataaggaaaacggtggggggccgccctgcccggccggcatgaatgtggatgggaatatggcttgtaggtatgctcattatgtgggaaaagcccggccaggccggc

SEQ ID NO: 22155 - DNA, 1169 bp, Zea mays
tttttttttttttttttggcctttttttttttttttttttttatattagaactatactactttactggtcttaatattattggtggtgtatcatacaatactttattgtcgtttttagagtttaagaaagggaagacgaacaacctcaacctttaaaaagttcacagtacctattcttcttattggtgaaactatagaataccaacggcgaaagaaaacatcataaatggcagatgaagcctccgaagaaaccggcagcccccactgcgagggtgtccagccggccgggcccggcggcgatcagctgtggttgtggtcgttgtgcggcgctgccggtgccgccatcgcctgcctgataaccgtgtcctcgagggattggaggttgcaccgaacgatggtgtccacgaagatgcgcgtctcctcgacggtgttccccggcggcacgtccaccacataggactcgacgaccatggtgagcggcccgccctctgaggccgcctcgtgcacggtggtcacggagcggtagttggcgaggcggtggtcgccgcccaggatccggaagctgatcacccgccgctcgtcgtcccggatctcaagccgctcgcggctgttctcggcgggcagcccggacacgaccaggagctcccgcacggaccccacctcgacgccgtcgccgtccaccaggtggcagctcctgatgaagcgcttgtacccctgcggctggtcgaagcggcgcaccagcgaccacaccgcgtccgccggcgccgcgatggactgcaccatcacagagcagcactgccccgcggccaccgcgtgctcgtggtgccgcgccacctcgtccggcacgcccgcgtggcctgcgcacgccgccacggccctcccgttgctggccacgcggctgtgctgctgcggcgacgtccttgtggctgcgtacggcattgtcggtctggagctagagcctcgccggtcttcttgatcgatcgatcgagttgtttctctctgcaaaggagaggtggagattgggttaggaggggaggtgctacacatatacagtagcatacactattttatccgtaggagattgatcatctattgttactgtgtggttcggtgagttgatgcgatagttaagggttactctagatggctgggctgggaatagtcaatgc

SEQ ID NO: 22156 - DNA, 2222 bp, Zea mays
gatgaagtgcgggttcctaacctattgagtggccttttggtaagtctcaaatggttcaggatgaattagcaaggctggggctctctaggcccccccccccccaccccccccgggcagttgctttggagctgtgccgagaatttgaggacaagtttcttgctcacataacatctggtgagggatctggttggaaaattgttgcaagttttgaaggcaagtttccagacagaatcaaacagctaccgttggaccgacatttcgatctcaacaatgtcaaaaggattgtcttggaagccgatggttatcaaccatatttgatatctccagagaaagggttgaaatccttaataaagttagtactggaaatggcaaaggagccatcacgactatgtgttgaggaggttcatcgtgtattgttagacatagtcaatgcctccgcaaatgccacaccaggactcggaaggtatcctccattcaagcgtgaggttgttgcaatagcatcaaatgcattggataccttcaaaaatgatgccaaaaagatggtcgtcgcgcttgttgatatggaacgtgcctttgttcctccccaacatttcatccgcttggtgcaaagaagaatggaaaggcagcgtcgagaggatgagttaagaaaccgatcttctaagaaaacacaggaagctgaacagtcaacatctaagagggccttcagtccccaaacagatgctgagcaaggtggtggcagcttaaaatcaatgaaagacaaatctggccagcaagataaagacgcaaaagagggatcgaatttgcaggttgctggtcctgctggtgaaattactgcaggttacctcttaaagaaaagcacaaaaactaatgggtggagtaaaaggtggtttgttcttaatgagaagagtggaaagcttgggtacacagagaaacaagaggagagacattttattagtgatgcaagttgctggtattggtgaaaaaaaaaaaaaaaagaggaagagccttctaaaagttcaaaggactcaaaaaaggcaaatggatcagaaaaaatctcaagtcttgtatttaagattactaatagggttgcatacagcgcccgccttgcagctcacagtgctgttctgttaaaggctgagagcatgcctgacaaggttgagtgggtgaataagatcaaagctgttattcagagcaaagggggttctttcaagggtccaagtactgagggtggttcaatgaagcaaagcaattcggatggcgctttagatgctatggcgcggagaccagctgatcctgaagaagagcttagatggatgtctcaagaagttcgtggttatgttgaggctgttttgaatagtctggcagcaaatgttccgaaggctattgtgctgtgccaagtggagaaagcaaaggaagacatgcttaaccagctatacagctcgataagcgggcaaagcaacgctaagattgaagagcttcttcaagaggatcataatgctaagcgcagaagggagaagtaccaaaaacaatcatctctcctgtcaaaacttactcgtcaactcagtatccatgacaacagggcatctgtttcctcgtattctaatgacagcactgaagttgagagccctcgaacaccaagccgctcaggtgaggactggaggtctgcctttgattcatcttcaaatgggcctgttgctacaagcacaaacagtgaatcaaggtcgagaagtgctgatggtcgcagccggcgctatgagaacggggatgtgagctcaggtgccaactctggcagccggcgcacaccgaaccggttgccaccagcaccgccaaaatactaatcgtgctgattggtattcatgaacattatgtattcttgcctggcacacgccccttgcttgtcatatgggttattggagcgtattccagatcggccgctagagattgtgttgtagtggagtctggtgattgcgtgaacattgtgttcgcaggtcgctgcgactcaggtgagttgtttatagaaatatataggtaaccatggtctctatctttactgtttattatctccgcacatttcctggccctggtgccgtccctgccataggattttgttggggcaatcgatcttgctttcgcacttggtcgttctgggacggcggctgtcagacaaagatttatgttgcccctcccgcgcatattgttcggtaaccctgatgattcttact

SEQ ID NO: 22157 - DNA, 1359 bp, Zea mays
  misc_feature (12)..(12): n is a, c, g, or t
ttcccgggtcgnccccacgcgtcccgatccgcttggtgcaaacaataatggaaaggcagcgtcgaggggatgagttaagaaaccgatcttctaagaaaacacagaagctgaacagtcaacatctaagagggccttcagtccccaaacagatgctgagcaaggtggtggcagcttaaaatcaatgaaagacaaatctggccagcaagataaagacgcaaaagagggatcgaatttgcaggttgctggtcctgctggtgaaattactgcaggttacctcttaaagaaaagcgcaaaaactaatgggtggagtaaaaggtggtttgttcttaatgagaagagtggaaagcttgggtacacagagaaacaagaggagagacattttcgtggtgtcatcactcttgaggagtgcaaccttgaggaggtagaggaggaagaaccatctaaaagctcaaaagactcaaaaaaggcaaatggatcagaaaaacccccaagtcttgtatttaagattactaacagggttgcatacaaaacagtcttaaaagctcacagtgctgttctgttaaaggctgagagcatgcctgacaaggttgagtgggtgaataagatcaaagctgttattcagagcaaagggggttctttcaagggtccaagtactgagggtggttcaatgaagcaaagcaattcggatggcgctttagatgctatggcgcggagaccagctgatcctgaagaagaacttagatggatgtctcaagaagttcgtggttatgttgaggctgttttgaacagtctggcagcaaatgttccgaaggctattgtgctgtgccaagtggagaaagcaaaggaagacatgcttaaccagctatacagctcgataagcgggcaaagcaacgctaagattgaagagcttcttcaagaggaccataatgctaagcgcagaagggagaagtaccaaaaacaatcatctctcctgtcaaaacttactcgtcaactcagtatccatgacaacagggcatctgtttcctcttattctaatgacaccactgaagctgagagccctcgaacaccgagccgctcaggtgaggactggaggtctgcctttgattctgcatcaaatgggcctgttgctgcaagcaaaaacagtgaatcaaggtcgagaagtgctgatggtcgcagtcggcgctacgagaatggcgatgtgagctcaggtgccaactctggcagccggcgcacaccgaaccggttgccaccagcgccgccgaaatactaatcgtgctgattggtattcatgaacattatgtattcttgcctggcacacgccccttgtttgtcatatgggttattggaggagcgtattcc

SEQ ID NO: 22158 - DNA, 1167 bp, Zea mays
aattcggcacgagggtctcttccatcccatccccgtgactccgcctccggttcaaatccgcgtcaggccagggcagagctcagggctcggtctcccccttcgccgccagttgccgcagcctccaacccctcgagatccgccgcgtgggagaccgccgaccatggaggccatggaggagctgtcagagctcgccgagtcgatgcgccaggcggcgtcgctcctcgccgacgacgacccctccgacgccgccgcgccgcgccggcccaccaccttcctcaacgccgtcgccctcggcaacgtcagctctggcaagtcggccgtgctaaacagcctcatcggtcacccggttttgccgacgggggagaacggggcgacgcgggcgccaatagtggttgacctgcagagggatccggggctcagcagcaagtccatcgtgctgcagatcgacagcaagtcgcagcaggtttccgcaagtgccctccggcattcactgcaggacagactcagcaaggggacgtctggtggatcagggaggggccgtgctgatgagatttacctcaagctgcggacgagtacagctccctcattaaagctgattgatttacctgggatagaccagcgagctgttgatgattccatgatcaatgagtatgctgggcacaatgatgcaatactgctcgttgtcataccggcaatgcaagctgctgatgttgcatcatctcgagctctgaggttggccaaggatatcgattcagatgggacaagaactgttggtgttataagcaaagttgatcaagcagatggagatgcaaaagttatagcctgtgttcaggccctactatcgaacaagggtccaaaaaaccttcctgagattgattgggttgctctaattggacaatctgttgcgattgcgtcagcacaatcagctgggtctgaaaactctctagagacagcttggcgagccgaagctgaaagcttgaaaaacatcttaactggagctccgcagaataagcttggtagaattgctttggttgacacaattgctaagcaaatccctaaaaagaatgaaagtgcgggttcctaacctattgaggggccttcagggttggctcgttcttcagtcacgttgtatctactatctaatgtttagatataaatgctatatag

SEQ ID NO: 22159 - DNA, 3285 bp, Zea mays
cattgggtacctcgaggccggccggggagtccgttgatgtgctcctcgcctcctccagtcccaccttctccgctgtcggcgcgtcggtccctctcgtgtgtcgcaaaaatccatcaccccccacgtctctcccatcccatccccgtgtagatttcaaatccgcgtcagagctcaggtctggtctcctccttcgccgccagttgcctcctccagtcgagatccgccgtcggggagaccactgaccatggaggccatggaggagctatcggagctcgccgagtcgatgcgccaggcggcgtcactcctcgccgacgacgacccctccgacgacgccgcgccgcgtcgccccaccaccttcctcaacgccgtcgccctcggcaacgtcggcgctggcaagtcggccgtgctgaacagcctcatcggccacccggtcttgccgacgggggagaacggggcgacgcgggcgccgatagtggttgacctgcagagggagccggggctcagcagcaagtccatcgtgctgcagatcgacagcaagtcgcagcaggtttccgcaagtgctctccggcattcactgcaggacagactcagcaggggagcatctggtggatcagggaggggccgtgttgatgagatttacctcaaactgcggaccagtacagctccctcattaaagctgattgatttacctgggatagaccagcgagctgttgatgattccatgatcaatgagtatgctgggcacaatgatgcaatactgctcattgtcatacccgcaatgcaagctgctgatgttgcatcatctcgagctctgaggttggccaaggatatcgatgcagatgggacaagaacagttggtgttataagcaaagttgatcaagcaaatggagatgcaaaaactatagcctgtgttcaggccctactgtcaaacaagggcccaaaaaaccttcctgacattgagtgggttgctctaattggacaatctgttgcaattgcgtcagcacaatcagttgggtctgaaaactcactagaaacagcctggagagctgaagctgaaagcctgaaaaacatcttaactggatctcctcagaataagcttggtagaattgctttggttgacacaattgctaagcaaatccgtaaaagaatgaaagtgcgggttcctaacctattgagtggacttcagggtaagtctcaaatggtgcaagatgaactggcaaggctgggagaatctatggtacaaagtgccgaaggaacccgagcagttgctttggagctgtgccgagaatttgaggacaagtttcttgctcacataacatctggtgagggatctggatccccccccccccccccccccgaaggcaagtttccagacagaattaaacagctaccgttggaccgacatttcgatctcaacaacgtcaaaaggattgtcttggaagcagatggttatcaaccatatttgatatctccagagaaagggttgagatccttaataaaaatagtactggaaatggcaaaggagccatcacgactatgtgttgaagaggttcatcgtgtattgttagacatagtcaatgcttccgcaaatgccacaccaggacttgggagatatcctccattcaagcgtgaggttgttgcaatagcatcaaatgcattggagaccttcaaaaacgacgccaaaaagatggtcgttgcgcttgttgatatggaacgtgcttttgttcctccccaacatttcatccgcttagtacaaagaagaatggaaagacagcgtcgggaggatgaattgagaaatcgatcttctaagaaaacacaagaagctgaacagccaacatctaagagggcctcaagtccccaaacagatgctgagcaaggtggtggcagcttaaaatcaatgaaagacaaatctggccagcaagataaagacacaaaagagggatcaaatttgcaagttgctggtcctgctggtgaaattactgcaggttaccttttaaagaaaagcgcaaaaactaatgggtggagcaaaagatggtttgttcttaatgagaagagtggaaagcttgggtacacaaagaaacaagaggagagacattttcgtggtgtcatcactcttgaggagtgcaaccttgaggaggtagaggaggaagagccttctaaaagttcaaaggactcaaaaaaggcaaatggatcagaaaaaatctcaagtcttgtatttaagattactaatagggttgcatacaaaacggtcctcaaagctcacagtgctgttgtgttaaaggctgagagcatggccgacaaggttgagtgggtaaataagatcaaagctgttattcagagcaaagggggttctttcaagggtccaagtactgagggtagttcaatgaggcaaagcaattcggatggcgctttagatactatggcacgtagacctgctgatcctgaagaagaacttagatggatgtctcaagaagttcgtggttatgtcgaggctgttttgaatagtctggcagcaaatgttccaaaggctattgtgctttgtcaagtggagaaagcaaaggaagacatgcttaaccagctatacagctcgataagcgggcaaagcaatgctaagattgaagagctgcttcaagaggaccataatgctaagcgcagaagggagaagtaccaaaaacaatcatctctcctgtcaaaacttactcgtcaactcagtatccatgataacagggcatctgtttcctcttattctaatgacaccactgaagccgagagccctcgaacaccaacccgctcaggtgaggactggaggtcagcttttgattccgcttcaaatggtcctgttgctggaagcacaaacagtcaatcaaggtccaaaagtgctgacggtcgcagtcggcgctatgagaacggggacgtgagctcaggtgccaactctggcagccggcgcacaccaaaccggttgccaccagcaccgccaaaatactaatcgtgctgattggtattcatgaacatttatgtattcttgcctggcacatgcgcccagatcggctgctagagattgtggtgtagtggatggagtatcgggtgattgcgtgaacattgtgttcgcaggtcgctgcgtctcagatgagctgtttatagaaaaatatacaggtaaccgtggtttctactgtttattatctctgtatatttatgacgtccctgccttttgatttaaaaagaaaaaacaaaaagcttccgcccttggtcggtctaagacaacggctgtcagactaagatttatct

SEQ ID NO: 22160 - DNA, 3032 bp, Zea mays
  misc_feature (3010)..(3010): n is a, c, g, or t
atttcaaatccgcgtcagagctcaggtctgggtctcctccttcgccgccagttgcctcctccagtcgagatccgccgtcggggagaccactgaccatggaggccatggaggagctatcggagctcgccgagtcgatgcgccaggcggcgtcactcctcgccgacgacgacccctccgacgacgcgggcgccgatagtggttgacctgcagagggagccggggctcagcagcaagtccatcgtgctgcagatcgacagcaagtcgcagcaggtttccgcaagtgctctccggcattcactgcaggacagactcagcaggggagcatctggtggatcagggaggggccgtgttgatgagatttacctcaaactgcggaccagtacagctccctcattaaagctgattgatttacctgggatagaccagcgagctgttgatgattccatgatcaatgagtatgctgggcacaatgatgcaatactgctcattgtcatacccgcaatgcaagctgctgatgttgcatcatctcgagctctgaggttggccaaggatatcgatgcagatgggacaagaacagttggtgttataagcaaagttgatcaagcaaatggagatgcaaaaactatagcctgtgttcaggccctactgtcaaacaagggcccaaaaaaccttcctgacattgagtgggttgctctaattggacaatctgttgcaattgcgtcagcacaatcagttgggtctgaaaactcactagaaacagcctggagagctgaagctgaaagcctgaaaaacatcttaactggatctcctcagaataagcttggtagaattgctttggttgacacaattgctaagcaaatccgtaaaagaatgaaagtgcgggttcctaacctattgagtggacttcagggtaagtctcaaatggtgcaagatgaactggcaaggctgggagaatctatggtacaaagtgccgaaggaacccgagcagttgctttggagctgtgccgagaatttgaggacaagtttcttgctcacataacatctggtgagggatctggttggaaaattgttgcaagttttgaaggcaagtttccagacagaattaaacagctaccgttggaccgacatttcgatctcaacaacgtcaaaaggattgtcttggaagcagatggttatcaaccatatttgatatctccagagaaagggttgagatccttaataaaaatagtactggaaatggcaaaggagccatcacgactatgtgttgaagaggttcatcgtgtattgttagacatagtcaatgcttccgcaaatgccacaccaggacttgggagatatcctccattcaagcgtgaggttgttgcaatagcatcaaatgcattggagaccttcaaaaacgacgccaaaaagatggtcgttgcgcttgttgatatggaacgtgcttttgttcctccccaacatttcatccgcttagtacaaagaagaatggaaagacagcgtcgggaggatgagttgagaaatcgatcttctaagaaaacacaagaagctgaacagccaacatctaagagggcctcaagtccccaaacagatgctgagcaaggtggtggcagcttaaaatcaatgaaagacaaatctggccagcaagataaagacacaaaagagggatcaaatttgcaagttgctggtcctgctggtgaaattactgcaggttaccttttaaagaaaagcacaaaaactaatgggtggagcaaaagatggtttgttcttaatgagaagagtggaaagcttgggtacacaaagaaacaagaggagagacattttcgtggtgtcatcactcttgaggagtgcaaccttgaggaggtagaggaggaagagccttctaaaagttcaaaggactcaaaaaaggcaaatggatcagaaaaaatctcaagtcttgtatttaagattactaatagggttgcatacaaaacggtcctcaaagctcacagtgctgttgtgttaaaggctgaaagcatggccgacaaggttgagtgggtaaataagatcaaagctgttattcagagcaaagggggttctttcaagggtccaagtactgagggtagttcaatgaggcaaagcaattcggatggcgctttagatactatggcacgtagacctgctgatcctgaagaagaacttagatggatgtctcaagaagttcgtggttatgtcgaggctgttttgaatagtctggcagcaaatgttccaaaggctattgtgctttgtcaagtggagaaagcaaaggaagacatgcttaaccagctatacagctcgataagcgggcaaagcaatgctaagattgaagagctgcttcaagaggaccataatgctaagcgcagaagggagaagtaccaaaaacaatcatctctcctgtcaaaacttactcgtcaactcagtatccatgataacagggcatctgtttcctcttattctaatgacaccactgaagccgagagccctcgaacaccaagccgctcaggtgaggactggaggtcagcttttgattccgcttcaaatggtcctgttgctggaagcacaaacagtcaatcaaggtccaaaagtgctgacggtcgcagtcggcgctatgagaacggggacgtgagctcaggtgccaattctggcagccggcgcacaccaaaccggttgccaccagcaccgccaaaatactaatcgtgctgattggtattcatgaacatttagctgtgcttgcctcgcacatgcgcccgggtcggctgctagagattgtggtgtagtggatggagtatcgggtgattgcgtgaacattgtgttcgcaggtcgctgcgtctcagatgagctgtttatagaaaaatatacaggtaaccgtggtttctactgtttattatctctgtatatttatgaaaaaaaaaaaaaaaaaaaaaaaaaaaaaaaaaaaaaaaaaaaaaaaaaaaaaggaaggaaaaaaaaaaaaaaaaaaaaaaaaaaaaaaagnactctgcgttgttaccactgct

SEQ ID NO: 22161 - DNA, 837 bp, Zea mays
ggttggggtttttttttttttttaaaaggaactatttattcccttcctgaaattccctttgaaaccatgggtattacaataatgatgctgaatcgcctttgtcctcgtcgcattcgcctccaacagcccccgtttcgcgccagcttatataagtggacaaattattactgtcagtatatgtaacaagaaaacaaaatcccggccagtggccgccgtcgaacgccaccaaataagtcaatatttggaaaaccacatgtacaaaacaccacagatacagcggcgctacctgcttcttttacatccaaggtaatctaaaacctcctcggtttccctatcctagcatattctaatggaaagcaaatgggcttccggcaacaaagtctgttacacgctaggctagcgaaacatggcgcaacagatgacgttgcgctcggtatctcgtccagtcagcagcaaaggctgagaggcagcgcgtttccccacatgaacagcaggtggtcactgctgtgcttcagcggatgtcaaacctcaaggggagaactctacctgccataatcacggcaatgggttgagcgagaacaggtcctaagctgcacacggggaaaaaggtttcatcgcttccggccctttgatcttgaagcaatcaagcggatggcctgcttccccagctccacgttctcagacctgccattgtctaactgaatacacagtgtgccacccatgacattcgacaccatcccttgatgccatttgccatcagaagttagatggacttcaatcctctttccgatagcatccttgcccaacttgcgtaggatccaatttgcgtccatcact

SEQ ID NO: 22162 - DNA, 1193 bp, Zea mays
tagcgtggtcgcggccgaggtaccaagatcgcccaaaaggctatttctttgttgcaccccagtatctctaactaacttcattacacttctctcttttacttcgtttcttgaacttttcagctggcttgtgacatctattttccctccatgtattgaacccaaatcttgctctctttgagaattggacagttccgacttaggagagccactcctagttttatgccgtgaaccaagatggatagccaacttggtagcttttccagtgtcattcttaggagtattttcttcaccatctttgtaatgcaaactcgaaaccttactgcctttaatcttgactttgggtatcatatcagcattgtttgccacagctttcatggatggagatttcaaattcttttctaaacttcgagttgaagatgaaacatagacattatcatcatttttaaaagggctcctgtcatgattctcatttatagtttgatctcccaaacagctatttgatgatttaacagcatgccttctctccagaaatatttcatcatggccatcaactgttttattagcctgaccacttttctttttggaaggcttcttatttgatccagagctcttaaaaacaatcttctcttgctcaggtgtatctggtggaggtttactactgttacttttcaatgaaaactttagagtatttctactctcatttttcaatgcatatgcaccgagtttctcatcatcagagttttgataaggtggtgagacatcttcaagagaaggcagtgcagcagcagcccgtaaagtagccataagctcatgatcggcaacatccctcctcttccaaagctcccggattgcatcctcagtgtctctgatctgggagcattcaccacggcatgctgcacatgtgtactgaaggttttgatcagcttggaattgttggtacttttcctcactgatgccatcacactcaatatgcacccacttttcacaaacatcgcagcaaaccataggtatcacttcagagtctctataaaccttcaagcagattggacagtagtttcctttcacaaacaatcgtccacacgcatcacagcatgtgtaccccaaaaaccaccttgtgctgtgtccactaccaggcacaccagatccacagctgtggcaccttgtatgttttggacataaatatggtccatgag

SEQ ID NO: 22163 - DNA, 3607 bp, Zea mays
aaaaacagactcaccagtgacacagtcatatatatagtatgtggggcttttcttacataatttcacaaagaaaagcataaatatatgtagataagatttaatagatgaaattcacagatatcacaactggacaacagatgtcaagtaataacaccgaagctaattaccagagctaagtgctaacacaccatcctcacaaacgacatcaacccagttgtactaaatgatccttgcactacaaaagccccacattaaacagaaaagatcaggcactcaacccagttggtccgcgcaccactgtaaccgggcatgttgcattgttgactacatagttgctgacactcccaaggagagcccttttcagtggccctaagcccctgcaaccaagcacaaaggagtccaccttgagatcatctaccgcctcacagagtttctcccttgcatcgccccagtaaacctttgctagtacttccacctgcttggacttggatacagctcgcaggatctccagtgtctccttatcagggttgagcccgtacctcgcctgcaggttcatctccatgaactccgacagaggaatcaaaggtgagccggtggtcttccagagctccttgtggctggagtccacgcccttggggaggacgtggacgaggacgaggcggtccccggccttgatcaggttgtcgaccgcccacctcgcggcggccttgctggacggcgagtagtccatgcccatgccaatggtgcgcttctcggctgccatgcctggcggacctgctgcaggtttcttgcggggttctccggtgtacgaaggctgtgaaaaggaaggtggtgcaccggccggccgaggcgcagaggcagctatatatataggggtattcctgggaagagttcgggttctgttctgaggttgtttaaaagatcgtcggagtcggagtcggagtcggagtcggagtcggagtcgagccaaatatcccgcccaattggcatccaactcgtaggagcctaggttggctttattcgcctgatgaggtaatcgagtcggtttctgacgattgggagcgcattgccagctgcacatgctaatcatggcgctggtaaacatccccgagcctctctcgacctgtctagaaagcccaagaagcggtggctgggtccaagactcccaaatttgtaaaagcttctcggctgttttctgtctccaagtctacttgtagcaggcagcagtcgttcgtgaggtatccgtgcccagccaggtctctttcctgtgggcaattccattgaattcaactggaagagaggtatccaaaaaaccaaactagagactcgcgctttcttaacagaatgtggcttgcctcattgttcatcagttcgtcatgttgatctcgacgtggcttcgtgatcagtagtagctgctgaggttagccaaggctaaaaccacgggccggccggtgggatgggtttgcaagctggtgctgggatggaaccgataccctgaccttttccccacctctcgatccttggctagcacctgcaggcatgcgcttgcgtgttcagtgatcatctcgaaggtgtcgtgcattgcatatctatgcttcggtcaactttgtctcggcaagtatgtgagcataaataaatactaagcaaaacatgcctggaaaaggcgcgttcagtgcgtacgtatggatgacagcgtatacccgttgatccgaggatacgttagtctgtctcttacagctaccgtatcgtatcatatcctatgccttatcctttattttaaacttcactctacatataaatctgctattttacacgatctgttgtaactgcaaataaggaccggttgtccccaacagcctaatactagtcgatagcgccagcagagagaaaacaaaaatagaagaaacacaaataaaaaatctcctgtagttcttgtctagtcacacaccaatggtactgaccggttcatatgcaacagaccaacagtaccacattttcttggcaggcgctgtctcgtactagacgcggcaacaaatgaagaaagaccacctatcaaggccacatggccctgggactgggatacagatgggctagtccacgaaccacttgcatctctacctggaccaaaccatcgaatgggcctccacataaggcaggcagtttcagataactggactgtgtaggatgaaatctcgttggctctcgttcggtccaatggccgtgggaatcaggcgacacagacatgtcagtcaacccctgagacccaattcggttttcaaaatacagagataactaaaaaaactgtataatacaaccctaaaactttagataataagtacagctattagacaacatgtataaagagtcgtgaaaaaatagactcttcgtgaagagatagactctttacgaagagtctgtctcttatattttttcacttagattcttagaaacccaacaagagacatcacattaaataggattatatataccccatagtgttcggtgaagacggatgctggctgcctgcctccaagccgtcgccgcctcgccggtgcaggcccaaacatctccatggggattgtcgacaattggaccatcaactcctgccagcttttcgtcgccacgtaagcagcagacccatgtggtacgccgcgtacgtttcatttaacgcgtatcgtatgcacgcatgcacataagtttccgacacgttaattctgcccaaaagtccactgtatattttgtacgtactaccttcgattttacacgacgggatgactaataatgaattggccgcaccagtccaataatccgttctctcgtgcaccgacaagaattctaggaaaaaaatatataagtattacttaaatgtttaataatcttattattctgaattataagacatattaacttttcatcatatattgtttttgttatagataatgcatctaactataaattattcacggatcctaattttttatgaaaggacatttagatcattgatctattatcacttctatgcacgcgggagcgacgcgggggccaaacgggtcgtcagtttaaggttacatttttcatcaagcatgtatactgattattcaacttccttgcgctccaatccaaggttccgcgattgccgccccgccgggaccacacgtttcaagatacatacactcctgctagaagctggactaccacttcactgaatgttcgtgttgatcctcgcgaacttttcctagctagtaaagtctcgttgaattactaaaccaagtatcaggtattcaggtcaggggatgctactaagcgcagtcgctacatccttaacactataataaaaaggagctaagcatgctagcacttgcaccaaaaggaagaaggcaaacctgctttgctcagttcagtttctcaggtattttcttatcctggaaatcgagttgcatgcatgccctgtccgattggcaggtttacttgcagtgttcgaattagagatggccaaacgggccgcccggcccggtgaagcccggccaaaaaccgggccgggcctgctgtgccagcgggcttaatttctgtccaagcccggccaaaacaggaaactaggccggcccgt

SEQ ID NO: 22164 - DNA, 3402 bp, Zea mays
  misc_feature (124)..(124): n is a, c, g, or t
tttgataaagctacgtgtttaaatattaattataaactacaattggatcatgatttaaaagcctagaatgccaacttatgtggtatcctggtccagggatcgtgatatcttggttccataggtngatagaatattcacattaacaaaggtggatcttcttttttgaaagactatatcaaaagaacctctatgttactcatgtttgacttagagcaatcttaagatgggtaatcggacgagaggttttccgggtgcgcacgagtgaggacaaagtgcacacaaaatactcgtgttggtctgtaggtatagtttatgattttgagaaggctcacatgagtaagtgccaccggtctgggagtagctggggtgctaaattataggattagttgtatatatgtcactcaacttttgcaaatttagatagctagtttatttggatgtcacatcaaaataaactagctatctaattttgcaaaagctaagtggcatgtttctaattagccctacattatatgtttgcacttacgggacatttggatctattcattttggaggaattaaaatttacttaataaaataacatatttagcttaacatttaatatttcactactttctaaagttcagatataattaaggctatcttaaattcacgtggtgaaggataagaaatgattttatatatcagtagaatttgtttctactctataacttatagaacgctcttcgactcgctcatgtttagtaaaaatatagcacaacttgttaataatagtatataaatatattttgtataaaactgaattaacttaattgatatgtgtctaaattattattattggaatgaaattcaatttcaaggatccaaacggggcattaagtccttttgcacaacaatcgttttctttatttccatcttacctttttctcatcaattctctgatagcacgcgccaagctaacacacaaccaacctaccccgtactacatattaggcgtcctaattaatcatcgtcaacagcaacaaaaaaaatacaatggtagtagtagagtagccctaattaaccactctagctccgcacttccctacgagctacgctgctgcgatatggagtatatagatagtacgtcaccatgggagtacagtacagcaactgtgtttgtttcttgcaagcctacgccactccagtactgaacaagacaatctcgatcttccctacttcaacatctcctgcggcgcttcgtcggcgcctggccagcggcggtggcgtagcaccagaaggggttctccggggacgagatgtccggcacgaacacggcggccacgtcggtggtggtggccgcgccgtggcgcgggccgccctgccagtggagccccgaggccgtgggcggggaagggagctccggcacggaccactggtggaactccggcacctgcccgaagaagtcctgggacgcgtcggacgacggccggccggccggcgagccgtcggtgctcccgagcttcccgctgtcggcctgccacgggtcgtcggagcgctgtcaggcaacaatatataggtgtatgcatcgtcagatgttcgaacttggctgtgaacagagttcgcttgctctgtaatcaaaattcagaaacatgtatgacgcatgcagttgcctaaattcaagcgagcttgcatcatgaactaaaaaactacgctcagtgatgacggagtctgctgccgaaattacgttcaggcaaagtatacatgcagatagattcgaaacgaatttgccagcatcattattccattcagtggccatttctgagaatcgagaactgagtgctgaccttggacgtgtcattctcagcgaaggcgaggccggcgctgtactcggagaagccaaagaactcgtcgagcggccagtccggcaagccccctgcaaggccgccgccgccctggacggtgaacgccgcggcgaccgaccgccggggactgcgcttggaagagggcgttctggctagcgccgggtccgcgtgtcggggcaccaccggcggggcgccgaactgctcgtggacgagcgaccagtccggcagggtgacggcgacgctgacgccgccgccggcgtccgcgccggccgcccagtcgatgtcgtcgtcgctgtagagcagcgccgggctgctgccgtcgccggccgccgccgccttcctgtcgggcggcgggggcgtctggaggggttccgcggcggcgggcgggtgcgggtctgcgtcctgggccgcggcggcgggctgcaggccgacctggacgccggtgaggaggaacctgcggtgcgcggagacgaaggcgttggccgtgtgcacggccatgtcgcaggcccggcagagcagcgcgcggtcctccacgcagaagaagtaggcgtgggcctcctggagagccggcaggaggggagtcgtcagccggcggtgcgcagggcagggcagcaaaatatcttcttttgtgtgtgtgtgtaccacagaggcgctacacgtacctggcatatgtcgcagttgggcgcggagacgtcgtcgggcgggaggagcggcaggcggtggtgcttgccggcgaggcggttggcggcgtgcacgtcgcggtcgcagcgcgcgcagagggcagcctcgtcggcgcagcagagcaggcgcgcctcggccgcctcgcacgcggagcagagcaccttcatggagctgttgctgcgacgaccatgcacaggttgagctcgcggcagcggggggaggatgaggatagaaaggggaagaggggcgattcagctcgggggtgggggtggattagcttagctgcaggctgcaggggaagagagagtggaagggaagctcagccgcctagcgggggcggggttttgtcaggtggacgatggatccggcggatgcggccgtcagcgtcacgcacgcggggacggttgggagttgaggcgtggcggagggcggaggcgggagatattatcgcgggggcgggaagggaggggtccgtacgaacgaacggcgacagcggtagatcggagatgaccggtcggtggaggcgacgtcgcgcgctcccattcgcccgtccggagggccaggtagtactggtttcactctgctgtcgtagctgagctggggcctggggcccggccctgccagctgctcgctggtcggcacgcggcgtgccggcggcacggacatccacgtcggcagatcttttaccgcagcccgaagccggatggacaagaaatagcttttgaaacttttgaagttaaacaaataggttgctaggattatttaagttaaactttttataacttaattgaattgctgaaaaaaactattaaaatttacgacatcgaattaatatcattcgatatgtacgatatatttatttcatttgtcgaagatg

SEQ ID NO: 22165 - DNA, 3427 bp, Zea mays
ttttctgggtacataatttttttttctatgcatttagatatatgctatgcctagatacgtagtgaagactacatatctaaaatgcaaagtgaagacacgtatttagaagaaaaaacaacaaaacaacttataatttagaatcatgggtgctgtttcaatgtggtgatttcatttcgaaagttattatgccaaacttgcatgatggtttcgtgcaagaggcagagtcttctacacttcatatcccctaaaatttgtgttgcgcctacaaacagtagataagtagatgacagagaagagacatcatttatttactatagacaaagagcatcaaacatgtcatcttcgagtgaagatgatacaatatcatatatctgtgcagaagttcataacaatttttgtctctgttgcatagaactggtgactttatcttatcactttgttggctttctgtatcgcaagcagaaggacttgagcctgtcaagcccctcttccagagaagatggatcaatcgcaaaggtgatgcgaagccaatccttgtatccgacagcacatcctgacaatttatttgccgcaagttacatctcaaataaaaaggtgatctcaaggtggatgggaaacgtcttgtatcaaagagatgaactgatctgcatactagaattgtagtttcaaacaagtcatgtattcagaaggagcgatacctggcagaacaaccactaattcttcctttgccagccggcagcagaagtccatgtcatctttgatgccctccaggcaggacagatccagtttcacctgtagcaagtcaagggaatatcacaccctgttaagaaatctgtcatggtttcctgccacatggaagagtatatatggttacagtgactcacagaccattacaaacatggatccctctggtttgcttgggcacgtgattgcattgatgcccttcagcttttcacagcatatatctacacatcgttttagaatttcgatagttttttcgaagaattcctcctttgtgttctccacgagttttggtattgctccctgacaaacaaaattttgtaagtaagtcgacgcaaaccattatttttcctgtgcacgatatcaagtcttgcaagaaaatggcaattccgttatagttacctggacaaatgttgcaggatcagaggagatatcaaggtagctcttgatgctgtgcactacctggaagaagaaaaaaaatgtgtaaccattatgagactgcattttacatggtaccttcacttaattccatatctgaagaatagcttcagtatttgatcaggcatgtcagcacccaggccattttgttaaatgaaatgcaaaccaactttccaatactgattaacacggaactatgttaaatcgtgaaaagtaaagaaccttagtcctctgaaatacaccattcggatcattggtaacaatccatccaagccgccatccaggcaccatccatctctttgatatggaccccagtgttaacactggagccacagccccaaacacacccatcggcacaaatttcctctctccaaatgtcaagtgtgcgtaaacctcatctgctatgacgaatatgccaagctttcgcgcggtctcagcgacctagaaaatcatggacacaaatagggattcaggcgatgcctcaggaactgtgaactacttaaggcagaaccagtagtagcatatcagaacttgccttggccaggtgctcataggagtacacattgccacatgggtttcctgggttcacaatgaccatggcaacagtattcttgtcggcaagagcttggacgccatcaatgtcaacctcccagccgttcccaggtagaagattgaagtaacgggcttccatgccattgaagatagcacgcgcctcatagaacataaatccaggtcttggaagcaggatgtttgcaccaggacgagctaacgcagagcagagtatctcaattgcttgagtgcaaccacttgtgaggtagacatcatcaggtgacagtttatatggcaaatcacaggataagtactgagcaatggacctgaaattaataatggaatcagtatgaattggaaggaaataggtagtgtgtatagtttgcactgcaaacaaaataagcctaaatgtctgtcaggagaaaatgttgtccgacaaattgttgtttcttaattcttatgactgtgagctcgtcacagtcctgtaacagcataactgatgcgataacaaaaaaaaagttctcaaaaacatgaaatgaatgttgtcatgactcatcacattctaagcaactgaatcttattatagtcggaacatgaatcatggtgaaggcaacatttcccagtgtattgttgatgtcagtggctaactgggtaaggcagcaagttgaccgagacaatattagcagatgtaaagttcagtggttcctaaacagagcatgttgatttcagcgaatgatgaattaagggtgtagaaatgaataaatctttttttttctaagatacggttggggagtaaaacagcccgcggatattgttcgagtttatgcatttagatgacggaaaacgaaattttgattgtgagatgccagcgcaccagagccgagtttttccaattgcttgagtgcaaccacttgtgaggtagacatcatcaggtgacagtttatatggcaaatcacaggataagtactgagcaatggacctccgtgcgagctcaaggccgacgctagtggaataggagttgtactgcccggactggaccgcgctggcgacggcgtccacggcctctggcaccgtccggaagcacgggaacgctgtcgggtcgccgctgcccaaccggaccaccgcccgcccaccgtcgggcaacatcccggccatgactctggtcagcacgccgcgaaccgagagcgccggaagacccaggagggtctcgtttggctcgaagttccacgaggccgggacagccgtcacaaccccatggccattggtggcgctgtcttccattggggcgtgggcgtggcgattgctcgggcgctgcgagataggtgagtgggagactggagtagatggccgatgggtgatgctgatgagaggcacttgtgcgagttgtgctggtctacttctaggctatagcacacaaataattctaataaaaaaattggatatgacagaaatttagcccggcccgcccggcgcaacctggttatatttaaataaataggattgatatgatctgcttgtctgtacgaagttatctactctaccacgccatctctcacaggataaacaaaattaacaaagtacaataacaacgtggcaataaagttaacaaagagatacgagaaaattatttttttaataagaaactatgactaccgaaaaccgaggtataaagagatactagtcgtcgtatgctcatgcg

SEQ ID NO: 22166 - DNA, 1721 bp, Zea mays
ggccgcttttttttttttttggagcagaatcaatgtggtgatttcatttcgaaagttattatgccaaacttgcatgatggtttcgtgcaagaggcagagtcttctacacttcatatcccctaaaatttgtgttgcgcctacaaacagtagataagtagatgacagagaagagacatcatttatttactatagacaaagagcatcaaacatgtcatcttcgagtgaagatgatacaatatcatatatctgtgcagaagttcataacaatttttgtctctgttgcatagaactggtgactttatcttatcactttgttggctttctgtatcgcaagcagaaggacttgagcctgtcaagcccctcttccagagaagatggatcaatcgcaaaggtgatgcgaagccaatccttgtatccgacagcacatcctggcagaacaaccactaattcttcctttgccagccggcagcagaagtccatgtcatctttgatgccctccaggcaggacagatccagtttcaccattacaaacatggatccctctggtttgcttgggcacgtgattgcattgatgcccttcagcttttcacagcatatatctacacatcgttttagaatttcgatagttttttcgaagaattcctcctttgtgttctccacgagttttggtattgctccctggacaaatgttgcaggatcagaggagatatcaaggtagctcttgatgctgtgcactaccttagtcctctgaaatacaccattcggatcattggtaacaatccatccaagccgccatccaggcaccatccatctctttgatatggaccccagtgttaacactggattaacactggagccacagccccaaacacacccatcggcacaaatttcctctctccaaatgtcaagtgtgcgtaaacctcatctgctatgacgaatatgccaagctttcgcgcggtctcagcgaccttggccaggtgctcataggagtacacattgccacatgggtttcctgggttcacaatgaccatggcaacagtattcttgtcggcaagagcttggacgccatcaatgtcaacctcccagccgttcccaggtagaagattgaagtaccgggcttccatgccattgaagatagcacgcgcctcatagaacataaatccaggtcttggaagcaggatgtttgcaccaggacgagctaacgcagagcagagtatctcaattgcttgagtgcaaccacttgtgaggtagacatcatcaggtgacagtttatatggcaaatcacaggataagtactgagcaatggacctccgtgcgagctcaaggccgacgctagtggaataggagttgtactgcccggactggaccgcgctggcgacggcgtccacggcctctggcaccgtccggaagcacgggaacgctgtcgggtcgccgctgcccaaccggaccaccgcccgcccaccgtcgggcaacatcccggccatgactctggtcagcacgccgcgaaccgagagcgccggaagacccaggagggtctcgtttggctcgaagttccacgaggccgggacagccgtcacaaccccatggccattggtggcgctgtcttccattggggcgtgggcgtggcgattgctcgggcgctgcgagataggtgagtgggagactggagtagatggccgatgggtgatgctgatcccggcccggccggcctcgaggtaccc

SEQ ID NO: 22167 - DNA, 1333 bp, Zea mays
  misc_feature (266)..(266): n is a, c, g, or t
agacagaagttatgtacatgcagtactcgagtcataactgtgccatgaatatatgcagaacatgtagggcactctcttttttttcttcttcttttcttttatgccttttatgccaggagctttaaatagttgatagataatcctgagaaaagttgtcgccagccttgctgtttcgctatcataaccaggctttcaaatgttcccctacccacaaggctggatgacgaaagggcttgaacctgcaactgatccgcaaccgagcttgnctatgataccttttctgtgctcttcaggaacgtggctcttcatcttctcgtagaagtagaatttaagaccagagtaagggaagattccatatagtgaaggagccatgccacggtatatgcctttcaatccattttgtctgtatattgttttcacgcaatccatgattcctttgtaaacctgttcagagggcttagattctctgaaacccacactgactgcacctttcacctgataagccaactttgtgcggactagatcaagagggtatgtgcatatgacagctgtccctccagctatagagccagccacgagatcaagaacaggcccttgctcaacattaggaaagccaagaatgatccaccggcggtattcttcataggccatataatgcaaagctgcatacgggacaattcgagcaacactagctccatttcccctgtaaaaccctaaaagaccttctgtccgatagattgttcggaaggatccaatcaatccagaaccatggaactccgctcttcttgtctggaacaggatcttgacgcgctcgagcggcgcgacagcggtcttggcgactcccccggcgacccctccggcgaggagctcccgcacggcgagcggcaacccggggccgctggtctctgcagcctccctggcccgcgcgtccatgccgcgcgccccccgccggcttcctcccctccctttccctcctctcgcgcgcgcggcgggaggagagcgagaggcgtaggcgacacgaattgaggtggaagagaagggagaccgcgcggcggaattgaaggcggaagggaatcaggccaatcaggcagcgcggggcccacgtgtaagtggaagcggtatggggccacgtgtacacggcggtgggcggcggaaggcgaaaggaagccgccggtcagccgtggtggaatcagcagttggctggtggtggagggcgcgcgtagccaccgagacgagaatgttttattatgaaatgggcacgcgtggagcgtgttcttgctgattgctgcctccacaagagcatctccggcagctggatcgtctagaggcaacc

SEQ ID NO: 22168 - DNA, 1087 bp, Zea mays
gagaattatttcagtagacagacaaccatcctagactgcaatccctcttgttaagcggacgggatctcctctgccccgtcgtgaccaaaaaatcctagatgtcgtgctgcgcgcgcagcccgcaacaatccaacagggtggggaatgcaaggcgcatagattcttttgtactcgtcgcgatagaatagggagggggcgcaacctatttattcatcagctatatatacatatacacacacaagagcctgtacacagaaatgctaatccgccaggaattacttttcgactgcttgcttatgcgcttattgatggtcgtcgaattattgtctccaacgcgttggagaagataagatccaagaaagaatgctatcctacactcctgcctaactggaggggataggagctgtattgcttcgctcctctgccaagacagcaacagcagtttcctccctcgacggaacttttagacagaccttcatcgagtcgtaaacagtaaatcctatggctactgatggcaccacctttaaatagttgatagataatcctgagaaaagttgtcgccagccttgctgtttcgctatcataaccaggctttcaaatgttcccctacccacaaggctggatgacgaaagggcttgaacctgcatttgtcgcctaacaacatctagggggtatgttattgtctgacctagcaaacctgcaactgatccgcaaccgagctttgctatgataccttttctgtgctcttcaggaacgtggctcttcatcttctcgtagaagtagaatttaagaccagagtaagggaagattccatatagtgaaggagccatgccacggtatatgcctttcaatccattttgtctgtatattgttttcacacaatccatgattcctcccgaaacctgttcagagggcttagattctctgaaacccacactgactgcacctttcacctgataagccaactttgtgcggactagatcaagagggtagtgtgcatatgacagctgtccctccagctatagagccagccacgagatcaagaacaggcccttgctcaacataggaaagccaagaatgatccacc

SEQ ID NO: 22169 - DNA, 4112 bp, Zea mays
  misc_feature (3742)..(3742): n is a, c, g, or t
gggtaccgggccccccctcgtgtttttccgggtcccccctcgtttttttttttttttttttttagtaccaaggacgaacttatattatatagcttaaataatctgatgaaatggaattcattgattggtgagctcagttcgactctacaaaatacagaccgcaaaatggtacatacatgtaagaggcagacataaaacgtggttttcagcctcactcagggacagtcaaggaaccaacccgactctgagtctctgacgatcaatgcaacgaagcaacagagaaaacaaatacaatcctctgctgaccaatactctgataaaaggcactgttggaacaacagggttttctgtgacttgacttgcattttccactcaagggatattcgttgcaattcgtccagcacccaaaaggttggacttgcaacaacaatcttccttggctgatagtaacagagcacaatttttgatgttgtcacttcagggttttgaatgatcgatgggtttatcagggacagaaagttcatccttgagcataaaggacagatcgtgcatctgagcaagcaactgttccacatttgtatttgcaggctctggtttattagctggccataatgaagacagcgaatcaacatcacccatctgctgcattccacttgtgcttttcaagtggtcatcagatggaaatgcttttgattcattagaaccctcctttttatcctttgagttttcggatgaagctacctgcaaaacactcccaaattcctgctctccaaaagcatcaggccttgatgccaaggttatatcaaataatgaagcatctgaagaaacttgtaaggttgtttgctgtggattggagttttggaaatcctgccagtcatcgaatagatcattatgttcacttatctgttcaaggttcttttcattaacatgacttgaggcccataagtccaaagtttcagcccctgaaggatcttttacaacatgtccttccacatgaactttagtaattctctgagcttgatcaaaactggcaaaatcctgccatccatcagatgaggcattagttctcccaacatcattgcttttagattccttgaagttgctggtaatccacaaatccaaggaatcatttcctttagctggttcaggcgacagactactcggttctctcccaagactagacatattttcttgcaggtgacctgatttagtaaaattttgccaaacatcaaatgggtcgctttctatacttgttgaggatgtttttgcggcatcattactgctgccatttgcccatgatggggcagaaacagttccaccatgctgctcaaatggcacacttatcatttctgcaccagtgctagatgaattttgctgtgcttgatctgaaccagtgaaaccttgccaatcgtccaacatgttatttgcattcatggtacccgtatttgctggctccctagaatgtccaatgaaccatgagtccatgtctgtttctttgtgactggcttttgagacctccatcatgtccccagtttgattcaacgaagtgtcctggacttgaccggtggtagtagaatcttgccaatcgtcaaaagaatcatttttttccttaaccatttctgcagtattttgagccttcacattgcccacatgccatacatcaacaggattaatttctgaagaatgttggtgtgagatgctgctcattgtctcttcatctccaactggtcccaccaaatttagtccgtggtcacttgttgatcgttccacagatgtcacaaaatctcttccttgaccagacacagaagcaaaaccttgccattcattagaggatttttcaataacattgttgggtgattccttgctgcctactcgcaagggatctattacatcattctcagacaaaatctctcctggccggttcctcaatatgttccgcatttgataggctgccttgattgccacttgttgtaaattcttgccattcatcaaaagcttcatcatcattgaatccatcatcgtcccttccatgtaactgatcacttttagcaaaatccatggggagagaggattcagtgaacccaggagcgttgctgctctcaaagatatggtggacaaccttttgatcagaaaggtcatcaccaaataatgtgctacttgctgaagccaaaacttctgagtgatgttctaggatggcacttctcgtatttgttttactttcagtacttactacaggtttgatggcaatctctgaagctgggaaactaaaagactcggccacagaagtgctcttaaatagatcaggttgcttggagtttttggcagcattttctgaactagcagactgaaaatcagcatcccaacttgcaaatgctggagtagcttcaatctgatttgttctttgagaactaattaagcttttaggtgcagcatgcacttccaatctagattcatggcttttgctatctgttcttttattttcctgctccaaaaaatgagtttgtggaagagaagcagaagtcatctcttcttttctttcaatgaaaaatgaatctaagttagcagcagataaatttagtgtatccacagaagatgattgctcctttgttatggaacttggagatgtttccttattttcagggaggcatgtgatttttaagtccagtagatcagatatgatcatcccactgtttggtggtggtacatccttgcttttattcgaagctgtagtgtcagtatcgaattctacaatctcctgaatgataaagggaaaagaagtagaaaaaaatcttacatcagccatgaacattgaacttcagaaacgagactatgtttcctgcatactttgaatttaaagagaactaggacaacgatatcaatacacgtaaattcaccacatatctatcataatggaagattcaatcatattaaaatcagtacatagttacaatgtatgaaagatcaatgtctgttaaaccgcatggagcttgcattccataaatggcttttacacattaatgaatacatagtgagttagcaagtaagcactacatgcaaatgtagtaatagtcaaatataaacaaatagctaagcaggtatgcatggatatccaacaatataagcattctctacacccaaaagttagcaccatcagaaattagcagcttgacaattacaattcatttaaaataggaatttgtttgggttgttctctacttggcattagtgattgagggattctgattgtaagctcatctatataatgacaaacactgaagaaataaagcaagcaagaatttggtcttcttttacccctctgtctctctgtgtgtactctgccacaccgtcagctccagcgaggcaaagcgaggtcctcgcggtcccattgagcatcaccacgatcacactcaccaccacaaccaagcacccacagtagcaagtttaaattctaggggggaaaatggtaccaaaggccctgttcagccaaatcagattctcctaaactataatacatgactggatgaatggatgagcgtgtaaggatctgtttggcatggcttatttgcagtttatgccctttttatcaaaatccaaatttcactagctctggttaatgtagcatgtctacagcctcattataattccttattttgtattgtgcatgcctcacaactcaaaaccctagcagaatatttctttcatggctcttgaattctgagcaaatcaaaatttccaaacaagntatactattcatacagacccgttggcaaccgacatttctctaactactgggcactttcctaggaatagcactgcgtaataagtaaaaaaagcgatagcaattccacaaacagttgtattagaagatctccaggagaataacatcatcttctttcccgaatgctggctcagctttgctagaaagaagagctaacagatcctaagcaacaagaatcaaatctacagattcttagcgtcaaataatgtgggaaggaaagctcacggatccgtcgagtccaagcgagccgagcagccactggtaggccacgccgtcacggaaggcgacgccgccgcttccaccgccttcagcctcctccccgcgcctggggcac

SEQ ID NO: 22170 - DNA, 694 bp, Zea mays
  misc_feature (641)..(641): n is a, c, g, or t
tttttttttttttttttttttcctgctccaaaaaatgagtttgtggaagagaagcagaagtcatctcttcttttctttcaatgaaaaatgaatctaagttagcagcagataaatttagtgtatccacagaagatgattgctcctttgttatggaacttggagatgtttccttattttcagggaggcatgtgatttttaagtccagtagatcagatatgatcatcccactgtttggtggtggtacatccttgcttttattcgaagctgtagtgtcagtatcgaattctacaatctcggatccgtcgagtccaagcgagccgagcagccactggtaggccacgccgtcacggaaggcgacgccgccgcttccaccgccttcagcctcctccccgcgcctggggcacccgcagtaggtgcagagggcagaccgcacaccgcgcaggagccctcccgaggccccgcagcgcacgcatcggagctccgccgacacggaggcggcacacgagtcgaaggctgcgacggcatcggcgacggaggggaagggaggggcgggtgcatcttctacagaaggggcgaaggtggcctcacggagagcggactggaggcggtggatgacagcggtggggatctccatcggcggngaggagcgggcaggagtgtgctgggaattcagatctctccaggtccccctggc

SEQ ID NO: 22171 - DNA, 3699 bp, Zea mays
  misc_feature (701)..(701): n is a, c, g, or t
  misc_feature (1142)..(1142): n is a, c, g, or t
  misc_feature (1824)..(1824): n is a, c, g, or t
tgccgaatatagtgatcaagggcgatactttgaccaagaacgcttgaaattatgcgaatcccgtctgtatctaaacttttaagaactatataatcaagtcctcctttcatccatgttgtcaaggatggtttctcaaccactgcataatctgttcatgcaaaataaatggcatcagctgatgttggtcttactctaaacctgcatctttacaaagagtcaaacagttcaattccagggggcatgtgctttgtcacagtggacgaaaagcagtaacaacttatttctgctaaacaaaaatgcacaaaacacacagtctaggcatgcaacaattctctttaagttgagttctatcacagttaacaaatagcatctttgaatataacagaagggagaaggcaactgtactgttttcggtccatgaaaatattattaaggaacacaaaaatggaggccagtaaaaagcagtaaacaggacgcagtttagcagtgagcataccatcttttctcatctctggaagccatcctgaagcatgcttcctaattatatcaagatagtactcggcttcatgatcagcaatgttgaaaagcacagcagaaccatactggaaaacaaccacatagcgatagcaaaatctgttatccttcactccaatgttctgcataaatatcaaccaaaatcacaaggaaatcaattcgtagcntaggtctatgtgcaactggttcaaagctgactgagatttgttcattttgatatgaatttcaggtcaaaaaagaagtgacgctaaactgtaataactaaccataatctcaggtgggaactcggagtaccgaagcgcaatgtagttaagcaaacgggtcgacggaggtacaatatcattcccgtgctccgcttgcatgctcttcagatcaatgctgtcacggcgaggaggaaaaattgaaaacacgtcgttttagttcgcagtgccaattggcatggacatttttagaatagtaaggtagcacccgaatgtttcctcgatggtaaatcatcaaacacctatcgagcaagcgcgggagcggcgctccgtgcttacctggtggagaggaagtaggctttgacggggatgtagcgtgctgggccctcgtcctcctcctcctggggncggcgaaggagccggggccgactcggtcgccgcgcgaatccaggcccagtacgccgaaccgccgaggcccgagtcgcgtgtgtcgtggggcgcaacggccgcggcccgacgagagaagcctcgagaaaggcgctacgtgagcggtagcggtgttggacccgcgggcccgagaattgtccccggtgatggcacttgtgccggcggcggcgcgaggaagcggtggagacggcagcacgcgcgaagccgccccatcaggctggcgagttgcagccacaaagctggcaagctccgcgaccccaccgtaccactcctggacttggagaggaagcatatgacggaacccaattctcagtgaaggcccgcacccgcacgaacgggagctgacgggccatttcgtatcatgagttgggccgcggcctcggataggatgataatgaactctaaattttacactataaaattttaaatcaaaataaattataattgagttttatttttatttattttaaaatcaaaattagttaaagatcctaagttattttgaaaaatatttagatcgtgatttattaccacctctaactttggacggactagatcgaaattcgtagaggtgataatattttgtgacgcaaaactcaaatctgcctccaaaattatcgatctaactttttcttattgtggntagtttgactacctcaggtttttcaaaggatttctatttttctaaagaaaattagtttatttttttttggaaaaatggaaatcttttgcgaaaataaagtgtcaaactaacccttaaaatataaaactaaacgactattttatcttctaataaaatcttcaaactattaaaattgggaacatataagccaatttattggtgcaaaccatgtaaatcaacacaaaaatagagacaagaagactttttaaacatatcgcatttcaaatcatctcttctaactctcttgaatatttttaaaatgattctctcacatctattcttgcgttggtttacacggtttgaactaataagttggtcttgttaaatacgttacaaggttttaaaataataaaaaaaatctaagtttttaatttttttaataaaaaccttaaaatagattgggatactaattttctaaataatatcataaaacaatcacaataatttaaaagggaacggatcaggtgaaaaccgtgcaaaccaacacgttgatataggtgggaaggtgtatttaaaaatatatcaaaggaggtggaagtgactttttaaaaggtaatatacggtgggagagttgttttataaaattatcatgactccatgcaaggtttgcaccaagtacttggtttgcacctgatttattccaatttaaaaaaactatatttatttctgagaatagaaaagtattaacaaatataattatcagtatctcgtatttagggtacccagcactactacctcaaggcaaactaatgcacggttaactctaaactatgtgctaagaaattaagtaggccagccatgtgtcgccgtgtgtactaaatgggtgcgcgcttaggggctaccactatgggtccggacccccgcaaacaccgctaaagtccacctagggcgggcttggcctagcacgtgtaaacgctcgaacctcaagcgttgaaactcggacccaaaaaggtgtgagtctaggcttactctataagtgcgcccttgtcccgcacgctctacgcaagcaggggtcaggagtcgtcacgtagccctagagcacgtagcacaacccttcatctagaagtaaactctccacctacagtcatattgcccgcatttattgcagggtgccggaagcgtgctctctaggtcgcggagcgtgacaggttgtacagaccaacaagactgtctcatgtgtttccaaggcacacaacagcatgactacgacacacgtatttaatgtatgttcaagataacgcgagtcatcgaggtgtttatctcgggcgtgtgagcaacaccatcatgaggcatcgctcggccacccgatacgcctgctgctgcgcaggccgggtgtgacaatacaaagatatcacattagtacatacgtacgtcggcacaccctgtccctgcaacgttagcatgctggatggtttccaaagcagacataggacaatggacaaggagaacatacttgatcgtggagtcggcacgatagtcgggagggaagatctcagcccgctgttgtacttatagctttgggcagtatgtgtttaagacaagcacgctgggcccacttgtcagggtctagctcccttgtgcatgctccccttagactagagagcacataagatgtagggggacagaacccaactcaaacactcaaacctatgacactcaacctcaaaagcaatctaactcacagtggatgtagggtattatactctggtggcctgaaccattctaaaacgttgtgttcttgtgttcatccattcgatcaggcaaactctaggctctctccacatcttaggatcaggacgggtgcattccgccacccgaccaggggatctcctctcc

SEQ ID NO: 22172 - DNA, 1273 bp, Zea mays
cctttatcttttacatttatattgcgtaccttggttatgagatttaacttcctaacttagttggcagattcagaatctactttgcataactctttacgatatagatagcaaaatactgtcaaaaatataattatacacagatagtttatttattgcatagattttgactagaagaaatatctaattcactctcactcataggcatcaagtgtactacacatacttacagtatgcatggttaattaccacgcaaaatggaacgagcaattcagtatggttaaaccaaatggaaccttcccacgctaagtatttgtacaaattacaaagccatttgataaaaactttcatgatttttccatcaggtccagttgcagctgcctggcgtcagccttgcccccaaaaaaaaagagctgacagtcctatcaagatactaaaaagtggcaccaagaacatgtatcaagaacacctggcatgaatattgaaaggaaaactagattctactcaaattggaaaacctggctgcccgggaactcattggacataggaaaattggccaaacttcttttcgtttggagttgtagaattaaaggatgtaaataaactcaagccagaacgccattcccaacttcctttcatctaaggttagaaatccaaagggtggagatggatagtcagaaaatatggaagctggggtcattcttttcctttttttgttaaaacagtggatctggagttagcataatgggatgatcgaggatgaatagaggtgttgttcagagctctcaatcgatcatggagtccttggcaatttcatataatgagatagcaatctcaataatcagcagtattatgacaccccattccagcagatcagaccgtctgttttggaggacctcttgaagaaagtgaatgttatgctccacaaatttcagtttgaagtcaaggcttccaaaacgctgattcagttcatattcctcccgaagatattctagaatttgtgcataatttgcatttttccaagcaatttctgacctgtcaaaaagaccaagtctgatgataacatccgcaagattagaattggccttacccacaagttgaaagagtttttttctttgcatggtaaagttaccggttttctccatgacacgattaatttcagtgaattcctcaaccatatcatcgacctgccgaatatagtgatcaagggcgatactttgaccaagaacgcttgaaattatgcctcgacccgattcggctcgagctcgagccgaat

SEQ ID NO: 22173 - DNA, 2434 bp, Zea mays
  misc_feature (1129)..(1129): n is a, c, g, or t
ctctttttatttttatttttctttcttttcctctgccctccagtcgatttggttttgtattatccatttcttttctctctaatataatatatatcggagcggcaagacttttgccccttcctttaaaaaaaatattctaccacatcgagtaatccaaacaattaaaaaaacatcgagtaattgctttcctagccaatgcatctaattgaaattcttttttgtggactattctacaaaggtcacggaagttatttttgacaagttattttaaccgcacgcgaacctacatgttcatttcatttgtgttgcttcaacactcaacaggggcgcgtcgcgtgtttagggtatagttgccactgcacttgctatatacgaacacgggcgaaatggcttcgcatgtcatgtggagtttgatcgatctctttttggtttgttgttgagcaaattagacgtatttattaaaaaaacgtttcctatacatgcatggagaaagcacggttgaaatgaaaacaaatctaacacatatatacgttcgacgagagagatcaaacaacaactttgtacacaagacgtacgatctcatgcatatcctgttgggagtgtttacatcgatcagtggtctcccgcagtctagctgtcgtcccgcgaagaaggaagaaggaacagcgcgtagaagccgccggcaacggtagaagctcccatgaagcagacggcagcggccccggcgggccacggcacgagcagggcgacggtcgtcctccaggagaaggccgccgtgagcaaggccgtcgtgagccagacgccggccttggcgcggcccctggccggcgagccgggcggagcgctctcgaaggcgcgcaggaagcggaggagcagtgcgaggctggcgtacgacgcgacgactgaggccgtcgcggctgcgtcgactccccatgacctgtggatcgcgagtatcgagctcgctgtgaggaggacgaaccctagagccgtggccatcggcatgcggtccaggaagaacgagagattatacgcacacgcacgtcgtcgttctgttcccgaatcccgatggagggagcacagcaggctgcatgcgcgtgcttgctacaatatataatgacaggaccgcagnagtaagcttagaacgcgttgttttcctttttttttaaaaaaaaaatctagtctagctagtattacttttgtcgaatcttctttatttagttgttgcattaaataaaatgtttgaagagggaatggagtgcccgaggtcgtcgtcgtcgcgttcccggcggtttggaacgtacgtaataacaacctggcgcgcacgtccttgcaggcctgcagctagaaggaaactcttgtggttcctgcatgcacgatgtttcccagttctatagcatggttatagatggctaagtggaccatactaaatagatcgtcactaagcacgacacgactcgtattattttggtatgacacgggcaaaatttatatagtaccagtgtcggctcgacaaaggtaactacttataccaaccggtggtatatagatgtgattgtgatgtgtgcatgtgattgtaaattataatctgttatgattttaaacataatgaatttactttataatgatatggatgttcaagttttaaaattatatatataatcttaaaaatcttctatattttttaaaatagtgtctggtcttgcacaagtattattagatgttagtgtcgtatagtgccgatacggcacgattagatactattatgtagtgtctgggccactggttagacactaatactgtgtcggcaagattactaatagtgtctaatagtaacgtacttaatagcgacagtgccagtgtcgtgccttgtctctataagcatggtaaacttctctgcgcttctgcccaagttcccctggggaaggcaatgcaagagcagcacaacagcgcgtacacatgcgaggcacatgtgctttgacaatctggaatcgatctctggaaagatggtgcatgccctggtttatcatgaagctctgacgacaggttcctttggtttgggtacccccgatcgagtcccgggagtttcagggccttcaaaactggtcaatgtttcgctgcaaattaaggatctaatggtggcgaaagatcgagtgaaaaaagagcctactagcatctcagaggtaataactctctgtgtggtgtgagcaaatatttcgtaatttaactgcatttcgtcgacaccgagacgattatagtgactccatcatcaatttcgaaaatttattcgcctagtttttaaaaacggttctatatatagggccggggtaggatttatatgcctgttgcattcttagggataagtgtgcttgtgatgtaagcatttacgttgtgccgtgtaataattagaaaaaggagagacttacatatgagttat

SEQ ID NO: 22174 - DNA, 957 bp, Zea mays
gcgggaaagcgcaccagaacaggcaacgcactactcgttcgtatctttaagcttgctgctgcagcgtaagaaaaagcagtctgcactcggtcggtcggtcgctctgttcagctagctgcatgctcggccaccatatctcctccagtacgttcgtcgttctccacgccgctatctggtctgcggtaagcagcagctagaggccgttgtgtaggctacacagaagatcatcgaggaggatgctggtgaagaagaacaacagcacggcgatggcggcgggcgtgctgccgctggcgtcgctgaaccacatcagcatcgtgtgccggtcggtggaggcgtcgctgcgcttctacgcggacgtgctcggcttcgtgcccatccgccgccccggctccttcgacttcgacggcgcctggctgttcaactacgggatcggcgtccacctactgcagtcggaggaccccggcagcctcccggagaataagggcgagatcaaccccaaggacaaccacatctccttccagtgcgagagcatggtggcggtggagcggcggctcaaggagatgggcatcccgtacgtgcagcgctgcgtggaggagggcggcatcaacgtggaccagatcttcttccacgacccggacgccttcatgatcgaggtctgcaactgcgacaacctccccgtcgtcccgctcgccgccgccgccgaccagcgcgcgcctgccgtcctcggggcctgcaagcgggccgcggcggcgtcggcgtcaagcagcagcagcagcaaagcagcgccggcggcgtgccttcttccgccgccccagcggcggccgcgcagcgcgtgccgtcggcggcgcaggcgcccatcgtccgcgtcgccgaggagtcgtcgtcgcacatctccgtgcgcgtgattcttcatgccaatggcgaggacggtcagtgtcgtgccggcctgccggatgc

SEQ ID NO: 22175 - DNA, 992 bp, Zea mays
atctttcattcgtgcctgaagcagcagccattgcccattgctaacgagagtggagtggtagagcagttcgagtttgcctttctctcttgcttgattggttgatcggtgactcgatccatcgtcggaggtacatatagttagcgaggaattctccggccggccaccggcgacgacgaccgcaagtgatccgtgaggatggtgaacacgacggcggctatggtgagcggcggcaagggcggcgtgctgccgctggcgtccctgaaccacatcagcatagtgtgcaagtcggtggaggagtcgctcgacttctacatgaacgtcctcgggttcacccccatccgccggcccggctccttcgacttcgacggcgcatggctgttcaactacgggatcggcatccacctgctgcagtcggagcgtcccgacagcttaccagcgaagaaggagatcaaccccaaggataaccacatctccttccagtgcgagagcatggtggcggtggagcggcggctcaaggagctgggcattccatacatccagcggtgcgtggaggagggcggcatctacgtggaccagatcttcttccacgaccccgacggcttcatgatcgagatctgcaactgcgacaacctcccggtcgtcccgctcgccgaccagaccttcgccatggccgcctgcaagagggtcgcctccgtcaagcagtagcaggtgcccatgccggtcgcacaagtagcgcaagcaacccctgctcccacggcggccgcggcttcgcagtgcattcccgcgccgaacccggccttgcagcgcgtcggcggcgaggaggcggcgcatatctcgtgcgcgtgagaggtgggaggccggggtagccaggccgcccaactggtggcgcgctccgtggagtcgtggtttttgtatattgtgatataacagtgtgcgtatgaataaagtgaggggagcagagtgtggtttcagctccaaaaaaaaaaaaaaaa

SEQ ID NO: 22176 - DNA, 1506 bp, Zea mays
atccgtagtacttatgttttggcgccgacgacggccggccaagaatttattcatttaatttcgtttgcaaccctgaagagtggccaggggaaccagttgtagtagtacactgcatgccaaatgcaggtgtaagctagtagtgaccggcatcgtagtcggttaatggctatagctagctagctagcttcatgtcatgtgcactacagaatggaatgatcccgatgaggatgacgtggatccacgtgtcttacgtggggagtcccagtatcgtctataaagtccgtcccatgcccaacaaacaccacctccatcccccgcgatcacgcactctgccagagaccaaactattcgtatcgtgcgtaggtgttgcttgctgttgcaacggaccatccatctagtgcttgcattgctgtcgcactcgctcagctatctccaccgctattggttgttgtttggttacccacgccctgctctctgataccagttgatagcagcagcagctagctataggttgtcagcaggatcgaccagatagatagcgcgcgcggatcggagttaacagcgctgcaggatggtgaagagcacgacgacgatgggggcggcgagctgcggcggcggcgtgctgccgctggcgtcgctgaaccacatcagcatcgtgtgccggtcggtggaggcgtcgctgcgcttctacacggatgtgctcggcttcgtccccatccgccgccccggctctttcgacttcggcggcgcctggctgttcaactacgggatcggcatccacctgctgcagtcggaggaccccggcagcctcccgccggagaagggagagatcaaccccaaggacaaccatatctccttccagtgcgagagcatggtggcggtggagcggcggctgaaggagatcggcatcccgtacgtgcagcgctgcgtggaggagggcggcatcaacgtggaccagatcttcttccacgaccccgacggcttcatgatcgagatctgcaactgcgacaacctccccgtcgtcccgctcgccggcgaccagcagcgcgcgccggccgcttgcaggcgggctccggcggcggtcaataccgtcaagcagcagcagcagggcagcgtggtgcctgcttcttccgctccggtcacgacggcggcggcgcagtgcatgccgtcggcggccacggcggcgcaagccatccgcgtcgccgaggagtcgtcgtcgcacatttcgtgcgcgtgattactagcttgttgacgacgacgccagcgcaaggattcggcgcggacggtgacgaagcaggcacgatggatcgacgagcgccgagtcacggccacaagaggcgtctctgtacatgcgcgtgcgtgcgtgcgtgggtgtaggtgctgtatgtgcagtgcactcaaactgcctagcttttttttagtaaagaataaacccatggtacggtgggagtgaagagactagtgcgtccactccatcaaaaaaaaaaaaaaaaaaaaaaaaaaaaa

SEQ ID NO: 22177 - DNA, 1836 bp, Zea mays
ctagagatccccctgaagcttctccagcttacacctgattccaaacaacaattgaactgtttttcctattgacatacatttatcacaatgtgtatactaatacatttgacggtcgatacagatttttttatttacaagatatacagggaaccctcccatgtctaacatgtatcagctttcagcaatcaaaattagtaatgacctgacgaaattatagcgcacaatttggaaagatattaaaaattgcaagtaagaatattcctcacagaatccaaatgttctcgccataagcaccggaatttaatttaattctacatcaataaagagcaacaaatagacaaatccacatcgaatgcaacgatgattcagaaaaaggaaatacgatatagagtacaacgagccaaggaagtcatcatatatattactcaatattgagatgggcacaagagaccagaagacaagattgaggactactccttgaacgacaatacagtttcaaaggcccccaccaaggccttcacccggctcttcctctccagcaggagcttgcttttggtttcctcaatcacgtcattgccctttggatcatccttcctccatacctgagccacttcagtcttcggcactgtcttatccacactccggtcagccttcttctcaacaatcccacattcatatatagtcttgacaccaccattgtcatcttgccctccattatgaatctcattagctcctgcatctactttctcttcagagaaatgaccctcggatttctcatcgtctttgagtacatgttctggttcattgaaagatggctcatgctgatcaggtacagtcatctccatggatttcagatcaactgggtcggggagctccttgtgcaagtgctcttctatagacgtggtggtgtttatgcactcagttcccttaatctgcattgatgggtccttatgtttctccttcctggctgaagatgcccccattgccttctgagaaacacttttagcctttgagttggtagtagcaccattaacagtatccaatctcttccttgcagctgcaccaggtgactgtgcggtagacagtggctgaactttgtctccttgagcagcacctggcaacatgaccctctgactgctaggtttcagtgatgctgccgctttgcaactgtcagaactaggccttggagatggcttactcctcggcaaggtggatggcgatgccttagctgccggcacagcaagcactggaggccgctgcaaggtggtgctgaccttgtcggatttctcctttgccagtgtaggttttgaggctgcagatgggaatggctgggccttggtgccctggatggaagagcccatggtccgtgatgagatggacctaccagcgttgaacaatgatgaatgatgcacgtctgtggagccagaggcagacacagacggcgacgatgagccaaatttgcggtgcgcggaactcggtacagaccgagcccgcctagcaccatatccgtgcccagaggactcactgctggacgacatgaggttgggtgacgtcctgcctctgctaggattggggggatccttcttggatgtcgccattgtttcacagttgcgcctggcttagatcagctggcgaggctggctgttggtggggcgatccgggagggagccggaggcggctaatccgggccagatgcggggctgacgaagagggggaggcgaggagggaaagtatccatggccaggctacattatatgcggcgatttggacggtagctgtgcggcccggcccgcgtcccgtgggtagagggccggagcacagcagagcggggacccg

SEQ ID NO: 22178 - DNA, 1137 bp, Zea mays
gccaggtgctggatcttgcgcttcagccacatggcgcgcacatcgccgccgagggagacgaaaatttcccggttgcccggcagcaggaagacgtcgggggcaactgacttctccacctgcgacagctccaccatgccgttcaggatctggacgcatctcgatatgctgtagccgtcctcgagcttggacatctgccagtgtcatggctcgagctcttgtagtgccccgtggcggaggagtcgtccatcgccctgtcgttgccgttcctctggttggaacagtgccacgagcggggcagcgcctgccactgggataccgcctgcgggaacacgtgcgcgtctctgctcgaggccctgagatggggtggggtctggtggaaagaagactccttcgacatgggtgactgcagacgaggcgagcgctccacaacgaagtcatgttcgccctcgctgtgatccaaatcagcaccagtgtacagatagcgcttactgtcatcagcaattatgccgtcatttttcccgaaagggttctggcaatcgtcacaacggcaaaacaaggaacatccggtcccatcctggtagcaatcacagtatttcttcaggcaacttgatttcttgcagttgcaacctctccttggtggagttgaagaagaagaatggtgagcatcttccattggttcagcatttgcctcaggtctcctattaattttcatcgacatgcgcttctgtcttgaaagtaacaccttgcgagtagtctgaactgtttctgaaaaggcttctttgttgaaacatggttggcagccacacttatcggaacaataaccacctccagcaaaacatgggcaatagagcttcaagcatctggacttcttgcaggcgcaatgcttgcacccgttgccatccgcagcctcctccaccctctgccgcttggggtccggcgctattgcgagctggttcatgctggatcgctccagctcggtcagtccgacggcatgcgttgacaattctatgggctccagagtgaccgggggtggcgccggtggcttcatggagatcggggtggcctccatgggagcgagcacgaagaggtgtgcgctgagacacgggcccgtatccccccccgcctcgaggtccccat

SEQ ID NO: 22179 - DNA, 1432 bp, Zea mays
  misc_feature (1411)..(1411): n is a, c, g, or t
ttttttttttttatttggaaacaatgtataatctcattttattatagccgataccaggctcgaaaacggctctctctacaaagacaatacataaccgtaatccagaaatacacctcagtatacagggcgaaaaaagaacctagaatcctgtgcacgcccaccccacgaccagaagaacatgcacaatctaaaagattgtactccactcggaagaacggcacagcacaaggaaaatttaagccaggtgctgaatcttgcgcttcagccacatggcgcgcacgtcgccgctgagggagacgaaaatttcccggttgcccggctgcaggaagacgtcgggggcaaccgatttctccacctgcgacagctccgccatgccgttcaggatctggacgcatttcgatatgctgtagctgtcctcgtgcttgggtacctgccagtagtcatggttcgagttcttgtagttcgcggagtcgtccatggctcggtcgctgctgttcctcttgttggaacagtgccacgagcggggcagcgcctgccactgggatatcgcgtgtgggaaaacgtgcgcgtctctgcttgacgccctgagatgaggtggggtttggtggaaggaagactccttcgagataggtgattgcagacgaggcgagcgctccacaacgaagtcatgttcgccctcgctgtgatccaaatcagcaccagtgtataaataccgcttactgtcgtcagccattatgccttcatttttcccaaaagggttctggcaatcgtcacagcggcaaaacaaggaacatccagtcccatcctggtagcaatcacagtatttctttaggcaacttgacttcttgcagttgcaacctctctttggtggagttgaagaagaagaatggtgagcatcttccattggttcggtattcgcctcaggtctcctattgattttcattgacatacgcttctgtctcgaaagtaacaccttgcgagtagtatgaactgtttctgcaaaagcttctttgttgaaacatggttggcagccacacttatcagagcaataaccacctccagaaaaacatgggcaatagagcttcaagcatctggactttttgcaggcgcaatgcttgcacccgttgccgtccgcagcctcctccaccctcggccgtttggggtccggagctattgcgagctggttcatactggacggctccagctcggtccctccgaaggcatgcgttggcaagtccccgggctccagagtggctgggggtggcgccgccggcgccggagacggtggcttcatggagatcggggtggcctccatgggatgggactatgggagtacgaggggtgcgctcacgcaacgggtccgtgtcgctgcccggccgcccccccccgcctttattagattgtagatggngccccccggcaggcctcgagg

SEQ ID NO: 22180 - DNA, 4063 bp, Zea mays
  misc_feature (21)..(32): n is a, c, g, or t
attgggacctcgagccggccnnnnnnnnnnnnaaaaaaaaaaaaaaaaaaaaaaaaaaaaccaccaggtggaagaataaacttcagagtaaagaatatgagatatccaagtctattttcaggctttcaactggtcttgcctctccagcctggccagagcctgatgtggtcaggaaaagtatttttggcgaaacagggtccgactttgaaacttttgtcctagcctactgggaaaagttgcctaatttgtacaggaggaaacaagccactaaaatggatagtcttgtgttcgtcacactgcataatgattttaatcttgggacaacacctgattctatcattgaatcattattacagggtcttgtttcttgccccgctatcgcttctgatgagcttgacatagattcatttctccatgaggttcatgattcattgggcgactctgtaaggtacaggcaagacattagagtcatgagaacacgagatccagatgaccaaacctcaaggggatgtgtgacagaggagcattttttcgatgatggaacgatcttcacggatgaagatgcattcatcgaaaaatgtaagcacgccttcaagaacggtaattcgatcgccttgcgtggcatggagtttcggtctgagaaggttgctgctatagcttctgcactggctggtttatttgggcagccttctgtaggagccaacatatacttctcgcccgccaggatctcaaggcctggcccgacactacgacgatcactgtgtacttgtttggcagctactcggtagcaagagatggacggtttggcctaatccgaagccactgttgcctagactgtatgaacctttcgaccctttagatggcactctagatgagagcagtgggagaggggaggtcttacatgaaggggacatgatgtacgtccccagaggttatgttcatgaggctcgcactgatgtcagtggatcagaggtgaacgattgctcactccatttgacccttgctattgaggtcgaggcaccctttgagtaagtattctctgtatcgaagtggagttcttgctgtgcatgtctggagcttctgcttgtaaacattaccgctcctgcgggtgggaaggttttgctcatatcgcccttcattgctgggcagagaagcagcagcttagaggttcccaatctgtcgagttcgaggggaaagcaggagcttccttatccgctattgtgcttcatgtagccatcaggttgctctccgacagtgagcctgttttcaggaaggcgtgcatggtcgcagcaaaggcagtcgacgtcgtccagttcctgtacatccacaacgactcacctggaggctcttcgaagcagccagaggtcaactttcgacgagatactgaggaagatcgaccagagctgcagcatcaaggaagcgctggagcgcatcgtgtcggcggtgagagagagagacgacggagccttccagtggatgagctggctccggcacctgccgcagcaaggaaccgctgcaggctacatcatcgacttctgcaatgtcttgggcgccctcgaggcgctcgtggaggcgttcgactctgaccctggccaggccctggatggcctcacggccttcaagtcagggttttgccggcgcgtcgcgtacgaggacgcgtgcgaggccttcgggactttgctcgagatgtacagggtggctaggacccagtacatgagggggatgctggcgttgcacggtgcaggtgcacacgtgagctgaggctgagccgtggagaatttgccgtgacagagaaaggttttgcttttctggtggtggttgggtggctaggctagtcttttctcctagcgaggaaaacctgacctgtgagtgctggacacttgtacgatcgtgccatgtatcgttcgatggctgcttttgactgctggtaagattatccaatggcatcgatctgtgacttgttccgttgttcgacaatcagttttcaattcagcagcactctggcttggccctttccagctctggacggttcttgcgtctttcatgagcatttgccagtaaagaagtcgctggtcagtaaagaattgccagtagtggtactggcttgagatctcatccctgctgaagtctccacttgtatattgtatacagaattgcagcaaaacaattggccgtctgcgtctccagcacctgcgcagcgaagtagatgacgtttcttggccgctaatgtcgcctccaatcatttttgcattacaaaatggtggtcaattaatcctacgcagaacaaaggcaacgaggaggccgctgattgccgcgctcggcgttccaagcgcaggaggtggctggccagtgtgcccaaggcgcgtcatgcctgccgcctttgcccgcctctgatgctcgcaaagggccagcattctctcgtccactcaacgacagcgagccctatcccctcagcaaaagccagatgcctgttgccgtcgcggccactggatgccaagtactttttatatacgccgtccgcgcccacgacccccgagacccgcctcccctcgtcgtctcgtctcgcctcgcgtcgtctgcgctcgcggctcgtcacaggtgaggtgagtgagtccgccgggagcgagcaagagcaatgctcggtgccgcactactctgtctgcattctctggcctcccgcgtgccggcgtgcgtggtttcggcctttcgggcgctgctggttgtggttgacgcgccggttgctttgctgaaggtctcggcgggagaggggcggcggccggtccgtgtccgtgtccgtcgacggttggttcgggaatggcgcaggcggtggtgccggcgatgcagtgccgggtcggagtgaaggcggcggcggggagggtgtggagcgccggcaggactaggaccggccgcggcggcgcctcgccggggttcaaggtcatggccgtcagcacgggcagcaccggggtggtgccgcgcctcgagcagctgctcaacatggacaccacgccctacaccgacaaggtcatcgccgagtacatctggtacgtgcctagtaccgtagtacgtagcgcagagaattcttccttttttttccttttcctcccgcacgcacgcacaccacctgaggaacagggagtactaggccaagacaacaaggccacagagaattgcgacttggttgcatagttcagtgagtgggatgccactaaaacttgtttaagtttttatttagtctaaaaggccatcacttctgaatctttgtgggtgctgattcgtctctgctttcaagttcttgctccccacttagatgacactgcgtgcaccaggtacttttatgagtaaactgaaatatatatacacacacacactaagatgaggatcacaacaacattgtgtagggtcggaggatctggaatcgacatccgaagcaaatcaagggtgaggattccacgtcaccaccaccaccatcatctgcgtttaatttttggacaattgggcagttccgaggtctttggggaacgaatcaatgagcacagggcactcttttcctatctgcatgtcgcttttgcttgacggtattcaaaataaatcttaatgcctgcttttttcagacgatttcgaaacccgtggaggatccctcggaactaccaaaatggaactacgatggatctagcacaggacaagccccgggagaagacagtgaagtcattctatagtaagatcttgattacaatatactactatacatgtgtgttcttttttatatgcaagcattttactgttgcatttctgacgtttctctttctgtttccagcccccaggctatcttcaaggacccattccgaggtggcaacaacgttttggtacttcccatcgcaaccgaatcagcccttttgtgccattccgcataagctcgaataaaaaggctaaaagaatagttactagttagaatgttactgccttttcaaatagtccttcaggcttggaatatatattttgatcctttgtaattgtcgcatatcactgttggattgaacaccacatgtcacctgaatgcattggc

SEQ ID NO: 22181 - DNA, 1718 bp, Zea mays
actggatgccaagtactttttatatacgccgtccgcgcccacaacccccgagacccgcctcccctcgtcgtctgcgctcgcggctcgtcacaggtgaggtctcggcgggagagcggcggcggccggtccgtgtccgtcgacggttagttcgggaatggcgcaggcggtggtgccggcgatgcagtgccgggtcggagtgaaggcggcggcggggagggtgtggagcgccggcaggactaggaccggccgcggcggcgcctcgccggggttcaaggtcatggccgtcagcacgggcagcaccggggtggtgccgcgcctcgagcagctgctcaacatggacaccacgccctacaccgacaaggtcatcgccgagtacatctgggtcggaggatctggaatcgacatcagaagcaaatcaaggacgatttcgaaacccgtggaggatccctcagaactaccaaaatggaactacgatggatctagcacaggacaagccccgggagaagacagtgaagtcattctatacccccaggctatcttcaaggacccattccgaggtggcaacaacgttttggttatctgtgacacctacacgccacagggggaaccccttccaactaacaaacgccacagggctgcgcagattttcagcgacccaaaggtcgctgaacaagtgccatggtttggcatagagcaagagtacactttgctccagaaagatgtaaattggcctcttggttggcctgttggaggcttccctggtccccagggtccatactactgtgccgtaggagccgacaaatcatttggccgtgacatatcagatgctcactacaaggcatgcctctacgctggaatcaacattagtggaacaaacggggaggtcatgcctggtcagtgggagtaccaagttggacctagtgttggtattgaagcaggagatcacatatggatttcgagatacattctcgagagaatcacagagcaagctggggttgtccttacccttgatccaaaaccaattcagggtgactggaacggagctggctgccacacaaattacagcacaaagactatgcgcgaagacggcgggtttgaagagatcaagagagcaatcctgaacctttctctgcgccatgatctgcatattagtgcatacggagaaggaaatgaaagaagactgactgggaaacatgagactgcgagcatcggaacgttctcatggggtgtggcaaaccgcggctgctctatccgtgtggggcgagataccgaggcaaaagggaaaggttacctggaagaccgtcggccggcatcaaacatggacccgtacactgtgacggggctactggccgagaccacgatcctctggcagccatccctcgaggcggaggctcttgccgccaagaagctggcgctgaaggtgtgaagcagctgaaggatggttcaggcaccaataaaccggtccgcgacaagattgatctttgtgtccatggcgtgggtcttgcgactctctgctcggcggtgccactctgtacaaaatcacggctgtctttggttcatcggatattcggatacggttgttcgtttgtttgttactttttgcttggacacccaccatgtttggaacttttttgggctccgtttgggggctgaacgatggtcagtggaaattttaaaaattcgtcgtctaaaaaaaaaaaaaaaagtgaagagaaaaa

SEQ ID NO: 22182 - DNA, 1061 bp, Zea mays
gcttgcatgcctgcaggcgggcagcagggcatgccattccagcgacatcacttgccatgcactctgacaccatctgacaccgagagcactgcctgagtgcctccccctgggccctgggctagtgggcttgtcttccaacggatacttgcccaaagctgcatgccactacgtggagggcctggctggtggctgcccccaaggctccaccactcccgctctctcccgagtcctactcctgagaggacctctggctctctggctctatattggcccccccgccgccggccccgcccaccaagtaccaactgcccgagacaagaacaactccaattcccatctctcactacggcaacactttgcgagctgagccatcaaagctcggggcggatggcggggcggcggcagatcaagaaggagtgggtgcaggcggcggcggacgcggcgtcgtggtgcgtggcgctgtcgctggtggcgatgctggtggtgctgtgcacgctgggcgccggggaaggcggcggcgccggcgcgccggtggtggtggtgcgcggcgcggcgctgtcggcgcggccgtgcgaggagatctacgtggtggcggagggcgagacgctgcacagcatcagcgacaagtgcggcgaccctctcatcctggagcggaacccgcacgtgcacgaccccgacgacgtcttccccggcctcgtcatccggatcacgccgtccaagcccaggtagatcgatggcgatccatcggtcgtcgtgaaccaaacagaatgccgttgctgacttgctgtggtgtcgtcaagccccctctgcatgcatgccgcgtacgtactacggtgtgcagactgcactgcagagggagcgtagcgatgcaagaggacgccatgtacttactgttaagtatgcgtgaacagcgtgtagcaagaagctctggacgaggcctccagcctcctgtgtgtaaattgtaagggacgccgcgctagtgcttcaagtgaatgaagagataaaattgttggcttatttttttaaaaaaaggcccctagggccgaaaaaaaaaaaaaaaa

SEQ ID NO: 22183 - DNA, 798 bp, Zea mays
  misc_feature (8)..(8): n is a, c, g, or t
  misc_feature (14)..(14): n is a, c, g, or t
  misc_feature (25)..(25): n is a, c, g, or t
gtaccctncgcggnctcggccgggnaaaaaaaaaaaaaaaaaaaaaaaaaaaaaaaaggcccgagacaagaacaactccaactcccatctctctctctcactacggcaacactttgcgagctgagccatcaaagctcggggcggatggcggggcggcggcagatcaagaaggagtgggtgcaggcggcggcggacgcggcgtcgtggtgcgtggcgctgtcgctggtggcgatgctggtggtgctgtgcacgctgggcgccggggaaggcggcggcgccggcgcgccggtggtggtggtgcgcggcgcggcgctgtcggcgcggccgtgcgaggagatctacgtggtggcggagggcgagacgctgcacagcatcagcgacaagtgcggcgaccctctcatcctggagcggaacccgcacgtgcacgaccccgacgacgtcttccccggcctcgtcatccggatcacgccgtccaagcccaggtagatgtagatcgatggtgatccatcggtcgtcgtgaaccgaacagaatgccgttgctgacttgctgtggtgtcgtcaagccccctctgcatgatgccgcgtacgtactaatacggtgtgcagactgcactgcagagggagcgtagcgatgcaagaggacgccatgtactgttaagtatgcgtgaacagcgtgtagcaagaagctctggacgaggcctccagcctcctgtgtgtaaattgtaagggacgccgcgctagtgcttcaagtgaatgaagagataaaattgtggcaaaaaaaaaaaaaaaaaagcggcc

SEQ ID NO: 22184 - DNA, 2682 bp, Zea mays
cattggttgtgctaatcaatcagatcctgatttcactttgagcaattaaaatttcccaatccatggtagccaaacctctggtccagggcacactatatatgcgcgctagcttgcccaggactgtagagacagaagcaggtagtttgtttcctctaggctagagtcctctagctactctctatggccatgtcgatcccgtcaatggttatggcaatggcaatggtccttgcggtagcgtctacggcgcactacgggcatcaggcgctggccgatgctcctgccgccgctccgagccctcgtcaccaccaccatggtcatcgcgccccggcggcgcagccatcgggttctcatcattctcatggccacgatggtgcaccggcggcaggtcatcgtggtcaccacggccaccatgcaccagcaccggcgccaagccatcacggtcatcacggccatcatcacgcaccagcatcggcgccaggtcctcatggccaccacggtcaccaccacgcaccaggtcctcacggtcaccgtgccccagcaccggtacataacgaccaccaatcggctcaggctccgaaactgcatcatcatcaccgtcacgctgcagcgcccgcccctgttcagagctcctactagtctagatggcagatggtcaaaacatgcgcatgtgtggcaataataagaagacgatatttacgttttggttgtatttttgtactcttggctatgcctctgcgttgttcatggtaatctctcggctaatcagccggaatcgagttacagtttttctgcttacagttgcacctcatccgcttactctcttaaccttaaaaaaaaatgtacatctcgcttctagataaattaaatcttttcccccctaaaattcttaatcacggttgtgcagctagtcagctagagagtacttcgtcggcacacacaaaacaacctctcatcccccagcgagtacgggagaagaaaaccttcctcttcataaaattcctcacatcagcggatcagcctgtgtgctagtattatcaatttttgaaagctattatttacatatccactacttaaagtaaacatttggttataccgatacgtttcttataataaatcctttaaaatgagacctcacttcgatatatttgttaaaaaaatctcatgtttttttgagcataacaatgttgtcctaggctcaggaaatagtgttccaggctcatcgtctgctaactctgcttgaaacagacaagtgtagcgtgcgtgtagcatagctgcacaggagtgaaaccaatcccgttaggcatgattgcttgaaggtttcagtgaccgctcttggtagcttttccccgattggcatccttctttccccaagtttagacatcaacattgcccattcaagttaacagttggtaagctatagagtttgcataattacatgtggagtgtgaaattccagtacgtactgcaaaaggtgactctgcagcatcacacacagattcttatcacaaggttctggagctatactaccaactcaaatttacatgcgaaaaaaaaagcaacaccacatagaaacaggcattgaagcctcgaccagaagacggtcatggcgtcatgctcctgcgtcgtcgctgccacggtacgacgactgccgctgctcaagctcgtggagactcatcacatggttctcgagcaggcttctgcgaatctatggcacagcaagcacacaacgcattgaattggggaatgagagatctcttgtcatgtgcgtgccaaaacgaaaaaaaggcgtatctcaatgtacacatagtcacatgatgagaatttttagaagctatttccaataaatgtggtgataaaatttaggggttcattatgagatcatactgcttttgaaagttaaaaaaaaaacaccacgttttattattatggagccttaaggagggacaagttgtaagtactagataccaaaatgtaacgggagattaaaccatcaaagcaaactcaaaggtatgtatgtgtacctccagcattgtgctctctaccatatcatgtagtttcttctgaaactctacttgcacctgtaatgcatagtcttggatgtgtctgccaaacaaaattcaaattttcatttacaaagggcaaagcttcaaacaattatttggtcttcgagatgcacgagagttcagaataaaattcagtcaactgcatacgcatgtgattttctttagttacggaaccagccatccttcatcatttactagcaaagtacccgcatgttgatacggtttccatttatacttgattataaagtataaaacataaagacatgtgtgctctgttggctagatgagtgtgaatgtgaatttagagcaaacaaccatggtttaaatctatatttgtacataattttagttatttagaatataaaacccaaagagatgtgtattttgttgactagttggatgtgaatgtgagtttagagataacaatcatggttcaaatctacatttgcacacaattttagctttttactgattaaatgtttaaacgtggatcccaccgagttagatggacgccaggttgattacaaagaaatataagggactttttgtaaaagtgacgatggtggcactgtaaaaccaaaaaaattgatgctttaatatagcagtgaaaagtttatgc

SEQ ID NO: 22185 - DNA, 3362 bp, Zea mays
  misc_feature (3344)..(3344): n is a, c, g, or t
  misc_feature (3346)..(3346): n is a, c, g, or t
cccgccttctctctccctccgaatccaaacgcggacgcaaatgttgctccacgccggtccctcgttcctgctcgcaccacctccgcgctttgccgccgctccgtcgtcagcttcgccgaggcgatccaggacaccgcaatcctcgccgccgacgtcgcatttcgcgcgccccgctgatcccgtggcccaaagggtgcgtcccgtcgcgccgaggccccccatggcgacggcggaggagggcgccagctctgacgtcggcgtcgccgtcgccgagtccgcacaggggttcttgttggatgcgagggcttactgggtgacaaaatccttgattgcatggaatatcagtgatcagaaaacttctctcttcttatatgcaagcagaaatgctacaatgtgcatgtcgagtcaggatatgaaaggttatgattccaaagttgagctgcaaccagaaaatgatggacttccatccagtgtgacccagaaattcccttttatcagctcttatagagccttcagaattccgagctccgttgatgttgccaccttggtgaaatgtcaacttgctgttgcttcatttgatgctcatgggaacaggcaagatgttactgggttgcaactacctggagtattggatgacatgttcgcctacactggaccgcttggtactatttttagtgaagaagctgtgagtatgtacctatgggctcctacagcacaggatgtaagtgtgagcttctatgatggtccagctggccctttactggaaacagttcaactcaacgagttaaatggtgtttggagtgttactggtccaaggaactgggagaaccggtattatctatatgaagtcacagtatatcatcaaactacaggaaacattgagaaatgtttagccgctgatccttatgctagagggctttctgcaaatagcacacgaacttggttggttgatattaataatgaaacattaaagccacttgcctgggatggattggcggctgaaaagccaaggcttgattccttctctgacataagcatatatgaattgcacattcgtgatttcagtgcccatgatagcacagtggactgtcctttccgaggaggtttctgtgcatttacatttcaggattctgtaggcatagaacacctaaagaaactatctgatgccggtttgactcatgtccatttgttgccaagctttcaatttggtggtgttgatgacataaagagcaattggaaatgtgttgatgagattgaactgtcaaaactccctccagggtcagatttgcaacaagctgcaattgtggctattcaggaagaggacccttataattgggggtataaccctgtggtttggggcgttccaaaaggaagctatgcaagtaacccagatggtccaagtcgtatcattgagtaccggctgatggtgcaggccttgaatcgcttaggtcttcgagttgtcatggatgttgtatacaatcatctatactcaagtggcccttttgccatcacttccgtgcttgacaagattgtacctggatactacctcagaagggactctaatggtcagactgagaacagcgcggctgtgaacaatacagcaagtgagcatttcatggttgatagattaatcgtggacgaccttctgaattgggcagtaaattacaaagttgacgggttcagatttgatctaatgggacatatcatgaaaaagacaatgattagagcaaaatcggctcttcaaagccttacaattgatgaacatggagtagatggttcaaagatatacttgtatggtgaaggatggaacttcggtgaagttgcggaaaatcaacgtgggataaatggatcccagctaaatatgagtggcactgggattggtagtttcaacgatagaatccgtgatgctataaatggtggcagtccgtttgggaatccactgcaacaaggtttctctactggattgttcttagagccaaatggattttatcagggcaatgaaacagagacaaggctcacgcttgctacatacgctgaccatatacagattggattagctggcaatctgaaggactatgtagttatatctcatactggagaagctagaaaaggatctgaaattcgcaccttcgatggctcaccagttggctatgcttcatcccctatagaaacaataaactacgcctctgctcatgacaatgaaacactatttgatattattagtctaaagactccgatggacctctcaattgacgagcgatgcaggataaatcatttgtccacaagcatgattgcattatcccagggaataccattttttcatgctggtgatgagatactacgatctaagtcgcttgatcgagattcatatgactctggtgattggtttaacaagattgattttacctatgaaacaaacaattggggtgttgggcttccaccaagagaaaagaacgaagggagctggcctttgatgaagccaagattggagaacccgtcgttcaaacctgcaaaacatgacattattgctgccttagacaaatttattgatatcctcaagatcagatactcatcacctctctttcgcctaactacagcaagtgatattgtgcaaagggttcactttcacaacacagggccctccttggttccaggagttattgtcatgagcatcgaagatgcacgaaatgataggcatgatatggcccagatagatgaaacattctcttgtgtcgttacagtcttcaatgtatgtccgtacgaagtgtctatagaaatccctgatcttgcatcactgcggcttcagttgcatccagtgcaggtgaattcatcggatgcgttagccaggcagtctgcgtacgaccccgccacaggtcgattcaccgtgccgaaaaggacagcagcagtgttcgtggaacccaggtgctgatggatgcctttcgctagcgagcaagtgcattcggcatccaagtcgaagcaaacgaatgaaataagagaaggccatcgaataaaacgaagtatataaatagattgaataagacgttgcccaagttgccaaggcacgctttgccatatgtatgcgttgaaaaataaataaataaataaataaataaataaataaataaatgatgttatagaggtacaaaagcattggaacatttctttatagaggtgaaccaccctattttccagtttccatgtgtgaattgtgattagcatatgtatggaataataatataaattaattttatgcatttgtgtgttgtgtcgtggatgacaacatcaacatattgcttctacttgatctctctataattttttttgaagaaatacctagtctagangnatatcgtaattcccta

SEQ ID NO: 22186 - DNA, 1436 bp, Zea mays
tcgatagtcggggtacacgataagtccatgtaacaagcgcagcagacgcattatgactcgaaaaagccacatggacagcacctaattcaggtgtgttgcggccaaagatagaagcacagcaggctaactaccctagcaagtttaagagctgcaaaagatctagttctaaacctggcaaccaacgaaactaataaccagccaactcatcaacaacaataagacagcaatatccaatcccaaagacactagcaaaccaccagaactggggcatcacagaacagacatccagcttctcttcccacaaagccttttcaactcttcattagtcttcatgagtcggctcatcctcctcatcattttcttcatggcctccatcttgagtaaccaccttgacattggctgcgcaaaccgaacagcttagcgcccctcctgaataaggtcctgcaactctttcttgcttagacttgcccaataagacatcaacgcacacacatggcagattatgtcatgaggagattttatcaaaatagtatcaaagcacgctttgtcacggagagattttccaaattcatgtcatccatgttacaaccaaccggtaagttccagctcccgttttcctggttttaaaagttcagaaacacaagtgataggttctgactctcatcccataccctacagcctttataaaaagtcgcagatgttacaaagagaacatttgatttctaagaaaacgcgcatctgccaatacagatgagactgcagaaacctggccaaacagttctacttcttctcctcatcgttcgccgcctcctcttcctcttcctcctcgattgcgtactcttcgtcgtcggagtcgtcggagtcttcgtcatcggagtcaatttcaatatcgtagtcgcccttcgtgtgaccatggctgaaacttctcagctcgtccctcccgccatccgcgttcaagaactccaacccgtataccgtgtctctgtgcttcacgaccagccagcgaagcagcctgtcctccttgttcagatagtggagttcttgcgggaacgaagggggaaccatcatggtcatttgcataagatggccctggaagtggcggccgtcgagcttcctgatgccgtaggcgaggctgaccttgccgaatgacttgacgtcggtgacgaccccgttgcgctggcatgcgcggcgcgccacccgcgtcaccagttccgctaggacctccctggtcaccgtcgtcttcagcagcagcatgcagtcgtacagcggcatctcgcttcgcgtcgccttgtcgggaaggggaggaggttgggttgggggggaccgaagcgttctccctcctcccgctctgccgccgccggctgagctcgtgtcgtgcctgtgtccgacgatcccgaactggtgggggaacggacgggagtgttgcttggggtttt

SEQ ID NO: 22187 - DNA, 901 bp, Zea mays
ttttttttttttttttgtggattcggttcaaacacaaatgatctacaaacacatcatggatcaaataatttacaccaggcacaatttcctgttacgctgggcgctcaaatttattgaccacaaacataacaccactcatccccgtcttgccatctcctttattggcaccgaaagaaaagatggcaattattactaaacaagacggtgtcagccttaacacagaaaccgcacggatacagattgttcaaggactaagcatgctaaacataagatcgttacagttatagacatctaattcaagtgtatatataggctacatcaagtcccggtcccccctcgtcaagtctgcatcctcctgtcctcacatctcaatgtgatgagaatggctctggacgtctccttggttgtccaggggcatgtactgagccatgatggcacggatctcggagtccatgtacctccggatcctgtacttgtacactgcatatcctgcaattcctgctgcaacaaggccaaagaagatgacccacaagaagccccagcctgcttctgatgctccacttttgctgatgcatgtatcatgctccttcatgtaaagcaagcctccactgcagccacactcatagcttccccatgtgtttttgcatttgcattctttgcattgacacgcagtcctttccttacactcatcaatatcttcacatttgtgcctaccgtcacccttgaatccatctgggcatttgcagccatcatcattacaggcagagtatgtccgaccattcttggtatctttccagcatcctccattgttaatttcacatcgcccagatccgggagcttcacaatgactatagccatcaccaacaaattttactcctttcacaattggacactcgcaaac

SEQ ID NO: 22188 - DNA, 538 bp, Zea mays
  misc_feature (529)..(529): n is a, c, g, or t
ctctcagttttggtcagttagcctttccccactccttgcttacttcactagcctcgaatctgcagtctggttcagcttgtaaggaagtgtttcttcctcactatagcgaggaagcgaggaacaggggaacaacaaggacatggacgctttcagtgcagtgatggacaaggtgaagggccacccagaagcgatggagaaggtcagcgctgtgatggacaaggtgaagagccacccggaagtggtggacaaggtcaagtacgaggtgatgagcctcgctggcgctctccgtctgcggagacatggatccgaagataaagaagctgagtccgaagagaaggcagaaggagcgcagagcgccgacgagggtgcctctgatggcatggctgagaacctagtgtgttggagcaggccgtgcaagagattcaggctgtcgcccatcctctcctttctaatcaccgtgctgatcagcggcagacagctgaacccgaagctgaaattccagctgagaccgctgctgctgcttgctgcnaaaacttct

SEQ ID NO: 22189 - DNA, 2456 bp, Zea mays
  misc_feature (2256)..(2256): n is a, c, g, or t
gagtcgacagtggcatctttaacactaacagatcacattctgcaacggtctcaaggagtgaatatcccacagaccaaacaagaaggagcgagataacgatggcccactctattcctcaaaccaaacaggccattacaacatgcttctaaaaaatacttgtctttttcatattcttatttagaaattagatcatgctgcttttgcatcataggaaaaaagttatgaaggttggtggacaaaggcctggtagcaactaggacagggttgagtcagtaccacctgtctcactggcctagaatgtttgaggtgatcaggatgctggaaggagacatgctcacagagagatgggaggtgtcgcagaacgtggacatgccagagttcgtctcatcggagctcctacttcaaaagtacatggattttgcagcggacgaatgctcgcttggtgtagaagccatggagctctctggactaaggtgaccatctgatcgatcgaatcggccatcacacaggtcgcataggtgtcttgccatatcaagcctatattattgttgtattacattggacacatagggaagggaaaaaatccggtgaattatagggtgtgatctgtctgcctatacttgtggtggcattcatttgtgcaaatgattttgatatattgatgtagagaatatatatgttgtttatttctatgtaatcgttgcacactataattttatcaaacaacttttgtattgttgcaaggggcgacaaaaatccagtggattgtagtgtgtgatttgtctatctataactgtggtggtattcagttgtgcaaatgatttgtggtatattgatgccaaggatatatatgtttgtttttatgtaattgtgcgtacgtggcaacccacgggcacatacctagtactataataacataatcgttcggcaggcatgccgtgtatggaaacaacgcatgcgagatccttggattttttttcttctcccgtttatttgtattgtgcattatcatctgccatatatttatcttacacgatcgagacgagagagagaccgacgctccattctccactggcactctggcacctgcatctgtgcatgcgcgcagctaccctagctaccgacggcagcagcaggtgaggccgctgccgaagtcgacgcagtcgccgcccttggcgaacttggcgtccctgcaccaggcgtcgcagtgcggcagctcccagcacggctggatgcagatgtactccgccgctcctgtatatacataccatgcatatataacagttacaatcacaacaacaatcctcgatccgctgttacataacgatcattacttgaagacaacgaacgaaagggcgcacataccgtaggacgaaagggcagcagcgacgagagcgacgacgataaggatcttgaagacgggggagcaggatgatgaagccatagatgatgatgatagtagtagtgcttgtgcttggactcttctttctttttgtttttggtatatgcacatggtgcgtgaattcgatgtatatatatatggttctttggtggatggatatttagtgcccattgattcttaccgttactactgctaattaaatcgctgaatgcatttgtgtgtccctcatttatctctctctctccctctttcaaataagaaagcaatgatcgtttgctgatacgaatcatattcacaaaaaaaaggcatggattcataagctgctaattgctttccatccggccgatcgatcgatagaaagcattaactccttttaaaattacaagatattttgattctctaagatatatatatatatatatatatatatatatatattgtcttagatatatatttccttatataagatatatattctctaagatatataagatatatttttctatgcacttagatatatattttgtctggataccgatctaataaaatatcttataatttagaatacattatgattatattcgtaattgattaatgcctgaattattgagtggctaaaatcaatttctgaaaatagtgtacgttagctgatttctcttcggtcgtccacttgacctcgaagggctggaatgacgacgaccacgtgacgatgaagaaccagaacagacgatcgaccaaaggacggtgagtgcgaatataatcaaaattatctcttttcaagaaggaaagagcagcctatatcaagaaaaaacccaccgacttctcgagtggtgctagccaatatttcgcgagcnctgcttgtttcagtttcataccagattttagccatcagaattaacttgtgcagccaaacgctccgcatgagaattaacatgaatgtagaatccatcgaatcgtcgcgatgggaagaatccgctatttcctaaaccataaaccgtatagaatcctttcatgttcctccacatgcaaatttcacaatatccatattcgtgtg

SEQ ID NO: 22190 - DNA, 2945 bp, Zea mays
  misc_feature (1)..(1): n is a, c, g, or t
  misc_feature (238)..(238): n is a, c, g, or t
nccacgcgtccgagaactgaaacggaactccctctctgcctcatggtctctgcggcggcggaatccgatccacgcatcttcgctcagacttggtggtgtacgagcagccatagatgtgcagacatccctattggaagaagatccgaacaagaattatcaagaagacaaaaggagtgttgaaacaggagtgcatcaactttcatgagataatgatccagtggacgtgccaatgacaagngtcatagaagaagctatgcttgaggaagctatgagtgactgaaggatttcattttccgtactatcatgtttcaactttcattggccagtcatcaaagaagtatatgatgtgtttggatttggggttctgttagtcaagttgatcattggtcagaaggcgttggattttggaagagtagcaaatcagaaaggtggaatgctcgactaggttaagaaacttcataaagaaaagcagctacctttctttggtggacaaaggcctgggtagcaactaggacagggttgagtcagtaccacttgtctcactggcctagaatgttcgaggtgatcaggtggaaggagacgggctcacacagagatgggaggtgtcgtagaacgtagacacgccagagttcgtctcatcggagctcctacttcaaaagtacatggattttgcagcggacgaatgctcgcttggtgtaaaacccatggagctctttggaccaaggtgacaaggtgaccatctgatcgaccggattggccatcgcacaggtcgcataggtgtattgccatatcaagcctatattattgttgtattccattggacacatagggaagggaaaaatccagtggattgtaaggtgtgatctgtctgtctatagttgtggtggcattcatttgtgcaaataatttgtgatatattgatgtcgagaatacatatgttgtttatttctatgtaatcgttgcacactatacttttatcaaacaacttttgtattgttgcaagaggcgacaaaaatctaatggattgtagtgtgtgatttgtctatctaaaaaaaaaaaagaaaaaaaaaaaaaactcgggccgtgatatattgatgtcgaggatatatatgtttgtttttatgtaattgtgtgtacttggcaacgcacggtcacatacctagtatgctatgaagtgtgaaaaaagctcaaataggttgtaagctgtcaaaaaactaaaaattatttggtataaaccactaaaggtcgttaaaagtttttctatgtatattttcataattccatctgaaagccgctacaagcggattcacatgtgctttcagttttgcactgcgagaaagtcggtttttgaaatagctgcttcctgggtccagccgtttggtttggcttttggtttttatgatgtaaaagtcaaaccaaaagccaaacaagcacacccttagaccctgtttatttatcctcaagattatataattcagcttaaatatattgagaggtaaacaaacaacacatattattagatagattatataatctagataactagattatataatctaacttattttgaactaaatctctccatattatataatctagattttttgaactaatatttagttcaaaataaactatattatataatttaggtagattatagtctcaaataatcagacctataatttataagttgtattatataatcctggaagaaaacaaacacattaataattgtagtaaaagaaaataaaataagaatagtaaacaatattaaatttgtacgattaccttaagtgagaataaaatttaaagtattaaacaatttcagattatatatagttctaatgtctcaaattaaataacttgtatttcattaggcaaaatctgtaaagataatgcccagagcaatattttctaatatatccttatcgatacaacatgcagctaatctatttaatcttttcgcgacatagttaacctcaaataaattttcaataacttaaagttctttcaaactgaggctacggtctctcttttaagcatcaaataagtacttcttagaaaaccttgtagaactaaattcataaggaaatgtaaataccaacaaactactatactaatatatagataatgcacaatacataatcaggattgcatatacgaatatattttcaggagaaaaagatcaagcatgctggtttggtgttaggcttttccaaatagagattttacgtgagttccgtcttcattaaataactcaccatataagcaagtttgatgacatgacaagaatttaataataaaagagatagagagaactcagaatattcaattttataggcaaaaatcgatattgtatttttaaaatacatcatgcagactaccatatataaatgtgttatattgttatgagaaaagattttgtaatccattggtgatcctggctatacatataattttgttattttaatctacctgtttcatcattacattgcaaccaccaatatcatgcagacctatatatctgatagttaggtgtctggcggttgcgtcctcctcttgttccactggggctccaactcatgtggctgtgatggagcgatccctgcacggagacggggtgtcatcctcctcgtcttgcgaaggcacgaacggtgaccgtcgggccttggcttctctgactgtcacgctaggcggggaggatgggtaggattggtctcttggcagtggctgtcgtgcgccaatattttatgaagcattttgtgtgccgtcgcaacgcacgggcacctaactagtaaaattatacattgagaatagtctccgaataaaattttggcccctcactgcttggtgtcagcactactccaagtatgcctcctgatgagttgatcaagctgtcggacgtagacatgccgaaggctggaagacgcagtggtcgtgagaag

SEQ ID NO: 22191 - DNA, 3388 bp, Zea mays
  misc_feature (2653)..(2653): n is a, c, g, or t
aggcgcaggcgcgagcgcgacgtccggcgtccggcttcggcggcggagtggagcgatcccgatccccacaaggaattccatcgctgtcgtggcgtttggtggcgctcctcccggccggcaagcaggatcaggtaccctcccgtcccggatcctcccaaccgttccgtttcccgcggccgggctggcttagttctgcggcgctggttgccatttcgggccaaatttgttgcgtgaagcggaaggatttggattgaatggcacgcgttgtttccagtcgacgccctcttggcttgcctttggctgtaggaaatcgcacggaggtgaggatacacgggtgcggaacgagagctaggcgaacctgtctggtacctcgcggcggagatggacgagaaggcgacgatggagagcaagctgtcctcggcggcggccttcgtggaggggggcgtgcaggacgcctgcgacgacgcctgcagcatctgcctcgacgccttctgcgacagcaaccccttccacgatgaccaagtgcaagcatgactaccatcttcagtgcattcttgaatggtgtatattataattcatgtaataatttaggtgccagagaagctcccagtgccccatgtgttggcagcatatcagcatgaaagatcctatgagccaagagctactagaggctgttgaacaagagaggaacatccgagctaatccttcacgtaatactgctgttttccaccatcaaatgctgggtgattttgagatccctgtaggtgcagatgatgcagaacttgaagaacgcattattcagcacttggctgccgcagctgcagtgcgtaggtcacaccgtcatcataatagaagagatgggcaccagagcagatcagaagcaagtagccacccacagtttctggtgctctcagcagacgagcgcacaatctcaggtcaagaaggggactacgaacaagcatctgctgtagcttctggccgccctttacgtacacttgttgaacaagaacgcactcgagggttagcggatgcttccagtccatctctccgttgttctactcctgctgatagtactggtagatcaaacaataggatttctgggatcgaatctacacctgtggatcaagacggaactggaccatccgctttacaatcaatggtacagggatttcataatcaaagtgcaagtggatggagggagaggtggttttctcggagcaactctttactggatcttggttctgaggtgaggagggaggtcaacgcggggattgctgcggtgtctcgcatgatggaatggcacgatgcaagggacgggacgggagcggggccttctcctacctctgcatcaagatctggttctcagtgaaacactctgcacttgaaaggaccgatgcaaatgtaaagattaaggtatgtgctcatgctgtgctaatgaaagccttaaattcagtgttttgttttttttctggtggcgtactgtcactgttgactggcctacggatctgagtttttgtgtaattgtttggaagcaattccattgtcgccgaaatggcgcggtagtttctctgactgctgctgctaaatactaggaactttagttttcttcaagtccaaagggtcagagttgagagcacctgagatccggcgatgcttcatggccacggtcccccagaggctattcgcaatagttgactctaaatttctctctatatatcagttttttgtgtcacattatcaacatttcataccttacttttttttaggagcagctattgtttgaggagcactttaggaagacaatcaccttgcaacttctctagcatatatgaatttttgaaaaccaccttggtcacttttagtaggtctttcttgttaacttgatgctcttcatcctaaaaggtacaatagtcttgattaaattcctaagggcttgttcggttagctctcaatccatgtggattgagtgggatttggtgggtttaaatcccaagcaagtcaaagttgttctaaatttttttccaatcccattcaatccatgtattgtaggaataaccgaaaaaggcctaacttggaaaaatttgctttccaccaccttgttataaggtccaccaactctagctttatccttctcactatacttcaaagtttgtattgtcttgtcagtcacctcgtccatattatccatcatcatatcatgttacataacacaaataaatcatttttctttgcaagtttgtatgtctccaaatccatttttgacaaataatcggtcccttgcgcataaactagctcaaaaggagtaattttgatagctccatgtctagagatgcgacgagcccacaaagcctccaacaaaaactcatgtcatctttagagattatactcaatctatttcttaaccacctttgtcattgtagacggtcaacgaggtacgtaaagtgtcaaaaagaagaaagtcagtagagagagcaggagcgtagacgagtggtgtgttgaacatgagcatgatcagaaactacactagacaatttagagacgttcggatcatattgtgcataatatcctacatccttttactactcattgattaatctaaataaatgtaaagaaaaaaatataagatcaataatcagtcatgcactatgacctncgagctgtcatttttcacttggttttggtggtctcttatccacctttatgcatgttcttagatatcgtatgtgatttagaatggatttgaatcctatgtgggtgagagttgtgagggtccaaagagagaatctctttagagcatgttcggttgcatatggattagagaagattgaggggattcaatcccattctattcaattttaaataagaagagattttattactctcaatccacctttaaccgaacaaacttttaaggggtagtttgtaaccaagaggagtcaaactcaaggaagaaaacctcacatgaagaactaaatgtataattcaattggtatcccatggattactcatcccgggaaaaaaaagacagggactacaagagaatttaagtttcaaaactggcccgtaaacgttatctggctatggatagagataacaatgggccccgatcctcgattctccgtgaggaattcctctattagagaacggggatgtagaatattctcctcatagggatgtaaacagggaaaaaatttcccggtaaacagggacgggaagcattctccatccccgttctccatgaggacccgttaaacttgtacgtgacgatgttttcatgtactacttaatgataaaaataaataattaacttgtcaagaaatcactcattatacaaatgtgttcattttgatgtaagcataataatttcttacatctaacaatatgtata

SEQ ID NO: 22192 - DNA, 3341 bp, Zea mays
aaatattcacaaataccgtgctataatggcatggtaatttccacctggtaagatatcgacctaccatcaccaaagtttccacacctaagggccagaattaaacctcccttccaatcttttctctcggtaaaattttcatgaatgcctatgaatagaactatagatagaagagaggtaaagaactcaggatggagaaatgaaagaattcagctacacacgcacaatgaagacttcagcgattaaagaggctcctccatcaccatcgaccatcttgacatagtcaacatcacaagtctgggagttgctctccacctccaccatcctcctcgctatttacaaatccgagctgggcctctgacttgaggctcccagtattatttacaagctcggcatgaaatttaacacttgggttgttaattacagcagaactgttatcatctactacatatttactgaaagcaccgtcatcagagcttttgggcccttcagacatgcagtccaaagaactacagctgcttctgcgagagagtctaccatcttctgaaatcccagatttctgtcgctgcagcagcccgcacctgctgttatcaggagcgttcaacctggagggtaaaaatataaaagtcaccacaggagaaatctaatcagacaaaacaatagcagcaatttccaaaatcaggatgaaggcctgaattatccagcaataattacccagcctttatcaaccacatagatgaaataccttatgtagcagtattggcattaatcagccactaacaaaagtgctcaagtgtacaatttgaatataccttgtctgttgaaaccttgatgtatggagggagtcgaagactggtatgagattctttgaccttgactctatgttgtgggtctggactttttctacttcaacttcccctgaaattacatcagcattgtctgcttctaaagtttcaccctccataacttgaaagtgtatctggcatcagtcaataagcaggcattgcactttatgagtcccagcatgtcaatcaaacataaaatataaatgcagcattgaaacagaaaatggtgcaagaaaataccctggatttagaccagagtggagtttgcacaacatgagtctgcaactcactctgagaaatatagagattacggttttcatcagcactgagcttttgcctttcaacagaacagtcaaatgggtagatactagtccctttccacatagctttcagcaaaagtttattattttctccattctcaaaatcactatatgcaaaactctcagcactgtctcttctatttcttttataacaaacatcccacttctgaagagcttcaataacaaattttgtatcagtttctctctctggcccataagaaatggggcttgtccggaaatccaatccagaatcctgttcagctgagagatggagagcatactgtatgatgcttcctgatggagaaaatactagtaaataatacttcatgcgcaaactgccatctgaatcgatgtcaccagccatgcggttgtgaaaagttgaagcaatcgcaccagaaattggagtggaagcaccagttgcaaatgcagcagcaccatggacagcacccttaaacacgttactcccatttcttatcctactaacaacagacaatgtgacagggggtccagatacgaagagagtcttctgactcagactcaaagaggttgctgaattttgggaccaatgagcagtatgattaactgatgaatccactgtgtaatcattttctacagggttgttatcactgtaacggaatcttgttgatccacaatatggagagattgaaaacaaatggctagttcctcttgaagagctaatcattatccagtcactatcatcactaaagctgatgtcttttatgatctgcacaagggaagtgatacttttacaggtcaaccaacttcacagataatgagcaataaataggtatgccaacttaccgcattggttatgcctctttgcagtttgtacagatgaacataggttccaatttgaccagcttctgatgtcccatgtggaggtataatgcggaaaacattcatgttttgaccatgaacagatgctgtcaccagcaaagttccacttggatcaaagcaaagtgcagaaatgagactagtgtgtgccctgaactgaactatcaataatttagagacaatatctcgaactatgacctgccattgcaatatcaaaatcatgtgagataagtaaagaaaaaaaataaaaaatacagcatgatcatattaattgaacttgtaatggcaaaaaaccatttgtatacactgaacacttaatcacggagataagaaaatttccatccatccgcatccattaggctactctacttttgaattccattccatccagatgaagaactaattacccaccttacctgctatactatctcgtctagtttcgatggataatattgttcacacttctgccacggatgtaaaatgaaagcaaacaactgaacaaaatggcaggcatgtaaaatgaagtacacaatctgccacggatatatttctgtaaagcgtgtatacaaatgcaggagacagaagatcagccgtggccaattcctgaggaagaatagcaagatcatcaaattgttagcaaactggccaggtgaattccgtggtccctgacagccttagggttggttagttcttactaatactagtatacagagatgacatggtaatgctagcaacaatgttaatcaagtttattgccaactccaggataacagaattaacgatgaaaatatgtacaagaggtctgtaccgttccagcatattcactgtcaatgaggtggccatttgttacaccatttgctttgtaaacagaacttctttgctttatggtaccattaccatttggaatgaaatctgcatagtacttggacagcttattatatccaacctcaccaagtgttgcaatgccagctgccagttgcttgcttgattcttttgcataatatgccaccacactaccatttgaaccaggaggtggaacagagggagatagactaagaagctgtgggctaacacgtccagtatctggaaccggaactggattcccagaatatgcaatccatctaggacccaatccaagtgggccatagcctgaaacttgtgcaaccgtaggactggtaagaacagtatattctctctccatggtcgcggcatcaaaacaatgtatctgcaaaaggtattttccccatcaggatcactcatgatccaagaactgctctggaacagtgaaaattgcatacctgagtagcctgtgaaatagctacga

SEQ ID NO: 22193 - DNA, 740 bp, Zea mays
ttttttttttttttttttgcaatcttaaatggtctttatgcattagagctttattacatgattaccctattagattgaaaaagccggtgacttgtttcgggcctaattcttactttgggagcaaaataacttgtgagatttattgtttctcgaatgaggttgatagagcatttgctttttgttcgtcaaccttcaccaaaaggtaggggacatatgttgagcaccaatattgcccaccagacgtcccgcggcgcggacagtccgtggtggcggcgaagacggtctgaaaaaatcgagcaaccttgaagaatccttgaagaacctctgtgagaactgatctcacggcgggacataatacgctaccagggataagtgaatatccagatctcctgctctgctgctcgccacctcgggggctctccggcgttggctcgacgcggcagcgccccccggtagcctagttccggatcccccaccgcccacgccccacaggtcaagttctgtgaccccggtgagtaagctcgatatcttcggttcctcgcacgaggatggggatttatagccgaggaggcttccgtggttttgctgctgggattttgttgctttggcgagggattggaagctacttccactggctactgatcaaacagttggatctgtggattccgcaacaaataagtttctttaaggctattgttggaacttgctctcccgacaagatgatccaccggggagtgaaa

SEQ ID NO: 22194 - DNA, 4100 bp, Zea mays
  misc_feature (2516)..(2516): n is a, c, g, or t
ttttttttttttttacagggtgttagatgtgtgtgctacgcctataatgggcttggtccagcctatatttgttttctccctattaatagggaaccccaaaactctagttagggttaaggttaccaatagaatattctatcattacaagaatatgatatcaatcaacctcttaactaatgctgatacgatattcaaatcagcttacacctttcaacagttgagtaaatatggggcagaatgaagaaatacactagcatttttttcctgcagattgtatctttctaacttccaatactccctggtacatggccacacgcacagttaccaaaagctgtcccagcaaagacagcaagtgagccctttgggtatacaggaaacaaaagcttaagaggattcatcagctcctaggggcatcaagccttctttgtaaacttcaaagtcatcgcccgaccagcgacacacaaggtatagacggaatgtcgccatttgtatcccaagcagccgcaagagagagatcgaaggatactcaatacaatggaatagaaaaggataaaatgagtaggtgtcgattttcacgtaaactgagcacaatagagcctaactttagattaatcataagttacataatgaattatggcatatcttcaaaatcaaacatataacagccatcacacagtaatactgtaccagagtctgcgctgcttctggcgaaaggggctttccttcctcacaaactacatggtctgcaaccaactctacaacacctgcaacaacaatggtagactttttaacgacaacttggcagattctaagcacatatgtaatgcagacgagactgcaaacctttgttcaagcgaactggaagtccttgcttgcgtagaaatggctccatctcatgtgtgaactgttccagagggccttccttaagctcaacctgaggaattgtagatgttgtttgtaaaatgttgtaaatttggtgaaactcattatacaagaaaccgaaaatggcactacagagctactacaaataagtgccattgtcaaagtactgttaccactgtgtgcgtgatagtatcagtatatactggtaatacattaacaccaagagcctaaacttgacattggtcagcagaacatggttttcctagccagtctatttgaagaaaccagaccagggatatacatgaaaagcaaaactagaataccgtatcgatagcagtacttcctgtccttgcaaaatcatgctcctcgaattctcgaaacatcctgccagtatgatatatacgagcatatcaaaatcttcatataaagctacaacaagaaatgtaagtaatggtgatgacatccggatactacctctcaacatcatcccttggaagattggtgaataacagaccagagttgccttgaaggaactaaacacggcgaagttactttcatcaaaacgtcatattaatggggaatgcagtgcctactaaattctgaaaaggaacaggtctcaccttggaaagtttgtggaggcctgttttagcttcatcagcaggcgaacgccccagcgctatctgcataaccttctttccagcgagaaaaatcctggaacagaacatattgcatggaagggtaagatggatgaccaaagcagaagcggaattagatccggtccactccactgcagcgttcggagacagaatcaacagcatgcaatgtgggcgccgtacctgctcgaagacttgagctgctccctgaggtccttgagcttctgattcctcatgttatcgtaggtaaaaacataggcgctgctgtatttgtcgacagcatcttttatctcggcgactactttgcccttgcgctctaaacctggcttcttcttggtcttcgataaggtcactgcgttcggcgcgcattagcataatttacagcagcgaggccactgtgcaagctaagaagtgttgttgcttgagagagatttgttttttacttccagactagcaaacaaattttagaaggcacaaatttgtacaggaaaacgcttcgatactacaaacaggaaataagcgagagagctctacgaaggtgcagaagggagaggaggagcttgaaacgattgatgatcacctgggcggttgcgcttcgacttcggcatcgcgttcctgcttccttcctcgtcgcggttggcggcggcggcgcgggcctctgctaggttttagaggtctgttcgtctcgtgctcggtgccactgccggcgctatgtttaggtgtatagtttttatcgcggaaggatacgatggagaggctaatgtctgttggactagcaggcccattaacttgcagagcccacttgttcatccaggatataataaatgaactaatactatctaaagtcatgttaggaagaaacctagttttttttaaaaaaaaaactgtttctatctcaaattttctataaaccggtttattaaaaaactgtataagggtgtttggaacctggtttttaagaaattagtttttagttatttnatacacgatggctagtctatatttactctattttaaaagtggtgataatagatgtaaattttgtgaaatcaataatgataagaatgggaaaactgtttttagataggacaagatagcttcttggttttttagaaaacaggaatcccagtttttatagattaatgtataaattggtatgttaagaaccacttagtttttataatgtggtttcatagaatctatatgattctaaacataccttaagtataagttaacatatatggcctattagctcagttggttagagcatcgtgctaataacgcgaaggtcgcaggttcgagacctgcatgggccaaattttagaatgttttttgttttttttttttgtttttttttctttggttctccacaacgatcctcatgggcaccacagctgcaagcgcagcccaagcatatgcataaagatagcaaaaccacagcctactctgcaatgtgttcagaagaagcataccagcgacagcgacaaacaaatatttgatcactaaaaaatatacctgcggtctccatgcgcctggtgatcatcgagttcagcacgcctctttcaccatgcctggcgatgatgataagcgcagcaaggaatggagcaaatacatcatctgattctgaaaacgaagcgaccaaggaaaggaactatttgcagcaaggtagatggactaggggcataagacgaagaactttgtctttgttggtggcctaatttttactttacctgaagaaagaggaaatgcactaattcctagagttatgtttatgtgcaccagtttcctgcagaggttgtagaatgcaaagataaagacatacggagcccaatcaataagttcatgtccttaattagagttcctagaaaaatacagtaccattctattgggaaaatattaaaactcttctctttgcatgcacacttagagtcgcttgacaaaggttaatgtgtcaattaacaaaaagatcaaaattggacataaaactgttaattgtatttttattgattatgttttcaacaatattggatatgtgattttaaggctatctccagcagcttacacatcatcatccatatattcaaactataatcgacgaacaatgtagcctacaatacaaaacaacatatgagtgaactgttgtagagtaccaaatgctcatgctagtattattacagatctggctgggccattggggggtcgttattcgtctcgatcgcgagacgcttaggccgcgtcgattgaccgaacatggaccctgctgccgcaacccctctgcggtgggacttcggacggcggcgcgagtcccatgcctccttagatggctgagtcgttgtcgaactactgatgcctgggctcggggaaaattgaggtggttccaaatatatcaattaatgactcactttgtagaaattggattctcagtttcttaaaacctaaaactaagaagttgatctcttctagctaaaaaataaaatgtttcttaaaaagcgagttgcttgcaaactgggcatttctccgttctggattataagttattttagcttcttgaacttatatatactc

SEQ ID NO: 22195 - DNA, 1207 bp, Zea mays
tttgggtttggcccttcctttttttgttttctcccttttaagagggaaccccaaaactctagttagggttatggtttccaatagaatattctatcattacaagaatatgatatcaatcaacctcttaactaatgctgatacgatattcaaatcagcttacacctttcaacagttgagtaaatatggggcagaatgaagaaatacactagcatttttttcctgcagattgtatctttctaacttccaatactccctggtacatggccacacgcacagttaccaaaagctgtcccagcaaagacagcaagtgagccctttgtgtatacaggaaacaaaagcttaagaggattcatcagctcctaggtgcatcaagccttctttgtaaacttcaaagtcatcgcccgaccagcgacacacaaggtatagacggaatgtcgccatttgtatcccaagcagccgcagagtctgcgctgcttctggcgaaaggggctttccttcctcacaaactacatggtctgcaaccaactctacaacacctttgttcaagcgaactggaagtccttgcttgcgtagaaatggctccatctcatgtgtgaactgttccagagggccttccttaagctcaaccgtatcgatagcagtacttcctgtccttgcaaaatcatgctcctcgaattctcgaaacatcctctcaacatcatcccttggaagattggtgaataacagaccagagttgccttgaaggaacttggaaagtttgtggaggcctgttttagcttcatcagcaggcgaacgccccagcgctatctgcataaccttctttccagcgagaaaaatcctgctagaagacttgagctgctccctgaggtccttgagcttctgattcctcatgttatcgtaggtaaaaacataggcgctgctgtatttgtcgacagcatcttttatctcggcgactactttgcccttgcgctctaaacctggcttcttcttggtcttcgataaggtcactgggcggttgcgcttcgacttcggcatcgcgttcctgcttccttcctcgtcgcggttggcggcggcggcggcggcgcgggcctctgctaggttttagaggtctgttcgtctcgtggtcgcgtccacggtcccgcccggccggaagatggtgattttgctgtactaatcacagtggttcaggaaatgtcttcatcacgga

SEQ ID NO: 22196 - DNA, 1203 bp, Zea mays
  misc_feature (34)..(35): n is a, c, g, or t
ttttttttttttttttggtttttttttttttctnntttttttttttttttgttttttttttttttttttttttttttttttttgatcagtccaaacctacttggaccattaatcgtgattaatcggaagacttgaaaacattgcaccaggtacagatttgccatttgccactgagctacattcagtttgaacaagtaaacccaactcagaaacctgaatccaaacagtttcttgaggttcagcaccccgtcgcacatacaaaaccccccactgaatctcagaaatacactagcaaaatttttctgcagacagcatctttctaatttccaacccagccaagacagcaagtgcgccctttgtgttgtgtatacacgaaacacaagcttaagaggaatcatcagctcctaggtgcatcaagccttctttgtaagcttcaaattcatcgctcgaccagcgacacacaaggtatagacggaatgtcgccatctgtatcccaagcagccgcagagtctgtgctgcttctggcgaaaggggcttcccttcctcacaaactacatggtctgcaactaactctacgacacctttgttcaagcgaactggaagtccttgcttgcgaagaaagggctccatctcatgtgtgaactgttccagagggccttccttaagctcaaccgtatctgccgcagtacttcctgtccttgcaaaatcatgctcctcaaattctcgaaacatcctctcaacatcatcccttggaagattggtgaataacagaccagagttgccttgaaggaacttggaaagtttgtggaggccagtcttagcttcatcagcaggtgaacgccccagcgctatctgcataaccttcttcccagcgagaaatatcctgctagaagacttgagctgctccctgaggtccttgagcttctgattcctcatgttatcgtaggtaaaaacataggcgctgctgtacttgtccacggcatcttttatctcggcgactactttgcccttgcgctccaaacctggcttcttcttggtcttcgataaagtcactgggcggttgcacttggacttgggcattgtgttcctggttccttccttgttgcggctggcggtggcggcacgagcctctgctaggttttagcggtgccgtcgcgctacagaataaaaatcggcctctgtatattggttgtttttttttac

SEQ ID NO: 22197 - DNA, 2528 bp, Zea mays
tatcggtcaaactgaacaaggagcccagaagaataaaataatgtgtagagcattaacggaatcctatagccaaaaaatgttgttcattcatcacaaacattattaaagagtggaaaagaaggccgaccataccttatggcgtgcgatgtatgccaacacagaaggtgctagaagcagatataaacttcacacaacaccacctcacagatctacacagttcacacttagtataggagcatgacgtagaacatgcactgtagacgaaggcagggtcctgcctgggagcgccttcaaggatgtgtcggagctcgccggactctgtgcagccggcagatctcgtcagcgccgccgacgagcgcacccccgaccaggagctatggaagcgagtatctgcggccccgggcgttgaggattccctgcagtgtcatttatacttttaggggtgtacttttaatgtgctgatcaaggcatatgcattaactgtggaatgctagataaggctatgatcatcttcaatgaaatgagagaccatggagtgaaacctgatgtggtaacctatacgacagtgattgctgccctctgcagaatcggtaagatggatgatgctatggaaaaatttaatcagatgattgatcaaggagtagcacctgataaatatgcatgccattgcctgattcaaggtttttgtactcatggtagtttactgaaagccaaggaattgattttggaaataatgaataatggcatgcgtcttgatattgttttcttcggttcgataattaacaatctttgcaaactgggaagggtaatggacgcacaaaatatatttgacttaactgtaaatgttggtctgcatcctactgctgtggtgtatagtatgctgatggatgggtactgtcttgttggcaagatggagaaagcattaagagtatttgatgctatggtgtcagctggcattgaaccaaacgatgtagtgtatggtacacttgttaatggctattgtaaaattggaaggattgatgaaggattgagtcttttcagagaaatgctgcaaaagggaataaagccttcaactattttatacaacatcataattgatgggttatttcaggatggagaacagttcctgcaaaggtgaaattacatgaaatcacagaaagtggtatcgctatggacaaatgtacatacaacatagttcttcgtggactttttaaaaatagatgctttgatgaagcaatctttcttttcaaagaattacgtgcaatgaatgtaaagatcgatatcataactctcaataccatgatagctggaatgtttcaaaccaggagagttgaagaagctaaggatctgtttgcttctatctcgagaagtcggctggtgcctagtgttgtgacttacagtataatgatcacaaatcttataaaagaaggattggtggaagaggcagaagatatgttttcatccatgcagaatgctggctgtgagcccaattctcgattgctgaatcatgtagtcagggaattactaaagaaaaatgaaatagtcagggctggagcttacctgtccaagattgacgagaggaatttctcacttgaacatttaaccacaatgttgctggtcgatctcttctcaagcaaaggaacttgtagggaacacataagatttctccctgcaaagtatcattttcttgcagaggccagtccgtgattgatattttgatttttttttttggaataagtccttgcacgcacctgtcacagttaagctagtatatgatcttaactaaaaccattggtttacttcatgttcatgttttctcggaagattttcttctcatttgacctgcttgatatgcagatgttcatttacttttgatccaatatatgcagagcgttttatgttttttgaaacatattcgttccggtgctgatgtagctatgtgctccccgtgcacaactgatgtgcgattctctcttgtagcatgttttatcatgtctgttaacacagccgatgttgcatttatgaggaatgacgttataactgctgaattgtgatgaagaataatgtagcatgctgaatcctgttttggcccctggccgagccgcccagttcgtcatgaccagcagggtaatgttcatctacatgtctagtttgctcatcttgtctttgagaagggacacccttagctgtttacattaacaaatagataacgttcttcctcattaggcagtttggcctaatgctgtggcttgtaagggcaaagtggataccctgctgctgggtagtactagtatattgctgttcaaacctgcaaatgtaagttttaaacaaacctgccatttctatctactgtactatgcacgtgcacttgaaacatataactttcattcatgatcagttagcatataagtatatgcattaatgattatcagcagcagcaggtttttctcaggtgttaagtatatcgccggcgatggtagccttgatcagggtttccagctcgtcgttcccgcggatcgccaggggta

SEQ ID NO: 22198 - DNA, 4711 bp, Zea mays
  misc_feature (3163)..(3163): n is a, c, g, or t
  misc_feature (4694)..(4694): n is a, c, g, or t
atagattcttgatctcattatcagtctccctggcaagctgcgctgcaatttgagaccacctttcccggaggacagcgtgcagctcgatgatgaggtcttcttcgtcttgggcgaatgcccctctcttgaggtctggcctcagatagtttatccacctcagcctacaactctttccgcacctttgaagccctgcaacaatttgtcttctcgaatttagataattgaactgaccgagaggtatttgagagacaagaggggtttcagctggcaattggaaatgagaaaaatgcagagggaggagaaggggaggattgagagttgataactgaggaccaagggaagaaaaatttcattgtacagcccagcgagtttgggaacagagctccagcagccatggccatgctttgttatgtgattcatgagtttctcatcctcctcaggggaccagagcccctttctcagcttctgcttgtagcagcaagaatgcctccccatctcaacgcaatgcagaacctgggagctccaaccaaactcacagagcttacaggtctgcggaatgtataattatgcacgacgacgaacaccttctccggtagcacagagcttcttcgacgatgttctgaagtagtgggaaattgcaaaggttgtagcgacttatataccaatgaatggttgggcttcatctgaggccaggattgagcaactgcatggctgcagataggagatttcagtggaaagcaaggaaaggctaggggcactcctctccttttcttcgccccggcccgcctcggcgcccttcttttaaaggtggtggtggaggtggaggtggtggttgtggcttgtggggcttgtgccaagggatggaggtttagcccttcccttggcctgcttccggctgtgtgtgtgggcgtctgcctcatcatctcctaagaatctatgtctggtgccaaaatcggtggggtagccccgtagccacctccaccgatatttaattgtcgtgacctttgtgcaagaaactgttacattaaaccaccctccatcttcctttgcaccccggttcccatgcatgcccggtgtgtttcttcgggcacaagcccagtgaaagtgaaacacgcgtgtccatattcagagtccatgttatttatttttttttgaaagaccagagttcatgttattaggacacggattgatgctcttgctgccatggtaagtgactgtgacatttagcagccggttttctctctctctctctccctctctctctctcttttccgcagctacttctgtgtcacgggtgctccatgcacggcagagcacacagttgggaagaggcctcttgtccacctttcatctgttgctaattaagactccttgtcttagctgctgttcgttccgtgcatgtgcatctcattttctttgtcacctgcctgagtttatgcgtcagaccaaagtgttgtcctttttttcttcttgcttttcaggtacggtaactcactcactgggtcacttctttctggtgaggaaggaaaaggcttggtcaatcatcacagttagggtcgtggggggagggaaaaaaaaggcgatgtcagtgatgttcgtattccaggacagagagcatctttcctttgtttatcgccggccggcagctagcaattctaatcagaaatggttactgctccggtccaacaccaatagaagcacgtcgcgggcgctggatgtctgtcaagaatcaagcttcccataatcgcgatgcaggtacgcgagtataattaatgatttgtccgattgactgtcgctagcgtcaatggaggcactgatcactgcaaggagggaacttaagcgcccttgaatttttgttttcttctttcatacaaaaaaggggtccactggaggagacaaatttctctctgagtaatgtactgggaacgggctagtcaattggcgtattattgctgggtatcttttgcttgtctagggaacgagcgtttctttatccatgattaggattgtaacggcatccgtcgtctgtgtgcccatgcatgtgagggcggatgctcctcgccaattaaacaaaacgcaaacgtgtccacgaatgagagagagagagagagagctctgatcggtgaattttgtaggtctcgtttccagctgaccatttcgttgtcgtttgattccccatgcatgcaacggatctcatccattctggagccttgcgttgtctgttggcgtgtagggtggcatggcatatattcgcattatgttattgttttctgaagattggatatgtgcatatatatgttactagttctggagattttatatgccagctatcaactgtcgttgtttgaattcagcggatacatatatagatgcgtacgtgctcctagaatcgatgtcaccatctgttctccctttcctctccgcgcaggaccggacttgcggttgagccagaaaataaaaaggactgcatgccagtgccaggtaagtacctacctacgacctaccttttgactgtaactgctagtgaccacttcctttttttttctggccccagggaagaagtgctcgttcgtccactccagaatctggagcagatgaagctgaccctacaggtaattttggatgtagttaacctgtgcagtggtacacaatcactgacggacttgtgtgcctcttcttttttctttgccaaaaggtgattatattattgcatgcgtgtacggacggaggtgggcattattctgacgaggggaagggaaggggaggcgggcggcggcagcggagcatggcaattaacaacaaggctggcactagaagatcacggggaaggcgagtttgacaacgggggcatcttttctggggtccccagaggcccactccccacacgatgatgcatgcacggtgagtgatttgcgactccgcaatatccgttcatttctttatttacaaaatataataacaataacaataataacaatagggtcgtcactcagcgttattgagagacagacagacagagagaggtgcgttaaatttgtgatggcctaggctggtgatgatgaacgacgactgatgggtacagccgggaatcaagagggatgaaagatcggaacagtacacaggacggcagcagcatcgtccatagtacgcgggggtaggcccntggaagtttacggcacgcagctttgtgcctttgtgctatctctctctctctcttagagagacggagatagagagagtgtggggtgcagtgtacgactatggggccggccgtcgtccctgaccttggaatggaaatggtagggcaccatccaatcccacagtccaatcttcccgtcccgtgtagcatagcacagacagacgctagtagggaccacgcccatgcaccctcgcccggccggggccgggtccggcccccgttccgtccgtgtgccaaccaactagacgcgcactagcgcgctaggtcattatagcttgcaatacaaatttcctacctatctgtctatccatccacacgacatacatgtgcacatgtatccatgtttttgtgcgtgacggtgatatgctctgcttgtaacagttaataacgtcatatatactatgcacttgacctgtatgtataatatgcattaatgtgcgcgcgcgcgcatacatatatatatatatatatatatatccaccgtttgcctaagttttttcaggggtcttttcgcccagaacaactagtgaatgctgctggacaggaataccctgcgagtcgccgttgtccttgtcacgccttttgttttcccctcccgttgctagctgtccgcggacgtgtacgtgcccaggcatcctatacgaacgccatgcaccaaggaaaggtggctactagatttaaatccggaatacatatatattatatatgcatctacccatctcgttttcatttctgggcctttcaatttcaacagcagctcatcccacggacaatcgtcctgaggtaataatttaaccacacgcttgccaccctcaatttttttttttagtttcgatgcttcgatgattttgactaaagtgttggagttgtaggtgtgcagtattcatgcatggacgcctggcctcctcctctgcagaattggaacatcatatcgaattggcgagcgagttttgcaggtaaggattcgcatctcttccttgcactagctgtaattggattatatctgaaaaaaacaactaaactgttactgcttgtttatgttgatgaatttgtgcttgagtaagttttttttccagtgatattcgtgtgagtattatagattagtgacgacgaataaccctctctccgtttcgagtgtatcaaaatgcagaaaaagtcaaacattgtaagatttgaccatcgattagtcactcacgactcacaaacatatatgtttgcacaaaaggttatacgccaataaattcgtaatccacttgtctcttggcattatatgttgggttatagtagtaattgacaacgtattgtaccagaagtcaatgcccaaagtacaccttgaaagactgtttatttcaacaaatatgccttggaaaaagaaatggagggagaagctagtactcagctagcttagcgtgccttgtgaagttcaaaccaataaatttcctaactactttgctatgtgtgtccgttaccacctccaacgttcaaccgtacatcntcccccaccccaccttt

SEQ ID NO: 22199 - DNA, 2583 bp, Zea mays
ccctgattataactatagccgagggcaaccattaacagattttgctggctaaatttacagttcacatcatggcgatgccatatagttaagggggctcattctcaatggagcatatattgagtctcaccacattgaggcttcatatattaaccaatctacatggtaagtaaatattcatgaatagttccttccttttttccccttgaatgtgtttacttctttttgagggtgattgttcttttggaccctatcaaatcaaccagtccttttccattcctgtattcaagtagaaagcgatcaagtagcttgggttctccacacagaaacgtttacgacaggaacaggaaaatggaaggggacgaaagtagctctcaggtcaatatttcaaatttcttcctttacaaatatacaactgccgtctgtcggcaacttatcgaaagaaatgaaaaatacaacatgcaataattaatttgcatggacatgcatggcagcagttgaaagtttggggctacttgcacgttgagagctaccgacacatgcatttttgcctatggctatctatatttatttaatttccaccagagagaacaaaaactcaaatatgcaaaagttcagtcgtgtacagaaggaaaacatcaattttcaagagaaaggaaaggagactctagaacatactttcctatgcatcctgctgcaacttctaatgccagggctgtcctttccttgatattgccagctcttcaactgaggaacagctgtggaggatgatttctgtatcaacttaacgtatctatgtgagcaattcagcataattctgcccacgaatctctgaaaatacgagtttctgcttcttctgatctgctctgttccatgtggtggaacataatgcctagatattctcaaaagatagttgcattctttgcaagtccttgtcatacatgtctggtgctacctgcagctgttgctgtggctgctgattctggaaccaagaagcacatatcccttctatgttgaattggctctctgccttgatcacatcatcataaagcgtttggctctggttctgcatgactgtggtcgtttcggcaaaggagtcaggccacttaagttccgctactaggtgagcccttgtatctttttcttgtccaatgtctgtccatgggaagacactgttctccagaattgtgctcgtgctctgtggttcaaatcccatactgttgctccctctgctcccagtactgctactgctgctaggattagtaccatcccagtagaatgaatctactgcggtactcccaatgccagttcctccatgtcgaggattatcaggtggaagattcagccccattgatgtagagagggccgatggtgaaactggcggcatcactgtagaaattgtgctgcagttgaagtcactctggttgaaccagagtgaattcatattcgccccatcgctgctgccactctcactgttgtagcctaaaggctgttggaaagggaaatagagagtttggcctgatgagtggcaggttgatggactctcgtgtccagcagtaagctgctccaggaacagctcctttggtggcagcttagggcgtgccaagtttggtgtttcagcacgattcttgtcgtacacgggcatcagcattgatgattgagccgtctcgctgaggagggggctcaagttccccagaggaccagtgcttgatgggttgatgtcgctggaccctgaggttctctcggtgctgatggtgggagctgcaccgccgtgatcagcctcagtaagtggcttgtgggtgttgggatcaatgcctttctgcctcagcttcttcttgatgcacgagttccatagattcttgatctcattatcagtcctccctggcagctgcgctgcaatttgagaccacctgttcccgaggacagcgtgcagctcgatgatgaggtcttcttcgtcttgggcgaatgcccctctcttgaggtctggcctcagatagtttatccacctcagcctacaactctttccgcacctttgaagcccagcgagtttgggaacagagctccagcagccatggccatgctttgttatgtgattcatgagtttctcatcctcctcaggggaccagagcccctttctcagcttctgcttgtagcagcaagaatgcctccccatctcaacgcaatgcagaacctgggagctccaaccaaactcacagagcttacaggtctgcggaatgtataattatgcacgacgacgaacaccttctccggtagcacagagcttcttcgacgatgttctgaagcagtgggaaattgcaaaggttgtagcgacttatataccaatgaatggttgggcttcatctgaggccaggattgagcaactgcatggctgcagataggagatttcagtggaaagcaaggaaaggctaggggcactcctctccttttcttcccgggccagccctttagcacccttcttttaaaggtggtggtggcccggccggcggtggttgtggcttgtgccaagggatggaggtttagcccttcccttggcctgcttccggctggtgtcgcagcccggccggc

SEQ ID NO: 22200 - DNA, 2190 bp, Zea mays
gaaagggggaagaaaatagctctcaggtcaacattccaaatttcttcttacaaatatacaactgtcgtttgtcggcaacttataaaaaaaaatacaacatgcaataattaatttgcatggacgtgcatggcagcagttgaaatgtttgggtctacttgcatggtgagagctaccgacacatgcagttttgcccatggctgcctatatttatttaatttccaccagagagtgaacaaaaactcaaatatgcaaaagttgagtcgttgtgtacagaaggaaacatcatttttcaagataaagaaaaagagactctagaacgtacttttgtatgcattctgctgccacttctaatgccagggctgtcctttccttgatattgccaggtcttcaactgaggagcagctgtggaggatgatttctgtatcaacttaatgtatctatgtaagcaattcagcatagttctgcccacgaatctctgaaaattacaaatttctgcttctgctgatctgctctgttccatgtggaacataatgcctagatattctcaaaagacagttgcattctttgcaagtccttgtcatacatgtctggtgttgcctgaagctgttgctgtggctgctgattctggaaccaagaagcacatatcccttccatgctgaattggctctccgccttgatcacgtcatcatagagcgtctggctctggttctgcatggctgtggtcgtctcggcaaaggttccatggagcaagtcagcccacttaagttcctctaccaggtgagctctggtatctttttcttgtccgatgtctgtccatgggaagacactgttctccagaattgagctcgtgctctgtggttcaaatcccatactgttgcttcctctgctcccagtactgctactgctgctaggattagtaccatcccagtagaatgaatctactgcagtacttccaatgccagttcctccatgtcgagaattatcaggtggaagattcagccccattgatgtagagagggccgatggtgaagctggcggcatcactgtagaaattgtgctgcagttgaagtcactctggttgaaccagagtgaattcatattcgccccatcgccactgccactctcactgttgtagcctaaaggctgttggaaagggaaatagagagtttggcctgatgagcggcaggttgatggactctcgtgtccagcagtaagctgctccaggaacaactcctttggtggcaccttagggcgtgccaagtttggagtttcagcgcgattcttgtcatacacgggcatcagcattgatgattgagccgtctcgctgaggaggtggctcaagtttcccagagcaccagcgcttgatgggttgatttcgctggaccctgaggttctctcggtgctgatggtgggagctgctccgctgcgatcagcctcagtaaggggcttgtgggtgttgggatcaatgcctttctgcctgagcttcttcttgatgcacgagttccatagattcttgatctcattatcagtcctccctggcagctgagctgcaatttgagaccacctgtttccaaggacagcgtgcagctcaatgatgaggtcttcttcgtcttgggagaatgcccctctcttgaggtctggcctcagatagtttatccacctcagcctacaactctttccgcacctttggagcccagcgagtttgggaatagaactccagcagccatggccatgctttgttatgtggttcatgagtttctcatcctcctcgggggaccagagcccctttctcaacttttgcttgtagcagcaagaatgcctccccatctcaacgccaatgcagaacctgtgggagctccaaattcacagagctttacaggtctgtggaatgtatatagtctgtgattatgcacggcgaacaccttctctggtggcacgaagctccttcaatgaccgatggtggctgaaggagtgggaaattgcaaaggctgcagcgacttatataacaatggatggttgggcttcagctgaggccagaattgagcaactgcatggttgcagataggaagatttcagtggaatgcaaggaaaggtttgtggggggcactcctctcttttcccgcccgcccccccccgcggtaccccttcccgcggcggtgtgcggggttggttgatcccgacccggccggc

SEQ ID NO: 22201 - DNA, 4066 bp, Zea mays
  misc_feature (4043)..(4043): n is a, c, g, or t
cacatgtgaaattgcacaggatcttctttaccccggcggcgtgggcggtctgaccatcgatccaataagaagcgaaggccgacaggtaatacgcacgagcgctggctaccaacaaccttcaccatgaaagcaagacgtagagcctagttcgcagtttggcacaccacgagtcccagtctgtgatccctcgcacggcacgatggattgattgattcgtcattggttgcaaggtcaatcccgcgtgcccggccgaaacgatctcgtccctggcgggtccggtctcgtgcgcgtgcagtagttagagagaaatttcgatgtgtgcgcgtgcagtagttatgctctgcaatttcgtgcgtatacagtcagagagcaatttcgagatcgtgcgcgtgcagtagctatcctctgcaatttccatgcgtgcttgcagtagtcagagagcaagttagaaagcgagccgagcctttgagatgttcttggatgtgcttagtctatctacattactttcttaatagtttgtagttctagacagtttcaggctgcaaccaactttagtaattgtttgaagtattcaacttctttcatgaattttaggaacagacgactcttttgtttattgttatctttcctttccctgcatagatccttcatcagcttataattctgaagtatttctagcacagtctctttattatagcagatcagatcagattatggaatagatgcttattgttatgtctctacatatatgcttatttttttgtgaaactgttttcagttatggattaaacgaacaacttgtttggattagagtcatggacaacaaactattagtttcatttatcaaaatagttatgagacaccttgtgtttatattgtttctccaaatttttcttataaaccatcgatttattgttctttccttttccatgctactacctattttcacatcctttttacaacatttgaaattgaatatccagtgctcgtgattcttaagtaagtatatgtaataacctttatttcctgcattgtttggctggcccactagcaatttttatggtgaatacctaaagatttttcactcaactactttggtcacatataaaattctatgatttataaacatgcaattttagtagatgtatcaacgaccagaaaatgacgaccacctgtaatatgtggttgtgaggagtctccacggcacagtgcaagctttgtccaatctagccggcggcacagtgcaagcaccttactatttaaaaattgtcactccattgtttgcatcataccttgagatctctgattctctgatgcatgtgttttggagctgaattcttttatggtgtttgtcaccttggaacacacagaatcatattgatctttgctttcctttgcattgctcaacatcatactcatttactgtaccatttttttcagcttgcagtcatactgatcagaattgttattgttctttttcagatttagattgtagagcaactatgtctgtgtttgtcaccttggaacacaaaatgtctactactctccccccataaggtgtgtggactccttaacaacaatatgttgtgaaattacactgatttttgcccatgcgttaggaccaaatgattgccccatttgttaggaccaaatgattgacccatgtttttgttattgtagtatattacagcctctcgctaaataacttgttttctactagaatccatcacaagtccctccaacaaactgcaagtaaacactatctatatttatttaattaatttccaccagagagaacaaaacctcaaaatatgcaaaaagttcagtcgtgtacagaaggaaaacatcaattttcaagagaaaggaaaggagactctagaacatactttcctatgcatcctgctgcaacttctaatgccagggctgtcctttccttgatattgccagctcttcaactgaggaacagctgtggaggatgatttctgtatcaacttaacgtatctatgtgagcaattcagcataattctgcccacgaatctctgaaaatacgagtttctgcttcttctgatctgctctgttccatgtggtggaacataatgcctagatattctcaaaagatagttgcattctttgcaagtccttgtcatacatgtctggtgctacctgcagctgttgctgtggctgctgattctggaaccaagaagcacatatcccttctatgttgaattggctctctgccttgatcacatcatcataaagcgtttggctctggttctgcatgactgtggtcgtttcggcaaaggagtcaggccacttaagttccgctactaggtgagcccttgtatctttttcttgtccaatgtctgtccatgggaagacactgttctccagaattgtgctcgtgctctgtggttcaaatcccatactgttgctccctctgctcccagtactgctactgctgctaggattagtaccatcccagtagaatgaatctactgcggtacttccaatgccagttcctccatgtcgaggattatcaggtggaagattcagccccattgatgtagagagggccgatggtgaaactggcggcatcactgtagttgctggcctgcagttgaagtcactctggttgaaccagagtgaattcatattcgccccatcgctgctgccactctcactgttgtagcctaaaggctgttggaaagggaaatagagagtttggcctgatgagtggcaggttgatggactctcgtgtccagcagtaagctgctccaggaacagctcctttggtggcagcttagggcgtgccaagtttggtgtttcagcacgattcttgtcgtacacgggcatcagcattgatgattgagccgtctcgctgaggagggggctcaagttccccagaggaccagtgcttgatgggttgacgtcgctggaccctgaggttctctcggtgctgatggtgggagctgcaccgccgcgatcagcctcagtaagtggcttgtgggtgctgggatcaatgcctttctgcctcagcttcttcttgatgcacgagttccatagattcttgatctcattatcagtcctccctggcagctgcgctgcaatttgagaccaccttctcatggaaaaagtaaagtgctaatatcagctaaattaccaactgctgctgtgcacatatgcagtctagaattctgatactacttcttcaggcttcaaatttacctgttcccgaggacagcgtgcagctcgatgatgaggtcttcttcgtcttgggcgaatgcccctctcttgaggtctggcctcagatagtttatccacctcagcctacaactctttccgcacctttgaagccctgcaacaatttgtcttctcgaatttagataattgaactgaccgagaggtatttgagagacaagaggggtttcagctggcaattggaaatgagaaaaatgcagaggggggagaagggggggattgagagttgataactgaggacctcggctcctctaccgcccctctgcagcccagcgagtttgggaacagacctccagcagccatggccatgctttgttatgtgattcatgagtttctcatcctcctcaggggaccagagcccctttctcagcttctgcttgtagcagcaagaatgcctccccatctcaacgcaatgcagaacctgggagctccaaccaaactcacagagcttacaggtctgcggaatgtataattatgcacgacgacgaacaccttctccggtagcacagagcttcttcgacgatgttctgaagcagtgggaaattgcaaaggttgtagcgacttatataccaatgaatggttgggcttcatctgaggccaggattgagcaactgcatggctgcagataggagatttcagtggaaagcaaggaaaggctaggggcactcctctccttttcttcgcaggacagccctttagcacccttcttttaaaggtggtggtggtggtggaggtggtggttgtggcttgtgccaagggatgggggtatagcccttcccttggcntctggctcccgtacccggccggc

SEQ ID NO: 22202 - DNA, 1501 bp, Zea mays
aatgaagatgttgaaaaaccatgttctttaactcatttgggttttttcagtcatagctagcttgaggggggtgatacaccattttatgtaaacaaaactcgccctagactattgcacaaacaatgaggaatagacccagccacccaggaagcatgctagcttcagcccccatgacagctgaatattaactcagccaaagtgcaaagctttaagagatttcactgactaaatttacagaacacatcatggctatgttacataaataatgatgcacaaactcaatggatcatatattgagtctcaccacattgaggcttcatagattacccaatctacatggtaggtagatattcatgaatagtttcttccttttttctttcctgaatgtgtttacttcttcttgagaatgattgctcctttgtaccctatcaaatcaaccaatcgttttccattcctgtattcaagtagagcgccctcaagtagcttgggttctccacacagaaaagtttacgacagaaacgggaaagtgaaagggggaagaaaatagctctcaggtcaacattccaaatttcttcttacaaatatacaactgtcgtttgtcggcaacttatcaaaaaaaagaaaaagaaaatacaacatgcaataattaatttgcatggacgtgcatggcagcagttgaaatgtttgggtctacttgcatggtgagagctaccaacacatgcagttttgcccatggctgcctatatttatttaatttccaccagagagtgaacaaaaactcaaatatgcaaaagttgagtcgttgtgtacagaaggaaacatcatttttcaagataaagaaaaagagactctagaacgtacttttgtatgcattctgctgccacttctaatgccagggctgtcctttccttgatattgccaggtcttcaactgaggagcagctgtggaggatgatttctgtatcaacttaatgtatctatgtaagcaattcagcatagttctgcccacgaatctctgaaaattacaaatttctgcttctgctgatctgctctgttccatgtggaacataatgcctagatattctcaaaagacagttgcattctttgcaagtccttgtcatacatgtctggtgttgcctgaagctgttgctgtggctgctgattctggaaccaagaagcacatatcccttccatgctgaattggctctctgccttgatcacgtcatcatagagcgtctggctctggttctgcatggctgtggtcgtctcggcaaaggttccatggagcaagtcaggccacttaagttcctctaccaggtgagctcttgtatctttttcttgtccgatgtctgtccattggaagacactgttctccagaattgagctcgtgctctgtggttcaaatcccatactgttgcttcctctgctcccagtactgctactgctgctaggattagtaccatccccagtagaatgaatctactgcagtacttccaatgcca

SEQ ID NO: 22203 - DNA, 1958 bp, Zea mays
ttatatgtaaaagtaatatgctgaaatatagtaataatacatgtaaaagtaatatgctaaaatatattaacagtacatgtaaaagtaatatgctgaaatatagtaacaatatgctcaaatggttcttcacttgttctccagtgagcttcatcttgaaatagccatttagagccttagcacacatgttaaggtgaactttcttgaagcctgttgatgtcctgatcccttcaaccacaaggcttgctaggttactgagcatgcaagcggacattgcagaagtccacacaacatggacactaccatcagcttgttccacaaagcgctcaccagctccttcactctccattttctgcaatatggttatgtccagacatatacatcccatgaagaattttgacataaatgattgatgtccatgattttttttttttttttatttaagtcatgtgcatatagcaagaagtaatctcacacaatatatgaatacattaattaagtccatatattaatgtccataaataaaaattacagcaagaaaaacaataacaaattaggaagcatagtggttttgacgatcttcccacatctgatttgctatttcctgcctcaaattaaccatgaatgcatgttcactagcttggccacttgatgttgtagcatgattatgaattggccaattagattcttcaatgatcagctcatcacctccatcttgtatgacccaattgtgaataatgcagcaggctacaacaatatctacttgagtagaaaatggaaagaatggtgtggcatcatcaagtattttaaatcttctcttcagtgaaccaaatgcacgctctacggtgacacgaagagacgagtgcctaaggttgaacaactccttctcattttgtaccggattatttccccattcattcaagtgacaccggacagcacgaaaagggggcaaaaatccaggtttggctccatatcccgcgtccactagatagaattttccttgtggtacacgaaggccattctctcgctctaaagcatctcttagtactaaagcatcatgtgctgaaccctcccaaccagccaagacatatgtgaatcgaagatcaaaatcaacagccgccattacattttgagaggcataagactttctaccacgaaatgaaggttccatatctatggaaaccaaagctcttatatgtgtgccatcaatagctccaatgcaatccttaaagtagggatcccatcttggatttcctgctattttggatggagtctctaatgatggtggcctaataagttcagctcgtagctctccaatagcacgaagcactttgttgaagtagcgactaacagtctcaccagatctaccataatttgttcccaccaacctattcctaaggttgtgtcccactgtgttcaaaaacatggccacttgttcctcaacacacatgtgtattgtatcttcaagtaaaccccggtctctaaagcccttacaaaagcgaaagaaactagacctactaagtctaagcatgttcacacatgttgtatcactcatccatattttagtgttaagataatcaagtctcatcctatccctttcctccattggcccataagtaataccgactcttctattatctctttttctttttctagactcaataaccatggccatcatggacaacaacaagtgtgctgaagcaccataaatcaaaagcttggtcgccttgtccatcagttcttggaatccaacgcctggacggacggtcgctcgcctggacgattggaccagttcgcttggacggacgcctagacggacggccgctcgcctgcgcctggacggacggccgctcgcctgcgccctgctgccggcgcgactggacggccgctcgcctgcgcctgcgccgcacttttctccgccgccaagataagaataagaggggatcccggccggcctcgag

SEQ ID NO: 22204 - DNA, 1454 bp, Zea mays
aaaaaagcatttcaaaacaatatttcaaacagtacttcaaaacaaacaaactgagcatacaccattacaatgaatctcaaacccagtatttcaaaacaaacaaaccgagcatccgtgttggtcataacaaacccagtatttcataacaaacccggtatttcgacatagcaaagccattattacataacaaaagaacaacatagttctaatttccacttaacctccagcatagtcctaattcctggtcctcataatctaaggaaggttctcactaacgaagcgagcaagcaaacttatctgatatgtcaatgggagagtagggaactgccttgccaatccaggatttttcactagatatgcaaagtaaaaggccttgtgtgtgtcatcaaaacctggaatactttgcaatgtttgaagcaagtcaggtggtaggtcatctgaaccagccttctcaatagccattgcaagcctttcagcaccatctttgaatgctccaatcagccctgcctcttcattaccagtaacctttgccttcttcctaggtctaggagctgaggatgaagccccaatatcatctataggactaggaacagcattaccatctccctcatcaatctctgtttcagccatactgtttctatcttcagtacctagagcttcacttgatccttttgcatactttcctgtagccatattgtttccaaagacaatgaacatttccttatagttctccaaaggcttgtttaaaaactcagcatcagatttgtgatcctgcacatagtttgcataatgttcatgatcaagagtgatcatgtagttatcttcgttccaagaagcagcacttaacttcctaagtctgtttatcttcgcatatcttctcttccatgtcctcaaatggttcttcacttgttctccagtgagcttcatcttgaaatagtcatttagagccttagcacacatgttaaggtgaactttcttgaagcctgttgatgtcctgatcccttcagccacaaggcttgctaggttactgagcatgtaagcggacattgcagaagtccacacaacatggccactaccatcagcttgttccacaaagtgctcaccagctccttcactctccattttcggttcttggaatgtgttgtgcgtagaaaagttctgccgctcgtctggatggaagcctggacggacgcctgctcgcagttcgctggacggatggccgctagcctgcgctggacagacggtcgctcgcctgcgcctggacggacggccgccccctgctgcccgcgcgactggacggccgctcgcctgcgcctgcgccgccgccaagataaggttgagaggggatagagtaaggatggaaggcaagacgatttttacggccgcgagaggggcgggggcggatccatccgttcgtttttgctggacagcgctgccactgaaaaatggtttgg

SEQ ID NO: 22205 - DNA, 1264 bp, Zea mays
gtctcaaacccagtatttcaaaacaagcgaaccgagcatcagtgttggtcataacaaacccagtatttcatagcaaacccagtatttcgacatagcaaagccattatttcaatcccagtacttgaaaacaaagtattggtcatggtttacataacaaaagaacaacatagttctaatttccacttaacctccagcatagtcctaattcccggtcctcataatctaaggaaaggtctcactaacgaaccaagcaagcaaacttatctgatatgtcattgccaatccaggatttttcattagatatgcaaagtaaaaggccttgtgtgtgtcatcaaaacctggaatactttgcaatgtttgaagcaagtcaggtggtaggtcatctgaaccagccttctcaatagccattgcaagcctttcagcaccatctttgaatgctccaatcagccctgcctcttcattactagtaacctttgccttcttcctaggtctaggagctgaggatgaagtcccaatatcatctataggactaggaacaacattaccatctccctcatcaatctctgtttcagccatactatttccatcttcagtccctagagcttcgcttgatccttttgcatactttcttgtagccatattgtttccaaagacagtgaacatttccttatagttctccaaaggcttgtttaaaaactcagcatcagatttgtgatcctgcacatagtttgcataatgttcatgatcaagagtgatcatgtagttatcttcgttccaagaagcagcacttaacttcctaagtctgtttatcttcgcatatcttctcttccatgtcctcaaatggttcttcacttgttctccagtgagcttatcttgaaatagtcatttagagtcttagcacacatgttaaggtgaactttcttgaagcctgttgatgtcctgatcccttcagccacaaggcttgctaggttactgagcatgtaagcggacattgcagaagtccacacaacatggccactaccatcagcttgttccacaaagtgctcaccagctccttcactctccattttcggttcttggaatgtgttgtgcgtagaaaagttctgccgctcgccccggggcggcagcctcgacgaacgcctgctcgcagttcgcctggacggatggccgctagcctgcgctggacagacggccgctcgcctgcgcctggacggacgaccgctcgcctgcgcctgcgccgccgccaagataaggttgagagggg

SEQ ID NO: 22206 - DNA, 533 bp, Zea mays
ccatgtcctcaaatggttcttcacttctcctccagtgagcttcatcttgaaatagtcatttagagccttagcacacatgttaaggtgaactttcttgaagcctgttgatgtcctgatcccttcagccacaaggcttgctaggttactgagcatgtaagcggacattgcagaagtccacacaacatggccactaccatcagcttgttccacaaagtgctcaccagctccttcactctccattttcggttcttggaatgtgttgtgcgtagaaaagttctgccgctcgttggacggaagcctggacgaacgctcgcagtttgcttggacggacgcttgctcgcagttcgcctggacggatggccgctagcctgcgctggacggacggccgctcgcctgcgcctggacggacggccgcccctgctgcccgcgtgactggacggacgacctcctgcgcctgcgccgccgccatgataaggatgagaggggatagggtaaggatggaagacaagacgatatttttacggtcgcgagag

SEQ ID NO: 22207 - DNA, 1182 bp, Zea mays
cgcaaaacagaatacatatcaatttaaatctcccttcatcatagtccgctattcataaggtaaggatacaataaacttccccagtgtcccgagcacacaaactgctactataacacactgtgtgaatgtgaccaaaactgcaacaattaggccttgttcagttattcctatacctcatggaattggaaaggattggaaaaaattatgaaggattttgacttgatatggaattaatctcactcaaacccctccaatccatatggtgcgggcaaaacctatttaatttaatacctttccgccaacctagctgatacagcccttagcttagaatacactttgccagcaggagaacccaagatgagactgcaaagtgaatcccgcgcgaccttgatgttaacgaaggatccaagtatgtggatctttgtatcagcgatgacgatgcgggtcctggttgagttctcaatggcgtacttggtcttgcctcctttccctgataagcggccaatagcgcgcgacagatgctcccctcgcaaggtcttcacgtccttgatctcaaaggaatccacatacagatcatcaagacgcagcaaggcgacggcatcagcaatgtcgaacccgagcataaaagcatgcacaaagtcagcacatttctgaaggttgctgacatctggtgtgtcttgccttgtctttagctccaccctcctcgccttgagattcatgcgtatgtcgatcttcatatgctcgtaaacgggtgtgtagatttccatccagcatcgcttgagcggcgcgaaccggtgctgcggcacggtcactttccggaactgggtcctcccgccgctcatctcactcggcatcagagcatcaaaccgcggcttctccacggtgcccagccccgtcgcgtggtccaccgccatctccgaggaggagccccccgtcgcggacgccatcgagtgcgttttcagcaggggcggatctactggtggcgctcttcgccggggaagaaatcggcaaaggactcagcaccgtagagcagcggcagcggcagcggcggcggcgtagcccacccagtcgtcgcaaacgggagaataggcggaggcttgtggcccgtcgggttgttccccacggatatatatggcaaggggcctttaatggccggtcccggccagctcgggggtccccaag

SEQ ID NO: 22208 - DNA, 1084 bp, Zea mays
  misc_feature (1)..(1): n is a, c, g, or t
  misc_feature (270)..(270): n is a, c, g, or t
nccccccctgagggttggcgggtttcatttttttttttttttttttgggtacactcattcccccctcaatacaaatattttggattttaatgggttagcttaggaaaataactaattttcttcaaaatcaacccccaccacatggattgtggtggcacaagagcacatgtacacaccaatttaaatctcccagcatccccgagcacacaaatccgctagtaaaacatactgtgatcaaaactgcaaccgtttacacggtacaagcaaaanccaatctaatttaatacctttccgccaacctagctgatacagcccttagcttagaatacactttgccagcaggtgaacccaagatgagactgcaaagcgaatcccgcgcgaccttgatgttaacaaaggatccaagtatatggatctttgtatcagcgataacgatgcgggtcctggtagagttctcaatagcgtacttggtcttgcctcctttccctgataggcggccgatagcacgcgacagatgctcccctcgcagggtcttcacgtccttgatttcgaaggagtccacatacaggtcatcaagacgcagcaaggcgacggcatcagcaatgtcgaacccaagcataaaagcatgcacaaagtccgcacatttctgaaggttgctcacgtccggtgtgtcttgccttgtcttcagctccaccctccttgccttgagattcatgcgtatatcgatcttcatatgctcgtatacgggtgtgtagatttccatccagcatcgcttgagcggcgcgaaccggtgctgcgggacgggcactttccggaactggggcctcccgccgctcatctcattcggcgtcagagcatcgaaccgcggcttgtccacggcgcccggccccgtcgcgtggtccaccgccatctccgaggaggaaacccccgtcgcggacgccatcgagtgcgttttcagcaggggcgcatcttgtgacgttttttgcgtggcgtagggcggcggcggcggtagagagacgtcgcagatagagagggagagggcacggcggttggcacttggtccaggccggcaaggcggcgggcc

SEQ ID NO: 22209 - DNA, 1118 bp, Zea mays
gcaccgaggtcgacggtatcgatattttttttttttttttttggctacactcatacccacctcaatacatatattatcgatttatagtgggttaggataagaaaataactaattttcatcaaaatcaaccccaccacatggattgtggtggcacaagagcacatgtacacaccaatttaaatctcccagcatccccgagcacacaaatccgctagtaaaacatactgtgatcaaaactgcaaccgttacacggtacaagcaaaaccaatctaatttaatacctttccgccaacctagctgatacagcccttagcttagaatacactttgccagcaggtgaacccaagatgagactgcaaagcgaatcccgcgcgaccttgatgttaacaaaggatccaagtatatggatctttgtatcagcgataacgatgcgggtcctggtagagttctcaatggcgtacttggtcttgcctcctttccctgataggcggccaatagcacgcgacagatgctcccctcgcagggtcttcacgtccttgatttcgaaggagtccacatacaggtcatcaagacgcagcaaggcgacggcatcagcaatgtcgaacccaagcataaaagcatgcacaaagtccgcacatttctgaaggttgctcacgtccggtgtgtcttgccttgtctttagctccaccctccttgccttgagattcatgcgtatatcgatcttcatatgctcgtatacgggtgtgtagatttccatccagcatcgcttgagcggcgcgaaccggtgctgcgggacgggcactttccggaactggggcctcccgccgctcatctcattcggcgtcagagcatcgaaccgcggcttgtccacggcgcccggccccgtcgcgtggtccaccgccatctccgaggaggaaacccccgtcgcggacgccatcgagtgcgttttcagcaggggcgaatcttgtggcgctttttgcgtggcgtagggcggcggcggcggcggtagagagtgagagacggcgcagatagagagggtgagggcacggcggttggcactgggtgtaaggcgtcgagacgaggcggaggcttcccggccggcctcgtgggtcccaatg

SEQ ID NO: 22210 - DNA, 1197 bp, Zea mays
agagcaaacacagaatacatatcaatttaaatctcccttcatcatagtccgctattcataaggtaaggatacattaaacttccccagtgtcccgagcacacaaactgctactataacacactgtgtgaatgtgaccaaaactgcaacaattaggccttgttcagttattcctatacctcattttttttttttttttggaaaaaaattatgaagaattttgacttgatatggaattaatcccactcaaatccctccaatccatatgaattgaggggaaccgaacatgcccttatacggtgcgggcaaaccccatttaatttaatacctttccgccaacctagctgatacagcccttagtttagaatacactttgccagcaggagaacccaagatgagactgcaaagtgaatcccgcgcgaccttgatgttaacgaaggatccaagtatgtggatctttgtatcagcgatgacaatgcgggtcctggttgagttctcaatggcgtacttggtcttgcctcctttccctgataagcggccaatagcgcgcgacagatgctcccctcgcaaggtcttcacgtccttgatctcaaaggaatccacatacagatcatcaagacgcagcaaggcgacggcatcagcaatgtcgaacccgagcataaaagcatgcacaaagtcagcacatttctgaaggttgctgacatctggtgtgtcttgccttgtctttagctccaccctcctcgccttgagattcatgcgtatgtcgatcttcatgtgctcgtaaacgggtgtgtagatttccatccagcatcgcttgagcggcgcgaaccggtgctgcggcacggtcactttccggaactgggtcctcccgccgctcatctcactcggcatcagagcatcaaaccgcggcttctccacggtgcccagccccgtcgcgtggtccaccgccatctccgaggaggaaccccccgtcgcggacgccatcgagtgcgttttcagcaggggcggatctactaaatgaagatggatgtatacccgatgatttatgcaaaaggctggtggcgctcttcgccgggaagaaatcggcaaaggactcagcaccgtagagcagcggcagcggcggcggcggcggcgtagcccacccagtcgtcgcaaacgggagaagaggcggaggcttgtgacacgtagggtttttcttcc

SEQ ID NO: 22211 - DNA, 3492 bp, Zea mays
ggccgctttttttttttttttttacagcagaaataaggagattaagaacgctcacaatcaactacattctcttgtgatcaaaacattgttgcagtgcgtgcaacagtgttagacgtcagcagaactggtcagcaactcaacacatcagcatgctaaataaatcttatgaacacggcatgcttagtcttcactgctatccaggacgaccaactacatcaggcatgaatgatcgagagatcctaacagggagtgtggaaggtgaagctacccgacctatagggaatacggaatagtgtacagtgccttcgctgctcagtgctgacccctcactgtccagatcaacagcgaaataatcagtgcatggcatccacgtggagatgagctcactaggctactagcagcagccagcagataccagttcaaaatccaccgagtttcaccgaaggaattgacgcccttctgggacacttaacaggtctatttggccgcataccaattctgtgcacacttggcatcaacagcaaggtcgaccttcaggatattggtgccatagaagggcttagacatgcactcaacaactatggacttggccagctccgcagactctgaaggcccttccagtatcacttcatcatgcacctgcaagagtagcgtccaaccaagctccttaagacgagtattcctgtctatctcaagcattgcacacatagcaacatcagctgcactgccctgtacaggagcattgatagcagcacgctcaatgtgacccctttggccagaagttgcatgagccatatttggaaaacggcgtgatcgcccaagcaaagtataaacttcacacttctcatgtgctagctgtttctgcttcatttgccaagccagaacttcctttctatcgctataccagagtttcagtgtgtctgttgcttccttaacagaaacctgcctcgccccggccgccccatgagccgttttcccatatgcaatggagaaatttagcatcttagctttcctcctctcagcaccaaaagcatccttcaacaacggcacaggaggtttctcttgaccgggttgaggatgccactcaagaattactctctcttcttcaacagcctcacgaatatgctgatacatgttcatggctgtcctggaatggaagtcgccgccagctttaaaagcatctaacatgcttttgcaatcagcaagatgcgccaagatcctgagttccagctgaccataatcagcaacaataagagtgttccctggagctgcaacaaaagcttggcggattttatacctatccttttcaagtccaggttggttctgtaaatttggtgcccttgccgataaacgtcctgtctctgtgttgatatttaaggaccagtgaatccgcccttccttacatgatatatgatttccctgtagaggaagaatgaagttggatattaacgagttaatagaacagatctcacacaaagctgcaatggcatggcatgcttcttttccttcctttcctcccccaaatgcatcatatgcagtaccataagaagaggtgtcttctagatcacaatgggaaatttcagaatgaataccacattcatcatcatttacatcatctgttgagtaaacaagatctgatggaaccttcccagccaaatttctcaatgcagccccactaactgaaggccaaccacttgcagtaaatatatcagttttcaggtcttccacaatgctgaaaaggtcaattgtgcgatactttggaaccttcttgccttctgaaacagcagtttcattgttaggcactttaatagctttactcttacggcaaacccgccccgcctcggggtctgtacaaagattaaaaacatcaaaatttatatcaatttgcgtgcaagaaatttctaggacacaaacttaaaaatgcattgactaaagttttttccttttgttttgtatttaatacacatacaggaaccttttctctctaagtgacagatggatgatgaagaatacacaaaatctggataacctaaggaactttgaagagagaataggtgagggttatacatgttctctataccaccgaagaagagttgtcgaatctgagtgtcactattaacattcatgtattttgcatcagggcaatacttagatgcccacttccgaaatttatctgcagctgattcgcgctgtgcaacagcaaccttttcaatctctgaaaggtaagcacggtcaacaagcattccagctgtttccatttttacaagaatagcaccgaaaggacaccaatactcctcgtagaaatcgtacaatgaacctccgggtctggggtaaccgtcaaaagtccagggcttcctttcaagcttgcttttcaagctctcataaagcctcaaggtactcatggaatctaacgaagaatagcagatccacaattctctgtcttctctttgtaaaatttcaacaggctcaattgcagtaatcttcccttctgacccatccttctttatttttttccgaccaaagatggttttcattgatctcttcccaatcttttgtaattcctttggaacaacacccatgaccctatgatcatttgtaagtccctcaagagaatatcctccatctgttcttcttgaagaatcccaaagtcgtgcaagatgcattgtatcagcatgaaatccagcaactttaattccatagttctctataacatgactatcaaaactatagttgtgccaaacctacataagaaaaataagctacttgcttaagattcaaacgatgagataatggaggtagatgtttaatcatattcctatatattctataaatagcaaagtttgactagagatggcaaaagaaggataaagtcagtgaaagaagataattcagcatgcaacacataataaagttgtaagcatgagtttagatttgactgtgatatattgtttacttccttaaataattgcaatgatttccatgtatactgcaataagcatatacaactggcggaacagagcagatgccagatctccaaacaaacgaacaaagaagtaagctgcatttcaccttcctgattgatgaatcctcaaaaaatgggacaaactccatgagtacatctggtccaccatctagcacatccacccaaatgcatgtcttgccatttccaaaatcagcctcagcacctttagtgccagagtaaatgctaaagcatgtgacctttccatggccaactggtgtctcttgtttaacattaatattagctacctgcataacattgaattctcctgaattataataccaaagagtcaatatgcattcaaaagggaagaaagtttcccaacatataactcagttgcccagtaatagggatgcaagacccacttttagtcattctaccgacccaaaacttactaaagtgacatgtcacttcattaatctagggaaagaagtgaatcaaaagagcatgctacgtaaaaaattagctgaccc

SEQ ID NO: 22212 - DNA, 1353 bp, Zea mays
  misc_feature (72)..(72): n is a, c, g, or t
  misc_feature (86)..(86): n is a, c, g, or t
  misc_feature (113)..(113): n is a, c, g, or t
  misc_feature (1234)..(1234): n is a, c, g, or t
accgagtttcaccgaaggaattgacgcctttctgggacacttaaacaggtctatttggccgcataccaattnctgtgcacacttgngcatcaacagcaagggtcgaccttcanggatattggtgccatagaagggcttagacatgcactcaacaactatggacttggccagctccgcagactctgaaggcccttccagtatcacttcatcatgcacctgcaagagtagcgtccaaccaagctccttaagacgagtattcctgtctatctcaagcattgcacacatagcaacatcagctgcactgccctgtacaggagcattgatagcagcacgctcaatgtgacccctttggccagaagttgcatgagccatatttggaaaacggcgtgatcgcccaagcaaagtataaacttcacacttctcatgtgctagctgtttctgcttcatttgccaagccagaacttcctttctatcgctataccagagtttcagtgtatcttttgcttccttaacagaaaccttccaatcacgagcaagcccatgggccgttttcccatatgcaatggagaaatttagcatcttagctttcctcctctcagcaccaaaagcatccttcaacaacggcacaggaggtttctcttgaccgggttgaggatgccactcaagaattactctctcttcttcaacagcctcacgaatatgctgatacatgttcatggctgtcctggaatggaagtcgccgccagctttaaaagcatctaacatgcttttgcaatcagcaagatgcgccaagatcctgagttccagctgaccataatcagcaacaataagagtgttccctggagctgcaacaaaagcttggcggattttatacctatccttttcaagtgcaggttggttctgtcatggagtaatttacatcacaggttcaacaaattatttgatgttggtatcacagtactagactatttaaaggaaccagctcacaatttgcaacacttgacaacatttctcatattttggttatctgatgtagtctgccgctgcttctcttgggagtacgcaggggagagtcaagaggatgagaggaacaggagatagatcgcaaggcgtagggggggaaggcgatcaccgtccccggcctggctgtgatggtcagccaggacgaccgaaggtaatctccctgtgtggagatctttattccttcaatgcctaatacaatcccggccaaccngggggtacccaaaaactgaaggccaattccctgatagactgggactgccgcacaacccaactgcctaacaaccatctactataaaatatgagatctaatctatctcttaactgaacaac

SEQ ID NO: 22213 - DNA, 2354 bp, Zea mays
  misc_feature (2114)..(2114): n is a, c, g, or t
ggtggtgtactcggtggagggaaagaggaaagcgagagataaaaaggctgggccccccgcgcggcccgccacttctatctatccccacctccttctccctttccgcccccggtttattttttcttcgtcctggatgcgtcggtcgcgtgtttgatctgactaagccgcggaggagggtgctagatgtccgtgcggtgggcggtggctcccgagggcgaccggagttaggtccttgccgccttcagtgcggtggggaagcgagacattgaaggcgcagaacccaaagaatgggtaagagaggaaagtggtttagcgcggtgaagaaagtcttcagctcctccgatccagatggaaagggagccaaggcccagaaggcagacaaatcgaaatccaagaggagatggccatttggaaagtccaagcactcggagccttccatatcgacggtgccaggcactgctccagcagtagctccgttgccatcaccaccagcaactcagccccactctctggagatcaaagatgtcaatccagttgaaacagacagtgagcagaacaagcatgcctactccgttgcgcttgcgtctgctgtcgctgctgaagctgcagcagttgctgcccaggctgctgcggaagttgtccgcctcacagcagttaccacggctgcaccaaagatgcctgttagttcgagggaagaacttgccgccaccaagatccagactgccttcaggggttatctggcaaggagagcattgcgtgcactaagagggctagttagattgaagtcgcttgttgatggaaatgctgtcaaacgccaaaccgctcacaccttgcaatgcacacaagcaatgacaagagttcaaactcaaatctactctagaagggtgaagttggaggaggagaaacaggctcttcaaagacaactccaattgaaacatcaaagggaacttgagaaaatgaagattgatgaagattgggatcacagccatcaatccaaagagcaaattgaggccaacctaatgatgaaacaggaagctgcactcaggcgagaaagagcacttgcatatgcattttctcaccagtggaggaattctggtcgaactataacccctacttttacggaacctgggaaccccaactggggctggagctggatggagcgctggatgacagcaagaccatgggagagccggttggcggcggcatcggacaaggaccctaaagaacgtgctgtgacaaagaatgcgagcaccagtgctgttcgagcacctgtatcccgtgccatctcgattcagagaccagcaacaccaaacaagtcgagccgcccaccaagccggcagtcactttcaaccccgccatcgaagaccccgtcagcctcaggaaaggccaggccggcaagtccaaggaacagttggctgtacaaggaggatgacctgaggagcatcacgagcatccgctccgagcgcccaaggaggcagagcacgggtggaggctcggtccgggacgataccagcctgaccagcacaccacctctccccagctacatgcagtcgaccgagtctgcacgggccaagtctcggtaccgcagtctactactgactgagaagcttgaggttcctgagagagcgcctctggcccactccgttgtcaagaagcgcctgtcgttccccgtcgtcgagaagccaagcgttgtgccgacagagaagcccagggaaagagtgaggcgccattccgaccctccgaaggtcgatcctgcgacgctcaaggatgcccctgctgcctgaccagtgaccaggccttatgtgattgttaggtttcgtgctcttttaacaccgtgatgtattatctgagttaggttgctttgttcgtgtcatcgtatgatctgtccgggttgattttgagacagttctaactgtgtttacagacaatgcgtgatgctaaatgtatgtgtggttggttggctttcaatgtactgatatgatagtatttgatttcaactttgctaaggacttgaggtgcaatgtgaatacactttgcgagtgtttgggaacaaaaattttctaccgtattgactcaatactgcagtattgaggaatattgtagtattatatatntttgaggtgtttgggaatttatttaaaacctcggccccctgggccgtagtattattaatactgcacttgctttgtagttttggaaactttggtctcaaccaaagtttttctctgtaaagagagcgtcgacgctcggtcccgttctgtccgtttagtctgaaccaaagtttttcccaaacattctgatatattggatattgtagtattcgaaaactgaaactgaagtactgtaaactgcag

SEQ ID NO: 22214 - DNA, 848 bp, Zea mays
  misc_feature (756)..(756): n is a, c, g, or t
aaccacctccattcacttcacccaggcaccgggagcgtgcgtgaccgtcacgaggaaggagatcgggagcgcagccgcaagccggcaagcggaagggaacggctcgtcgccggcggggccacctacccaggccggggtcaccgtccgggcggctggggtgggcgaatcgattctgcgtgcgcggctgggtcgaggtcgagatagcctttggacggggtgagggaagcgtgggataaaagcgagacattgaaggcgcagaacccaaagaatgggtaagagaggaaagtggtttagcgcggtgaagaaagtcttcagctcctccgatccagatggaaagggagccaaggcccagaaggcagacaaatcgaaatccaagaggagatggccatttggaaagtccaagcactcggagccttccatatcgacggtgccaggcactgctccagcagtagctccgttgccatcaccaccagcaactcagccccactctctggagatcaaagatgtcaatccagttgaaacagacagtgagcagaacaagcatgcctactccgttgcgcttgcgtctgctgtcgctgctgaagctgcagcagttgctgcccaggctgctgcggaagttgtccgcctcacagcagttaccacggctgcaccaaagatgcctgttagttcgagggaagaacttgccgccaccaagattcagactgccttcaggggttatctggcaaggagagcattgcgtgcactaagagggctagntagattgaagtcgcttggtgatggaaatgctgtcaacgcccaacgctcacacttgcatgcacacagcaatgacaagagttcaactcaatcta

SEQ ID NO: 22215 - DNA, 6962 bp, Zea mays
  misc_feature (2616)..(2616): n is a, c, g, or t
  misc_feature (6847)..(6847): n is a, c, g, or t
ggaccgcccatttaattatctatacggttagtattactccctacattctaatttataattcgtttgactttttcaccctaagcttgaccgactcgtcttattaaaaaatcataattattgttaatttttgctatgatagtgtttagtatataatatattttaaatgtggcttcaattttttttattttttcgcaaaaaaatgaatatgacaaaccgatcaaactcttcaacatagataaattttgacgagttttgtattaacagttcgtaactgcgatgaacaaggacacatttttttcggtagaaagtccagtcgagggtgcccgataattcctgcgttcaaattaatacaaaatcgatttgactcaaatttaacattttttatcgctctgatcgatattagataacgtgagttgtcttaatttaagaattctctgctgctttgttcaagacgaagggaagaaaaaaaatactaaaacctagtcctatatgaaattctctacaactattatttaggacccacacccgcttaaatattttgactacgattttccaaaacagccgaatccactgcctttaagcctattaggtcgactagagttggaagtttaattaagcaaattgtcgaacaaaaaccttgcttaaaataacctatctaataatcctaacaacatatcctatactagagcacacacaccacacagttaaaaatgtgataatggtttacaaaccttgatcaagcaagtctaactcattctaagataatttagcatacatacaccactccctagtaggatagaattcaagaacataaacttctagtgttttcaagcacattcataatccacatcaaatgacaaacaactcatgaattaaattcaagttacgagtgattaataatatttgtataaacatgtttaacaccatgttacactacccgccgtccccgtacaatggcgaaaaaaatgcgtgacggtaaaggtggctgggcgactgcccaatctggccttcggcacgtgcgagagcactggccaccgggaaccgagggcaacaacgatggccgtggccaccaccagtggcctccaccgagttggcaagatccggcaggcatcaggacgaaggacaaccgcgcgaggctggcgcgcgtagttttgaataaaaaacacacacatacaagaaaacggatctcatcgcaggtcgcagccactctcggttgcactgacaccaacgctattctaatcatatacgtactgatgtggccgttccatcggctttggcctttgctctcggctccactcgactactctctctcagtcaagtctcgctcctccccatgcatgggcctatccacctgtgggagtaaaagaatggcaggcaggtaggcagaggcaggcaaaaaaaaactgcaaaagaccagcagcgtttcacaggctactgcaccatcaactgataaaagctgtaaaaaacggccgagcgaagcctttccaggcctttttccaccgttgggggcgtttaatgacggagtcaccaaggtgtaaatgccccccatttaacacgggcatttaacgggatcaagttggaacggtaggggcgctgccgctgggtacttccgtactacccgctatcggttgcctaacacacggtgccgcagcaatcgccgcgaagaaagatcagcgtccgtccatgacgtgtgggccaccagccggttggccagcggcgggaccgcgggcctgcaggctgctgctgcctacaggccacaggccatgagccaacgccaacgtctcctactcgtactctaccagtcgtcgcaacgcaaccggctaacgtcttctgccgcgactggtctgcggccgcgtggcgggccccagctgtcatgctcccctcggcggggccgccccgctgccaatataagaggcgaacagggacagcgcctttcggctggcaccgggagcgtgcgtgaccgtcacgaggaaggagatcgggagcgcagccgcaagccggcaagcggaagggaacggctcgtcgccggcggggccacgtacccaggccggggtcaccgtccgggcggctggggtgggcgaatcgattctgcgtgcgcggctgggtcgaggtcgagatagcctttggacggggtgaggaaagcgagagataaaaggttgggccgcttgcttgcccttccacttctatctatccccacctccttctccctttccgcccccggtttattttttcttcgtcctggatgcgtcggtcgcgtgtttgatctgactaagccgcggaggagggtgctagatgtccgtgcggtgggcggtggctcccgagggcgaccggagttaggtccttgccgccttcagtgcggtggggaaggtgaggggctcagggcttttcggtgggtgcttgactcgcttcgacgtgaaagcttgcctttctcgcggtaaattcggatcttttggggtttcgcgcgccctgctgttcgtgttcggttcctctcggtacggttggctttgcctgaggttttgttctgggggtccgggtttctggctggttttgcgcagcgactgtggaagaggtgccaggctcagtcttcccgtttgtgtctcggccttccggtgagtngttccctgctgaacgcttacttgatcgagtgcccaaggatagaagttgccacacgaagcttggtttctgtgccaacgcccctttcttcttctgtgaagaaattgccgtttacggcgaagacttgtgcgctggctcagtttcacctagttcgtgcttatttttactcgatccactccaatctttggtatgcttgtaatcctgctatttcgtggtgaagacgggattttcttttctttttttctgtacgacatttgagcagtgggaactggggagctattcttgttgtcgatttgtgatagaagtccgtagaacctctcttgttttttagaacttttactcttggatgcatgaattatgagagagtactgctgacctttttttcgtgtttaacatcatgttttagttgctgatgcaaatactagattctgatggtcaaatatttgggtaccgcctttttttagtggggacattctggcacacctctgatctgttcttgtacttgcaatctttcagcgagacattgaaggcgcagaacccaaagaatgggtaagagaggaaagtggtttagtgcggtgaagaaagtcttcagctcctccgatccagatggaaaggaagccaaggtacgtcgaaattccttattcacaacaaaaaaaaaagtccacttggtgacatgtggctactatgaaggcccagaaggcagacaaatcgaaatccaagaggagatggccatttggaaagtccaagcactcggagccttccatatcgacggtgccaggcactgctccagcagtagctccgttgccatcaccaccagcaactcagccccactctctggagatcaaagatgtcaatccagttgaaacagacagtgagcagaacaagcatgcctactccgttgcgcttgcgtctgctgtcgctgctgaagctgcagcagttgctgcccaggctgctgcggaagttgtccgcctcacagcagttaccacggctgcaccaaagatgcctgttagttcgagggaagaacttgccgccaccaagattcagactgccttcaggggttatctggtaattcatctgcacttgtaggtcatttactactcacatctgttatcttgttgatgtcgtgcactacagccctatagtaagaaaattcagatcctctgactgctgtttgtcactgtcttgaacttgttagcacctgagaccatgcacgcaatgacgcaagcttccttttggttaatattttgtaagacatctgatttggttggtaaagcgttgctgtctaattcatcattgtgtatctctataatctgttcgttttagaatacagtcaagattgcacttgcttgtcgttttcaaacttatatttgtctgatatttcaaatattgtgccacttaaaagagatgctgatgctaatgttatatctaaaaaacactgaacatgatctattgagaatacttccactgattggattcactgacctatatttatatatatgcatatttctatgcgatattaattgcttgctaaatctgcaaaaaaccgaattttaatttttttaggcaaggagagcattgcgtgcactaagagggctagttagattgaagtcgcttgttgatggaaatgctgtcaaacgccaaaccgctcacaccttgcaatgcacacaagcaatgacaaggggtcaaactcaaatctactctagaagggtgaagttggaggaggagaaacaggctcttcaaagacaactccaattgaaacatcaaagggaacttgagaaaatgaaggtgagcacaccattttgatgcaagcaagagtctaagctacatgatatctagggaaaattaatgtttttctatcactactaagctacattgatatctaaggaatatatgttttatatcatgatttaaaatataataatgttgcacccaagtagttttttttttgggtactgatgttgcaactatagaataggacggtcctgacataagagatttcttacacttatttttcttatcagattgatgaagattgggatcacagccatcaatccaaagagcaaattgaggccaacctaatgatgaaacaggaagctgcactgaggcgagagagagcacttgcatatgcattttctcaccaggcaagctgtcccttctgtttccgcggggcccgccgggtatttttcttggtcccaacttctgttgttacatcgaattattctgctatacatgtatctctgtttcattctttcgccattcttttcccccctcacgcagtggaggaattctggtcgaactataacccctacttttacggaacctgggaaccccaactggggctggagctggatggagcgctggatgacagcaagaccatgggagagccggttggcggcggcatcggacaaggaccctaaagaacgtgctgtgacaaagaatgcgagcaccagtgctgttcgagcacctgtatcccgtgccatctcgattcagagaccagcaacaccaaacaagtcgagccgcccaccaagccggcagtcactttcaaccccgccatcgaagaccccgtcagcctcaggaaaggccaggccggcaagtccaaggaacagttggctgtacaaggaggatgacctgaggagcatcacgagcatccgctccgagcgcccaaggaggcagagcacgggtggaggctcggtccgggacgataccagcctgaccagcacaccacctctccccagctacatgcagtcgaccgagtctgcacgggccaagtctcggtaccgcagtctactactgactgagaagcttgaggttcctgagagagcgcctctggcccactccgttgtcaagaagcgcctgtcgttccccgtcgtcgagaagccaagcgttgtgccgacagagaagcccagggaaagagtgaggcgccattccgaccctccgaaggtcgatcctgcgacgctcaaggatgcccctgctgcctgaccagtgaccaggccttatgtgattgttaggtttcgtgctcttttaacaccgtgatgtattatctgagttaggttgctttgttcgtgtcatcgtatgatctgtccgggttgattttgagacagttctaactgtgtttacagacaatgcgtgatgctaaatgtatgtgtggttggttggctttcaatgtactgatatgatagtatttgatttaaactttgctaaggaaatgaggtgcaatgtgaatacatttgccagggtgcgggaacaaagtttttctacagtattgactcaacagacgtattaagcaatattgtagtattatatactttgaggtatttagaaactcatctaaaatctctatatactaaactgtagtattgttaatactgcacttgttttgcagttttggaaactttggtctcaaccaaagtttttctctgtaaaaagagcgacgcttggtcccgttctgaccgattagtctgaactaaagtttttccaaatattctgatgtattggatattgtagtattccaaaactaaagtaatgtgaactgcagtaatgctatgactaaagtatactatattatttgaaaaactacagttttaaaaaactgtgtttccaatcagagcctcactgtatgtcccgaccaataacgaaggcgtgttccatttgctccaccactagtgaccgaggcctgattgccctagcctagcagcaccaagaggtccactcatagtgccttgtccagcagtagacccggatggatggcccagatgttcactttaatcagtggatgcattggccattggtcagcgcttgcaggccacaggaccccagcccacacccccgcacccccagcttgctactaatagagtttccccccgagttcacagtttcagactggttttgctcgtcctgttgctccgcaagtgttcccagagacaggcctcagaacttcacttgtgcagttgtgctcgcagagacaggctctgaagtagggctggaaaaaaaagatcgagctcgatgagctggctcgggctcgcaacagctcggcttgactcgggccggctcgacgttcagaacgagcccgagccaagcctgttttttggctcgtgaaaagagcgagccagctcggctcggtgcagctcgcgagctgtctcgtggctcgatccaacaattctagggatgacaattttatccgtggaccgtggatttggatatccgtcggatatccgacccgacggaaaggatatgnatatgttttttgacccgcgggtaagacccgtatccgatccgagataaagtgggcatggatttggatattaaatctcacccgcgggtaatccgttggatatccgaaattaaccatt

SEQ ID NO: 22216 - DNA, 860 bp, Zea mays
gtttcagtgctattgtgccagagcacgctttattgtgcatttttacacttctatatccctttcatttcacaatatctgtagaggataataagtatatatagatgcctatcataaaacaaagaattttcagttctcttaggggggaaaaagaggaaaagggaaataaaattacacgggttttcaaaggatcagcgttcctttctctctggaactgatcgaatattgttctgtccaggctaatactacattatgactgcttttactgggagaacttcgctgtccacatgactctgtgaatatcctatctttttatccgtatagttcatgccgcgcgacattgtcagtcatccatcatctgcggcatctggatctcactaatataagatgtcaaagaagttccagaacgattaactgtcctgttgttgccacgacactgcaccaactgttgctgaagatttcggacaaaattattcaatctttgaatcatcttttcttgagtgaagattatctgatccttgacaagctcttctctacttgaaacatgtttctggttgcgagccgtagattccaactcgtttacaagctgttgcttccattcaaactgggacgtgattatgagtaccaccaacaggaagacaagcactacaggctttgacaccattatattgtatgagaggaaacagggcagcggctcatcggacgacgaagccgcggggctagtacggcgaggcgatgagacggtggcggcacgtggtagctgccgccggcgcccggctagaagcggttcttgggaggaaggggagggagcgcaccgggccggggaaagagaaaacctgaagaaactgcggaaaatggggagc

SEQ ID NO: 22217 - DNA, 4257 bp, Zea mays
  misc_feature (583)..(583): n is a, c, g, or t
  misc_feature (3307)..(3307): n is a, c, g, or t
  misc_feature (3953)..(3953): n is a, c, g, or t
tatatgtttctgttgttggctctcttcttagagtaggattggattttaaaggagatctgcagtaatttattattctagtgaattagtggcctggttaaatacttctactgtactgtgttcaaacatgacaatgttatggtctccgaattgattgcacaactgaaatccaaagcttactaggaatacttcatatttgggatagtgtctggatgctgttaaggatagatgctatctcgctgcctggtgtaactatacttcagtgatctatggaactatacaccgtttaattttaaaaacatacatgtacaaatacaacatgtattatcaattgccatttgtaaattattttatgagtccactgtcatggaattgcaaacgttttacgcaaattctacctttgaacatttatattagctatactattacgtgtcactaatgtgttttacttgttaaatctaaaacatctcagctccgctttgaacatttatgttggcactgttaggacctacgatattaatgtgtgtttggtttgtaatcttcaaacatcttagctctactttgaaatgctctattcttattagtncttttgttatcataaccaattgttcatttccaagaagactggtgccagattcttattagtcctgactcttgacctccacgtcaagaaatactcttaggactagtttgacaactctatttctataatggattttcattttctaaaaaatactatttttcggaaaatataaatctcttgccgttgccaaactagaccttacaataagaattttatgaggaaatagcataagctagaaaatctgatgatattaaagcatttgaaatgctgagaaagagattaaatctgtgtaaatgtgagaatcttacagtcaaaaatctgttggcattaaaatcgttatgacgttttaaaaaagttgcagcatgctgcgaaatggggagaaacggagactgtaatatgtaaaggcagagtcctctcctcactgaagaggtttcagtgctattgtgccagagcacgcatttaagggccaatttacacttctaaaacaccttcatatcacaatatctgtagaggataataagtatatatagatgcctatcataaaacaaagaattttcagttctcttaggggggaaaaagaggaaaagggaaataaaattacacgggttttcaaaggatcagcgttcctttctctctggaactgatcgaatattgttctgtccaggctaatactacattatgactgcttttactgggagaacttcgctgtccacatgactctgtgaatatcctatctttttatccgtatagttcatgccgcgcgacattgtcagtcatccatcatctgcggcatctggatctcactaatataagatgtcaaagaagttccagaacgattaactgtcctgttgttgccacgacactgcaccaactgttgctgaagatttcggacaaaattattcaatctttgaatcatcttttcttgagtgaagattatctgaaacaagtataaggttatagccaaatttgaatactgctgccaaaaaaagatctcttccagtcctctagtacgacacaataattttctttctaaccaaattgcaatgtgctgggacaacaacataagactatatctaatatgaggttactgaacacatctcaacgcttacacttaccatgaaaataaggtcttggaagcaataatttgcatgttattagagccctgctattcaagctccttttcatctcaaattttgccactatctaaaactaaaaaaaaatcgcttaaagcattcagatacacaaagtgagtcgcctcacctgatccttgacaagctcttctctacttgaaacatgtttctggttgcgagccgtagattccaactcgtttacaagctgttgcttccattcaaactgggatgtgattatgagtaccaccaacaggaagacaagcactacaggctttgacaccattatattgtatgagaggaaacctagaaacaaattcatcaatgaacgcactaatatgcagacattgctattcatctgaaaatcacgaagtgcttttaaaaataatatagggaagtgaataaaaggtacgcaaaccaaatcacgacctttcctttagtacttgtttcaatgcgctacatacaagaacaagattagccccttcgatgctattccaatcagtacttgatatttccccatcacaggcaactgaactactgaagtggaagtgtatggtccatgactcatgagactcatgacaataactgttacagcaattaccaagattcgcgggcaaatccaattctcagacacgcgggcgctcgaaacaaaatcgaccaatatggtagggatcccctatttatttatttattttaaaaaataaactcgagtgaactttgggggccaacgccaacatgtcgaggcgcgccaacaggagcaattagcagacgctatcgcacaaggggggcactctactaaatttggttccgttggcaacacaacgatcaccgcacagggaccgacttgcgccacgcacgcacgaagcgaatgaacgggcgggtcacggaaaaagacgagaagagaggaggggggagcggccgaccaggagaggatagctcacagggcagcggctcatcggctgacgaagccgcggggctagtacggcgaggcgatgagacggtggcggcacgtggcagctgccgccggcgcccggcgagaagcggttgcttgggaggaagataagcgaggagaggaaagagaaaacctgaagaaactgcggaaaatggggagaagcacggcagcgggcggggacccactcggtttggacgttgtacgaatcgtgcggttgtggtttccgcgactccgcctgtccgccgtctgattatggggccttcgacggttggagatggaaggtgtgcttcgttaggtgccttgtcctttcggatttcccccctaatccgcttagtttgaaattttaaacccctcaaaaataggaggaaaataagggtttgtttgagagcataggattgataaatagttagagattttaacattctcaatccccttgctccaaagaagccatggtggggaaaataactaatatgttccccaagcccatcgaatttcagagagaatttgagtttccaactagcactcaaatttacagcgggttttcttacaattccattcccaagtcagcaaggtgaacaatgaaaaatctcagctgaactgtcaaatttctacgatatatgattagatgagttttgtttgtaagatagntgtttaaacttgtcgttgtgttattttggtttttaataaacttataaaattctcattgaatacctaaattataaaattctcattgaacccaaatatatttaaccttagctctccatgtcagatatataggactcaataaatcagttgaacctcctccctcactcttcttactctatagtcacctttgtctctcttctccgttgagccccctagagattgtgtgcctgagtgacagagtgagtgtatctctatcataactataatgaaatgtgtgccactatcgtcatccttgtcctcatcttcttgcttccatacttccgcgttagggtgtacaaatttttggatggctaaataagggtgaccatttatttaaaattttctagcaaatacacattagacaaatagttagcataaaagaatatcataatattcactaccagtatctgtagcttttaagaataaggtgatcaagacttacatggtcctactgcttaagagatcaactaagctatgtcactagaattgataaactagctaggtttgttctctaggatgacaagttctgctgaatagcacaaataatgtaagagtagagtaacaatcaataccacaaaaagaagacaatatatatctatgtggtttagtnatgtgccatttacttacatgcactttgaggcaagccaaatgatcattgatcctctaccaacctcaacaatccaacaagattggcttcggcataagtgcatgatctttaattatctctatcactaggtgcttacaaatactagatatatggatcatattttataaatttcatatggagggaagcgaaggcagcacaaggagccatcaggaaaggtgtatcaaggtgaaacaacttcgttaagggaatttggctatcaaatcataatatcaagagttggtccattttgcttctagttaagtggata

SEQ ID NO: 22218 - DNA, 1789 bp, Zea mays
acgagcaaatatagtttgacatgcttccggttgcaagagtccagctgattaccgaggtccaactagccagaaactggttgtttctgcttcaactaaacaagacaattaatcaacttcgcagctcatgcagtagagcgtgcaaagaattttacaaggactgccaagaacgataggcttacaacttcacatacccttacaaggatgatgaccagactgaaacctgcacccttgccaggattgcttatgagcaaagaataagctccccttttgcagcgctcgtcatttcaattctgatttccgtttgcctcagctcattgacacttacatcagtggcattgcttgttctgcctctttcttcaccaattgcgttgctagcttccgttacgttctcagaggagctaagccactctgcctctgcctctttctctgagggaggagagtttctactgtcgccttcatcaacactttccctcactgatttccattctagccttcttaagaagcattcctcaatatcatccagtgatacgtcttcactgtcgttactgtatctaatgtaaggcagatggaaatcggttgatgtgtgcctcctggacacaccaattagctgctcactgtctactctcagtgcagtggccttgtcaatatctcttggtcttccgttagcactgccattatagtttttctcactgccactatcatgttcatcatcctgttggtcatggccatcatcctcgtcaagttcaccggatgaagataacgaagatgaaaatgacgaataggctcctgcatcatcatcttcgcgttcccgaagtgttttgagaattaaggttttgagcaagttcatcacttgaacagcatgcatcagtgctgtcagaggatcggacatctgtgtcatatttggtgcaaaaaccatggcaacatttcttgcattcatcttattcgactcctcttcctcaacaacatcagccatgagctcaacgacccaatgaagaagtgcagcctgggttgctggaagaagcttcacgagctcaatgcattgctcctctgtgttgcagtgaaggacttgctcaggtgaaagcctgtcaagcacgccttcagggagttctctgaaccaggccttgatcaaactagcaaggcagtgcacatcgatgtcgtcaggcacgatgccgctgttgagctgctccctgacatgctcctcctggctgttttccggggtgatccggaagatcccctctgccttgagtccatcctgcgcgtacagcctctcttgcatgagcagaaggatcttgggcaccgagttccccttgtcatcgtagccacactgcatcgactccggtgataccccgaacacgctggcgctggcgctggggacctggccggggatctcgagctcgaactcgacggggaggccgaggaagccgtggaggcggtcgaaggtgacgtgcgcgacgtggcggacgtctgtgggccagccgatctccatcccccacgccgcccccgatgggtcgtcggcgtccgccatctggcacggtagcaccaccgacttgcggagcgcggccagcagcagcgccagcacctgcccctgtccctgcccctgctgctgcccgtcctccgccttcccgtcgcttcctacaccaccaccctcgccgcagccgtgggagctgggtaccatcatcacctcaaccatggtcactcctcgctgcggtcgtggcacctcacgggcacttggtggagctgagccgaggtgagtgacggcaggcaacctcgatttggggaaaccggtggc

SEQ ID NO: 22219 - DNA, 1799 bp, Zea mays
ttttttttttttttttttttacgagcaaatatagtttcacatgcttccggttgcaagagttcagctgattaccgaggtccaactagctagaaactggttgtttctgcttcaattaaacaacacaattaatcaacttcgcagccaaagtacaaactggcgtgcaaagaattttacaaggactgacggactgccaagaacgataggcttagagctacatacccttacaaggacgataaccaaactacgagcaaagaataaactccccttttgcagcactcgtcatttcaattctgatttccgtttgcctcagctcattgacacttacatcagtggcattgcttgttctgcctctttcttcaccaattgcgttgctagcttccgttacgttctcagaggagctaagccactctgcctctgcctctttctctgagggaggagagtttctactgtcgccttcatcaacactttccctcactgatttccattctagccttcttaagaagcattcctcaatatcatccagtgatacgtcttcactgtcgttactgtatctaatgtaaggcagatggaaatcggttgatgtgtgcctcctggacacaccaattagctgctcactgtctactctcagtgcagtggccttgtcaatatctcttggtcttccgttagcactgccattatagtttttctcactgccactatcatgttcatcatcctgttggtcatggccatcatcctcgtcaagttcaccggatgaagataacgaagatgaaaatgacgaataggctcctgcatcatcatcttcgcgttcccgaagtgttttgagaattaaggttttgagcaagttcatcacttgaacagcatgcatcagtgctgtcagaggatcggacatctgtgtcatatttggtgcaaaaaccatggcaacatttcttgcattcatcttatttgactcctcttcctcaacaacatcagccatgagctcaacgacccaatgaagaagtgcagcctgggttgctggaagaagcttcacgagctcaatgcattgctcctctgtgttgcagtgaaggacttgctcaggtgaaagcctgtcaagcacgccttcagggagttctctgaaccaggccttgatcaaactagcaaggcagtgcacatcgatgtcgtcaggcacgatgccgctgttgagctgctccctgacatgctcctcctggctattctctggggtgatccggaagatcccctctgccttgagtccatcctgcgcgtacagcctctcttgcatgagcagaaggatcttgggcaccgagttccccttgtcatcgtagccacactgcatcgactccggtgataccccgaacacgctggcgctggcgctggggacctggccggggatctcgagctcgaactcgacggggaggccgaggaagccgtggaggcggtcgaaggtgacgtgcgcgacgtggcggacgtctgtgggccagccgatctccatcccccacgccgcccccgatgggtcgtcggcgtccgccatctggcacggtagcaccaccgacttgcggagcgcggccagcagcagcgccagcacctgcccctgtccctgcccctgctggctgcccgtcctccgccttcccgtcgcttcctacaccaccaccctcgccgcagccgtgggagctgggtaccatcatcacctcaaccatggtcactcctcgctgcggtcgtggcacctcacgggcacttggtggagctgagccgaggtgagtgacggcaggcttttgattaggatgttctaggtaatggtctcgtgc

SEQ ID NO: 22220 - DNA, 2046 bp, Zea mays
  misc_feature (2024)..(2024): n is a, c, g, or t
ggccgcttttttttttttttttttggacaatggaagattaacggtgagcagtacaatgaaatgtaagagtgctgggacatttttttttttttttttggctgcaaagttgactgaaagcttaacttaaccattcctaaaatacaattctacagcttgtacaaaatttgcctgtcactactaacaccagtcacgattgaaaacacacaaaaaaaaaccatgtatggcaccccggatgaaacctaatcaatcaggagtttgaggtgttgtagactgtcgttgatttatctggggcatacaaaattacaggcttgcaactaaactaactcttgtcacttttcttcttctttcttttatgttttggtttgatagcatcttttagactctttggcgatccaatttcatgggcctcagactctccagcagccacagcacttgatgtgttcacctcagcattagatgattcagtcattggttgggcatcctcacggctgctggccttgaccatagttggtggatccggcaaatcagaaattttgagggatcttaatgaaactcctttagaatatgggtccctacatggcaaaaaaaaggaccagttggcaaaaaaaacttgtgtcgagcaaatgtttatgctaaatatctagaaattgggaaacaaaacatcagaccaatcactaccaatttgatgggccaccaatgaatgtggatgtttgtttgtgttttgcaattcggtccctagtcaagggtgaattcctttttatactttgctggttctcatcacctttgcttatctgctgaacatcactatgcatctgcatagattgcttttccaattcaccatcacctttgccgtccatagttacattagtgacattaattttctgaggaaccgaggttggcaaacgttttactttctttagggctttctcggtggtgtatgagtctactgctttctttattttgcttgttatatcagcagcctttaccgaagcaattcttaaacactgcatgataacacttgacatgacaccctctccaccagctttctgaatggcacaaacatccccatttgagttaactatagcagtcatcctccctcccattactgcttcttccttgtatgtgggatcaagaaccttcaccaaaatatgcaaatgttacagctatgggcatatggtgtatcgtaagaggaagtggatccctaacctcaggatcatgcactgtaacttgctgaccatcgtccccaccaaccgtgcattcaggcctccggaaagtagataaagctgccaatgcagcgatattagctgcatcaatgagattccctccgttatccaagatgtgaaggtccacacgcacagaccagacgtgcttcccagcaacaacacacaaggactccatgtcaacagctcgactctccctgaggccacggtcaataactcggccaagctcaattgctaattccccaggacgcccaggctcaaaggaggggtcggccatgggtgagaactcggtgaatatggccagcgtcccctcattcggcctgtcacggtatggctgcaccagctgcacggtcacgtagcccatcacgtgtgtctccccgagctgcacctctgacgagccatcctccctgccgaaggtgatcttgagcttgcggaagtcaaaggagtggcggccgtcaacacggaggtcagactggagcgcacactcaatgaagtcgcgctcgttcactgtggggcgccaccggaggtgctccatgaccggcaggcggacagtggcagatctgcagggcgccgccgcgccggggaaggaggaggggggcgcgaccgctgatcctgttgtcgagtgctgcagtgctagggcctaggtgcagggcgccgccgcgccggggaaggaggggagtgatgccgctgatcccgtcgccggtggcgcgccgccgtcgccgagtgctgggcctagggttcctcagttcgaaagactgtgcggcggctgggcacccgtgttagcggtagaggacagtgggcacncccggccgagcccgagggtacc

SEQ ID NO: 22221 - DNA, 1790 bp, Zea mays
ggccgcttttctgttggaacaaatatggcaatccttacgaccgtttggacaatggaagattaacgctgagcagtacaatgaaatgtaggagtgctgggacatcacgcatcacagaactagctgcaaagttgactgaaagcttaactgaaccattcctaaaatacaattctacagcttgtacaaaatttgcctgtcactactagcaccagtcacaattgaaaacacaaaaaaacccatgtatggcaccccggatgaaacctcatcaatcaggagtttgaggtgttgtagactgtccttgatttatctggggcatacaaaattacaggcttgcaactaaactaactcctgtcacttttcttcttctttcttttatgttttggtttgatagcatcttttagactctttggcgatccaatttcatgggactcagactctccagcagccacagcacttgatgtgttcacctcagcattagatgattcagtcattggttgggcatcctcacggctgctggccttgaccatagttggtggatctttgcttatctgctgaacatcactatgcatctgcatagattgcttttccaattcaccatcacctttgccgtccatagttacattagtgacattaattttctgaggaaccgaggttggcaaacgttttactttctttagggctttctcggtggtgtatgagtctactgctttctttattttgcttgttatatcagcagcctttaccgaagcaattcttaaacactgcatgataacacttgacatgacaccctctccaccagctttctgaatggcacaaacatccccatttgagttaactatagcagtcatcctccctcccattactgcttcttccttgtatgtgggatcaagaaccacgatgttaccttcaccaaaatatgcaaatgttacagctatgggcatatggtgtatcgtaagaggaagtggatccctaacctcaggatcatgcactgtaacttgctgaccatcgtccccaccaaccgtgcattcaggcctccggaaagtagataaagctgccaatgcagcgatattagctgcatcaatgagattccctccgttatccaagatgtgaaggtccacacgcccagacccgacatgcttcccagcaacgacacacaaggactccatgtcaacagctcgactctccctgaggccacggtcaataactcggccaagctcaattgctaattccccaggacgcccaggctcaaaggaggggtcggccatgggtgagaactcggtgaatatggccagcgtcccctcattcggcctgtcacggtatggctgcaccagctgcacggtcacgtagcccatcacgtgtgtctccccgagctgcacctctgacgagccatcctccctgccgaaggtgatcttgagcttgcggaagtcaaaggagtggcggccgtcaacacggaggtcagactggagcgcacactcaatgaagtcgcgctcgttcactgtggggcgccaccggaggtgctccatgaccggcaggcggacagtggcagatctgcagctacagggcgccgccgcgccggggaaggaggaggggggcgcgaccgctgatcctgttgtcgagtgctgcagtgctagggcctaggtgcggggcgccgccgcgccggggaaggaggggagtgatgccgctgatcccgtcgccggtggcgcgccgccgtcgccgagtgctgggcctagggttcctcagttcgaaagactgcggcggctgggcacccgtgttagcgtataggacagtgggca

SEQ ID NO: 22222 - DNA, 807 bp, Zea mays
tattcccatgtgactggatcaagtaaagatgcagcagctttcccagcgaagtttgagcatctttgcaaaataaccaatctgggaaagtttctttagaaacatccattaaaaaaggggtggaacctatccttgattattaatcccctttgtattggatataatttcatttgccttctcaagagtgtctttactacagtcacaagcaaagacagtgatcctttcactagaccgtagaatggaaacagcagtgcttccattcccacccccccacttctaaaaccttggcatgatcttggctgctacaaagttcaggaaattcctaaagcaaatatctcctttccttaaagaactttccggacgcatggcgacggtggaagcttctccaggcctccgacgagggctgcggcggcgaggtggtactggcggcggggtcgagaaagggggagaggtggtaggagaagacaggtccagattccacctcttccttgaggtcctcccattcgaaatcgcgcgaatggtactccgcctcgtccttgccggcgatctccacttcgcctcctgcttcttccacttccataggagcgcaccttgccttgttatcgaattagctagatctacctatccttttcatttcaattacggtctgcccgtcccgaggacgtcgcccaaagctcaagtcgccagaaggtgcgccgccgctgtcgggagggactaggagcgagcagggagcagagcctcccgcagtaattctgaaataagagagagaacgaattggaaaaaggcctccggaggccggagggtcccaag

SEQ ID NO: 22223 - DNA, 1623 bp, Zea mays
tttttttttctttttttgatgaaaaaatattaaataattaaattatagtgtacaaagagagctggataggaaaatggacggagacccctcgccggagaaagtgtttgtttttgtgtttttgttaaatataatcgaaagtactgataaagggtgaattttaaggaaaatggttggagaatggctattgggggtgggggagggcataatttcaatgccatttaagtttgtggctacaaaactgttacaacgctttgttgcaacaacaaagtggccgagcaaaactaacagctaagccctttggttatttctacaccatatggattgggatgagattggaaaaaattagtagagattttgacttgctatggatttaaatccacacaattctatccaattcatatggattgagctgaacacgaacaagccctaactgatgtcacctaggtggttttttgaatttgccatggacccatacccgccgcatcgtcttcccattctttcggttcacggacttgacacagcaatattccagctccaactctactagcccagcagcacgaaagagttctctcacagtatccaatgagaagaagtatgaaaaggtaccatctgatcgcatatattcccgaaaccctactctttgatgaggtaaaaaccgaagcattgtcatgtcataaagaccgtaatccctaaaaagaagaaggccgcctggtttcagaacagaaacacattgttctatggtagttggcattatgtcgaagggtatggctgacagtgtgaatatcatggtaataaaatccatgccaccagcacaacattggttctctccaaggaagactgggtgctcttctctaattccatggtgacttggatcaagtaaagatgcagcagcttttcccagcgaagtttgacaggctttgcaaaataaccaatctgggaaagtttctttagaaacatccattaaaaaggggtggaacctatccttgatattaatcccttttgtattggatataatttcatatgccttctcaagagtgtctttactacagtcacaagcaaagacagtgatcctttcactagaccgtagaatggaaacagcagtgcttccattcccacaccccacttctaaaaccttggcatgatctttgctgctacaaagttcaggaaattccttaagcaaatatctcctttccttaaagaattttccggacgcatggcgacggtggaagcttctccaggcctccgacgagggctgcggcggcgaggtggtactggcggcggggtcgagaaagggggagaggtggtaggagaagacaggtccagattccacctcttccttgaggtcctcccattcgaaatcgcgcgaatggtactccgcctccgcctcgtccttgccggcgttctccacttcgcctcctgcttcttccacttccataggagcgcaccttgctctgttgtcgaattagctagatctacctatccttttcatttcaattacagtctgcccgtcccgaggacgtcgcccagagagctcaagtcgccataaggtgcgccgccgctgccgggagcccgggagggactaggagcgagcagggagcatcccccccccctcgagggtcccaa

SEQ ID NO: 22224 - DNA, 1378 bp, Zea mays
ttttttttttttcatttttgcttttgttagttataacgatcttatgtcgtcattaatcaccgaaaccacttaggattcggatgctttcagttagttagtgtaacaaatatttatcttgaaatgacaggtgttgctttattcatagtgtaggatactactaaaaaaacagggcacgctaagaaaaaaatcctttaatcggtgaatccaatttgtggagctatcattcaaccccaataacttttccttgccaaccttcgaaaatggtcacgcaaagaaacatgacccttcctgttcagtcacctccatccacaactactcgagtgagataccctttggcgggtcaaactttgccccaagattgctcaatttggcatgagcttcagcgtagtcctcgaaaaatgtgtcctgatccttggcatattttgtagcatagatcttgaatgaggaatcctcaaacagcacagcatcagtaggcagaattaggaggtcttcatctcgcctttcttcgatagccttgaaatagctgttgtcaaacttgagccattgagatgtccaagattgtcccccaggtgcaccaggaccatctttagtgtactttgtttctgatttaccccagccactacgctctggtcttgcacgtccaagtgtatgagctcctgacagtgcaacgatttccttgtcgttcaggcccattctgtagaatacttcacgcaaatgttccgcgggtgaaggtgggccagcagcaggaagcctcccctctggtgggcattgttcgggggcaataacatcaacccttccatagatcataggaattttggggccacctgcttcctcaatggctgtggcgctggcaagctgaaacagatctgcataggtaacacctgaaaacttgtccttgataggttggatcagcttcagagcattcacaagaccagcattggccccatgcttcaactcgacttcgaatctcaagctaccattagctccaccacacttgggccactcggtaatgttcttgtcatatgtaccagcatcatgccaacctaatcgaaccaggatgggatggcaggaggtggccttgagcagctgcctgacgtcctcccgcgcgcccctcagctcggccgctgcgtctcccgccgccgcagagcccaacggacgcctcccaagctccttggaggcgaggaagagaccgcggatagggtggagcagtgagccaccggagaccccgcggcggaggaggtagtggacggccatgtcggcgccggcgccggagggagaggaagggtttagaggagttgcggaccgcgtcaatgcgaggctaatggaggcgtgcacatgagacttgatgcagggaggctactaacaaagtttataaatc

SEQ ID NO: 22225 - DNA, 2031 bp, Zea mays
ataaaaagccaaatccttttatagtttgaatgtctttattttgtgttgaagaccaaacggcatccatttcgtacaacaccacgagctgctaaaaacatttaaagaataaaaaacaaatactgctacactacgcataatacaagctcatacagcgaatggtgcacgaacgaattgagatatttacagtgagcagtcaattccgtttaagctacccaacagaatcctcaaccatagcctcctcgctgtcgctgtcgctgccatctgaacctgaatctgaatcaccttcctcgacgccttcatccgtctcagcgtcagacatcggctcctcgtttccagctccactcctggacatttgcttcctgaattcaggatcaacaatcccaatcatggcactaagaacacggcgatcatcggttattttggaactggcctgctcaacattattctggctcccagccgcctggccctctgagttcaccaaagttagcaaagcatcagctgccacgctacctccatcttcatctcgctctgtagcatctcccaagctccttggagattcgttctccccattgacagatggagctgtttccactgcccccctgccagcaacttctgaggccaacagatcacccgttctgatagctccaacatgtgtgtcatcccgtttgctctcagagcaagcaccctcgtgtttttcttctgaacagtggccgccgccatcatcgagaattggaataggaaccatatttgattgtggctgccctgcatctttgagcaatgcagtaggctcctcgttctctggaagcagcacttcgtcctctagcggcatagtctctcctccgatattgtcacatctttggtcatcgcaaccaacattaccagcttcgctttctgtctcaggaacttgctcagtatctgttacttccctctcaggagctgtaggaacaggattgccatgaaaacccggcctcctctccactgacctttctggactggtgcattctagatcttgagtgttgccaccattggcagtaacatcatcatcttgctgctcagtcatgttggcatcttcgtcactggaactatgttcacttacctgagtattttctggtgaagcaattgaagctcccagtgtattttttgagcagtttactggcttcataccagcattatcaatggctagatgctctttattgagatccacactcattaaggtgctctcatagttctcctcatcctccaaagttctctgcatagctttcagctgttcctgctgcttcgcaaacagagaagagatttcttctgtagttgaatagaaagcacgcagctgagtctcccgtagaataatccgttctctagccccttgatacctctgtttctcaattgatagatctctaatcgttgcagctatttcaagctcaagagctgagccctttgcccatgcttcttctcgagcagccttctcattctcgagttccttcttcagttttctcaattcagtttccagattttctgatttctttcgattgttggctgatactagctgctcgtcctgaagctgagcttccagctctcttactcttttctcggatgctacaagattatctcgagcatcttccagcttggacctcaaagtttccacaaacaaacgggtttctttttctgattcctgaagcttgttaataacttctttctgttctctttgttgtctaaggtaagactctgcttgtttcttaatttcttcttgagcctcggcttgcactttatgcactgcaaatttcaagtcatgtgcagccttatcacgctcttctcttcttaagttgcgctcctcacttagctgttcctcaagctcacggatgattgctttctggcttgaaattatctcatcagcatccgcgcgtgattgtttagatgcaccaagcctttcatccagatcttttatagagttctgtaactctgtatttgatgtactgagtgaatctatttgcttctgtttctcctcaagtgtggactggagagatttagtttgat

SEQ ID NO: 22226 - DNA, 5766 bp, Zea mays
ccaccgcctcagcccgtccgcccgcccgtcaccaaacgccgattaaatttaatacccttaaaagcgcccgcgcgacccagtcgagccggccccgcatcccattccgtgccaccgccgccgcgctgcgtctgcgtctgcgtgcgtcgcccgcagtgtccgcagccagaaccagcgcacgcgctgctccgccgacgccgaagcctcgtccgcgagcgcgtggggctaagcaagcactcgagctccctcgagcggcgggtgcagtgcagccaggccgcgcgcgccgcagcatgaacggcgtcggcgacgcgcacgcggccgcggccgcggccgccatggtgcagcaaacgctggggatgtcgctgccgatggcggcgttcgtgcccgagcagggcagcgccaataggctgaccaggccgccggggctgccgccgctgccgcaggcgttcgcggcccagcagcgcggggacgtgtgcatggaggccgtcgaccccgcggctggcccgcgcaaggcgcaccggcgctcccgcagcgacgtcccgttcggctacttcccgccggcgggccaccaccagctcccgccgcccaaggtggaggccggctggggcggccacctccccgccggcggcggcggcggcggcgacgacgacctgttcaacgcgtacctcaacctggaggggctggacgggctcaactcctccgacgaccgcctcgacgacggggacagccgcggcagcagcatgaggaccaacggcgccgacagcagcgagaacgagtcggaggagtgcgccgccgacagccgcgccgggatccgcctctgcgccgccgctgccgacaggcgggaggggctcaagagggccgccgctgcgcccgtggcgcgccacgccaggagcctgtccatggatagcctcatcggcaagctcaacttctccgccggcgcgacgggcgccgctagcggcgtcattccgggacccaacaggttcagcctcgagttcggcaccggcgagttttcgccggtcgagatgaagaagatcatggccgacgagaagctggccgagatggcgctcgccgaccccaagcgcgtcaagaggtaagaccgctacccgatgccactcatcttaaatctttgggacccccgcgcgtgggcgtggctccctcccattgttcttgctacttctttggacccgtcgaactggcaaaatgtttagcttcggactgatcgagctgcggtgcggttcgtcgcttgctagggtgctggccaacaggcagtcggcggcgcggtccaaggagcgcaagatgcgatacattggcgagctggagcacaaggtgcagatcctgcagacggaggccaccactctctccgcccagctcacgcttcttcaggtacctagctactctcccctacgctaatctctaatgcactttgaattgcagcgaaatcctccgtatcatcgttcgtgcgtgtgcgactcgatcacaacttcttcttcttattttgtcctcacagcgggactccgcggggatcgcgacgcagaacaacgcccccttggtccgcctgcaggccatggagcagcaggcgcagctgcgtgacggtgcgtcgtctcatcatctcactcacctgcacacctgcttcttcctcgctgtgttcgtcaacgtccggccggcggtgtgctgggcactatgagttgtagcatgctagaatgctaggtacaagtcttggataagcaataagttagcagaagcaactccaatattgacatgctggcttgtccggcccagttcgtgtgcccacggtttgtgaaagcctgaatcgtgggtgagctcgtgttggcatttggagacagccggcttggtggttggctgattttctatgcgatcccctcgcgcgataccggtagtcgttagcatgtactgctactggagcctaggaagatgtgctaaccatcttctgggaaccaagatttgctcgtgcttttgtttaatctcgcacccttccctccagtctccagataaaagtaatgtggttcctctgccgatcgatacgatgttaggtagtgtctcgatcccggactaattaaactgtagtatggattttgcatgtcttattagaaggacaaagcataagttaattataaagttagttgcataagctgtggttaattcgtgagaggaacctattaaacctaaataatccatgctcatgttttactacagtaaaaatgaaagtacggcagggtagcgtatcaaacatatgtcagctatagagtttaagtggtagcaacatgggaaattgatgaattgtatatgtttttggaggttaatgtcgtgttgtgttgtcttgttgaacagcattgaatgaggcactgacagccgaggtccaacgcctgaaggtcgcgaccgcagagctcggggattcttgctcgtccagcaacctagcccagcagatccaaatcagcgttcaggaccagatgtttcaactgcatcagcagcaggcaacgcctataccgttctaccagctgcagcaggcgcagcagaatggcgcagggaagaagcatgagccgacggaatgatctcagacctgccattatccaccgctgcgtgagcaggggaaaaaaagatcggtttcgatggactgaaaacatttcttttcctaactcattggttaagtgtcgttaataagcaccgtgcatttttttccaggtgatgaacctgctgcttgtacctgtttatttattctttggatgattcagttgcttgagttgccaaactgatcaaattgtagccggttaatattcttttatagttgtagtgtttatggatgcttttgcactttggtaccttacgttgacttttattcttgagttatttttgacttttctatattatgtctgaatatatagaaaatcaactgtatataaaaagccaaatccttttatagtttgaatgtctttattttgtgttgaagaccaaacggcatccatttcgtacaacaccacgagctgctaaaaacatttaaagaataaaaaacaaatactgctacactacgcataatacaagctcatacagcgaatggtgcacgaacgaattgagatatttacagtgagcagtcaattccgtttaagctacccaacagaatcctcaaccatagcctcctcgctgtcgctgtcgctgccatctgaacctgaatctgaatcaccttcctcgacgccttcatccgtctcagcgtcagacatcggctcctcgtttccagctccactcctggacatttgcttcctgaattcaggatcaacaatcccaatcatggcactaagaacacggcgatcatcggttattttggaactggcctgctcaacattattctggctcccagccgcctggccctctgagttcaccaaagttagcaaagcatcagctgccacgctacctccatcttcatctcgctctgtagcatctcccaagctccttggagattcgttctccccattgacagatggagctgtttccactgcccagctgccagcaacttctgaggccaacagatcacccgttctgatagctccaacatgtgtgtcatcccgtttgctctcagagcaagcaccctcgtgtttttcttctgaacagtggccgccgccatcatcgggaattggaataggaaccatatttgcttgtggctgccctgcatctttgagcaatgcagtaggttcctcgttctctggaagcagcacttcgtcctctagcggcatagtctctcctccgatattgtcacatctttggtcatcgcaaccaacattaccagcttcgctttctgtctcaggaacttgctcagtatctgttacttccctctcaggagctgtaggaacaggattgccatgaaaacccggcctcctctccactgacctttctggactggtgcattctagatcttgagtgttgccaccattggcagtaacatcatcatcttgctgctcagtcatgttggcatcttcgtcactggaactatgttcacttacctgagtattttctggtgaagcaattgaagctcccagtgtattttttgagcagtttactggcttcataccagcattatcaatggctagatgctctttattgagatccacactcattaaggtgctctcatagttctcctcatcctccaaagttctctgcatagctttcagctgttcctgctgcttcgcaaacagagaagagatttcttctgtagttgaatagaaagcacgcagctgagtctccctgcaataagcaccatagaggagggaggggggtagtaaaggattatacttatacgtaacttctaatgcacacacttgggattcttaatgtgtctatataagactggaacattaaccttaccgtagaataatccgttctctagccccttgatacctctgtttctcaattgatagatctctaatcgttgcagctatttcaagctcaagagctgagacctttgcccatgcttcttctcgagcagcctgctaacaaaaggatatgccttatcagcctgttagtaatggagaaacagccttctatgcatgctcatttcactggaacatttttaccttctcattctcaagttccttcttcagttttctcaattcagtttccagattttctgatttctgcaacagcaagggtgcagaagggggtaagatattatcagcaataaaactacaataaataaaaaataattagatgtaattacttaagtttagcatgcacaatgcttggtacctttcgattgttggctgatactagctgctcgtcctgaaactgagcttccagctctcttacttttttctcagatgttacaagattatctcgagcatcttcctgcatgagaagaacaagtaacaaataattgtagtgcagtaaaggaatggtagattcgaagcagtcattgtgaaatagcataccaacttggacctcaaagtttccacaaacaaacgtgtttctttttctgattcctgaaaacaggagtagaaggttattaactctaggatacgaaaaagcatgaacttgtgatcagactaactggagttaagtataacctgaagcttgttaataacttctttctgttctctttgttgtctaaggtaagactctgcttgtttcttaatttcttcttgagcctcggcttgcactttatgcactgcaaatttcaagtcatgtgcagccttatcacgctcttctcttcttaagttgcgctcctcacttagctgttcctcaagctcacggatgattgctttctggctggaaacatttcaaaattcaaagatatgagatcctcatgtaaatagtaatgtgtggaaagagatggacatgcgttgtcaaatggcaacaagttgacctcatgcaatgcagaataccttgaaattatctcatcagcatccgcgcgtgattgtttagatgcaccaagcctttcatccagatcttttatagagttctgtaactctgtatttgatgtactgagtgaatctatttgcttctgtttctcctcaagtgtggactggagagatttagtttgatcaagataagaactcgacgtagtttctctcaactcctcaagttcctacagcatcagatatgcaaaattttaatttgtagtattatgcaaaaaaatggaacatgatgattgacgagtacaagactaaagtaagtagaaacctaatcaatgacaacaaaagaggaactctaacagtttaacgtaaaagggaatggttatttccactcaaaaaaatatattcactt

SEQ ID NO: 22227 - DNA, 4417 bp, Zea mays
gtttttcggtgttagtcactgaaatcaaacatattacttgtttggaacttctagaattaatagtcagatgctaaaactaggtgtgaaggttgcaaacatcccaactaattgttagctaccttacaattcattggctgattcaatccaactaataatttgttatagttctaggattccaccatgtcaaggccggcctctcacggtcagggggacgcctccgatccgatggatcatcggcgacggtatcgctcgctctccgtcgtccgtccggccccgcaggcaggtgtgtatatggcgcgcgcacgtgtagggcggacggacggctcgccgaccagcgactatgcaagcaatatgcacatgatgcgggcgcgtacatgtacagcagagcacggcggtttcgacgacatcactcgggtgtccgtgtcccccggtgcgccttgtgtggtccgtcgccgtcgctacggcttggctctgagatgatgcttgacgtcgcgtcgtacctggtcggcttgccttctgtcaactggatgtcccgtgtctggtgtccggacgcactgctagctgctgccaaggcccaaggatcaggtcatcatgtgtgtctggcgttcctggtgcaaatgccacggtggctgcataggtagacccggcgtcatcccaatcccatccatgtaccagtataagaatggccgttgtccccgccggccgccgcggcgtccaggtccatccgcttcgccgaggcagacaagtggagacaaagcaagcggcggtcgaaccgagcccgcgctgcgcacacgtacggcgcggccaaccccccaccgcctgccagtcaccaaacagcgattaaatacgccgcccgcgcgacccagacacccggcccgcattccattctgtgccaccgccgccgcgctgtgtctgcgtctgcgtctgcgtctgcgtgcgtcgcgcgcgtgcccgcccgcggtgtgcatggaggcgttcgcggcccagcatcagggggacgtgtgcatggaggccgtcggcgtcgacaccgcggcgcagcagggcccgcgcccgcgcacggcgcaccggcgctcccgcagcgacgtcccgtccgggtactacttcggcggcgaggggcaccagctgccgccgcccaaggtggaggccggatggggcgggcacctccacggcggcgggggcgacgacgacctcttcaacgcgtatctcaacctggaagggctggacgggctgaactcctccgacgaccgccggcagtactacgacggcgacagccgcgggagcagcgtgaggaccaacggcgccgacagcagcgagaacgattcggaggagtgcgccgccgcaggcccgcccgtggcccaccacgtcaggagcctgtccatggacagcagcctcatcggcaagctcaacttctccgccggcgcggctgcggccaacggcggcgtcattccggggcccaacaggttcagcctcgagttcggcagcggcgagttcacccccgtcgagatgaacaagatcatggccgacgagaagctggccgagatggcgctcgccgaccctaagcgcgccaagaggtaaaactgctgccactactgaatatatgccactcactcatcttaaaacatgttgtttggctattgtcacaatgtgctacgaagcgaagcgaaacgaaacgcttgaaaactgatcgagctgtggtccgtccgttgcttgcttgctgtttgctagggtgctggccaacaggcagtcggcggcgcggtccaaggagcggaagatgcgatacatcgcggagctggagcagaaggtgcagatcctgcagacggaggccaccgctctctccgcccacctcacgcttcttcaggtcagcctatgctgcccctcgctgctcttgattttccagcgcacgaaatccttcgcgccgatcgtacagctgatcgtcgtgtgactcaaaccagcgggactccgcggggatcgcgacgcagaacaacgagctccagttccggctgcaggccatggcgcagcaggcgcagctgcgtgacggtgcgtctcctcacctgtactgcacactacttgctgcttaattcccagttcgttgacgttgacatgctggcttgtccggcccagttcgtgtgcccacggctctgaaactctgaatcgtgttggcatctggagacagccgggcggccgggttggttgctttggtggttggctgcttttctatggagtagtcgttagcatgtcgtacagctacaagtgcctaggaagatgtgctaagcatcatctgggaaccaagatttgctcgtgttttatttaatctcatcactctttctaaagaaatactagcatgtaggagtacccacatgtgcttcgagagaacatatatgttaatcccgtgtttctgttgtcttgtcgaacagcattgaatgaggcactgacagccgaggtccagcgcctgaaactcgcgactgcagagctcggcgactcttgctcgtccaacagtctagcccagcagatgcagatccaactcagcgcgcatgaccagacgttcgaactgcatcagcagcaggcgatgccgatagcgttctaccagctgcggcaggcgcagtgaagaagcatgaatcgaaggagtgatctcagactcagagacatcattatccaccgctgcgtgagatgtttgtttattctttggatcatacatcaaattgtagccgaccaatattcttttatactagctagtagtgtttattgatgcttttgcactttggtaacttgtttttgtaagtgcactttgacaccatgcataggatcgatacgatacacactcagatgtcttttgcggtgtaataatgtaagatgacatgattcagtctttggaaccacaattgaagatcaaatgtaaaaaatatattattttttcttttgtttataaaaaaaccaaaacgttttataattggaaaccaagtgagtacatatatttatttgtgttgaagaccaaaaggcctcgatttcgtacaacatgcaccacgagctgctgaggacactctaacgaataaaataatcaaatgcacacgaggggcttacgctacgcatgatgatacaacgaaaggtacacaaaacgaattgaggtatatttacagtgagcagtcacttctgtttaagctaaacgacagaatcctcaaccatagcctcctcgctgtcactgccgtctgaacctgaatctgaatcgccttcctcgatgccctcacccgtctcggcgtcagacatgggttcctcgtttccaactccgcttctgccggacatttgcttcctgaactcaggatcaacaattccaatcatggcactaagaacacgatggtgatgacgatgatgatgatgatgatgggttattttggagctgccacgctcaacattgttctggctcccagccgcctggccctctgagttcaccagagttaccaaagcatcgcctgccacgctgcctccagcttcatcgtgctctgtagcatcgcccaagctccttggagattcgttctccccattgacagacggagctgtttccactgcccagctcccagcgacttctgaggccaacagatcagccgttctgatggctccagcatgtgtgtcctcccgtttgctctcagagcaggcaccctcatgtttttcttcggaacagtgcccaacgccatcaccggggattggaataggaaccacatttgcttgtggctgccctgcatctttgagcaatgcagtaggttcctcgttatctgggagcagcatatcatcttctagtggcatagtctctcctcccgtgttgtcacatctttggtcatcgcaaccagcattaccagcttggctatctgtctcgggaacttgctcggtatctgtaccctctctctcaggagctgtagaaaccggattgccatgaaaccctgacttcaatctcccctctgacctttctggactggtgcattctagcccttgagtgctgccaccaatggcagtaccatcatcatcctgctgctcagtcatgttggcatcttcgtcactggaatcatgttcacttccctgagtattttctggtgaagcacttgaagctcccactgtattttttgagcagtctactggcttcataccagcattatcagtggctagaggcactttattaagatccacacccattaaggtgctctcatagttctctctcctcctccaaagttctctgcatagctttcagctgttcctgctgtttcgcaaacagagaagagatttcttctgtggttgaatagaaagcacgcagctgagtctcccgtagaataatccgttccctagctccctgacacctctgtttctcaattgatagctctctaatcgttgcagctatttcaagctcaagagctgaaccctttgcccatgcttc

SEQ ID NO: 22228 - DNA, 1608 bp, Zea mays
  misc_feature (20)..(20): n is a, c, g, or t
  misc_feature (1543)..(1546): n is a, c, g, or t
  misc_feature (1592)..(1592): n is a, c, g, or t
gcacgagaccattacctagnaacatcctaatcgaaaaaaaggattttgtttcgggtgaggtggggggcggcatggcgccacccgccgctcaggctcagctcctcctctccaaccacccctcgccgttgctgtcgccgccgcaacgtcgtcgcatcctcagtggaccgccgcctcgctcacacacctgcgccatccggcaccaccacggccacgacaagtgcgcctcctcctcctccactcgccttcgccacgccctccgcccgcccgccgccaccgccgtggccatcgcgcccggcgaccactggggaaactgggccttcctcctctccgccgccgcgttcggcacatgggcggaggagaacacgtcgtggggcgccgcgctcagcggggcgctggtcagcatcatggccggcctggctgccacggccgtcggcctcgtcacccccggggcgcccgcgcacgacgccgtcatggagtacctgctgccggccgccgtcccgctgctgctcctcggcgccgacctccgccgcgtcgtccgcaccaccggcgacctcctcaaggcattcctgctcggatctgttgcaagtgtaatcggcacgacggtggcctatctgctgatccccatgagatcgctgggccaagatagctggaagatcgcagctgcactcatgggcagctacattggcggagcggtgaactacgtcgccgtctcggaagctctaggcctcacgccgtccgtccttgccgccggcgtcgcagcggacaacctcatctcggcgctctacttcatggggctcttctcactggcgtcaaacatcccagcagagcccaagacggcgacggcgagtccgcagaaggacggcgagcggctgtcggtgctgaacggtggcgcggcggtcgctttgtccttcatcatctgcaaggccgggtcggtcatggccgcgcggctggggctccagggcggcacgctgccctgcgtcacggcgctggccgtgttcctggccacggcgttcccggcgccgctcggcaggctggcgcctgccggcgagaccctggcgctcatcctcatgcagctcttcttcgccgtcgtcggtgccaacggcaacgtcgtggacgccgtcacccgggcgcccagcgtcttcgccttcgcgctcgtgcaggtgtccgtccacctggccgtggtgctcgccgccggcagggttattgggatcgacaggaagccgctgctcatcgcctccaacgccaacataggcggccccaccaccgcagccgccatggccacggccaaaggctggacctcgctcgtcgtgcccgggatcctcgtcggcatcttcgggatctccattgccacgtttcttggcatcggatatggcatgttcgtgctcagaaggatctgcggctgaacaatttcttattgattccgagatgtgtctttaagtggctgtcgcgcgatagctagaccatagaacaatgcttgctttatagagctgctgaatgcctgaattaaagagctttcgctagagttcccacccaaaaaaaaaannnnaaaaaaaaaaaaaaaaaaaaaaaaaaaaaaaaaaaaaaaaaaaaantaaaaaaaaaaaaaaa

SEQ ID NO: 22229 - DNA, 3184 bp, Zea mays
  misc_feature (1075)..(1075): n is a, c, g, or t
aacgtctcgtattgaaaaaaatgtatgtccatgctcgttctcgacaaaaaagttgtcgtataaatatcgatctttagtgagagactcttattttttaccccacacttgtttgtctatcaaattatattcttgaaatatttaatggagaccattatttcatgaaaaaaactataagtgttaatattgccaaaaacgaacgaccatggcacatttaggcaaaaataccagtcatatgccctttgatcttctgaaagaggctcatattccttactgcacaaatatttccttaccataaatcggtttattggaatttcggtggaaacaatttttttctgaaaaatcacgagttagcctttggtattgcaaaaacgttcgttgtcggtaaaaaatacttgttgtatacccactaatctttggcaagagcatcatattcctcacctcacacatgtttgcttaccataaatcacactattagatttttgctacaagccatttctttgttacaaatatatgtgttaacctttggtattggcaaaaatgaccgctcatggccgttttgaccaaaaatgtcggtccaatatttatatatttttagtgagagactcatattttttacctcacacatgtttggttgccataaatgacattattggattttgtggagactatttttttcttgaaaaatacataggtattagccattgatattacaaaaaactgccctttatggtcgttttggctaagggttattctacctttccatagagttgttgtgctaagggttcataaaatttgattctagctatgagaaatctacatcgagctggtggttgtgggaaaactaaagctgatggttatgggaaaactaaagcatgatagatcagtaacatggatgatacaaatctagaaaatctgagatatgaggtgattctaaattgaaatagagtaatttatagattattaggaattcattctatttttgtaattgtttggttgagatcttagatttctagcagtgaacctgattcataaaactaaaccaaacacactctaaggctacctcaatcattcgtcntggctgtgagtgttgaaacatctggatgcatgatgtcggtgttgcggaaaatatgattcattctagcagatcgtgaaaaatagagggtacgcggacgtgggggagagagacgatggcctgtctgtttcagcttttcctagcttttggcacccgaagttgctgtagcccgccaaacacttagcttttcagtcgaattatatgaggattactttagttaaaacgtcaaaaattatatctgtgagactgtgatggtataccgtatacaggagctgctggacaaaccaacaaagcttaaaactgctaaagtctgacgtgcacgtaccgcatgggccatggggtggtcgctctaaatgggaccggcgtctagttggcggttggccgttgcacgagacggaaccaacgagtgcgggccaggccaatggtactgggctatgggcttccaaacgactcggatgcccaatttacggggttgccagtagcctgccaagcccatgcaatgcagcccaggagtggagaaggagggcgtggcactggtaccccgattccgttccgggtaggggaggaaggtaagcgaagcagcatccggactctctcgctcgagggtagggcagggcagggcagggcaggcggcgatccgaatccaatcgccggaggaggaagccaccggtggccgcagtgagggcggcggaggtagaggcaaagggatgacgcgcgggaagcagaagatcgacgcgcagcggcgtaacgcggagcgaaaccagaaatccaaggggtctcagctcgaggcccgcgccgtcggcctcaagatcgtctgctccatctgcaaggtaagccggggcccttcgatcgatctccagccatcgtgtggacctgctgggttgcctgggtagtagatccggccagcccgccagatccgtgctttgccctgcccctattcaggcgaaggaatagtgactaccgcatcacatcgtacggcacggagtatatctatctagcgcctcactttatctgcacaaaaaaaatcgtgccaacagattgaaatgttcctgctgcatatataccataagaataagattgccctaaccttctttaatcaggcagtttgtacgtattggtgccttggtagtagtgttacctaggcactgtgactcgaagtggaatctactagccagtgtaaccttctcctagcatgatttgatcccagagctaatacttcagaaacagttcctgccgtggaacgttttgtgggttcgtctctaaacatggttcagctgtactcttttatttgtcatcccagtaatttctctatatgatggcgcaaaggttactgtggcatacttactgtcttctatagttctatattttctgcattcgtttctgctcacaagtaaagttgtgggttcattatgtatgtggatgccttactttttagctggctagttgcatttgaggaacatgtctgctcacctggcgttgctatttctatttccgtaggtacaattggcaaatgaaaaacagctgaccgcccgccgtggatcaaagcatccaaaggagaaacctccgagcacatcgagcaccgaataaccatggctggtcgtgacgcagaaatatagatcctgcttggctggtttgaggatctttaagtccgtctgatccatgccttggacctcaacgtcagttatatactctctagtgtgtgcatttcctcttgtttcaggtattgtgttgtcgtgctgccaatgtgtctccaaagtccaaactgtatgtggtcaccatggcattgggatgatgcgaaaaaattatgagcgtatctatgttccaatgtttgtgtggcttacggccccgtttgtgcccgtgcgttccctccctaaacggcttccgcccgtgccgcttgatcggcgccatgcttccgaatgaatgaaatgagggaaattggccgttcgatcccaaacaaggaaggctcctgctcctctgactcggatgttatgccattagccggatgtaattttcttcttaatcctcgaaaatcctagagataatttaattaactgcacgtctcgcataacatactagcccttatataatattaatgtttaccaaataaacctt

SEQ ID NO: 22230 - DNA, 922 bp, Zea mays
aatgcagcccaggagtggagaaggagggcgtggcactggtacccgattccgttccgggtaggggaggaaggtaagcgaagaagcatccggactctctcgctcgagggtagggcagggcagggcagggcaggcggcgatccgaatccaatcgccggagggaggaagccaccggtggccgcagtgagggcggcggaggtagaggcaaagggatgacgcgcgggaagcagaagatcgacgcgcagcggcgtaacgcggagcgaaaccagaaatccaaggggtctcagctcgaggcccgcgccgtcggcctcaagatcgtctgctccatctgcaaggtacaattggcaaatgaaaaacagctgaccgatcactatggatcaaagcatccaaaggagaaacctccgagcacatcgagcaccgaataaccatggctggtcgtgacgcagaaatatagatcctgcttggctggtttgaggatctttaagtccgtctgatccatgccttggacctcaacgtcagttatatactctctagtgtgttcatttcctcttgtttcaggtattgtgttgtcgtgctgccaatgtgtctccaaactgtatgtggtcaccatggcattgggatgatgcgaaaaaattatgagcgtatctatgttccaatgtttgtgtggcttacaagatggtttgtgcccgtgcgttccctccctaaacggcttccgcccgtgccgcttgatcggcgccatgcttccgaatgaatgaaatgagggaaattggccgttcgatcccaaacaaggaaggctcctgctcctctgactcggatgttatgccattagccggatgtaattttcttcttaatcctcgaaaatcctagaggtaatttaaattttcaaactagcccccttttataaatgtctgtttgttttgtactc

SEQ ID NO: 22231 - DNA, 2200 bp, Zea mays
ctggaacaaaagttgttcttggtacagactacagagcgtagagcgagtgggtatcggacacttctctggcaattgcagattatctccgaatctgcggacgcgtggggccgcggtccattccgtctgaagaccctcctcctacctaattatttttctctgtcgtgacgtgaaatgccagcgcgcagcttcttgatccgttccggctgatcccgtggaccggacttggggttgggggaggccctctgtctccatggatgaggcagcagggctgctgttgcaagaagagggtggaggtggggaccaagaagctctcctccttccacttccacaggatgttggcctttacacaggtgatggatctgttgatgtcaaagggcgccctgcgttaaagggcactacaggcaattggaaagcatgctttttcatcctagggaatgaatgttgtgaaaggctggcctactacggaattgcaaaaaacctagttacttatttgaaagtgaagcttcatctaggcaacctcgaggctgcaagacatgttaccacttggcaagggacatgctatctcactccccttgttggaggcatcttagcagactctcgttgggggaaatactggactattgctgttttctcatcggtttactttattggcctggctattttaacgctttctgcatcagtcccagcgttgcaaccaccttcatgtttaaggacagtttgtccagaagcaagcttacttcagtatggcatattttttggtggcctctatatgattgccctagggactggaggtatcaaaccttgtgtctcctcctttggagctgatcaatttgatgacactgaccaagcagagagagctaagaagggttcattcttcaattggttctacttctgtataaatataggttcattcatatcaggcactatgatagtgtggatacaagataacactggttggggaataggctttgcgattcctactatattcatggcattagctatttcattcttcttctcagcttcaaataagtacagattccaaaaacctggtgggagtccactcacaagagtgtgccaggtggttatagcagcatttcgtaagtggcacattgaagtgccacatgatacatctctcctatatgaagttgatggccaaacttcagcaattgaaggaagccggaagctggagcacacaaatgagctcgagttccttgatagagctgctgttatctcatctgctgatctgaagagtgaatcctttaccgacccatggaagctttgcacagttacccaggtggaagaattgaagatcctaataagaatgtttcccatttgggctactactatcatattcagtgctgtttatgcccaaaactcttccatgttcatagagcagggcatggttcttgacaagcgcattgggtctttcaacattcctcctgcatctctctccacttttgatgtaatcagcgtcatcatgtgggtcccactctatgaccgcatcctggtgccactagctagaaaattcactggaagggagaagggtttttctgagctacagcggatgggaattggattagtcctgtccattctcgcgatggtatctgcagctctagttgagttgaagcgtttagagattgccaggtctgaaggtctcattcatgagaaggctgctgttccaatgagcattctttggcaaataccacaatatttcttggtgggcgctgctgaggtgtttacttgtattggtcaagttgagttcttttacgatcaggccccagatgccatgaggagtttatgtagtgcacttgcacttattacagtctcactgggaaactatataagctccatcatactgacattggtgtcgtacattacaactcagggaggagatcctggatggatccctgacaatctgaatgaaggccatctcgaccggttcttttggttaattgcagggataagctttgtaaatttgatagtttatatgggttgtgctgtcagatacagatataagaaagcctcttgattatatttatgtgaactcttgtaatgtgatttcccattcccgatatcatacttatcaaatacaatgcactgtacagatttctgaaatcctgcgattcatctgccgcctttctattgcaaaacctactgtagtttattaaaaaaaaaaaaaaaaaactcgagggggggcccg

SEQ ID NO: 22232 - DNA, 817 bp, Zea mays
agcagtggtacaacgcagggtaccggctcccttccctcgtttttttttttttttttttttgaggtgaaaaaattatgacaaaggtgacagggttcaatagtttaggcgccacatggaaccgtcagcttttagatatgagaagatatagagaactacagggctaggtcacctctacagtgagtgcctgcatccatactttcatagaccaattcttgcctgccatttagagcttaggctatggctacacgtagctacaacagctatcgtacaacatgtccattaccataatgatacaatggatctagctatattaacgactaggttatttctgaccaacacaacttgagagaagatagatcataggaaccgaaaagactcgtggacggcaatcctgcggtgctgaattgccggttttggttcagaacttcagtttctggtcttcatctcggtctcagtagtccagaggcaccacaggtgcgatgctgccggtgagattctgcatgtcgtggcctgcagaataatcatcgcagacactgccctgcagtgtcctcactccagttgtagacagaaggtcgcctccgccgcggaccatctgctgcacgtcttgcggcgagaggatctttatgcaccatacactattcacaaactcctgccacgggtcatcgccgacgagaagaatatcgttttcccggtcaacgaatacaagctgccagcctgatcttacagggttcctccagttggccttcaagaccaaataaccgctcgagctcgctacgtaactcgtagtagctgctgaacctggtgatgtcgaagcgat

SEQ ID NO: 22233 - DNA, 2764 bp, Zea mays
atatcgatggacaacttctttttatcaaaatccactacgaacggtggttttcgacactactgaaaactaatacctatgaattttttacgaagatatagtctccactaaaaatctaagaatgtaatttattcaaaaatgtgatttatgacaagcaaacatatgtgggataaagaatattagtgtcttattgatcatcaatagatatacaatcggtattttttgtaaaaattggctatgaacaatagttttcggcaatactgaagagtaatatctatagatttttcatgaataaattatctccactaaaactccaaaaatgtgatttatgacaaaaaaatatctggggtaaggaataagagtctttcgccgataatcaatgagaatatgaccgatattttcgccaaaaacaaccatgtattgttgtttttcacagtactgaagactaccacgtatgaatttttcacaaagaaataatcctcactaaaaacaaaattgtgatttatggcaataaaacatgttaaagaatagaggcatctcaccgaagatggatatactaccaacaatttttgatgaaaaatgtcatgtatgatacttttttggtaatgttgatggctaaagagcctatcgccaaagatcaatagacatacgaccaacaattttggctaaaaaaagctaataaatggtattttttggtaatactaaagcctaacaaatacattttaaaaaaaatggtcttcatcaaaactataaaagtataagaatgtggtttatgacaaagataagtacgttaaaaagaaatgagcctctcactaaaaatcgatatacatattgccaacattgttagctaaaactcgctatgaacgaccgtttttggactactgactacagaatgccaactatggattcagcgtaaacactatggccccgggctcgagttttttttttttttttttttttttttttttggttgcttaagcgcttttcttgaagcctaagcaaaggataattattttaaaaaatatatcactgggttctgcttgtttgtacagatgattatcatgacagttgtctacgcaaaataataggggtactgtatttcaaatccagataatacttccaacttgacaacggcagcaatttaccctgccaacaagagcccctcaatagaaaatatttctcagaatgttgctatcacgggatcccttttccatcatcagaacaagacatctgttgaggctaaacaaacgccaaatcgtccatgaatccttacaaaaaaacaccgccaaaaaaactcatccatgtatgcaggtttgttgaacctttcaagtaggatttggtccatcgtgccaaagtaaaaatatcagagtcctcttctgtagagccctttgtccatcctcatttcccagaactaaaaatcccaaaccttttaggcgagtcggtattaccaggattaccatccaacttcctctgctcagatgatccagatttctgagtactactgaagatcccaaaactcttgcttgctcgattaggatcaccgccacctgctggttgcctttggttgttatttagtggaaaagaacttctcctttcgttccttggatcttgttgtgataatccaccttggttgaacctcggtaacggccggttatgctgctgttcaagaggtctctggttctcataacgacctccattttcattccttctatcaccttgagggggtattccttggctgctgtctcctcttattggctgcctccgagcggcgtatctgttggtttcaacaggaccctgatcttgcactcgcttttccatgccaggttgcacatctcgtggtcccctctggccaggattatttctgtttcccccagcccctgggttggattttggccaattgaactcccttttaaattctctatcgtgcccctccttttgggcaggggagtctctggagagacgggtggctgtttccttaacacgatctgagatggtacgatcatcaggtttcccgagaccatgtccaactgccatgtcttcggtattgctgccatcaatgggtgactctgggacagcactgctggtaccttttcctgcatcttccatggcctggctagctttcttcccacctttctttgttgcaaacttcacatgcctgacaataacatacgcatgcttcgagtccaggtgtggtccactttcgacaatgcacacatcttgtatctgttcaattgatgggaattactgaaagaaatgtgctttcacaggcagcagccttgaacatgttgccgtgaccttaactaatatcaaatggaacaaatggcatttgggagcaacagggagacaataaggtgtagagtactcacaagtcctaacaaccgagagagtggtgttcctaaatcttctccttcattacctgagggcatggccatgcactgccaaacagaaaggacattttgattttcagagtttaatttcaaaatcgaggataaatatatgaatatgattacaaacgcaaattgcagatatactgaaaaagaacagctgaggattcagttggccaaatcgacaacacccagttcatctgggaaatggatataggcatggtcattcagaggccatcgtaaaaatgatgcccacatcaagtatataaggccaccaattgtactccactgagtaagaaagagtcagtgtggccctaatcctactctggtcataatgtatggattctgcattacatcaggaataccaaatcccaccctcaccc

SEQ ID NO: 22234 - DNA, 1239 bp, Zea mays
attttcattccttctatcaccttgagggggtattctttggctgctgtctcctcttattggctgcctccgagcggcgtatctgttggtttcaacaggaccctgatcttgcactcgcttttccatgccaggttgcacatctcgtgggtcccctctggccaggattatttctgtttcccccagcccctgggttggattttggccaattgaactcccttttaaattctctatcgtgcccctccttttgggcaggggagtctctggagagacgggtggctgtttccttaacacgatctgagatggtacgatcatcaggtttcccgagaccatgtccaactgccatgtcttcggtattgctgccatcaatgggtgactctgggacagcactgctggtaccttttcctgcatcttccatggcctggctagctttcttcccacctttctttgttgcaaacttcacatgcctaacaataacatacgcatgcttcgagtccaagtgcggtccactttcgacaatgcacacatcttgtataagtcctaacaaccgagagagtggtgttcctaaatcttctccttcattacctgagggcatggccatgcacttcaccctgtaaccccgctccattaatctggtaatcccatctgccttcaccatcaaatcttttagttcagtcttccccttaaatcgcacttctttgttctccccaccacgtaagacaatagcagacttggttttcaagcgttctttctccttggtttctttcttatacttctctctgtgaaaatccatgattttgcatacaggtgggtctgatttcctatcgacctcaaccaagtccatgtccatcctgatcgcaagctgcaaggcttcatgccgggggagaatgttgtggccttcatccatgacgagcctgacgaagggagcggcgatggcgttgttcatgcgcgggcccgcgctggcatcgtcctcctccttgcctcgcttcctattggtctgagtaccaggcggagcagcgaagtgccggaaaggcggggccagcggggagcgtatgggagtgggagcgggggcggcgagggccagtgggggaggaggatggggacggtggcggcggaggtaggcggcggcgcggagcgcgagggatccggcgttgcgccggagagccatccttttttttccttgccttgtgtcgccgggcccggagggttgcgggacgctcccggccggcctcgagggtcccaatg

SEQ ID NO: 22235 - DNA, 2211 bp, Zea mays
ttttttttttttttgtagctcgcgtaatgcttattattaacttactaatggtcatttggatcattacaaactccaatgaaacctaccggaaaatgaaatcaaagaaataaacaaatatgatgcattgacccgatgtaaaatattttccttgattaccaggtcaccgcaggaaattgctaacgacagcgattatgtgtttgctaacactagtagcaaaactcaattaactaatgtacagaagttgttacaacaatggttagactaaatcggtcaaatgcctgctccctataaaaggaatgcagcagctgtaatctgacttaggaaaacagttaagatggggtaatatggactttcctgtaatcatcctccttgcgtcttcttcgtctctgcctgcaagggccagactcccaggaccacgacgacgggactacattttgccacagcagtaaagctactatagaagttggatgacttccgttccgctggagcaaactctccaatctccaggacagacaggatctcacgccatacaatcacctcggtggcttctgtcaacatctctttctccatgcggagtagcttataatcaacccgtcattgcaaaatagtatacatcagaggggcggcaatcttcattgacacagatctgtctgttctgcgtactaatgtctacaaagatctgtatgtgcatcgacctttcttgcatctgatggcttccacagtatattcacatcagagttgcaccaggaagagaggtggttgcatccgctgtttgtaatgtagctgtcacaaatgccatcggtgcctgctgtgtttcactaaaaatacccagaatgttcaaaatctgtctgggcaaggtgttatgcatattccgctgattaacaaaggaagaaagaggtgtccgaagattgggatatttattcaacataaattcaagttgtggtggaggtagctgtaataagacatcaaaagaacgtggctgagtctggaatgacaattttaaaaacccaacccagagcttcggcattttccatatctgtttatcgatgagcctggagagtattcccatgacaaaatcaaccaaagcaggaaaagcatcaagcgcttgaataactgttctcataaaaagaagaggaattggtattctgtcaaccaattgattaagtgacttctccaaaacctgctgagtaaataccgtgcgttgctcaaagcaagccgtgcaagcatccgtgaccttttttagggcaactttatctttttcagggttaatatcatgaattgcaatgagaacttcagcaggagtcaatgctggaccagtatgagcagttccctgcaatatccgagcaagtacgtcttggaatctctcaagcgggagatcaactagcctaggaaatataggcaatacctcctcctttggaaatgaaggcagtaagggaatcagaatagatgcatccttcagcttggtattatataattgtttaacagcagcaactaggtcagctgagggatttgaatcttcagtcaatgtttgcagtgtcaaggtaataagatgttcactgccttcaggtggattatgaataatgttcagcaattcaggacacgagggccccagatttcttataaggttgggcatatgccaatggatacactgcttgacaacttttgggcccctgcccggcccgctgaacagatgttgaagaagactagatctcttggtgcaaagtgcaaagaacaaagaagtacgccgctttgcctcagatacagatactgctgactgttttgtagaaaccgatgatgtcttgaatggcccattttcagagaactcagtatctgggatctgggagccacttactgaagttccctgactacctacctcaatctcagctgtagattctttcaaagatttcgaattaatatctgtgtccacagtatgctcattagcaactcccacaaggctctctatggcaaactgctctattttttctgttgcatatgttagatcatagagcctttttgcaaccaatctaactgcttttcccctgacttcatcttgagagtgggcagcacactgtaaatacacaacagaaggtaagtgcagcacggaccaacgtaccaccaccaacaacaacaacaaagccttatagtcccaagcaagttggagtattagagttgaaacccaacagaccaatgtaccagccacataaaaagaac

SEQ ID NO: 22236 - DNA, 7362 bp, Zea mays
gtcgacctgcagccatggatgatcatacatacgcgcctgacgtcgaggaggatgatcggttggcctagggcgcggatgggaaagaagatctcgctgccgtcatcgtggacggtcgcaggccgatcgtttcgtttcagacactttgaagctggcaagagagactgagagagtagccgaatagtagtaggacagagaaacacggtacaatacaaggcacaggcaccaaaagcgtcgtgcaacgataccgcaagttaattcatgtacacaccaccggttgcaatgcaaggatgtgacgacgtacgagcgaacaatagcaacttggatgaaattttaattatagacgccagaaacgtacgcccgatcgagccacggttgggcatcacacgttgccccggtttcatcattggccgcacgtacgtacgcatcgcatagcatcgcgcgcgtactcggcggtcatgcgcgctgtagcaagcaagcaagcaaagccacccaccgccgccgccaccagtcgagatcaaacggaaggcggagaggagagcgaccccgggcaagcctgcagtgctgcgctttgcacagtgcgtcccgttcgtatgcaattcagcactgtatcttggataaaaaaaagagagaaactattcagtgcacaacaaacggccgcgttgtcgtgctgccagaatggtcaatgtgagtcattttctaccatggttcatttcttcttcgtgtattgtatactagtagagtaccacagtggatctcgttaaactccgtgacatttacaagtttgtatttcaaaacgagacccccccaagaacaatgtacaggccgcgtcctggtgccacagctcgacgacgtccagatttgtctgactgaatgatggcgtgttccgtccaatccagcgagcagagcaggcggcggcagccccgcacgcgccgcgtccgtgcgcggcggccgaaaaaacgcgcgaggccgcccgcggtccgacgagaccgcggcgggaagagggaagcgatcgacggccggccgggcctagagctagagggcggaggcgaggtgcatcgtctccgccgcgaccgcgacggtgtcggagaaccgctgcagcgcctcgcgcatccacgggtgggggcagcgcgcgatggcctcggcggcggagacccactccctgcggcgcgcggccatctcgggccaccggtccagctccgcggtgacgcgcagcgggagcacgaagccctcgtacgtggcgtcgtagctgcggctgcggtagcaccagcggcccagcgcggggcccgtctcgccgagcacgccggcctcctccgcggcctcgcgccgggccgcctcgtccatggactcgtccagctcccacccgcccttggggatcagcacgccccccgcggggcccttcttctgcgagctgatcaccaggacctccacctcgccgtcgcccccgcgcacgcggtacgggacgcagcccaccaccacgcgcccgcccgtgctcgcgctgtaccgctgcagctcccggccttggcgagacaccataaccgctgccatctgtgtcggtctctgcctcaaattactcgctccttgtgggagaaggggattctctcaaagtagaaatagctcggcgtgtgagatgcgattgtgctatctttggatcttcgctgccagtgccaggagaaggaggaggaggagccggatttggattcgcgcgggtcgaaggcgttgctgcctattaataggagaagccgcggttgctggtcactgtcgttgccgagtgggagggaggaggatgagtgggcacggcacgggcaccacgcgacataagagaagacaagggaagggaccaatttttttttaaaaaaaagagatggggaacgcggcaccagcgctctccgcctgcctcggcgtgtggacagggtgcatggactggggactgccacacctgcctttgctaaaaatgattgtattctctgccttctcttccgattctgctgcttgggtatatatcccagaatagtacccggttttgtgtgaccatgctttgcttttgaaaggcgtggttcgacccggatagcttctactagttgttcactggtacttggttgttgattatggcgttctgggtgtttatgtttggtccaacgattattccctgttcagttgggattttgtgctgacttttttcaattagtcttcttcaagttttgtgggattctgtgctgtttatcgagtagaatttaaaatagattgtgtgatatgaagtctgatggagataaccttaaaatgcattttaggtgttgtatggttaacgtaattgtaacgtaatggataaccgataacatttcattgataccggtaatcagataccacactaaaaaatgcatgataacagcccattcaaatttaataccgcaatcactcgagtattaatcactaccgttgctatttacgttatatttcgtgaactaaacaacaccttaaaagcactggactattctatagaaaaaaaaactgttctgcttgaagatgtttttatatgacccagtagctatgtttatgatcgagatcggcacgtttggctttgaatttcctttttgccgtaggttttccttcttcttttgttagtacgttttagatacacacgcgctccgccgctttccgccaagacatgtggtggtgttggctcaggcacgcaggtggttggatgtggaagctagaaacctaaacccacttgtaggttaatcttgatccatgcatgcatggaagcttcttttgtgtccttgagttgaagaacacgactgctgttggatggcctagttcttgacttcctttttttgtaaatttgttagagcgtttttcaagttcttgggtggaagcccacttgtacatatttttttcaacggggcaattttttttttgagaaagcgatattattttgcctcgagatgttttcatctactatgcccatatataactctggtatgagatccacatattacagtcacgtttgcgctgtgagtttcaatgcaaagtacggattattgctatctggatttacagttatttatttatctatttatttatttatcgtcttatacatgaggaaagcatttctgttactacatggtaaccatgataagtggcttgcgtatagtacctttgaatgttatcaccacggcttacaaggttgtcacttgttaggggtacccttttgccatagaaacgaaaaaaaacaatattaggaagcaattggttaactaggttgtgcgaatttgtttttttttgtctgaatctggttcccaataaacgcgtactcccaaacaggcacggatagataaccccttgctggcctcctggcatcgttccgagtgttgccttccccaaccaaatcagctgtcggtttagccgtgttcaggatccagtggaccacgtccacgcaagcagcctgcttgtgaagacaagcgtcggataaagcgcgtaggagagggagggagaggcggcctcggccttcgcagctgcttctctggctctggctccacccgctcccgcgctgccgcgcgcttttccagtcgccgggacggcgctcgcgtcggcttgcgctcgatggccctccctagctcacgcgcccggccccagccagcctactccgcctccgcggttcctccccgaccaccgcggtgccagtcccacgcgctgcgcactctttttctccgccctcttcttcttcttcctcctcccttgcagtccaaagaaccgcactagtttatgacacacaaaaaaactctccagtccatcgacaacttttccattgtgttccatgtgggtcataaattggtactagttttttttgttctggccttccagcagtgcagagcccaccagcgtcatcgtcctgtctagtttatcgttgagaatactgtaccggtctgtcccgtcatcgtgggtgcgtgcgtgcgtacccgcttgtacctactgtgcactgcactggacgtctctctctctccctctacccattttatttcccctcctcctccaagagcttttgcttttcacgggaaaaaaaggtgaagggacaaggaacagtgcaggtgcgcgcgcactgctggtcgcaattcacaaactgcgcgcgtggtgctcatcgtgctgcggccccagttgtccgtcgacccccccgcgcgcctgccgagagggccggtgccgcatttttcgccatgtcggccgggccggcgtcgttgggtctttgcattgggattgggatcgatcgggcggcgctgacccagtgaccctcccgcgagtcaccaccgacccgccgtgctgggcgggggagtgcacgccagcccgcctgccacacaaattacgtgcgcgggggcgcgtttgggatttcttcgtcgaccgctcgtgtacgggtggatacaaataaccagtagaacaagtcgtcgccctgacgtgcgtggtgcactgcaggcggcatgggatatgcatggtggattggatgggatgacacggtcgcccatcgcccaaaccaacggcggcgccgaccacggctttcgtcttcgtgcctgtgtatccctagcttcctgttcgtgcgtaccagggagggtctaggctttgagcctttgacggttgcacgatctagatggaaattgatcgggagtacaccccaccccctgcagggggctacagctgctctgtacgaaccctactaccactgtgttgtgctgatttactgctctgaacttcctggaggtagtggtggctgtggaggttggtacaagatccattgcatttttttacaaattgtttagcagaacggctccggctgtattttttatttgatgcataaggcaaatgccaacaatgccaatgcgtgaccatttgcacgaacaacatgtacatataaacagtgcacaaacaattcatggccatgataaagttttaaaaactgatgatcaaatagtttggcttgaggcgcgggggcggctgaggttagcgtgggtatagacatgagttctcggtagttttcttgcgaaaaccggcgagaaaaagtaggtctcgcggcgagaaacagcgaaaaccgtctctgttttaaaaaaacaattttgaaatcccaaaccgttcgggaacgtcggatttcgacagttttggtctggtttctcgttttccgcggtggcggggcgaggaatttgtttcgaacgggattggtaaacctgggtcccatgcgtcctagatctgggagaactgctgggacatgcttgtcgcggagctgcaatgcagccgcagtaccgatcgtgatggcagtcgaattattagcttccttactcactcactcacgcaccaaccaaacatatagcaatggcacatgacatgatgagtcctagactcctgctccggacaaagcatccagctatggtggcctgttacagtacggcgcgcagcagttattgcagttgcaagcatgattgctcagatatctttgtctttgtttccttgtgccctccacctacctacctatcgcaaccgtataggtagtgcctctccatcgatctatgatttgtctcaacagctagctgtcttgattagattgtgtgcgcgacgccattattactagtgtatgctgttgcactcactccgttgaggaattgagttcggcgaacaaacgccgaaaagttcggtacggtgcacatggctgtcgtatgggcaaagctagtagctcaatggttgaataatgtggtttatttgttaagtatttgttaagatttgtcctttttttcatataagttatgttttggttatccgactttgtctgaaccccctggagaaagtaatttggggaaaaaaattccccttcaaaagttatagaacaactgccacgagattaaaccagttcaactgcaaaaatctactcactctttttagaaacatacataaaaaatccactcattttgagttagatgctccacggctagctagctgatttttgagtcctggttttttttgccatggcatccgagaacgggaatccttcgtccactgttagatgttgactcgactgacaagaaggatctagagctttcctctactcttcgcaggcaggccgcggaagctgctgactttcaccaccgacccgccgccaacgccggcacttgccagaccgccacgcgaatgaaacggagcgatgatgtcgtggtagtagtacaattttttttcccgcacgccgcatctttttacgtgcgtttggttcacatgattgaagcagagaaacggtcaaggtagacttgtcagagggctcaatggcagtagccgtcacccctgcgcagaggaaggataggattcatggcaaaagggagctcagcctcttcctccttcaacatcttagattagtatcaatgttctagtttattatttaagtttctttttttctctctcactatagacagagagcagttctgtttatgttagagaggtattaccaagttttttttaaaatttttattgaagattttacttatctaattataaaaaaagattagcaagctgatcctcttatcttgcatggtgacaaaggtttactgtcttcttttattttttagttagttagtttatatttagttgtaaatggatatatgtatgatccaaattttttctaagatatgtttgaagacttcaagtatatagttatatataaaaacactggtttaaaatactggttttaccctaggtgagtccatgcatactcatggggcccagggctgcctcactgtcgtgtacttatcatggtgatgatgtaggggcagctatggtcccaagcaccatcatttgggctacgccgacccctggcttacgtagcctgggactcgacgcggcccgtcgtgtagtgcccgacgggatgtctgcgcacttaggcctagtccgataggccataaatgcacaacaggtcgagtgtgcatgggccattaatgtgccacagtctaggggctcataggtcatgagtgctatgcaccccgagggacggtaggtcttgagtgggaagcagaccagcgcccacgctgtagctcggtgtcaggcatggttaatacagccagtcatttatggcaggtcagtccggggctgagcgtgggatccactcaagtggctcccttctgacacatctggtcttccttgttaggctccgccatgcctggccccaggctcggtgccacggggttcgatcgggggagggtccttccaaggctagcacacctgcctctttcggctggctaacagaccctagcgatcagggactctttcctcagtgtgctcactgattggtgggtcccaaggaccgggggtcattccacagacagtagctcccgagcccccgacgggaga

SEQ ID NO: 22237 - DNA, 5382 bp, Zea mays
catcaagattcaagactgtggtactctactctgagataagtgtcattctgcactcagcgctaagcaccctgcagtcctgcactcaccgcatgaagagcaactgcagacagactgaaaattgaaatgcgcgaccattcgctttgccgtaaggcagaatttgaggcacttttgctcaaaaaaaaaaatgcatcgactgactacaacgagcagaatcctctagtgttgttcggttcctctttacaccgcaggcgcgcgcatacacctggcaggaggcgggagggcaagaagaaacgacgcacgcggttcaggtgatgaagctagctaatggtggcagagcggagacaggtcccagagcgagtcgcaggcggaggcgtcgagcacccggtcgaagtactcctgcaggccgttcatggcgtacagcgacgccgagatgcgccgctccaccttgatccgctcgaactcggccatctcggcgcccggttcctccgtggtgccagcagctgggacggcgctgtcgacggccgcgaagctgtccagcgccgggaacgccgagtcgaacatccaagagtcgaactcctcctcggtgcccgcggtggcgaaccccggccggtacacctcgccggcgtccagtgcgccggtgccgccgccctgcgtggccatgtcgtcgtcgcagctgactgcgctgctggagctggagctgctgctgctgctggtggtggtggtggtgatgctagagccaccaccacgaagcactattcgtgctatgactattgctgttgctgttgcttgtggtgaatcaggggagctcgacgacgcctgctgctggcggctgcggcggcggccttggccttcttgatcttctttgtggtggaggagtccgcggatgcggacggcgagcgggcagtcgggagagatgcgcggcgcgaagttggtgcgggcgtcggtgccgcggaggaggcgggcggcctcgtcgtaggccttggccgcggcctcggcggtctcgaaggtgccgagccacatgcggatcttctgcgtggtgtccttgatctccgccacccaccggcccgacgggagctgccggacgccgacgaacttgctgtggttgttgctgcccttcttccggccccgtggcttggacggcttggcctgagccgccgcctcttgctgctggtagtagtagtagctgctgctgctgctgtagttctcgagctggaacactggtggctgcgcttggaagtggagctccatgtgagcttccttggctttgagcagctggttggagcggttggaaaggaggaggaagacaggtgtcgatgcttggtacctctggtggtggtgagcagttcagcacagggggcgaggattttatagtggatttcagggcatccagtcacttggcaatggcaatggaccctgtggggttgctgtcaggggctggtcaaatgcaaatgctggtctgcctgtgatcatgtcatggaaatgaagtgagtgtttgggggataaggcatcttgtttggatccttttgtcctttcagtttgttttttcggttttgccatcatgtattgtcagtgagcaaacatgcattgtcagtttcagcagttttttttttggctgaatacaatcagcagaattgaggaacctgtagctgtagtgcatcaccactcgccagtgttctgacttctcgcgtttcctgccatctagattatcattatagcatcattacccgtgttgaatatgagagatccttacttacaatatatgagaagtaaccattttgctcttgagtcaatacaatgaaaattccatttttttaaaaaagaaaaattaaataaataaataaactttagaatccatccatgcctgcaggccgcaggcaacaacgagcaagcacgctagtggccagcaagtacatgctccccactacaacaccaaaatgaccaccaggtaaaagcatgtaagcaggagtcaaggggtctagctacttctctcctagtttacgatgtctacaccagcaagcattaccataaccgaaagctttcaggccactgattggactagttcttccctaaacacacacgacacgactacctcgctcgctggtcaagccactaacaggagaccaggtctggagttgccgcatcgcccgccatatggcagcgctgggagaggatggcgacgatggttaggatacaaagtagaaacggctgaacatcagcttttcatcaaccacgagcacacttgtttatcttgtttcctcacagatgctgctatcaaccgagtctctctccgtcactcggatgacgtagtttcgtcctttgttgttagctcagttttgggagccccttcaaatttttcagagcatatttttgtactggtaacgtattcagccgccgcccggaattgtttttcgtatgcttacgagtaagcttcagtacttcaaacatatttcaaagaaaggacatgggtgtgggaattcgactctggattcggtgtaggttggaagaatccccttgctattcaagaggatccatgggtaggaatccggttcccttgccattcaaaataaatagcaaggagatttctatggatcccctcgtgattcttatccactaaatcagccctaaagtagcgggtattccccttttttctgctcaaagtcaggatggggtgactgatctttcttgaatcacgtcttactggccaaatggtggtataagcttcgttatggatacacacaccaaaaaaaaacttatcgcagataggtgatggtgagcttcccttcttccaacttcaaatcaacacttgactacttgttcatgttttctcttttgggaaaaggcacttaaagagttcaaggaacaatagctagagtcttaaagctatgattttttttttttttacaataggagacaaatctagagcctggagaatctttgcttgcctttgagacttgcaacagttctatagaaagttaaagctgaggcaagcatgacggcaaaagctttcttgacgtccccaagctatagagacggcactgctaagttcaaagaacgaaataggtccttgcactcgcaatgtactgttttaaggataaacaaacctgcatcccttggtcatcagtggccattttctacatcactcgagaagaggtcatcgtcatgacatatagccagagccacatcacggaccccttcaacctcaagctagggcatgggcatgcctaccctcacctatcaaaaagcaaactttgtcaaatgtggcgcgtcattccaccacataaattatgttcgacttcaacatgatgattgagcaatagggtagggcgcccacatcggctattgttttatacgggtcaggatgactccaagaggttgtggcttgcaagctcttggttcagagcaaagcagatgccttgtttgtcgctgtcaaagtgcatttattagtcgagcttggtgggctacttgcgctaacacgacaaaataccacttttttgggcagcagcaaggtcaagagctggcatctcggttaggttcagatttgtctttgggtgcggaagccgctatgaagctggtacatattccagccgtgttttgggaggtcattgcagttttttgcagcgaagagcctaacattatctgaaatgcaccaacgaatctgttacgactgattcttcgattatgaagagggacggtaatggatcaagattcaaatatttcttcatttgaacctttaaaactaattttagttcaaaaaataaataaaatttgttgctgatatgatccgatgattgatctttaaattttatagtataacatttagagtcctaatgcaccggctttgtgatctgcatgcaatttcaaacaaggactacttggtcattggtaccattaaattcaagctccacgtgatacggctcaattgatattcatttgggaatccccagccgtcaggaatcttcaattccaccgcagacatgttgatgccattcatacgcagacaaggaaataaaataactgaagcaactgctatcagcatatcgccagatggaaatttgcaacggtttgatctccgaacacattagcgaattgctacggttttatctcagaataaattaacgatccagcttaaatacacacgaacccaaggttcattcagaaagataagacggctttttatttcaccaattaccagtatgaccccggaggagcttctgcatcttccaacagagcacattttaataattttcaacagaattaaaatggcttcaaagagaagcagaaagtaactccacttatagtgatctcattaccaaaaaactgcaaatgtccaacccatccgacaataaatcccaccgtttcccttgcacctctgttgcagcacatctcaaaccatatttcgaatacaagacagacaatatacactctatcaaaaccatgtgtggtgacagcctccagttcgttgaagcaaacaatgcattcacaaagtaccccaccagaaaaagatacgacataaagaattggctgataaaacatcaagaaaaataacaaacccccaccttgcagcgacagaaaaaacaactatgtcgacaagatggactgtagcagtagctgttgctgcggttgcaagttggaaaacgtcgatgcaagaaaatcaggaggcaaagtctgctggaaacgcctcaagacattcaccatcctgtttctagtttcatcagtggcaagttctgttccattgcacaaaacctctgcaaaaattgaaacaattttaggaagatactgactgtgaggcccaagaatttcagcatccgacctctccaccatggagcaaagctgtccatgtacaactttagcttcaaccttgtcgtcttttataggcaagcagctaagccaggctggaacaacctgagctgcatcaataccatcccgatgaaattggcatatttttccaagcgccgaaacagcattgtcatatgccatgatattatcaggaagtcgtgcatcaggatgccttataacattgtttaattttgataaggcctctcctactagagggcgaaaaacatgaccaccaaactcggcacatacacccacaccatagacagcagcctgccgaacatctgaattttcatcgtttgatgcctccaaaaggaaaggaaggtatgtgtcataatacttcagagctgattcacggcattgctctgcaacatcatcaaaaatacagatagctatccttctctcttcaggtgttttatcttttcccaacattggtgtaatgtacatagagagctcttcaaaaaacggcaagaaagaaccttgaaggttttaatcaaagtcctaggcacccccggacctggtagtttaaaaaggaaatttaaaacgacg

SEQ ID NO: 22238 - DNA, 2312 bp, Zea mays
ctatgcacaaagtaactttctctttgcaaagctaacagcaaaatcgacaccatgcaatacactttaagcctagggtgtgtgtggtccatcatcttctcgatcctcacttttttgtatggtttgtggcacatagaataagttggttctccaccactttacacctctcaagcaacaaataatacaagcatcgagaatgggtaattctgacaaaattcatgggaagaacagaagatgcaccacctcatctaggattatctatagttcctcaaccaaaaattctccctaaggtctctgcctcgcttgtcattcccttcctcaagtgtgtgctttttgtgaggacctaatctgcagcaggtcatccagccccacctcaccttactactctctgcctcgcttggcattccctccctcaagtgtgtgcttcttgtgaggacctaatatgtgcaggtcatccagccccacctcaccactctccactgtccagtctctactatgaccacctagggtgcactaagcaacttcagacaaaatgtgtcacatttggttgacaacggatataacctacatttttttatcatatcacaacaacacaatcatctcaagcaagttgtcaaaggcacattactagaaaatattggcgacatcataaggaaaagatgctgatacctgagctgcatcaataccatcccgatgaaattggcatatttttccaagcgccgaaacaacattgtcatatgccatgatattatcaggaagtcgtgcatcaggatgccttataacattgtttaattttgataaggcctctgaaaacataagcaacacattgttggataggttggaaaaagtcaggagaaatataagtgtaaacacatatataaaatgtactgaatctacctcctactagagggcgaaaaacatgaccaccaaactcggcacatacacccacaccatagacagcagcctaaatgaagaaaagattcatcactacatcagtgttcaagttgaccaagtaaaaaagggtgaataggtcaagggaacatgacagaacaaaaacagacctgccgaacatctgaattttcatcgtttgatgcctccaaaaggaaaggaaggtatgtgtcataatacttcagagctgattcacggcattgctctgcaacatcatcaaaaatacagatagctatccttctctcttcaggtgttttatcttttcccaacattggtgtaatgtacatagagagctcttcaaaaaacggcaagaaagaacctttgaaggttttaatcaaagtccctaggcactcactgacctgatcaaatacttcctcctcctgttcattctcttctttgagtagctctccttcatcagcatcaaaatcttccgcttttgttctctccgagcgttctcttttccgggtggcactggctataatgacgtttttaatctcatctatgatagctcgtacttgggcttcatcaagcaaaagacccgaaagctgcatacactcgtttaaagaatccagcatggatgagcacatttctgtttctggctccttgtgcagtgcttcaacaagtgctgcaattatgtagtcagacaactgtttgacataagactcatcacgtccttgagcctgccctttctcaacagccaattttgctgagcgtagaagttccggcatggccgcaacagcagctctcctgacttcctcatggaagtaaaacttcagcagaggaaccaacgttggggcaacctgatcaatccatgggaagaaaccctccttaagctcatcagcatagcagcacagcatgttgcaagctgttgctttctcttccagcacactagttcgaattcctattcttttgtcaccaagtgtgattgtttcaatgctatcgtcatctgatgcaatatcgtcatctgattcggctgaagtaactgtaacatcaggcttgagttgagcagactgaagcagtggaggcataacaacactcatgtaaggaaggaaatcctgtccaagacatttgcatagcctagcccaagcctgcaacatgtagctggtaattggatcatcagtttccattggagctccttgcaaagccataagtacctccgccgcctcccttgcgtcgtctctgaacttgtccttacccacagccattcctaccaaacttatacactccatggacttggcacggagcatcctattggacttatcagttgcatgcatcaagatagattttaggtatggcatgacagcatcatacccggccggcctcggggcccccgatgaatctgctacagacgctaaagctgtcaatgc

SEQ ID NO: 22239 - DNA, 1143 bp, Zea mays
gtgtggctgctgggattcgagcccaggtctctacggccacaacgtagaattcttaccactaaactacagccacattgttgtaaggtttcataaccacatttattagttctatataacatgacacctgtttcgtgcaatcacacatttctatgttttctcgaaaatcttcggcagaccagtgtctgtggtcaatacagtacattacgaatacacacaattctctcgtctagcactgcataatcgccctttatcctccaatcaagtagagacagtctaaaggctagtactcgttgaagtgtatggcgccgagcttccacacgaggaaggcggtgccgaacatgatggtggtgatgagcgtgaaggagacgaggacgaggaagacgtccaccccgaacggcagctcgaacgtccacccgtccttgggcatcccgcgcttgctgtcgtcgaacaggttgcccggcgcctcgggtaggcgcgacccacgccgcccgcccccgcccccgcccccggccttcttcgcgtccgcctcgcgcagcgcgtccagcacaccgctcccgaactccggtttggccggtttcgacgaagaccctttcgccgacggctctgcgtacttccccagcacgcgcgccgcccgcagccgctcccgcgccgtcagcggcgcccgcttcggcggctcgctcggcgcgctgccgttggcgtcggcgaccggctgctgcggctggccgttgccgggcgtcaccggggatctctcggcgctcggaacgggagagcctgggagaggaggggtgctggtagttccttgcgccgcggccggcgccgcttggtcgttgtccgtggcccgccgccagctggttcttgcatgcttattattcctcgccgggtagcttagccggaggagctcgggtgggagcttctggaaagctgcagctgccgccgccttctggaaaggatgcctcgagcaaaagatcagctgggtgtagtacgacgaagatcttggcactcctgttagttttgcagtggccctgggcaacgaggagctgaggctggtagcagccatcttcctctcattcgctcggccacagcattttgtgctcgaggccagtgaagctcgagccgaattccgagcttcgtcggcgtgcatcc

SEQ ID NO: 22240 - DNA, 985 bp, Zea mays
  misc_feature (58)..(60): n is a, c, g, or t
  misc_feature (90)..(90): n is a, c, g, or t
  misc_feature (125)..(125): n is a, c, g, or t
  misc_feature (970)..(971): n is a, c, g, or t
  misc_feature (977)..(977): n is a, c, g, or t
gtagtccttgatcagctacttctttattgaaaacttgtgtggtgatatccctcatctnnnggtagtgccagaatgctgaccagaaagttnccagtgttggctctagctgagccactttgatccancccaatatggctatcaccccattggtccaccaccaaaaaaggttcgagaaaacatcacccaaggatcaaaccccccccccaagaacgggtttccaccactggccccaggtttaccaccaaatgaaaatgaaaacgtttttgtatttccttgaccacccatcgtctgccatccattaccagatgtgaattgactggacttagggccaccaccagtgaagtatgtagaacccccatgatttccaaaatttccaccaccaaatccagggttacccttctcatccccgtagaggtcatagtttttcctcttctcttcatcagataggatctcatatgcattgtttatttcttcaaatttttcctgtgcgcccttccctttattcttgtcagggtggtattttagagaaagtttgtgaaaggctttctgaatatcccgttggctagcattcttgtcaactcctagaaccttgtaaggatctatagttttagccgctgcgacgtgcaagacgagcgaactgaggacgagcgaggcgacgaggagggaccggaggaggatccccatcgcggcgtggcgtgcggctccgattcgattctgcttcgccgggtgaagcttcaagcgctcaatttgctcgggtttgcttctgctggggaaaatcggggttggagatccagggtcgatttggagggaagcggaggaggacaacgatttggccatggaggaaggccgccgttttaagaggcggggcgtcggttcggtcgagatgtttcgcgacgtatggtacacgtggcactcccggggttgctccaccgaactcgaccaatagaattcgatctttcgagcccggttnncccggnagagcccg

SEQ ID NO: 22241 - DNA, 1082 bp, Zea mays
tttttttttttttttttttttttttggtataagtcttcataaccatatttattaattctacataacaggacacctgtttcgcgcaatcacacatttctacgttctctcgaaaatctccggcagaccagtgtctgtggtcaatacagtacattacgaatgcacacagttctctcgtctagcactgcaagaatcactgcataatcgccctttatcccccaatcaagtagagacagtctaaaggctagtactcgttgaagtgtatagcgccgagcttccacacgaggaaggcggtgccgaacatgatggtggtgatgagcgtgaaggagacgaggacgaggaagacgtccaccccgaacggcagctcgaacgtccacccgtccttgggcatcccgcgcttgctgtcgtcgaacaggttgcccggcgcctcgggtaggcgcgacccacgccgcccgcccccgcccccgggccttcttcgcgtccgcctcgcgcagcgcgtccagcacaccgctcccgaactccggtttggccggtttcgacgaagaccctttcgccgacggctctgcgtacttcccaagcacgcgcgccgcccgcagccgctcccgcgccgtcagcggcgcccgcttcggcggcgcgctgccgttggcgtcggcgacgggctgctgcggctggccgttgccgggcgtcaccggggatctctcggcgctcggaacgggagagcctgggagaggaggggtgctggtagttccttgcgccgcggccggcgccgcttggtcgttgtccgtggcccgccgccagctggttcttgcatgcttattattcctcgccgggtagcttagccggaggagctcgggtgggagcttctggaaagctgcagctgccgccgccttctggaaaggatgcctcgagcaaaagatcagctgggtgtagtacgacgaagatcttggcactcctgttagttttgcagtggccctgggcaacgaggagctgaggctggtagcagccatcttcctctcattcgctcggccacagcattttgtgctcgaggccagtgaagatcccggccggcctcgaggtacccaatg

SEQ ID NO: 22242 - DNA, 2268 bp, Zea mays
ttttttttttttttttttttttggggaaacaaaaggtagtagacttggctagtatagaaatggtccgctgtatgcctgtatatattcaatatctcgacaggactgcagcatttgcacaatttacattggcacggttgagggagagatgtagcaactctggtttaccgaacgactaaactgtccagcaaacgctctatgattttactctcttcgtccatctatgtacaagccttaatacaagccttaattaagataataagtgttagatctaaaacccttgcaacttgcaataatcgtctaccgaaggacaggtttttgtttcgtcggcgacagttgaacgtctccgttcaaaacggatcccacgaacctttcagcttcttccagtgtcacctcgccgtcgtacaccgcgaacttcccccggcggggcttgtaggcgatgagcagcttgtcagatgacctgtatccagacttgtcaaacgatgacaggaatccagattgtttgtccttatccagcaaagcataggagacagcatttctggaattatagttctgcccccttatcaaagtcttcatagatatctcagacaggactgcttcaagctgccccttggctttgtttgacccgaaaacaccaatgatgcatactgaagtcttctctccacatgtttcctcaaagttggaagctgtgaggagaggaatcttcttgatttcttcccattgaccggaaggtttcttattagctagattcgataataacttcttattcttcttctcaaaactatctagcagtgtcttcaattccttgacaccagatctgagatctttcaccgaaatgccatccttcagaaggagctcctcaccattcacggttcggccaattacagctgggagattcttcacgccaagacttttcagcagaggatgagaaacatcgtgaacctcagcatcataaaagattatccgattgcggaacatcccactgatagcacgccacattgctggtgtgtccttcttactcgatagtaagagcacttgaggaaggtttggtagaacatttaaagggaagctgaattggctaatatctacccgtttggagaatcttggcaggtgttcttgacaaaatgtcttcaagctcttagcatcatgttccccagaatactcgtgcaaagaccctttctctgcagtagcatatgaatagatgaagagacgggccgatttccctattgaaacaccagaccttttgcaaagagatttttcattgtcacagttgatcttaccagccctaagaacaccatctagtgaatggaccacgtcttgcatgacactctctagcacaaactgacttttagattggggagtataaaataacagaagccaagtagttccttgatcagctacttctttattgaaaacttgtgtggtgatatcctcaatcttggtagtgccagaatgctgaccagaagttccagtgttggctctagctgagccacttgatccaccaatatggctatcacccattggtccaccaccaaaaaggttcgagaaaacatcaccaagatcaaaaccaccaccaaacgggtttccaccactggccccaggtttaccaccaaatgaaaatgaaaacgtttttgtatttccttgaccacccatcgtctgccatccattaccagatgtgaattgactggacttagggccaccaccagtgaagtatgtagaacccccatgatttccaaaatttccaccaccaaattcagggttacccttctcatccccgtagaggtcatagtttttcctcttctcttcatcagatagaatctcatatgcattgtttatttcttcaaatttttcctgtgcgcccttccctttattcttgtcagggtggtattttagagaaagtttgtgaaaggctttctgaatatcccgttggctagcattcttgtcaactcctagaaccttgtaaggatctatagttttagccgctgcgacgtgcaagacgagcgaactgaggacgagcgaggcgacgaggagggaccggaggaggatccccatcgcggagtggcgagcggctccgattcgattctgcttcgccgggtgaagctgcaagcgctcaatttgctcgggtttgcttctgctggggaaaatcggggttggatccagggtggatttggagggaagcggaggaggacaacttgccgcctcggaggtcccccgaccgttttaagaggcggggcgtcggttggtccccggccggcctcgaggtacccaatg

SEQ ID NO: 22243 - DNA, 4532 bp, Zea mays
gatacatgatatacatcatagctttttacatgctttttgggagattgtattaatctgcatgctggttgggaggttgtagaggtttgcatggtgtcattgttcctttgctagagttcatttgctaaagtttgcttctttgtagtgaacatcgttacattgattactaggctggggcctctctctctctctctctctgataattacttgtcccaagcaacgtcttcttgctgaaattgggtaaggtataaacccttgcttgcaatattctccccctgcttcattcaagaagtgaagcaagttcttcatatgaatgaagcataccattgttatgtattgcgtgttctgaggttagccattcttgttgagtacttcctacatgctttcccagattaacttctcacctttgttaagatatgccatacttatccaaactacatcatcatttaacaagctttctaaccattgagcagctcctcgtttgtttaggacattcctgcaaatcccaacatcctcttcttcagcttatcgcgcactagtagcttcgtctgcattcttgccatcaagacggagctttgaaggctacattcctcgtagctgctccagctcatcgctccagatctacagccggtcaccgctgttaaatctatcgccgtcttcagctctcatggtatcctcccagctcacgggctcctccgacgtagcccaacgttcagaggaatggtttgctcttcgcaaggacaagctcaccacaagcaccttcagtactgctttgggtttctgggctggcaacagaagaccagagctgtggaacgagaaagtcttcggagcgacagagatcaagctagcagatgccgctagatctgccatggactgggggacgcatcacgaaagcgtagccatagagcagtacacgagcatcacaggaagaccggtgggcaccctcggcttcgcggtgcacaccgaggccagcttcggatggctcggagcctcgcctgatggggtcctcgggtgcgagccgcacgacgggatcctggaagtgaagtgcccgttcaacaagggcaagcctgagctcgctctgccctggcgcgccatgccgtactactacatgccgcaggtgcaggggctgatggaaatcctgggcagggactgggtggacctctactgctggacacccaacgggagcagcctgttccgggtgccgcgggactgcgcgtactgggagctcatccacgaggcgctgcgcgacttctggtggggcaacgtggtgcccgcgcgggagctggcgctcctggggaaggacgacgaggcgaggtccttcgagcctcagcccaagcaccggctcacgaacctcgtgctgtataggagccggaagctggcctccgaagcgaagctactttgtatggatgttggcggccatgtagaattcttccaatgaggagtcctgccgccgtttattgtacactgtattatgactattctttaattaacctatgaattcgttaccttcccagcgccatgttcttttttgttctgttctgttctgtttaacaaagagtgtaagtataatcttccagtttgcgtgttcatcagatttaatgtgtttgcaaattttcattcgctgaaactatggaatctggaaaggccagaatagaacctagaaggttagccgcccaatacttctaccaacatatggataccaagctgtgtcgtggcaccaccgcaccagtctcgtgcccactctaaattgcaatgcttttgggttggcctttgctttcccttgtacgcgacgaaagtaatcagatcagataggcagatagcgattgcctgcttcctggatattcttattccctccgttctgaatgtacaaaacggcaaaacggacggctcctcttacccatcatccatccagttgcttccgacttccgagctctcaggaatccttgcgagctctcgccttgcatgtggaacaagcacgtctgcaaacgtgcgaatcgtccacgccagatgtagccggcacctggcttagcagggcagggcttaacataacccggtgccccggtcaagaatatgccggaggcggacctgtccaaaactccaagccaaggccggtaaaccatgcgctcggtaaggcaagacggctttatgattaggacatgtacaacccaattaaacattaaatgaagggtttcttgataggtctttatggattaagtgaaaaaaaattaaaagatagtttttcacgaagagtccatctctatacgactctatatttctctatatttattatctgagactctagattctagattgtatcacacaagggttgtacatgcccttatagcgtagcatgccactagcccaccaccctcgggttgtgccattctgtggatgttgagccatgtggtcgggagcgaccagcactagtctggctctataattagaacagcaggcagcagtgcactcctatcaggtttgtggatcttaagccatttgtggtcacgaatgcccagcaatacagaagcctgctggttcagcaggtttgtagtgtctgtctatatttagaacagcagtcagcagtgctcgcgccgctgaaccacacaatccatgaccagaaaggcacccactccaggtgtcctgtgaatattgcgttgtttaagcgatcatgcctcttttctgtccagaaggacatgaccagacacttggtttcaggagagtggcagcacgcagtagcatgaaaacattaccgcaaagagccagagaccaaaaactataaaggtggacgcagccctttgcatgctttgtttcagctttcatcagcagtacagtggcaaagaatggccatttatttcgctcaccagcacataaaagacggacagttcccagactagccacaaccacaacaggatgacagatatatagccaccagaaaatagaactgaaacgcacctggcaaaaccaggcacctgagcatatgcagtcgcgatataatctaggtgggttagaggtttgtctttattttattctaataaatcacgtggtacaaagtgtctataacctagaaagtaactagtattacatttgtcaattgtcaagtaatagcacacagccacgcaattagataggtaacgtaagggacagatagatacatctgattttatttttgggccaatgaattaaattacttctgacgttccaggaacatgcagcatcaagcaaccggctggagagaaagaaaaaaagtatgatgttgtacttcaacactcctgagcagagcactcccattattccagaaggaaacatccctgaaacaattgtacaagcaaagagtcagcaaaaaaaaactagggcccgatttggagagcagtagctagtacaaattgcagcaaggaccaaaagaactttattagaggtacaacgtcacctacagcaattgtcagttgtcaccattcactgctgacaccatgatacggaaaccatactttgatcttctgatttcctaggttatactgtttttttttcgtttttcttgcaagcaaaaacaatatatcagctgctgcacctacaccgatagcaaactggtagacctttctctcttttttttccttgttagaaatactcagtcaagatgtctgatggatgggagcatcaatcacagaaatccaatgttacaactgtatccatccaatggataacagaatcaaacatctatttttctgtggtggggtgaatacttgacacagtcacggcaaatgctccccagaaaaaatgtctcttcaaattcaaactcactgtcgatacatctcccacatcgcaaacatctagagatgcaaacaacacaccctctgcaaatactagatccgctggtcttgcattcctttgatgtgcaatcataaacaagcttgtagttcggacaaagaggacacttctcaatatcaagagcatactcatcatgaagatctggtacgaaagaatcaggaacatatccaccatgaagatctggtaaaagacgatcagcatgaaagatccgaggctcctgtttgtgtaatggcatctccttgtctattttcatcaaggacaacagctctacatattgcacttctgatgcagtgacacgatttgcaactctgagtttcttgataccaatatctgcttccatactaaatgacctcagactgtcaacaagaccttgatgagtaatccggaaagcaccgaaaatgcccacctgtatcaaaaaataaataaagagacaagaggcagttaagcaaatggagaattggattgccaaaacttgtagcacaagttttcgtaccagttcaactgctattgcaacaaaactaaaatactacaaggcaagtagaaattcatgtgaaattttttcctaaacttcagttgaaaaataagtaaccctcctttgtattctgctgcaaaaacatgcaatattatcaaggtaagtgcatgtaagtagtcctatctaattagtttgcattcgagtttgtagtctaccaagtattatatagacaaaatcatgaaat

SEQ ID NO: 22244 - DNA, 2536 bp, Zea mays
  misc_feature (280)..(280): n is a, c, g, or t
aaaaatagcatatatgatggttgacctcgaattgaaacttgactaattttcctgacaagcaacaagctttgaactcggaaaatgcttagatacgcatacagaaattttgaggcgggaaaaatagttcgtcgttattgatttgttcttatctgtttggaacatcatagcatttacatgcttgttgggaggttgtagaggtttgcatgcttttgttgacttcctagagtttgcttctctgtagtggacatcattgcttgagaggtgggatctctttagctanttctctttgcccaaatattttcttgtcccaagcaatgtcttcttgctgaaatggggtaaggtataaacccttgctggcaatattctacccctgcttcgttcaagaagtgaagcaagttcttcatataaatgaagcatactatttgtgatgcactgcgcattctggggttagccgttcttgttgagtacttcctacatgctttcccagatcaacttctcaccttcgttaatatatgtcatacttattccaaaccacagcatcaactgcgcattctggggttagccgttcttttactcgtttgtttagggcattgctgcagattccaacggcctattcttcaatttctcgcgtgcgtttagccccggctgcattcttgccagcaagatacaactttgaaggctatatcccccgtagctgctccagttcatcgcttcagatctatagccggtcatcgatgttaaatctaccaccatcttcagctctcacggtgtcctcccagctcacctcctctgacgtagcccagcgttcagaggaatggttcgctcttcgcaaggacaagctcaccacaagcaccttcagtaccgccttgggtttctgggctggcaacagaagggcagagctgtggaacgagaaagtctttggcgcgacagagatcaagctggcggacaccgcgaggtctgccatggactggggcacgcatcatgagagcgtagccatagagcagtacacgaacatcacaggaagacacgtgggcaccttcggcttcgcggtgcacgccgaggccagctccggatggctcggagcctcgcccgatggagtcctcgggtgcgggctggacggcgggatcctggaagtcaagtgccccttcaacaagggcaagcccgagctcgcgctgccctggcgcgccatgccctactactacatgccgcaggtgcagggcctgatggagatcatgggcagggactgggcggagctctactgctggacgcccagcgggagcagcctgttccgcgtgccgcgggaccgcgcgtactgggagctcctgcacgaggcgctgcgcgacttctggtggggcgacgtggtgcccgcgcgggagctggcgctcctggggaagcacgacgaggcgaggtccttcgagcctcggcccaagcaccggctcacgaacctggtgctgtacaggagcaggaagctggcctccgaggccaagctgctgtggatggatgttggcggccgtgtagagttctttcagtgagacgttctgccggtggttgtactgtgcactgtgttgtgactattctttgaattaactcattgccttccgagtgtccaaaaaaattttttttgttctgttttttacgagcgtatgatcttccactcacgtcttgtgatcgttttgtgtgtgcatcggatttgatgtatttccattcgctgaaactgtgaaatctggaaagatgacgggttagaactagaaggttgttgtttagctcagataatggattaggtgggtcggccaaatacaagtgcaaatatatttgtggttttcctagcatatggataccaagctgtgtcgtggcaccggggatttcctgcgttgatcccacatgtacgccaaggagaagtaatcgaatcatacagcgattgcctgctcgctggatattctcattcgtcgttccctccgtcctggatgtcagaaacggcaaaaacggactgctttttatggactaatttttagtcttttattttattttagtatttaaattgctaaataagaaaagttttaactttcatatttagtaattttaaaattaaaatagaataaaatatagaaactaaaaattagtctaaaaaaaacaaacccctcttatccatccacctgcctggcagcctgtgcctgttgcttgcgatttccgaactctcaggaatcctcctctcggcttgcatgtgggacaagcaactctgtcttcaaagttcaaatcacccacgccaaatgtggccggcgcctggcttggcagttggcaggttgagacatgcggtcgggagcactgccttcctgtcacttcttgagttcttgtggctcttaaggttatccacgtttataccactctaaatttattatctaaaagaaatattctatctttatcatcaaaattctttaccctatattacaatcttttgtatttatatttactctatatctcaactctacactaataaccatatattttaccacttatttccaaccaaaaaagtagataa

SEQ ID NO: 22245 - DNA, 1379 bp, Zea mays
ggacgcagccctttgcatgctttgtttcagctttcatcagcagtacagtggcaaagaatggccatttatttcgctcaccagcacataaaagacggacagttcccagactagccacaaccacaacaggatgacagatatatagccaccagaaaatagaactgaaacgcacctggcaaaaccaggcacctgagcatatgcagtcgcgtttttttctaggtgggttagaggtttgtctttattttattctaataaatcacgtggtacaaagtgtctacaacctagaaagtaactagtattacatttgtcaattgtcaagtaatagcacacagccacgcaattagataggtaacgtaagggacagatagatacatctgattttatttttgggccaatgaattaaattacttctgacgttccaggaacatgcagcatcaagcaaccggctggagagaaagaaaaaaagtatgctgttgtacttcaacactcctgagcagagcactcccattattccagaaggaaacatccagcaattgtcagttgtcaccattcactgctgacaccatgatacggaaaccatactttgatcttctgatttcctaggttatactgtttttttttcgtttttcttgcaagcaaaaacaatatatcagctgctgcacctacaccgatagcaaactggtagacctttctctcttttttttccttgttagaaatactcagtcaagatgtctgatggatgggagcatcaatcacagaaatccaatgttacaactgtatccatccaatggataacagaatcaaacatctatttttctgtggtggggtgaatacttgacacagtcacggcaaatgctccccagaaaaaatgtctcttcaaattcaaactcactgtcgatacatctcccacatcgcaaacatctagagatgcaaacaacacaccctctgcaaatactagatccgctggtcttgcattcctttgatgtgcaatcataaacaagcttgtagttcggacaaagaggacacttctcaatatcaagagcatactcatcatgaagatctggtacgaaagaatcaggaacatatccaccatgaagatctggtaaaagacgatcagcatgaaagatccgaggctcctgtttgtgtaatggcatctccttgtctattttcatcaaggacaacagctctacatattgcacttctgatgcagtgacacgatttgcaactctgagtttcttgataccaatatctgcttccatactaaatgacctcagactgtcaacaagaccttgatgagtaatccggaaagcaccgaaaatacccaactttgttaactgcagattactctctaaaacagctttcaatccctgctggtgccgaat

SEQ ID NO: 22246 - DNA, 630 bp, Zea mays
caaaatatctggacgcagacactgggccgcgctgcttctccgtcacgctgaatcgtcgtcggctcgtcgcctagtcgccgccggccagccgcaggagctcgccgtcgcgcgttttttgaagctctcgaggaaagggggcgcgcgcaggcgcagcatgagagcggccgtgaacacgccacctccgcgctgctactcgcggcggcgcgccagcgccacgctgctggaagcgcgttatgtgttcgaccacgtgccgcagcggcgcctgccgagcctggccgcggaactccgcgcgcggcccgcggccgtggctgcccggaggcccgcgcggcgctcgcccgcgtctgcggctgcccccacctgtggcgccgcttcagttactcgtttgtttagggcattgctgcagattccaacggcctattcttcaatttctcgcgtgcgtgtagccccggctgcattcttgccagcaagatacaactttgaaggcttatatcccccgtagctgctcccagtcatcgcttcagatctatagccggtcatcgatgttaaatctaccacccatctcagctctcacggtgtccctccagctcacctcctctgacgtagcccagcgttcagaaggatggttcgctc

SEQ ID NO: 22247 - DNA, 1850 bp, Zea mays
gagtttattcttattgatactgggtggggtaattactttgtcaaagtctcaagcaggtgtaatggaagaacttgccgtcaccactactgttggtatggatgggattcctctcgccactagagaagctgctattgcaaggatgccatcaatgattgaaaaacaagcagttgcagctgttgatgaagcatccgtcatactattcgttgtggatggtcaggctggtcttgtggcagctgatatagagatttctgattggttacgacgcaactactctgacaagtgtattctacttgctgtcaataagtgtggggctcctcggggccggccggggcaagcattagacttttggtcactcgggttttctcctctgccaatttctgctatcactggcacaggaactggagatctccttgacctggtgtgttcagagttgagaaaatttgaggtattggatgccgttgaagaagagaaaaataaggttcctgctattgccattgtgggaagaccaaatgtgggtaaaagtagcattctaaatgctttggttggagaagatagaactattgtcagcccagttagtgggacaacacgtgatgccattgatactgagtttactacagcagatggggagaagtacaaactcattgatactgctgggatccggcgcaggacagcagttatttctgctggcagcacaaccgaatcactttcggtaaagcgtgcatttcgagcaattcggcgctctgatgtggttgcccttgttattgaagcaatggcctgtgtcacagagcaggattataaaattgcagagaggattgaaaaagaaggaaaggcttgtgtcattgttgtgaacaaatgggatacaatcccaaacaagaaccacgagagtacaacacattatgaacaagatgtaagagaaaagcttcgcatacttgattgggcacctattgtctactgttctgcgacaaatggcaccagtgttgaaaagataatttctgctgctgctttggttgagaaggaaaggtctagaagactcagcacctccattcttaatcaagttattagagaagctatagcattcaaatcaccaccaagaacaagaggtggcaaaagaggtcgtgtctattatacaacacaggctgccgtcggtccaccaacattcgttctatttgtaaatgatgcgaagctcttccctgacacgtaccgccgttacatggaaaagaaactccggtcagacgccggttttccaggcacccctattcggttactgtggcgtagcagaaggcggccagacaaacgaggtaaatctgctgacagtagagcgcagagcccaggaacccctagtgaagtggctctagccgcctaactaaaccgcggcctccagaaatgctcgccacagatcagctcgaccactgggaatggaattctatcgaggcggcggcagttgcttgctccaagaacctggatcggctgaggagctagctgttcatggagtagcgctctcatgttcgggccttggagattttgttgcgtctatatactactagtacggatcagacggagaaagcacattgggccaatgaatgaatagtcacacttcaccgacagagctccaagcacgctttttccacagcgctcttggaacatgtaagattgtaccgaaagaatggcgttagaatgaccatgtaaatgtaatcgtagactgagttctcggatgtgtgggtaaacagcatacttaggtgccgtttggttgttttgtttacgaaatgtaacttaattggtaacggtaatatgttaggagtattttttattttgaacgagaaaaaggcgtgcggactgccaattacatattc

SEQ ID NO: 22248 - DNA, 1140 bp, Zea mays
gagaaaatagagatctcttagaaaatggtgttgcaaaactagcccttatacgacattcagcaccaggctatagtacagatccaacagtgaaatattctggcgattctcataggccaatacgccatcacaatgtcaaactgccatgccaacagcactgaaatgccaggaggagcactccccagaattacaatttccaaaccatgacgaggagacgttgccaaacaagctttaaaacgcgaggaggctcgcgagcactagaattacaatcatgaagagcagggccttcagataaatatctgcctgctgctgttgttgccccaacggtgcctgtcggtggacgccatgggcttgtgcttgtcccatatgcccgccatggtggaacccatgcccatgcccatgcccgtatccatagtggaacccagcaggctgcgcgtaagcggcggcatctggaaacccatgaacttggaagctaagcatagggaacagtcccccgaaagcagctgagaatgcgtagttcccccatcgcgcatttgccagagggactcctgtgcccgggaaccatggattggcattggcattggcaaagttgctgttagcatcggcccggggggctgtggcgggcctctggccagttgggcggtgaggaatctcgccctcgggcatgttcttcgacctcgggtcgacgcgatccttgccacgcccataaagggggacgagcttgtcctcctccacgagggccttgcacactgggcactctggcgagtgtgcgtgaatgtgcagccaccggtaaaggcacggccagcagaagaggtggccacagagagtcactattggctcctgaggcagctcgaagcatatgttgcactcaaagctccccccagctgcatcgctgctgctgacaccgctagttgattcacccacattggctgacattttgttgggagtgaaccaagctggtggtgctcgtcgccggcgaggggtcctaggaagtaggaaaacttggggcccctgatgtaggcggcagcgacctgggccccgaagaagacctggcgtagtcgtcggcgacagagagggagaggagctgcctggagcccgggaagtccggcccaggtaggagaagaagcccggccggcctcgagg

SEQ ID NO: 22249 - DNA, 3072 bp, Zea mays
atttaaaaaactgtagttcggaaaaactgtgttcccaaacaaggcctaagatgttgtttacattccagtagattctacagatctcgatgagaaatagtgtatttaattgattatgtgtttgtataatacgacccaatagagcctagccttgtttagacgggattctattcacacttttttattgtgttgtgaaactcagatacttagctagacgcagatgcatattctatggacagtccatgcaaatacaatacttaggactagtttgtcaagtgatttccatttttctaaaagaaaaccagttcaattttctttgagaaaatagagatctcttagaaaatggtgttgcaaaactagcccttatacgacattcagcaccaggctatagtacagatccaacagtgaaatattctggcgattctcataggccaatacgccatcacaatgtcaaactgccatgccaacagcactgaaatgccaggaggagcactccccagaattacaatttccaaaccatgacgaggagacgttgccaaacaagctttaaaacgcgaggaggcttgcgagcactagaattacaatcatgaagagcagggccttcagataaatatctgcctgctgctgttgttgccccaacggtgcctgtcggtggacgccatgggcttgtgcttgtcccatatgcccgccatggtggaacccatgcccatgcccatgcccgtatccatagtggaacccagcaggctgcgcgtaagcggcggcatctggaaacccatggacttggaagctaagcatagggaacagtcccccgaaggcagctgagaatgcgtagttcccccatcgcgcatttgccagagggactcctgggcccgggaaccatggattggcattggcattggcaaagttgctgttagcatcggcccggggggctgtggcgggcctctggccagttgggcggtgaggaatctcgccctcgggcatgttcttcgacctcgggtcgacgcgatccttgccacgcccataaagggggacgagcttgtcctcctccacgagggccttgcacactgggcactctggcgagtgtgcgtgaatgtgcagccaccggtaaaggcacggccagcagaagaggtggccacagagagtcactattggctcctgaggcagctcgaagcatatcccgccctcgccgcgccccccacctgcatcgctgctgctgacaccgctagttgattcacccacattggctgacattttgttgggagtgaaccaaactgcaattgccaaaaaaaaaaacaccatcaccaacactgatagaaatttgaatggctgcaaatactgatgctggtgaaaaccagcatccaacaagtaggaaattacataactagaaagggaatcccaattttcctctactcagcataatgaaagccacaaaaagggtccatgtttaggggaagagcaaaatttcaatggacttagacttgaatcaaaccataaaccaacaaatattgtaacaagaaaggttccccaaaggggtggagcttggttaaggccaagctgggccacagccatccctactcaatgtgatctaaacagtgattttgtatagtttgttagggtgtctttggtttctatggactagtttttagtctctccgttttatttcatttttagtccctaaattactaaatacggaaactaaaacagagttttagaaatcccccttgattccccaattagttctgaataaaaacgacaactccagcaaaaccattttatctgcagaaacaagccctggaaagtaatttcctagaaaagagttcgatagctccctccagggggatttctaaactctcagaaaatttttttaagctttacgccaaactctagaagaacatgataccaacggaagccaatccaattctatcggcgcaggggcggaccgacatgggtgtacacatgtgcggccgtttttttttggaaaacaatcgaaagttagtaggcatgatacatgtatgtatcacatgtaattagatcagatccgaatacagatagtaagttaatttttgcaaaacaatcgaagttagtaggcatgatgcatgtatgaacacatataattagatcagatccgaatacagatagtaagttattttttgcaaaacagtcgaagttagtagggatggtacatgcatatacacatgtaattagatcagatccgaatacgaatagttaggtttgggtgctcgatgccgtgatgcagaaacggaagactaaggggtaggcgtacctggtggtgctcgtcgccagcgaggggtcctaggaaaacttggggcccctgatgtaggcggcagcgacctgggccccgaagaagacctggcgtagtcgtcggcgacagagagggagaggagctgcctggagaggtaacggaagaagaaaaaagacagcgacgctggccacgaataaatttgcatggattcgggtttaattctctgtctcgtatataaatttttaattattttaacggaccatatgtagcatctttaaaaaaacatacggtagaatgtgtgtatgaatattttatagaaacaaattaagaccttattctgttattcttatctcatataaattggatgaaatttaaaaaatatgaaaattttgacttatttagaatttaaattcactcaatcctactaaatctatatagattgagaacataacaaacaaaaccatataaagtgggtaggactcatttatgttttctcttttgtttattcttccctattaatcttgtcgatttcttctacttccatcgtcttcatcctccttatgctaccttcggcagttttttttatcctcatattcatattcaatctatactctacgaattatacagtctacagcgcaaagatgtataaaacatcattttagatggccatataagtaaattggagacaatcttacaaataaccagggtaaaaaagatgcaattatgacaggatcacgatcgagtaggtgagctgcagcagatgatataaatacatctgtagtttatgatgttttaattctactaacaataaa

SEQ ID NO: 22250 - DNA, 1089 bp, Zea mays
tttttttttttttcctacagtgaaatattctggcgattctcataggccaatacgccatcacaatgtcaaactgccatgccaacagcactgaaatgccaggaggagcactccccagaattacaatttccaaaccatgacgaggagacgttgccaaacaagctttaaaacgcgaggaggcttgcgagcactagaattacaatcatgaagagcagggccttcagataaatatctgcctgctgctgttgttgccccaacggtgcctgtcggtggacgccatgggcttgtgcttgtcccatatgcccgccatggtggaacccatgcccatgcccatgcccgtatccatagtggaacccagcaggctgcgcgtaagcggcggcatctggaaacccatgaacttggaagctaagcatagggaacagtcccccgaaagcagctgagaatgcgtagttcccccatcgcgcatttgccagagggactcctgcgcccgggaaccatggattggcattggcattggcattggcaaagttgctgttagcatgggcccggggggctgtggcaggcctctggcccgttgggcggtgaggaatctcgccctcgggcatgttcttcgacctcgggtcgacgcgatccttgccacgcccataaagggggacgagcttgtcctcctccacgagggccttgcacactgggcactctggcgagtgtgcgtgaatgtgcagccaccggtaaaggcacggccagcagaagaggtggccacagagagtcactattggctcctgaggcagctcgaagcatatgttgcactcaaagctccccccagctgcatcgctgctgctgacaccgctagttgattcacccacattggctgacattttgttgggagtgaaccaagctggtggtgctcgtcgccggcgaggggtcctaggaaaacttggggcccctgatgtaggcggcagcgacctgggccccgaagaagacctggcgtagtcgtcggcgacagagagggagaggagctgcctggagaggtaacggaagaaaaaaagacagcgacgctggccacgactaaatttgcatgccggccggctcgag

SEQ ID NO: 22251 - DNA, 1413 bp, Zea mays
aatatatgaaaatcttaaatattaatatgaaaatcgaaaacccatcacaacactagaaccattgtttgtgcaaagctaggcactgacaaatattgcaaagctctacccctccttcttttgtcattcttacctttttaagtgcacatcacattcatctccaaaatgtttttttaaaaaaatcaagactagacagtaataatttcaccatgttcctcctagtactctatataaggtgttacgaaacgtaggtacttatctagacattaatacatattctatgaacacttcatgcaaacagaataataacttatgcaacattcagcgccaagctatagtacaaacacactgaaattctggcggttcatgggccaatatgccatcacaaatgtcaagctatcaacggactctgacatgtcaggaggattgcattcccagaattccacgtcccagccgtgacgagcaggcctcctggtagacgttgccaacaaattttaaaacgcaatgaggcttgcaatcactagaattccaatcatgaagagcagggccttcaagtagatatctgcctgctgctgttgccccaatggtgcttgtcggtggacgccatgggcgtgtcccatatggccgccatggaatccatgcccatggccatacccatagtggaacccagcaggctgcgcataagcagcagcatctggaaacccatgaacttggaagctaagcatagggaatagtcccccgaaagcagctgagaatgcgtagttcccccagcgcgcattagccaaagggactcctgtgcccatgaaccatggattcgcatttggattggcattggcaaagttgttgttagcatcggcctggggggctggggcaggcctctgaccagttgggcggtgaggaatctcaccctcgggcatgttctttgaccttgggtcaacacgatccttgccgcgtccataaaggggaacaagcttgtcttcctccacaagagccttgcacactgggcactctggcgaatgtgcatggatgtgcagccaccggtaaaggcatggccagcagaagaggtggccacaaagagtcactattggctcttgaggcagctcaaagcatatgttacattcaaagctccccccagctgcatcgttgctgctgccaccgctggttgattcaccgacattggctgacattttgcaatttgttgggggtcaaccaagcttgtgtgctcgtcgccggcgaagggccctaagaagatttgggcacctggcgtaggcggcaacgacctgggtctgaagaagacccggcgtagtcgtcgccgacggagaggggaagagagcgcgcacgctggaacctggaggtaagagcgggccgccgcggcggaccgggaataaatttgcatggaccgggtttcccggcagg

SEQ ID NO: 22252 - DNA, 1904 bp, Zea mays
cggacgcgtgggaaaaaaaaaaaaaaaaaaaaaaggaaaaaacttcaacctattgtcttctctgtttggccaacagtcaatagattcatttcagatatacaaagtgcttcaaggattgtgctgcaccgcactgtactgaagaccacaaaaaaaatgggctgcaaaattgtgtacaattactatccactcattctacaaaaccatctgagattttttacaaagctactctaccaaaatccgttggtttccttcccatctaaatgacctagcctttgcacccattgtgaccctcaattttgtacaaacagtgtatctcatgccttaattttcattactttactactgtctatgataactagtagatagcaaatctggaagcaagtaatggacagctgaacattgaatctttgccacgggtcattactgaagtaggccatcaccttcccaaccaagccgcagcatctgatccaccaccttcaagctcaaagcgggatcagtaaagactataagctgtttatcagcagtagaaactaaaagatttgtgttctctttgtttagagcaattgctgtgatgtcctggccctttgccagcttcagagtatgaaaaaccttcagtgtatgcaggtcaacaaagcagattgaaggcgcgtgaacagattgttcagaattttttgatacatcatcagtgccattgggtccaagctcatgatccccagtttcagtactgttatcacacttgtagttgttgaacaaagatgttccaaataaagcaaaatggccatctgtagaaatctcgatgcaactaacttgtccagagaaaggcaacagaactgagttagcaatagggagtccattgacagtgaaggtagataatgttttctttgttccattccaaaccaaaatgattccttgagaagataagcatattgcatgtgcctcatcgacatcaagcctccttatcagcctgcctgtgcgtaaggaatgcagaagaatgcctgttgcatttgatgaggaagcaacaagtcctaagtctggactaaccgagcagcaggttacttccccaagatgtcctctcattacatgcattggaccttcaacgcgacgtctctttgtttctgagaggctgctcatggtgctagtgctgccagagagaggactgcgtggtgtcgttggtgtagtcggtggaggttcttgagcatttttcttatgtgaggagcctgtctgatgaatcctccagagtataactgtggtatctctagaccctgtcacaaggtagttgctatcaggtgacagcgcaaggcatgtcactggagcaatatgcccagaagcagtttcaattgtcttcgctccatctagggatatcaacttcaatgaaccatcaacgtggccaccagtaattatctctttgtcacatgtcacagcaacaactgctgaactgcggattgcagaagcagcaaatgctatagcccttgggaacccataatcttccgcagaaccagcagatcctttgaaaatgcgcatgagtgcgccactggttgaatttgtggaatttctaccatgatggaaaaggaaaggtgttccctgaccatctggagtattagcctgccattggtgaagtgccacatgtgctgctggggcatttacatcaacaactacaatagagtcgtttgatacaagcatagcactggcaggaacattgcaacgatctgaatgtggaagcacatatgatttaagttcacttggatttcggaatattgtctgtagttgtaagacctccgccagtggcttcctcttcatgtgaggtacagtcagcagttgagatggtgtttgtccaaagtaagctatttgatcttgtgtagctcgccgatccactgggtttgtaattttgtcaatgtcaacagtcc

SEQ ID NO: 22253 - DNA, 1607 bp, Zea mays
gagggaatcgctcaccttgaggttggggctgacgagggccatgaccgcagttctagcaagggagctcccaatgcgagtggataactccattgcagcattgttccgcctcctcggaggtcgtaggctcgcagcagcagttgaagccgcaatcccccgctcccctgtccccattcacagctgaggggatcggacggttagcttgaggttttctcgttccttgatctatctcagccgttgatttccatataggacgggggaaatgcctccctgatcggtttaagttctttcgctgcggagatggcagcggcggcggggccgtacaaagagatgctggaagtggtgaacgcgtgcgcggcccggatccggtggcgcctccgtccagcttccaagcgccgcctcctcaacgatatcctgtttctctgcactgggttgcggcctgtggtactggtcgactatggtggcacaatgcctcagctacaagaaaatctttgtggcctgctatatcatgcccggcaggaaacaagcatattgaatccactccgcgtgatgattattagagatatgctttacttgatccatgttaaaggacttgcggaacatgcatcaccaaacgcaaggtcgcagcaagggctagctttcgtggacctagagaaaagatgttgcaatctgcttacaaccatagaagagaatgacactgtgctggagcttgtatccatacaagatcaattcgcagccaaatttcctgtagatctctctgatgttcgacctggaataacaaagcaaatgtcaggaaatccacagagtactgttgttgcagagtgcactgacaatcacgttgaggacaggaccctattggtcgttgatctgagtagcttcctcgagaacacccagattgccttgccttctctgaatgggtggcttttaggttatccggtaacatatttgttccgcaatgcaagttctgaggcagcgatacagaacctctcaaggcagtctctgcatatctaccgagtatatgtgtgcggaagttatcggtcagctggcgaacgaagagaagaggaactgatgagtttttcagttccatgtggcgcgagcacgaagcgtgatgaagaagtatgggctagatcgttcatagctcgcatgaatgagaagctcaggcgatgcagccaagtctgggcatccataaggctagaagtcgaggttttccagagccagtcgcaggtcattgtgttgtagttgagatcagtatggctgttattacgggctgatggcataaactccttatacaaagcgacgtgtctcagaagtatcactgccctgggccaaataaacgagttggatacaagtcatgcatgcagaggccggaggtcatatccattatatattttatatatttatctaaaaaagccattatattatgctcgaattattgagcagtttatgtcactataaattcaaattcgttttagtcgtttctgttgactttgtataacctaatccttgacgccgacatgtcttttatatttacatcaaaatcgcaaaaaaaaaaaaaaaagagttacaatttgacaaaaaaaaaaaaaaaaaaaaaaaaaaaaacagaagaa

SEQ ID NO: 22254 - DNA, 3253 bp, Zea mays
gtccaaatatatttttacataaaattgaattaacttaattaatatatatctaaattactattattagaatgtaattcaatttcaatgatacaaacgggacgttaacctaacttgagccatcctgtagcataatttcccacaaggtgttactgcaaccgagattatcctcacaaccacgcagagaagcatccgactgagggaatcgctcaccttgaggttggggctgacgagggccatgaccgcagttctagcaagggatggataactccattgcagcattgctccgcctcctcggaggtcgtaggctcgcagcagcagttgaagccgcaattccccgctcccctgtccccattcacagctgaggagatcggacggttagcttgaggttttctcgttctttgatccatctcagccgttgatttccatataggacgggggaaatgcctccgtgatcggtttaagttctttcgctgcggagatggcagcggcggcggggccgtacaaagagatgctggaagtggtgaacgcgtgcgcggcccggatccggtggcgccttcgtccagcttccaagcgccgcctcctcaacggtcagtgcccactcgcttgctgctttctcttagtagttgtagtcgttttttaacgggaaatacagcagggaagccaccagcccaccactataggattttattaattgaaaaatagtgttgtagttgttattatctctatttaggacttgctgttggcaattgtcctgtttcttgcttaattcgctaccgccatgctgtctttctgttctactgctaaaacacttattttttgtggtcgttgaatgaattgttaaccaaacccaattgcagaagacattcatccactaaatcgtcacatgatccaccttagttcataagtttataccaccgtagttataggtcacttggtcagtagctgcaacttgcaagtgatttagggtttaataaaaaatttctggtagtaaagttgaaaggtatggtttgaggagagtgaatggtatcatgtcgaattacagtacattacaatttacaagtaaattgattagtcctctggtctgttgattggtagcatgtttttcctatgtaattgcctctgttcttcttctttaggggctaggttcgttgtaatcatttgaccgtggggatgtttgtactaaattcttatttctcttaaggaaaatcatgctaatgcacagccgcgaaaaaaagtaaattgatgaacaaatctacctaacttttgatttctgttggattttaactctagtctacctctttgaaattaaaaggctgtgctgtggttgttgatgaacaaacccagttgttgccagatatcctgtttctctgcactgggttgcggcctgtggtactggtcgactatggtggcacaatgcctcagctacaagaaaatctttgcggcctgctatatcatgcccggcaggtaatttcgtgacctcgatgtatcaaatattaggattctctgtaccagttcaacacagaatcaggtattgcatatggatcatttttctccactgctaattgtcatccgactgacaataaacgatcgccggaaataatactgccatctgtagtcttactcccttgcaagcgcatcggaatgatgtggttctggtcactgtttaaatttcacccacgtcagcactgtatgccctttccccttcactcacctggcaaacccctgttctatggaaggatccttgtgccaaaagacataagttttttggatcttgatagtgactagaagtttgtaatatgtatattgctctgccatgcaacagttacatttacaacagatatcttgaatagtaatgttattttatttctttttcttaaatagtcctcatatttaacttcgtttttatatcatactatgatcttagttcgtaactctagccacaaaaaataaaaaacgggggtgtatatctttaggattggagggagttgtgatgggaagtcgaagtccggtggccggtgtaggtagtggcggcggcggccttccctctacttccgcgtagagatagatcggatctcactagtctgtgtatgcatgaggatgtgcaatgaatgttggttcgtgtgccggccttgatccctatttatttacacggtatgaaagggggccaccaccaacacggtcaggatgcgagtgtgaggtccggctcgatcctcaaacagagtccggatgagatcaacccaacaaaactgacctgtgtcctgttcagtttccaactctttccatgaccaaactactatctttagtagaggttatttggatgtcctctgtatatccaactgcatccagtttcggcatattgagtcatgcttgacttgcaggaaacaagcatattgaatccactccgcgtgatgattattagagatatgctttacttgatccatgttaaaggacttgcggaacatgcatcaccaaacgcaaggtcgcagcaagggctagctttcgtggacctagagaaaagatgttgcaatgtatttaccttctcaaaccacacttttgtatttctgtctactgtgaagtgaatgtgtagtatttgttgttaatgaaaagttgtttgtgttcagctgcttacaaccatagaagagaatgacactgtgctggagcttgtatccatacaagatcaattcgcagccaaatttcctgtagatctctctgatgttcgacctggaataacaaagcaaatgtcaggaaatccacagagtactgttgttgcagagtgcactgacaatcacgttgaggacaggaccctattggtcgttgatctgagtagcttcctcgagaacacccagattgccttgccttctctgaatgggtaatttctggttctgtgtcatcaaaactgtaaccatgaaattcttgatctagtgaaaccactgtttgaacacttggaagaaaaaaacatttgcacagcggcatcagcataaaaaatggcaaatttattcgttttgatagttctaataacatgtaacagaggtgtggttcatactgccattgttatggatgctatcttgattaagttttgacatttgctctgctctctgaataacatgcttctgtttcaatatctgcaggtggcttttaggttatccggtaacatatttgttccgcaatgcaagttctgaggcagcgatacagaacctctcaaggcagtctctgcatatctaccgagtatatgtgtgcggaagttatcggtcag

SEQ ID NO: 22255 - DNA, 1404 bp, Zea mays
  misc_feature (49)..(49): n is a, c, g, or t
  misc_feature (51)..(51): n is a, c, g, or t
ttgagcattgaataacgaagtactatatgaacaagataatttccttgtnanatcaatcagaacattttgtttttttattttagctttggaggtgtcatcccttggcaactttgtgtatatttcttttgagctgatttcatcttttcaagcaagtctcatcttccttctccatatttcttcggcacaggatattaacaaaggcccaaagaacaaaccatcaattctgggaactgcttctctcaatctagcagattatgcattgacggctggagagacaattgagataattcttccgttgtctatacctgtcggtgcccctgaacgagcctcatcccttcatgtgagtatacgaagtgaactagaagttctggttaacggttgtccttcaatttgttaggaaaaaaacttttacttagatcactataccatgtgacctttgatctttttttgcagctcactctgagtatggttgaattaagagcttttcaagaaacatctgatgcatcacagcgatctgctgcaaccttgccattgtccccatcacctagtgattctcttcctggaggaaaatatgaggttttggttattaaagcagggttgaggaaggtaaaaattctcacagatctggtgtcgacacgaaggcctaagaagacttgccaggcaggtggcgaagataagttttgtgttaacagtgatggtgctgaatatccatgtgatactgagtctcttgatgacgatctagatgacagagtagaggaagatgaatttggagattcaactatcaggaagtctttcagttatgggtctctgcaatctgtcaactatgttggtggcctagtttatgcccatgcaaagattgatggggagcatgaggactggatatattatagtaaccgaaaaactgatgtcggtttccatgtagagaaagtattgccatcaaccacagagaatgggttgctaactgctaagcgcagtatacttccttggagaaagaggaaactgagtttacggtcgctgaaggctaaaggtgaacctctcttgaaaaaggcatatggggaagagggaggtgatgatattgactatgatcgacgcttgctaacatcatctgatgaatctgtttcagaggtaaattttccttcctatttttagcattataaaacaaagctatcagtatatttcaggaatttacttcagcttcactttttccctttttaatacatttttggatttcagggatcaagaggagatggatcagcaaatactatggtgtcagaatttggtgatgacaattttgtcattggaaattgggagttgaaggagataattagccgcgatggccgtatgaagctttcatcccagatgttctttgcatccatagaccagagaagtgagcgagcagggggg

SEQ ID NO: 22256 - DNA, 1302 bp, Zea mays
ttgggtacctcgaggccggccgggtattatttcaggcccaaagaacaaaccatcaattctgggaactgtttctctcaatctagcagattatgcattgacggctggagagacaattgagatgttccctccgtccccgccgcctggtggtgccacctgatcgagcctcatcccttcatctcactctgagtatggttgaattaagagcttttcaagaaacatctgatgcatcacagcgatctgctgcaaccttgccattgtccccatcacctagtgattctcttcctggaggaaaatatgaggttttggttattaaagcagggttgaggaaggtaaaaattctcacagatctggtgtcgacacgaaggcctaagaagacttgccagggaggtggcgaagataagttctgtgttaacagtgatagtgttgaatatccatgcgatactgagtctcttgatgacgatctagatgacagagttgaggaagatgaatttggagattcaactatcaggaagtctttcagttatgggtatctgcaatctgtcaactatgttggtggcctagtttatgcccatgcaaagattgatggggagcatgaggactggatatattatagtaaccgaaaaactgatgtcggtttccatgtagagaaagtattgccatcaaccacagagaatgggttgctaactgctaagcgcagtatacttccttggagaaagaggaaactgagtttacggtcgctgaaggctaaaggtgaacctctgttgaaaaaggcatatggggaagagggaggtgatgatattgactatgatcgacgcttgctaacatcatctgatgaatctgtttcagagggatcaagaggagatggatcagcaaatactatggtgtcagaatttggtgatgacaattttgtcattggaaattgggagttgaaggagataattagccgtgatggccgtatgaagctttcatcccagatgttctttgcatcaatagaccagagaagtgagcgagcagctggggagagtgcatgtacagcacttgtggctgttattgcagactggttccaagcaaatcagaatatcatgcctatccagtcacagtttgacagccttatccgtgaaggatcactagagtggagaaacctttgtgagaacgagacgtatagagagcgttttcctgacaagcactttgatcttgaaactgtccttcatgccaagattcgccgctgacagtttcccccagcaatctttattgattcttattatgactatggatgagacttttgtgatataattgatgaga

SEQ ID NO: 22257 - DNA, 1056 bp, Zea mays
ggttgaggaaggtaaaaattctactgatctggtgtcgacacgaaggcctaagaggacttgccagggaggtggacaagataagttctgtgttaacagtgatggtgctgaatatccatgtgatactgacttctcttgatgacgatctagatgacatgagtagaggaagatgaaattggagattcaactatcaggaagtctttcagtggggggtgtctgcaatctgtttttatgtcggtggcctagtttatgcccatgcaaagattgatggggagcatgaggactggatatattatagtaaccgaaaaactgatctcggtttccatgtagagaaaggattgccatcaaccacagagaatgggttgctaactgctaagcgcagtatacttccttggagaaagaggaaactgagtttacggtcgctgaaggctaaaggtgaacctctcttgaaaaaggcatatggggaagagggaggtgatgatattgaatatgatcgacgcttgctaacatcatttgatgaatctgtttcagagggatcaagaggatatggatcagcaaatactatggtgtcaaaatttggtgatgacaattttgtcattggaaattaggagttgaaggagataattagctgtgatgatcgtatgaagctttcatcccagatgttctttgcatcaatagaccagagaagtgagcgagcagctggggagagtgcatgtacaacacttgtggctgttattgcagactggttccaagaaaatcagaatattatgcctatccagtcacagtttgacagccttatccgtgaaggatcactagagtggagaaacctttgtgagaacgagacatatagagagcgttttcctgacaagcactttgatcttgaaattgtccttcatgccaaaattcgcccgctgacagtttcccctagcaaatcttttattagatctgtcttattatgactatggatgagacttttgtgatgtaattgatgagactatggatttcaatattgttatgtgattgtgtgtgagatgttttatgtgaaaaaaaaaaaaaaaa

SEQ ID NO: 22258 - DNA, 6282 bp, Zea mays
cttatatgctatcgggctcgagcccacccagccgcctcgacgtaagtcattccaagagttaaaacatctcaaagttaattaaaattatagagaaaatacaaaatattataatattaaatatgtatactataaaataatattaatgaagaatctaatcatacatattaaatattataaattttatctatttattatataagtttaatcgactgtataaaatcttttctcgatccgctccacgcatgcacaccagaattatcgatgaggttacaactgctagtatcttggtatgtattttatttatattgtacatggagtacaccgaagccaaggcttgtatcgtgctagcgatagcaaataacatcagtttaatttttagtagcagataggaccataaatggctggtgattgggtgcagtatcgagaacaccgcagagactgaactgccgatacggttggcgagataggaagcatgtgcaagccacggtggcgtccataattttgcagcgctgctctgcaatcagtaggtggcggtgctggtggcgtaccaccgatctcacctcccagctccaaagaggacacttaattctagttctagtagcagcagcagcagctactagtactggttcctcgtgattagtatgagtaattactagtaagacgcagaagcaacgatctgcctattgccagtacgcaggagtagttgttgtcctgccctgcagagcgggaacggagttggaaattgtggggggaggaccggagtttcgtagccgtcggcgacgacggacgtggtcctgccctttctcttccttccctccgcatctgatctgcctgtctgcgctgctcgtctggtctggtctggtctggcctggcaacccccctcctcccctcttcggccgcctttgccttttgcctttgcagcctttttgcaccctgcctgcctcccctcctaccctccctccgcccccgcctccccctccgcctcccaccggcccacccccactctcttcttctccactcggccgggcactctccttgccccggcctcacaccatcacatgtccacaatgctgccgtcctccagatcgaggtgacttactttcgccccctcccctgctcccggactcttgcgttttctctctcttttatttatttatttgctcgcgctcttgttccgcctgtcggttttctcttctttcttgaatgacagatctagtatccagtaatccagttagagccgcctgtcgctcttgctgccgtagttgcctccttgtcaaatatgtgtatactgggctactggctcgtgtgatttccgccacacgccaatgtgcctttcttcagatgccgtttcatctctgcaaatcctcgaattccgatcgtggccgttacggtttcatttgatcgatttccaacaagaaaaatctgaacctgcctgcgttcaaccctgtggcttcgtgccactccactagtttgcagtttgcactcgattcggcgacagagaaaaaaaaatagatttttgatttttaattaacggcgatggatgtcgccattggcagatctgggccgaacgagtcccccgtcagcaggggcaggccgagcacgccatcctccaaccaccgcccctccacgccgtcctccaaccaccgcccctccaccccgggcggcaccaggaggagcagcgtcggcacgccatccacgccgcgctcccgcagcaacggcgcgggccccttcaagtccgagcccaactcgccgccgtcggccgccgcgcagaagccccgcctctcgttcgaccgctccccgagatccggggacaccaagcccgtcgtcgagcgccgggtgcccaagatcggcacgactcctgaagtaagtataccgcacccaacggcaaccatcgtgtcggttcttgacgcactcctatgcctgttgcctgatcgctatggttttctcgctgggatcgcagaagcatctccggagggaggccgaactgcaggcgcggcttgagtccgcccaggaggacctgaagaaggcgaaggatcaactggcattcatcctcggagagagggaccgtcttgtcggggagctcaacgaggccaagagagtcgctgatgagactcacgagaagctccaggatgccctcatggccaagaggtgggccgaggaggccactgagatcgagaagttccgggcggatgagctcgagcaggcaggcatcgacgaggcgcagaggcgggaggacgagtggcagagggagattgagtgtgtgcgtggccagcatgccgctgacttggagagtctggtcaacacaacggaggaggtggagaggctcaggcgtgatctttccatggcgaacgaggccaagaaggctgcacttggccacgccgatgatgcaatgaagattgctgaagtcaatgcagagaaggtggagattctctcaaatgaagttgttcgcttgaaaggcttgcttgattcgagtgctgccagcgaagagagtaagagccgtgaagctgagcttcttgttaagaatctggagtctgaagtttcatctctgaaaggcaaacttgaggaggcaaaagtccttgaagacaggttagccgacgcagaaaaaatgattgaggagcttaaatcagagatagctaatgcgcagaaggtcgaggaagacatccgtcagcagttagaagaatggaagcagaagtcagtatcacttgagatgaaattggaggaagttactctatctgagaagttcaaaagtgactcacttgtttccacgactgaagagctgtacaagatccagtcgatattgcaagatcgagaatcggaaattgaagttcttaaaggaaagacaactgccttggaaatcgaggtgacaaggcttttagcagatgtgactgattcaaatgagcatcttgatgcatcacagcaagaggtgtttgggctgcagacaacaatagatgttctgaagaacaagcttgaggctgcagagctagctgcctcagaggctttggacaatgagaggactgctaccacaaagattgaagtcctgactgaggagaaaaccaaccttattagtgagctggatgacgctagagacagagaggagagagagaaaagggcaattgaggatcttactgctgcattggataaggtaactggtgaagcacaggaagcacatgataggtgtcagaagaaagaagatgattatgaacatgcccttgcgcagataggtgatctgaagatggccctgaagagtatggaagagacttatgaggtaatgcttgatgagtcagaacaggacataactggcctaagggaaactgtggagaagctggaagctgaggtgagcaagtacagagaagaatgtgaatctaaggagcttgaccttatcacggctactaaacagtctgaacaagaaattgctgctcttaaagaagaagcggagcatgtatgtgcatccctgcgaggtgcagagcaggagcttgaagcagtcaatgaagagaaagagaggcttgaggggaaattggcacgcacagaatcagcagttgctgaagccaacgatgctgtgcaggaggcaaaagctgaaaatgagaggcttcaagagaaacttgcacacgtggaatcagaggctgctgaggccaacatggctgcagaggaatctaagaatgagatcgagagacttcaagagaaactgacatacacagagtcggcggttgctgaagccaacaagactgtgcaggaggcaaaggctgagagttcacagctgaaggagcgattacttgacaaagagaatgcattgcagagcataacccaggagaatgatgagttcaggatgcgagaagctgacgccacgaagaaaatagaggagctatctgcgctgcttgccgaagccatgacaaagaagcatcccgaggaggaagagaagctggtggttgttgatgaggcacacaattctggacgtgaagctatccgttctgtggcagaaaatgaagatacagaagaaactgaccataagaaaccaaagcttgaagctgatgcagtcgatacgaactccaacggagaaccgaagcacgacgagaaagacgacagcaaggtggaagaagaggagctgaagactgagctcagcctacaggagagcgacagagctagctctgagaaggaagcacagtccgaaaacaggagacaagaaacagaaccatccaacgacgagttagacccgaagaaggacagcagcaccgagagcgccaacggaacggccgtgccagaggatacggcagcgacgacgactaaagcggcaacgtctcctacgaaaccgcagcagccgcagcagaaaaagaacaagcctctgctgaagaagtttgggagcttactgaaaaagaaaaacagcaagtagccgaacggtgggctgtactactactagtgttgttttgattttcttctttcctctccctttttcttttttttttctttttggggtctgtttgacgaggtgttgtgcttgctatgcgtcgtttaccgccaatgcctgtatttgtgggtgattggagaagtttgtgggtgtcgtgaattttttaacttggggacctatatggtgttggctgctgctgtctacacgtttgtggcagatcctcccatgtgtgtaaatggagttactcttcctgatcagaatgcatggctattcgtttctggaaaaaaaaaaaaaactgaaagatagaaaggtcatgtgatgtaaacctcctagcagagaatgtgatctggcatgcagttggtatcatagtgcagaacacctgaaacgaaatgagttggcttatggttgtctttatgtggttgtagcctcctaatctgttccggttgcttaagaagacggcatcgatcagatcaggtgcagaaaaaaaaggcggcagcaggtgtgactggaatggaatcattaggcatgcgctggaggatgtggccgtcgcttcttactaccacactgatagcagagagagtatcgatcatatcattatttctgataacacactcattgttttgtttaatccacctccaggctttgtacaacttgtcggaatgcattacccgcttgtgcgtgcggtgccctgacgcacgccacggctgggcaggacagctcgtcggttccaaccctaagagttgttccaaccaagcgcaaatgacatgtgaattcctggctgtcgacgtcgaatcatgggcgctggcttacctcgccgcgcttttttttttcccttcgtgttcgtgacgggggcgcccgcgtgtacgtcccgcccgacgcccgtcgtcgtcccgtgcgctctgtggctttccggacaggaacctcccaaccttcccggtcgatcggggagagccgagctgttgcatcttgccggccggagacgacgtcgctggcatggcaggcagcagcgccgtggaggtaatggcatgcatgagtcgtactcgggcccggctgaatatctgctgccgatggcgacgtgcaacccgaacgaagtaaccagcattgtgatggtactgtgggaattggcatcgtcaaccgtcttgtccgaacttgtggggatcgcctctacgggagtatattctccatggcgtgccgtagtaccgcaccgtctttgctgcagggtttgtgtgctgtagtccactgttactgtaagcgcctaccgctgctctttgggctgggtttgggtgcgcggcattcatgctgtggtccggcggccgaataggaaacttcctaggtaaattcacctatttacttgcagaaagaccagacagtcagacatggcaggtcaagcaggtatatagtagcagatgttccttctgttacctttattacaagtgggaggcaagttactcagtatccacaacgattcctcctagatttcttcccactatacctcactttaattttatgtcatgtcatcaagattcaactctctattttttcatctcccaaagagattttctctaaattctccctctatactcacgtcaaccataacatatcatttttcataccgattcattatctatcgtcattttttcactataagagttagtttgaaaaccccaattttctaagggatttctatttttataagagaaattagttcattttcttattaaaaaatagaaatcccttagaaattaaggttccaaactaatctaaaaaaacaacaccggtgcgagctttgaggccgatctaagcggccaccgtttggaagaggagcctagaagagtcgaaaactcgaattgatctgtttggctttggcataaaaagatgggctt

SEQ ID NO: 22259 - DNA, 2317 bp, Zea mays
tgatctttccatggcgaacgaggccaagaaggctgcacttggcctcgccgatgatgcaatgaagattgctgaagtcaatgcggagaaggtggagattctctcaaatgaagctgttcgcttgaaaggcttgcttgattcgagtgctgccagcgaagagagtaagagccgcgaagctgagcttcttgttaagaatctggagtctgaagtttcatctctgaaaggaaaacttgaggaggcaaaagtccttgaagacaggttagctgaagcagaaaaaatgattgaggagcttaaatcagagatagctaatgcgcagaaggtcgaggcagacatctgtcagcagttagaagaatggaaggataagtcaggatcacttgagatgaaattggaggttgttactctatctgagaagttcaaaagggactcacttgcctccacgactgatgagctggacaagatccagtcgatattgcaagatcgagaatcggaaattgaagttcttaaagggaaaacaactgccttggaaattgaggtggaaaggcttttagcagatgttactgattcaaatgagcatcttgatgcatcacagcaagaggtgtttgggctgcagacaacaatagatgttctgaggaacaagcgcgtgcctgcagagctagctgcctcagaggctttggacaatgagaggactgctaccacaaagattgaaggcctgactgaggagaaaaccaagctcattactgagctggatgacgctagagacagagaggagagagagaaaagggcaattgaggatcttactgctgcattggataaggtaactggtgaagcacaggaagcacatgataggtgtcagaagaaagaagatgattatgaacatgcccttgcgcagataggtgatctgaagatggccctgaagagtatggaagagacttatgaggtaatgcttgatgagtcagaacaggacataactggcctaagggaaactgtggagaagctggaagctgaggtgagcaagtacagagaagaatgtgaatctaaggagcttgaccttatcacggctactaaacagtctgaacaagaaattgctgctcttaaagaagaagcggagcatgtatgtgcatccctgcgaggtgcagagcaggagcttgaagcagtcaatgaagagaaagagaggcttgaggggaaattggcacgcacagaatcagccgttgctgaagccaacgatgctgtgcaggaggcaaaagctgaaaatgagaggcttcaagagaaacttgcacacgtggaatcagaggttgctgaggccaacatggctgcagaggaatctaagaatgagatcgagaggcttcaagagaaactgacatacacagagtcggcggttgctgaagccaacaagactgtgcaagaggcaaaggctgagagttcacagctgaaggagcgattacttgacaaagagaatgcattgcagagcataacccaggagaatgatgagttcaggatgcgagaagctgacgccatgaagaaaatagaggagctatctgccctgcttgccgaagccatgacaaagaagcatcccgaggaggaagagaagctggtggttgttgatgaggcacacaattctggacgtgaagctatccgttctgtggcagaaaatgaagatacagaagaaactgaccataagaaaccaaagcttgaagctgatgcagtcgatacgaactccaacggagaaccgaagcacgaagagaaagacgacagcaaggtggaacaggaggaactgaaggctgagctcatcctacaggagagcgacagagctagctccgagaaggaagcacagtccgaaaacaggagccaagaaacagaaccatccaacgacgagttagacccgaagaaggacagcagcaccgagagcgccaacggaacggccgtgccagaggatacggcggcgacgactactaaagcggcaacgtctcctacgaaaccgcagcagaaaaagaacaagcctctgctgaagaagtttgggagcttactgaaaaagaaaaacagcaagtagccgaacggtagctgcacctgcactattagtgttgttttgattttcttctttttttttgggtctgtttgacgaggtggtgtgcttgctatgcgtcgtttaccgccaatgcctgtatttgtgggtgattggagaagtttgtgggtgtcgtgtattttttaacttggggacctatatggtgttggctgctgctgtctacacgtttgtggcagatcctcccatgtgtgtaaatggatctactcttcctgatcagaatgcatggctattcgtttccgg

SEQ ID NO: 22260 - DNA, 2105 bp, Zea mays
  misc_feature (1457)..(1457): n is a, c, g, or t
tgttgctgtcgcatcactgcaagttgcagagcacgagcggacgcgtggccgggcgcgtggggaaaggtttcaggagaaactggcgtgcacagaatcagcagttgctgaagccaaccacgctgtgcaggaggcaaaggccgagaaggagaggcttcaagagaagcttgcacacacggaatcagaggttgctgtggccaacatggctgcacatgaatctaagattgagttcgacaggcttcaagagaaacttacatacacagagttggtggttgctgaagccaacaaggctgtgcaggaggcaaaggctgagagttcgcatctgaaggagcggttacttgacaaagagaatgcattgcagagcataacccaggagaatgatgaattcaggatgcgagaagctgacgccatgaagaaaatagacgagctgtctgctctgcttgctgaagccatgacaaagaagcatcctgaggaggaagaaaagctggtggttgttgatgaggcacacaattctatgcgtgatgaagttatccgttctgttgcagaaaatggagatacggaagaaactggtgataaaaaaccaaagcttgaagttgaagcagtcgatatgaagtccaatggtcaatccaagcatgaagagaaagatgacagcaaggtggaacaagaggaactgaaaactgagctcagcttgcaagagagcaagaaagttagcttcgacaaggacacatggacaaaaaacaaaaaacaagaaactgaatcgcccaatgatgagttaggctcggagaaggttagcagcagcaccgagaacgcaagcagggccattataccagaggatacggcgattaaagtgtcagcctctccaacgaagccacagcatcagaaaaagaataagcctctgctgaagaagtttgggagcttactgaaaaagaaaaacagcaagtagccgaacagtgaccgtactattagtgttgttttgaatttcttcttatccttttgtttgacgaggtgttgtgcttcctatgcgtttgatcccagtgcctatatttgtggtgattggagaagtttgtgggtgtcgtgatttttttctctctcactttcttaacttggggcctatatggtgttggctgctatctacacgtttatggctgtgtaaatggagttcctcctgatcagaatggatattcgtttctgaaactgtgcagctccttgattgattgtaggttaatgtgatgtaaggcgcccgtgacctaacctggatataatatttattaactagaggactttgagcatagaatgttatctgcaatccagttgataccataatgttgaagcttgtgattgcctttgcgagttgtagcctcctaatctgttctggttgcttgccatcgatcagatcaggtgcagaaaaaggtgcagcaggtgtgattggattggaatccctcgttggggttggccatcgnttcttaccacactgacatcagagggttggccatcgcttcttgctacactgacagcagaggaagtatcatttcatttctgccaacacacaggattgttttaatccactcgaggcttcgtatatcttgtccgatgcattatcctcttgtgcgtgtcctgagtcctaacggtacggcaccgctgtgtcgcttatgggtccaaccacgtgctgttccaagcgcaaacgacatatgaatacctctgttggatggtttgagtcgtcgacttcgaatatgggtgctgccttgggggcgcagccgaatgtcatgcggatgatatcgtggtggtccctcaacatgttctgaattgaaggcggtgggaagcatctgagagaggccataatcccaacaccatttacgtgtagagaaagctcacgactttatacgaagttacctatccaagctgtttggttctcgtgtggctaccctttacatagggacaataataaggattagtaagaaccttctgtgatttttgatactttggtaaaaatacgggtgcgtcattaggagtttgcattctctaccactcttaagcttctgcatttacattgcttcctttggttctgatttaccttacctagcttaaatcataggctagttaataatatt

SEQ ID NO: 22261 - DNA, 1475 bp, Zea mays
taacgacaataaaatgattagattataccacagcatatatcgccacatgcatgtctctcatctttgagatatttcagcacatttgttttctcataaaggaatggcgtccatgctgcctccgattaataataatatttttaaaagttgtccgtcgtacgttttattgcttgacataaatatgctcgtcgtacgttttattaaaggaataaaatcttggaggacccctgctggccggacgatctctctggtaaataaatatgctcatatcttcttctggatattcttaagatctgtagtctggttgatggatgaccccagcttgacagtgttgtacatgcgcatgaagtcaccgaacctgatggtgcggtagcacggtggcttgtccccggcgaggaactcctttgacgggccgatgaggcagtctggggtgggcatgatgaatgtggccaccgccgtccgcgccagcgtcgagctggtcaccacgcggtgctcaacgctcttcagcaatccgttggtcaccacctcgagttgctggccgaagttgacgacgaaggcaccgggcatgggctcgacctttatccactctcccctgtaggcgacgtcgaggccatagacggagccttggaggaggagggtgatgaggttgcggtcgcaatgtggcggcaggccgagcgtcttctccgggctggggcacggagggtagtggttgacgttgaggaccacgtcgccggcgctgatgtcgccctcgaagtagtcgggccggatccccatggcctcggacagcagccgcagcagctccacccccagccctctggtcagagcggtgaaacgctccacgacacccctcagccgctggggcgtgtgcggccagtcgtcccttgtgccgctgccgaccgggaaggacgaggggcaggcgaggcggaggcagtcccgccagtacttgtcgccgcccgtgtcgtaggttgtgccggagaagatccggttgggcctctgactgtcctccgagtacatgtacgccttgctcgccgccggcagctggaagaactcctcgcacacctccagcatgtcgcgcatcacctcctctgggatgccgtgctccaccaccaggaagaagccgaactccatgccggcgtcgaggatagcgcggcggacctcgtcgcggctgcgagacatgtcgataactggcagggaggtgacagcggagacggccggcggcacgtgctcacgcgagaagacggaggagcggtccaaggccaatgcctgggacgacgacggggctaggtggagcatattctccatgaatggaacgaggggaaagtgacggacggagctctctgatcgagatggagaccagaccacgcactagttaatttgggccttcagaagagtggtaaaaaaacatgaatcatatatgtagtcagcaacaagctccctgcgtgcgtgtgcatgcattaactgcgctccaacaagcttcg

SEQ ID NO: 22262 - DNA, 1114 bp, Zea mays
  misc_feature (41)..(41): n is a, c, g, or t
cgcggtgctcaacgctcttcagcaatccgttggtcaccacntacatgcatgcatgcatggatggaaggaagaagaccacaaaagcatgcaattaattacacggagaagaagaagtaggcaagtgaatcaaatgcggacctcgagttgctggccgaagttgacgacgaaggcaccgggcatgggctcgacctttatccactctcccctgtaggcgacgtcgaggccatagacggagccttggaggaggagggtgatgaggttgcggtcgcaatgtggcggcaggccgagcgtcttctccgggctggggcacggagggtagtggttgacgttgaggaccacgtcgcccggcgctgatgtcgccctcgaagtagtcgggccggatccccatggcctcggacagcagccgcagcagctccacccccagcccctctcgtcagagcggtgaaacgctccacgacacccccttcagccgctggggcgtgtgcggccagtcgtcccttgtgccgaccgggaaggacgaggggcaggcgaggcggaggcagtcccgccagtacttgtcgccgcccgtgtcgtaggttgtgccggagaagatccggttgggcctctgactgtcctccgagtacatgtacgccttgctcgccgccggcagctggaagaactcctcgcacacctccagcatgtcgcgcatcacctcctctgggatgccgtgctccaccaccaggaagaagccgaactccatgccggcgtcgaggatagcgcggcggacctcgtcgcggctgcgagacatgtcgataactggcagggaggtgacagcggagacggccggcggcacgtgctcacgcgagaagacggaggagcggtccaaggccaatgcctgggccgacgacggggctaggtggagcatattctccatgaatggaacgaggggaaagtgacggacggagctctctgatcgagatggagaccagaccacgcactagttaatttgggccttcagccgggtggtaaaaaaacatgaaacgtatatgtagtcagcaacaagcttcctgcgtgcgtgtgcatgcattaactgcgctccagcaaaatttctcagtgtctttcctttttttgattt

SEQ ID NO: 22263 - DNA, 848 bp, Zea mays
gggtaattgtttttaaagcagaaataaacccagtgatactaacgacaataatgattagattataccacagcatatatcgccacatgcatgtctctcatctttgagatattccagcacatttgtttttttagcatatctcataaaggaatggcgtccatgctgcctccgattaatattattattagtattaaaagttgcccgtcgtacgttttattgcttgacataaattcgtcgtacgttttattaaaggaataaaatcttggaggacccctgctggccggacgatctcgggtaaatataatatgctcatatcttcttctggacattcttaagatctgtagtctggttgatggatgaccccagcttgacagtgttgtacatgcgcatgaagtcaccgaacctgatggtgcggtagcacggtggcttgtccccggcgaggaactcctttgacgggccgatgaggcagtctggggtgggcatgatgaatgtggccaccgccgtccgcgccagcgtcgagctggtcaccacgcggtgctcaacgctcttcagcaatccgttggtcaccacctcgagttgctggccgaagttgacgacgaaggcaccgggcatgggctcgacctttatccactctcccctgtaggcgacgtcgaggccatagacggagccttggaggaggagggtgatgaggttgcggtcgcaatgtggcggcaggccgagcgtcttctccgggctggggcacggagggtagtggttgacgttgaggaccacgtcgccggcgctgatgtcaccctcgacatactctgtccggatccccatggcctaggacagcagccgcagcagcttcaccc

SEQ ID NO: 22264 - DNA, 1783 bp, Zea mays
attattccaaattgggcacaaacatccccccggtcgcccctgcgcccgacacaactgacttgcacaaatgtgtatcatttatcacaagcaatctccctatcccagagaagtctaatctgtgtattcttgttcttggcgcacttggcggaaggttcgatcatgagatggggaacatcaatgtattataccgcttttcaagcatcaagatcatcctcctatcagacgactgttcaatctttctgctccctaagacacactcccacgagatccatattgagaaatcggttgaaggtcctcactgtggtttgattccgatgggtggaccgtcagctaccacaacaaccacagggctccgatggaatttagataacaccaacatgatgtatggtggattgataagcacatctaacatcgtggatgacgataaagtaacggtgacttcagattctgatctggtttggaccatatcgcttcggaattgagttcaacttgtataattccatgcccaaattttgtcgcctcaaattacatgtattcagtttcaatattattctgtaactggtgtgatattgttttccgctgcatgtcgttatgtccatatatgtgaacttattcttcatagtttaggaatccagcatctgccagccaaatgtccccacaatctatattcagctgtttcacactttcactgtttgtgcatctgaatatcaatcaactttgtcgaagaagtgcatgactgcaaacatctctcgtatttttttcaagacgattttcttggccattttagatgcattcggatgtttttagataaggagccgccgtcagctcagctcatgggacctattcgtttcgttcctgattaaacgttatgtttcgtttggatgttgatattggagagcatgaaattaaattgtgttaaataccaaaccagtcatggtattgaaataagatgtaattttactgatacacagaaactctaatagtggtggttgtgaatctatttttattggtgttttttagaaacgttagtgctatagaccagtagaaatcatcattttataggcgagtaactaaggacccctagtggaaattgattttcactatcggttgagctaaagaaaacgtctcacccgccagccaagttgtggcatttttcgcacaaattcacgcgctacacggttgctaggaatcgaaccttgtatctcacccaagcgcatccttatctaccactttatttatgacatgctttatatctagtttgtagttttgttattcacatattataaccaactgagtgtaaattgcttgtttgatactgttaacgaattcaaataaaaagttgtcaactacaaagttcaataacttttaaagttatataacttttattttgacatgtttttatccgaggtcgtttgcaaaatttgaattttaaatttgccaaatttagatgtaatttttaagagacgaaatggttcaaataaaaaagttgttaactataagtttcataacttttagagatctataacttttattttggtgattttattatacgaggtcgtttgaaaaactcgaaaaattaaggataaaatgatttttagtggcgattcactaaaaaacatgtatttctaaatgcggttttcttaaggcggttttcttaaggaactgactgtagaaatatgattcttgtgacagttttttaagaaaccgacactaaatataacacacacggttgatgtgtgcttatgaagacatccttgtgacttgcgagtggctccaacaagaa

SEQ ID NO: 22265 - DNA, 1030 bp, Zea mays
cattgggtacctcgaggccggccgggagagcgagactgggagcttcgaaagccacacgccccacgggccacgggcgcagctcctttcccctgtaccccccaacggcccaaccccgctgggtcgctactcctctgctcctccggtgaccgcgtcatgccgctcccgacgatgacccactcctctgcctatctcctcccggccccaaccgccccgtccgaccccagcggcgctgccccgaccacctacgcgctcgtcgtcctcaaccagcgcctcccccgcttcgcgccgctcctctggtcccgcgcgcgcctgcgcgtgtgcgccgacggaggcgccaaccgcgtcttcgacggcatgccggaactcctcgcgggcgaggaccccgccgaggtccgcaccaggtacaagccagatgtaattaaaggggacatggactcaataaggccagaagtgaaggagtattattccaaattgggcacaaacatagttgatgaatcacatgatcaggacacaactgacttgcacaaatgtgtatcatttatcacaagcaatctccctatcccagagaactgtgtattcttgttcttggcgcacttggcggaaggttcgatcatgagatggggaacatcaatgtattataccgcttttcaagcatcaagatcatcctcctatcagacgactgttcaatctttctgctccctaagacacactcccacgagatccatattaagaaatcggttgaaggtcctcactgtggtttgattccgatgggtggaccgtcagctaccacaacaaccacagggctccgatggaatttagataacaccaacatgatgtatggtggattgataagcacatctaacatcgtggatgacgataaagtaacggtgacttcagattctgatctggtttggaccatatcgcttcggaattgagttcaacttgtataattccatgcccaaattttgtcgcctcaaattacatgtattcagtttcaatattattctgtaactggtgtgatattgtttcc

SEQ ID NO: 22266 - DNA, 1457 bp, Zea mays
ttgcctttccgtccagtccttccgagtctatgtatatcctgttctctatcagctggcagaccaacttgcatgacaagggtgacatcaggataatctacaccacgggcagatacgtcggagctgactaatatgagaccctttgacttcctgaattcatctgagaccttagttcttgcagattgtgtctttctggaatgaatctctcttatattcagttttagctgggagagtacctcagcaacaagtcttgtaaccattgcagtagtacagaatactataactttgtattctgcatcttctgcaacatgcttcttcaacacatcatacaatatggggaggtgcagacctagaggtgcaaccatgtacgtttggtttacctgggcatgtgtctcctcatcaccctcttgaacagcgttaatgaaatcataatcctttctcattgcgaggtgagaaatttggtggatctcttctgaaacagtagcagaaaacagcagtgtttgcctatctttagggatgaaagtaattattttctcaatgtctcttctaaatcccatatccaacaggcggtcagcctcatctagaacaagaaccttgacacctctaattcgggtggagaatccaggcgtgttctcaagatgatcctttagccttccaggagtagcaacaagaatctgacatgggttagcttgcatgctccgttgctcttgaggtaaccgtgtgccacctattacaacctgcacacccagtgagcgatgatacttgagaagcttcctggcctcagcagccaattggtttgcaagctccctggtagggcacatcaccagcaaatttatagaagttgaacgaggtaatgcagagagaacttcgatggctggaagcaaaaaggcaactgttttccctgttcctgtcttcgcttttgcaagaacatcctttccttgaagaattattggcagagtagcctcctgcacccgagtcatcctctcatatccagcatctttgatggctttcagtgacagtggagaaatggcacattgatcaaaccgtgtctcggtgaggtacgtgccatcgacgccaactgcctcgtgaacgctcctatcagttttcgacgccgaaccttccattccgtcagcgccctgctcaatggcacctcctcccctggtcgaggtggcaaccaccctaggcaacgcgggtccttgcctcgtgtccctccgtggcccttcggcgcccacctcatgggcaaacattgcccccgtggtggccaccgtggggtacccaggaccctgcttccgcaagcccccccgccgccgcttcagtttcgggttggcgctggtcgacatgatccggctggcgaagtcggcgatactttgacctagggtcaggggagaagtgcggcggcggaaggagaaatggagaatagggatttttcgattaggttgttctaggtaatggtctcgtgc

SEQ ID NO: 22267 - DNA, 874 bp, Zea mays
ttttcctctgtttgtttttttttttttttttttttctttttgttttttttttttttttttttttttttttgcgagaattgcaatgccaataacttccgaaataaatgtagcaggacaagtctactattacaatgaatatatcaactggcatgtctcacatgtggtgctgccagtgccagcaaatacatacattttcttttcctccccggaactgattgatacgagcccgtgcccttttgaatgaaaacatgacatagttgaatactaatcgtagggcctgtttgaacctgtccgttgtggacactgaacaggtcaagatacggtctcagataaaatgcggccgtcatgcttgaagacatgactacagaatctggttcttcgtaagaaactacttacgtgcagcgatggtggtggaagagccagcgtttagcaagctggtacaagcactggtcaagttctgctggatctggatcaccacggttagttacgaagaccggagcccaggaacgttgctgaggcccatcttccgtagaatttgtttgggaatggctggcgggactgcgagccccatgctctgactgaactcttcagccagcatcacgagtctggccttgtctcggttggtagccttgtgcgagttgtagtaccccagccatgcctggtaggctgattccttgctcttcatctccactcttctgactgcgtctttcactgctgcctgaatgcttgaatcaaccgaaggtgttgcagcctctgatattgacaaatcgttaactgtactaagaaaatgcatttcccagggagccagtagtaagatgccttgcccttccttgcctttccgtccagtccttccccctctatgtatatactgttc

SEQ ID NO: 22268 - DNA, 7925 bp, Zea mays
  misc_feature (6087)..(6087): n is a, c, g, or t
  misc_feature (6166)..(6166): n is a, c, g, or t
  misc_feature (6241)..(6241): n is a, c, g, or t
  misc_feature (6519)..(6519): n is a, c, g, or t
ctgcagcaaatggctatgcgggctttaaaaagcgcacggtttgggaagggcagcccggaggtggaaaccgagggtggtgacggggcaagaagccggagacgccacgacagcgtgaggaccggtgaagacgtgaacaaataggccaatggatttcgacacttgttcagccgcagcagcaggctatttgagaccagatcggaggggtatttccgggaatactgaacactggcatggcaccttacgcgagcagtaaaaagtatacagcgctgcctgctgctgctgcacctgcatgcgggggcgggtcgagggtgggcggcggagacgggagggaaaaaagaataaaaaatggcagcaggttcgtccggcatcggtgtctccgccgcccgcaggagacgaaaagaaagaggggcggaagcagcatgagtgtcttgcttggacggagtgagcactctacgtcccttaggaggaggctaggagtattatggctgtaaaaataaataaataaatcgctggtagttactccaaacgcccgttcttctgtgtctgttaccactaccgaacttccagctcgaccgacctgttccattttctttcgctcggacaaagacaaaggcaaagaccttcagccgcatgcaatgcaacgcaggagcctgacctaccgagcttgccctcgccgcagcttgtgcttgtctgagacattctgatgagaccgaggggcgagggcgaggacaggatacacgaagcgggtatcggagacgccgtcccttgcgtggacgccaacgatgcggaaaccttgttgcagccaagtaaaaaaaaaaaaaacaagcattgcgacagcgaccgattcatcaacgacgacgggttatatatagttttcttcttcttcttcttctttttccccctttttattagcaagaggatggagtcgagaccggccattggagcgtctctctaaagattagcattacgcagtgcaaggtttgatcgacgagtacattggagcgaactactgctattgttgtgtctatatagatctcgctggtgatggcgaggagagcgatcttgtgtgtgtgtgtgtgtgcagagtgcagacgacgccagagccacagcaggtgtggtaaggtagtagaatgaaatggattgaatggcgatatgaatgctcatcagtcatcataaggctggcacaccgagtaccaccacgatctgacgatggacggcgcggtgtgtgtgcgcatgagaacagttgccactcacatcacatgctcatcactctggtgtgtagacgtgtactcctgccagcgggcagcgctctctgcatctgcacgcattcactctcgatcgctgctccgcgctacgtacgtacgcaggtacgctgcctggcctggctgcctctccctccctcgctccctcccgtcggcaccacgggggcggtggcacatgtgcgactgcatgcctcgcacggtggcggtctggcggacgctggggagtcgagactcgagagtgcagccacaccgcaggcaagcatgggttgccctgtcctcgcgtggctgcggcgccgctctgcgtgccgccacgtgccaagtgcttgccctacggtcagctcctgcgctgtgtatcaagttttttttttttttgagtctcgtcgacatggtgttgagttgcagaatctcttatcagttagtcgcattttactggtcctttattgaagtccgcagtcacaaaaaaaaaactgagctgttaagcttccgtacccttccttggatggaatggatggttgattagtggtcagatcctggcaacacagcatttgagtccgtccgagcccgcacaaacaggccagcagcacacaaatatcgtgacacggttgaccatgacgcgcccacccccacgacatacgcatggcccgtcgagctagggcctcaggcctctcaccaagattgaccaggcgcgcgcacgcctggcagagtggcagtaacctgcgtgcgtctaccaatccttcctaacatctcaccagtccatccttttcctaacactttttcacccgtcacggaccaggccatgaatttctcgatcgattctagcggatacttcctctacaaaagagtccttttcagctcacttgttcaagctagagacgaacaagtgccttggaacagtcgtcggctcttccccgacgatgatgacaagctgcttttggtctaaaaagtgattgccaaactgagacaacaacaacaaaaaaacgacttcaagaggctgctgctttgtagtaccggctacggacagggaaaaggctgcccactgcagggccgctctaaacgagacgggactgagtacaaaaaggcaagcccgaggacacaattcctgggtctgggagggtccaataaagtcagttcaatgaagctggtatcgaggagacgcgcgccagccgccagctcctctaaaatgcaacgtcactgcagcgccaacccggaagagtcaaaatttacagattcgctcgttcataatggacggttctcatgaacagtgtagctacagaaaccgacgccagaacggttgcctacagcttgccatggatatggatgaatgatgcacgcatgcgagaattgcaatgccaataacttcggaaataaatgtagcaggacaagtctactatcacaatgaatatatcaactggcatgtctcacatgtggtgctgccagtgccagcaaatacatacattttcttttcctccccggaactgattgatacgagcccgtgcccttttgaatgaaaacatgacatagttgaatactaatcgtagggcctgtttgaacctgtccgttgtggacactgaacaggtcaagatacggtctcagataaaatgcggccgtcatgcttgaagacatgactacagaatctggttcttcgtaagaaactacttacgtgcagcgatggtggtggaagagccagcgtttagcaagctggtacaagcactggtcaagttctgctggatctggatcaccacggttagttacgaagaccggagcccaggaacgttgctgaggcccatcttccgtagaatttgtttgggaatggctggcgggactgcgagccccatgctctgactgaactcttcagccagcatcacgagtctggccttgtctcggttggtagccttgtgcgagttgtagtaccccagccatgcctggtaggctgattccttgctcttcatctccactcttctgactgcgtctttgacctataaagtcaagaaggaatattaaaacataaaggcaccaggtttgttaatctttggtagccaagataagaccttcttttaacaaaatttgctctgggattgaccaagctaagctaaatgggaagataggacacaagcactaattctatacaacttactgctgcctgaatgcttgaatcaaccgaaggtgttgcagcctctgatattgacaaatcgttaactgtactaagaaaatgcatttcccagggagccagtagtaagatgccttgcccttccttgcctttccgtccagtccttccgagtctatgtatatactgttctctatcagctggcagaccaacctacatgtgcaaataaatttcttgatgaatccacacatttttcttttattttcctttcttttggcaaggtacacaattatatgcctcaacttgcatgacaagggtgacatcaggataatctacaccacgggcagatacgtcggagctgactaatatgagaccctttgacttcctgaattcatctgagaccttagttcttgcagattgtgtctttctggaatgaatctctcttatattcagttttagctgggagagtacctcagcaacaagtcttgtaaccattgcagtagtacagaatactataacctgcattgtattctgcatcgtctttgtcaatgacacactgctgcagccagagccacaaagaacgtggtaagtagtggggttgcacgttccgggatcaaccgttctggaccgtggatcgggaacgttgcggtacgcaagctgggtcagtggttaggaggcgttctgatggctgtgggtcatatatagaagaattaaaaggaacagtcgcagacccagattatggttctgtccattcaccattactccattagcacatctcaaaatcaaataggcttggagaccagatgctagagcctagatggctattcctcaagattcaggcctatggtcgaggcccagtctttgtgcagcccatcatcttttcatgtatttaggtattctcgttttgataatgaacagtatgtagaacataccgattgcattcaaaaaattttatactaagttattaagtaaaaaaagtagattggagcaacatttaagccacaattaagggcctgtttggtttgagggactaaagattagtccctccattttagtctcatttagtccctaaattgccaaacggtgggattaaaacagggactaaactgttttagtctttagtcccttaaggggtgactaaaagggactaaattatataaattccactttttacccctcctttattttagttgcactaatggtatgagaatgacaaggggtatttaggtcctcttatgattaatttaatatgttttgaatacttttagtccctagaaccaaacaaggtagggactaaactttagtcttctaactaaactttagtccatggactaaaggaaccaaacataacctaatacttgttccttagctacgttccacatacagtgataccaatattttacgatcacgatcccctcctcgtaccaatcgtcacgaggaggtataccgccgtacaaaccgggaacttaaaattgatgatccacgtcccaaggaccccgttcctcatatcctacggtaccaggaactttgtggctatgtgccgcaccagattgctcgaggcataatcatgcaattaccatgggtaaggtaacgtactttgtattctgcatcttctgcaacatgcttcttcaacacatcatacaatatggggaggtgcagacctagaggtgcaaccatgtacgtttggtttacctgatgcatcagcattaattaatgtaacattacattgcaggacactcaaaatctatgaaattttaccaacatagctcatgaaaatgcatcctcgaacctgggcatgtgtctcctcatcaccctcttgaacagcgctaatgaaatcataatcctttctcattgcgaggtgagaaatttggtggatctaacagtaatggttcccttttagaatggtctgatcatataaggtaaaaaaagggactagtgaattaatgacaggagatacctcttctgaaacagtagcagaaaacagcagtgtttgcctatctttagggatgaaagtaattattttctcaatgtctcttctaaatcccatatccaacaggcggtcagcctcatctagaacaagaaccttgacacctctaattcgggtggagaatccaggcgtgttctcaagatgatcctttagccttccaggagtagcaacaagaatctaatttaaaagaaccagagtattaatgcatgtgttgcacctagatatgtatgcactgtattactgtgaatctgtgattcatgcatacaacctgacatgggttagcttgcatgctccgttgctcttgaggtaaccgtgtgccacctattacaacctgcacacccagtgagcgatgatacttgagaagcttcctggcctcagcagccaattggtttgcaagctccctggtagggcacatcaccagcaaatttatagaagttgaacgaggtaatgcagagagaacttcgatggctggaagctaaaagaaattagaactcagtcacatgggttaatccagtagttatatcgctgagaaaactgctacgacagtcaaattgatcagttgggctttaggcaaggagtaccaaaaaggcaactgttttccctgttcctgtcttcgcttttgcaagaacatcctttcctgcaggcatgcaagctcaaatgttagtttaaaggtcccaagatattgatatcagggatttagctgtagtgtttaggcatgtatcctgagttcctgnccttgaagaattattggcagagtagcctcctgcacccgagtcatcctctcatatccagcatctttgatggctttcagtnacagtggagaaatggcacattgatcaaacctgtgacatgcataacagctgactattaaagctacaggatgatggntcctaactcctaatagttaaaatgcacacttgcacagtaacaatgcagccagtaatgtgataaattgcaaatcaaatccaaaataaactcccagttccacattatactgaattacaaataactcttaaagctgaagaagttactaaaaatgtgatgttgaactagacatcttacaaacaatacagtttattgcaacacagtgaaaattctcaattctggaacaaaggaatagacaattagggaaaaataacaacaacaacaacaacaacttttagtcntaagcaagttggggtaagcagtaggcttgagttgaaacccaacagaagccacgagtcaaggttcaaacgtggattgcagtttttcatacactcatgtttaagattaaacctttgaatatgtctcatcctttcaagtctccttttgctgcctcttttatatcaacttcgaccttctcctacctttcttcccattactatcgtgcctaagaatcccactacgcaccggtgagatctccgtagcatatgtcaaaccatctcaacggtgtgcttttcttcaattggtgctattcctaccggtgagatctccgtagcacatgtcaaatcatctcaacggtgtgcttttcttcaattggtgctactcctaccctatcacgtatatcatcatttcagacttgatcccttattatatggtcaatccaacacaagatacacatttctgcaatactcatgtagtcatgtgctgaatatgtcatcttttttagaaacgttctgcaccaaagcacataggtataaaacttttattttagcaaagcaggtctaatcgccgtcatacaaggccttttaggtacccgaaataagatcttactaacctatgttttagcgataaccatggaatcacagcaacactaatcctctgttgcaagttccagcaatcacgttggtatttcagtgtatatcccctaacctaattccgtaattcgtgacgcaagtaagcaagacattaccgtgtctcggtgaggtacgtgccatcgacgccaactgcctcgtgaacgctcctatcagttttcgacgccgaaccttccattccgtcagcgccctgctcaatggcacctcctcccctggtcgaggtggcaaccaccctaggcaacgcgggtccttgcctcgtgtccctccgtggcccttcggcgcccacctcatgggcaaacattgcccccgtggtggccaccgtggggtacccaggaccctgcttccgcaagcccccccgccgccgcttcagtttcgggttggcgctggtcgacatgatccggctggcgaagtcggcgatactttgacctagggtcaggggagaagtgcggcggcggaaggagaaatggagaatagggattttcacagtgttttatttttgggttttttacaagcgcaccctgagtctggtcactttgctccgctgcccaaattgattgctcagtttcctcctacatccacttcaactcagaattggcatcacggtaactttccgtccgtcgtacatgtggacctcaagctattacatgtgggacctgtgttctctttctccttcccttctccacccaaattgaatcagctaagctcgacatcagcattgtgacatccgacggctgtacgcctgtacctctgcccgacgcaactgtacgcgcgtcggctgg

SEQ ID NO: 22269 - DNA, 831 bp, Zea mays
ctcgaggccggccgcgcaagaatccgacgaacctgaattttcgagatgaacgaacagtccagaacccactgctcgaaaccgcagccactggccagtcgatgcccatgactgcggtgcccaggaccggccccggttgcctggggtcgccgccggctcaggctctgtcgagctcactagccggggttcaaggcgccccgaagcgactgggcgtatcgaagccgtcgtggatcgttcgcactgagtcaaacgtgaggagggagagagcaaaacgacctgatcctccttgcaccatctgcaaaggcacagggagaatagactgccgcaactgctttggtcgaggaagaacaaaccatgccgatgtggccatgcttccgaacggcgaatggccacaatggtgtcgaatttgtggtggtagtggactggattactgcctccggtgccatggaactggtgagtatcgagaacccatgggcttccacttcactgtccaaagaaaatgaggtgggatggccttgtatgctacgatgcagcgcagttggtaccagctgcggggacatcgtagccactcagagcatgtttctccactgtctctcagaactcaaatgatttatgtctagcgctaacgctgtaataacgttgcttcataaaaggaaaaaatgtaatgaaaaatcacagtggtctgccgtgcattgatagtcttttagtctgtgtactagtggcagtgcacgtgcggtccgcgaaaaaatacatacaagatgtttatatatatctctatgtaatatcagattcattgatatatactggccttttaattagttataatagttgctt

SEQ ID NO: 22270 - DNA, 712 bp, Zea mays
  misc_feature (695)..(695): n is a, c, g, or t
  misc_feature (708)..(708): n is a, c, g, or t
tttgtttttttttgttccaaaaattgctttcgtgataatcttctatttggtacgtccttttcatgtgtactcatgatagcttacaggcgatcaacagaactataagagggcaaacatagtttattcattctctcgactcaagttatacaagaatctataaacctaaaagaatagaggtggaaaatggatacaccaatacataatttaatggcaccttatgttgcggcttagcgaccagccaaaggatatcaatccaattttatctcctccaactggtcctccagcccattcgtactgttcgccgccatttccacacttggtacctcactatccatcctgggtgtccctagtctcagttcattgtctctttccggtgttcggacaatctgttcaccctcttttggcgagtcgtcctttttgggtgtttcaaccccttgatcggtgctattattgagcttaccgtttgttgactcatcagagccgttctgcttgcccttgttcttgtctcgccatccgagggaagaaaacggggcaagcaagcttattcttctaggctggaactcctgcgatgaatcttggttcccttggcctggtgatgcatctcgagttggggtccttggagaaggagagggcgatggaagctgtgcttctgctgactagattaggtactgaatggttgcctctaacatagttcntgccataatgtcnctga

SEQ ID NO: 22271 - DNA, 2242 bp, Zea mays
  misc_feature (5)..(17): n is a, c, g, or t
cgggnnnnnnnnnnnnnttttttttttttttggtccaaaaattgctttcgtggtaatcttctatttggtacgtctttttcatgtgtacttatgatagcttacaggcgttcttctgttttttaagagggcaaacatagtttattcattctctctcctcaagttatacaagaatctataaacctaaaagaatagaggtggaagatggatacaccaatacataatttaatggcaccttatgttgcggcttagcgaccagccaaaggatatcaatccaattttatctcctccaactggtcctccagcccattcgtactgtttgccgccatttccacacttggtacctcactatccatcttgggtgtccctagtctcagttcattgtctctttccggtgttcggacaatctgttcactctcttttggcgagtcggccttcttttcgtcgtcctttttgggtgtttcaaccccttgatcggtgctattattgagcttaccgtttgttgactcatcagagccgttctgcttgcccttgttcttgtctcgccatccgagggaagaaaatggggcaagcaagcttattcttctaggctggaactcctgcgatgaatcttggttcccttggcctggtgatgcatctcgagttggggtccttggagaaggagagggcgatggaagctgtgctttctgctgactagattggtactgaatggttgcctctaacatagtttctgccataactgctctgttctccatttgagcaagtgaagccatagctccctcgtacttctcctgaagtatatgtgcagcatatttctgagcagcagcatcttgctctgcaaagatacgggcgtcctctgtgactttctgttcttgctctacacgcatcagaacctgaagcattgcttgttcctgttcctgcttgtctgatagagcttgcctaagctcagataactcttgttccaattgctcgacctttgcacttaattcgcgtctgttatcttgcttaaccatctccataagtgctgtctctaattcatcagccctcagaacagcggatcttctctcctctagcagttggcacagctcacccttcagccagactacctggtctttaggatcaggcagagaatcaatctcagagttgacagtgaggccatgatacatatcatccacattactacaattggcttcttggttcttatcgccatctgtcaagtcatttgactgttctgataacgacaccaatggttcagtgtcacgcttaaaattatatagcctagatgcaagcctgttcgtatccctccagacacgaagaccttttgctctctgttccattgaggagataacagatggtcggtgtttatttctcaattcttgcagtcttgcttcacctacagcttgatatcccatgcaagctgttaaaacaagctggctactgtcaaaagtggaaccagctaaagactgcaaaagggttactgcatccccagcatcttttgttgtcacaagtgcaggaccatacaactccatcagtgcaagagctgtccggaacagcatcacacggtttccctcaaagagaagaacatcccacacacgaagcacactttcccagggaagcatgttcataaaaatagataggaaccatggaccagtgacccatgcaacttgtacaccaaggtaatcaagatgatttactaactttgggaatctccctcggactaactcctctaaaacaagctgatccacctgagattcgatcatttcttcagagaagtaaccatcaaaatagtcatccataatgcctgtcaatgcccaaaatgcattctctcctggccgcagcagaagtagcaagccagcaaagaagttcattgcctggcagtaaccaactggtggattgtgtcgagcataagctgtgagcaagcgccttaaggcatttctgccatcctcatctagtgcagggtgtcctggaaatgttctaggcaaatccttctctatttgccctttccatttttcagaagaaaatgtttgagatggttttggttttccatcaccacattccgaagattggagatcccgaatatttgttgtcttgactttcactgtccgctgcaaggaggccctcatagtacccttcgacccgccgagctccaataccaataaaagcttgccacgagctctcctctcagggccattggaagcccatcacggcctgagcattctcattcttctttccaaggataatgttc

SEQ ID NO: 22272 - DNA, 749 bp, Zea mays
ttttttttttttttttttttcttttttttttttttttaaatttttttttaacaaaggttctctgccattgggagatccaacacttttgggagaaatttagccctcgaaggtgaagctggcaccgagcttgtgggtagcctggtcgagcttctgggtgtcgaaagagccaccgagacccaaggtgacgccctttcggaggaggacgttgtaggcaagggcagcaataccacggtcgttgatcttgaccttggtgaaagaaacagggtcgatgcggtacttgctggcaacctcaaggccgacagcgttaccggtcttggagttccaggtagccttggcaccagcctcgacctgtgagttgaccttgtggtagtaagaggcagcgaagacgctgaggttatcaaaggcggtgatggcagcgctgtactgaggagcagcgtagccaacagcagcactgtaggcggtcagagcagccttgttagcatcataaccagcggaggcaccagccaggaaaccctcgtggccaacaacagcgtcgacgttggcaacagggcccttcaggagatcgaaaaaggcacggccgtggaaaccgggttgcttaaagtggaggttgaacttggctcccttagcggcggtagcagggaggaagttgaagagaccctcaagcttgagtcccttggcgagggagtcggcgacctcgatcttggtgtcgagagcattggcggtgttccaggtctgggtaagggtcaagc

SEQ ID NO: 22273 - DNA, 3395 bp, Zea mays
ggggaatgcagggaataaacatggaaagatcgacacatataggtgacgttttgtggcttatggatattgctatgatcatctagggtgttcattttaactctcactttttatgtctataatcaaattggatgatggtaagtctagacacgtatataagacatatacaccaagtattgtataaacttgtaaaaaaccaaaatgaatttgaagttaggacaaaggaagtatctgttacatattgtatacttctatatgatatagcaggtgcaaagtgattccttctatggtcttttatatagtaggaatgtaggagtgaagtttaagaaggatgctaactgaaagttgtacgttcattcactttttttttggtggatcctaaacatgagctcttgacctcgtgtaaattttttccttcaaagctagtttagaaactccatagcaataacacatgctacacatataatactagctccgtcttaaaataaactgacttttaaatttttttttaaggtaaactattagcagtttggttaactttatagcgaacatttctgaccctaaagtagtatattataaaattataattcaatgatataaatttgatgtgtaaatattagtgtttttgtaaattgattaaatttaaaataatttgatttaggatagctttataggttgattcattctttattagtaaatagatataaaatccctcagatctgacggcgaggcgacatctgctagaggtggaaatctcgaggaagtcagcccgctggcgaagtcaaggggagaacgggaagaggtatggtatccaaatccaaccaaccactcggcccgaggcccatcgtctccagtgtcctgtcctgtccacaagccgcggcgcctgaacgcgtcactgcttacctaacccaacccgaccagaaaccaccgcgcactgacgccgcccggctccgtctccggctcccgctcccgctcgaggtcgaggcccacgcagcaatctggtcttctggaaatctccatcaatccgattccgaacggcagaaaattttcccttcccccggccaccaaccaaccaaacccgagcaaccagcctgagccacctcccatgcgccgcgccgcagcctgaggaggaggaggaggacgcggtggtctggagagggatggagggcgcgtcctcgctgccgcccttcctgagcaagacgtacgagatggtggacgacccggccacggacgccgtggtggcgtggacgccgctggggaccagcttcgtcgtcgcgaaccaggccgagttctggagggatctgctccccaagtacttcaagcacaacaacttctccagcttcgtgcggcaactgaacacctacgtaagcccccaccgcacagcacgatcattcattttcttcgccccatctccctctctgtccacctgtggttttgatcaatcggggtgcgtggcggcgtgctactgtcagctatggctgttgcccctttgcaaaactccacaatttggcatttatggggcgaatcttgttagcgttgtagtagaacaattgtttagggtatcgtcttaggtcgaatgaactgtttccttgttatagcatagcgtgttgacaacttggcgataactttaaattacatgtgtccactatatatctagtatatatgctcaattatcttgttgagatgtttttccttttctaaatccaacagagttagtgtaccttttgacaaatgaagtgctgctaacggtaaacactgttgaattggcatctttgttcacacccaaattaaatccaatagaaaccataatgatttcggatggttacttttgatttatgagccttgatgggtcaaatttctgtgatgtatcgtttattcgttttcctgcttcttcttatgtagggctttaagaaaattgatcctgaacaatgggagtttgcaaatgatgatttcattaggggacaacagcaccgactgaaaaatatacacaggcgtaagcctatattcagccattcatcgcatactcagggttctggaccattaccagataccgaaaggagggattatgaggaggaaatcgaaaggcttaagtgtgacaatgcagctctgacctcagagcttgaaaagaatgcacagaagaaacttgttacagagaaacgaatgcaggagctagaagataagttgatctttttggaggatcggcagaagaatctgatggcgtatgtcagggatattgtacaggcaccaggatctttctctagctttgtgcagcaacctgatcatcacggaaagaaaaggagactaccagtacctatctctctctaccaagattctaatgctgaggggaaccaggttgtgcatgggggcttcatcaccaacccaccagcttgcagggaatcattcgacaagacggaatcttcgttgaactcattggagaatttccttcgggaagcgagtgaagcgttcaatatttcatatggtgatggcctccctggcccttcatctgctgtcgttatcacagagctccattcatccggagaaagtgatccccatgtgccatcacctgtctcaagaatgcatacatcttcggctggtgcgggagattcgctctcttcccgcgatttaacagagtcaactagctgcgctgagagccctcgcctccctcagatccaaccctgtacagattcacgaactaaggtgtctgagatcgatgtcaatcgggagcctgctgtcacagaaactggtccgacaagggaccaacctgccgaggagcctccccacgtagcagctggggtgaacgatggcttttggcagcagttcctcaccgagcagcccggtcctgatgtacaccaggaggcccaatcagaaaggagagatggcgatgatgataagggcgatcagacgaggataggggaccgagaaaatttttggtgggggaagaagaatgttgagcagatgagagagaagctggggcgtctcacctcggtggagaaaacctgactgtatttcttgtagctggaaaaaaaaagttagcacagaaacacatataggacgctggtgcctctgactgacatgtactttgcagtgtaccatatatcttcgccaccagatatgctgactgacatcgacctcgtagtcgtacttcttccacctgtacttttgccgagtttacagtgagatttagttgttgctatactttttttttcttttttcttttgagatggactagtcgctatacttctgttaggagttctgcattcgtacttggttagtagacacttcctggtactgttgtccaacgacgtggttatatatgtagatgatgataatattcacttcgttgttggatagtacaaaaaaaaaaaaaaaaaaaaaaaaaaaaaaaaaaaaaaaaaaaa

SEQ ID NO: 22274 - DNA, 1767 bp, Zea mays
ctaatgtttgcaaaacatgagattagtcgactggaaagtgaattttctgcatacaaggtccgggcacatgcacttctgcaaaaaaaggatgctgagcttaccgcagctaaaagttcagatttcattaaagaacatgaagaggccataagggaagctgaaaaggaggtggcagctgctttagcagaaagagataaagcaatagatgatctccaaaaggcagaatccagacatggtgatgagattgaggcaagagatatggctcttgctgatgctgagaaaaagctaaaggatgtaatgaagaagttagattctgttacttctaatttcatctcagaaaaagggtcctgggagaaaaatttgatgaatgtagagggaaagctggagattgaaatgtgagtctttgaaggttcagagcaatgaccatgtcgatgatgaactaaaaaagaatttaggagagctgacactaaaatatgagaaactgaaggaagagcatcaatcattccgtgatattgctgatagaatgattgaagacaaggaacgagagataactaaactcctcaaggaaaacagggaccttcaccagtctttagatgctagaccaacagttagcaacaatgatcatcaaagtcaaggacctgttaaggatacaatgagtgttgaattggctgagcaacaaattttgcttctcgcaaggcaacaagcacaacgagaagaggaattggctcagtcacagaggcatatcttagcacttcaacaagaaattgaagagctcgagcgtgaaaatcgtctccatgatcaacaggaagcaatgttgaaaaccgagcttcgcaatatggagagatcacaaaagcgagaaggaatagatatgacatatctcaaaaatgtgattctaaaacttcttgaaacaggggaagtgggagcgttgttgcctgtggttgggacgttactacagtttagtcctgacgagctcaagaagtgccagcaaggtgtcctttcgagtgtggtctcttcacaagctactgcagtgtcagatggcacaaccacacagaattcgttctttgcaagattctcgttctgaggcattgccctcgaagatcagcagtttagctgggggagaggatgtcctgagccttcagattcacagttttgttgaccgtagaaaacgtttattcatttattagttacaagcgtccttaccccccttctccttctgtaaaagtagtgcatatagcaggattaagataaacacatgtaatggagtatatattgtgcaactgccatatatgatatgatatatagcggctcatattaggtaaaaaaaaaacgcgagtgtggaagggaatggtttttacactgttgcgtatcttttattgaacactattgagggttcaggaattattagtgttgtctcctccagtcatccgtatgttcataagcattcagaggcaggggcaagtttcttaataattaagatagacaagagacggtgagatagctccactcttcaccttgtaaagtatttctatattaaactctaggtttctatattaaacattgtgttctaaccttactctagcatgatatattaaacatcaaaatttataatatataattaatgttgttagatagatgatcattgaatctatttccataataagcatattttgagataaacattttgataataattttctacagatacagttaaatctaagagagtttgactggcacaaatactatgcccacttatttcagaacggatgaaac

SEQ ID NO: 22275 - DNA, 2288 bp, Zea mays
cacagacttgataactttgatgggcctgctgttggagtcgctgccccccccccccaactgtatgaggaggcttttgctatattcaagaagttcaacttaaatgtgcaggctgtcgatgttctcttggacaacatccggagcatagaaagagctgaggaatttgctttccgtgttgaagaagatgctgtttggagccaggttgccaaagcccagttacgtgaaggtctggtcagtgaagcaattgagtccttcattcgtgcagatgatgctgcacacttccttgatgtcatccgtgctgccgaggaagctaatgtgtacaatgatttagtgaagtaccttctgatggtaaggcaaaaggcacgggaacccaaagtcgatggagaactcatctttgcatatgctaagattgacaggctcagtgatattgaggaattcattcttatgccaaatgttgccaaccttcaaaatgttggtgaccgtctgtatgacgaagaactatatgaagctgcaaaaatcatctatgctttcatctcaaactgggctaagctggctgttaccctggttaagctgaagcagttccaaggtgctgtggatgctgctcgcaaggctaacagtgccaaaacatggaaggaggtctgctttgcttgtgttgacgctgaggagttccgtcttgcacaaatatgtggtctcaatattattgttcaggttgatgacttggaagaagtcagtgagtactaccagaacagaggatgcttcagtgaacttattgctctcatggagagtggtcttggacttgaacgtgcacacatgggcatcttcacagaattgggagttctatatgctagataccgctctgagaagcttatggagcacatcaaacttttctccacccgtctcaatattcctaagcttattcgagcttgtgatgaacagcagcactggaaagaacttacctacctgtacatacagtatgatgaatttgacaatgctgccaccactattatgaaccactctccagatgcatgggatcatatgcagttcaaggatgtttgcgttaaagttgcaaatgttgagctatattacaaggcagttcacttctatttgcaagagcatcctgatctcatcaatgatatgctgaatgtgcttgcacttcgtttagatcataccagagttgtagacataatgcgcaaggctggtcaattgcatcttgtgaaaccatatatggttgcagttcagagtaacaatgtctctgctgtgaatgaagccttgaatgagctttatgttgaagaggaggactatgagagactccgtgaatcagttgacatgcatgacaactttgaccagataggtcttgcccagaagcttgagaagcatgaattgctggagatgaggaggattgccgcctacatttacaagaaggctggcaggtggaagcaatcgatagctctatcgaagaaagacaacatgtacaaggattgcatggagacatgctcacaatctggtgaccgcgaattgtcagaggacttgcttgtctatttcattgagcagggtaagaaagaatgcttcgcttcttgcctcttcatttgctatgacctgatccgaccggatgtcgctcttgagcttgcatggatgaacaacatgatggactttgccttcccgtacctgttgcagttcattcgtgaatacactagcaaggtggatgatttagtgaaggacaagattgagtcgcagaaggaagaaagagccaaagagaaggaggagaaagaccttgtggctcagcagaacatgtatgcacagctgcttcctctcgctttgcccgccccgccaatgcctggcatgggtggccctccacctccgatgggcggaatgggcatgcctccgatgggtatgccgccgatgccagcatttgggatgccaccgatgggaagctactgatttggttttgcagcataagtggaacttcattggagttgtagatggttgacagtttggaatcaatattcttcattgtaccaggaaactttttggcgagtgagtgaaatcagtcttacccgtagtttgagaagtgcaacctgtgatatgtttacgatgggatcggaaataggatgattaggttgtttcagcatgagctgttgaaagctggtaccatatgtatagtgtgataaaatctttgtagacatttttcttgtatgatacttgtcggcacagtgatatatatatatatatatatatactgtttttatgtcacttgcagattcccatcctcgagtcttattccttcattactt

SEQ ID NO: 22276 - DNA, 2107 bp, Zea mays
  misc_feature (91)..(91): n is a, c, g, or t
  misc_feature (160)..(160): n is a, c, g, or t
  misc_feature (271)..(271): n is a, c, g, or t
  misc_feature (433)..(433): n is a, c, g, or t
ctagtccccccccccccccccccttctgatggtaaggcaaaaggcacgggaacctaaagtcgacggagaactcatctttgcatacgctaanattgacagactcagtgacattgaagaattcatacttatgccaaatgttgccaaccttcaaaatgttggngaccgtctatatgatgaagaactatatgaagctgcaaagatcatatatgctttcatctcaaactgggctaagctggctgttaccctggttaagctgaagcagtaccaaggngctgtggatgctgctcgcaaggctaacagtgctaaaacatggaaggaggtctgctttgcttgtgttgacgcggaggagttccgtcttgcacaaatatgtggtctcaatattattgttcaggttgacgacccggtaccggcctgcccgggctaccagaacagnaggatgcttcagtgaacttattgctctcatggagagtggtcttggacttgaacgtgcacacatgggcatcttcacagaattgggagttctatatgctagataccgctctgagaagcttatggagcacatcaaacttttctccacccggctcaacattcctaagcttattcgagcttgtgacgagcagcccccccgccacgctagcttccccccccccacatacagtatgatgaatttgacaatgctgccaccacaattatgaaccactctccagatgcatgggatcacatgcagttcaaggatgtctgtgttaaagttgcaaatgtcgagctatattacaaggcagttcacttttatttgcaagagcatcctgatctcatcaatgatatgctaaacgtgcttgcacttcgtttagatcacaccagagttgtagacataatgcgcaaggctggtcagttgcatcttgtgaaaccatatatggttgcagttcagagtaacaatgtatctgccgtgaatgaagccttgaatgagctttatgtcgaagaggaggactacgagagactccgtgaatcagttgacatgcatgacaactttgaccagattggtcttgcccagaagcttgagaagcatgaaatgctggagatgaggaggatcgccgcctacatttacaagaaggctggcaggtggaagcagtcgattgctctatcgaagaaagacaacatgtacaaggactgcatggagacatgctcacaatctggcgaccgtgaactgtcagaggacttgctcgtgtatttcattgagcagggtaagaaagaatgttttgcttcttgcctcttcatttgctacgacctgatccggccggatgtcgctcttgagcttgcatggatgaacaacatggtggactttgccttcccgtacctgttacagttcattcgtgaatacactagcaaggtggatgatttagtgaaggacaagatcgagtcgcagaaggaagaaagagccaaggagaaggaggagaaagaccttgtggctcagcagaacatgtatgcgcagctgcttcctctcgctttgccggcgccgccaatgcctggcatgggtggccctccacctccgatgggtggaatgggcatgcctcccatgggccgggatgggtatgccgccaatgggccctggtccgatgccagcattcggaatgggaggctactgagttgtggttttgcagggagcttagatgatgatgtgaattgttccattgcaagcataagtggaacctcattggagctgtagatggttttacagtttgggaaatcaatattctttattgtaccaggaaacttttttttgggcgagtgagtgaaatcagcctgacccatagtttgagaagcgcaacctgtgatatgttttacgatgggatcggaaataggatgattaggttgtttcagcatgagctgttaaaagctggtaccatgtgtatgtatagtggtgtgataaaatcttttgcgtgtcggcagagtgaagatagacaaatgtatgtttccttgttacgacctgttaatctatatattagcccgacttgtagttcaaatgccctacattattttcttctagctcctccgacgcggagttcaatcggtaatactatatttattaataaattcaatggctatgttctct

SEQ ID NO: 22277 - DNA, 1366 bp, Zea mays
tcagttcatttcgagctgaagaacagagggcatggccaactcggatccgcttcccatcctctgcaggcttctcgtgtagaattccagacagatcatcaaccacacacatactactagtatattggattatcgatcaaacaaggttctaatcaatacgcagacgtgaacctcaacgatagtagtgtaaggcaagtaaaattttatcagtacatcgtcttgatgttgaattcccctcctctctggatgctcgctactccaagagaaaagaagataagagaagagagggctcccgctctactcgaacttcttgatgagggagaggtcgttgagcatcttctcgatcttctcgtccccggggtcgccgacgaacctgccgccggacttgagggaggggacgagcgcggtggcctcgccgctggtgtcggggcagaggttgccgagcgtgcagagctcgaactcggcgaggccgtagcggctcagcgtctcgcggacctggcgcacggcgtcggggttcttgtagcggctgaagcgcttcacgtactgcagcgacttctcgaacacctgcgacacctgcgacgacgggtccgactccgacgacgcgtgctgctggatctgctcgtacttgtgctccaggatgatcgccacctcgcagttcatcaggcacttggccttgaggaactcttcgccgatcttgagctccgcggcgttctcctcctcctcgccagacatcgctggtagctggtggtgcttccgaccgggcgacggggaatggctcggggaagcccaagttgcgatttccgacggggaatggggctgggaattgcgaattgcgatttttgacattttatacaatttcgatatgtcttacaagataaacaaaatcaccaaggatcattctgttcctgttaaaatatcgaccacggttgtaaagtttttgacatgtattatgtcctgatgccaccttaaatgaaagcagcatgatacagctgccagctaaacaccatcgtaactctcccgtagaatgccataaccagcaggagaaacgaaaaatgacagcttcagccacgctgtttcttcgagctaggtaaatcatcgtcgtagtgaccgccatcttccgccccatctttctcgcccttcttcctagccaggatcttgttgatcttgtggaggtcattagtgagcttctgatccttgttctgcttcctcgtcttcctgccgtcctgcatcttcaccccaaactggaaggcagcctttggcatggcttctttctggtcgttgtacttggcccactcctcttcagtctcaaagtcccacctgtgaagacggccctttgcccgtccacccatatccatttcgacccggccgg

SEQ ID NO: 22278 - DNA, 858 bp, Zea mays
  misc_feature (68)..(68): n is a, c, g, or t
gtcaaaggaaatcagttcatttcgagctgaagaccagagggcatggccaactcgatccttcatctctngcaggctccttctcggcccgttttttttatttttcttcaaccacacacatactactagtatattggattatcgatcaaacaaggttctaatcaatacgcagacgtgaacctcaacgatagtagtgtaaggcaagtaaaattttatcagtacatcgtcttgatgttgaattcccctcctctctggatgctcgctactccaagagaaaagaagataagagaagagagggctcccgctctactcgaacttcttgatgagggagaggtcgttgagcatcttctcgatcttctcgtccccggggtcgccgacgaacctgccgccggacttgagggaggggacgagcgcggtggcctcgccgctggtgtcggggcagaggttgccgagcgtgcagagctcgaactcggcgaggccgtagcggctcagcgtctcgcggacctggcgcacggcgtcggggttcttgtagcggctgaagcgcttcacgtactgcagcgacttctcgaacacctgcgacacctgcgacgacgggtccgactccgacgacgcgtgctgctggatctgctcgtacttgtgctccaggatgatcgccacctcgcagttcatcaggcacttggccttgaggaactcttcgccgatcttgagctccgcggcgttctcctcctcctcgccagacatcgctggtggctggtggtgcttccgaccggggcgaagtcgctcgctggagtcggccgacggggaatggggctgggaattgcgaattgcgattcccggcccggcgggacccaacccggccgg

SEQ ID NO: 22279 - DNA, 944 bp, Zea mays
tttttttttttttttttttccattaattcatgtatacatgactagatggaaagcggaggaagataatatgaaccttaacaatagcaaggaaatcagtacatttcgagctgaagaacagagggcatggccaactcggatcctcatcctctgcaggctttctcgtgtagaattccagacagatcatcaaccacacacatactactagtatcttggattatcgatcaaacaaggttctaatcaatacgcagacgtgaacctcaacgatagtagtgtaaggcaagtaaaattttagcagtacatcgtcttgatgttgaattcccctcctctctggatgctcgctactccaagagaagagaagataagagaagagagggctcccgctctactcgaacttcttgatgagggagaggtcgttgagcatcttctcgatcttctcgtccccggggtcgccgacgaacctgccgccggacttgagggaggggacgagcgcggtggcctcgccgctggtgtcggggcagaggttgccgagcgtgcagagctcgaactcggcgaggccgtagcggctcagcgtctcgcggacctggcgcacggcgtcggggttcttgtagcggctgaagcgcttcacgtactgcagcgacttctcgaacacctgcgacacctgcgacgacgggtccgactccgacgacgcgtgctgctggatctgctcgtacttgtgctccaggatgatcgccacctcgcagttcatcaggcacttggccttgaggaactcttcgccgatcttgagctccgcggcgttctcctcctcctcgccggacatcgctggtagctggtggtgcttccgaccgggcgacggggaatggctgggaattgcgaattgcgatccgaggcccggccggcgcggggaagccaaggatgacggcgggagggctatgcctatgtgctgg

SEQ ID NO: 22280 - DNA, 841 bp, Zea mays
  misc_feature (68)..(68): n is a, c, g, or t
gagatataatgacctttaccaatagccaggaaatcagtacatttcgagctgaagaccagaggccatgnccatctcggatcctcatcctctgcaggcttttcgtgtagaatttcagacagatcatcaaccacacacatactactagtatcttggattatcgatcaaacaaggttctaatcaatacgcagacgcaaacctcaacgatagtagtaaggcaagtaaaattttagcagtacatcgtcttgatgttgaattcccctcctctctggatgctcgctactccaagagaaaagaagagaagaggggggagatacggaccctgggggctcccgctctactcgaacttcttgatgagggagaggtcgttgagcatcttctcgatcttctcgtccccggggtcgccgacgaacctgccgccggacttgagggaggggacgagcgcggtggcctcgccgctggtgtcggggcagaggttgccgagcgtgcagagctcgaactcggcgaggccgtagcggctcagcgtctcgcggacctggcgcacggcgtcggggttcttgtagcggctgaagcgcttcacgtactgcagcgacttctcgaacacctgcgacacctgcgacgacgggtccgactccgacgacgcgtgctgctggatctgctcgtacttgtgctccaggatgatcgccacctcgcagttcatcaggcacttggccttgaggaactcttcgccgatcttgagctccgcggcgttctcctcctcctcgccggacatccctggtagctggtggtgcttccgaccgggcgacggggaatggctgggaattgcgaattgccccggccggcc

SEQ ID NO: 22281 - DNA, 2214 bp, Zea mays
gtttaatttattgcttgtgtgttttttttttttttttatgataataacaccaggatgatgattaacatactcctgcagacactcagcatatgaggataacgcacggacacgatacaactccaacttagataagagtagctgggtgttgcacagacacaggctacttgcaaaattattagtacttcttgtcgtcgctgttggcagcgacgatggtggtggtggccacgtcaaggaacatgccggtgatcaggcgatcgctgtttcgaagaacaggctactgcttgtagattactactgctacttcttcctgtccatgactgacaccgtgccgtccttgttggcgacgatgacggtggtggccatgcccaggaacatgccgtgctctacgacgccggtgatccggagcaggcggtcactgatgtcgcgcaggtcgccgcggatgccgtcctcgaagaacatctcgacgatgtagttgccgttgtcggtgacgaagggctgctccgactccgagtccgagtcttctccccccttggcgggagcggcggggacagtcctcagcctggcgtggaatccaggcaatccgtcgaagaggccgcggatgaggcccagcgtgtggagcgcgccgaaggggatgacctcgacggggatggcgcccgtgcagccgaggcgcggcacgagcttggactcgtcgacgatgacgacgaagcgggcgccggcgccctcgatcatcttctcgcggagcagcgagccgccgcggcccttgacgaggttgaggtccgggtcgacctcgtcggcgccgtcgatggagagcgcgatcctggcgcccgggagcgggagcagcgggatcccggcgcgcgccgcgtgggcctccgtcttgagggaggtgggcacgccggccacccccggcagcgcgcccgcgcggaggaggtcgcccaggcggtccagcgcgtgcgccgccgtggagcccgtgcccaggcccagcgtcatgccgggctccacgaactccaccgcgcggtgcgccgccacgcgcttcagctcttcctgcgtcagcttcccggacggcggcggcgaggcggcggcgctgcccatggcgaggtggggacgaggggttcttgggtggggagtgtcgggggtgatttcgggaattgggaggtcgggagagggaaaaaagggggcaagtgaatgggaggaccaggcgggaaaggggaggtgggcagcgcagggatagggaatcaaatcgccgaatcggaatggttctaggtaatggtctcgtgcgacgatttaaaggcctcggaatgcgggaaagcagccgtgataactgatagagatacgtagttccttttacacggaaaaataatatctaaactctacatataccaccaaaaaggttacccaaaaagcaccgctactccatccatttcctttttaccctagtttggttccgtgtgctaatagttttcactctagtttgctccactgattctaattctatgtttgaagtgatttcctaagagaagtgattctatggctcagagtgacttttgaaaaaaaaaacatatgataaactccacgtgaaccctaactatacggtggcaatgaataagaagtagctttttttagctcacggcctccggttcattttgaagaatcacttcacagaattcactctataattgattcttagaaaacttaagttttgcacagctcttcagatccactttgcgaaatctaggaacggagctctgccaaacgggatttctatgtaccaaattacaatttgttttagccttctaattaattcaatatatgtgtctatgttcatcatcatcattcatttgaatatagacataaaaactaagagctaaaacaaatactaatttggaatagagatagtcttaaccatatttggttagctatgttggcaattggctagttgtttgtcgttgagtaacatatgttaccatgagtttaatcatagggtgtttggtttctagggactaatttttagtccctctattctattctattttagtctctaagataccgaatacagaaaaccaaaactccattttagtttccgtatttggtaatttagaaaataaagtgtaataaagtggagggactaaaaattagtcactaggaaccaaacaccctatgattaaactccatggtaacatatgttactcaacgacaaacaactagccaattgccaac

SEQ ID NO: 22282 - DNA, 1291 bp, Zea mays
tttttttttttttttttggtttagtaaaatagcgtgagaatcactgataacaaggtttgtgatgataacataaggatgatgatgatgattaacatactccatagtaatcagcagacactcagtatagtatgggaggatgacgcacggacacgacaacagctccaactttagataagagtagctggatattgcacagacacaggctacatgcagaattattacttattgtcgtcgccgttggcgacggtggtgatgatggccacgtagaggaacacgctgttgatggggagcaggcgatggctgcttcgatgaattgtagactaactacttcctttccatgactgcgaccgtgccgtccttcttggcgacaatggcgacggtggccatgcccaggaacatgccgtgctcgacgacgccggttatgcggagcaggcggtcgctgatgtcgcgcaggtcgccgcggatgccgccgtcgaagaacatctcgacgatgtagttgccgttgtcggtgacgaagggctgctgctcggagccttgctccccctcggggacggtggtggtcctgagcctggcgtggaagccgggcaggccgtggaagaggccgcggatgaggcccagcgtgtggggcgcgccgaacgggacgacctcgacggggacggcgccggtgcagccgaggcgcggcacgagcttggactcgtcgacgatgacggcgaagcgggcgccggcgccctcgaccatcttctcgcggagcagcgagccgccgcggcccttgacgaggttgaggtccgggtcgacctcgtcggcgccgtcgatggacagcgcgatgctggcggcgtcgagcgggagcagcgggatgccgacgcgcgccgcgtgcgcctccgtcttgagcgaggtcggcacgccggacacccccggcagcgcgcccgcgcggaggaggtcgcccaggcggtccagcgcgtgcgccgccgtggagcccgtgcccaggcccagcgtcatgcagggctccacgagctccaccgcgcggtgcgccgccaagcgcttcagctcgtcctgcgtcggcttcccggacggcggcggcgaggcggcggcgctgaccatggcgagggtggtggggagggggcggcgcggggttgaggtgaggatcgggaacgggaattgggtttctgagaagcgggggtgactctgttcgggaattttggatatttttattgtagtaggaaagaggggcgggaaatgggaggtgggcagagcagggggaaggctgggaatcaaatcgccgaatcggaatggt

SEQ ID NO: 22283 - DNA, 2145 bp, Zea mays
ctactctcttctaaagaaggttctgctgctcttgacaagtttcataaagcgtccccatcagagtcttgctggtataggtattgctgcatttgttcgtttgatgagcagtgctggatctatgttcggggacctcgagccgccgggggggggtctgtcattgaaagaagctgccactgagacacttcctgatttcacttatgtttcatctggagcctaactggaaaatgtgccaacagaaaatggagtctctgctgacaatagagaggacgaatctgaaccagtagcggatgacaatgaagaatcctctagatcaaggaatctatactttacaattggtgatgccaaatgtcgagctgctgtacaactcctgttgattcaggctgtgatggaggtatataacatgtacagaggacagttatcagcacagaacacagtaatcctcttcgaagccttgcacactgttgccgcacatgctcacaaaataaacagtgatagtgatttgcgttccaagttgcaagagttgggctcgatgacacagatgcaggacccgccattgttacgccttgagaatgagtcgtaccagctgtgcctcagtatccttcagaacatatttctggacagctctcctgatcatggaagcacagaggtggtggagagtcaccttattggcttgtgcaaggaggtccttgaggtatacttgagcacagcaagaccttctcagccttccagtggcacacagccgctaggccattggcttatccctgttggttcatcgaagcgaagggaacttgcggcaagagcacctcttgttgtctcaaccctgcaagctatcagcggactaggtgactcagctttcgagaagaaccttcgccagttctttcctcttctcgctgggctcataagctgcgagcatggttctagtgaagtacaggtggccctgagtgatatgttcagcacttgggttggcccactcgttctccagtcctgctgatgctgaacatcatgttatacatagtagtatacatcccattgtgttcctcctttcctccattatgttatgttaatcttttagtcgctgggagttcatattgttgtgctgaactgatcatgcagatcaaattttcgttgacgttattttcttgttcgtatcgggaggagtgtatgtcactatagagaactgaattatgtacggtagtttagctaaaattgtgcccattctgttcctaatgtgctgatttctagatttttaggcatgttttgcatgcttttgctcagtagcgtttctcctttctggaattctggaatgtggtagggttggattataattcttgcgagttgggtgtgttaggctatctccttttatcttaccttctatcttaaactctattatgtaatcagtgcaatttatagtataaaactgtgttttgcacgtccatttacactggctgttggagatggccatagcggatatataaatttccatatattccaaacaataggcatatatgagtgttttgatcaaggaaaaattaataaaatatactgacttattatttatataatgtgttgttatttgctaaagaatcaatatctcatgcattttgaatataaatctgtatatgcaagtttgtgtgtgttggtcatggctttgcacaatttgacttcctatataaacaaaagatgcctattattttatgatggagagcgaattataatttttttagttgacattgatttatgttgattgttgattagcatcaaaaagtgatacaagtaacaagtgatcatctttcatcgtaaacaagttcaatatctcgctgtactctggatctagaagagagaacaaccaagagattctgtccaaagatgcgtatttaaaataagctctatggaggtttacaactgtacccacacgaagaccaaggacaaaccttcatactagtgcccgcaggtcgccgatgaacgggtttatcagatttatcgaaaaatctgtcatttttatcgttttgctttcagatggttttttagaaaactcaatttgcatagtataatacatagattatgtccaaatcatctaagtcgaaaaatacacatataatattatatatatatatcttatatcttatgtactaactattaagccag

SEQ ID NO: 22284 - DNA, 5355 bp, Zea mays
  misc_feature (3418)..(3418): n is a, c, g, or t
ctatattctattatttcataatcaaagaaaaaagactaaaaaactaatatccgaataagatccgtttacaccccgtaacactgaaaaggaacaaaaggctgaaccgagagtccaataaatcaggcagaagctggagctccttgccctttctgcatgaaaatgatcactttttttatatgtttggtttgaagttgtagtacacgtcgcttctccccctctgaattgtgattgtgacgttttcctttttctgaactctggacaacgcgcagcacgtcgtctgaaattgtaacgctgcagagcaacatcaagaacctttgtagtaccgcgggctgcattctcgccgccctgtttgtttgtgaatcgctggagttttcagcagcagctgggtgttggtgttggctcttgatctggatcttgcctccttgcatcgtgggtctatgccacggcagcgaagccgcgaatgattagtttaaatgtcagtttttagataaacaaatagcggggatagctcagttgggagagcgtcagactgaagatctgaaggtcgcgtgttcgatccacgctcaccgcatatatttatttcacttttggctcccattttgaatcttttgaagaatacagaatacaaaattggccctgctttaaacatttacacaacagacagtcgaaagacatgttatatatacttttcataattaatttggccctcatttttaatcttttgaattgacaaatttggtcatgttgtgcacatttacacaatggacaaaatcgaaagcaatgatttagtttgtccctcgttttgaatattttcaatagacaaatttggtcctgcgttaaacatttacacaggagaggtcgcaaatagctgcgcgcatgctaggttttgccgttcacgaacgagcgacaaggtactgtacattagtttatttacactgatccaagtcatagcttttcgataccaaaatattaatctgtacagcgatctcctcgtgttttctagttatacattgtactttcccccgatttatttggaagcacatggttacatctgccgtggaaatcctaactactacacagaaatagcagcttgcacagattgtagtcatctataagattttgtgaggatttacatcaggacgtgtacacgtataactacataacaaattagcaagggcgacaacaaaccttaagagctgatttagtgggttgatttggtgacaagaggatcatagaaggattaaaggtgattgagggcgaaattagtttatttcccctcaacgccctccaatccttccgtgatcccatgtcaccaaatcaactctaaaacataagaatatacagaactttctgttacaatttcttaaggtccacatttaattctactaacaactttttagtcaactaaatattacctctagtccattcaaataacactaaacgtcaccgctgacgcccctggccggccgggaaaatagagaggaaacactggtccatccataaacaaaaactaaacaagcagaagctgaaattgccatcagattgggagactcacttcactcactcgggagtcgggtcctcctcgactcagctcctccacaaacaaagccaccaccatcccaacccaaacacatcggccgaccacgggcgccgccatgtccaccgctgacgcggcgagcccggccctggcgccggactgggacgcgccggcgggcgaaggcctggccctggcccagttcgccgcgggctgcttctggagcgtggagctggtgtaccagcgcctcccaggcgtggcgcgcacggaggtggggtactcgcagggccaccgccacgcccccacctaccgcgacgtctgcggcaacggcacgggccacgccgaggtggtccgcgtgcactacgaccccaaggcctgcccctacgacgtcctcctcgacgtcttctgggccaagcacaaccccaccacgctcaacagacagggcaacgacgtcgggacgcagtaccggtcgggcatctactactacacggcagagcaggagacccccgcccgcgctgatcgcctgatcctgtcgccggcgtcgcagtcgcagtcgcagggctggttgggggcccactgcaaccagttgccaggttcaatggacctggtcacctggaacggatactattttcgattccgctgcgcctttcgcagccgctgaacgcgatctatgtttctttattgcaccacgtagctagtatcccaaattagttgacaagtcagcatattagccaatggtagaccgtacgtagacaagacagcatcagtcgatgtcatgtggaggagcatcgtgttcgtgtccataaaaaacactgtatggtgtcaataatatggaacctggtcattgacgtcaacatcctaatttagtcgtttagacagccaaacgcttgtttccctagtaatagataaggccccgttctaaaccttgtcaagctaattaggttagagcagctagcaattaatagctatcgagatatatataactagcaattagttgatctattagttggtccattctaaaccctaaaacaaaaatagaagatcataaaaaactcttaaaattttatagaacaccttattatttattctaccacgatattaagagataaaaactacaaaattctattcttttaatcgtgtgtattaaataaaactagtacaataatacctgcacattgccacgtcgcgcaagaataaatattatattttattttagccaaaagatataaaaatgtataagtcaaatagaactcgacactttttttataactcgttcgatggttcgtcctcttttaactatcgtgtggtaatatataggagtgttgcgttgtgaatggtttcctgtcgttttgggcttggatgctcacgatgcatgtaggcttggatggttttcatggctcgtctatagagtaacgacatataagtaggggagagaaatagacatcaaaactagtgttttacaggagtagagactttctgttttataccgtttatagataaatcataacttaatattttgatatattagtagagtaaagccttgtttggaacccctagagctaatagttacctagctaataaattattagctaggttgagccggctaatgaactactccctctgtttctttttattagtcgctggatagtgcaattttgcactatctagcgactaataaaaagaaacggagggagtaattgttagttgtgaggtatctaacaattatctacggtactagtcgatggtgtttagaacccaacaactaatttttaatagctaactattagttttagagatgttccaaacagggcctaaataacgaagaaattactttttggtaatttcacggaagatcgactgcacatcttgctttctcctaattanttaattactcggtccaatgtgacgcatttctccgtgacgccagggcaacgacgtcgggacgcagtaccggtcgggcatctactactacacggcagagcaggagacgctggcgcgcgagtcgctggctgcgaagcagaaggagtggcaggacgcgatcgtcaccgaggtcctgccggcgcgacggttctaccccgccgaggagtaccaccagcagtacctcgagaagggcgggcagtccgccaagaagggctgcagcgatcccatccgctgctacggttgagtaccgaccgacccctgtccggagcaccgaagacgccgtgaatgaactgtgctgcatcgatgcgttgtactacctccacctccgctctcgaatagttgttgcccgctagttcattttataactaaacgaccataaataaaaaagaacggagggaagatattgtaactaaagtgtaagatgacttttttgtgttgtgtatcgtactactgcttgttcagagatctacgttgatacaaatgatgcttgtgctggaataaacgcatgggtcgtgcagaggctatgttgatgttcagtttgtgctgggaaaaccgtgaaggtttaacgttgagaacaggcacttgcgtgcttcacctcacctgtgaaggtttgtttcatatagcaggatcgaagcccgggcagacacgacggaccttgccaactacgcactagccaatgaggcctgatccttttccatgcgcatcgtggcagatgcctagctagccgaggaagtcgaggacggggactatgttcttgcgcacgctgcagccgagagcgacagggtataggcggcgagcccgacagggttactcgtcgcgagggatgccgtgagatctcttcaacttcccctggccgtcgagcacctatggtcacaaatatatgatactgttatttttttcgaaaactttaaccactaatcttattcaaaatatttattcgaaaacttaaaattttaaatcaatcataagttaccttatttgataaaacaaatcataaaaaataaatgataagtcattattattttgaataagacgagtagttaaagttttttaagagtcaaagttgtcatatatttatgaacgaaggtagtatcaatcatcttcatgtttgttttaggatagtgacatttatcttattatttttttaatcccaaaagagcggttagaagcttcatattggtgattggtggttagacgaagcacatcgtagcatctgatgaagcagataacaagaagacaaagcaagggccaaacaacgtgcacgtctctaagaggaagagatagcggcacactcgatagtcactatagatcacatatatatgatttgaggacataaatttaattttatataaagttatatgtcgcctcgtccctacatgatacaatacccatgcacttgggaggctttttcttcaaaccacattcgaacactaccaagatatcattttaagtgtttgtaagaccatctctagtagcttatccgtacacataccaatattcaaactacactctacaaacaatgcgatctacagtacaaaatgtgtttttttatcatataagtgaactattgtacattgcacctatataatcactgaaaataccgttatgtatccttttatattgtagtttgcactgtttatagagtgtagtttgaatataagtatagataaatggagatggttaaatggataaagctaataattttcggcttatgcagcctcacatctttaggctttaatatatttcacatcagtacttatcaaaagatccttcgagttggtcacttgctcttgatttctgagagataataaaaataagacaacacaaatatattcttatacttcactctttaattaacccttgttaaagagattaaataagagagagaatgtgtcaaagca

SEQ ID NO: 22285 - DNA, 979 bp, Zea mays
gggtacctcggggccgcccgcccccggggcatcagattgggagactcacttcactcactcgggagtcgggtcctcctcgactcagctcctccacaaacaaagccaccaccatcccaacccaaacacatcggccgaccacgggcgccgccatgtccaccgctgacgcggcgagcccggccctggcgccggactgggacgcgccggcgggcgaaggcctggccctggcccagttcgccgcgggctgcttctggagcgtggagctggtgtaccagcgcctcccaggcgtggcgcgcacggaggtggggtactcgcagggccaccgccacgcccccacctaccgcgacgtctgcggcaacggcacgggccacgccgaggtggtccgcgtgcactacgaccccaaggcctgcccctacgacgtcctcctcgacgtcttctgggccaagcacaaccccaccacgctcaacagacagggcaacgacgtcgggacgcagtaccggtcgggcatctactactacacggcagagcaggagacgctggcgcgcgagtcgctggctgcgaagcagaaggagtggcaggacgcgatcgtcaccgaggtcctgccggcgcgacggttctaccccgccgaggagtaccaccagcagtacctcgagaagggcgggcagtccgccaagaagggctgcagcgatcccatccgctgctacggttgagtaccgaccgacccctgtccggagcaccgaagacgccgtgaatgaactgtgctgcatcgatgcgttgtactacctccacctccgctctcgaatagttgttgcccgctagttcattttataactaaacgaccataaataaaaaagaacggagggaagatattgtaactaaagtgtaagatgacttttttgtgttgtgtatcgtactactgcttgttcagagatctacgttgatacaaatgatgcttgtgctggaataaacgcatgggtcgtgc

SEQ ID NO: 22286 - DNA, 4190 bp, Zea mays
  misc_feature (27)..(31): n is a, c, g, or t
  misc_feature (40)..(90): n is a, c, g, or t
  misc_feature (138)..(142): n is a, c, g, or t
tgaggaacgaagagcagttaaaattgnnnnntcatttacnnnnnnnnnnnnnnnnnnnnnnnnnnnnnnnnnnnnnnnnnnnnnnnnnnnaaaatgatttgtctaatcttttgaagttgcacgtaaatactacgactnnnnncatggtgatgggtagcaccgtggcaggcaatcatatctatatgctcgtccccggcccgtcagcagaggcaccagctggaacaaggcaaccagagggagcgcgagccgggccactcccctccgtctctctcgaccatggcgaggctcccgctggccgcctgcgccgtcgccgccgccttctacctgtgcctccaccttgcgtcgtcgtcctcttccgctcctcgtcttgcgcctgccccgagcgaccccggccgccgtgcaggcaggaccgcctaccacttccagccggccaagaactggcagaatgatccgaatgggccgatgtactacaacggcatgtaccatctcttctaccagtacaacccgcacggcgcgctctggggcgttggcaacctctcctggggccactccgtctccggcgacctcgtcaactgggccgctctggacacggcgctggacccgacgtcgcccttcgacgccaacggctgctggtcgggctccgccaccatcctccccggcggcaccccggccatcctctacacgggcatcgacgccaacggggagcaggtgcagaacgtggcgttccccagggacccggcggacccgctccttcgccggtgggacaagcccggctacaaccccgtcatcccgctccccgccgacgtcccgggcgacaagttccgggacccttcgacggcgtggctcggccgcgacgggctgtggcgcgtcgcggtgtccgccgaggtccgcggcgtggcgtccacgctcgtgtaccggagcgcggacttcctccgctgggagcgcgcccccgccgccgcgccgctgcacgcctcgcgcgccgcgggtatggtggagtgcccggacctgttcccggtgagggaggagggtgacgatggcgacggccaagggctcgacgcgtcggcgagcggcgccggggtgcggcacgtgctgaagctcagcgtgatggacacgctccaggattactacatggtggggcggtacgacgacgcggcggacgcgttcgtgccggcggagcccgagcgcggggacgacgtgcgcggctggcggcggctggactacggccacgtgtacgcgtccaagaccttcttcgacgcgcgcgggagccggcgcgtgctgtgggcgtgggccaacgagtccgacagccaggccgacgacgtcgccaagggctggtccggcgttcagacgttcccgcggaagctgtggctggacgaggacgggaagcagctgcggcagtggccggtggaggagatcgaaacgctgcggaggaagcgcgtcgtcctgcgccgcggcacggcgctggccaccggaggcatgaacgagatcgtcggcgtcgcgggctcgcaggcggacgtggaggtcgcgttcaaggtctcgagcctggcgggggccgaggcactggaccccaactggctgctggacccgcagaagctgtgcggggagaagggcgcctcggtgcccggcggcgtcgggccgttcgggctcatcgtgatggcctccagcgacctgcgcgagcacaccgctgtcttcttccgcgcgttcaggtaccatggcaggtacaagcttctcatgtgcactgacctgacaaggtcgtccacgagggcaggcgtgtacaagccgccatacggaggattcgtggacgtcgacgttgaggagcacgagaccatcaatttgagaaccctgattgatcactcggtggtggagagcttcggagctgacgggcggatgtgcatcacggctcgagtgtaccctgagcacgcggagacgagcaacagccacatgttcgtgttcaacaatggcaccggcacggtggaggtgtccaagctcgaggcatgggagctcgcggcggcgaccgtaaattccgttgggggcaacgacagcttggttatgtctgaatctaataaccaaagtgaatcctattaaaatcttcaggttaatgtgtcaaaaatggggtccgtttgatttgattgctatactttgttatggagaggggggaaaggtgtatttcaaataagaaatattggccgattgctgttgagaaattcatattggttgatttggagaggagaataaacaagttctactgatctggcgcctctggctagcagcactatcatcggtttgaccatcagccaagagtggagttttgattttcgcgtgttggtgacggatacttattcggaggcctcgttcggcagcttgggaatttttgatggtctggtttttttctacacatggattaggtgaatccaagcctttcacctaatcccttgtgggattaaatctctaaacccaaacaaccaatattgttcgtttattccatatgaattatatcctaaaacccaatcaactatgtttgttcgtttattccatgtggatcaaatcctaaacttgaaaaccaacaaaagctaataaaacctaacaaagtttaaacatagaaaatacaattgtacaaaatttaaacatagaaaatacaattgtatctctcactaaatttaaacatgcatgtcatgattctcaatacatatatttaaaaaacggacataaaaacaaacatcaacatccaatgatcagatttttatcaaacaattgctttcaaactctaccaagcctaatgatgtatcaactggcatgacatgacttgaatttctctctcttatccttggaccctggaacaccatgagacaaatgaatgaatatgcacaataaaccaaagcaagctgcaatagaaaaaatgtgaagcaataacacaacaatagatggacaagtatataataggcattgctgctaatttccaagtgtacatgcagtagtagaaaacagaaacaatcattgtggttaataagtgcaaatgtttttttcatgctcagcatttgcttgtcatgcaattaaaaatcaacatttgcttgtcatgcaatcttttgcttgctattgcaccatttccatgacaacgatctagtaatgaattttgaatgttttttggagtctctagagactaggttataccagtagataatataatattaacaaaattgacatatgaagtcaatgtaaatatttttttccaaactttacattttacttgataaattcaatagtatgttggtttcagtaatctcattacactattatagtatagagaatacattatagagaatgcatccatccccagattcctcagctggctatagttggttactctgtgagccttataaacatatatgcctcaaagtggatgagcaattgggtagttcattttctggctggttgcttccaattgccaagcataagatgtatggaggagagtgtagcagaatggacatagtacaagattacagtggtatacaagaaattgtcatcctattatcctaaaaaatattagtttattagactactgagggtacccaaatgagacaggaaaagggctccatctagatgaaaaatctgagcagagaaatataagtatcgtccttcatttagatgaaaaatatgagcagagaaatataagtgcataaatatcattttatatacattgaagtggtcaattcagtagctacgacacacatcaggtacgaagaaacttactctacaactgcaacaccaccaatatcggatcaccggcccacaacctatatgcagtatactattcataccaatagcaagcaccaaaaaaagaatttgctgtctaccggaagcagcagacagcgtgttgaagccgagcaacaatgctaatgcgataaggacaggggtcagtagtacctaggggcctcggagccctgctgcttcttgccgccgccgtgctggcacttgtccttgatccattggaacccctgcgacattccctctttcaccttcctcatgccggtggtcgcagccgccttggtcttctgccccacgtcgccgcctgccggcagaaatcagaaagggaacatatcgattcgaaaaggaaactatgaggtgctcatggcctcacgccgaccgtggcccccggccgccccactgcctgcacccatggcccctcccccatcccc

SEQ ID NO: 22287 - DNA, 2656 bp, Zea mays
tttttttttttttttttttttttttttttttttgaaagaacacaaccaaaactgtgttgattacgagttggggtatcacaaactgatgaacgacaaattcttagatgacaaatatgatctaagcaaaacccaaacactaatatggtggtggttgctgataaaatagagattaggggcgtgcatgacctttggttgcatccctaatatgctccaacacgatacatggcccaacagcccaacatacggtgttgcaacactaaaacagaatctgaacgctaacttgtttcgacgattcctgttgactccggatgaattttaaggtgattccagttgggttggaaagcgtatctccttaggtttccatccatataaagcataacctaatcggagttcggatgcatcttgggcgtctgttttagtgtagactagtcctagacttcgaggtggagacgaagttgagtcagacttggatttctcttgttgtgaatatcctagcttctcgtccttgacatcttggcctttcccaagtccttactagtcctctccaaggttccttagcccaccaaatgttcaggaagaagctgagcatgtattcacgccatccttgcaatcacgtgtaagctcgttgaatgtctccacatgcctcttccccctcaagaatacctcagtgtcaactgcaatcctcatatagccatcaaattctactggctgaccattgctcagctccttagtttcagtgaaccactcactattctcatcccacaggtacttgaaatcatcaaggaagtgtgttttatacttttccttgagtgggttaaagaacgatttgtcaggttcattggtagcaatgtacaaataccggccagcaccaaccttatcattaagtgccataaggagactgtctggtgaggtatctctgtcaaggtttggccaaagttgtgtgttctgcgctttctcccctctgacaacatggaccgagtcaaagtcccagttcatccgtgaggcaatggcagatacaatctccatcaagcgacgagatttccacaggaaatgccatgggcgcttgattattccctcagtctcaccctcgcacacacgtgaccaatagttatcaggctcaacattcccaaacttcctcatgatcaatgtgtccttgatgtcacgaagtttcattggggtcatcctgatgtcttcagtgtagaagttcttgagcctatctttcttgtgccactgtccccaatcttgccagaactggctctggtcaatcacggacgcagattgcttcaaatgctcaaaatcaaagtagagcctgaaatctctttcttcatccttgccactcgaagtataccgtgcattgaggcagacattcaagtccatgacaagagtccggttcaagaattgtgcctcaccaagggcacacaagaacccccaaatgaaatggttcatgctcttgcacctctcgccaccaccaatgtaaataaggtacttaccacggctgaaatcagactcagaagcaaccactggcaagctgtcattgacagcctcaccaacaacaaacaccggctccgctgcagccccagcagcctcattgttggcggtgttctcgtccagcctaatctgtgtcttaaccggcacgaagtcagtcacaggtgcatcctgctttcccttcttccctttcttccccttgcgccgtccattgcgcttggcacccacacccgagtggtattcacccacggtgtcgacgacgaggctgcaggtgttgacgtcgcgggtaagcgtgaaccggcggtagtccttgtagtatgtggtccggccggtgccgatggcgtcggcagcggggcggaagcgccacgcgaggtcacactccatgggactccccggcaccgccacgggacggccaaagcggtagaagtggaggtcggggaaccgctcgatggccgcgcgcatgagcaggttgaagagttccctgtctcctgtgcagtccacgggcgcctccgtgtcgcaggaaaccgcctccgcaacggcggtttcctccgccaccgctgcaccctcgcccgtggccgcatcagtgtcgacggtgacggcccgctccgtctcgggctccgtcttctcggcctcggcgccaacttcggagagcttgatgaacgggacggcctccgcgacgacttcgacacccccagcggcgacctcgccggcggcgccggtggacgaggagttgaagtcctccccggtgcgcagcacggagtcgtcagtgaggaaggtggaggtggaagtggcggaggtgaggaaatcggtgagctggtgagaggacgggtggaggagcggatcgtcggggctgtggaacgccgcgaggagcgtgaatgcgagcacggccgccacgaagagcgcgaagaggaggttgccccccgaccgcagcgcggcgcgaaggtctggcaccccgccgcgccaccgtggcgcggacagtgccgccgcccgccccagcattcgcggatctggattcggattgggagtgaagtgggggaataggagggatctggctggagggggcggagtggcggacgccgacaaggcgacaggacgcgagcgagcgggcgtggagatcactcctcccgtcctccgtactgggcacgcggccgccggtcccgacccggccggc

SEQ ID NO: 22288 - DNA, 1326 bp, Zea mays
ctctagaagtactctccccgcttttttttttttggtcatggtggaaaaatccaagtgagctatatagaagagatacagaagacaactgcaataatgcatgttcaactaaacagcacaagcccaatgcatgaactgaatgtactaatgtaatctggaaacacaaaacagtggtataacaaaaagtgataccagctacttagctacaacaagactaggcgtggcataagagacaccaataacacagtcgaaaatatcctctgaagcataatatttcatagtatcagctcaccttagcccaccaaatgttcaggaagaagctgagcatgtattcacgccatccttgcaatcacgtgtaagctcgttgaatgtctccacatgcctcttccccctcaagaatacctcagtgtcaactgcaatcctcatatagccatcaaattctactggctgaccattgctcagctccttagtttcagtgaaccactcactattctcatcccacaggtacttgaaatcatcaaggaagtgtgttttatacttttccttgagtgggttaaagaacgatttgtcaggttcattggtagcaatgtacaaataccggccagcaccaaccttatcattaagtgccataaggagactgtctggtgaggtatctctgtcaaggtttggccaaagttgtgtgttctgcgctttctcccctctgacaacatggaccgagtcaaagtcccagttcatccgtgaggcaatggcagatacaatctccatcaagcgacgagatttccacaggaaatgccatgggcgcttgattattccctcagtctcaccctcgcacacacgtgaccaatagttatcaggctcaacattcccaaacttcctcatgatcaatgtgtccttgatgtcacgaagtttcattggggtcatcctgatgtcttcagtgtagaagttcttgagcctatctttcttgtgccactgtccccaatcttgccagaactggctctggtcaatcacggacgcagattgcttcaaatgctcaaaatcataactccaccaggattcataattctggtctcatactggtagatccgaggtgaattgtagcatatatatagaaatttatttggaagaagattctcagtaaaataaaagtacccatagtgataaatttaaattagaaactaaatcctggcctcatgaaagcagacaagccaggatttgctgcaccgataaagataaactagttaaacaaatcttattttcaagtaaagctatgcatgaaaattgacttgttttatgacatgataagtttgttcctagtttcaggggctgcag

SEQ ID NO: 22289 - DNA, 2288 bp, Zea mays
acgaatttacgagaaaacagagaatcgaaacgcaatttcgtgtgctggtggtgctcagctcagggccattcacggtgtcctgcctggctgccatgtgcttgcaagctgtgagcaagtgcgtgtgctgctagcctgctaccatttgccgcccagcgtatccgtatctagggcaatttcaaccagacaatgttacatcacgaaacacacgatcagagtgctgagtttgttttcaagatgctgcagttttttttaaaccaaacccagcgccggaagctccggtcaccccaatatgaatatagcagtatagggacaagaaggatgcggatgccggaagcagcacaaaactttggatcgccatctgttgcgtgctcgcacctcgccgcgcccccaagggctcacgctcgtgacgcgtcccacgttgcgtgaacgcactcgcgctccccagtggcgcacacgccaccgccgccgcctatttagaggcccccaccgcctcacgagcacgccccccccgtcgactcgcccgctccatcgcccccacgcacccgctgccggccaaaagccaattcgaatctccccgctgcgcggcggggcctctgcttccgcaatgcgggcctccgtcgaggaggcgggcgcgctcctggcgcggagcgactcagccggccgccgccgccgctccccgccgccggtgcagaccgcgtccccgaggcccggtagcctcaggcgccagtcgtcgtcgttccgcgaggacgtcgggcacgccgcctccgagacttacctcgtctcgcgcctcaccttcaccctcctccagtacctcgggttaggttaccgatggatgtcacaacttctttcactcacaatctatgcaattgtacttatgccaggatttatacaagttggatattactatttcttttcgagccaagtgcgtagaagtgtagtctatggagaccaacccagaaacaggttggatctatacataccagaagataatagtaggccctgtccagtggtggcctttgtgactggtggagcatggattattggttacaaggcatggggtgctcttctaggacgacgattggcagagcgaggaataatagttgcttgcattgattacagaaatttcccacaaggtacaataggggacatggttcatgatgcttctcaggggatttcttttgtgtgcaacaacatcgccagccatggaggagatcctaatcagatctacttgataggtcagtcagcaggtgcacatattgcagcgtgtgccctcatggagcaagcagtaaaagaatctggtgggaatcctgtttcttggagtcttacccaaatcaaagcatacttcggtttatctggagggtattaaattggatatctaatgaagtggtatctagtaacgattagatataacagtaaggattaatgatggatttgaagtacaatttcagcataatggaaggagaggaatcattgtcacgttattctcctgaaattgttgcaaagacgtcaagtgctgaaaccatagctcttctgcctcttgttgttcttatgcatggaactgaagattattcaataccatcatcttccagtcaaacttttgttgacgtcctccaacaagctggtgctcaagcaaggttactattgtacgaagggaaaacacatacagatatctttgtacaggaccctctaaggggtggaagagatccattggttgaagacgtgttgtctattattcatgctgatgatgcaaatgcatgtcaaaagattgctttagcaccaactcctaggagattagttttcgagtggcaattaaagttggcacgcaaaattagtccattctagcagtatgaaccatggagaagcttggagctatggattttgcaccttcatgaggaaagggtgctcgtctgctcggggagccgttgagctggattggatcaggcaagtaaaaggttctcgcgtcttctttacttgcacaacgttggtcaatgtgaaacttgtagctggtacgcaatacgagaggaagaagctaaatacacgactgggaatggaaaccacgtcatcttttttttgcaaggctgtatataatgttgcatattatattgtacaaaggcttgtactacgtttcttgtgcctctattctaaaatgtaagttttttttttaattttagccgaaatcaaactgactaaaggcttgtttcaaactgactaaaggcttgtttggaagcactcagtttttaagaaattagtttataaaaattgagttggtttcaaaaaaaaaaaaaaaa

SEQ ID NO: 22290 - DNA, 3287 bp, Zea mays
ccaagtatcagaaagcatgcataataacatacaaccatatacatgccaatggtctaggccttctcacgtaatagcatctagatttgtgtcgaatactagcaacttcataaaatcaatgggctgtttagaaaacgaattaacaaagggatgctctgccattcgtgcggttcgtcaatcgcaggcttacagcgcaggtatagattaattgcatgattcagaaacccacagccaggtactccgctcaacaatgaagtaataggtaaaaaggacattgagataacatcaggttctgattgaacagtgtttatccattcactgtgaggcatatctttgtcccattcctttccacctctccgcttaaccaccatcaccaagtcctgaaataaaaaaaccaagaaaggagttagttgaatagtcaaagtggtgagcacacttcctagaaaagaaaagaaaaaactcgatacctcctttgaacagtatgaacttgacggacttgattccacaaatcttagccgttgatctcttgcatcatgctgcacaggacattacatcaaattactgaagactcatctttgaaaagacaagaaacaatgatcatcatgcagttttcacaaacttagcaatagcttatcaaaacttcaatagtaacttttacagggcagatttctgcatttttgctgattgattggaatacaaacacaaataaacaaacaacaaaatgcagagtaggagtaccttgtccttcccgtgcacatgcttgttgttcatgtcatactgtccatttccatccagaaatctcatgtccgacatgtccttgagtcgtttctgcacagcagctggttgcaagcttgacgaatgttgttgtttcaaatatataacatctttccctcccatttttacaccgacaactatgtgtgttccaaacttatcaataaacctgaaaagtgaagcagcaagaatcaaaggttcaggtgcaatataactagtatattcctttgcaacgtctacttatacaataaaccatttagctgagaaactctgaaggaaaaaaaacgatatatgaatgtaggtacaggtagggtcctaaacacaatcacaatatagtcttatggcatcatcataggagagtaagagcaagcgtctaaccttgccaaagcagcagggtcccaggttgaaggaactgcctgagtaacatgatcccggagtagaatacgagattttgacagtgcgagcgtatatagcgaaatgtaccaaccatcaaaagcaagtgacttggtgttagctgcatctttctgccagcacccggaaaaatcaaacatgctattgaacatgccggagggaattttcccggtcaacgatagctcccggttgaacagctctgacatctagagtccaaaaaaagtacaattcttggttagttcagatttttctccagaaaaaaaaaatagtagtggccatccatgaaccaaagcaacgacagcggtatgttgaacgctttagaagactgaaatcaaaaccaacctgctgaaaggagaggacgtcggagcggaaccgcgtgcgctcgcccttgtcacacgtgacggacttggggacggcagcgaccttgatcccgccggggagcaggacgtcctggaccccatcgcgggaaacgtcaatgagtcgcgcgtccgggtccgcgagcttgcccttgcagtacttgaggcggacgtcggaaacaacgtcgtagccccggccgatggccgctacggccgcctccgcggcgccctgcgccgtggccttaagcgccattcccgagcatcacggggcgcgcgcgcgggaaccctagagcgcccccaagccagagaggcagaggcggaccagacggagcagctccgccactgagacggggtggcgggcggccaaagtctcggattttgaggaatccgatagctccggtgatccgattcgactcgacggtagaaagaggaacctcgggaggaagatctgtgcagccagctagcgagcggaagggatcgagcttccggaagccttcaagcgagtgggggccgggcgattgaagcactagcaggaggcggccaggcgagcagttgagtggaagtcagcgagcgagcgagcagaaagagcaattcagcgacccgtgagccgaaaagcggaggacgcgtgagccgatttcgcgcgcggggagcggattgcggcgggattgcggtttggaatttggtggtggcgacgcgcaagaggaagagggaggaggaggatgaggagggcgcggcaggcaggcacgacgggacaagcaataaaagttgccgtgctgcgtgtccatctacttgctgtgatgttgtcgctgggttgggtcaaacacaacgagcaccgaaaacgaaaaaaaaaaagagggttgtttggaaagagcggttggtcacgccccctccttccctctggttttggcgccttttgcgctgtttttagcaagtaaacttgtcaaagatgttgtctttcttttttcccacgccttttttttctccgcacaacttgtcaagactcggtaggttttgagcttgggaccatgtgggccccacagccacgtccattactgtggatgcggactccgtttgcagagcagggacaccttgcctaacatttgtctcagtgacatgcttctttactgttctctctgaattcctacagacatgtacaacatctatggagaaaagaaatttacctgacgacggccacgacgacaaggctgctgcacagtgctccggtgggccttgtgcttccaaagttcatttattatacaggtttttgcaaagaaatacacatctcactgcatggtttcgaggacagcatacaaaatcaaagaggacatatccaacagctacgatgcatacaacatccaatcagcagctcctcaggccatagtgaggtttaaaatgagagatgcgatagaaaatatgctagagatagctttaaatcggaagcgagcactctcattccctttgtaattagtaacaaaatatatattgtcagagagaactccagctgggtggcggagtgcacccgcctaatcctaagaatagaggggcagccatggttttgtccgaacagatgtatgagtaagtacaaggacacatatgggtttagagtggttcgtgccgccggagcgtaatgtcctactccacatgttagttgtattgctgagggtcaagataaacttagatgagttcaaccccctcaagtttatgtgtgtcctcccttttatagcccaaggaagacacgtacatgatgaccgt

SEQ ID NO: 22291 - DNA, 2664 bp, Zea mays
  misc_feature (6)..(18): n is a, c, g, or t
ccgggnnnnnnnnnnnnntttggccgcttttttttttttttgtttaaaagaatgccagagcaagcaaagcaaggcgatcatcgttttcacctcgctgcattacggatacatgtgtagaatgtactgtctcccttttctgcaaaacgaatttaatttcaaagattctacggacagccgccgatcagccgagaaaatggttataatcgaaagatgaggcgatgcacataagtcaggtttccaaagaagcatgctgaaactctttacttgcaatgcacaaatgcacattagctagcccccatcttcccccttttgagactgagttcctcccacccttgttcattcttcatactcctcgtcaggtaccatggctgtcaagagcgaatacttcacccgcagtgatatcttgcccctctccagctgcagcttggcaccagagaccacccagtatcccggcgtgtcctgtggtccgcgcaccatctctgccgtgtccacatacttgaggagctttggtgcctgcactggcgttggcggaccgccagggtacacagccgagttgatgttcacatcagcagggcgaggggcaggcttctgagccgccatggagaaatgcgtgctgataagcgtcgagatgaggccagatttctgccccaaattcggtgacccttcccactcgggattcttgacgagcgcagcattgctgactctggcgaattggaggcggaggaagaggaccttcgtcaacccatggctgctcacatgtaactgcgccccggtcacgatggagtcgtcgtcatccgactccactggtgccgtgtaaacatgtgagaaacgcttccaggatccaaatggttccacatacttgcggtcatatggttctggttctggataccggtggttgtatggatcatcctggagctgcaggatctgaggaagcgagcatagatgctgaaggtggattgccagcatgttgctcttcttcccctcaagatacaatcggatcccagtaacaggtctttcacccacatcaaccatattagtgcagacatagagccttggtcccataaaacttaagggcaaagatgcactgctctgtttcctcctctgaggaccaagagggtggtcactgtacacaggtgcccattgtcttggtagttggaactccaaaaattgatgtagttcttcaatcggaggcttatagcgcaggtatagattaattgcatgattcagaaacccacagccaggtactccgctcaacaatgaagtaataggtaaaaaggacattgagataacatcaggttctgattgaacagtgtttatccattcactgtgaggcatatctttgtcccattcctttccacctctccgcttaaccaccatcaccaagtcctcctttgaacagtatgaacttgacggacttgattccacaaatcttagccgttgatctcttgcatcatgcttgtccttcccgtgcacatgcttgttgttcatgtcatactgtccatttccatccagaaatctcatgtccgacatgtccttgagtcgtttctgcacagcagctggttgcaagcttgacgaatgttgttgtttcaaatatataacatctttccctcccatttttacaccgacaactatgtgtgttccaaacttatcaataaaccttgccaaagcagcagggtcccaggttgaaggaactgcctgagtaacatgatcccggagtagaatacgagattttgacagtgcgagcgtatatagcgaaatgtaccaaccatcaaaagcaagtgacttggtgttagctgcatctttctgccagcacccggaaaaatcaaacatgctattgaacatgccggagggaattttcccggtcaacgatagctcccggttgaacagctctgacatctgctgaaaggagaggacgtcggagcggaaccgcgtgcgctcgcccttgtcacacgtgacggacttggggacggcagcgaccttgatcccgccggggagcaggacgtcctggaccccatcgcgggaaacgtcaatgagtcgcgcgtccgggtccgcgagcttgcccttgcagtacttgaggcggacgtcggaaacaacgtcgtagccccggccgatggccgctacggccgcctccgcggcgccctgcgccgtggccttaagcgccattcccgagcatcacggggcgcgcgcgcgggaaccctagagcgcccccaagccagagaggcagaggcggaccagacggagcagctccgccactgagacggggtggcgggcggccaaagtctcggattttgaggaatccgatagctccggtgatccgattcgactcgacggtagaaagaggaacctcgggaggaagatctgtgcagccagctagcgagcggaagggatcgagcttccggaagccttcaagcgagtgggggccgggcgattgaagcactagcaggaggcggccaggcgagcagttgagtggaagtcagcgagcgagcgagcagaaagagcaattcagcgacccgtgagccgaaaagcggaggacgcgtgagccgatttcgcgcgcggggagcggattgcggcgggattgcggtttagaatttggtggtggcgacgcgcaagaggaagagggaggaggaggatgaggagggcgcggccccgcctcgaggtacccaa

SEQ ID NO: 22292 - DNA, 3819 bp, Zea mays
  misc_feature (515)..(515): n is a, c, g, or t
  misc_feature (674)..(674): n is a, c, g, or t
taataaaatatgatactttagactgagaataacctaagaaacaatttcttgtatttttctctctctttattgacaagtgtgtcacctcatttttaaaaattatgtggcatggccatttaatgctataaaaacattttatcttttcagattgtgagagtgctcttagactatctctagcaggatagtgcaaaataaagaacacataattatagatgacactattttttacactgtttgtataatgaagtttgaaatagaagatgagataggtgatgagattgaggatctgttggagatagccttaagagctgtgctcgcatgtttgactttgaccagatcctaccagcctgtttgactttgaccagatcctaccagctcctttcaactttccaggattagagttagacctgttcaaacatcagatcgggtcaagatcgggttgtaagtcatttaacatggcccgtatccgactcatgcctagtgtcgagtcagattgacccgtgcatccatattangtgtgtcgatcaagtttttttggctttaggtcagatttttttggattgggttaagttttcgattaaaaatcatggtctgtatctaaccatggattgttacaggtcaaaaacaatggtccatatctacccgtcgagttttttttttttgagcgggtcgancagcccataatcaggtctaattagactcaacctcgcttcacattatttatgcttatgcgttcaaaatgaaccggttacctacatgtcccaagaaaatccatgtcgtccaagtaatccattgaaaatttcatcgggttgggttcgtaacccaatctgcatgcagcacccacaacagtactagcctgaaaaagtatttcggaaaattaaactagagcattcaatacatttttcatttctcttacggaaacgtttcaaatcaatcaatattcgcaatcctcacaatcagctatagctagtgccgcatggggttaaaaaaaattaagcaaacacaaaatagaggatacggccttttatgttgcacatgcatattggggcacaaaacatttttccctgacgagctcgtgcagatcgtggacgattttgaacacagcatcaggtcgtgctagcttgagggcattctgggacattaccctgaattcgtctgaccttgggccaaaccagtcggcaactatcttcgcaatttgttttggagatttcgagaacttcccacatccgttttcaacaacgtaggggacaattgccagcttcctgtccagctttcgagtccttttgagtacgtgatgtatatcatgcttagcataaaattgaaactcatgtagacacgttagttttaatgccgatgatatttgttatatgggcctaatagtatataggccttctaaagtttaacaatgttcaaagttgctagacgattttgcctcttggcatgagaatgcatctcatcgaaccagcaataaaaaaaatggcctttgatacattccaatatcagtgccatgttgaagggtttagaaagttgttttcatggtaaaaaaaagaaagaattacaactacaaaatttcaaacacaggtattcttccatttgagaaactttgaatttcagggtttagaatttgatgcttggcaacttgggtcatgtgtaagaagtaaaacacatttatatttaacctaaaaataagactagatagtgttatttagaccctgaattagccctgccgaagcaaaccaacttagtcaatttgactggttctcaactgaacagtgactattttgctggttccttgaagtgccatcctaaatatagccatgttcatggtttggtgccaaccaacccaaccgtgaaaccagcctactggctctaacagttttcatacaggttgagctagagatccgggtttggacaagctaacccctgtacaagcagccctgttcatggtttggtggcaaccaaccaatccaacccgtgaaaccagcctgtcaaaacccactctacagtttccatacgggttagctagactgctatttggaccagcctgcccatctaacagagccaaattgtgaagatcatcagcaacagctatggcctacgggtagcacgagtaatggtgcagctggggcaacttgccatggctccgcctacaacaggggccaccttcaacacactattcttgctggtaactgtacgaaatcaatgccactgagaacccacaccggcagtatcttcacaagcacgcgcttgagtcaaacaggcacttctgtgttgaactgtggcatgtgcttcttccaccgtggcagtggcagttgcagcagcagaggctctcgtactgatcgtcctgaatttttgctccatgaacagttcaatcacaaattaacttaagggatttggtaagatcagaggacaaattgcggaagtggaaaaaatcctagaaccatctgtagcactcctaggaccgcttgcgcctctggccttctgttgaccttccaaattgcggcagtctgcttggtcatgaggaagacagcgagacagagaaaagggcgaaagtgtacaaggggtcaaactgtggagggggagtacggacagcgttggcagcaccaatcatcattgtcgggttcagtaggtggatgttgttagcggcgtcaccacagccagtctacagtcaaactggcatctgacggactgttttggtttcagtagcaaaactggctgaaagcgtgagtgaagaggcctagttataaggttttagtataaccacaaggatgaaatcaagaaatcataatcttacatgggcaagtaaattttggagatgtgcatatctaaacaagcgtagccatgatttggagttaagcttgagctcatggtgtatggtaatatgaatatatgacagtacatcaatcttctatttttgtgatttttacagactctttctcctaaacatttaacattgaaatggtcaaatgagtcaatgtctcaatgatccaggggacaatttcaatgttccacagacagctcatatttgaggagagtgagatgcggcagcatgagagctaataatggaatagaagagcccctacactcagttgccaaaaaataccttcccctgagttcctgacccgtatgcacttgcggacagcgctatcgaccaaggaacaggttgtgaaccaggtcagaatccagttgagtctataggaagccccgccgcatccgtaagtgctcggttcaaacgtggcgaaaggatgcatagcttccaactcagttttttttttgagattttttggacgagattacctgtctagcagagccaagctgtggagatcatcaccaaccagtgccacagaagctacatctgtagctgattgcataagttaccgtgcagttgggggcaatttgccatggcccatctctggcaggggccaccctcaccacacttttctcgcgaaaatagtacaaaatcgatgccgctgagaaccccaccagcagtatctcctcaagcacgtgctgagtggaccaagcggccaagcccttttgaatcaagctgtggcctgtacttcaactgtggcagttgcagcagcagccagtctctcatgctggtcgcccagaactctcgctccataagtggttcaatcacaaaatagggtaagggatggggtaagatcagacaaaatttcagaagtggaagaaatcctcgaaccatccatggtgctctttctaggaccgcttgtgcctggcagtcttttgttgatcttccaaattgcggcagtctgcttgaccatgaggaagacagggcagggagacagagaaggaagaggg

SEQ ID NO: 22293 - DNA, 1939 bp, Zea mays
tggggtcccggccccccccctcgtgtttttttttttttttttttttttagcctgaaaaagtatttcggaaaattaaactagagcattcaatacattttcatttctcttacggaaacgtttcaaatcaatcaatattcgcaatcctcacaatcagctatagctagtgccgcatggggttaaaaaaaattaagcaaacacaaaatagaggatacggccttttatgttgcacatgcatattggggcacaaaacatttttccctgacgagctcgtgcagatcgtggacgattttgaacacagcatcaggtcgtgctagcttgagggcattctgggacattaccctgaattcgtctgaccttgggccaaaccagtcggcaactatcttcgcaatctgttttggagatttcgagaacttcccacatccattttcaacaacgtaggggacattgccagcttcctgtccagcaatataatcatttagaataattggtaagccacggatcattgcctctgcaattgtaccaggtcctgcctttgtaatgatacaatcacaagcacccatacattcttccatctttgtaacaaagcctttcacctgaactggaactttccaatttattgattgcaatcgattgaccagcttcttattacgcccacaaattacaagtatttgaccagtgggttcccctaggttttcatcatacagagaatcaccaagtgctttagcagtggcctcaataggacccatcccttcacccccacccattaatagaacagcaggcagatcttcatccatgcctaactctcttcgcagctcatccttcggtcgaacaggtttgacaaaagagggccggacagggaggccatagactttaatctgtgcgggcttcagtccagcttttagtgctctcttttccacctcagttgatggacagtaacatctagtgacaagcttatggaaccatgttgggtgacaagtgctgagatccgtgataacagttgcgaatgggatcttatccaagagacctttcgatcttagaattcggagggggacatgttgcattaaagggtgtacactgataattacatctggttggtacttcattagaccttttgccacttctcttgctatgaatgtggatgttgcagcaaaatgaggctgatggactacacgcggtgcagtaccatagtatgtcatcttccacaagggtccatgtttcaccaaaaaactatagctcctaggcagttgattgaatggccatggagtgtggtcagtccacagatcagtgacaaatacctggtagtcgtcgccgaactcctgggtgaaggcagccttgatggcctcggcagacgcgcggtgaccgccgcccgtgtcgctcataaggatcagcaccttctttggcgcctcggcccgcgccgcggcctcctctacctcgcctaccccatccacatccccctcccaccccctcctcccccaccgccgacgttatccccgccaccgccgccgaaacccaggcccatggacgcgaacccgagcggcgctatttggttcccgtgcagccgcacgaaccgcgcgaactcgccccacatctgatggagccgcgacgccacggagaaagtggggcccgggacggagatggcgacggagagcgctcggggcccgccgcgcgggcgcgggaggaaggaggcatggtgggaggagggcgcgggggaggcggagagtgcagcgccggggagcggcgtggagaggagcggggacgggacgcagaggaaggccgccgggagcgccggctcggcggtcggtgcgggcatcgcggctgcggcgacgagggagaggtcagtctcgtggcattcgagtgctgatgctgaggcacgatgctggaggtgggggggggggtggtggtgagccacacagcccccggccggcctcgaggtacccaa

SEQ ID NO: 22294 - DNA, 1501 bp, Zea mays
  misc_feature (20)..(20): n is a, c, g, or t
ccgggaacgaagtccacggncacaaaggaaatgaaacaatccacgcggaacgccgccgccgccattcccatggttttccatgctcggttgcgagccagcaattccatttcagtgtcctccctcgtctcgagaccttgccccatccagcccaacgctccgtccatcaactgaatagcttggcggtgtaaccctgtcgtgtgcgatgagctcctcgccgttgatcaccgccgcggcgtcggctgccgtggtggcgctggctgtcgccaaccgcgtgctctacaagctcgcgcttgtgcctctcaaggcgtaccctttcttcctcgcccagctcaccaccttcgggtacgttgccgtgtacttctcgatgctctacacgaggtaccgcactgggttggtgactagagacatgctggcgctccccaagcaccggttcgtcgctatcggtttgctggaggcacttggagtctttgctggcatgtctgctggagctatgctaccagggcctgcgattcctatactgtcccagtcattcttggtctggcagcttatcttctctgccctgcttttagggaggacatattcggccagacaagtcattggttgcttcctagtagtttctggtgtgattcttgctgttgcaagtggagcggatgatggccagcttctttcagatgtaaagttaatttggccagcactcatgatcgcttcatcagcatttcacgctggtgcatctattctgaaggaagctgttttcattgatggtgcaaaacgtcttaaggggaagcggccagacatatttgtggtcaattcatttggatctggatttcaggctgtttttgtctttcttcttcttccattcctttctaatttgaggggaattaagtttgctgagcttcctgcttatttaaatggtggtgctgagtgcttcttaaatgtcgcagaaagtccaatcgactgcggaggagctccattcctgcctttgctgtttatagtggtgaatatggcattcaatgtctctctcctcaatttggtgaagatgtcatctgccattgtggcttcacttacagcaacatcagcagtgccaatatcgatctatattctttcacttcctttgccctacatccctcatggcacggaattaagcacgtctttcatcattggtgccgtgatattgctgatgggcctgattctgtataaccttcctcaatcgtcactgaaacaattgaaggctgattgaaggtaaagtgacacactgccacatgccttgtaacagagagtttactgattgatattttatggtgaaattgatttccacactgaactatacgaagcatgtgactcattcagattttgtattatgaatgttatcgaaattaagattttctaaaacgcaagcaacatgtgtatgtagtagggacatttttaatacttaccctatagtctggaagtgtgatctaaatgcaagttcagtgagcttggtgcttaaaaaaaaaaaaaaaaa

SEQ ID NO: 22295 - DNA, 1499 bp, Zea mays
  misc_feature (853)..(854): n is a, c, g, or t
gtaccctcgggtctgccggctgcaaccctagtcctgatgtctcccacgcacctcgctcccccagtcctgcattcgtgttcctgtagccgccaccccagcccctggacgctcggctcgatccctccctcctccaccacccgttctcctctagtcatcctcctcgccagtcgccaggtgtcggccgccggttgtgctccccgtcaggcgtcagcgtgatcccatcggtcgtcgcagaaacacagtcgctgctcgccgtcaccactcgccaggcgccggttcttctccaatccacgactcagcggctctccagtcctccgtccgttaccgaatttaaagtgcaacgtgccgattctttatatgtacttctgaatgcttggacctggtgtgactacatagcctggtattcatttcataaatgatggaaagaagattgggacggcgtgtatatttgattcccagaacccttccctttatgcaactcaatgctatgtcctcattctcagctggccatggacgccgacccaagaagaaggtatatcaccgtgaacctggtcttgacagggccatggatcttcaaaagaagcctgcccttctccttcgtctgcgtgacctcattttggcacaaaagacaggatcactacttgtgcgtgaccttgaaaaggaggttgggttttgtccaaaaagggaactttctttcacttatcgagcgtcaccccaatatcttccatgtctctggtggaagtgcctcccgagagcccatttctgtcacacttacggagaaggccagaaagatatccagtgaagaggctgaagcgcgagagctaatggagccaatcttggtgagaaaccttanngaagtactgatgatgtcgatggactgccagattcctctggataagattgaactgatccagtctgaactgggcttacctaacaacttcaagagcaacatgattccaaggtaccctgattttttttcaatccgtgatgtgaagggactggaccatttgtgtctggagaattgggactcttcactagcagtcacaatacgagaagaaaaaatgaattttgagggtttccagataggctgtagagggattcctaaagatggaaatgtcttgggtccttttgctttcaagttgaagtatccaacaggatttaggccaaaccggaagtaccttgaggaggttgtcaggtggcagaagatggcatttccttcgccttatttgaatgctagacgagtcgagtctgcaacaccacagtctcgaaagcgtgccattgctgttctgcatgagattttgagccttacaatggagagacgattgacatctgataagctagacatatttcacaacgagtacaggcttccatgcaagttacttctttgtttagtgaaaaatcatggcatcttttacatcactaacaagggagcaagaagcacagtcttcctcaaggaggcttatgaaaactgtaacctaattgataagtgtcctttactg

SEQ ID NO: 22296 - DNA, 2753 bp, Zea mays
ggtattcttcaaggagacaagtccgattcccttctgtatggttctgttgataatggcaagaagatatcttggaacgaatcgttccattctaaggttgttgaggctgcaaagcagctccatttgaaggaacatgtggtattggatggttctggcaatcctgtaaaattagctgctacagtcgaatgcaagggtattgttgggagtgatgacagacattacattttggatctgatgagagtgactcctcgagattctaactacattggacaagagcaccgcttctgtgtgttgagacctgaacttatagcatcatttgttgaggttgaatccataaaacaatcgttgaagcaaaaggttccagatgctccagttgcaagtacttctgatgctaaggctacctctgttgaaggagatgacaagtctgaagaaagctctgttcatacacacgaggaaaatgacaactcaagctccgagattcttttcaatccgaatgtgtttacagagtacaagcttgctggcagtgcagaggaaatcgctgctgacgaagagttggtaaaaagggctggtacatatcttgtagatatagtgatcccaaagtttgttcaggatctttgttcccttgatatctcccctatggatggacagactttaacagatgcattgcatctccatgggataaatattaggtatctgggcaagattgcaggcatggtcaaacatttaccacacctatgggacttgttttctactgagataatagttagatctgcaaagcatgttatcaaggatatactgagacaaagtttggaccatgatattgcgccagctattgctcatttcttaaactgtttcgttgggaaagttttaggtgcttccacaaagagtagtcttagcaacgcacagtcaaaaactctgaagggtcacgaaaatagccaaactcaaaagtctactaaaggccctaaactgagccatgctgccgcttcaagaaaaagcttatcaacttattctcatctaacctctgatggaatttggtttagcattaaggaatttgcaaaatcaaaatatcagtttgaagtgccagatgaagctaggctttcagccaaaagggtagctgttctccgcaacctatgccgaaaggtaggaataacaattgctgcacgaaaatatgatatggatgcttcaagtccatttgaggcctcggatatgttaaatctccaaccagttgtcaagcattctgttccaacctgtacagatgcaaagaatcttatggaagcagggaaagtcaggatggctgagggaacattgaatgaggcatatgcattgttttctgaagccttttcactgcttcaacagattactggtcccatgcacaaggatgctgcaaattgttgccggtaccttgctatggttttgtaccatgctggtgatacagccggtgcaattgtgcagcagcatagggaactcatcataaacgagagatgtcttggtcttgatcatccggacacagcccacagttatggtaacatggccttgttctatcatgggctcaatcaaactgaattggcactgcggcacatgtcccggacactgctgctgctaaggttggcgtcaggacctgatcatccagatgttgcagcaactctcgcgtgggcgccgccgaggtaccaggatgccagtaatatgaatactgctcttaggtatcttcaagaagcccttatgaagaatgagcgacttcttggccctgaccatgttcaaacagccgtatgctatcatgctcttgccattgcattcagttgtatgagcttatataagctttcaattcagcatgaaaagaagacctatgatatactggtaaaacaattaggggaaaatgactcacggactaaagattcagaaaattggttgaatacatttaagcttcgagaagaacaggtcaacgcccagaagcagaaggaccagggagctaatgcatctgataacgctgttaaattcttgaaggcaaaccctgcatttttacaagcaatgaaggctgctgcgctccaatcaggtgacaggtcagcaaatgtcaacaggtccctcaatgctgcagtagttggagaaggtgtaccacgactgagaggagtggatgagcgagctgctcgagcgaccgcagaagctcggaagaaagctgttgcaagaggcctgaatgtccgtaatggccctgcggcaaaccatgcgtctgatgaactagctcagattctcaaactcatcaatactgcttcggggtcttccacttcggcatctgcaaaaaccgaggaatctgcctctgaagggcaggcaacaaatggatctgttcaaaacggagctgcaaccgatgcgaagtctgcagatatcaacgtgccacctgcacctgccaaccaaccagttggattgggggcaacattggagttgaagaagcagaaatcaaagcaaaagtcgtagaaaacccgtgcctggaatttcttttatgactgcagttttggactttagggtgatttgtttttttacatttatagaaattccacgttcacgtggtggaagagttcatttgtttctgttggaggttcttaggagagttcaataatcattacgagaaagaagacaattgtttggaatcatcattgatagaccactgatgagataatggctaatccttaagctaataaatctgtagccggtacaacacctgtttaatttaatttagtgcaagattagtatgctaatttgttgtccca

SEQ ID NO: 22297 - DNA, 1636 bp, Zea mays
gctaaggctacctctgttgaaggagatgacaaggctgaagaaagctctgttcatacacacgaggcaaatgacaactcaagctccgagattcttttcaatccgaatgtgtttacagagaaatcgctgctgacgaagagttggtaaaaagggctggtacatatcttgtagatatagtgatcccaaagtttgttcaggatctttgttcccttgatatctcccctatggatggacagactttaacagatgcattgcatctccatgggataaatattaggtatctgggcaagattgcaggcatggtcaaacatttaccacacctatgggactcgttttctactgagataatagttagagctgcaaagcatgttatcaaggatatactgagacaaagtttggaccatgatattgcgccagctattgctcatttcttaaactgtttcgttgggaaagttttaggtgcttccacaaagagtagtcttagcaacgcacagtcaaaaactctgaagggtcacgaaaatagccaaactcaaaagtctactaaaggccctaaactgagccatgctgccgcttcaagaaaaagcttatcaacttattctcatctaacctctgatggaatttggtttagcattaaggaatttgcaaaatcaaaatatcagtttgaagtgccagatgaagctaggctttcagccaaaagggtagctgttctccgcaacctatgccgaaaggtaggaataacaattgctgcacgaaaatacgatatggatgcttcaagtccatttgaggcctcggatgtgttaaatctccaaccagttgtcaagcattctgttccaacctgtacagatgcaaagaatcttatggaagcagggaaagtcaggatggctgagggaacattgaatgaggcatatgcattgttttctgaagccttttcactgcttcaacagattactggtcccatgcacaaggatgctgcaaattgttgccggtaccttgctatggttttgtaccatgctggtgatacagccggtgcaattgtgcagcagcatagggaactcatcataaacgagagatgtcttggtcttgatcatccggacacagcccacagttatggtaacatggccttgttctatcatgggctcaatcaaactgaattggcactgcggcacatgtcccgtacactgctgctgctaagtttggcgtcaggacctgatcatccagatgttgcagcaactctcataaatgttgcaatgatgtaccaggatgccagtaatatgaatactgctcttaggtatcttcaagaagcccttatgaagaatgaacgacttcttggccctgaccatgttcaaacagccgtatgctatcatgctcttgccattgcattcagttgtatgagcttatataagctttcaattcagcatgaaaagaagacctatgatatactggtaaaacaattaggggaaaatgactcacggactaaagattcagaaaattggttgaatacatttaagcttcgagaagaacaggtcaacgcccagaagcagaaggaccagggagctaatgcatctgataacgctgttaaattcttgaaggcaaaccctgcatttttacaagccaatgaagccgcctgcgctccaatcag

SEQ ID NO: 22298 - DNA, 2154 bp, Zea mays
tgaaataatagttagatctgcaaagcatgttatcaaggatatactgaggcaaagtttggatcatgatattgggccagctattgctcatttcttgaactgtttcatggggaaagttttaggtgcttctacagagggtagtctaagtgacatgcagtcaaagactctgaagggccatgaaaatagccaaactcaaaagtctactaaaggccataaactgagcaatgctgctgcttcaagaaaaagcttgtcagcttattctcatctaacctctgatggaatttggtttagcattacggcgggtgcgcattccaaatatcagtttgaagtgccagatgatgcaaggctttcagccaaaagggtagctgttctccgaaatctttgccaaaaggtaggaataacaattgctgcacgtaaatatgatcttgatgcttcaactccatttgaagcctcagatattttaaatctccaaccagtcgtcaagcattctgttccaacctgtacggaagcaaaaaatcttatggaagcagggaaagtcaggatggctgagggaacattgaatgaggcatatgcattgttttctgaagccttttcactgcttcaacagataactggtcccatgcacaaggatgctgcaaattgttgccggtaccttgctatggttttgtaccatgctggtgatacagctggggcagttgtgcagcaacatagggaactcatcataaacgagagatgtcttggtcttgatcatccagacacagcccacagttatggtaacatggccttattctatcatgggctcaatcaaactgagctggcactgcggcacatgtctcgcacactgctgctgctaagtttggcgtcaggacctgatcacccggatgttgcagcaactcttataaatgttgcaatgatgtaccaggatgccagtaatatgaataccgctctcaggtatcttcaagaagcccttatgaagaatgagcgacttcttgggcctgtccatgttcaaacagctgtgtgctatcatgctctagccattgcatttagttgtatgagcttatataagctttcaattcagcatgaaaagaagacatatgatatactggtaaaacaattaggggaaaatgactcacggactgaagactcaaaaaattggttgaatacatttaagcttcgagaagagcaggtcaacgcccagaagcagaagggccaggaagctaatgcatccgataacgctgttaaattcttgaaggcaaaccctgcagttttacaagcaatgaaggctgctgcgatccaatcaggtggtgtgtcagcaaatgtcaacaggtcgctcaatgctgcagtcgttggagaaggtgtaccacgactgagaggagtggatgagcgagctgctcgagcgactgcagaagcacggaagaaagctgctgcaagaggccttaatgtccgtaatggccctgtggcaaaccatgcgtctgatgaactagctcagattctcaaactcatcaacgctgtttcggggtcttccactcctggctctgcaaagactgaggtatctgcctctgaagggcaggcaacgaatggatgtattcaaaatggaactgacactgaaccgaaggctgcggataccaacgggctatctgcatcggttaagtccactgtcaacgcaccatttggattggggacaacattggagtcgaagaagcagaaatcgaagcaaaagtcgtagaaaacctgtgcttggaatttcctttagcaacagttttggactgtagagtgatttgggtttttgacctttataggattgccacgttcacgtggtggaagagttcatttgtttttgttggaggttttttaggaggtctcaataatcattacaagaaagaagacaattgtttcgaatcatcattgatagaccactgatgagatattggctaatccttaagttaataaatcttcagtcgatacaatacctgtaaaaaaaaaccggccgcggcctccctttgtttgtcgtacggcatatgctggtataccgttaatgtagttcttgatcatcgttctttttctagaaggtatacccgtacaatgttgccaactattttattattgctatcgataattattgaactaggctgagcgctgttgcttggcctggccgtg

SEQ ID NO: 22299 - DNA, 3686 bp, Zea mays
  misc_feature (20)..(30): n is a, c, g, or t
cacatagtccgcactccgcnnnnnnnnnnnaattcggcacgaggagaacctctacgcaccgggtatcgaacgcatctacgatggagggcgacgacttcacgccggagggcggcaagctccccgagttcaagctagatgcgagacaagcgcagggtttcatctccttcttcaagaagctgccgcaggatccccgggccgttcgtctcttcgatcgcagggattattacactgcccatggcgagaatgctacgtttatcgcaaggacatactaccacacaatgtctgccttacgtcaactaggtagcagctctgatggaatcttaagtgccagcgtgagcaaggctatgtttgagaccattgcccgcaacattttgttggaaaggactgactgtacattggaactctatgagggaagtgggtcaaattggaggttaacaaagtccggaacacctggaaatattggtagttttgaagacattctgtttgcaaacaatgacatggaagattcaccagtgattgttgctttgtttccagcgtgccgggaaagtcagctgtatgtagggcttagttttttggatatgaccaataggaagcttgggttggctgagtttcccgaagatagccgattcactaatgttgaatcagctcttgttgcattaggttgcaaggagtgtcttctcccagcagattgtgaaaaatccattgacctaaatccccttcaagacgtcattagtaactgtaatgttctgttgactgagaaaaagaaggctgacttcaaatccagggatctcgcacaagatcttggtagaataatcaggggttctgttgagcctgtacgtgatctactatctcagtttgactatgctcttggtccccttggagctcttttatcttatgccgagttgctagcagatgacactaactatggaaattacacaattgagaagtacaatttgaactgctacatgcgacttgattctgctgcagttcgagcattaaacattgcagaagggaaaactgatgtaaacaagaacttcagtttgtttggtttgatgaacagaacttgtactgttgggatgggaaaaagattgctgaacagatggctgaaacaacctctattagatgttaatgaaattaataaccgactagacatggttcaggcttttgtagaagacccagaacttcgtcagggactccggcaacaacttaaaaggatatcagatattgatcgtctaacacatagtctccgaaagaaatcagctaatctgcagcctgttgttaagctttatcagtcctgtagcagaatcccatacatcaagggcattcttcagcaatataatggccaattttcaacattgataaggtcaaagtttcttgaaccgttagaagaatggatggcaaagaatcgatttggtcggttttcttctcttgttgagacagctattgatcttgctcagctggagaatggagagtacagaatatctcctctatattcttctgacttgggtgtactaaaggatgagctttctgtggttgaaaaccacataaacaatctgcacgtggatacagctagtgatctggatctttctgttgataagcaactgaagctagaaaaaggatcccttggacatgtgttcagaatgtcaaagaaagaggaacagaaagtcaggaagaaactcactggcagctacttaatcatagaaactcgtaaagatggtgtaaagttcacaaattctaagctgaaaaatctaagtgatcaataccaggcattgtttggtgagtacacaagttgtcagaaaaaggtggttggtgatgtagtgagggtttcaggcacattctcagaggtatttgaaaattttgctgcagttctgtcggagttggatgttttacaaagttttgctgatttggcaactagttgcccagttccttatgttaggccagacatcactgcgtcggatgaaggagatattgttctactgggtagcagacatccttgtctagaggcacaagatggtgttaactttatacccaatgattgcactctggtgagagggaaaagttggtttcagatcatcactggaccaaacatgggaggaaaatccacatttataagacaggttggtgtaaatgtattgatggcacaagttggttcctttgtaccttgtgatcaagcaagcattagtgtgagggattgtatttttgctcgtgttggcgctggtgattgccaacttcatggtgtatcaacttttatgcaagaaatgcttgaaacagcatccatcctaaaaggcgcctctgataagtctcttataattattgatgagctggggcgtggaacttccacatatgatggatttggtcttgcatgggctatctgtgagcatcttatggaagtgactcgagcgcctaccttgtttgcaacccatttccatgaactaactgcattagcacatagaaatgatgatgagcaccaacacatttcagacatcggagttgcaaattatcacgtgggtgctcacatagacccattaagtaggaagttaactatgctttacaaggttgaacctggtgcatgcgaccaaagttttggtattcatgttgcagaatttgctaattttccagaagctgttgttgcccttgcgaaaagcaaagcagcagagttagaagacttttctactacacctaccttttccgatgatttgaaagacgaggttggatcaaagcgcaagagggtatttagcccagatgacatcaccagaggagctgcacgggctcggcttttccttgaggaattcgccgcattgcctatggatgagatggatgggagcaagatcttggagatggccaccaagatgaaagctgacttgcagaaagatgcagctgacaatccttggctccagcagttcttctgaagctaattaatccccgcgtgtatggaggcaagaccatgagagaacctcgctgatgctaggatctcctgatccattttgttaatacgcatcagcagatgtactctagtctttaggcttagccgacagtgcaacagggaaaaccatgtgcatatttaacgcggcggtagtgctgctactcctgcataccgttcgggtgcagctactctgctctgccgttctgccccgtctgtgattgcacgccgtcctttacagccgtgaagtctgctgtgccagtctcgtcgaagcttgaagtttctgcacgtctattggctattgctgtgctgcttgtctagcaaaattctttcagtgcaagtagggattgatagtttgtagagattgttgggattttgtcgaggatggcctcacaacgacctttaatcagcttttcaacccagccatacttaccttctaaacaaattaataaaaagaagcaaacttagtgacaaaggtttccttatcaagtcttagtttgggagcaagaagattgaagcggattagatgggctaaaatttatttaattttgaataacaagaagattttaatctctctaatccttttcatttcccttcacaaacaagccctcagtgataaaagaagccttctctaaatatagagagactgctttcaatcatccttattcctaaaaaaggctgatgcgattgggagtttctgttttcctaatgcatagtgtcagtgaataaaagttggttgacttatcttgataacgctgttcagggg

SEQ ID NO: 22300 - DNA, 1096 bp, Zea mays
cactcctatgggcgattgggaccctcgaggccgcccggccgcccgctctcacacacacagtcacacacacaccgtcctccctccttggtccttggctccccttgctaccttgccttcacagatctcccgctccccaacagaactgtcacgtctcggcgcccgggggccgtggtattacggctcatcgcggctcggcggtggtggcgcgcagctgaccggatcgagcagcggatggacggcggcggcgggctgggcggcctgcggtggaccgcggaagaggcgtcgacgatcggaggcatcgccacggtgtcgctgctgcactccttcatccccacgcactggctccccttctccatcgtcgcgcgcgcgcagcgctggccgctctcccgcacccttctcgtcactgcatttggaggtgttcttcatgttgtttctacggctcttcttgggataactgcagttactatggcaaatactatagctggcgaagaaacagtgcataaacttgcctcgctgttgctgatttttcttggagcaagttatatcctcttgtttgccttaggaaaaggtggtcatagccatgcccataatcatccaatggaaaaaatggcagtcgccggtcttgtacttgtacctgcattatcaccttgtgcaacaactcttccagtttttcttgctgttggcaactcttcctcaatgatgattcttgcaatcattgtgctcctcttcagcaccatcacagtgatgacatccttggtggccctttcattctacggtgctagccagatcaagttccactgggtggagcgttacgacaagatcctcgtcggcacggtgctgtgccttgttggagtcttaacatatgtgttccatcatcacgatggtgatgagcatgtgcaccagaaactcgtatctccctagatgcatacatactgaagttccatctctgttgctccctattttgtatacaatcctgattatcgacttactctgccgctctggttttgctggagatacgtatcatctgatcaagtgaatatatttgagcaaactgcgtgaagtttgaaaaaaaaaagcgccctaaaaaaaaaaaaaa

SEQ ID NO: 22301 - DNA, 3961 bp, Zea mays
gataatctttgagagaagtctataaagaacaaatatagaggaggaatatgtgaggacaccactaaagatagtttgatagactcaggtaaggagtgccatgaagttgttcatcagtgtctttggccttctctttgtttattattggtggatggttcatcacaaccacacagagattgattcttaaggcatttgttgatgacattgatcttctcatctgtcactgatagagggctaggggaaagtggaaccaccactgaaaatgctcgtgtaagtgtaaccatcttcctttctactagtggttgaaaagaaggtaactcgaacaaattaacagtctgtttggttaatggaataaccctgttcggaaccaagtgatccagcatggactcactccttgtaggttcggatgggaggaatgagttggtccgcctgttttgcgaggaatgagtagcttctagattttagttttagatcggaatgaggggatgacggatgagatgaatctgtgatggtaaccaaacactattttaggctcggatgtaggttcggatgactccggaccattcgatgcctctaaccaaacacactgtaaacttatcaggatcatcaacccaccgaaagaaaaggcacccctatggtcctaaataagttgatgtcactaacttatcagtaagtaaattacacatatcaagcaacaatgaaatataatatttacaaataattagtgggtgtttgatttctagggactaatttttagtccctacattttattccattttaattctaaaattgccaaatttagaaattagaactctattttagtttctatatttgacaacttatagactaaaatggaataaaatgaagggactaaacattagtccctataaaccaaacaccccttacttatattaaaataaccatgtggatagtagcaacgagcaactatgtttacatgcctgaatgaaaacacgcggattgcttaccataatcattgttagccacctatagcttaggagggatacacacgtccttacaagacgtgtccgagaataaatctctggatcaactttattttcgctacttcttttctcgccatgtaccatgtatctatcaaaatagagggttgtaagaaaataagtctctttgctttataccataatctaatcatttcacattaatataaacaaactaactaaactaaactaaacctaaagtataaacactataaataagaataattaaacttaaatatgacaaataatattataacctcgtaaaagacatgcactaatatgtacacgtataaaccaaggacagaaactaaacacacctttataaatgttatgatctatctaagcattttgtttatacatcaaaatttaaattaattcaaccgatatctatctagaaaactatagttacaaaatacacttacatagaccaaattaatgcatataaattaaagaggcgaaggatgcctcactctcgaatatctacagattaaatccaaccttcaaaggttgaatcaacatattggagaagttaaaggagatggggagagtgatagattaaaaaataaataggatatgcccagccttgtcctataattttgaagacccccatacgaacttattgtgatagatcttctacattgtataattttttataatatataaataatatgtgttaattttacttgtaaaaatataaacaaatatattgatatatattcaatttaatatgtctgataattattttgaaaaaagtttggttaattggtatcaattttacttgcatggcctagggccggccctgcatatgccttggccagaaaacaaccgatgtcgtttaaattagagtttgacgtcaagatcttgaggctgacttcaacgcacaccatttgtgacgtaataccctggattatgatgtatagctctaagccgtgtaatgtttggttaattggttccctgactagttcgtatcatattaatatttgaatatcaattataaatattgaaaaatgttaaaatttaaaaaatctgcgcaaatctatagggatgaatacggcatacggcggaacgggacgccggcctgcgcagttggggccggaccgctttcgcacgccaactcgcctcgctttcttccccgttcccacctctctctctatctctctctcacacacacagtcacacacacaccgtcctccctccttggtccttggctccccttgctaccttgccttcacagatctcccgctccccaacagaactgtcacgtctcgacgcccgggggccgtggtattacggctcgtcgcggctcggcggtggtggcgcgcagctgaccggatcgagcagcggatggacggcggcggcgggctgggcggcctgcggtggaccgcggaagaggcgtcgacgatcggaggcatcgccacggtgtcgctgctgcactccttcatccccacgcactggctccccttctccatcgtcgcgcgcgcgcagcgctggccgctctcccgcacccttctcgtcagtcagtacccacctcccttccgcgtgcctcgttccccccatttgctgcggttgccgctcgttactgttcaccgcctcggcgcctccagatctggttatctcctaattctaagaggttgggtgaaggctagctcccaattgatggtgcaagagtgtgccattagggttttactctggttgggctgctctcggtggttggttcccttggatggatccggttttgcatggtgtcattaacaaacgatggcagtttttgtgtcatggtagtgtggtggtgcctggctgctgcctattgcgtgtagcatatgctgagtattgcctgaacatctgaatgagattgcatgggcatcatgttcagatgcgcatgctcctatgatctgattttctgtgtgggatggattcgtaagactgcatttgtgcttctgttaccttcctttctcggtggaatgttgttccatggttcagggaacgcaaatttctaggggaagtgtgtccttgtcttcttccgacttctgctgctttcatgtgtacatccgtctgcggtgactgtgacaaatggctattgttgtagtgttttttagtaatgcaagtgatgtaatgtgttctatcaacgagccaagtttgggcaaacaagttatcaaagctttgtttagttaaaccagttgccagcaaatgcctataagttggttgtgatctaatctggcaatgaaataattgcatcatatttgtcatgatctcttaagaattaatgatgacttaaacaaaaaagttatgattcttgcactacatctattttttatctcatcctggttccactgttttggtgcaccctgtttgcttcatcctgggcagtatacactccaagaacctgcaatttcatattttccaattttttaaattttcaaatgatgcccttctctctatatgattgttactgagaaaagattactaacttctgcagctgcatttggaggtgttcttcatgttgtttctacggctcttcttgggataactgcagttactatggcaaatactatagctggcgaagaaacagtgcataaactgccctcgctgttgctgatctatctaggagcaagttatatcctcttgtttgccttaagaaaaggtggtcatagccatgcccataatcatccaatggaaaaaatggcagtcgccgatcttgtacttgtacctgcattatcaccttgtgcaacaactattccagattgtcttgctgaaggcaactcttcctcaacgatgattcttgcaatcattgtgctcctcttcagcaccatcacagtgtatgacattccattggtgagccactttcaaaattctacaggtgctagccaatatcaagttccactgggtggagcgttactacaagatcctcgttggcacggagctatgcctagatggagtcttaacatatg

SEQ ID NO: 22302 - DNA, 2935 bp, Zea mays
acagacaatcgacagactacagacaccgtcctcccttcttggtccttggctccccttgctgccttgccttcagcccttcacagatctcccgctccccaacagaactgtcacgtctcggcgcccgggggccgtggtattacggctcatcgcggctcggcggtggtggcgcgcagctgaccggatcgagcagcggatggacggcggcggcgggctgggcggcctgcggtggaccgcggaagaggcgtcgacgatcggaggcatcgccacggtgtcgctgctgcactccttcatccccacgcactggctccccttctccatcgtcgcgcgcgcgcagcgctggccgctctcccgcacccttctcgtcactgcatttggaggtgttcttcatgttgtttctacggctcttcttgggataactgctgttactatggcaaatactatagctggcgaagaaacagtgcataaacttgcctcgctgttgctgatttttcttggagcaagttatatcctcttgtttgccttaggaaaaggtggtcatagccatgcccataatcatccaatggaaaaaatggcagtcgccggtcttgtgcttgtacctgcattatcaccttgtgcaacaactcttccagtttttcttgctgctggcaactcttcctcaatgatgattcttgcgatcattgtgctcctcttcaggtcttcaccctctttcactccactgtttttttattgtatttgttggtactaccaattcaaattgcattatcacgtcctttctgttattgggtttgttaactcactaaagttgaaaaagggatttaattatagcaagatgtttttatctctatcttaattaatgaagcaaaaagtagcattgctgacccatgatcatcaggattacctatatcctccttgcctcttagaaggtttagcctcaggatttcctctgttaggacctatgagcactttgtgttaccttagtagatacttggagcacatcgagacaaaaaggaacaaactcaagcagaacactataccgatgcatttgctgagtatgaactcataatcttgtttctttcagtctgcaagatcttcctcttgagacattttcttgccctgtcagtcatcattttgttatagcacacatgtacattaggagtcaaatgactgaaggaaccaacctagattctagagtatgacaggatcactagttattgtcatgtagtcacgttaaaatgagctgcagctttattagagcagcgctcattttttttaatatctgcgactaattcacacttttgttcaaccatggttcgtaagggcaagtattgttagctgccattcatgtccttcattttttttctaggtgttttattttaaatgtgatagttgtatcaagttcgaaaaagatgcttcttacagctattcttcttttcgattcatcagttccgtttcttcctgcagcaccatcacagtgatgacatccttcggggccctttcattctacggtgctagcctgatcaagttccactgggtggagcgttacgacaagatcctcgtcggcacggtgctgtgccttgttggagtcttaacatatgtgttccatcatcacgatggtgatgagcatgtgcaccagaaactcgtatctccctagatgcatacatactgaagttccatctctgttgctccctattttgtatacaatcctgattatcgacttactctgccgctctggttttgctggagatacgtatcatctgatcaagtgaatatatttgagcaaactgcgtgaagtttgtatcgttgtggtggtagtggcctctttttcggcactctgaaatggtaccttcctacttttggacgcaataaattgttttctgaaatttcctttccttggttcttttttcctttcaatccattttatttaggaaaaaaactgtttatgctgggtgtaaaagtaaaacccaattgaccgcaaattgtgtttgaaaaaaaaaaactgttggcagaagatgagagcttaggttcagtggggtttttcgcaaattcggcccagtatactgcaaatagccgagccgggcctggggaaaacgcgcggcaggcagagcggccacgacgccgcccgtcgccgccgatccctttcgaccgctcgggtctccctgctccttcgcctttcctcctgaaatccagcgaccgaatccgatcgccttggcgcaggcgttcgatgggcaaccactaccagacgctgggtgtccggcaggacgccaccaaggctgaggtcaaggctgccttccgtcgcagcgcgctacgcgaccaccctgaccgccacgccggctccaccgacgcggccgcccgtgccgacgccgccagccggtttcgccaggcgtccgacgcgtactacgtcctctccgacgacagacgccgcgccgagtacgacctccgtcttcgcggttccacgtcttcctacgcgcgcacctcctcctctggttgggcctcctcgtcggcttcctacgggtacggccatggcggcggttcgtggcgacggactcctccgggtgcaggtgccggcgccggcgcctcggtggggtcaattgattgggaattcttactgaaggcggtcactcggcgagggttccttatcaatctgggattagccaggtaagccaaacaggcgtcggaatcggaagtttttcatcgttcataatcgctatcattttcgccgtgcaaaaagtgggcttccgggaatgtccaatagttgttgttttggtgagtgccacctcggcttgtttacgaagcacacaagatgattgatcagttcctgatctagggatatcaaaatggagtcaaatatgcaaatatgccttacatggttgcagtccattgatgttccgtcaggccagtttctcataagaaaactatggttgttacaagttttagc

SEQ ID NO: 22303 - DNA, 2917 bp, Zea mays
ccagcgtccgggactgagcaccgtccacgaatattgttgtgcccgtcatgtaccgggactcgtcgccgacaaggtacagcaccgtcgacgccaggtccttctccggatccagccatctccgcaggggcatcacctccgccgttgccttctccgccttctccttgcccacggacacggggaacttgtcttgcagatgcaggccgcggcaggcggcgttaacccttatcttgtgtttcccaagctccatcgcacacagctgaaacacaagaagaacttattagcaatcaaaagacgaaacgccaatgaacgatacagagatagttaaccctgggaaagacagtctaatgtctgtgaaagcttttcctgaactgaccactcagaggccgccattccatcatcctctccaccataaattcagaaacacaatgggtgcagattgcggggaagaaggaaaaaggcatgtgtggcgtgcggaattgcagcagaaacttggtcatctaaggattcaggattgtttcagggttccagtgttcttaggccgtcatactgtctgaaaatacaggttgcacaaccaagacaccagcagttcactgcatgcattgttcacggagtggagtttgaatatgaggatgtgttggagatagcctaaggcattaccacgtcagtgtgacctggcgattggtttgacaagtcatgtacttaggttggtactttggtcagttgctccaaacttaaaacaagtcgaagtagatatcaagcgtttccaccactgaagatgctgtgttcgtgtgtgtgcatgtgtgtcatatacaggagtgccgaaaaaccattgatttatgatctagcaattggcttatagataacctctacatctttcattgcgaacaaatttataggtgcagaaagccattcatgtatgattgctgtatttatccaatctttgttgttcatttcaatgcgcaatttagcattgcaacatgaccattttttttgaggatcttatctccacagcatctgtcagcagaaccatacagaaagggtacacgtccaagcagtagacaagggtgggtacttacacggaccaactggtggatggctcccaagcttgtgccatatgctgcagcgcctggatacaatcctctctcagcaccaataatctgagtcaagaacacaatagatccaccagattgtgtatcctggaaccgctttgcgatcgccttcattagaaaccaaggtgttatcacatttactttgatggtcttcctgtactcgtcttcacttatactgaggcaatcttgcacctcccctggccacacagtaaaggaacatttatttatttatttatatgtgtcaaacatgatacaaggtgcaaattcagttcatccaacgctgtgtttcgccgcctttgctgccaaatacggctaatatgcattactatttgtttgccttcttttctcaagtgaaagggcgctctttgctaagaggggaaggtattagcagttcgatcacaggcatccagtcgttcacaattttcactccgacgtgagcattgagcaacaggctcacctgctaaggcgaacaagaaggaactgtatctgtatgcgaatccttcgtaccctcgtatgagtagcagttgacgaaggcatccagtccggcgaagcagcgccaggcccgatccaccgccgcgtcggcagcagcctcaccgcacgccttgaagtccagcccgaccaattcgacgcatccgccccctaccccgcagcgccgcgcctcctcctccgtcgcggccagcgcgccctcgtcgcccaacaagaccaatcttcaacaggaatcagaaccgagccatgcgggggcaaagtgagcatgcgacgacgggcagtgggcgtagctacctgcagccgtgcttggtgagggtacatgcgatcccccgcgagacggtgtcgccagctgcggtgagtagcacccgcttcgcgtaggcgtctcccatcgcctgattccagcggcggaggcgtctctctccagcagtacagtacagtacagtgcagcacgtggtttggagtggagctgcgggcaaggatcatgcacctgcatacaggcatcgagttaggccgcctcactgagctgggcctgcgtcctgtgggctggccctcccttctcgaccggcggaacaaacgggcccaattagaagaggttccaaacatacgtcttcaattcagagaagaggctccaaaacatacgacggaacaggcaggaaggctgacctgaccctccacaggtcacccgataatcctaatgctgacaaccatcatcacgttatggagatgacatttcaaaaagaccaaaaccaatgacctcatgatccatctgcaactctttgaactttgttacaatgcatgtatcaatgcctcagcatattatcaccttccttgcacctttcttgcagctgcccagttagtagctaataaaagacaagagagagagagaaatatatagctgagacaacgaaaccattgggccttaatgtaactgacatagaaacaccagttgcctaataatctataataagtagataaaagtatctttccaactatgattcccttctttatttcagatatatggccacttctctcgattattcctccaattttcgacaagaaataattctctgcacgctgacctcaatagccctttttacaacaatggattctgttcatcaattgatttctggcaagatggggacagtcaaaacaaaagaagctgtcaagaaaagattcaaagtgtgtcgatgtgcccccaaatgagtatcggatggtacattgactagtattttttctttatgcacatatggtatctgctcttgcgcacactattctaaaagaacatgtaggctgtagttgccacccagccgacgagcttctgc

SEQ ID NO: 22304 - DNA, 1103 bp, Zea mays
  misc_feature (67)..(67): n is a, c, g, or t
  misc_feature (70)..(70): n is a, c, g, or t
  misc_feature (86)..(86): n is a, c, g, or t
ttttttttttttttttaccatacactattttttatataaatttagggggtatcaatttaaggactanaancacatttttgaagttnagggacagccgatgcatttaaccctaggctaggcctaggctacatgaaggatcgcaagcgcggccgcacgatggactgagcaccgtccacgaatattgttgtgcccgtcatgtaccgggactcgtcgccgacaaggtacagcaccgtcgacgccaggtccttctccggatccagccatctccgcaggggcatcacctccgccgttgccttctccgccttctccttgcccacggacacggggaacttgtcttgcagatgcaggccgcggcaggcggcgttaacccttatcttgtgtttcccaagctccatcgcacacagacggaccaactggtggatggctcccaagcttgtgccatatgctgcagcgcctggatacaatcctctctcagcaccaataatctgagtcaagaacacaatagatccaccagattttgtatcctggaaccgctttgcgatcgccttcattagaaaccaaggtgttatcacatttactttgatggtcttcatgtactcgtcttcacttatactgaggcaatcttgcacctccccctcgtaggagtagcagttgacgaaggcatccagtccggcgaagcagcgccaggcccgatccaccgccgcgtcggcagcagcctcaccgcacgccttgaagtccagcccgaccaattcgacgcatccgccccctaccccgcaacgccgcgcctcctcctccgtcgcggccagcgcgccctcgtcgcccaacaagaccaatctgcagccgtgcttggtgagggtagaggcgatcccccgcgagacggtgtcgccagctgcggtgagtagcacccgcttcgcgtaggcgtccgcgtctcccatcgcctgattccagcggcggaggcggcccgccccggccagcagtacagtacagtacagtgcagcacgtggtttggagtggagctgcgggcaaggatcatgcacctgcataccggcatcgagttaggccgcctcactgagctgggcctgcgtcctgtgggctggccctcc

SEQ ID NO: 22305 - DNA, 863 bp, Zea mays
gttggtgatatattattataaatagtgatacaacagccatagagagaaaatggagtacttgactatttggatagaaacatgagtcgcgccgacaaaaaagtggtaaactttagatgatcttagttattaaccttacattgttggcttaacaacgaaagaaatttttacaaactaaaggtattgcccgtaaaaataaaatgaccaaacaatatatataggatacaaattatagaagaatgcagatcaaattgcagcttccatacattacaaatgattatatattaaaatataagatatggcgctcacgtgacgtggaatagactccagcttacaacaacgagaaggaaaagaacaacatgaaaacggtggatgcaacattaagggagttgagagcatcagcaaacatgcacgccgtagtagagccacatttctagacaagggtggtatcagttcgccccagcttcgtcccccttttgcacaatgggttcctcgtcacctctcgatcggacctcaacgggctgctgcacggtgcgtgactgtaacttggtggactcctctggcggcgtatccttggcgacgccgctgctggtccagccggtgatgttgtcgatgacgccgaggaacttgtccctgagctgagcagcgaagctggccatgggagagcgagctgtatctatgtagttggtcacgccgaagaacttgtccctagctagtttgttttggcgtggctagcttgatagatgagcggtggtgaccggttgaaggtgatcgccgacgaacggccctatttgtagctaggcgtccatggcgcagactgatgctttaacttgattattgagcaatggccacgtgcccagtggact

SEQ ID NO: 22306 - DNA, 1801 bp, Zea mays
ggccgctttttttttttttcccccctcgagtttttttttttttttttttctaagcttaaaattttatcctgaataactgccccagtgagggagaagagaaaacacattttttgtacaaaattgagatggcacataagaaacgaagagttttacaaagtcgccgaaccaaaaggccacaagtgttgctattaatcttggggataattgataaaaggataaatattacagcatttcacttcaattagcctaatttggggctaaatccaatctgcatcactgccaagagtaacaggtcatcaaatgctagtgcaggagtgcagcaaaaccctccaatttggtgctttctactcagatttaacgcaccatggagaatgtgttgtgctgtattgtagctggaaacaacttaagcttattgtgcaattgttagctggaaacaaccagaagagcccacagattgctagttgcagagcagtgcaattgtgcagcaggctaacagtgatattggccaattaagcacccttataagcgatcctgtttcccataactgaagttacttccacagtatatcacccaaaaaattgagagccggaacacctctaatctccatgtccacaagaggtgcttggataatgttcaaaccttttaactctgggtcagtccgtatcatatccaatgcacgcgtttgatcctttctttttatagaacagaatttacagtccgatgttgaaggtggcagaacttggttcacaatgagtctccttacaggaacactttccttttgcaacgaagaatgcagtcttgatgactcactgattgccatcaccgttgggattgtcacgattataaactctgttgattccgtgtcgcggaaaagctctcttactttgaccatcctttctctgagttgctctaatttgttcgctgcatcctgctgttggacctcttgtccaaatactgatttaatagctgatgttgcagaagcaatcttactcctcagcttcaagattttcccaatggacgcatccaagaaatctggcaaggataataaccggagtgtatggcccgtaggggcagtgtcaaatacaatgcgactaaacatgctgtattcttgtgcttcaaggaattgcataaccttagaaattgcaattgcttcatccaagccaggtggtggtgtgtccaacaattcccccaattttaactctccaagctgctcaacaagcaccccaaggcccatgctatccatgaaatcttttactcctgttcctccatttttttgacttactgtccgaaactcctcccgggccttttcaggatttatctcaagcgcaaacagaggtgaatcagggccctcgacctgcacgagcgtcccgccactcaaatcctgtgcgaaggaatcgctgagcgagtgcgcagggtcggtggagacgacgagggtcgggtggccgttgttggcgaaccgcacggccaacgacgccgcgcagctcgtcttcccgaccccacccttgcccccaagcatgtagtaccgtcgccgcgtcccggacgacatctccaggaaccccaggtcgtccgccccctccttcgcgggcggggcggtcaccgacgccgcgcgcaccgacgcgtaccggccgaagcatctgcgcgggaggcggatgctactgcagccctgattcacgggtacagccaggaagaggcggcgcgcggccgcctgaaggtgcggcgaggcggtcgcgagcatcgtgacgagctgggatgaggcggattgcttggttttctcctctctttgtacccccggcccggccgg

SEQ ID NO: 22307 - DNA, 1419 bp, Zea mays
ggccgcttttttttttttttttttcgtttgcaacatacaattccatccatttcccaaggagaaaaaaggatgcatcgtctgtgtcgtcaggtactcaggtcgtcagctagctgtccctgataaaatgtggcatgaacaacacgtttgtgacagagcagcagtgtagctggcaactggcatgtacatactcgtacaacagagcattggtttcacatcaaaaagaagaagaagaaaccttcctaaataaccgaatggtattacaagtacaatatacaccggcgaatacatctacagcctaaaagaacctctccatgacttcagaatccgacaagagttctttcaacccgataaatttgctgtactgcaaggtgatccagccaacagcggatacataggcgacaagaaggcaggcacgcttcaaccggctggcaaatactctgatgcaatgcttcctcacagcccacctggcggcagcgagcaacaacccatacatacctctgaataaggccgtaatgaacatcgaactcagcatgcccagcacaacacctgctgccacatatacaagcattcgccctgaactgaaatcttctgacacatacatctctgaaaacagtataagtatccttttgaaaagctccccagtcgaaggttcctcagcagtacaattgaatagcttgttcgagtgaatatcagccttgttactacctagcatatatctgcagctgtacgattcattgaccttgaactttaatgttgttgaccaagcagcaccaaaatcaggtcgacaattatgaggaagagcctctttcggggcctcggccactgcataagataattggccagaaaaatattctgtatattcaacctgtaaaactgaagcccagtagtagtcatcatggcagcggaatctcctcttactcgatgggtagaagacatgcttagctctatagttcaataacccaagctcgcaaacttttgatgacctaaggtcaacgccactggagaggatgcggcaggtggagggcatggagaccgatgcggtggacgagaggccaccaagcgcgagcccagcgagcccaacgaggaaggagaagaggaacgataccgcgatggggaaggccaccccgagggcgccacggagtgcagaccttggtcgctgccggttctggtccgatggctgtgccccatcgcccgcagggggggccggggaaggagctgtcggatccatcacgtggatgggtgatccatcgctcggatgccggcgatcgccggacgccggcgaggggagggtcaattgagcgcagcggctgtgaacccgtcgtttccttggactttgcaagactattttgggccgtgtgtccccgcgcccggccccgtaccccgtcttgtagcacgacagcaggacgaacacatatttgc

SEQ ID NO: 22308 - DNA, 4525 bp, Zea mays
  misc_feature (845)..(845): n is a, c, g, or t
agatatttagggctcagcataatgcaacatatcatgactcacctaggttttgatatagtaaagaaataataatctccccacctagtagacacaattctaataaaaagaagagagagaagactagagagagaaataagaggtaacacctaaatttgatattcattagagaaaaaatttataccccaaatttaggatgttacagtggtggcccaaggggcagcggcggccacgcccagaggtgcgacagcggccttaggggacaacgacatcggcccagagaggcagatgtggtggcggcggccaagggtggtgacagctacatagatgacaaccgagaagtgatagtgattaccatgttagatgatgtaggaataatggatttatcgattgagagggaacacatgaagaggaggtgagacaaaaggaaatatcctaaatggtaaagatcatgattgatcctaactagtaatcctcttctcaaatctctctctatcaatctatatcatatcttgttatactgagacaacactatatatgtgttggtgtttggtaccaacggcacactacaaggtgtaccgtgtagtgcttttgggtgcgcggcgaggttgatcgtagctcgatggttcgtacggggctcaacggaacataatggattatacaggttcaggtcgctcgagtgcgtaataccctatgtcctatgagtttgtggatgtgtattgctcggtaactgggattacagagaattctggaggtggaaaatgattatgcaactgagggtctacttgttttcgtaggggctcctctttagccttattaccaaccaaagaggagttacaacgcacaanctagtacacaatctccgtccacccgcctctgctagtcgtgtcgagttcctccgatggtcagcgagtccttaggagatttgcacgtcatctgcatgcgcggaacacgacctaggagacttagcccacgcaaccgtcttcttcgctcgctctcagtcgcgcccgactaaagtcacttagggaggcatacgctcgacccgttagagccctttcatgcgtcccatagagaataatcaagctatggtgatccgaggatatctatctcccacaatatggcagtgagccgttagaggcctttcacgcgtcccatagagaataatcaagctatggtgatccgaggatatctatccccataatatggcagtgctttgggcgatatatcctgtatattgggtccatatatcctgtataattggtcttctaacattaactagtatagagggaagatggtcatagcaagaaaaatgcacagaatcgtaaccaagggatggttttttacttcttagttcttaccagtgccattgaaaagttgaacatttatgactttgaagttttccaacaaatgaattggaggttggatgtcccgttaatgttcttgcgcaaggttttgttcagattctgccccgtatggtaatgtaaatatcgcgttataatcacccaaaaaatagaacagagaataaacgtgaaaatattctgtacactgaaggcgtggcatcagctatgaaactatctgtgttcaacacctcagtacatcgctaaaatacaggacaggcgcatgatttcccacacattaaacattcagagcgatcacctgaaccgggctatccttgtcaacaacaaacgatctagctaccttgcctgaaggcgtgttcacttccactgtgtacgaaccatggtatcctctgaacttaaactctccttggtgatcgacactgccgttcatacgggtcagccactcttgtttgagagcaaggtacctcctgccagcctcgttgattgtcccatcagcatcgaccagatgggcgtgctctcgaaacataaacatctcccagaatccccagaggatgattccccccacagcaggatgtgcaaatgcttcccggaggaacacctctagatcatcagctcgtatgtgctcgttctctgctgtgacatccaactcagtaatccagatcgggagacccagtatggcgagcttgtccagggaatcacatatgatttctcctaccggatggctgatatgaccttgcacaccgatcccaccaactggagcgcccctatcttggagatcaacgacctgctcaaccaatttctcgggggtagattttgtgtcacatccatcttcgacgttgtaatcattaacaaataggacagcagaaggatcaagcttatgtgcttctctgaacatgtaagctctaatgtcccttcccaatctgtcttcatagaaagacccatgtagcatctcattgtttacatcgtgatgtctaaatcgacctttgtaccttgacaataggctttgcaaacgattttggatggcagccattaagtggtgaccttgcaatgactgaacccaaggttggacagcgtcttccacttcccagaataaacagtggccacgaacctgtatcttatgtttctcacaaaactcaagcaactcatcagaatctttataattaagtctcccttgttctgcttctgtatggtaccatttcaattcattctcaaatacagcccaattgaagttcttcacaaaaaactcagcaagatcctcgttctcaatgttgtgtctcgcgatgcaagatccaaatggaaagctattctcggtctgttgtatcctcaaagatgaacctagaagattcactgcattcgatccttggaactttagaacaacatcacgctttctcaccttgtctgttttctccttcagatactcaaaccgtgcttttctgtcgacggcatatatttgaaagtccatgactctgagatcaacacctgcaggagggccttgaacatatgcagtaactttggatggctgcttttcaagtttgaatgctccttttatttcataccattgatccccatcagcatccacttgcccaccattgacccattggtttttatccacagcaagacagacatttacatggtgacgtccatgtcctccagaaccaactcgtacccaagcagatactctgtaagtgacatgcaatcttagcttatcagttatgacctgcgaaggacccatccaaacatctgtgcggttcgtggcaaggatataatgaccacttatatgtttctggcttgcacggtctttcaagatagaaggtaacatatggggtgcttcagtctggatactcaatcgacatgaacccataggactccacccagaaagcccacgagtgaagccattattgtgcaatagattagttccatacagaacattctcaatttttgggcatggtgcagcttggagctttcttgctggagataagacaagaccatctacaagaatgtcaattccagcaggaggcccttctatgaaaataacagctttggtaaagggagcatgaaggaggaactttcctttcaaatgtgtccattgctgatcagaagtctggtttttggccagtcccacatatcgctcacgaccatattcttgtacccacagagtagcacgcacttcagtatcattggcactcccaaatattcgaacagcagaactgatctcataaagaactttccgctgcaccctgcccgtgatctcttgctggatgccattccaattgtgaacccgtccagtcgccgaagcgaaatagctgccatttaaaggccggacattcccatatgcactgaactcatgtctgcagatattgcatcctcttcctgaccaattttttaacccatcttcgaagtgaggatttttaattatagtctcaactccacttggtacttttacttccttcaaaagtaatcatcaatcagcaaacccgaggccgtaagagttcatgcacattttttttatgccatgaagacaatgaatgaagaccccagaatcattaaccaagggtatatatgttaagaacaaagttaaatatgaagcacatggagatcaatacaaaagaaacttcacagtaaaatcatgtgcactgcattcctagtaactgatttcatagaacaaaaagaaaatagagcttacaatctattataaagaatttcgtcactccatgaaagatcaagcataaattaggttaagttctgattatttttaattagaattctgaaaaatataaaagcgcatgacaagatattgattaaaaaaggtcaagaaaatattataataagcacataagaactcacttttgactgtttatgtctggagcaagcaacagtgacagaatcaatgacaagatccacaccagcaggaggtccttccaggtaaaatacaacattttttggcatgtttgttaaagaaaaggaaccttccaatttgttccacttttcttttgaggcaaccacactgttacatcaaattctatcgtcaatcaaggatagtgtcaaaagaatatgactgttgaacagttttaagtacaataccttccaacagggttataatgtgttgatccatctgcattttgcaacctaagggttgctttgacttcaacctggccttgaacaatcccatc

SEQ ID NO: 22309 - DNA, 897 bp, Zea mays
accgttaaatcttctttgtttatgtttaaccataatcagtttttttttttttttttgataccaacttactcaaacttattattgttgtcacacgagtgttaattattatcatttacattacattttgtgaaaccaaacggcacccgaggttcgttaggtacatactccttagcaaggtaaccgactcccaacttggggctcctactgttcaccagcgatataggaatccagcatcggtttcagcttggtactgtcacaatcctgttctgcagcacagatgagaggattcccggctatgttgagcgttcttgcagacgtttttggtatcgggccactcaagttattgtacgacaagtctatgtactggagtcttccgagtcggcctaaagaatttgggactgtgccatgtaatttgttactggacagaaccagcgtcctgagctttgctaacttgccgatctctgctgggattggcccaattatgttgttgttctgcagctgaagcttctcaagttttgtcaggttccctatgctcggggagagccggccggaaaggttcttgcttggagcttccagtgcagtgacgagattctccggcgagcaggagatgaaggaccaggtacagggatcgacggagttcctgtcccagtttctcagcgcgccataggggtccttgaggaggctcttgatcaccataaggacttgcacttcatggttaaaatccatgggggcggcaaggccgctcgaagggaagaacagcaggagcaacactaggaagggagaagatggaggcgcctccatggctagaagcaggtgagtcgggactcgagagcgcgagcgcgaggaagtatgttcggctttcggtcgattaggatgttctaggtaatggtctcgtgc

SEQ ID NO: 22310 - DNA, 625 bp, Zea mays
tttttttttttttttttttctttttttttttttttttttttttttttaactgataacgttaaatcttttttgtttatgtttaaccataatcagattttacactaaaaactgataccaacttactcaaacttatttttgttgtcacacgagtgttaattattatcatttacattacattttgggaaaccaaacggcacccgaggttcgttaggtacatactccttagcaaggtaaccgactcccaacttggggctcctactgttcaccagcgatataggaatccagcatcggtttcagcttggtactgtcacaatcctgttctgcagcacaaatgaaaggattcccggctatgttgagcgttcttgcaaacgtttttggtatcgggccactcaagttattgtacgacaagtctatgtactggagtcttccgagtcggcctaaaaaatttgggactgtgccatgtaatttgttactggacaaaaccagcgtcctgagctttgctaacttgccgatctctgctgggattggcccaattatgttgttgttctgcagctgaagcttctcaagttttgtcaggttccctatgctcggggagagccggccggaaaggttcttgcttggagct

SEQ ID NO: 22311 - DNA, 3395 bp, Zea mays
  misc_feature (2549)..(2549): n is a, c, g, or t
tggtagtatatttggagaatttgagtgtaacactataaataaaaatctaacattgtctagagaaaaaaaattataaggtttcattcaaccacctctgatcgtcttgtttgtccttcctacatttccattgataatcctgaattctgatgtaatagaatagctgcagctgaaagtaacataccacgatgaataatgaatcgttcaaaaacagtatttgtatcaataggaatcgtttgttttttctttctcaagacaaagcatcgtgtaaagcaagaaaaagaaagaatccaattccagactcggctcgtcagtttgcaacatttgggtgggcaccgttcttttagcgtaacacatgactagaaaaatatgaggataagcagtgcacgacaggagacagatgctctcaatttcttacaataaatctctgtattacctatcgccaacaaggatgcgatcaaattcttaaaataaatcaccgccggtgtctcgagattaaccaatgcctttccgttgaacgtgttaagtcaggttttttttgttgagtcgagtttttttgagccaggcttaggctgggcttaggcggaacggcccaacaaagctcatattatttaatttctttaatttagtatgatataaatttaatatgatagtaatatttggattttatgtggtccaatgctgctcacattgtttaatatattaaatttagtaagatatgaactttatgtgattgtaatatttggtttttatacggtttaaatatatggatcgggcttacaccggtacagcctaacaaagtgacgacgtgctttagagccagaccagaccgaactaaaagctttttttttggtctttttgtcccaacctatttaacctaaagcacgataggcttaggccggcccgcctaattcccaacactaatcatgcatagtatatcataggggtattgagatccatgttagccctaccgggtttggataaacgccggaggggatcatcataggaccgaaaatcatggaagtcggtaaaatttcggacgaagtgttcaaacatctatgaaattttggttaaatatttttggaactgaatggaattcaccagagtttagcagtagaaccaaaaactgtccgaaattccataccctacctaattcggaacaagatcgtactggtgtaagtggatggtgggttctactgcttgtgcaccgaacgtcatatgcccgacatgaaaatgtgcctgtagggaagaacaaacacaagcactgatctgatttaccgaatcgaacggcaattgcaaaacgttacgcaagacggatgagtgggagaactgtgtaataatcaatatgcgatgcgcgaagagccagttcacaaaatactagccgtcaagagtagacaacagggctggctcctaaaaacttcgtaatacttattcgattacggcacctgccattttttttttttttgctggaacagcaacggcttattcaaactgggtgttgttgccagatagatcttaataataaggcgttgtttagttcacataattgtaaagtgatggataactgataacgttaaatcttctttgtttatgtttaaccataatcagattttacactaaaaactgataccaacttactcaaacttattattgttgtcacacgagtgttaattattatcatttacattacattttgtgaaaccaaacggcacccgaggttcgttaggtacatactccttagcaaggtaaccgactcccaacttggggctcctactgttcaccagcgatataggaatccagcatcggtttcagcttggtactgtcacaatcctgttctgcagcacagatgagaggattcccggctgtgctgcaggcagaaaaaaaaaaacaacagattttaagggatttcttccagaccattgattccctataaaaatgtcacacacgtccatgacgaaaacacaggaccggatccttacttgagcgttcttgcagacgtttttgatatcgggccactcaagttattgtacgacaagtctctgcaagagaggagtgcagtgtcagtgcaaaccaggctatggttttacccaggcaagaacatgaagcattaagaaattggcacgtgtgcctcacttacatgtactggagtcttccgagtcggcctaaagaatttgggactgtgccatgtaatttgttactggacagaaccagcgtcctgagctttgctaacttgccgatctctgctgggattggcccaattatgttgttgttctgcagctgactgggacaccaaaaaaacgaacaactcccaataaaaagaaagtaaaaaaaaaaaacactcaacgctaaggccttcctgcgtttttctcgtaaaaatgaactgatttctgtgaaattactgtataatttattaatttatctaaaaagttctgtattccaaaataagcctaagacttgttgtacccatggaacagtactcacagcttctcaagttttgtcaggttccctatgctcggggagagccggccggaaaggttcttgcttggagcttnccctgccagatattcaaccataggaacatcagagctatatatatatggtgggtttgatttgaggctaggaataattggagagctggggtctagctcacagtgcagtgacgagattctccggcgagcaggagatgaaggaccaggtacagggatcgacggagttcctgtcccagtttctcagcgcgccataggggtccttgaggaggctcttgatcaccataaggacttgcactgccagtaccacaggaatcaacacctagcagtgcaagaaactagcagagacatacaccgctaaaacaagatatgagtccgtcgaaaccacggcaaaggagaacgaaccttcatggttaaaatccatgggggcggcaaggccgctcgaagggaagaacagcaggagcaacactaggaagggagaagatggaggcgcctccatggcgtgaagcaggggggtccgggctcgagagcgcgagcgcgaggaagtgtgttcggctttgggggagaaagcatggacagggttgcctctgcatttaatatggccatcagtgcagagaatgcagaaattctctctgactatgtttaactgttctgttgccaaaaagtacgtggacacacaacactcaacatacactacaccaccagcaaataagcacgcgtatgcgtgcacatcgaataaatgccgacaatttatggatgctctaattaaggagcgacagaacattgggcatatacgctttacacttgtgttgggagccttcgtcttctgaatgttttcaaaaacatgatttaacaatgtttaccaagtgtaatatacatacaggtatcttcagactcggaataaaactaaca

SEQ ID NO: 22312 - DNA, 2085 bp, Zea mays
taaattttttgacctgtacaatattagctatagtagggccgctttttgtctccgtttctgtactttaaaattatccttacaacaaccaaatattttgtgttgtatgtactcaattaggacaagtgtagccttgttgacctaatgagagccaggcatgcctgggcgcctcggaagcaaaccaaacgcgcccaaacaacaatgatgatgagaagaaaaaaaaacgatgaatgtcctgtcccatattagctatagtggaacaatattttgacacgcgcggtacgcaattccactatgggaggtttccgtacaccatcgtcagaaacctgcggcttcattttcctgtagcaaactgccgcagcaagctgcagggaacggcgtctgaaggccggaatatgcatagcgctgtatcagaagttatcttagcttcaggggttcccctgtgtgcctggctaacaaacaaagcgcagcagtgcagtgggtttatttcgactcgtcggcccacttcttcattctcatactagctaacttcgcctcttcgtgccaatcacatttggcagtgaggtatgccagtatgagcgtttgaacggcggtccctccaatcatcccggaccagattccccctactccgaagtgcagcggccaaccgagtacgatacccaagggaactccgatgaggtagtagctgccgacgttgacgtaggcgaccagtgcttgccatcctgaaccaacggccacccctgagaggacgggctgcacactgttgagcaggatggtgaatgcgagcagcacggacaggtggtgcacggcgtcgagcacgaccgcgctggacgtgaagagaagcgcgatcttgtcgtcgaagtagaggatgaggcaccagaagacgaggccgatcaccacggacgtcgtgatggacaccacgatggcgaagcgcgcacctttgccgctccctgcgccgagctcatttgcgactcgcaccccggttgctgctaagaagccgaacgggatcatcatctcccatccgttgatcgtctgactgcattttatttgccaatatggagagtgcatccacagcgatttcagcgttgtccaggtaccctgtcagcaacaccaacactcggtagtaccagttctccaagcagagcatcactccccaggccggggagagcttgatgaactcccagaagtcggcgaacgcctccatggtgaaccccttccacgacagcgggcaccagccgccgacgacgtagacgtactggcccagcacgaccagccaccacgccatgtccgcggaggcgacggccccgacgatgccgaagtcgaggagacgcactagcacgtaggtggcgacgacgtggatggcgagcgcgacggccgcggtgatcgcggtcacccagttcttcagctggctctgcaggaaccgcgtgagcgggagcagcatcgccatggcgaagtgctgcgggagcagccacacgctcatctgccccgccagccgcgacagctccggggactgcccgatcagcagcagcaggtcctccatgaagatgtacgtcggcgtcagcgcggcggcgaagatgaggagcacgatccaggagcgctgcaggtacacccccagcatgtggtgcttcttggcgccgaacgcctgcccgcacagcgtctccagcgcgctcgccattcccagcaggaaaccgaagttgaagcccccgacgacggtggcagcaatggagaaggcggcgagctcgaggtcgccgaggtggccgatgaaggactgcgtgacgacgttgaccccgtacagcgcgatccgttggaagatggccgggcccacgatgtgccatagcttcttcgactccacccaccactccagcgccgcccgcctcgcgcgccccttgatggcccccgtttcgccgagcgggagcggctgcagcagcggcgccagcgcctgatcctccatggcaggatggcgcagcgacacgcgctagcttaataagcttcctatctacggcgcgtgcgcctacgacggcagggtggctctggttggtgtggatttcccgcccgcccgccgcgccgccgccctcgaggtacccaatg

SEQ ID NO: 22313 - DNA, 2234 bp, Zea mays
cccttttgggaaaaatgttgtccccccggattccctccccgaagtaatttccggttggcgggggtgattatttttgggcggcccccctttttttttttttttttttttttttgcactggagtcaagactatatagtatgtaggtcgatcaagtgagaagtcaatcgatggtcagagtaggtgattacacttcaaagggtagaaatgtctgagcagtccttgggaagggcaacatagtttgctggtgccacagcagtcttgacagcttcctgcacccttccagaagatggcctacccttccgtgacatgggggtagaaacacggcggctggtcggagttccaccaataatattggcattagagctctgcccaagaggcttccttgaagaaagaggacggatagggcttggtttcgttccgaacttggcaccttgctctgtagcaaactgttcttgcagtttcttcaattcccttgatcggcgcttttcctcttctttttgctgtcttgtacaggtgtattcatctaaacagtccaacagcctcaccttgttaaatataaatggaatacccatttccttttcccaggctttaattttagcagtcaagttctccaaaagagatggaagtttgctgaccaatatcctagctttctccgcacgcttgagatttatgtgagctcctcggacagcattatatcggttttgatccctttcgtattcatcaagccaagtctcctcttctgatgccaatgtccacttctccaccttttctaaaatatcctttctacttaatgcatgttcttttgcctccgcaattcgaatatccattcttgccagcaactctgaaagatctgctctaccagaatcaatgagatcattgagggtttgccgctcagaatcactatcaatatccatgtgaacacttctgtagatttcctcaagatcagtcaatttcttgaagactagctctttcattttgctagctttcaacttagtcagtctcttaacctcagtctctaccttttcaattatttcgtgtgcaaggcacccttggggcatcgctgtagttggtgagactttaataagagaagtcacatggtcaaaaaatctctgttcatcagttggtgtatccatgaggttccataactcaatgagtgtgctgccaagatcttgaagcttccgaagcctttgtttcttttcatgatttaacgcatgtactttttcagatagtctatcaagcgaactgttgctaatactcatgggtttgcttctccccagctcagcgtaactgggatgaacatcctttagtgccattttgagatcaatagacattatgttgcacatttcatgaatactgttagtctggatgtcaattttttgcagccttccattcttttctgtctgaagatcattaagatgctccttcaattcccctgatcttttcaaggataaatcattctcatctaccacaggagcagcaggatccccatgatcaatggctcctgaaatttctgcttgtagacatacaatctttgactgaatagccttgaactcatttactctctcatccctcctacgcctcaaatcttctagcactggctctatcttagcgagttgttccattaatgtgcccccaagcttctctgacctaggaaatgtttctctctctccaagagcagaaaggatcttgtctatatcagcttcgccaagggacagctcttgaagcaggtctgccttctgtttcctagtctgattcactttttgcttgtaaacattgagacaatcctcctccagttgcagtatcatcctatctcttttcatttcatcctgaccaatttctccccatagttcctgcagttcctgtagaagtgagccgcaggagacgtgcctcggcggcatgggcgggagcggcggcggcggggtcgccatgacgcggctactgtctctgcggacgcgatcttcggggtcaggttgggtagtgaagtgcgcgcacccttgcttcgactaggatttataaaggagccgagagagggtttgatttaaaagggggagagcgggagggacgaagcgaggccggcgaagggggagggaggaggatggaactatcgaatgaacggtatcccggccccgcccgccgcgaggaatttgaaagggtttgaaaacgaacgcgctgttctcgccatctttgctgggccgtcagccgtgattggaagcggttcggtggggcgagcggcga

SEQ ID NO: 22314 - DNA, 1866 bp, Zea mays
tttttttttttttttggacgagaactcgctgggggagcacttaaagtggcgaagccagacgaggaaaatattacaatcgcaaataacttcatccgcaccagaggcgttctccctcccccgctgcaccttctgtcacgagtccctcgcccggtgcggcgcgccgcctgctcgacgaaatggggcagtgggacgcgctagtggacgccgcgctcgcgaggctggaggccaggagcctgctacgtgccacgcgccccatcgcgctcgcggcgccgaccgcggcgccgaggaccttcgacggcccggggccttgggaccatgccgccgtcgagatccgcctcgaccgcgacaccctgcaccagtggctggccgaaggcgatgaggcgggtggacaggaagaacagctggatggaaacctgatcctcttctcagggaatgactacatgggcctcagctcgcatccggcagtccgtgaggctgctgtgaaggcagctcaagattatggcatggggccaagaggctcggcgttgatatgtggttatactacttatcacaaattggtggaggaatcattagcacgactgaagaaaaaagaggattgccttctttgccccactggattttctgccaacatggctgcaattacagccctggggagtattacctctcttttgtcccctggaagaaaacctgcagagcacgagagaattgccatcttctcagatgcgctgaaccatgcttcaatcattgatgggattcgccttttggagcggcagcaagaagcattagtgtttgtgtacaagcactgtgacatgttccatctcgatttcctgctgtccagttgctcattggaaaagaaagttgttgtcacagatagcctgttcagcatggatggtgatttcgctccatttcctgaacttattaaattacgcagaaagtatggttatttgttggtcatcgatgatgctcatgggacacttgtttgcggtgagaatggtggtggtgcagctgagctgtttgaatgtgaaaaggacattgacataggtgttggcaccttaagcaaggctgccggctgccagggtggttttataacatgcagcactcaatggaaaaggctgattcagtcgcgaggtcgctcgttcatattttcaactgctttgccagtgccagttgttgcttctgtgcatgcggcactctatgtctcgagtaaggagacatggcggagatcagtgatctggaggcatgtgcagtattttgcctcattgaccaagctcgagataactagtcccataatttccattgtggttggaagtgaagcaggagcgctcagggctagcaggtatttgctaagatctggatttcatgttacaccaatcagaccacccacggtgccacccaactcgtgcaggctgagaatcactcttagtgcttcccattcctcggacgacatcaaaaggctggttgatgcactcacaccatggctccctgtcaaatatggtaatgggagctatgctacagcttcgaaactctaacccatcggaggagagtctggtatcctgcggaaagaggcggcatgctagtgggtggttgacgcgtacgcatttatatattctgtggcgtgacgcctacgtccttccccatttataagcaaatactactgttttgttagataccaatgttgaaataggcttattattattattattattagcaagacaccgtcgtgacaccataaatatttaggttgcatctagttttggaacgattttctctattttctataatgggatgatctcacgaagcaatattattgtttgcaaaaaaaaaaaaaaaatcttggggtgctcctcgtcaaaaaaaaaaaaaaaa

SEQ ID NO: 22315 - DNA, 1142 bp, Zea mays
ctttatttctctagtaaacctttcaacactgttcaaaacagaatttgttactgtccttgtgtctgcattttctctactatacctctgcaacacatttcaaaaagtataatgagccaactcctctacttgtaatgtcaaggaaagcaacacaggaaatgatgtgcatggtgtgcctaaagattcaacccgttggtccgttctgccaaaccccatcttgcaacagactatcgatggcaaagtactactgcaacatctgtaaatttttcgatgacgaaaggactgtgtaccactgcccgttttgtaatttgtgtcgtcttgggaaaggtcttggtgttgatttctttcattgcatgaaatgcaactgctgtcttggaatgaaattaactgagcacaaatgtcgggaaaaagggctagagacaaattgtccaatatgctgtgacttcctgtttacatcaagtgccgcagtcagagccctcccttgcggccacttcatgcattcagcttgctttcaggcatacacttgtagccactacacttgtcctatctgctgcaaatctctgggagatatggcggtgtattttggcatgcttgatgccttgttggctgctgaagagcttccggaggaataccgtgataggtgtcaggatatactgtgcaatgactgtgagaggaaaggcagatgtcgatttcactggctataccacaaatgcggctcctgtgggtcgtacaatacccgagttatcaagactgacactgcagattgctccacaccaaattagctggagggaacatttgtgcttatttgtagcctttttttttctcttatgtaaatatcttctagcgggaaggaaaaaagagatgtcctgtaggatagttaacataatttcattcgtagcgatatcagttttgtaagtgtagcagtttacaatttactaggtctagtgcgttgtactgccaaaatggacggttctgctggacaaaggacataatccgagaaaataggctagttagaacaaaaaaaaaaaaacatgttctacatatttcgcggttcacgtatagcagtagggaatcgctaatactaatttcttaatttttaaatttagtttttgtttggtttagctgcagatcgcttcaagggtccc

SEQ ID NO: 22316 - DNA, 2086 bp, Zea mays
ggaagcaaggtatccgtagaaggactgattgtcaactctaatcattcgttacatgttggagttcattgatcacaatagttcaggtatactggaatgaattgtatgccacatttgttaggatgctactacataaaatggtttttgatagcaatagttggaggatcaacaacagaagaaaatacagatagggtttccaacagataaatttcatgatatacaagcaacaaaagagaagttcaccatcattggaaaggtagaaacacatccaaacgtggcaagacaaactcattacctagtggctaaatgtttttcaattattttctcctcgtcttcagtaaacataaaccacttgtctttatttgccattaattcatcgccaccatactcttgaagcaatattgctgagttatcacagtaaccatctaacttccaatatgctgcccctttctctaccatcagaggcttggtccaaaaacctccttgcttctccatagttgccatgtcatttatggctgcacgcttgacttcctgtgcctcctttatttgggaaataatatacttatttgcttcactgttagaggctgctgcttcatttggtgaaacaattattttgttcatgttgtcctttagcctttcctttagctcctttaccatttcttttgcagcacgcgccttttctctagcagcattcactggttcagcagctatgtcattttgcatgtcaatccagttcctcagcttgtcagtagagagggtctcatcacaaagaaaattcagaacacgcagcttacaagaagggctcaagtttttatatcctgatatcccctgattgatatggttgagaggaaacccttttgatatagaagctgattcacttatatatttgccaatatcaattacccatgcatctccgtctcttgtgtaagccagaggcttcttcccctttccttcttgaatgacagataacaaatttatatgaaacccagcaacaactgaggatacaaaccgaagttcacggcctccaactaaatcttgaagaattttttctggttgccctttctttatttgaaaaatctctgtaaatgcacggcagaattctataaactgaattgcagccccagtatcctcgtcatcaagctctgcgcctgcaattttagtgactggggtacccctgggtcgcacagttttactattgagaaaatcaaggttcccatccatctgcaatggttcagtattgactccatgtgacgttgcatcagcaggatccttctttgtcctgtgcttgagcttctgccgcttctgccttttcttggtatcaacagaaggaagtgaattgagatcaacacctatattttcatctccttcatctgctataactgtattgatatcaatgcctatatttacatccttttcagtcgccacctcagcagcagcatctgtccctcgggatctctttgtgcccttgtcactaccattcaccttgagaatcgcctgtgcagcagaaaccacatctgacccctttttaaggagatcatggacagaggtgcacccggaagccttggcgatgtgggccattatcccagttggcatctcgcctttcttctttctacagaagctgcagttgcagatgcccctgcacttaggacagatccagtcctccttgccggccgcctcctcggcactctcgccatacctgttaaggaggcacttgaggcaatacttgactgggcacggacccttcttcttgacttgcttgcacgccgctgcgaagtctgttgtcttctggcggcattggtggcaggtcttgccattctctggatcgtagatccggcgaccaacaacccgaactccgggcgccggattgcgcttcttggacttgacatccggcgctatgacctccagcggctgcggctccagcacgtcgtcctcgtcccacccctcgcctaagcggacattcccctccggtggtgccgccatccgaagtgaccgacagtcgtggagactcagtcgttgatttcctgatgcgagcgagaggcgggcacttttcagttctctgctgctccagttaaaagtgttgacgcgtggg

SEQ ID NO: 22317 - DNA, 1402 bp, Zea mays
gaggctcggccgggaaggacgccttcccggcctttagcagcagtcagcagcttctcgtttcatcagccagccaccaccaaccaaccacagcgaaacacctctttctcgctctctcataaacgacgaggaggccgtacggcactccgcaagcttctcagttcactctctggtctccagtctccaccgctccagcagcctgagctagtgagctgagccccgagctgctataccgtacaccaagtgcacaagcggatcggatcggatcggagcgagatggccgcggccgggctgggcgtgaaggcgacgccgttcacgtacgcggcgcacgcgctggccgcggtggcggcggcgctggtgctggtgtggtgcgtccacttccgcggcggcctcgcgctcgaggcacagaacaagaacctcatcttcaacgttcatcctgttcttatgctgatcggctacattatcctcggcagtgaagccattatgatctacaaggtgtttccgaacctgaaccacgacacggccaagctgacgcacctgatcctccacgccgtcgcgaccgtgctcggcgccttcggcatctactgcgcgttcaagtaccacaacgacagcggcatcgccaacctctacagcctgcactcctggctcgggatcgggaccatcgctctgtacgccattcagtgggtgttcgggttcgtgaccttcttcctccccggcgcggcgcccggcgtgaggcgcggcgcgctgccctggcacgcgctcttcggcctcttcgtctacgttctggcgctggcgaccgcggagctcgggttcctggagaagctgaccttcctggagagcggggggctcgacaagtacggcgccgaggcgttcctggtcaacttcacggcgctcgtcgtcgtgctgctcggcgccttcgtcgtcgtcgccgcagtcactccggcgcacgccgaggaaccgcggggctacgccccgattccggtcagctagagggggaggagttcgctgggcagtcagaagagggcagctgtgttttgtttttgaattgaaccatgacacatcaggcgtgtgcgtgcctcgcgtccgggtttacttcgaagcggacgcgacgggtttcggtctatgaatgaatacagcccgatgggccgcagctttccacaaaaaaaaaaaaaaaataaaaaaaaaaaaaaaatgctccgcatataggcacaacggcgcatagactttaactaactaatcacgtcaccgggatctaacaaggttctctgctcactgatgatcgaaatcacttcacgttaatctaataacagctcgccatggactgttgcttgcaaggcgcttggtacccccgccatggtaggcgataattaagcagtccaattccatcttcttggcctataatgcc

SEQ ID NO: 22318 - DNA, 1061 bp, Zea mays
ctctctctcgcagtctcgctctctcatactcgcggccgccccgaggaggcaggacgtactccgcaagcttctcagttcactctctagtctccaccgctccagagccccgagctgctataccgtacagccagtgcagaagcggatcggatcggagcgagatggccgcggccggtctgggcgtgaaggcgacgccgttcacgtacgcggcgcacgcgctggccgcggtggcggcggcgctggtgctggtgtggtgcgtccacttccgcggcggcctcgcgctcgaggcacagaacaagaacctcatcttcaacgttcatcctgttcttatgctgatcggctacatcatcctcggcagtgaagccattatgatctacaaggtgtttccgaacctgaaccacgacacggccaagctgacgcacctgatcctccacgccatcgcgaccgtgctcggtgccttgggcatctactgcgcgttcaagtaccacaacgacagcggcatcgccaacctctacagcctgcactcctggctcgggatcgggaccatcgctctgtacgccatccagtgggtgttcgggttcgtgaccttcttcctccccggcgcggcgcccggcgtgaggcgcggcgcgctgccctggcacgcgctcttcggcctcttcgtctacgttctggcgctggcgaccgcggagctcgggttcctggagaagctgaccttcctggagagcggggggctcgacaagtacggcgccgaggcgttcctggtcaacttcacggcgctcgtcgtcgtgctgctcggcgccttcgtcgtcgtctccgcggtcacgccggcgcacgccgaggaaccgcggggctacgccccgattccgatcagctaagactaagagggggaggagttcgctgggcagtcagaagagggcagctgtgttttgtttttgaattgtaccatgacacatcaggcgtgtgcgtgcctcgcatccgggtttacttcaaggggaaagcggacgagagtacgcgacgggtttcggtctatgaatgaatacagcccaatgggccgcagcttttcc

SEQ ID NO: 22319 - DNA, 5146 bp, Zea mays
ctgaaaaggacgatagaagtgagctccatgaagattctatcaacaactcatagtgacactatgtcaagtgagcacctgacttctttatgtacgggttcccactgatagtggtgtagtcacttctctccaaaatctgaaaccggtcaaggaaaatatgtcaaaactcataatagagtttgagaaggcgaagcagctaaagtcaaaagatccactgaagatcaagctttgatatctttttctgcatcaaaagcatatgtgtaccatggcatcgaacgtgacaattttctatcgagattacataagattatatactgaacacataaaatgagacaatgagagcacactacacacatttgtttagtttgagaaagtgcagcaaagcaaatcaaagttaaatactactgaactttacaaagttatcacatggaacataagtttgtcaatatgttccttttaacaggtgatcaaaagaccaaatacgcaaacagccagatattaatggtgcctaataatatcatcaactaaccgatacatgacctaagaagaagcagatatacacgaggcataaactctgatcccccatcacacaagcatagtgaatataagtgaagttcattcatttccttgagtgatctatcaaggcacaacaatcccctctgggagggccactattagttatggacttatggtaggcaactgagtccacttagttctgtttgatcatggtcccagaggatctggttccgcaggctgcagagcatcattatctatgttttgcagggcaagacaaacatgactcaagcttaactaccgtcattgcgtgaatttctacagattatcattttctatgtcagtagcccaaaacagagacaacccgagcgtgactgtagttgtttctccaatgccagttaagggttcccatcttgataattacaaattgctagtagtaactctatcagcaacttaatcactaattacactctatcggcttgcaaagtgtaacgagacgatagaacaagtacaagttgacggggcaatacaatggtgtgtgtgggacagtgggagggtggcgggaggggtgagggacgcaccgagagagctacgtcctggtagtttttgaagttggccacggagagggaggggagcaagcccccgtcataggcggcggcgatggggctcgccatgggaagcccccagagctcatggggcggggggctctcaacgacctggagcctgttcctggctgccgctgcgtcgggcgtggcgtagggagacgcatgaagccggggcgatggcgagggcagaggcagcggtgcggggggaggcggtgtggcgtgagaggcggagacgagccgcgggtttttgaacgggcgggccggctgcagcacctcgccgcggtggtcgtcgtcgctggcggcgcagcggacgcgggaggaggccttggcagcggcggagtcgatggcggcccagagcgctgcggagtcgaggtcgctgtcgtccattgccgatggcggaggaagcctgtactgctgtggcgttgcagcgcctcccccgtcgccgattgaattagaaatggaaatggccgagaaaaaggagatccattcgcctggctgggcctgcctattctccaggcccagcccaaaataattgcaatgagcccgccttcctgttgctgtcgaaacgattgttgcagcagatcaatttggcgcattgattaagatacgaattcaaaacacacatcatgtgctatcattgtttcaaatcgtagaagctgacgcatcagaacttttgtgctctgtgctgtgctgctgcctgctcccctgttcttacttttttgtcaatataacaatatgttaatcatggaataaagaaggtagtacacagtacaaaacagtccaatataatccgctgcatgcatatatatacatataaagaagggcgcggctcagctccccggcccgatccggccctagaagttcttggtggcctggtacgttttgccgaactgccagtcgcggggcgtgacgtgccaggaggtagccttgcggtggtcggcggtcatgacgcggaacgtcagcgactcgccggtgaggtcgacctccgtggtccagagctggccccagctgcgcttcatcggcgtccacttgacgcgcttgttgcccttcacccacagcgccaccacgtccccggcgccgcccacgttggtcaccttcacctcgctgtagtgctggttccccgtgatcgtgtaccggatgccgcctttcctctcgcacgccaccctgcggtaggtgatgggcagttgtatatatatacataccagatcgatatgatgtatacctccgtacgtgcccttgagtagctagttgacgtaccttgcggtaggtgatgggcacgatgccggccttctcctcggcgatcttgaggaacgccggtatggtgaggtcgaagtgctcgcccttctgcccgctcaccggcggcggggcctcgttggtggccgtcaccaccacggtgcccttggggcccttgagctcatagcacgcgccgcacccggtgccgttggtgtacagcgacgggcccacggccgccgtcagggtgccgtagtctttccccagctcgcccttgtagccgcacgcgccgccgtccgtggtgtcagttaacccgtcgcgcccgccgtagtacgtcgcgtgcccgtccgtccacggctccgccttaaacttgccgtggttgacgtggggcttctttttgccgccgccgtcctcctcctcctcggagcccacggcgagcccgacgagcagcatcgacgccaggagaggcgccattattgtccacgaacgaccagacatgattgatgctatggtttgatttgtccttggtattgcccgcccgctacgtgatagtaatatatacgtaggggcgcaggcatgcacctgccatttttagatgcatgcgtgctttgcttgtggatgcatgtccggtgcaatgaaaatgaaactatggacggcttggagcaacaggaggacgttgccaacgcactcctaaaaaaagcatcgcattatacaagaataccaataaaaacctaaaatatataactcttatatgtagaatgttgtttaattaatttgatgccattagatgatgttgggctccaccaataagacaatgctacatccgatccggcaagacgcgcgcacacaagtcgcctttatttttgtagggcctgtttgaaaacatccaatcttgaaactgaggtggtttcaaacatatccgtttataatgtagaaattggattttcagttttttaaaacaatgaaaccggccactcctagctaaaaaaaaataaaagtcagtttcttaaaaattgagttgcttccaaacaggatcttattataagagaacattttaaaggacgatgctaattcatccatgctccattcagttgtgctacaaatggtgaaaaacatgcccaagattttgcttgagtatgaaaagcttcatcaatctgcaccagctattctactgatcaactgcttctcattttccccattttccatggcatctgcccttctacttgtcccactcatgtatcttccactctggcaactgttgaatgatcatctgcgcaaaacaacaaatcccataggcatgctatcaacgttatgcccttgtgaaaagaaacatgaaacagcacggctaaaacgttatccagttgcagtatatatactcaagaataatgctgtaaaaaaaattcagagcaactttcgacggaaaattcagaacggacagttcaatttcctttttcgtttgggaatacagtacgttaaagaaaacactggaaagcattcgtgcatacctgtccggttgaatctgcattgcccaccgttgcctggcacgccaatctccacgtcttgggtttctgaaaattggcgcgaagaggttagcacttttacttaaaaactaggaagtttgcaagcttattcttctgataaagaaaacggttctgatgatgaacagatggagtcgtgtgtgcaaactacaaacccttttgagcaactccttctccacttcggtttttggggatagcatttccttgccttcgaccacctgtaaatttagcgaagcggcaaagtgtcaaaatgaactgtactgtcaggcaggcttcaggaaacctatcctgcagagttccttgtgccctatcttcgacaggaaatgtcactgcatcaggcttcaggagaatgagttgtgactggctgcattgggttcacctcgacgacgcaggtcccgcacacaccgccccctgagcagttgagaagaactttatcctgcggcaaccagcagagagcagcagcgaaaacgaatcagttccagaaagacgcctgaggcctgacgatgagcagtggagccgcggcacggtgatcggcaaattaagcgagagcgagatcagcggcggccgcatgcagtgtgactcacgtagggcccgtagaggtcgatgtagccgtcgagcatgacgtccctgagcttctgcccgccgcgcgccgtccggtaatgcacgtccggcgtcccgtccggcagcagccgtggctgcaacgtcacgactcacgagcgcgcgcaccaattaaaccgccgtcaaccaatcacgaacgcgcggacagctcggcgcatcaaaaaaaaacacacacacacacaagggaagcgcgagaggaactcacgctgacgaacgcgaagtcgatggacggctcctccacctcctccggcggaaggctccccgccggaaggcgcgcccatctcgacgacgcggaggcgcctcctctgctgccgcggcgaacgcagcgagcagctctgcttcttggcgccggcgcaggtgcagtgggacggagcgagaggcggcgacgtcacgccgagggcaccggttacggtgaggtgcacggttgcccccatccctgacggtgtgcaaatgcggtggccttgggctgttcgacgacgcaggcgcgcagtggcgtagctagaatttcttcgtgaggtatgccattagaactttttataaataatttaatataatatataacaatttagtatatagttcaaaatataaagataaaaatagcatataacactatagatttaacatttaagtctataaatgtatata

SEQ ID NO: 22320 - DNA, 1068 bp, Zea mays
aatccgacagaaacgaacaaggccttattgactccgttcctgcgacgacggaggtttcgttcgtgtttttttttcagtacaaacaacccagtcaatataacaatatgttaatcatggaataaacaaggtagtacacagtacaacagtccaatataatccgcttcatgcatatatatacatataaagaagggcgcggctcagctccccgatccgaccctagaagttcttggtggcctggtacgttttgccgaactgccagtcgcggggcgtgacgtgccaggaggtagccttgcggtggtcggcggtcatgacgcggaacgtcagcgactcgccggtgaggtcgacctccgtggtccagagctggccccagctgcgcttcatcggcgtccacttgacgcgcttgttgcccttcacccacagcgccaccacgtccccggcgccgcccacgttggtcaccttcacctcgctgtagtgctggttccccgtgatcgtgtaccggatgccgcctttcctctcgcacgccaccttgcggtaggtgatgggcacgatgccggccttctcctcggcgatcttgaggaacgccggtatggtgaggtcgaagtgctcgcccttctgcccgctcaccggcggcggggcctcgttggtggccgtcaccaccacggtgcccttggggcccttgagctcatagcacgcgccgcacccggtgccgttggtgtacagcgacgggcccacggccgccgtcagggtgccgtagtctttccccagctcgcccttgtagccgcacgcgccgccgtccgtggtgtcagttaacccgtcgcgcccgccgtagtacgtcgcgtgcccgtccgtccacggctccgccttaaacttgccgtggttgacgtggggcttctttttgccgccgccgtcctcctcctcctcggagcccacggcgagcccgacgagcagcatcgacgccaggagaggcgccattattgtccacgaacgaccagacatgattgatgctatggtttgatttgtccttggtggcccggccggcctcgaggtacccaatcgcccataggagtg

SEQ ID NO: 22321 - DNA, 2220 bp, Zea mays
tttttttttttttaattccgtgcattccagtaggccccccctcgggcctttttttttttttttttgaggctccaatcttacttgcattagtagtatacaaatattaataacagagcttacaacaatgcccgctggaaccaagtagagccgagagacgctacccgtaccgtatagtaagatgaatggattgagtgtgcgaattcaagcgatcaagaggaggaagtggaggagtggggactctcaacgcaaaacttcatgacaagaatgccgtccgatgttaccttgctaaactgtgtttccttcctactacgaagatgcaacctcgatggcactgccaagcggccatgcggcttcgacgtaggcgtcgctgtaagggaccttctttaccaaggtcatctcgtggtccggatcgacgccgaatccttccacgagtaatgtgtactgataaacgaggtccatgcagatatatggaatgctatccttctgtacaccagggaaggtggcctcggcgttcttcacgctcaacgagcaagcgcgctccgcagcttgtctgaagtccgatggtttaaccttagcgacaggcgcattggcgttaacaaatccagcctcagcagccctatcaaagaaaaaggatgctacaaagagattcttctgtccagcaccaccaccaccattccaaatgccaccaaaagaacacttcatgtgggtgcatgcttcatcaactttaagggctttcactgcatcatccttgcattttgagtaactagcaccggaaggtggagcggatgcttcaaatgaatcgccgccatacttgtatttcccttgaaatccttctaacatacagttgctgtaaccattgccattgccagcttttaagacctccgctctagcggccagcaacccataatgcaaataactatgaacataaagataatatgtggttcctttgaggaacaatttcttcacatatgcatcttccccctcggatggtttaggagccttttctgcatccttctctgcaatagcatatgccatttggacagatccaccaccaagatccactactccaactgtgtctgcataagtctttcccaagtttcccaacagataattgatggtaacccattcgtatgcaccttcctgcgttccatcaagaactgtaacccaatccggttggtttttaaaggaactcttttcgcgaagaatgtccctaaccgcttgcaatatcgcctccgatttttgtgcacccaaatttctcagccctgcggtggccccgactctgacaggagtttggtcgcgcaattccgcgggcaccactcgcttggcatcgtcaaggagagagacgagcgactcggcggcctcccggggatcgttggcgtagtggctaagccccggttttatctggacgaagagctcgatctcgctgccaatgtggacgagatccaggttggcgtcgaagcggaagacgtggacgcggctgccggagctcccggcgtcgaagatgacggcgtacttgtcggccccgggcgggccggacctcctggcgccggccgtggcgccggcgggcgagcgcggcatgaggaggagcacgagggagacgagcgcgagcggggcgaggacgacgagcaagacgccccggtagcggtgcgcgcggtcggccagcgtctcctggcggccgccgttgggcagcgcggagtagcggcgcatcttggggtcggcggggaggagcaggaggtccggggacgagggcgtgcggtagcggacgccgcggccgccgcttgcgggggccgggggagactgcgacggcgacgggttggccgcctcctgctgcgcgggatccagcgctccgcgtcggggcgcgcggcgcgcgcgtcggtggtggatctgctgctgctgcgactgcgtcgtggcgtgggggacgctcggaagacgcggcaggcaacgtttatggcgtacgcgcggcgcgggtactttgagttgacctcgctcgggtttggaaattgggatcgcgtggcgtgggcaaaggcaagcgcggcggacggaacacggaagtgcgagccgcctcaggatctgccgcgggcggacaaggcacaggggagatgcagcgcgaggaggggagggccggccggagggaaagtgctctgcctgccgatgccgatgccgaaccacccccgactggctgtggtgtggtgtggtgttgaagcccccgacccggccggc

SEQ ID NO: 22322 - DNA, 2575 bp, Zea mays
gtcgtgggccacaggcgtgggaatggcgccgatcctggtgggcgcatggggaggaaggagctccttgtggtggggtagagagccatgcagttggtgaaggaagccagtgcagtggtgctcaagctaccgcgtatggtggcactatgagcagaggggagaggcatcggcttggggaggagttggctggagcgaatggggaagaaggtcagtatggacgtcgacggcagacacatcctcgagtgctggaggggagggcgcgggtggcacggttgggcgccaaacgagcatgcatggaaggggcgacatcagcacacctgggagcggcgaggcacgggcacaccgatgccaggaaggggcgacacgggcacgggcgtgccgagggtgggaagcggcggtgcgaactcaccgaggacgagcacgaaggcgccagcagcagatgcgcctggagagccacccatgaggaaggaggggaggcgagcgacgagtcgctagaggggaggaagaaggtgacggctgggtcaagggatagagagagaagagacttaatatcatgttagaggttaagaatagaaaccttaatcctaattggacaggggatatattaatatatatctaagtacattggccaagtcccattacagaaatgaaatacacaatactataacaacgataactctgtgctccttttaaaaaaaacgataactacgtgctcctgcctatgaacaagatgcaacctacctcgatggtactgcatttctcaggaattgcacttctgaaagctagaccgtgcacattagcagcactgtatcaggctgcgtgtgacaggcaaaattgcgtaggaactaggaactagcagtacagtaaagccgatgtttaccgggccgaagctcgtctgtacaggcacagggcacagcaagccagcagtagataagcagctcaggcccacacggttaataaatatgtactctttttccagcagcaaagggctgccagtaaacacaatgaccaaacttgttcgcttttgtgtgagcgaaggatggcactttatatcatgcacatccctgtttttttttttaaaaaagaatgcctgaggctctcatcttacttgcattagtagtatacagatattaataacaataatagtaatagggcttacaatggccgctagaaccaagtacagccgaggcttcccttggtgtgtaaagctacccgttaccgtatggggaggatggatggattgagtgacaaaatggtgtgaattcagtaagcggtcagggggggggggactcccaacgctaaaacttcatgacaacaatgccgtccgatgttaccttgctaaactgtgtctccttgctatgatgaagatgccacctcgatggcactgccaagaggccatgcggcttcgacatatgcaccactgtaggggaccttctttaccaaggtcatctcatggtctggatcaacgccgaatccgtgcacaagtaatgtgtactgataaacaaggtccatgcagatatatggaatgttatccttttggacaccaggaaaggtagcctcggcgttcttcacactcaaagagcaagcgcgctcagcagcttgtctgaagtctgagggtttaaccttagcaacaggtgcattggcgttcacaaatccagcctcagcagccctatcgaagaaaaaggatgctacaaagagattattctgtccagcaccaccaccaccattccaaatgccaccaaaagaacacttcatgtgggtgcatgcttcatcaaccttaagagctttcactgcatcatccttgcattttgaataactagcaccagaaggtgaagcagatgcttcaaatgaattgtcgccatatttgtattgcccttgaaatccctctaacatacagttgctgtaaccattgccattgccagcttttaagacctctgctctagctgccagcaacccataatgcaaataactatgaacataaagataatatgtggttcctttgagaaacagtttcttcacatatgcatcttccccatcggatggcttaggagccttttctgcatccttctccgcaatagcatatgccatttggacagatccaccaccaagatcgactactccaactgtgtctgcataagtctttcccaagttccccaacagataattgatagtaacccactcgtatgcaccttcctgtgttccatcaagaactgtaacccaatccggttggtttttaaaggaactcttttcgcgaagaaggtccctaaccgcttgcagtattgcctcggatttttgtgcacccaaatttctcagccctgcggtggccccgaccctgacaggcgtttggtcgcgcaattcggcgggcaccactcgcttggcatcgtcaaggagagagacgagcgactcggcagcctcccgggggtcgttggcatagtggctaagccccggttttatctggacgaagagctcgatctcgctgccaatgcggacgagatccaggttggcgtcgaagcggccgccggcgacgcggctgccggagctaccggcgtcgaagatgacggcgtacctgtctgccccg

SEQ ID NO: 22323 - DNA, 1640 bp, Zea mays
ctgataaatggggttgtacttattcacgcccttagagctacatcgtcgagaatcgtaaagcttttcatgtccggttgatgtaagtttgcttagtgaacggtacttgatatagttaggcacgcagtgttgaacccctaagacaactaggatagatatatcatgatgtttttgttaggttatatccaacatatcgtttatatagtcgtgtaaaacataattttgcaccgtaaattgagtagactttgaaattaaagatgatgaatatgctgatagaaatagccttataccttagaaagttacaactgcattggatacaaaatctagtcttatttcatcgtgttacttcaaacttccgtctccatttgttcatctgaaacaagcgtacctgaacaaccattttgctgatagccatttacatgatacaagtttcagctgtacttgttggcaacctccatgagaagttctgacagctcccctggtttcgagagcatggacatatggtcggctccctgcaaccccgtcacctccgtgccggggttccacgacgccatccgccgctggaagcctgccggcactgacgcgtcgtcctcggcgacgacgcacacccgcctcacgccgccgtaccgttccgccgtcaggataccccccttcatcgtcgcgtcgtctcggaaccgctgtgacggcctcaccatcgccattgccagggtcaagtcctacgttgcgcgcgccagaggaagcaacacacgtcagatggtgacgcccgcgtcaccgcgtgtgtggctcaggaactagtgggctagtggccattgtccgttgtcacctacctctgggggactgagctggtacagtctctgcttcaggtactgtggcccgaaccgaaatgtctccacgggacgctgggggtcgccgctggtttcgaattcgcagtccatgtagcggtccgctgggtactcttcttgcaaaaactagagtccatcgatcacgaaatcatggttaaaaataaaatttgaccccttcctgcccttttcgacgaaacgatcacgcaacgcaaccctcgggtctcggatttccgcttacctgctcgaagacgaacgccatcggcttcccagcggagggcatgccggtcgcgacgaagacggcgacggcgaccctgtccgggtactgctccatggccagcgcgaggctgaccccgccgaagctgtggccgacgaggaccaccttctcctcgggcgccaggccggccaccgtggccaggagcggccggctgtactcctcaaaggacggcacctcctcggcgcgcccggggctggcgccgcacgcggccatgtccagcgccgtcacgcggtggcccgcggatgacaggagggtggccaccttgtaccagcaccacgcgccgtggcaggtgccgtgcaccagcacgaagtggtgccgccgccgctccgtgccgctctccatggtcctctgtcctctgcggttggtgggatcaggacgcaagcacacttcgatcggaggaggaagagacaaaatatccttgccttgtagtaactagttttctttttgagacacttatcttgccattggtccgaccttctttcgccttctacttctgcgtcactaccttcatattttgctctaacaat

SEQ ID NO: 22324 - DNA, 1055 bp, Zea mays
gctgatagaaatagccttataccttagaaagttacaactgcattggatacaaaatctagtcttatttcatcgtgttacttcaaacttccgtctccatttgttcatctgaaacaagcgtacctgaacaaccattttgctgatagccatttacatgatacaagtttcagctgtacttgttggcaacctccatgagaagttctgacagctcccctggtttcgagagcatggacatatgatcggctccctgcaaccccctcacctccgtgccggggttccacgacgccatccgccgcaggaagcctgccggcactgacgcgtcgtcctcggcgacgacgcacacccgcctcacgccgccgtaccgctccgccgtcaggacgccccccttcatcgtcgcgtcgtctcggaaccgctgtgacggcctcaccatcgccattgccagggtcaaatcctctggggggctgagctggtacagtctctgcttcaggtactgtggcccgaaccgaaatgtctccacgggacgctgggggtcgccgctggtttcgaattcgcagtccatgtagcggtccgctgggtactcttcttgcaaaaactgctcgaagacgaacgccatcggcttcccagcggagggcatgccggtcgcgacgaagacggcgacggcgaccctgtccgggtactgctccatggccagcgcgaggctgaccccgccgaagctgtggccgacgaggaccaccttctcctcgggcgccaggccggccaccgtggccaggagcgggcggctgtactcctcaaaggacggcacctcctcggcgcgcccggggctggcgccgcacgcggccatgtccagcgccgtcacgcggtggcccgcggatgacaggagggtggccaccttgtaccagcaccacgcgccgtggcaggtgccgtgcaccagcacgaagtggtgccgccgccgctccgtgccgctctccatggtcctctgtcctctgcggttggtgggatcaggacgcaagcacacttcgatcttttcgattaggatgttctaggtaatggtctcgtgc

SEQ ID NO: 22325 - DNA, 3751 bp, Zea mays
  misc_feature (3100)..(3100): n is a, c, g, or t
cgaatgtggataattttaaatttgcagacatccaatccaacatccgcgcagacatccaaaaggctcgccgaacgagtagacgagcactggtcaaaagcctaaacgagcagccgggtactgcagtgcagcagtggagtggcaaaagcccaaatccaatcgcatatcccaccaggccccaagatcaaatccacccagttcatcactttctctcccgtacgtaaaagcgaaaaaccctcccaaaaagcaaattccgcaggtgcccaggggcctaaatttagcagcagctgctcctcatgctcccccacggaggctattggatcggaggggagggcgggaggaggaggacgggacagaaataggcgggcggctggagagagattggcggaggagtccaggagggtgcgcgcacaagcaaggcaggaccggaggaaacgaggagcggaggtcagggttaaatgagacaggactgggggaggagcaggagggagcggagcgcgcgtcaggttgtccagagatgggaggagctccccggcgtccccgccttctactcctctcggctcgttgaggattgaggtgaccgtctccgtctgcccctgttcttgtcagctgtcaccccacaccaactggggtgatctcattccctttcgcaagtgtctcgggggtatctcggtcggaaagctggggcctattctttaggattaggaggagccgtatgaagcaagcttggttcctctagattcagtttggtggcaatccgtgccggcggcagagcgcggcagctggttttttcgttagattcctcccaccttgtttgcattgcccctgacgcgtgcagtaatgcttacctagccttccgatcgttcagctcaagagaagaatgagagatccgttcttcagtggggagatatccaatcatcgatatgcgctccaaaatgtggcagattggtgaagacaaatgccgtgtttggatttagcctaggcgatgatttggttcgggtagcacagggttgcctgcttgctttgtgctgctggaacggaaatgcgtttttcgtagtggtccgttgatctttcaccagtgtacatgtacggcccatctcgctaggcctgattgctgatttcccttaattatttatttatgctgttggaattggaacctgggagtactcagaagtaaggacaatcacatggctaggtcatggcttgtgttagggatttttgtggttctctgataaactttgctggccttagtgcatgctgttcttttgtatcctttattattggaatgattggtagaacggtagtggaccatttgtcttagtgtgtatcaatccatggttccgtgttgtactctccttttagatgtttattaaagaacatgtcagttgtattgcaaatttacaagcgcgcatgaacctgtctgtaactcatgtcattatccttgtatatgcattctttccaacatgttacttttctgtagttaaataatctgcatagttcagttcttaagccactactgctttttttcttattattttctgccttctcttgcaaaatgcagattacattcagattcggatttttgccacaccctcggcaagatagagaatctggagcactcttgaatgctaatcagacaccctgcccatttctttctctgtcttaggcacaaggccttctcatggccagagacccgcctcatctgcccgtaactaaacggaaaatcctgcaattcaagttcctgataccgtttgttcttgttctttctgtgtctgttattgctgtcacccagtacttccaaagtatctcctaccttctacggccactgtgggacacgccgcctaaaccattcacccgcatcccacactactatgcacccaacatctccatggcccagctgtgccaactccatggctgggacatcctccccgcccctcgccgtgtcttcgacgctgtcctcttcagcaacgagcttgatattctagaaatccgctaccacgagctccttccacatgttgacaggtttgtcatccttgaggccaattccaccttcaccggcatccccaagtcactctccttttacgaaaacttcagccgttttgggtttcctggatcaaagattgtctacgacatgctttctattggagagctggataccagttctcgtcgccaaccattccatgtcgaggcctatcaccgtcgctcactcaatatgctgatacgaagatcgggtattgctgccggtgatatcctgatcatggctgatgctgacgagatccctacccccgagaccgtgcagttgctcaagtggtgcgacgggataccaccagtaatgcaccttgggatgaagaactatatgtactccttcgaatttcctgtggatgacaacagctggagggcgacggcacacgtgtacaacgagcacacatcgtaccgccattcccgccagagcaacttcatcctggccgacgccggctggcactgcagcttctgcttcagggagatcaaggagtttgttttcaagatgaaggcgtacagccatgcagaccgagtgaagcagaaaagcttcctgaacccagacagaatccagaagatcatatgcaacggggacgacctgttcgacatgctgcctgaagagtacacattcgccgacctcttcaagaagatggggccgatacccaagtcagggtccgccgtgcatctgccttcccatctgatcaagaatgcagacaagttcaggttcttgcttcccggtgggtgcttgagatcggagtagatcagagattagctttttttttttttttgttagccgacagtatttcttttagctgcaatactgttgttcctggagaaacgatttcttttgggagtttcgtatgatatggtattgttactttttagatagggtgctaggagctgttttggtgtgggcttgaggaagttttcatgttgtatctgtagcggtgggcttatcagcccctgaatttacagcaagtaacgtacaggtcaaattgctatagtaaattggtaccttttgggtgcatcctgaccttctccaggcaactggaggttgtttgtcacctgtcgtcactgcttaaacttnatctgaaatatttgtttctctacatgcctgtctgctgctactcctggttccaaggctaatccaggggtcaacggatgcaaggcaaagctcacttccagatcttttgcaagcctatccaaagctgtcagttctctgccttatgttcctgctgatgagaattgcatgcatgattcaagacggaggaaccttgcaaatgacccatcaaagttgagatttgatagggctgatgcctccaaaagaattcggcattatcgtggagcagaatatagaccttacatgattgcatggcctacaattgatgttactttaatcaatgcaaggtaatgttgtgcatggttgaacttttgagaaatgtttctgccaccaaaaaaacataaagtcaaccaatcaaataaaaaactgaagctgtcttttttagaagcagctacttttgtgtagtactattttaaagaggtggcataagaagttttaaatgatgtccctgcgaggacgattttctagctccaagttagtgttccaaactaatgttcatctggatgaagtaaaatgatttttcttctatacaattttgagaaaaaatgttacaatgtaatgttcaattgaatgctttgctagtgttggaacttagtgaaaacgagaatttagtagaca

SEQ ID NO: 22326 - DNA, 3894 bp, Zea mays
  misc_feature (1680)..(1680): n is a, c, g, or t
cgacaacaatgatcagttcgtcatcctccccaccgtcgggtagctttttgtgctagtctgtctttaattctcttcacaaacacacacaattgctttttttgtttgagcaagcgcgtatggtggtacgtgactgatgactgacgatgcacgagggaacttatttcggtagccgtggggcgtgctctccaatgatgagaccataaaaatcgtggcgtatatcgaagtcggcatgatactgatggttgcaatgtagtggtgaaacaactagattaaaacaataaaatttatgtatgaccacgattagaaatggattatgaaacattttctaatggcagtataacacacattttgtatataagttattgttgtattatatatactcgttgcaacgcacgggcactcacatagtactaacgaacaaggataaactactcgtgaaatagtcgaataaagacagataacagaaatatacacaaatataccctcggatttttgtcgcgtgttgggtggagcgagcagatgcaagacggcgaggggcccatgggccatgtccggccggcagcaggccgcggggagaggacgatcgagagaggtcacgaaccgggccgcgaagggcgcaggaacgcaggggggtcacatgaccgtcacgggcgcttgcccgcgggggggcgcgaatgaggcagcgagacgggggagtgacgtgaagccacggcgcgcgcccatgcggacgcggcatgcgcgccggggtccttctgcctcctgtcgcggggaacgtgcatgacgacccctgttcccgctgcgcgtgccgtgtccttttccgcgcctccggactcaggcggtggcccccactggcaccgccacctctgagctctgtcccgcgcgcgacccgcctcatcactcgtctcggtatccctgctgcccaatagcaatggcaaagaggggacgcagccggcagcctgccgctcgccgccgacgcgaccccacaacacaacgcggcgcccccgcgcgcgcgcactttcccgcacccaagggcatccaaggcagaaatggcgggaaacatgaccggccggccggacgaaatcatgcaatgcggtagggcctactactactactactcgctcggtacagactacagacacagtgtcctgcacgacgtagcgagcctgtgcccagcccagcccagcccagcccgtcgcaatgcactgtggtccgttctgtagccgcgtacagcaccgtaacgtacgcagcctgtccgtcgtgatcgcgaatccgcgtacagcccgcgcaagcaaactcacttccaacctccaaacgatgagctgccacgctccctgcttttacgatggaccacgccacagccgcgagttttccgttgcacgggccagtgaagattaatgccagtgttttttttactggtgggcagccggcagcggcgacccacctacccacccaccaccacaaccgtccaccgtgtcctgctgccttcacttcacttcacggagtgaagtgggtgcggcgacgcggcggtaaatgacgctcttcacgccgtgcgacaggacgaaaagggccatctttactttaccccacagtgtgctgtgcatcagctgtccgtgttcacttcactcaggatagtctccctttgacctttgtcatcgtccaaaaaccatagtatatgaacangggggtgatttgtaaatatcgaaacgaagggggggtctccagtgaacattcctcgtccgtttttgttaaagccttaataaaggcaggtgcagctcccggggaagaagccaagggggaagcgaaaccgaaagagaggcagagcttggcaatggagctcccgtggggaatgctgctgccgctgctgctggtcctctccgtctcgtccccgtcctcgtcgtcggctgctgccacgctcgccgtcaccgctccgcccccactgcctgttcctcctcctcgtcatgctcaagacgccgaaggtaacactgctggctgctgtgcttgcctctcattgatttcaccatcaccgcgctgttttttttctgtgccaatcttccatccactatcccattcctggtgctcggggtcatttcgtctggattctttttagatctgcatgctgttctgtcaagcgcagcgcagtgcgtttagagtagtagtccatgcttgatcgatctccgtggaggaaaacgaagaaacagcggcctcatttttattacccctacagatgtctgtcatccgtgcaggacagtgaatctggtctagtgctattcttttcatcactctgttacttttcaccgtccataatcagttcacatttgcggtttcctgtccaagaacgctgttgattatcttgttccagcaatgtcccgtcaaatgcgctgtaatagaatagtatacgcgtcggacagacatcaaaagctcagatttttgctgacgcacccgtggtggtggcacacgcgcaggcatgctcatcaacggcaacttcgagacggcgccgcggaggctgaacaagaccctcatcgtggggcgccactcgctgccggggtggacggtgcaggggcacgtggagtacgtctcgggcggtccccagcccgggggcatgttcttcgcggtgccgcacggcgtgcacgcgctgcgcctcggcagccgcgcgtcggcgtcgcagaacgtgacggtgcggccgggggcgctgtacgcgctcacgttcgcggcgacgcggacgtgcgcgcaggacgaggccctgcgcgtggcggtggcgccgtcgctctcggcgcccgccgacgtcgccgtgcgcacgctctacagcggcgcgtccgccgacacctgggcctggggcttccgcgcctcctcccccgtcgcgcaggtcacgttcgccaaccccggcgtgcaggaggaccccgcgtgcggcccgctgctggacgccgtcgccatcaaggagctgcccgcgccgtacccgaccaaaggtatcactgatggattcactacctttacctttctctttcggttcggggggcctgcagaacctaaatgacgaatctctctggccgcatgcagacaacctgatcaagaacgacggcttcgagatcggtccccaggtgcccgcgtccgccccgcgccccgtgctgctgccccccaagcagaaggacgcgacgtcgccgctgcccggctggatcatcgagtcgctcaaggcggtgcggtttattgacgcggcccacttctctgtccccgcggggcagtacgcggtggagctggtggccgggcgggagagcgccatcgcgcaggtcatccgcaccgtgcccaaccgcgcctacaacctgtcgttcgccgtcggcgacgcccggaacggctgccacggctctatgctggtggaggcgttcgcgggcaacgtcacgcagaaggtgccgttcgattccacggggaaaggcgggttcaagacggcggcgttcaggttcgtggccggcggcgtccgcacccgcctcaccttctacagctcctactaccacaccaaggtcaccgacggcgtctcgctctgcggccccgtgctggaccaggtcaaggttgtgcctgtcaaggcgtagtgaaatgaatcgtgagagcgccgagtgacggtctgctctgctcgtcgtctgtagctgtgctcgtcgtgatttggcgtggtgggttgtgaaagtgtggtcgaattctggacccttcggaatctgatcgtggtgtgctgtgcggtgcgatgtgctgtagcgaaatttggttgctatctcttgttcactccacgtttggaatttgcgttttcaatccggtattgaaggtataataattaactgctagtacggtgactggaacctaactagtctttaagatgttaaaatttatacgaaacatatatacaaaatgataaat

SEQ ID NO: 22327 - DNA, 1517 bp, Zea mays
  misc_feature (7)..(7): n is a, c, g, or t
gggaggnagctccccggcgtccccgccttctactcctctcggctcgttgagattacattcagattcggatttttgccacaccctcggcaagatagagaatctggagcactcttgaatgctaatcagacaccctgcccatttctttctctgtcttagacacaaggccttctcatggccagagacttgcctcatctgcccgtaactagacggaaaatcctgcaattcaagttcctcctcctcgtcatgctcaagacgccgaaggcatgctcatcaacggcaacttcgagacggcgccgcggaggctgaacaagaccctcatcgtggggcgccactcgctgccggggtggacggtgcaggggcacgtggagtacgtctcgggcggtccccagcccgggggcatgttcttcgcggtgccgcacggcgtgcacgcgctgcgcctcggcagccgcgcgtcggcgtcgcagaacgtgacggtgcggccgggggcgctgtacgcgctcacgttcgcggcgacgcggacgtgcgcgcaggacgaggccctgcgcgtggcggtggcgccgtcgctctcggcgcccgccgacgtcgccgtgcgcacgctctacagcggcgcgtccgccgacacctgggcctggggcttccgcgcctcctcccccgtcgcgcaggtcacgttcgccaaccccggcgtgcaggaggaccccgcgtgcggcccgctgctggacgccgtcgccatcaaggagctgcccgcgccgtacccgaccaaagacaacctgatcaagaacgacggcttcgagatcggtccccaggtgctcaggaactcgacggtcggcgtgctgctgccccccaagcagaaggacgcgacgtcgccgctgcccggctggatcatcgagtcgctcaaggcggtgcggttcatcgacgcggcccacttctctgtccccgcggggcagtacgcggtggagctggtggccgggcgggagagcgccatcgcgcaggtcatccgcaccgtgcccaaccgcgcctacaacctgtcgttcgccgtcggcgacgcccggaacggctgccacggctctatgctggtggaggcgttcgcgggcaacgtcacgcagaaggtgccgttcgattccgccgggaaaggcgggttcaagacggcggcgttcaggttcgtggccggcggcgtccgcacccgcctcaccttctacagctcctactaccacaccaaggtcaccgacggcgtctcgctctgcggccccgtgctggaccaggtcaaggttgtgcctgtcaaggcgtagtgaaatgaatcgtgagagcgccgagtgacggtctgctctgctcgtcgtctgtagctgtgctcgtcgtgatttggcgtggtgggttgtgaaagtgtggtcgaattctggacccttcggaatctgatcgtggtgtgctgtgcggtgcgatgtgctgtagcgaaatttggttgctatctcttgttcactccacgtttgggatttgcgttttcaatccggtattgaagttataat

SEQ ID NO: 22328 - DNA, 1588 bp, Zea mays
attcctcgtccgtttttggcacgagcccattacctacagctgcctcctcgagggaagaagccaagggggaagcgaaaccgaaagcgagcagagtttggcaatggagctcccgtggggaatgctgctgccgctgctgctggtcctctccgtctcgtcctcgtcatcgtcgtcggctgctgccacgctcgccgtcagcgctccgcccccactgcttgttcctcctcctcgtcatgctcaagacgccgaaggcatgctcatcaacggcaacttcgagacggcgccgcggaggctgaacaagaccctcatcgtggggcgccactcgctgccggggtggacggtgcaggggcacgtggagtacgtctcgggcggtccccagcccgggggcatgttcttcgcggtgccgcacggcgtgcacgcgctgcgcctcggcagccgcgcgtcggcgtcgcagaacgtgacggtgcggccgggggcgctgtacgcgctcacgttcgcggcgacgcggacgtgcgcgcaggacgaggccctgcgcgtggcggtggcgccgtcgctctcggcgcccgccgacgtcgccgtgcgcacgctctacagcggcgcgtccgccgacacctgggcctggggcttccgcgcctcctcccccgtcgcgcaggtcacgttcgccaaccccggcgtgcaggaggaccccgcgtgcggcccgctgctggacgctgtcgccatcaaggagctgcccgcgccgtacccgaccaaagacaacctgatcaagaacgacggcttcgagatcggtccccaggtgctcaggaactcgacggtcggcgttctgctgccccccaagcagaaggacgcgacgtcgccgctgcccggctggatcatcgagtcgctcaaggcggtgcggttcatcgacgcggcccacttctctgtccccgcggggcagtacgcggtggagctggtggccgggcgggagagcgccatcgcgcaggtcatccgcaccgtgcccaaccgcgcctacaacctgtcgttcgccgtcggcgacgcccggaacggctgccacggctctatgctggtggaggcgttcgcgggcaacgtcacgcagaaggtgccgttcgattccacggggaaaggcgggtttaagacggcggcgttcaggttcgtggccagcggcgtccgcacccgcctcaccttctacagctcctactaccacaccaaggtcaccgacggcgtctcgctctgcggccccgtgctggaccaggtcaaggttgtgcctgtcaaggcgtagtgaaatgtagtgaaatgaatcgtgagagcgccgagtgacggtcgagtgacggtctgctctgctctgctctgctcgtcgtctgtagctgtgctcgtcgtgatttggcgtggtgggttgtgaaagtgtggacgaattatggacccttcggaatctgatcgtggtgtgctgtgcggtgcgatgtgctgtagcgaaatttggttactcatctcttgttctctccgcgtttggaatttgcgttttccaatccggtattgaatgtataataattaactacaaaaaaaaaaaaaaaaaaactcgcgcccggggccccggtac

SEQ ID NO: 22329 - DNA, 1451 bp, Zea mays
  misc_feature (12)..(12): n is a, c, g, or t
  misc_feature (17)..(18): n is a, c, g, or t
tacctcgaggcncggcnncgggaaaaaaaattcattgggtacctcgaggccggccggcaagggggaagcgaaaccgaaagagaggcagagcttggcaatggagctcccgtggggaatgctgctgccgctgctgctggtcctctccgtctcgtccccgtcctcgtcgtcggctgctgccacgctcgccgtcaccgctccgcccccactgcctgttcctcctcctcgtcatgctcaagacgccgaaggcatgctcatcaacggcaacttcgagacggcgccgcggaggctgaacaagaccctcatcgtggggcgccactcgctgccggggtggacggtgcagggccacgtggagtacgtctcgggcggtccccagcccgggggcatgttcttcgcggtgccgcacggcgtgcacgcgctgcgcctcggcagccgcgcgtcggcgtcgcagaacgtgacggtgcggccgggggcgctgtacgcgctcacgttcgcggcgacgcggacgtgcgcgcaggacgaggccctgcgcgtggcggtggcgccgtcgctctcggcgcccgccgacgtcgccgtgcgcacgctctacagcggcgcgtccgccgacacctgggcctggggcttccgcgcctcctcccccgtcgcgcaggtcacgttcgccaaccccggcgtgcaggaggaccccgcgtgcggcccgctgctggacgccgtcgccatcaaggagctgcccgcgccgtacccgaccaaagacaacctgatcaagaacgacggcttcgagatcggtccccaggtgctcaggaactcgacggtcggcgtgctgctgccccccaagcagaaggacgcgacgtcgccgctgcccggctggatcatcgagtcgctcaaggcggtgcggttcatcgacgcggcccacttctctgtccccgcggggcagtacgcggtggagctggtggccgggcgggagagcgccatcgcgcaggtcatccgcaccgtgcccaaccgcgcctacaacctgtcgttcgccgtcggcgacgcccggaacggctgccacggctccatgctggtggaggcgttcgcgggcaacgtcacgcagaaggtgccgttcgattccgccgggaaaggcgggttcaagacggcggcgttcaggttcgtggccggcggcgtccgcacccgcctcaccttctacagctcctactaccacaccaaggtcaccgacggcgtctcgctctgcggccccgtgctggaccaggtcaaggttgtgcctgtcaaggcgtagtgaaatgaatcgtgagagcgccgagtgacggtctgctctgctcgtcgtctgtagctgtgctcgtcgtgatttggcgtggtgggttgtgaaagtgtggtcgaattctggacccttcggaatctgatcgtggtgtgctgtgcggtgcgttgtgctcgccccgtattttggctgctgtctcttg

SEQ ID NO: 22330 - DNA, 2191 bp, Zea mays
cttttaatggtatggatccaaatttccctagaaacattcatcttctaaattattaggccaagacaacacatttttttttttttttttgggtcaagacaagatcaatcattaccccagtgcagcatatggactagttttgccatcctatggaaaacaaacttttaagacgattgttagatatcctctgcaaagccttctttgcaccaggcacatcagcatcagccagcttctgtagatgctgacaagaaccagcatcaacaagtcgtcgtcgtgtcccgttcccgccacccatggcaagaactagaaagatcgagagtggatacttcttatcagtctcctgaaaccggggatcaagcatccgcacaaatattgttaaactcttctcatccctgacaaaacccttcctattagacttcaaggtaaacagagcaagcagtgcacgaccagctgactcctgtattgttgctggcttagccacctcgatcagcttaatcagtgtaccaatgcatggtgccatgcacctctttgtgtcatcgctcacagtaggtgcaagatcagcaatcatatcagcagccatttgttgcaacaggaagctaccagagctgcatatgaggtctgtaagtcgtgcaaagaacagtggcgatgaacaaaggattctggtggcagcaggggctgatgtaagtgcgtgtatagcacgcagtacagaatcatggaggtcctgatcagaggcgatatgcagtgcttgtaggagtggcgacaatgcacctgcttgcacaatctggttctgtgtcttatggtctcccatcgaagcaagtgaccagaggcagagagcagcactcttctgcgtctcagcagtgccactggcaagcaggtcaacaagaacaggcaaaccactctcctccaccagagtggagcgcacatcatcgactgaagaaacattcttaattgccgccacggcaaatgcctgcaatgcgggggatccagacccaggacggcaagcattaatcaagatgggcaatccaccataagccgatagagcccacgcgctgccggcatcaccagtgatggccacaatggccgcagcagaccgctcacgcgtggcgggcggtgagcctgagtcgagcacgcgcagaagtgggccgagtccgccttcgtcgaagaccaccctccgggacgcagcgcaggcggtcgcaaggtgggccacggccgtgaccgcacggtcccgcagcgccgagtgggacgacgcgtcaagcaaacggagcagcgccgcaacgtccccttcggtggcgacgatctgcgcggcctccgcagtagggtcgtcacccagcaggtcgagcagcgacactagcgcctttagcttcaggtccagcgacccgatctggaggcgggcaaaggcgtcacggacgaagagggacttgtctgcgtgcggagccgccgacgcaggcacctgcagtacgatgtcagtgggaatggacagctcggagtcgacggagagcagccccgagcgaaggagcagcgagaggtcgtgcaggaggagcgagagcgaggaggccaccatgtcaaggtcgctctgtagccgcagccgccccccggggagcccagggtcctggcaccggacagagagcgcgtggagggaacggagggctgggagaagcgcggccaccaggtcggcgaagagcgggtgggacggggcggaggcgggcgcggagacgagcgaggactgcaacgcgaggagggaggcctggagcgcgcgccaccgcgagtggagcgccctgaccgacgccgcggccagcagaaccgaaggcaggaggtcctgcaggatctgcgcaagcgcgtccgcggcggatgccggtgccgccggcgtcatgggcgatggcggcgggaagcaggagcggacgagtggggaaagcagagggagaaaacactacacatcacatggagcgcggggtgggtctgcagcaacgcacggacccccgccgggtccccaggtacccaagctgtaaagcggggcgagagctggcatgccggacgatggctttgtacggcagtgacataactgctcagctttatggggcccgcaaacggggcaggcctccatggcttctagaaacactatagcattggctatatgcagatattttctctctctctatattccacacttttatgtcacttcagttagatttcaccc

SEQ ID NO: 22331 - DNA, 2285 bp, Zea mays
ggccgcttttttttttttttggcccgcgtacagatatataacattagcaagccagacaattacacgaaacataggcttaactgttattatacaggcaaagcaaaaggaataatttcattcccattgaatcagatcagaagccggagcacaaccctgtttgtcagttttgccaaagcccgaccggaattacaaacaggacaggggcagagcaagaaaaggagtgctccaaatcaatggcatctaagtaaaaaggctatcttcctttcctttctgcttctatgtaccctaaacgactttaaacctaaaactcaaccctaactctcctcgtgtcagctgctacccgctataggtttccctagaatgtacaaaagcaccaagaccagtcatcatacttggaccctctgccttgtcacacggccacccccactgaagtcaagcactcttgggcccccggtccagtcgtcatcatcggagtcgtcggagtcgtcgccacgtgcgccaccacgggcttttgtaacactcgaggcagccgttctcctgaccctcgtcgtacttcttggggttgggtttgtcgtatttctcggggttgggcgcttcctaatctggactgaagggatgaacacagcaaagtccatggaatcttcgtggagcactgtcttgaaatcctggtaaacagaagctacgtcctgcaggcagctcggcagactgatgttagtgctgctaacattaaaaggaatattctgcctggagaatgtttctccagatttcggaggctcctttagagaaaatgactgacagcgggcatcatctaaactatagacaactttcaaatgtctcttcaatttcagcagtagctgaagggctattgcatcaaggcaatctccctgcactttggccatatccacgtcaacctgcactttggccatgtccacgtctgaagtactgcaaggattggcattcaccctttcatgggcatagcccacgttatcataatatccgccaggctcttgcatgacaacatgcctctctcctggcaacgttggcatatccactgtattttgagactgagacatagaagtccaccttttcaaattgctctcaactcctccagctttaaggtgaataattcgatttatatcatagatcaagtaaagtggttcatcggagcatgtgaaaggcagggaggcaagaacttcggcacagtatacaagaaagctaactgtgctgcgactccggctatcagactcgaatttccgaactatcgagtggacaaatttgtttctggaatttcgatttgaacggataagacggtatattctagatatgccaggtttgacaaatgcaattggatttgattttatgtttgctgccatcttatggttgctgactatggattcaaagaatttaaatgacatttgtagtccatcacccaaacggctttcaaaaaataaagggtacctcgcccgcatattcatcagcagatgatgagccaactttgagttcccctccagtgggtccatttcaagtgctataaggtgaggaacacaggtaatagggtggactaaaccctggcggagtacaacttcaacaatcttaagtgcactctggcgaacttgatcatttgtatccaagcacctttcaagaatagaactccaatacaattgaataataccaccacatatgttggtgtctccagcaccagcagcaacaggcactttacttctgccatttatttcacaccggacaggaggtttcacagtgctctcggcagtaagttggctttcagcatctctgagatactcatagaggttttgaagtccttgaatctttaatctataatcaacctcagaagagagtgctgtctctatgagtttcaacatatccttttgtagcataaattcaggcttcgcaataagtatgtatcccaaagtctgcaaagctcgaaccttcaagctaaaatcatccctgagaagatattttctctggagcaagttgataatcttgggaaaatcaagctgattttcagatgtttgcatcaattgataaccataccgaaggaggagtccaagacaaaacagtgatcgacccaataactgactatctgaattagctccagacagatgcttgtagaaaatattgacaaggttttccactaatcctggacctctccctgctgactcgctcagagcacaaaggcacttgatacaggcatgtacaactgcccccgccgccgcgcgaactatcatatgattcagatctttctcaagttcttcaacaacattttg

SEQ ID NO: 22332 - DNA, 3746 bp, Zea mays
  misc_feature (1392)..(1392): n is a, c, g, or t
tgcgcattaatgcccctactctcccacgaatctcatagaggaccatgcgaagcactgtttcaaccactccgactcgacaattccgcacccctgtcaagctggggctcggacacatgcccatgctcccgagcctagcctcgactctctaccccatcacggagcatgcaatagggatcgagcgtccttctcctgacaaaaagtcaacacaaggacagggccatctcgccggccatgccgctacaggtctcagacacaagggcaagaatcatcccgtcggcgatgcctctaaaaggataggacacatctcctctgaccacaacaacaacgcaacaatccttgtacacctgggccccctccttgtgactataaaaggaggagcctggggccttctagggagggcgatttcatggctcacaactcaccttactgctgatattggcactcaccttaatcatattcagagacttgggacacattccctctctcaactcgcttgtatcccctactatcagcacttaggtgcaagataatacaagcttccctcctccgctggatgtagggcattctcttacccgaaccaagataaatcttgtgtgtcttcttgcatcaaccatccgggacaagggcacgcgacacaaatttactagttggttaggacccttggtttccaaaacatcggacagcagggttgctcggcagagagttggtcgcctgctcgtcctcgtagggtttctagatagagacttggtcagctgctcggcctcacatgtttactcggcagagacttggtcgacaagtggaccgttaagagtcttggtcctactttgggcacttggttcctaggtacccaacaagtatattatcacaggtctataaaaagtaattcaagaaaatgaattcacaacttagtatgcgcggaccgtcggatcccatgtcacggatcgtccagggcaccaaagttagattcaatcaggaactgtatcaaattatagatataaactactgactgtctgaaggaaaagtaagtaccatccaacactctgctcggaccgtccggcaacaatgctcggaccgaccgacaacaatgcgtgggccaacacctattcaaagtcatatcaacccgaaggtgccaaatatgctaaaatgattttagtgccaagtgcggaccattcgagcctactagcggaccatccaagcctaccatcggaccatccgcaatacactatccaacatctgacaacacatttaatgtgattatagttgttacaaataactgttgcaatctagtcgttgatcttgtaggagcggaccgtttgcaagtgggcagagcgagagtaacaactaggtggtggttataaataccactccaaccacctccattcaatgacatcnaagtgattcaagcaacacaagcactcatattcgttgcaagagcaagaacttccattcaatgacatccaagtgattcaagcaacacaagtactcatattcgttgcaagagcaatagcttccattctaagtcacacttaaagcaacagagatccttcaagtgccacaattaagaaaatgatcaactagagaatagtgccttgagagagacattggagaagagtgtcattgagtttcttgtgctcttgtcgatcttgtgtcaaagatcaactatttgattttattttcaaagccagcctgaattaaagaatagacaagagagaccaacccgagttaaagaacaagttccgcaccatcaattgctcttaaagtcttatgtcaaaattccccttataaacatacttggtgtatcaacactcttatatatctacattataaatttaaaaattaacttgttgaaaagggttattagttttaatttggtcctctaaataatggattaatcagggaccctttcataggtaatttcatgctgggccagtccacctaaaataaaatccatacatacatatatttgtcgcgtccgccttttaactactagtagtagcttttaagaggcccaggcgccggcccaggagacgatgagatggcgggagaagtggcggcaaaatccggtgccggggcaggagacggtgaagaggctgaagcgggtgccggtgaagaagccgaagcgggtgccggtgccgatgcagaagaaatcttgcagtgtgcgatgttgtcgtggccacactggaggcggccattggcgatgtcggtggccaggggagctccgccgccgttgctcctctatgcattcatttcaatcatgtcggatggttcaagtttgttcatgcatgcacgcacgctaataaacatgtagtaccatgtagaaatcgacggcgatgtagtttggccatcgtttggcggaggcgtggtagcaggcgttaagcctgctgatgagcggcgcggagttgttgctgcaggcccagctttggctcgggttgctggtgaagaagttcagcagcactagtgactgggccttagagtccatgggcttcgactcggtccgctttgggcaactgccatccgccatgccctcgctcccgtctgagcatgtgtgcatgctcacaagaagaagaagatgacgaccacaaaaaagaaggaaaaatacaatacatacgtacattgggtttccacgacgtagtcccactggtacgcgagcccctccgtcccctgcttccctttcttggatgtgaacacgatgagccggtggttatcggcgatcatgtccctgagcagcggccagtcaccgccgcccttactagggctaggcatttgagcctcggggaaccagtacttggacagtccggcggcattgaaggtgttgctgagtgaccctggcgccgcgtagtcctcgaggaagacggtgaccacctcggacgggttggcgtccaggaacacccggacctccgtaagcacgctcagcgccggcacgtaggctgtgaaggtcaggcaacgaccatggaaggagtggcagaaccacacagcgtcgttgaagtcgtaggcatccagcatcaggccccgcacgccgttcttcagctggtcggtcaccgagtcctcctggttgggcggagagatgatggcagaccccagcggcgacttggtgcctaccaccgcaaacgagttgtgcgtcgtcagccatgagtacctgttgaaggggagacccgtgccgtgtgtctttgggtccacgggcgtggtccgcgcgcacgcggccggacccgtccccggtggaggcacgcaggtggtgcaacgaagccccttgccgcagccgcctccgtccgaggtggacgatgacgctctgcacgagtcacccactagcgcggcgccggacgtcgtgccgaataaggcggagaaggcgacgacaatggccgttccgagcaccaggacgaagcaacgccgctggcggatcgtggccacgacggccattgtctagctatcgcgtcccgttccgccctatgcctacgcccgatatgatcgagggaaggaaggtcgtggacaagctttcctgttgtggcaggtacggcgtgcgttggaccggagggacgcccacgacccaccccggccggggtgcctcgctcctcccccgccggcgcacacgatgataccatgcacgacagctgcccgccaacaatagaaagatgtccaccttcgttggaggctttcgcgcgccgacaccaccattattgtcgttgttgccagcatcaccaacaccctagagcccacacttagattatctcaaaaaagaaacgctaaatgag

SEQ ID NO: 22333 - DNA, 2138 bp, Zea mays
ggagtgatgcagccgagggggccagaccagaggaagggacggcggggaggtggcaaggcgcagagagcaggttcgtttggcggacgcaccgagggaggcgtgtgggagccatgcttcttccctcttcgtcttccgcttccgcttccgcttccgcttccgcttccaaaggtaactcctttgggaaaaccgttaacgatcatctgaggtcaactttgagttttgataacaagcaacctccatttgcaagtcaaaactttgactacggtcaaacaatagcttgcatttcatacccgtacaatcgttctagatcaggagatgtttgggcagcctatgagtcacgcaccagcactgccactgtgttccgttcccaaattgctggtgggggttcatccacaagaattcccttgcctttggaattagcagagaatgaacccatatatgttaatcccaaacaatatcacgggatacttcgcagaagacagttacgtgccaagttagaggctcagaacaagctagtcagagcccgaaagccttaccttcatgagtctaggcatcttcatgcaatgaagagggcacgaggttccggtggacgattcctcaacactaagcagctccagcagtctcacactgccctcaccaggtccaccaccacaagtggcacaagctcctcaggctcaactcatctgcggcttggtggtggcgcagccgcagctggagatcgatctgtgctggcacccaaaacaatggcctcacaagacagtagcaagaaggccgtttcttcagccctcgccttcactgcgactccaatgctgcgcagagatgacggcttcttgcagcacccaagccatcttttcagtttttctggtcattttgggcaggcaagcgcgcaagctggcgtccataatggaagtcagcatagggttccagttatgagatgaccggtttgcgaaccatagctggtgatccaggcgtctagggtcaacttcgctgtggtgtcttagtctctcaggcaattcatccttggcttaatttctggctttttattagaaggtaccaaaatgtgttccataccgttgtggccacagagcccataaaccagggggtttgatggttggcactcctacccaaactattgttgcagtggtgtttgttagaataaaccttgactattattctgtacaatttgcctttatcttgtactgccaattattgtgtagtggtcacctgtccagtttatggcctcaagactagtctaccctgtttgtcacaacatctgccctgaaaaatcatactgcagcgggacccgtgtggtccgtcccagctgtgatcttcctaatttttagccgtacaaaccagaatgcagcaacttcagaccatggatatgaatttcataatttgcttgccaagcataagaaaataggaatactgcttgtttacataaagattggtcccataggctcacagaagacaaaacaacgttttgtcggcgctgcctacgaaaccggcctagccaggtttggacctgtagtcctgtactcatttagtattgtgtgcaatggtccacctcgtgccttctgtcgaggcgcaacccagctgcctcaaagtgttggtctgttactatagtgctactcgtgtttccttattaaaattcagtaatccatatccatctattcacaaatataaaggaaaatttgtccataaatataaggaactttacatattttgtcatttgatattattaacttgccgccaaatcttaaccttctatttaatcttcttattaggttactccctttgtaaaaaaaatgtgccaccatacaacaacttgatacgtgtggttgtagctatgggtgcaacttggtgaacaacttatagacttcagccctgttttttttcggattataatctctatagattatataatccagcgcaaataatctaacaggtaaacaaacatctagattatgggttcagagtatataatctaaagtctagtttgtgataatctcataatctcctcaagagtagcttttttgagattattttagtaaaagacccactacccatgtttatgtaaatagaaattacaatatatgtcatccttctttcctcacctcaaataaatactcaaaaaagac

SEQ ID NO: 22334 - DNA, 1201 bp, Zea mays
attgggtacctcgaggccggccgggacaagatgagggataaaagaacagcgcaagtggagtgatgcagccgagggggccagaccagaggaagggacggcggggaggtggcaaggcgcagagagcaggttcgcttggcggacgcaccgagggaggcgtgtgggagccatgcttcttccctcttcgtcttcgtcttccgcttccgcttccaaaggtaactcctttgggaaaaccgttaacgatcatctgaggtcaactttgagttttgataacaagcaacctccatttgcaagtcaaaactttgactacggtcaaacaatagcttgcatttcatacccgtacaatcgttctagatcaggagatgtttgggcagcctatgagtcacgcaccagcactgccactgtgttccgttcccaaattgctggtgggggtacatccacaagaattcccttgcctttggaattagcagagaatgaacccatatatgtgaatcccaaacaatatcacgggatacttcgcagaagacagttacgtgccaagctagaggctcagaacaagctagtcagagcccgaaagccttaccttcatgagtctaggcatcttcatgcaatgaagagggcacgaggttccggtggacgattcctcaacactaagcagctccagcagtctcacactgccctcaccaggtccaccaccacaagtggcacaagctcctcaggctcaactcatctgcggcttggtggtggcgcagccgcagctggagatcgatctgtgctggcacccaaaacaatggcctcacaagacagaagcaagaaggccgtttcttcagccctcgccttcactgcgactccaatgctgcgcagagatgacggctttcttgcagcaccccaaccatctttttccagttttttctggcctttttgggcagggaagcgcgcaagctggcgtcccataatggaagtcagcataagggttccgttattgaaatgacccggtttgccaaccataccttggggattccaggcgtctaaggggccacttttccttggggggggcttaagttccctccagggaatttcttcccttgggttttaattttcctggggttttttattttaaaaggggaaccacaaaagtgtgtttcccttaacccgttgtgggggccccccaaacaccccctttaaaacccctggggggggtttt

SEQ ID NO: 22335 - DNA, 588 bp, Zea mays
gtataagaacccattcgggtcccctcttttttttcatttttttgacttcatgcacgccgtgatatatatgatgttttacttgatgcatggcatggggaagctgatgaactaacgtaacaagctagccatcagatcgactgaggccaccgtacgtgatctcagttgctgccggcgatgacatccctgaaccagtacgccgagctcttggggtagcgccggagcgtcctgaagtcgacgtagacgaggccgaaccgggacgtgtaccccagcttccactcgaagttgtcgagcaacgaccaggcgaagtatcccacgcagttggcgccgccgtcgatcgccgccttcagctcggcgacgtagctccggtagtaggccaccctcgccgcgtcgcgcacgccctgggccaccgtgacgttgcccgggtcgtccataccgttctctgacaggagcatcgtggggttgccgtacttctccttgacgtaggtgacggctttgtacagtccccaaggcacgatgtagagccagtctgagttcgcccttggtccaatcggcacaccgtcgcgttcatagacgaacttagggggccag

SEQ ID NO: 22336 - DNA, 1412 bp, Zea mays
gcagagaagaaggattgcagaaatatattaagcataagtttagggacaatctgtagcaagggtagccggagcagggtggaggctgagcggcactcgccttgctcccgcacctaaggcgagtgggagaagctgctggcatattgaattacaatctgcttattacccgttgagaagaataaacagctaaaagagtagaacaaatgatggctgctatgcaagttcaagtactgatgatcaaatattaactcaacaataaagatgaaatattaaaaggtaaagtacctcatattgaagtgaacataaattaaggatggtagtacaaaacacattcaccaaacaccttgtaaaaagagtgagtctaggctcctgccggattggcattttcttctacatcaagcaccacaacagctttctttagaagagcctcaacaggcaggtgtgagttttcaacagacttggatattgcttgccatttttcaccatgctttggttctgctgcaacacatcttttcagaacatccttctgtgtgtccacatttccatgctgaagttcaaatttgtagtacaatgcccaaaaatcaccaacatcaggagcaagagtaacagctctgttcaaccaactcctagctttatcgaccttcctgtcaagccagaaaagtttggccacagttgcaatgacatgtggatcatgatcacttcgcttaatagcatctgtactctttcctttgcgctgtgggcgtggcgccatctcaatagcggcagcccacaaaataccacttgtgggacactcttgtaatgccttggccagtagagcatcagcttcctttttgttcccattcctcaactcagctcgaattgccgctagccagagttcaggtgtagcagggttcttctttctagccattgtgaggacagcacgtgatttactcaatccactaatcttctcctctaggttagctagagagagccaaagagggatgcaactggggcagtgcttgaggccattctcaaaaacctccttggccttcgctccgttatcaagccggtcctccatctgtccaagcattaaccacaatttgaagaatgaagggaatagcttcaaaccttcctccaacaatctcctttcctcaccaacattccccaattccctctcaacaatggcagatttcatccagaccctctctgtccctcctctttccctggccttggccaagagcattcttgctctctctggctcattgttctcaaactcgagcttgaatgcggccagccagatctcctctgaattggggatagcagcataagcttcctgaagaatggcacgagcagcaggcacgtccccagccaaccatttctccccggcagccataagccatacccacgcgtccgcggagcgtgggtagaccggggtt

SEQ ID NO: 22337 - DNA, 1762 bp, Zea mays
  misc_feature (5)..(6): n is a, c, g, or t
  misc_feature (15)..(16): n is a, c, g, or t
acacnncttcttaannaaatgcgaaaaccattatatttacttgtctctgcaatcatgttgatgacaatgtcatgccttttcctcatgggtactgtgtcttacctatttaagggacgatctctgagtctccccgcgccccattcagagtcatatttggatcaacgctggcaccttgatgaggttctcgttcttgctgggatgtttctctatgtcatcagtcttggctcaagttcttttgtggaagaagagcagtatacatggcacttcctcacttctactctgtatctaatatttctggccaaggcagttcagtcaatgctaaaaggatcaaatccaacacttggtcataaagcagaaggaaatagctttgacagaagtagctttttctatgctacaagctatgaattaacaccaggcaagagaaatggttacaagttatgtactatccttgttgttcttgttgctggaagagttataagagcttggcatcaaggtggaatcaactgggttcactttcctgatatttccaagttactggcgcaagctgacccttctgttgtaaagtctcttcagattatctcagttcttgcagttgtggtattgttttcaatttcactcactttactcagagcaagaccagagtttgttataggagtatggttgacccacatttcttgtggatttttggtcctactgcatgtttggggaaatcatattggtacttcattaccaattaaccataccacagcatcggtagctcgacaattttatgtcattgctagtgtttcagtatctgtcactgttcttgcttcaccttgggtatttccaatattttctacggaagcaaaatcagcatcctctggttctagtcctgtcaaggcaatacatggcatcagaaaatcacttgttctcactggaatgacatacacagcgttctggggccttctgcaattgcttcttcaacaaccaatcaatgcaattcctcttttcctcattttcttgcaaacagtctcgagtgcagttcatttttctctggacaaaacattacataaacaatgggtacaggttgtggcaatgcatttcttgggaatggctggtcacttcggtcttgggaatacaaatagccttgccagcattgatgttgcgggagctttcattggcatttcaagttactccacagttctttctggtatactgatgtttatgataacatatgcatcacctctcatgttataccttgggttggtccttcatgcatcggtgaaagatgtcgatgatgcctccaatctacggcagctgaaatggagctatattctagacaaaattgtcacattgccatgtttgtttcctttgctcatcaattctcttgcgttgacttcatacaccattgttttgctagccatgaggaatcacttatttgtttggagcgtattctcaccaaagtacctctatgcctgcgcagcaacagtgtgcacatatgtcggagtatccatcatagctatgactgcattatacagttgtgctgttttcaagttcagggcgagaagctacagggataaatccctgtaatcagactaatgattagctgttctgatttaatggacatttgtaagaattcagaaagggagggtatcttggcctattctctcgttgtacaacatcgtactcacatgtttccagaccatgcaatccctgcaagggcctttacacatttccaaaaagaatgaaaaaaccctgacgttacccaaccttaaaaagcctt

SEQ ID NO: 22338 - DNA, 4465 bp, Zea mays
ataggctaacatttgggttcatatgtgaagcaggaagtccgccgtgggcgtttgccataaacttttaaaaattgtatcttctttttgacgaggggaggcgtgtgccagagcgagctcgcagtcgccgtccactccgttgagctttttctcaggcttcgcatggcctgattcatcctacagtctccaacaagccaaggaaacgccgcaccgcgctttctccgcttccttccactcagagggtctgaccccaacgccgggagaataggggattaggagccagacctggcggcgccgggcgtccaagaaacgctgcctaataaaatccctccggcgtctgtcgtcttgaccgcggcgacgcaggcttcttcttttcgctctccacggcagcgtcatgaagattaaggggaacttgcatgtttgatgtacctctgtagcaaaaaattcttgtgataaaatttgttgaattagtcactgtcagggagggatctagttgtcagttgtttgtaaagctgctggcactttccttgcagggtatctgtagaataaatgggagaagcacacttggatgaatgttgtcattgccaggggtgtgctggcaagtatacactactcagagatgaagaaaacccacggtggacaatctttgagaggcggcttccttgctgtggttgtgggataggatggtcttcttttcttttagggttcttgtgtcctttgatttggtactttgcagccactctttactgctgtaagtactacaacaaggatcctcgagagcgccctgggctagctgcatcagctgttgcggcactcatcttcacagtcctagcactcatcgctctctctgtggcactgataatctatatataaaacgaggaatgaacttgcgcttgcttgaaatgcgtactcaggcactcatcttcacagccctggcaaccatacatcgctctctgtggcacagatcatctgaaacccaaagcgaggaaaacgcggtagctggacttggcattcagaaggaacttgtaatttcagtgatagtagcatatcgttgcaatcatccttcatgtatcgccatatcaagttgttgatttaaatgctgcaaccgtccctgttgtcggttgacctgtcggctgctgttgtctatcaacgaggatgatcattgctctatcgcaaactgtgtgctccgtgatctgtgatgcttctaaactaaaaaaaaaaaaaaaacctttagggctcattttacagagctccccttcatgattctctaacataagtgaatctatctaacaaaaaccgtttgataaatagtcgtgaattgatttctgaggggttggagaatagggtgcaggttgggagcggcgagaagcagaatttttttagctctcacattttaatataaaacaaagactagaatttacttcgctctcaccgtggaacagtacgattttttttgtgaatttacttcgctctcaccgtagaacagtacgatttttttgtcgtttagctgtgcaaagagagcggaggtataagactggccgcaacggacgcggcgcgacgccccctccccttgccctgtagctcggctaccgggcgcctcccaacgccgcagcggtggacgctagccagcgctctacgaagaggtaacgttctctctccccctcgttctggcgttatctctctcccccctctaaacactgttcacgtgggcccgctttcaattgttagtagataaaaaatttatagtagatgaaaagtatgtataaaaaatgatattttatagtgtagtgggatatagagggaatatttagagggaaccgctgcgggagatgaaaaaatagggggttgaatgttgatgatgtgacccaaaaaagtgatatagggggaaaaatttagggggaacggttgcggatagcctaagagctctgccatatgacgcaaaggataacacaagtacacagcgccgcatgaggcagctactgtcacctccatcagcgacaatctttcaattgactcttatccacgtttatctacttcaaccgttcaacattccaaatatacagtctttaaatttaccctcactttacagctatccgctatatgatcctttttttatggactccccgttgatatgaaacacgtcgttttattaaaataaaacaaatcttattacataaataaatacataaaattacatgattcataataaaaatacaaaaatattacttagatataaaaataaaattacacaattcataaatataaactaataaactattactcctcttcgtcgtattgtcttcatctcttttgttgtttccttcctttgtcaacgctttcaccgttaatttatggatctttttcgtgtcttcgtttatattggaagtgtaacgatccagcaatttattaaattgatcaaataacttagtttaatcaatcattccacacaacaactatttttgtccatttcacgtttagtaattaccttttactcctaatgagatgcagttaagttgacctgaattggtacatacaattgccgttaaagggccaggtagccgtttgatgtagtcagtactctgcttgacgctcaagttggcactttattgtggatgagaacataatatttctgaaagcctaaaacataagctcaacttgtgtcctgtgcgaacactcaaaaaatctggtattctgaaatgcagacgcagaattcataatgcaaattttgtggcggtgtagtgtagtacgtcccatcgcagttatgctatctgcttgctcgaatgataccgacacgccttggtttcctagctatagacacattggctacaaagtgagcctcatatcaaactctcaaagaattatggtgcacaaaaaaagtcatcaattttccaatagaatttagaaaacattgctaatgccaactgccaaccttacagctagcaccatgccctagtagaaaacattttccttgtcatcatgtgttagtactaaacatacccaaaagtgatgtgcacattgacccgtacagcctaataacaagggagaagagccaaattgccatcaaatttgcatcgtaggagcagctgcacaattcaaggtatgggctcacacagacacacagaaatcccggaaaataagcaaaatgacaacgaatcagaggaacagaaaagcgtaatttaattgcatgttcatacattcatcacagcacccatagaattttgaagtaaacatttagatcaccaaaatatggaagcacgtacgcagagagagacacctctaggtaaccttctggaagaaggcatcgatgcggcgggtcccacgcggcagcggcttcgcgttccctcctcctccgccgccgccgccgcgggctgatcctgcggtctggcgggcgcggggagcctcctcttcggcagcgaggcagtcaagcaggaagtccgccgtgggccggtgcgcgcggcccgcggcgcggacgtgcacggcacgcacagtgcgccggctgcgccgcgccgccgcggcgtgggcccctgtcgcgaggctgcccaggaagagctcggtggcggcggcgatgagcagcgccgcctcgctcgtcaccttcttgatgtcccggtccacccgcatgatccgcttgaccctccccaccggcagcgccggccgcagcgacgccccctcttcggcctccgcctcctctccagccttctccattgcctcggcggggtcgacgccctcctctggctccacctcgacttgccgcgctgcctcggcggactctgccgcctcctcgctctcctttccgagttgctcttccattgcatcggcggcttcctcgctctcctttccgggctgctcctccattgcgacgctgggttcgtcggcggtggcgggggacatggctagggcttgcagttgggttggtgtgatccgccgccgctggattcgtcggtgtgaatgggttggcaaaaaatggcggggaatttggggatctttcccgcgcgatcccaacttcgatcgctgcagcccgcaccccgcaggcagcgccgtctgacggggctaaagctaaagtaacagtggaagcctgaaaggggccgtagtgggctcgtgaggtgaagaaagcccatttagttttatccgagaaaaaaagcagctcattaggcccactactgctccttccttctagacgttgtgagttgtgaccaggtatttatacataatagtatgctcctgtttggttcagcttttggggggcttctggccgccagaagctagaagctaaaccaaacacctagattttaacgggcttctcgtgcaaacgctttttaccgaagctgttatctctgcgcccgtgagaagcggcaagcaagtcgcttcaggccgatgctggacgttcgaactccctccaccacccaccgcaacgcaagagctctgcacttgggtttaattattcatattcataattttttgttttgttttg

SEQ ID NO: 22339 - DNA, 1288 bp, Zea mays
gaatttttacccatctggtttcggggtacccattgccagccagagcgagagggagagggagagcgagcgcgagcgcgcagtcgccgtccacaccgttgagctttttctcaggcttcgcatggcctgattcatcctacagtctccaacaagccaagcaaacgccgcatcgcgctttctccgcttccttctttcccctcacagggtcagaccccaacgccgggagaataggggattaggagccagacctggcggcgccgggcgtccaagaaacgctgcctaataaaatccctccggcgtctgtcgtcttgaccgcggcggcgcaggcttcttcttttcgctctccacggcagcgtcatgaagattaaggggaacttgcatgtttgatgtacccctgtagcaaaaaattcttgtgataaaatttgttgaattagtcactgtcagggagggatctagttgtcagttgtttgtattaaagctgctggcactttccttgcagggtttctgtagaataaatgggagaagcacacttggatgaatgttgtcattgccaggggtgtgctggcaagtatacactactcagagatgaagaaaacccacggtggacaatctttgagaggcggcttccttgctgtggttgtgggataggatggtcttcttttcttttagggttcttgtgtcctttgatttggtactttgcagccactctttactgctgcaagtactacaacaaggatcctcgagagcgccctgggctagctgcatcagctgttgcggcactcatcttcacagtcctggcactcatcgctctctctgtggcactgatattctatatataaagcgaggaatgaacttgcgcttgcttgaaatgcgtactcaggcactcatcttcacagccctggcaaccatacatcgctctctgtggcacagatcatctgaaacccaaagcgaggaaaacgcggtagctggacctggcattcagaaggaacttgtaatctcagtgatagtagcatatcgttgcaatcatccttcatgtatcgccatatcaatttgttgatttaaatgctgcatcggttgacctgtcggctgctgttgtctatcaacgaggatgatcattgctctatcgcaaactgcgtgctccgtgatctgtgatgcttctgaactcattctgtcttggcaacccttcggactcggttggtagagctccgctttatgattctgagctccgagagctgatttttcaattgagtggttttctagcagaagtgaatctatctatacactgtttggt

SEQ ID NO: 22340 - DNA, 992 bp, Zea mays
ctcgaggccggccgggataatcccatggccggattcatcctgtggggccgtggcccgtgggctggccaagcaaacggacaaaagccccgccgccccgcgctttctccggttccttctctcccctgagaccaccaacgccggggccggaaaaaagggaagccagagcacagagccagacctggcggcgctggacatccaaaaacgccgccaaggatccttctctctctctctctctctctcttcgcgtccatcgacctgaccgcggaggcgcgtgcttcttcttcccgctctccactgtcatgaagattgagggaaacttgcatgtttgatatacccagctgctttctgtaacgaaaaactcgtgatcattttgttgaattggtcactgtcagggagggatctacttgtcagtttttggtattaaggctgctggccttcccttgcagggtatctgtagaataaatgggagaagcacactcggatgaattttgccattgccaggggtgtgctggcaagtatgcactactcagagacgaagaaaacccacgattggcaatctttgagaggcggctgccttgctgtggttgtgggataggatggtctacttttcttttaggtttcttgtgtcctttgatttggtactttgcagccatactttactgctgcaagtactacaacaaggatcctcgagagcgccctggtctagctgcatcagctgttgcggcactcatcttcacagttctggcaatcatcgctctctctgtggcactgataatctgtgtatacaagtagtacccaaagcgaggaaaacgcggtcgctggacctggaattcagaagaaacttgtaatttgagtgatagtagcatgcctttgcagtcatcctacatgcatcagtatcactatagcatgttgttgatttaaatgctgctaccgtcccggttgaccagtcggctgcggttgtttatcaacgaggatgttcattgctctatctc

SEQ ID NO: 22341 - DNA, 1570 bp, Zea mays
cttctccgtgttgggcttggaggagatattggtgtctaggtgcacctgcttcagcaccttgaagatgtagatcttgtatgtctccaaacccttcttgccctttttcctcccctcttatcactatcgctctctttgccaacatattttcccgctaggagccgcttctccgccttgggcttcttccccatggggccttctctattggggccatgggcttctccaatataggcctcttcatcgttggcttcttctccgtctccttcgccccctctagtaccggctcctcggtgaccagctctgataccatgtagaaattttggaaagcctcactttattgttcccagatacaacacatatatatacaagatgggcaaggccaacacgaccaattcctctaccccgcttcttcccctgatctttattttccctcttcccaccgggttcccctttcttgcttggccgagatagaaccagcgatggcccaacaagatttatgaattatttcaccgtaattgatgaaaaatcgagttttggatcttgtcaaataactcatcatgaaggatcaaggaacaactcaatgcaacccagattatgtgctttcgatgtattccaactcctggtgattgatctaaagagaagtaacttaggaattaggaatgttaaacctttacatgcaaaccaagtctgtcacatgctagctgaagactaataaaaaattgtaagttctagaagagatttcagattttttgcttgtggcattaccttacagaccaggcgaatccacattgttataacttagggctacaatccttgcacagaaatttgtgaaattacaattgaaggaatagaaacaacatcaccaatttggcaagcacaagcagtacaattaagagcagtaaaccttcaggaattaagaaatagaccatcaacttatatcgcctcatggaatgcatagactgcactacaaaaatatttttggcagcttgtagttttgaactgctaggtagtagttgagacttgagagcaacaacattctttctgtcctctgttttgtataaccttagtatatgacttcaagagacaagaatgcagtttgtttgaacaaacaatgaagcagcagaaaagtgttttgctacatctcaaattatgcatttggaaagaccctttgaatctgtatgactatacatggtttttttacttcccggatatggtacccatcaaatgaatcaatcaaataggaactcaaaatttggaaattaatgaagtaaacggattctagctacatcaagtgttgctcgttaaaattttgtagtgttatgatgctactccacaaggaaagtgcagggcttcaagaaccaaaacatgctgctggagctcccttctgcatcacatgctcttgtattattcatatccttaaccccaaagggttgcctcacagcatattttttgctctccggatccttactaggggtccccttctccttcagtgggttcttgagtggcgatcctgctatggccgcccctccaagcttaacattcttaatgcggttcggcgatggggatggaaacc

SEQ ID NO: 22342 - DNA, 1669 bp, Zea mays
cgttctgttttgtttttgttgaattgtataacctcagtatttctcttcaagggacaaaaaaatgcagtttatttgaacaaacgacaaagcagcagaaccacgttttgctatatctcgaattatacatatggagaagactttcaacctgtatgactatacatgattctttttgtttacttcccggatagagtacccatgaaatgaatcgatcaaataggaacagagaatatttggaaatgaatgaagtaatggattctaactatatcaagtgttgttcgttaaaaaattgtagtgttatgacgctactccacaaggaaagtgcagggcttcaagaaccaaaacatgctgctggagctcccttctgcatcacatgctcttgtattgttcatatccttaacaccaaagggttgcctcacagcatcttttttgctctccaggtccttactaggtgtccccttctcctttggtgcctttttgagtggcgagcctgctgtggacatccctccaggtttaacattcttaatgcggtttggcgatggggatagaaaccgctgtggagtcggcggcgttgccctcacctccttcagcacagagggagacctttgcttccctggttccaccttcagccccactttctttcccttcattgggcttggactctttttcgccgtttcttgtctcgcctcctccttcactgtctcatcaggagccaccttctccatcaaatagctcggattcactgggtctgagctgtgctcctcctgtgtgtctgtgacaggccggccgacgccaccaccaaccatccgcttcagctcatcgtagaactccgaaatctggccaagtatatcctttccagagaagaggttcctcgctgagagggtgctcttgagctgcctcggcgggacgtgcttattgagcagcgcctccttctcagcattgtccggccgcttctccgcactggacttgatggcctccttggcattcttgttccaccgaggggcgccgaacggcggcctacttggcgcctgccgtgggggcggcgtggccagcgcagggtcatggttctcgctatcctcctggaacctcttcttgggcgctgcctttggcttcggcggcgtggaggcagcaacggcgccgccaccccgccacttgagattgctactgccgtccctgaggctgctggcattggcgtccctttccacgaacggcagcatggccgaaaccgatcgcagcagcttgcccttggggctggggctcagcttgaggaaatcgtcggccgtcttcggatgctggcaatcggggcggcagaaccaggcctcgtcgtcgacggcggcgcggccggcgttggggtcggtgaggtccgcccagtgcggggcctcgatgtcctcgtaggtctcgtcgcgcacgtaccgtgacaccaccctgctccagtcgatatccttgggctccatgaactccatgccgtcctcccctttgctcccgcgcgctcccctctgttatctcctgcgtcctgccgtgcgggcgctgtggaggaggagccccaagcgatagaaagaaagggattgcttggtcgccgctcctcctttgtcgcactcgtgagaagtgccggggcactggcgagggcgagagccgttgcgcgtgttatcggccggcctcgaggtacccaatg

SEQ ID NO: 22343 - DNA, 2398 bp, Zea mays
caatgtaaatggcaataaattagaaagagagcgactccattacctgcggcccgagcgttactttaattatgtactcagatcacaaaccacgaaatagagaagctgaccttgtagagctgactatcggattcacggaccaatcctcgtcttctcccaattctcattgcatcgaatcgggctcgatgctgcccctctccctcttcgtttccctcttggtgctccatctcccccacgcatccgccgacggcgacatctgcatcatcggcggtggcatctccggcgcctccaccgccttcttcctcaccagctacaccagcaccctcggtggagcgcagctgcgcgtttttgagcgccgtcagaaggtgggcggccgcctgggcaccgtcactctcgcgggcgacagcttcgaggccgggggctccatcatccacccccgcaacctccacgcgcgccgcttcgccgacctcctgggactcgccgtgaagaccggcggcgacgactggctagggatctgggacggcaaaagcttcgtcttccagacggcccgcccacctcctgtcggcagctcctggtggcggcgcaagctgcacagtctcgtcaactcgctgctgctgctcaggcgatatggtctgtccctgctaaagatggaacaagtttgtccaggttaggcgaattcttccttccttctctttccccaactaggatgcacagatttggaacctggcggattgcaaaaaaaaaaaaaaaacaataaaaaataaataaatgctggagtgagtgactggtgcaggaaatgttgcggcggtttatgctcttctacaatggcatggagtctcgccctgtgtttgccacggttgaggagatgctccaatggacgggtctctatggcctcacccgcaggacccttgaggaggagctgctggatgccggcctcaacacccgaacgatagcagagcttgtcactgtatgcttctcctgacatcctaagccacacacatctcatcccatgattgattatttaccatgtcgaatggatgttttattcgttctccaaaccaattggagagaacaaaacattcactagtacgtacgtagtataattctgtaccatctccaacatggaccctgaacaagatacctcacaggttatcacaaggatcaactatgggcaaagcacacacataagtggcctggcaggcgccgtgtccttagctggatctgagtcaggattatgggctgtcaaagggggcaactggcagctagctgccggattgctcaagacctctaatgctaccttgcatcttcaagaaggcatagactccatcactgatgccggggatcactacgttctgagatccaatagtgggagcgaatacgagtgtatggtgacggtggtggcaaccccactcgacgagctgaacattacgtttagccctccaatctccattccgccgaggaagatgcagcacacacatgcgacctttgtgagaggcatattgaacccggtaactatatattgtccttcttttgagtagcaaaatggatgtaactgatagatagatagatgaagacgaggttgtcaactttcagggatattttggtctgaactcggcatcagatattccagagctgattggtaccctagagctccctgatatccctttctcctgcatctctgttctgaagaggtacagcgaaggcgacatggcggcgtacaagatgttttcacgggcaaagctggatgatggtttgctggatcagatcttcaggtacgtagcagcttgattgatcttcaggtacgtagcagtttgattgatggatcagatcatatcgtggttgctggcatggcagggctcggatagagacgatccggatcacccgggccgcttccccgcactcccaagccccagaggagttcgctccgatagtgttggacgggaagcagctcgtactacgtgaacacctttgagagcgccgcgagcgccatagagacgggtgctgtagcagcagagaacgtggcgcggctcatcatctccaggctctctctactaccgcaggcacagcagcagcagcctcatatcatcaagtcattcgccgaacaagaatcccagcgtcgccatgtagacctgtgaaatgttgtaatggcattgtagccagttttatcccagctagcattttggtacatttatttatgtatttgaccaatggtttggtttgtaaatggatgatatagttagtaattgttagcgccgatctagatgtctagacgtcgatcattgcgatgagtatcggcgatggtgctctctgtggaagcgttaacagtccacgaccgagggtccacgaccgagggtcggatggtccgcccgtgcgcagaggcgacgtagtttgccaacaaccc

SEQ ID NO: 22344 - DNA, 1765 bp, Zea mays
agctgaccttgtagagctgactatcggattcacggaccaatcctcgtcttctcccaattctcattgcatcgaatcgggctcgatgctgcccctctccctcttcgtttccctcttggtgctccctctcccccacgcatccgccgacggcgacatctgcatcatcggcggtggcatctccggcgcctccaccgccttcttcctcaccagctacaccagcaccctcggtggagcgcagctgcgcgtttttgagcgccgtcagaaggtgggcggccgcctgggcaccgtcactctcgcgggcgacagcttcgaggccgggggctccatcatccacccccgcaacctccacgcgcgccgcttcgccgacctcctgggactcgccgtgaagaccggcggcgacggcgacggcgacgactggctagggatctgggacggcaaaagcttcgtcttccagacggcccgcccacctcctgtcggcagctcctggtggcggcgcaagctgcacagtctcgtcaactcgctgctgctgctcaggcgatatggcctgtccctgctaaagatggacaagtttgtccaggaaatgctgcggcggtttatgctcttctacaatggcatggagtctcgccctgtgtttgccacggttgaggagatgctccaatggacgggtctctatggcctcacccgcaggacccttgaggaggagctgctggatgccggcctcaacacccgaatgatagcagagcttgtcactgttatcacaaggatcaactatgggcaaagcacacacataagtggcctggcaggcgccgtgtccttagctggatctgagtcaggattatgggctgtcaaagggggcaactggcagctagctgccggattgctcaagacctctaatgctaccttgcatcttcaagaaggcatagactccatcactgatgccggggatcactacgttctgagatccaatagtgggagcgaatacgagtgtatggtgacggtggtggcaaccccactcgacgagctgaacattacgtttagccctccaatctccattccgccgaggaagatgcagcacacacatgcgacctttgtgagaggcatattgaacccgggatattttggtctgaactcggcatcagatattccagagctgattggtaccctagagctccctgatatccctttctcctgcatctctgttctgaagaggtacagcgaaggcgacatggcggcgtacaagatgttttcacgggcaaagctggatgatggtttgctggatcagatcttcagggctcggatagagacgatccggatcaactgggctgcttacccgcactaccaagccccagaggagtttgctccgatagtgttggacgggaagcagctgtactacgtgaacacctttgagagcgccgcgagcgccatagagacgggtgctgtagcagcagagaacgtggcgcggctcatcatctccaggctctctctactaccgcaggcacagcagcagcagcctcatatcatcaagtcattcgccgaacaagaatcccagcgtcgccatgtagacctgtgaaatgttgtaatggcattgtagccagttttatcccagctagcattttggtacatttatttatgtatttgaccaatggtttggtttgtaaatggatgatatagttagtaattgttagcgccgatctagacgtcaatcattgcgatgagtatcggcgacgttgctctcaaaaaaaaaaaaaaaaaaaaaaaaaaaaaaaaa

SEQ ID NO: 22345 - DNA, 1758 bp, Zea mays
acgtattggaaattagtttttaggagcagttagagatgctctaagactatgtatatacttgtatgtataaaaaatatgtgacctaaaataaaatctattggaaaccccatatttaaaggatttttattttccaaaaaaatagtctattttaccttataaaaatagaaatctctcgaaaaaaatgaagtttccaaaacccctttttctctggaggttgtcgaaattatttgcaataaaatattggctacaatcaaggtcttaccaataaaatttccatttatatatatatatatatatatagacataattcccaacccattctattccgaatccgaagctgtactattcggttattacccgtatccctcgaatataaaaatacccgtacccgtatcaaaaaatagtctcgaatcagtacccgtatccgatacccgtttcgggtaccctgcccgttttcacccctattggtcaccttgctctagctttggattttttaagaagttaaaggaagttgttggagtatggtcagctttttaggcactaaaacattttgaaagattccaatctttacgtattggaaaattagtttttaggagccgttagagatgctctagactatgtacatacttgtacgtatcaaaaatatgtgacctaaaatataatctaagggttagtttgggaccccattttttaaaggattttcattttccaaaaaaatagtttattttaccttagaaaaataaaaatctctcgaaaaaatatagttctcaaaaccttttttctccggaggttgtcgaaattatttacaataaaatattggctacaatcaatgtcttatcaataaaatttccatttatatggaatctagacataattcccaacccattttatggtggtggcggctatggttggataaactgctgcataatgtcttactgcagttctgccgcacgaccggcaacagtgcagtctacacggtctgctggcaattctcggacaagaccccggtgcacggcgcgacccctcctttttttttttttttttttttactagcaaataacaatataacatgaaagtatgccatgtttgccggcacaagcgccagcatgcaacgcacgctttgaaagttccacaactcaaactcaacaaaaggactcgttccattatttagacatcagacacctatcatgttaacagaaaacactaccgaatacatatggcctagaatccacacggcctcgcatggtggtggtggacacaaattagctcctcttgttggcgtagctgtcaggctcatcgtccttgaagagatcatccatgatttcatcattcttgttaccgtcaccaggtgtgccagcagagaacccatcagcgccactggaaccacccgttgcgccaaagctaccagcagggttttcaccaaaaccactgtcagcaaagttactgctgccaaagctgtcgctacctccagcagcaaaactgccttcagccccacctgcaactccataatcaccaccaccaccatagccaccaccagccctgttgccgtagttgccaccatatccaccgctgccgccaccatagtcaccactgccgccgccgccatagccaccgctaccaccaccatagccgccaccatagccaccgccaccatagccaccaccaccaccaccatagccgccaccaccataaccaccgctgctgcggaagccacccggacgcgtgggcggacgcgtggcgtcgacccgggaattccga

SEQ ID NO: 22346 - DNA, 1353 bp, Zea mays
gggtacccgggccctccccgcgaggtcccccccccccccccccccccccccctttgacagaaaagtttaacatgttggcaacgggcactgtctctgttcacaaaagtaaccaagcaagcgacattttccttaccggtcacaaactattaactgatcacatcaggttcgtgttcttagctaggacactctcccattcttcttggtaccatccacggttcaagaatgaaccgacacactgcactcggacgtttcgcctaacagctacacaggcaacaaaagagaggcaaaaacaattgataccgggctaaaattacaaggtcaggccatgaagccggagtctcgaaacctcaacttcaggcatccgcggccagctgcttcttctgcttcgacaccttagcctgcagcttgtcgagcttggcgctcatgctcctgtgctgctcactgacggagccctcctgggcgctgcacatctgcgacctcaccttcaggcccagtcgccggggcacgacgcgggaggcccacccgccaccgccgcccttaccagcgcgcccgcccagcttctcgatctcctgccgcatgctcgagcactccttctccagctcggccagccgcgtccgcatgttgtccatgccgaccttcaggacctggttctctcggacagccgtggcccagcctccagcctcgccggatgtggcaatgccgctccgcagaggcctggagccttcgaggttgtccgagaccagcaggcaccctgcgatcgaggttcttagctggagttgctcgaagaagaggacttgcaccaccacgcgcaacggcagcctctcgttctgggcggcgtgggtgcatgcttccagggagagcttctggcagtccaacagccggcagaactgctccctttcagcttctgacagccaggaatgagccttcaagtatatgtcaatggcacgataaaggccatcatccagtggccgggcatattcaggaatagcagaggccagagcttggaacttaggaggcttcaaattgatatctggtgcaatttctgcaagatagccgtcaattagcttggcaacacttgtgatcggtgtcaaggatggggatgccataacatcatccaagcatggggactcgccaccatttgcttggtccattgccaagaaatgatcaagaatcctgtgcacacactccacattgtacagtgtttccattgtgtaggagaaatttggcagcagtagatcctccaaagtggcctggtctagttgcatgccaattcgtttctcccagttagaaatgcacgtggggctggctttcagaatcatggcagtgcgaaggagcccaagcagaacttttgtc

SEQ ID NO: 22347 - DNA, 853 bp, Zea mays
ggccgcttttttttttttttttttctttctcaattcggtcattatagactataggaagatacagggcggttcctctgaatgcaagtatatcataggctcataacatcaccagtgcgcaatgagtcctagttgccattccttcaatgcatcgacctcagatggacacagacgacagacagatatatgctagagcctagatcctagtaggctgtcgcaactagcctcctcgacgcaccaccgccgatcgcccccatcgccgaccgtggcccgtggtggagacggcgaggcaacccacgccgcatgcgctgcttcccgccgaacatggcttcacgctccctcgcctcgtctaccaagatctgctcacaccggcactcctcgctgcagaacccctggtcgcctctgtacatgaacacgtcgtccttgccgctgagctccttcctgcagcgggagcaggcgctcaagaagctgctgcacggcccacggcggtgtggcgccaccgtcgtcaggactaccacctgcttcaggacgatatgcgagtgcgacggcggcaccttcgtgtggtggcggttctggaccaggatctgtagcccgacgccgaccgcgtccacggcggcgtctcgctttcgccattgacagccgtcgtcttggcgcgctccgtggctgcgcctagtatcgatgttcttcacatgctcctcggcgacgctgtggtcgtcgccaccctcctccccgaggtagaagatgcttctttggctcggcctcggaagcatggcggagtggagagcgccgggggaggagggtttgtgctcgtaagtcgtaaccactgactcgcccactgtgcgtggggggcgacaag

SEQ ID NO: 22348 - DNA, 1504 bp, Zea mays
aggataaacaacagatatcaggaacaatcagaatagcatgtgcctgaactagcggggcatactcccgtataggtatagtgatctgacaagaacgagaagcggttttgccacctgcctattactgtctggcgagttgatacatcaaatacagtggagatattgccaatcaagagtaacgtaacaggactcgaactcctcccaatttacatggccacaaaagggtgaacgatggcttatcgtccagggtgaaaattgtgtacacggtgtagtatgagtaaaaataaaagaatactacgcatagcggccagagcacctcgggcagaatggtacagaaggtcaagccacgaagaatatgaagatcatgaggaacaccatcagcacaaagaatatcttcatcatcagccacctgttggacgaaatgctgttgagatacttcaggagctggccctgcgctccctccacgttagccactgtttcctccatgttctcgtcaattctgattgctagctctccctgttgagaaaccatggttgccaactgtgtaaatatgttgctcagctcatggattgttgattccacattttgaagggcctcagctctgctctgcatgtaactgtcctgctgtactgccaattgttgctgctgtgcgaaaggctgagatgatgatgccccatggtctccattagtcttcttcctctggaataatggggtagatgcagagtcgctggcccatggtgctgggggcacagatgactctgatggatccctagcaacaaggggtcgttgacggatgaatggatttgacgcgtcctttgcagccgacgaagagaacatttgccttctattttcatgaaccttcaaattctctgttcgcatggtaagaacttctttaaattcttttgttgcactcatcagacgattttttaggttgtccacgactgtagtggaatgatttgatgtgtccttggagagactgccactctcattttgtgaattgcagagagcttgtaggtctacaacagcgttattcaaagccgtgatatccttcttaatgactgcagtcaactcttgaatctccactgtagggtcatcaaaaacagatgttctctttgccaatttcgcaaggcgggttagcttctgtgaggtctggtggatcccgagcccgatcttggacgcgcggttgttgaactccgagcgagccgacgtggctgcgatcaacccatcgaggggcctggtagagctgctactcggcgcggcggcggctgacgacgaggaaggtacggcgtggcggcgcgcgctctcgacggcggcgcggaactcgttggtgcggtcgcggaacgacgcctgcgcgggccgcgtcgggatcatggcgaaccccgggcgatggatctagacgcggatctggatctcgcgcgcgccctcgactcggtgggtgggagggggatggggttcgggggaggagcacgcgaaggagggagacgcggtgccgatttttttaattttt

SEQ ID NO: 22349 - DNA, 1650 bp, Zea mays
ttttttttttttttttataacactgctaccacctgcctattactattactgttcagcatactgatacatcaaatacagtggagatattaccaatcaagagtaaacttaagtactggaactcctcccgatttacatgaccacaaaagggtgaacgactctgctcatcatccatgggtgaaaattgtgtacacggtgtagtatgagttaaaaataaaagaatgctatgcgtttagcagccagagcgtctcgggcagaatgattgcagaaggtcaagcgacgaagaatatgaagatcatgaggaacaccatcagcacaaagaatatcttcatcatcagccacctgttggacgaaatgctgttgaggtacttcaggagctggccctgcgctccctccacgttagccacggtttcctccatgttctcgtcgattctgattgctagctctccctgttgagaaaccatggttgccaactgtgtaaagatgttgctcagctcatggattgttgattccacattttgtagagcttcagctctgctctgcatgtaactgtcctgttgtactgccaattgctgctgctgcacgaaaggctgagatgatgatgatgctccatgatctccattagtcttcttcctctggaatagtggggtagatgcagagtcgctggcccatggtgctgggggcacagaggactccgatggatccctagcaacaaggggtcgttgacggatgaatggatttgactcatcctttgcagctgacgaagaaaatatttgccttctattttcatgaaccttcaaattctcggttcgcatggtaagaacttctttaaattcttttgttgcactcatcagacgatttttaaggttgtccacgactgtagtggaatggtttgttgtgtccttggagagactgccactctcattttgtgaattgcagagagcttgtaggtctacgacagcagtattcaaagccgtgatatcctttttgataactgaggtcagctcttgaatctctaatgtaggatcatcaaaaacagacgttctctttgccaatttggcaaggcgggctagcttctgggaggtctggtggatcccgagcccgatcttggacgcgcggttgttgaactccgagcgagccgacgtggccgagatcatcccgtcgagggacccggtagagctgctgctcgccgcggtgggggccgacgacgaggaaggtgcagcgtggcggcgcgcgctctcaactgcggcgcggaactcgttggtacggtcgcggaacgacgcctgcgcggggcgcgtcgggttcatggcgccccccagcgatggatctgagcgcggatctggatctcagactcggattcggactcggggagagcctgggtctgaggaaggagcacacgaacaaggaagacgcggtgcgagagcggaagcacggcggttggggaatcgagctagaaactgcggggatatggttttttgtcgccggcccgtccgtcctttgtatttgtcctattttagttaaaaataaattagtagatgataaatatttgagaatataagagcatctctaagagactaactaaataacttatcaagctaaattttagctatttaatagtataataattctccaacaaactagtcatataacaag

SEQ ID NO: 22350 - DNA, 2231 bp, Zea mays
  misc_feature (2060)..(2092): n is a, c, g, or t
ggtacttctctttggggttctccgttcccctccccattcccctgcccccgcctcttcgagctagggttagggtttgcttcgcgttcccttggaaattgatcgaatcgggcacccctaaccggtgtcctcaccgatccatccgtgcgtcctccggcccgcccgaatttccacctctcgacatcagcaatctcgctgcctctctctctctcttttgagagagggggaagtaataaaagggaaaaagctagcaaggggatttccttgatcccatcatcgtgctacagatcctttagttctagcaaggaggaggaaaaagagagagcaagcccatggatcccagccagatgatgttccccatctggggggcgccgcctcccgccgccttgaagccgccctccgatgaccacgccgccgcccccaacgcgcaggcgcagcccttcctcccccctcccaatcccaaccgcggctggaagcgcaagaatcccgccgccgccgcctaccagccaccggccctcggcgatctccaggtgcagaaccgcgccaaggctcgccgctggttcaagaacagcggcggcggcaaccccaaccaaagccgcaagtatttcttccccaagaacaagaacaacaaggtcgccgcgccgcgcaacaccacctccttcatcatccgggccaagcgcgccggcggcattgcctccctcgtctccccgtgccccgtcacgcccgccgtgctccccaccccgcgtctctccccctcccgcgagggcctagctgacatggcccaggcgcagtggggcgtcgatgggtacggctccatgaagggcctcatccgcctccgtagctccccccagccagccaaccccaatgctgccgcatcagatgacgatgatgaggggaactccagtggaagcgacgtcgaggagcacgtcgaggtggagcgacgcctcgaccatgacctcagccgttttgagatggtgtaccctggtagaggggaggatgctgggggctacgtgttggaggacgatgacgagtatgaccaggatgcgcatgtggctcgccttgaggaagagaacctgaccctaaaggagaggctcttcttgatggagcaagaggttggtgacatgaggcgccgcctggaggctcttgaggcaaaattttcgctaggtggtggtgttggaggtggcgagaatgaagtggaggaagctcctcctcagaatgatgcagagaggatccatacttggccagagaatagcagcgaggatgatgtagagatggttgatgcgggatctgagaagggcagagcacaaactcagggtgcaatgacttcagagaaatctggcggggatgataccacaaatcagggtgctgcgcgctcagataagactggcggaaatgatgcaggtgaacaggatggtgttggtgttttggagaagactgatgcgcacaatgcagagaagcagcaggttgctgcgggttcagagaaggctggtggaaatgatccaggtgagcaggttgttgttggtgttttggataagaccgatgcgcacaatgcagagaagcagcagggtgctgcaggttcagagaaggctggtggaaacgatgtggatggacaggatgtcgttgttggtgtttcggggaagactggcgcagatagtgcagagaagcagcagggtattgtgggtaccgagaagacaggtgagcacagcatagagatggttgattcactgatagaggagaagatggatgacgacaatggcgagaatgaggttaggcttgcggcttcacagtgatgattgattggagatggacaagagaagtagtagttcattcaatgacggattgaagggatgcgacgtggaatgggcttgctttggagattgacgattgacatgttgtgcgagccttgatattggcgatatattttgttttctgtcgtgttttcactttgtttttcttactacaacttgcagcttcttatgatgatgatgcaaaagtcgcagacatggaggaaataactgacatgatgaatatgttgttggtacctgcccggccggtcgctctannnnnnnnnnnnnnnnnnnnnnnnnnnnnnnnnttctatccagctgtggtggatatgtatctgaatctgaatgtatcgtctgtttatgtcatttgcttggattgtaaaatggggtagcatgtttatatcttactactctcatcacatgataagtgaatattggactgtcttg

SEQ ID NO: 22351 - DNA, 768 bp, Zea mays
cattgggacctcgaggccgcgtgttcggaccgactacccacccgtctattctggtcacttcttttggggttctccgttcccctccccattcccctgcccccgcctcttcgagctagggttagggtttgctttgcgttcccttggaaattgatcgaatcgggcacccctaaccggtgtcctcaccgatccatccgttcatccttcgattcgatcaaatttccacctctcgacatcagcaatctcgctgcctctctctctctctcttttgagagagggggaagtaataaaagggaaaaagctagcaaggggatttccttgatcccatcatcgtgctacagatcctttagttctagcaaggaggaggaaaaagagagagcaagcccatggatcccagccagatgatgttccccatctggggggcgccgcctcccgccgccttgaagccgccctccgatgaccacgccgccgcccccaacgcgcaggcgcagcccttcctcccccctcccaatcccaaccgcggctggaagcgcaagaatcccgccgccgccgcctaccagccaccggccctcggcgatctccaggtgcagaaccgcgccaaggctcgccgctggttcaagaacagcggcggcggcaaccccaaccaaagccgcaagtatttcttccccaagaacaagaacaacaaggtcgccgcgccgcgcaacaccacctccttcatcatccgggccaagcgcgccggcggcattccctcccccgggattccccggggcc

SEQ ID NO: 22352 - DNA, 916 bp, Zea mays
cattgggtacctcgagcattggggacctcgacgccgccggcggccagcctcgccgccccaccaccccagcattgccttaccttgccttgccttgccctgccctccattccacctccacctcgccgcccaaatccccccacccaacaatcccccatggggtcgcaggccatcgaggcgcaccgcgcgggcgcggaggtgtaccgcggcgcggcgctgtgcgcggagaagtcgacggagctgctggcagaggcgcacctcccgctgggcctgctgccgctggccgacatggaggaggtcggctacaaccgcgccacgggcttcgtgtggctgcgccagaggaagtcgctcacgcacacgttccgcccgatcgcgcgccaggtctcgtacgccgccgaggtcaccgccttcgtggaggaccggcggatgaggcgcatgaccggggtcaagaccaaggagctcctcatctgggtcaccctctccgacatgttcgtcgacagggacgacccctccaagatcaccttcaagacgcccaccgggctcggcaggacctaccccgtctccgccttcgctaaggaaggcgccggtgacgacggcgcggcggccaagcacaaggatgatgcccccgccccgaccgccgccggtaaggctgctgccagcaagtgaggtgcgcggcgtccggagctttttaccttgccgtagtcgccatacttgcctccccaataatggcgtttgtaccccctctacctgcttcaaattagtgtgttttatgaatggaaacgaccatccaactttccatccgtccttgcaatgtgtcacggcgggatgtttttactacacatcagctttaccagtttcaagattgttttttcccgctatcttgagctaaaacaaaaactaataagtgctcaattttcct

SEQ ID NO: 22353 - DNA, 979 bp, Zea mays
cctcgaggccggcccggctgggccgtcgcgggcccggccggcagcctcgccgccccaccaccccagcattgccttaccttgccttgccttcccctccatcccacctccacctcgccgctcgaatcccccccaacccaacaatcccccatggggtcgcaggccatcgaggcgcaccgcgcgggcgcggaggtgtaccgcggcgcggcgctgtgcgcggagaagtcgacggagctgctggcagaggcgcacctcccgctgggcctgctgccgctggccgacatggaggaggtcggctacaaccgcgccacgggcttcgtgtggctgcgccagaggaagtcgctcacgcacacgttccgcccgatcgcgcgccaggtctcgtacgccgccgaggtcaccgccttcgtggaggaccggcggatgaggcgcatgaccggggtcaagaccaaggagctcctcatctgggtcaccctctccgacatgttcgtcgacagggacgacccctccaagatcaccttcaagacgcccacagggctcggcaggacctaccccgtctccgccttcgccaaggaaggcgccggtgacgacggcgcggcggccaagcacaaggatgatgcccccgccccgaccgccgccggtaaggctgctgccagcaagtgaggtggcggcgtccggccggagcttttaccttgccgtagtcgccatacttgcctcctcaataatggcgtttgtacccctctacctgcttcaaattagtgtgttttatgaatggaaaattggaaacgaccatccaactttccatccgtccttgcaatgtgtcacggggtgtttttactacacatcagctttaccagtttcaagattgtttttttccctaatcttgagctaaaacaaaaactaataagtgctcaaaaaaaaaaataaaaaaaaaaaaaaaaaaaaaaaaaaaaaaagtgctctgcgttgttaccactgcttacga

SEQ ID NO: 22354 - DNA, 914 bp, Zea mays
aaccggcaaccgcccctcgccgactgcacggacggggaagcctcctagagagtggactccctttccttctataaatccggctcctcccaatccaggatcttcccagcctcgccgccccaccaccccagcattgccttaccttgccttgccttcccctccattccacctccacctcgccgcccgaatcccccccaacccaacaatcccccatggggtcgctggccatcgaggcgcaccgcgcgggcgcggaggtgtaccgcggcgcggcgctgtgcgcggagaagtcgacggagctgctggcagaggcgcacctcccgctgggcctgctgccgctggccgacatggaggaggtcggctacaaccgcgccacgggcttcgtgtggctgcgccagaggaaggcgctcacgcacacgttccgcccgatcgcgcgccaggtctcgtacgccgccgaggtcaccgccttcgtggaggaccggcggatgaagcgcatgaccggggtcaagaccaaggagctcctcatctgggtcaccctctccgacatgttcgtcgacagggacgacccgtccaagatcaccttcaagacgcccaccgggctcggcaggacctaccccgtctccgccttcgccaaggaaggcgccggtgacgacggcgcggcggccaagcacaaggatgatgcccccgccccgaccgccgccggtaaggctgctgccagcaagtgaggtggcggcgtccggagctttttaccttgccgtagtcgccatacttgcctcctcaataatggcgtttgtaccccctctacctgcttcaaattagtgtgttttatgaatggaaacgaccatccaactttccatccgtccttgcaatgccaatgtgtcacggggtgtttttactacaaaaaaaaaaaaaaaaaaagc

SEQ ID NO: 22355 - DNA, 3329 bp, Zea mays
gaaagcggaacatctcgccttctctgaaagccatttcagaaccaccttcaaagttcgaactccatctcctccgcgtccgcaaaccaatccctagatcctctcgccctcgcaccaacccccaattcgatccaccccgtcccctatccgcctcgagtcccacccaattcggcgctagcctgatcggcattgcctgccggcctcgtcgtacagatctgagcgccgtctcgagcgccagatctcgccggctccgcgcctagcattccgccaggaccaggattcgcgcagcgccggcgccggcaccggcaccggcgcctgacgccaagttggcgcctcagaagcggtcccagcgtggcggcggcggaggtggcgcctccgccgccgccgcggcttcgtcagccgccgcgggggactccggcgacgccgttatggcgcggtggctgcagtccgcaggtctgcagcacctcgccgcgtcctcggccgcaggcggggccggggccggcgaccttcgcgttggtggcctgagtggcggtggcggcggcggccttctcccgagtcttctcatgcagggatatggaccacaaacaatcgaggagaaacagaagctttatacattattgaggagcctaaatgttaatggtggattagcatctgcatctatatccgagccctatacttcaacaggacagagctttgctggtggtgctcctgtagatggattttattcacctgaacttagaggtgaatttggggctggccttttggatcttcatgcaatggatgacagcgagcttctttctgagaatgctgcatcagaaccatttgagccttcgccttttatgccaaaagaaatggatgatgacgactacgatgtaatagcagaaaaccaacaaggtctagtagacaaccagagtgccttcaccaacgaaaaaaaaaaaaaaaaggtcagtgcaagagaaagtaatgtagcaaagattaaagtcgtggtaaggaaaagacctctgaacaaaaaggaggtatctcgaaaagaggaagacatcatagatgtacacaattctcaattcttaactgtccatgagcctaaactaaaggtggatttgacagcttatgtggaaaagcatgatttctgctttgacactgtcttgggcgagaatgtaactaatgatgaggtgtaccgtgagactgtggagcctattataccattaattttccaaaggacaaaagcgacatgctttgcatatggccaaacaggcagtggcaagacctatacaatgcaacccctacctcttagagctgcacatgatgtggtttgtcttttgcatcaacctatgtatcggaatcaacatttcaagttatggcttagctactttgaaatttatggtggcaaactctttgatcttcttagcgaaaggaggcaactcttaatgagagaagacggaaagaaacaggtctgtattgttggtttacaggagttcgaggtttctgatgtccagattgtcaaagaatacattgagaaaggaaatgctgcaagaagcacaggcacaactggagccaatgaagagtcctcacgatctcatgctattctgcaattgtctgtgaaaaagcatatcccagttactgaaacccggagacagagagaccgagatgctattgaagcaaagaatacaaagcatgtggggaaaatgtcatttattgatcttgctggaagtgagcgtggtgctgatacaacagataatgacaaacaaacaagaattgaaggtgcagagatcaacaagagccttttggctctcaaggaatgtattcgggcactggataacgatcaaatacacattcctttcagaggaagcaagctaacagaggtgcttcgggactcctttgttggaaactcccgtacagtgatgatttcttgcgtttcaccaagttcaggttcatgtgaacacacactgaatacgttaagatatgctgacagggttaaaagtctttcaaaaggtggtaacacaaaaaaggagcagtttgctgtgcagtctgtatcatctggcaaggaatctacctacacatcgtaccctttatcatgtgaagctgaagagactatggagcagactcaagaaattaggcctgttgattcttctaggaaaggtgttgacagtttcacttccaattcttccattgagcctgagaaaaactcctattgtatgattccaagctatccacataaaggaaaagaagaaactagtactagatctggtttgaatgatagggagagaggggacttgaaatataaccaggctggttttaatagtaaaacacattcacttcaggaatcaataaattcacaagaagaggtgaaagtgacaaaagtctcaccaccccggagaaaagctaacagggatgagaaatcagaaaggcaggtcaactacatgaaaaaagaaagtgggcctgaaattagtcggactggtgttaagcagcaacagcaacttaaacagctgcaaaggccatcatcaacctcatcgtcgcaggttttatccaagcaatctgagaaggaagatatggaaataaacacaatacttgaggaagaggcgctgatagcagctcacagaaaggaaattgaaagtacaatggagatagtacgagaagagatgaatctattagcagaggtcgatcagccaggtagtcttattgacaactacgtggcacagctaagctttctgttgtcgcggaaggcttctggtttggtaagccttcaggcacgcttggcacggtttcagcagcgcctcaaggaacaggagattcttagccgtcaaaaaccattgagatagtttaaaccgcccaaaatggaaacctttcggtttgtcgttgatcgcgagaagcctcggatactggaaactgccatcgattgcgacagcctcggatcatggcctccaacatcgccttttagggatctaagggtgaaaggatgggagatggaaatgtgggctgatgaagtgcgcattcattattgattttgaggttttatgaaccagtttactaatttttcttttactgaaaagggtgcttgagtgtattttctatcgatgtcatgggtttgtcaacgtttgccattttcttttgtacgagtatagttgtaactgttgttcgaataccggtagtgaagtgctgcgagtgaggaaataaccttgccttgccgttatggtgttgtatcttttgttgatatttatttcgcatcaacaaaagaaaagcagcgttcgataaatgtctacaggatttgctttgtaccttgggggtgccctgtttattgtgactacaagtctgtgatatgcattttttataccttt

SEQ ID NO: 22356 - DNA, 1512 bp, Zea mays
ttttttttttttgaagaaaaaattattcattatcttaacctagtgaaggcatcagggcaaagtcttttcttttgttccgcctttttttttttttttcaaggttcagtaataaatactggagtagatggggcgagacgtgcatgaaattcactctcatgatacatcagcgacttagtgaagatattcgttttactcatccttcatggattttggcaacccgtacacagaatttctaacctatgtggtgacgcagaaagaaaggtacgattgatcaaaacataccatggcctttgtgagtaaggcattccctggaaagtttaaagtgtttcaggatgatcaacatctagtatgatcggctaatcctgtcaacttctgaatccacattccctttctggttgtttgaggaagcaaggagcgaatcccaagagttggcgagcaatactctcaaattgctaaatggacagctgtactagaaacttgattctgcgactttcttttctagcaagctcaactttgtggctgcgatgtggattcactggcattaaatgcttcaggagcagctgcagcaccaggattagcatcagcattaacattatcaacctggtcaggcttgtcctcctgcatctctatgtcgtggctaccagatgattcctcagcttctgcttcagccatctctccgtcaacatcacctgctacatgctctgttccatttggtactgctgttgtatgctcaggtgtgctcacagactctacatcagcaggcccagaaatttctgtaatttgcgtgcaatccgaacatggcagcccatgagcagctggatatgggtcagtgcacttcgttattgtagatgtaactaggagattcttctccagggccaatgtaagctttggtaattttgtatatgttccttttggatccaacaaaatctcacaaagcctttgcagtgtgaatggaggaccctcttcaaacctttcaagggcaccatttagccgactaaatagctctgagaaagacctcagttgcccatcattttggctcaccatttcaacctcaaaatattcatccaagacctgcttcaattgaatagacagtacactcttgaggaacctccagtcatgccagaactttccggtgtcagctataacttcaatgatgcttctcatgtcctcaggactgacatcaacatttgtcactgtatcctcgtccaccccgtcctccggggctgcgtcctcgatagcctgatctgcgtcagaagttgactctggagccaccgtggacgccgcagagtcctccaccatcgcaccactctccacatgctgatccgagtgaacagcggcttcaggggccgccgttcgcacaggcaccgctgcattctccgtcacggcaccctccattcgtggttttccccgattcttccgagggcgagaggacctgggggcgctgcaatctagggtttttcgacgccagtagcgggcagagggcgggggaggacagggctggaaaacgggtat

SEQ ID NO: 22357 - DNA, 7928 bp, Zea mays
  misc_feature (551)..(551): n is a, c, g, or t
ttgtacgattactgcaaatattatttttaccagcgcccagcagtttcgttctcttgcatgctgcagaacgttttctttcttttctttttttttgcgcgactcttgtgcacatctatgtacctatatatactcttactcgtatcgtctaattattggttatacccgcaccatcacctgtgttaactctatctaagattttatatttttatttggttgactggaaaaataatacattttgaagccatttgctacatccgccggtcaggcagcaaatactgttgcaaacgttgatcgtaccgaccgttacagtgcgtgtggacacgcgtcaacagaatgtacgttctcgatctatactctatagaaataaagatctgcggaataaaaacaacatatagataaacgtgcaatattgtgcgtacctttgaatttacatatagctgtttccattcgagctctatcgaataaaaatcagtggattctgatgactatccaaagacaattaaggaagatgtgcgtggacagaaacttcttcataccaccgtcagtcattntactacttcaggatggtttattatttacaagatgctaatcgacggcatgacacgcgtgcgcgaagaattgcggtggaaagtaactcgatcgttttaacgcacgtcactcatgccaacaaaatatactgctgtgtatatgtctttcggtgcctactgcggaagcatatcatctccagatgcaggtagcaaccatgcaagagatgctatatatagtgacaccagatatattccgggttttcgaaagttaaaggcgcgccggttcatattccttatgccacctgtcgtcactatatatgatactcccaaaatactacttgttccaagtgtgtttttccccccacgcgcacgtgaattaagtcgaagcagttgatggtactccaaaaacacgagccccaccgaatcgcataatccacaaaaccgtggcttcttggctggtgcttgtggattacattttctatgctagctaggacctaggagagatgatcctcactgtaaggctgcgagctttgtaacaaaaaaaaacaacaacagcttcggtcaccgaagtccaagtagtagggacggacggtagctatgcaaaagtgcgagacatttacagctcacgcgctttacagtaatcgacgacggccgggccggcgaccggggaatcgaaatgactgtcatgatcagatcacgtacgggtggccgcccctagaaattcccgacacgggcggggggcgtgcgtgcgtgcgcgaatcggacaaaagggcccctaacaagtgttttgttcccttctggttcacgtgacagaaaccccagctagccagccttttttcccccaccccgtcccccttgtcgcgcaaaagcgaagcttcacggtactcgccggcgcgtacattcacggcctcggacgcgccggcgcctcttttcctgaccgcgcgccacaaaaaaaaaagtgcggtgtttcacggcacccgccacctgctcgcttggcagcttacgcttgcccggcgccccggctggcggcctcggcgaccggtgaacaattggacactgactggcagcagcttggcaaggctagcacttgcagctcgcgatgtacgcggccccgcaacgaacgcacgcggcctccgcctcgtcgcgcggcatcaccggcccaaaggctggcatggcatggcccgccccgaccaatcaggcggggggcagcagccgcatcgtcgcacgtccgagccaccaccgggcggcccgcgtcggccgacggcgtcgcgctggaaacgcgagagcacgaccggtgatccccccgcgtgctggcatgcatggccggtgattcgaagttccgtctgacgcgaaacgtatctcggccggatctctgcacacttctcgcggcctcactttcttagtatattctcccagcgccacggcgcgcgctgggagctcgtgagcagagagtggttgacagacagaaccgtaagaatattttatctccgccacgccgtccagcacaggcatcatctactagcactgtagcagtggagcgtgatctatcccggccgtggactggatcaaacccctggcgatgccgacgagcatgttccagctcgctgccggcttaccccctacccttcacgtggccgcaggtcctggttccaggttccgctcgatcgctaacctccccaaccgcggcgattcaatgcacctcgccccgccgcaggttagcggcgcccgcgcgcaacgtaaccgccggtccctccgccgaagccggccatgcgctacgacgtgacgccgggcgtcgcgatccgtgcgtcccctggaggggaaatcgggcctcgtgtttcccgaaccaaccaagccgttggcccgccggacgcgtgcccccctcccccctccgcctccccgcgttccgttcgattcgatgtgatcggaggagcagggcgccccgtggaattccgtgcccaaagcggatcgacaaaggctggggcgggtaaaaagtcgtggataatggaggccaccaacacacatgttcgagcaggccagagccagacagcggcgcggcaggcggccgggccgccgcccacgcagatttcgcgttcaattcggcgacttggttcgttgagctgcaagaaagacgttgcgttcgtttccggcactctctcctggcctcgaagctctcaccacattcggcgcttgcgtccgatcgattcctcgcgctgacaacaactcgtaacggattcgagaaatatatgggacagtcaatcagcaagcgtatcacggctttgcaagcgccaaaaacccacgaccgagctgtagggaaatttgcatcggtcgggagacgacggcgtgctcgagagagcggagtcgacacgggcagggcatcatcgtcgcccgctccgacgtggcattacgggccgcccccaccttgccgggcggttgttcacccccggacgcgacaccgggtcccaccgctgccccgccgtggagcgacaggcccgacgtcacccaatatccttctttcccccgtcccacactcccactgcgccgtcgccgcgacccagcccgcccctgcccctggctcgccgagctacgacgagctcgcctcccgcacgagaccattaccccgacccatgcccaagccatacgacccaggcaagaggcaacacagcaagcagcagaaaacatctccgggagtccgaaccacccacaggcggcaggccacaccacaggttccgcttccgcacagctgctagctagctagcgttcgcaagtagcagtagcgttccatcgaggtcgaggcaatggcggtgatggccgaagtagtctcgaccaccggcgcggcgctccggagcccggcctcgcagccgctgccggccgcggtgaagaacgcagacgctgagaagctccagttcatcgaggagatgacctccaacgtggacgccgtgcaggagcgcgtgctgggggagatcctcgcccgcaacgccggcaccgagtacctcgccaagtacggcctcgccgccgctactacggaccgcgccaccttccgcgccaaggtgccgatggcgacgtacgaggacctgcagccgtacatccgccgcattgccgacggcgaccgctcgcccatcctgtcggggcacccggtctccgagttcctcaccagctccggcacgtccgccggcgagcgcaagctcatgcccaccatcgaggacgagctcaaccgccgccagctgctgtacagcctccagatgcccgtaatgaacctgtacgtgcccgggatggacaaggggaaggctctccatttcctcttcgtcaagtcggagacgaagacgccgggcggcctcgcggcgaggcccgtcctgacgagctactacaagagcaaccacttcaagaaccgcccgttcgacgcctacaacaactacacgagccccacggcggccatcctctgcgccgacgcgttccagagcatgtacgcgcagatgctgtgcgggctgtgccagcgccaggacgtgctgcgcgtcggcgcggtgttcgcgtcgggcctcctccgcgccattcgcttcctccagctcaactgggagcagctcgcggaggacatcgaagccggctcgctcaccccgcgcgtcaccgacccgtcggtgcgcgaggcggtcgccggcatcctccgcgctgaccccgagctcgcggcgctggtccgctccgagtgctccaagggcgactgggctggcatcatcacccgcatttggcccagcaccaagtacctggacgtcatcgtcaccggcgccatggcgcagtacatcccgacgctcaagtactacagcggcgggctcccgatggcgtgcaccatgtacgcgtcctccgagtgctacttcgggctcaacctccgccccatgtgcgacccctcggaggtgtcctacaccctgatgcccaacatgtgctacttcgagttcctgccgatggactccgcggcggcgtccggcggcgacgcgagcaagctggttgacctcgcccgcgtggaggtcgggcgcgagtacgagctggtgatcaccacgtacgcggggctgaaccggtaccgcgtcggcgacgtgctccaggtgaccggcttccacaactccgcgccgcagttccggttcgtgcggcgcaagaacgtgctgctgtccatcgagtccgacaagacggacgaggccgagctgcagcgcgccgtggagcgcgcgtccgcgctgctccgcccgcacggcgccgccgtggtggagtacaccagccaggcctacaccaagagcatcccgggccactacgtcatctactgggagctcctggccaagggccccgcgggcggcgccgcggtgggcgaggggacgctggagaggtgctgcctggagatggaggaggcgctgaacacggtgtacaggcagagccgcgtggcggacgggtccatcgggccgctggagatccgggtggtccggccgggcaccttcgaggagctcatggactacgccatctcccgcggcgcgtccatcaaccagtacaaggtgccccggtgcgtgacgttcccgcccatcatcgagctcctggactcccgcgtcgtgtccagccacttcagccccgcgctgccgcactggacccccggccagcgctccgactccgactagacacgcgggccggcgtgcggcgaggcgtgtccggcgcgcttaattagactgggaattcgttccttgcgtatcgcagacgtagaatatgcccgtgaaattaaaatatttgttaattttggaattttgggtactgtcagttagcggctttgagggtaacctgtgatgtgacgagagttggagtcactactgaaggctgagctggtcagctgaagcaacagtcgacgcctgaaggtgttttccggcagtaatggcactgttgtccctatcactttagtagtacggaggacgcggctaacttaaacgttcttccaaatccaaatcccaaatccgtacgagctatgcccctgtgcatgcagaagacattgctgcaacattctgattactactaaaaccggctgcgagctcgttgtgcagacgagtactccagtagtaacttcccagttcgtacggttctttagccttccgacatttccgtttcaggcgagagaattcggttaacgccttcatccatgttttgccacggttaacattagatacggatacggcatgctagaaaaactaaaagccacatcttttgatgcttaaataaatactgtcatactctggaatatagttaggaatctctctaaagtctagttttaaaccaagcacttgccaccttaatcaatctttgactaaaacaaagtgaatgcagtgtatatatagttgaacgaaacgccctcagaagtcagaacttgccacattattggcctcaccatacaaacgcagcgctcggcacggcgactggcatagctcaacggcctctgatctttgtgctgtgcgcgcgactgattgcagtcttttaggtagcctagccgacggcgtctggcagtattatgcgagtgtgacgccttctgcgacgttgatggatgatcaacaaactcttcaggcaccgcacagcgatcattggcggaccggcgcacgatcctgcacgctgctcggtcgcctggtatgctcatcgcttccgggacgcactgtaccttgtgcgtttcatctttcatgcccgcttttccatccacgtacggcggagtcaaaagcgagatcatttgcccgccgagaaagaaaggtatattaacggcctgcgaagttttgcgccgcacagagagagagagtcgtccgtgcaaattggctggctcacggtaaccgaatcacgtgaacgcgatcgggcctacgtgtccgatcctgctctccgcagtcgcgttgcagggagcccgtgacaggacgtgcttgtcgatttggctccgttgacgacctgcaaagagggaggagccacggacggcggatatctgtcgtgtcgtgtcgtgtcgtgtcgtgtcgtgcgcggttgccggacacgccctcgggtcgggcctcctcagataagcgtttgactctgcgtgcgttacctgtcgatccgtcagcgatccacatcgtcgtcactgttgccggatcttccgagactccgaccgcgcgcgcactagccgacacgtcggtcgtcgccttcgccttcgccttcgccttgagtgcttcctccgcagcacgtcgcctctgcctctgcctgcctccgccgcaggctccagtccaaaagggcaccacggtttctagcccggctgcgggccggtcaaccccgcgaaaatgcggtgcggatcacgcgcgaatcgcgggtcatggccgcgtcggactgcgagtggccagcgcccgcgatagcggcaggccgctggtcaacgtttcgtcccgtccggcgagcgctggggcgggggccggcgaggcggctgggaagtgggaactgcgcggccgcccgaatcgccgcccggccgcgcggccgagacacagatgcgggtctccctgccggaggcccgggcgccgctttcctgaccgcaccgtgtggaccgacgagcagcttttttagtatctctgctctgctcctgtatgataggcgtatgcgtatagtacgcgctcgcgtgcagctgctgcaaagtttggcactggcaccgtgctggagtaggagaactgtacaggagatcttgaggctcgtgatcgatccgcgacggctccgtgccggtgccggtgccgcggtgctgccgcgccctttggccgtcggcctgtagctagcagtacgctcttttctcggctgcttgtcgtcttgccgccaaacgctcttatcccgagctgctgctgtatgcatgcctgtgtagtgtgtgtcatgtgtggcgccggggtactccgtaccgccgcggccatgaaacgtgcagagatgtcgggaatcggagaaaccgataactcgtgcaccatttgttcggggcaattattggacccatggcctaggaaatgaacagtcaaacgtggtggatgtgaatggggatgtttgccgttgtcaggttgctatccggataccggggataagactgcgaacgcaactctgtcaggtacgtattgttgacttcgtttgcattgcatgtactacgtacgagtggcgtgcaagccattactgtaggcgtggttgtctccagtctcctggaagcgggtaagactgtgctttgctaaccaacgaccaatcaacaaaagctacatgtatcgagcttggccacttggcagtttgcactagctagagcagcctgccggtgttcggtactcggtttgagtcgccgatgaggtgtgctactgctacctcgagaggacgcaggagcgcgtgtacgcaggcgccgctgtccccgaagcacccaaaaaaaaaaggaaaaaaaaa

SEQ ID NO: 22358 - DNA, 5830 bp, Zea mays
ccgctgccgcgccgtggaccgacagccccgacgtcaccccgtgtccttctccccgtaccactgcgccatgcccccccgccactagctcgcccgagctgtgcaagctcctcgaccactataaatacccccccgccatgccccaaccactccaacccaggcaacacagcaatcagcagaaaaacatctccttggccttcttccatccatatgatccatccctcatccctcctcctaactccaaactacccactggttcgactcgcgttcgcatcgcaagcagcagcgttccatcgaggcaatggcggtgatggccgaagtagtgtcgaccaccggcgcggcgctccggagcccggcctcgcagcagccggcggcggcgggcgcggcgaagggcaccgacgctgagaagctccagttcatcgaggacatgacctccaacgtggacgccgtgcaggagcgcgtgctgggggagatcctcgcccgcaacgcggacaccgagtacctcgccggcaggtgcggcctcgccggcgctacggaccgcgccaccttccgcgccaaggtgccgatggcgacgtacgaggacctgcagccgtacatccggcgcatcgccgacggcgaccgctcgcccatcctgtcggggcacccggtctccgagttcctcaccagctccggcacgtccggcggcgagcggaagctcatgcccacatcgaggacgagctcaaccgccgccagctgctgtacagcctccagatgcccgtcatgaacctggacgtgcccggctgcgactccgccagtgcccgtaacaattattggcagctagcacacacgtgcgcggcgcaacgcagcgcagtcgttgatggtggccatgagcgttggttgaatgatcgtgtacgtgcaggtacgtgcctgggatggacaaggggaaagctctccatttcctgttcgtcaagtcggagaccaagacaccgggcggcctcgcggcgaggcccgtcctcacgagctactacaagagcaaccacttgcacgagaccattacctagaacatcctaatcgaaaagagccccacggcggccatcctctgcgcgggcgttccagagcatgtacgcgcagatggtgtgcgggctgtgccagcggcaggacgtgctgcgcgtgggcgccgtgttcgcgtcgggcctcctccgcgccatccgcttcctccagctcaactgggagcagctggcggaggacatcgaggccggctcgctgaccccgcgcgtgaccgacccgtcggtgcgcgaggcggtcgccggcatcctccgccctgaccccgcggtcgccgagctggtccgctccgagtgctccgggggcgactgggcgggcatcgtcacccgcatttggcccaacaccaagtacctggacgtgatcgtcaccggcgccatggcgcagtacatcccgacgctcaagcactacagcggcgggctcccgatggcgtgcaccatgtacgcgtcctcggagtgctacttcgggctgaacctccggcccatgtgcgacccgtcggaggtgtcctacaccctgatgcccaacatgtgctacttcgagttcctgccgatgggcggcgccgtcgacgcgagccagctggtggacctcggccgcgtggagcgcgggcgcgagtacgagctggtgatcaccacgtacgcggggctgaaccggtaccgcgtcggcgacgtgctccaggtgaccggcttccacaactcggcgccgcagttccggttcgtgcgccgcaagaacgtgctgctgtccatcgagtcggacaagacggacgaggccgagctgcagcgcgccgtggagcgcgcgtccgcgctgctccgcccgcacggcgccgccgtggtggagtacaccagccaggcctacaccaagagcatcccgggccactacgtcgtctactgggagctcctgcaggccaaggggggcgccgcggtggacggggagacgctggaagggtgctgcctcgagatggaggaggcgctgaacgcggtgtacaggcagagccgcgtggccgacggctccatcggcccgctggagatccgggtggtccggccgggcaccttcgaggagctcatggactacgccatctcccgcggcgcgtcgatcaaccagtacaaggtgccccggtgcgtgacgttcccgcccatcatcgagctcctggactcccgcgtcgtgtccagccacttgagccccgcgctgccgcactggaccgccggccagcgctccggctccggctccggctccgactagacacagcggcagggcggcgaggcgtgtccgtgtccaggcgcgcttaattagactgtggaatcatctgctgcgtgtcgcagacgtagaagaatgcccgtgaaaacttaaatactatttgttaattttggagttttgagtacgtgctgccagttagaagcgtgagggtaacttaactcgatgcgatgagagttgggctgcttctgcttgaaccgatcagctgaagcaacagtggacgcatatgtatttccggtccggtagtagtggcactgctgtccgtatcacttagcagtacggagaacgaacgcagctaattttaacgtccatccaaatctgtgcgggctgtgcgcctgcacaagacaagctagatcttgctgcaatattccgattactacaaccggctaggagcctgtgaagaaagattcgtaatacatgattcagtgaagcatagatatgagccaaagacccttagaatttgcctcattactggcacaaacgaagtgcttgccggctaaccatagctgatatctcaacacagcttctgtccctcaccctctgatcttgtgctgtgcgggtgtgactgacctcttgtgcagttgtgcgacgttgacggacgattaataaactaaccagtgcaaccttttcaagcacagtgtaccgctgaatcattggcggaccgatgcacgctgctcgtgctcggccgtctcgtcaggtcatcgctgcggaccggacggacggacggacggaccaacatgctttccctcgatgcgctgtacctaccttgtgcgtttcatgctcactttccatccacgaagtcaaaagcgagatcactcgccctcatagaaggggggttttttttggcgccgcagaaagtccctccgaaattcgtctatccgaaccgtactatcggcctgctcgcgaccgggccctacgtgtccgatcctgctcttcgcgtcgcggtgagccccgtgacagggacgcgtgctcgtcgtcgacgttgtcgataatgtgtgagcgatccacgtcgtcgtcgccgttgccggatctccgagactttgaccccgcgcgcactagccgacgacgcgtcgggcgatgcggatgcggtacggcgttgagatccgctctctcgtccccttgtgtgcttcctccgcaccacagtgcttttaaaaggacctcgcctctgcctgcctgagtgcttaaagggcccacggttttgtagccccgctggcggggtcaggtcaaccccgcgaaatggaactgcgggtcacgcgcgaatcccgggtcttggccgcgtcggactgcgagtggccagcgtccgcaactgcggcagcccgcaggtcaacgtacgggtagggctcgagcctttcggcccgtccggcgaggcggggggcgctcggtggccgtcagaatcgccgcccgcccgcgcggccgagacacagacacagatgcgggtctccctgcccggaggcccggtcgccgctttcctgcgcccgcgccccagggcgccgtggcgtacttgtgcttgtagacgcgtgcagccgctgccaaatttggcgctggcactctgtgctggagactggagtacgtgtacaagagatgttgaggagtcgtgatcgatatcgtagatgaccgcgacggccgtgctgtgcacgccgctatgcatgctgcctccttttgaccgttggccattaggatacactcatatacatacagtacgctcttcgtcggcccgtgctctgcttgtcgtcttgtgtgccaagcgatatccgacctgctgctgctgctgctgctgcatgtgtggcgaggggtgctccgcctccgtgtcgctgcggccatggaacgtgcagaaatgtcagggtcggagaaacagacaagcagtgcagcattgcttcggatcgtccgggcaattattggctccatgggccatgccatgccgccatggcctagaaaatgaagagtcaaacgtgcggggtgtggatgttcgccggtgtcaggttgctatccgcataccggtgataagactgcgaacgcaattctgtcaggtacgtattgttgacttcgtttgcattgcatgtactacgtacgagtggcgtgcaagccattactgtaggcgtggttgtctccagtctcctggaagcgggtaagactgtgctttgctaaccaacgaccaatcaacaaaagctacatgtatcgagcttggccacttggcagtttgcactagctagagcagcctgccggtgttcggtactcggtttgagtcgccgatgaggtgtgctactgctacctcgagaggacgcaggagcgcgtgtacgcaggcgccgctgtccccgaagcacccaaaaaaaaaaggaaaaaaaaaggctcacgtggcgtggtacaggtcaggcggtgcgcgttgcctacaccaatgaattgtgggtcaggtaacgtggacctcgtagacagaagtggtgcgatatagtacgttaatctctaactaaacgtgcatatctaattcggaaatacccgttagaagaatgagcccattataacattaattatacaaatcatgatgggttacgtgctgaatctattgtctactatacaactattattagtacatgttttctgcaggtcgattatgttggttatagattatttagacttaatatatttgtatcgtgaactggctgtcttatataattagtttatatttactccaccttcctctatataggggtgttacgttttatagagaggttcgtattccagctcttcaacatcgacatcacatcgacaattatatgaagggctgttttttgtcatctcatgtccgttgatcatttgtcagtttggttgcaaattggatgaacccaaaccaggcacctcacgcttcccctctctcgggtgggggagccccacacaatggctataagtcctgcatcgcgcaagcccttgattgagtgctcaaaggcatcccacaacatgtgtactctttctttttgtaatatttgaatcaggataaattctatctcaagtttcttaacgttcgcctccaaggtcccaagccttgggatggtctcgtccctgctagcctcttaaccatagtctacaggctttcttcttccgagaggcaagtgcctcaccttgtctctgctcaaaattggtcacaacaactagttgactggtttggggctatatatagttgctcatctcaccaatacggctctcttgttcatttcttcagttgaaacaatactttgagatcaagggcaagttttagcccaagaaagacatctgagtttctttaatccatgtttaaggacctcgttagcgtatagaaagtagcaagtgtgcatccaccttgtttttgagatcaagggcaagttttagcccaagaaagacatctgagtttctttaatccatgtttaaggacctcgttagcgtatagaaagtagcaagtgtgcatccaccttgtttggtaggcttatttaggttaaatgagagcttgtgcttgttactcttagtgatcggcatcacctaaacaacttgatggcgatcgaagagctaagcaatcacccaa

SEQ ID NO: 22359 - DNA, 2472 bp, Zea mays
agtccgggccgcccccaccttgccgggcggttgcccacccccggacgggacacggggtcccaccgctgccgcgccgtggaccgacagcccagacgtcaccccgtgtccttctccccgtaccactgcgccatgcccccccgccactagctcgcccgagctgtgcaagctcctcgaccactataaatacccccccgccctcccccccccccgccaacccaggcaacacagcaatcagcagaaaaacatctccttggccttccatccatatgatccatccctccaggctccagctaactccaaactaccctctggttcgactcgcgttcgcatcgcaagcagcagcgtaccatcgaggcaatggcggtgatggccgaagtagtgtcgaccaccggcgcggcgctccggagcccggccacgcagcagccggcggcggcgggcgcggcgaagggcaccgacgctgagaagctccagttcatcgaggacatgacctccaacgtggacgccgtgcaggagcgcgtgctgggggagatcctcgcccgcaacgcggacaccgagtacctctccagcaggtgcggcctcgccggcgctacggaccgcgccaccttccgcgccaaggtgccgatggcgacgtacgaggacctgcagccgtacatccggcgcatcgccgacggcgaccgctcgcccatcctgtcggggcacccggtctccgagttcctcaccagctccggcacgtccggcggcgagcggaagctcatgcccaccatcgaggacgagctcaaccgccgccagctgctgtacagcctccagatgcccgtcatgaacctgtacgtgcctgggatggacaaggggaaagctctccatttcctgttcgtcaagtcggagaccaagacaccgggcggcctcgcggcgaggcccgtcctcacgagctactacaagagcaaccacttcaggaaccgcccgttcgacgcgtacaacaactacacgagccccacggcggccatcctctgcgcggacgcgttccagagcatgtacgcgcagatggtgtgcgggctgtgccagcggcaggacgtgctgcgcgtgggcgccgtgttcgcgtcgggcctcctccgcgccatccgcttcctccagctcaactgggagcagctggcggaggacatcgaggccggctcgctgaccccgcgcgtgaccgacccgtcggtgcgcgaggcggtcgccggcatcctccgccctgaccccgcggtcgccgagctggtccgctccgagtgctccgggggcgactgggcgggcatcgtcacccgcatttggcccaacaccaagtacctggacgtgatcgtcaccggcgccatggcgcagtacatcccgacgctcaagcactacagcggcgggctcccgatggcgtgcaccatgtacgcgtcctcggagtgctacttcgggctgaacctccggcccatgtgcgacccgtcggaggtgtcctacaccctgatgcccaacatgtgctacttcgagttcctgccgatgggcggcgccgtcgacgcgagccagctggtggacctcggccgcgtggagcgcgggcgcgagtacgagctggtgatcaccacgtacgcggggctgaaccggtaccgcgtcggcgacgtgctccaggtgaccggcttccacaactcggcgccgcagttccggttcgtgcgccgcaagaacgtgctgctgtccatcgagtcggacaagacggacgaggccgagctgcagcgcgccgtggagcgcgcgtccgcgctggctccgcccgcacggcgccgccgtggtggagtacaccagccaggcctacaccaagagcatccctggccactacgtcgtctactgggagctcctgcaggccaacccgcgcgccccgcggtgggcgaggggacgctggagaggtgctgcctggagatggaggaggcgctgaacacggtgtacaggcagagccgcgtggcggacgggtccatcgggccgctggagatccgggtggtccggccgggcaccttcgaggagctcatggactacgccatctcccgcggcgcgtccatcaaccagtacaaggtgccccggtgcgtgacgttcccgcccatcatcgagctcctggactcccgcgtcgtgtccagccacttcagccccgcgctgccgcactggacccccggccagcgctccgactccgactagacacgccggccggcgagcggcgaggcgtgtccggcgcgcttaattagactgggaattcgttccttgcgtatcgcagacgtagaatatgcccgtgaaattaaaatatttgttaattttggaattttgggtactgtcagttagcggcttgagggtaacctgtgatgtgatgagagttggagacactactgaaggctgagctggtcagctgaagcaacagtcgacgcctgaaggtgttttccggcagtaaaaaacaaaaaaaaaaaaaaaaaaaaaaaaaaa

SEQ ID NO: 22360 - DNA, 1145 bp, Zea mays
cattgggtacctcgaggccggccggggtgcccgtgcgcaggtgcggcgggtcgcggcgccactgccgtagccagagcggccctattaacttggccaactcgactccgctgacccgtgacgccggcgccggggcgagtggaggaagataagctgccccactttgcttcgcttctccgctccctgccttctttctttcttccgcgattgtgctgtgtccaactcaaacaacaacagcaacaacaaagaaacctccccttcatcgtatccaaactccaccaccaccatcatcgaatcgaaaccgccatgaccaccagcatcgagtacgactatctcttcaagctgctcctcatcggcgactcctccgtcggcaagtcctgcctcctcctccgtttcgccgacgattcgtacgttgacacctacatcagtaccatcggcgttgatttcaaaatccgcaccatcgacctcgatggaaagactgtcaagctacagatttgggacacagcaggccaggaaaggttcaggacaattacgagcagctactaccgaggagctcatggaatcattatcgtgtatgacgtgacagacatggagagcttcaataacatcaagcagtggctgagtgagattgataggtatgccagtgacaacgtatgcaagctcctagttgggaacaagtgtgatttggttgacagtaaggttgttgacactgaaaaggcaaaggattttgcagattcgttaggaattccctttattgagacaagcgcaaaggaatccatcaacgtggaggaagctttcctgaccatgtcatcagaaatcaagaaaaggatggcaacccaaccaacggtggagaggagacccacagtccatgttcacatgaaaggacagccaatacagcagaagagcagctgctgctcatcatagtcagggctcatagggcacttaaatttggctagtggttagatggacgccgcaggatgttgttcacttaagattatattggaggcggcactgaatggaatggagctagttacatgcccgtgcgttacgacgggagtaaaaaatagatacagatcgacagacatcactatgatatacaaaatgcagacaagtacatagcctctgttcataaaaaaaaaaaaaaaaaa

SEQ ID NO: 22361 - DNA, 1108 bp, Zea mays
gactaaaagaagacttggttattaaagagagagactgaagatggtttgatatatagacatgtggagaattttatcaaacccacacccccattatgtgctggtgcgctgcaggattgaatgcttattcgagtgagctcttcagaagatatcagctttgcagtctttatcgcggtacgtctgtactctgtactcgtccagtgctctttccgacactattaataaatttgaactctccaaatccgcgtttttatgccactctcatcacaggatttttgttctacaacatgcaaatctctatgcacactgggacatcaacatcgttcgcctagtacttctgaattctctggttcaagcaaagaatcgatccgccaagttataacctcttgacgaatacgtctccctgcggcaccggtgctgtacttgtattttgtgccgtctcccagctgtcgagtccactctggttactgtgaccaatagcgttgcaaccttctcttgcgcagctccagaactgtcccctgaagtcccagtaagataatcttgacttcgtatttgtccatgttgcaacgtcacttcaacagattgtctgggagaaattataccgactgccggagaaaccttcagccaagaagggaaacctgagaaagctgtgccagatgactttggtgtctgaccaatgatctcaaaacaagccaactcttttgtacttctgttatgcagtttcacaacaaaagggttttgatcttgcagcatgatgtcattcgtgctgatatctacttcaggcaaagcctccaagccctgaagtgagtcaagcacttccttatttgaactcattatttctccatacttctgcctcattgtttgtttgtccacatgagcaatatctaaattgaacacgcatttgacaggtttatgatcactgtctgttgcttccatacaagagtcgtacagtgatatcgaacagactacaggacattccaaagaacactcaatctgtgaactagttcggctgcccacgcgtccgcggacgcgtgggcaggctggaatgcgccttttctcactattatcataaccagataagcctgctatgtgcttctcaaatttataagta

SEQ ID NO: 22362 - DNA, 6879 bp, Zea mays
  misc_feature (1814)..(1814): n is a, c, g, or t
  misc_feature (5382)..(5382): n is a, c, g, or t
cccctaaataaataaaagtaaatgtgtgctttagcaggatgagcatttttttggttttgtatgtgtgtgtgttacagatacgctacgcgtcacacgatagataaatcgactcacacctgtgtggccatggaaattccgagggtgcgattcctgagactggtcaatggcgacgcgggagagaagggccccgcatggaagaaacgatcacaacggcgaagacccgacagcttcgagatcgttctgggtctccctttctcgttcagtcgttctgcctcacctctccctgcctatgccttctcccgcacgcggccatgacccacaggccacaaaaacaactgtaaacgacatgcggacggtactgccggagttcaacgtctgacgcctttcctacatggcgctgatgaggctgctcatgattgcctcgctcccgctcccgctcccgtctctatcgtataagacgtcgcgctgctgctgccaccgcagtcgccgactcgtccgcagtgcaatgccgggggcctgccaggacctcagcaccatcacgcccacaccacggcggcagagtatggcgcagctccagcgcgggtccgtgctggttggtgggcgcgagctcctcgtccgcgccccgcccaacgtcaacctacggcccgccggtgccggcgtcgccgacggcggggccgcctcgggcgccgcgttcctcggagccagggctccggccgcgtccagccgccacgtgttctccgtcggaaacctggctaggtaagcccgttgttagtcgtactcgtgtcgtggaagaacgcgtcgcgtcgcgtcgcgcgggcggggggcgcctgtgtggccccgaatcgatttgtgaccgatggtttcgttcttggaatctgtggccgcgcgcgcagtgggtggaggtggttgtcgttgttcaggttcaagatctggtggatgatcccggccacgggcgtcggcgcggcggctgtgccggcggagacgcagatgctgcttctggagtacaggagcgaggcgggtcctgcggccgcgacggagcgtggctcactgtacgcgctggtgctgccggttcttgacggcggcttccgagccagcctccaggggagccccgaggacgagctacagttctgcttcgagagcggtgagcttcgtctgctgccatagtgccatgtgctgaaatttgaaactttaagtactctatcgcatcaaacgtgcgaaacttgggattttgattgggatttctgagagaggaaatgccggactgttgttaggtgatcctgatgtccagacgatggaagcagttgatgcagtgttcgtcaactcaggggacaaccccttcaagcttctgaaagaatccatcaagtaatgccattctcttaggtcctaaaataaccctgcttttatacttgtactttcttaggcacggccgataaaaaaaggtcttggacatggttttttcttgtatgtagacaatttgcttaattgcatgttcaacttctttatttaggatgttgtccaagatcaaaggaactttcagtcatatagaggacaaggaggtaaagctacgctcatttcatctgatttgatattgttgcttcttaggcatcttttcattcattatctttttctcatgtcttgtttacattcatcacaaaatatcagatcccttcaaatttgaactggtttgggtggtgcacttgggatgcattttacaaagctgttaacccaagtgggattgaggagggccttcaaaggtttgcaggaacaaatgtttcactagaaaatgggaacacaaactaagagcatcttttgcntcattttcatagctatcacttactaatgatgcatttcatgtccttcagtctgcgtgaaggtggtgtgccaccaaggtttctgattatagatgatggttggcaagaaacagttgacgaaatcaaggaagtggatgaagccctccgtgagcagactgtgttagtgttccatcctttggtaatccataaaagtgtgcatagcgccagttcctgattcatactgtaattatgccagatttgcgcagaggctggctgatctgaaggagaatcataagttcaggggggaaacctgcaagaatcttgaggaccttgttaaaacgataaaagaaaaacatggagtcaagtaattttttttttcagaatacttgttctatgatgactgaatctttatatttttttgatggttaagatgcaatgtgcaaaactataggtgcgtctacatgtggcatgctttacttggatattggggaggcaccttagcagcatccaaagtgatgaagaagtataatccaaagcttgtttatccagtccaatcgcggggtaatgttgcaaatctgagggatattgccatggatagcttggagaaatttggagtgggtatcgttgatcctgacaagatatatgagttctacaatgatcagcacagctacctttctagtgtgggtgtggatggcgtgaaggttgatgttcagaacgtgttggaaactcttggacgcggatttggtggtcgtgttgcagtaactcgaaagtaccagcaggctcttgaggaatcaattgcccagaacttcaaaacaaacaacctaatctgttgcatgagtcacaattcagacagcatctttaggtagcatatttctagctgtggaaaatatgagtgtagatagaatctgatataattcttggttgttttctagtgccttgaagagtgcagttgctagagcctcagaagatttcatgcctcgggaaccaacactgcaaactctgcacattgcgtctgtggcattcaatagcctattgttgggagaaatcttcatacctgactgggatatgttccatgtgagatttcgacatctcgggcagtatgtttaggctcacttctatacttcagtagcagctaattttcgttttccttgtgaagagcaagcatgaatcagcggaattccacggagcagctagagccctgagtggaggtggtgtttatgtcaggtagttttgtgtagaccatttacttaatatatcttctatttatggtcttgtggttgattacttttaacccaagcacaggaattgaccatgcatgtaaatttgttgtgatacgcagtgacaaacctggggtgcatgatttcagtgttctaaaaaagcttgttctaccagatggttcgattctaagagcaaggtatgctggtcgtcctacacgcgattgtctgttcactgacccagtcatggatggcaaaaggtatgagcacgaatatagatttacattttcttttgctactaagttgttccttatagcatactccctccgtttcgttttagttgtcgctggatagtgcaaaattaaactattcagcgacaactaaaaagaaacggagggagtgctaatttgtgaattcttctacagtctgatgaagatatggaacttgaacaatttcactggtgtcattggagtgttcaattgtcagggagctggacagtgggtttggccagttaaacaaactgcttatgttcctaccaacataaacataactggtcagctctcaccgtccgacgtagaatctctcaaggagatagctggtgatgactggaatggggagactgcagtatatgctttcggttcatgtaaatatttgttggctgactgtttctttctaacaatcccatcgtaccactatactatcagtgactgattagccatctgttttgtctcccaggttctctttcaaggcttcagaaacaccaaagtttggaggtgtcactgtctactatgacatgtgagatctacagcatttcaccaataaaggtcagaacttcagattactttccactccctcccttcttacatgtattccacattgtaaatattaagtttttacagacattctttgcttcttgcaccagattttcagcgaagtcgtccagtttgcgcctcttggactgatcgacatgttcaactccggtggtgcacttgacaatatttcaagcgttgcagattcttcagctacgacagttcatataagatgccgaggaccagggcggtttggggcgtattcagacaccaggccagagctttgcagagttgatgaacacgaagtggagttcactcttgcagaggatggcctcctgaccttttaccttcccccttcttcctcccaggacaacctgagacacgttgagattgtctacaaagcatcatgaacgacatttacccttatgattcttacgctccagcatgcaatttctggcgtgctcttcagtaaccaccacacatgcacattgacatgatgtaacaaagaacccattttgttggatttgactgtgtatgctgtgctgcaaatacctgttttatacgattgttctgcacctggactgctataatttgattgacatggtatagcttttttagataaaagatggacatggtatttgaattattgagatccatttttaacctgatgccttactaaatactgtcaggctgccccaacgtgaacttgtcaaaccttttggagtctgattaaattgatagaaaagaacatcttagtcaaaccttttgaagtctgattaaattgatagaaaagaacaccgagatttatgtctcaaataagcaaatgctataagaatatgcctttcatatgtacgtctatataatactagtggtgagttaggaacaggatgaggatctcctgtcaaaagcccaaaatcttaccagccaaaaatcgaagggacaaatttaatatcgtctacggtgtcaataagttaagattagcttatctccttttgaaactctaaaaacagtgcagagaacaataaagctacccaacttccaaacgccaaaggaccagaattaaatttatcagaattggcaggggccgcgcgaacgcgtaccccctctaccacaaattatgacgtccactctcccacttggggagatggtaagccagcgcacccgccatgtgcaatgcaggccactgacctaggccactgggcttcttgatccctagtcgaccccgtccagtaagtatggagcaatggagcacggagcgctcatcttatagcgcgagctcgtggcgcgtctgccttcgcctggcgaggtggtgctaaatcctgagaccgaacgaaacgcgttctgcacttgtgcgcgctgctgcttgagttctcgtgggccactgcttgtagtccatggacctttaacctcgagcccaacatattttccttttccgtgtttggaaacaaccggactgcgagctgcaatggactggacccggttaggcgtgaaattagagccttttgagagtgcaattattatccgtgccctataacaatgttttactgttcttcaacagcttcaaatccnaagttcatcccttagttttttcttttctattttattaaaaaaaatcaaacaagttcgccactgctatgtatgtttcatgtgatcattaggttgtatagtgaactctctagtaatcggggccaggctaaaaaaaggcagcatagtaccagggattaacaaggacgcatgttgccaaaaaaagaaaaagaaatcgcagatcactactacatctcatcacagtccgtgtcgttacacaggaaatacatgtagtgctcctcaagcgaggcagtgcatcttgctctcttgttagatgagagctggactcactaaacctctggacacgcagtttgttgtaggcttccatgttgagatccgaggccaggaagagctcgcctccacctcggcgacgcgttcggccgaggaggaacggcctagcagcatcttctctgctgaagtcgtccttgacgacgtgtgctccttttcgagcctcttcatgaaggatctgatgacacctgaatatggtggactatgacctcaacgttctcgtccttaacaaaagctaggtcgcctaccccagtagctaaaggcactcatgattcttgtaacctatgcaatagctgtagtgctaataggtaacaacggcttacccgagtaaggccctgttcgtcttgtgccaatctataaggattgagggggattaaatcctctacaagtcaaaatcctctccaattctttccaatccccctcaatcactatggttttgggatcaaacgaacatggcctaagggcctcaatttcccgtcttagccaggtttgaagccaaattttcttccggagatatctttgttgctcccagtattgctgcacaccataaatgttgcttgtggtctctagttaattcagcaagcataagtcttacataacaagtgaggcacatagaattctgatgtagcatacagaaaggtgaaagggggaaaacagattggcataataccttttatgttatagaattatgacaccaactcgtgtgcatctgaaagacgcctgcaccaggaggaaagggggattagtatacttcttcacatatgcaataataagttataagtttgtgcatgcagatagcctccatccagcaaccaaatgaatggttgcttgtggatatgggctacagggtgcacatgtaatcactgaaagcagccgtttctctctactctgcttttttggttggtataccaaagttacttctgctattgcccagtgaagattttctatttatttaatgagcacaagagacatacagaagattacctttttagttaaagttcatgtaaatgctttctttttctagaagaatagagtcagtctctttgcaggctactggttatgaaggatagcctttgccttgttcatttactgaatactcacaatcatgcataactagagggagagaaaaaacaagagaggacaggtacctcttcctaggttcctgatttatgtaccaccgctcaaatgattcgc

SEQ ID NO: 22363 - DNA, 2558 bp, Zea mays
ataagacgtcgcgctgctgctgccaccgcagtcgccgactcgtccgcagtgcaatgccgggggcctgccaggacctcagcaccatcacgcccacaccacggcggcagagtatggcgcagctccagcgcgggtccgtgctggttggtgggcgcgagctcctcgtccgcgccccgcccaacgtcaacctacggcccgccggtgccggcgtcgccgacggcggggccgcctcgggcgccgcgttcctcggagccagggctccggccgcgtccagccgccacgtgttctccgtcggaaacctggctagtgggtggaggtggttgtcgttgttcaggttcaagatctggtggatgatcccggccacgggcgtcggcgcggcggctgtgccggcggagacgcagatgctgcttctggagtacaggagcgaggcgggtcctgcggccgcgacggagcgtggctcactgtacgcgctggtgctgccagttcttgacggcggcttccgagccagcctccaggggagccccgaggacgagctacagttctgcttcgagagcggtgatcctgatgtccagacgatggaagcagttgatgcagtgttcgtcaactcaggggacaaccccttcaagcttctgaaagaatccatcaagatgttgtccaagatcaaaggaactttcagtcatatagaggacaaggagatcccttcaaatttggactggtttgggtggtgcacttgggatgcattttacaaagctgttaacccaagtgggattgaggagggccttcaaagtctgcgtgaaggtggtgtgccgccaaggtttctgattatagatgatggttggcaagaaacagttgacgaaatcaaggaagtggatgaagccctccgtgagcagactgtatttgcgcagaggctggctgatctgaaggagaatcataagttcaggggggaaacctgcaagaatcttgaggaccttgttaaaacgataaaaggaaaacatggagtcaagtgtgtctacatgtggcatgctttacttggatattggggaggtaccttagcaacatccgaagtgatgaagaagtataatccaaagcttgtttatccagtccaatcgcggggtaatgttgcgaatctgagggatattgccatggacagcttggagaaatttggagtgggcatcgttgatcctgacaagatatatgagttctacaatgatcagcacagctacctttctagtgtgggtgtggatggcgtgaaggttgatgttcagaacgtgttggaaacccttggacgcggatttggtggtcgtgttgcagtaactcgaaagtaccagcaggctcttgaggaatcaattgcccagaacttcaaaacaaacaacctaatctgctgcatgagtcacaattcagacagcatctttagtgccttgaagggtgcagttgctagagcctcagaagatttcatgcctcgggaaccaacactgcaaactctgcacattgcgtctgtggcattcaatagcctattgttgggagaaatcttcatacctgactgggatatgttccatagcaagcatgaatcagcggaattccacggagcagctagagccctgagtggaggtggtgtttatgtcagtgacaaacctggggtgcatgatttcagtgttctaaaaaagcttgttctaccagatggttcgattctaagagcaaggtatgctggtcgtcctacacgcgattgtctgttcactgacccagtcatggatggcaaaagtctgatgaagatatggaacttgaacaatttcactggtgtcattggagtgttcaattgtcagggagctggacagtgggtttggccagttaaacaaactgcttatgttcctaccaacataaacatcactggtcagctctcaccgtccgacgtagaatctctcgaggagatagctggtgatgactggaatggggagactgcagtatatgctttcggttcatgttctctttcaaggcttcagaaacaccaaagtttggaggtgtcactgtctactatgacatgtgagatctacagcatttcaccaataaagattttcagcgaagtcgtccagtttgcgcctcttggactgatcgacatgttcaactccggtggtgcacttgacaatatttcaagcgttgcagattcttcagctacgacagttcatataagatgccgaggaccagggcggtttggggcgtattcagacaccaggccagagctttgcagagttgatgaacacgaagtggagttcactcttgcagaggatggcctcctgaccttttaccttcccccttcttcctcccaggacaacctgagacacgttgagattgtctacaaagcatcatgaacgacatttacccttatgattcttacgctccagcatgcaatttctggcgtgctcttcagtaaccaccacacatgcacattgacatgatgtaacaaagaacccattttgttggatttgactgtgtatgctgtgctgcaaatacctgttttatacgattgttctgcacctggactgcaaaaaaaaaaaaaaaaaaaaaaa

SEQ ID NO: 22364 - DNA, 2140 bp, Zea mays
  misc_feature (1831)..(1831): n is a, c, g, or t
ggccctaggggcctttttttggcccttggggcctgtttttttttttttttttctattatgagtagatattctctattcaaactctttaaacagtacagtgaacaataatgcaagtcgcgaccaaactttcaactgacaaaggacctaatttaaatttaacagatttcaaactcttacagtacagtaaacaacaattcgagaaacaatcaacttttaactgacaaaggacctaaattaaatttttcagatttggcaggggccgcgcgaacgcgtaccccctctaccacaaattatgacgtccactctcccacttggggagatggtaagccagcgcacccgccatgtgcaatgcgggccactgacctaggccacagggcttcttgatccccagtcgaccccgtccaggtaagtcccggcccggccggccccgagcgctcatcttatagcgcgagctcgtggcgcgtctgccttcgccagccgaggtggtgctaaatcctgagacggaacgaacgcgttctgcacttctgcgcgcgctgctgcttgagttctcgtgggccactccttgtagtccatgggcctttaacctcgaacccaacatatttttcttttccgtgtttggaaacaaccggactgcgggctgcaatggactggacccggttaggcgtgaaattagagcattttgagagtgcattatccgtgcactgtaacaacgttttactgttcttcaacagcttcaaatccgaagttcatcccttagtttttcttttctattttattaaaaaaatcaaacaagttcgccactgctatgtatgttccatgtatcagcattaggttgtaccgtgaactctctagtaatcgtaacgaggacgcatgttgccaaaaaagaaaaagaaatcgcagatcactacatctcatcacagtccgtgtcgttacacaggaaatacatgtagtgctcctcaagcgaccgatcacgaggcagtgcatcttgctctctcgttagatgagagctggactccctaaacctctggacgcgcagtttgttgtaggcttccatgttgagatccgatgccaggaagagctccacctcggcgacgaatcgctccgttcggccgaggaggaacggcctagcagcatcggaaaccaatctcctgaactcttccctccttttctccggtgaagtcgtccaccttgacgacgtgtgctccttttcgagcctcttcatgaaggatccgatgacaccgtgaatgtggtggactatgacctcaacgttctcgtcctgcaaaaaactcaacgttgctatatatccttaacaaaagctaggtcgcctaccccagtagctaaaggcactcatgattcttgtaacctatggaatagctgtagtgctaatagataacaacggcttacccgagtaagggcctgaatttcccgtcttagccaggtttgaagccaaattttcttacggagatatctttgttgctcccagtattgctgcaccccagaaatgttgcttgtggtctctgcttaattcagcaagcataagtcctacataacaagtgaggcacatagaattctgatgtagcatacagaagggtgaaaggaaaaaaaaagattgacataatacctttcatgttatagaattgtgacaccaactcgtgtgcatctgaaagacgcctgcaccaggaggaaagggggattagtatacttcttcacatatgcaataataagttataagtttgtgcatgtagatagcctccatccagcaaccaaataaatggttgcttcattgcttgtggatatgggctacatggtgcacatgtaatcactgaaagcngccgtttctctctactctgctttttggctggtatatcaaagttacttctgctattgcccagtgaatattttctatttatttaaaaagcacaagagacatacagaatataacctttttagttatagttcatgtaaattctttctttttctagaagaatagagtcagtctctttgcaggctactggttatgaaggatagcctttgccttgttcatttactgaatactcacaatcatgcataactagagggagagagaaacaagagaggacaggtacctcttcctaggttcctgatttatgtaccaccgctc

SEQ ID NO: 22365 - DNA, 2193 bp, Zea mays
gcagcgccacaacattcatgacattataaattcaaaacaaggagccatgctcaggacaacaccccacggtggtccaaatattcttcatgggctgataattgacaaacccacattctccagctgttccaaacgaataaatactcatttgaagaaacaacatcacagtatattctttaacactaacatcactattttgtggattttacataatcagatgtctggtgaaagcttgagcaatggctctatgattcttatgcataaagttatataacaatggctaagcatggatggcaatgaacgccccaagagacattgaccactatgattcacatcgcctgacaatcaatccctcattctgttgcagatcgaagtcatctttcaaccgcctgtatgggttcactcgtatgggtttctgaagttcttgagaagttcaggaatgtcatatccaagcatatcatccacggcctgtatcatcttgggcttcaccttctcaaacttgtcaaagctgtaaccgctcaagacctctttgaagtgctccacataaggaaaatctcccgacggaagatggtattcccgttgcacctttgcaaactcatcaggcagattgtctatgagtcgttgttgggcttttgctttgcccatcattgtaggcatctccttctttagatgacctattatataagcatggatcttggcagctctagcacgtttaacaaattcattgatccggcggtcacaggctttcttggggatatctttgagatcagaaagaagatcatcttgctctctctcaaatagttcctttccaagtggaccaacagctgattcatttactggtttgtcattgaatgatccaatataaacacgtgaaacctcaggtgtattcaatactttcccgagagaccacatcaatgcaccataaactctcataagctgttgagtgtctacttggtctgccttgttcaaaactacgcgtattttgtcatcatggccacgtaatgatccaatgacacgtttgaactcatcactgatatcgagcttatgaggatcaaacaggagaaggataagatcacacttcgcagcaaaccatgatgtcacaccagtgaaatcatagctgcgctgtgtgcgttgcttttcaccagaaagaacaccaggtgtgtcaacaaatgtgatatgctctagcagtggatgtcgcatctgagagcactcaaacttggataaaaatgcagtcccaaatgttgtaagaccgctaaaaggcatgtcagcttgaacagcaatagtattcccaggaatagtcctttcatcagatcctgacatgacaactacaaatctgtctgttgttggctctggtccgatatgggcacctggataacttgttcttagcagatgcttgataaaagttgttttaccagtagaatattgacctaagagcataaccattggctttgcatcaaaatcactacttgtcagcaaaggggaaacgaaatcattgaacttgtatgtaacttccaaaggcttcaacttttcgatgtaaagttttttcaagccatcgataacagaagtgacggctgtcagaggtatcttctttgatgactttgagctaaaccatttgtttgttaaaggagattgttcctgaggatatccatccatttctggatcaacacgcttcaccaaatgcttagatttcgcaagtagggcatccaaaccttccatcacaggtggattcaaactgctcaaatcatctcgcttaaggctatcttgagtaatctcgttgcctgcttgtgccagagagactagctgcatcgccgtgacgaattcagagaaacccagatacccctgccttctggtgtccgcgatagcccagacctgcttgaggtcagggcgggagagcttggacatgccaaaaaacttgatcgcatcggggcccgtgatgcggccatccccatctgcgtccgcgagcgcgaaccactcctggtagatcttctggtgctccttggagcagccgctcgcggggtactgtccgatctccatgaccgggcgcgcggcgggcggcgcttcttcggtctccggctctcgccgcgctcagctttaccgccgggcgaagcaagcaaaaaaccctacaacgtgggcctcgctgtgttgaaaccggaacacaagttttcaaaagggcttttttcggctcgaggtcccaat

SEQ ID NO: 22366 - DNA, 1909 bp, Zea mays
cttttttttttttttttttggttcaagagtgagatccttcaaatttattcgtcgcattgctcatgggtttccatggcataacataacataacataacataagctcttgtgtgtgtgttcactgaaaattattcgctaatcattgcaatgctcatgggtttccatggcataacatagccatccttattattctctacatccttctcccgagaccaatcaatcactcctcagctatgaactgcgcgcctatcaacaagtcattctctacctggggaacgtcaccttctcacccgtcaggaccgtagctagacatgatcaggtaggcatgcatggcctcagtcacatgtgaggaaccttcaggacttgggcaatggctccccggccaagaacgaccggaacatcctgaacgccctccggggctggaacaacggcacctcatgccctgcgcctctcaccgacgcaaacgtgagcccttcgtacacctcagaccatcctcctacctgtccagctgagtaccacggataccagcgggtcttgatcttcagaccgagatgactgatggcgaacctcgtcgcggtcaccgggacgactgaatctgtgtcgccgctgaacacccatatcctcagtcctgctttcatcagcttcttgtacgtcggcagcatggagaactctgaatcttgccatgtcttgatcagcacatcactgcaggcagtccatctgtaggggatccccgtggtgttggcgtgcatcgccctctgcacgtccatcctgttgtagtacctctcggcgtaggtctccgtgcaggggtcgtagccggaggagcggcggcggcggacgagggtgttcttgaacctgagcacggtggcgttggccctggccgcggcggcggcgcacgacggcgtgtagatgctgtactggtcgatgtccccgaactcgtggttcatggcgtagctcatggcgcggttgcaggggcgcgagatgctgctgctgctgaagttgcaccacctgaggatggccttgtaggtgcggtcggagatcatggcgtgcgtccaccagtaggtgaccgtgccgatgttgtcgtagtagttgtcggtcaccgcgttgcccacaaggattcccttgaggttgatgaaggggtgtggcgaggcctcgttgtactcgacgatcttccttgccaactgggggacgtagtggcccgcgtagctttctccggcgatgtagaaatctcggtgccggtactgcgggaaccgtgacatccagctgaccaggaactgcagcgcgtcttgagcggtcctctcgtcgcccgacgtcttgaggtccgaggtggtgttggcgtaggagaagccgactcccgcgggcgactcgaggaacagaaggtttgcctctctgttccatgagtacttgttgaggaacaggcctgtcccgtttggtttgatccggaacgggccgatctcctccgacgctccatacgccaccgacgagcatccaggacctccgttgagccagagcacgaggggcttggcggccgcgtcgtcgccgacggcctcggtgagccagtagaagagcgcgcggccgcggtcccggtccaccgccacgtacccggagtactgcgcgaacgccaccgccggctgccccggcagcgcctccacgcggtcgcccgcgcgcgcccggctgctgatgccgccgtcctcgcactcctccgcgccggctccatatggcggcagtagcagcagcacgacgatcgccatgaccagcgcgccgctcgccgccccacccccaccgcgaggccgcgtcgtcgccatggcctttgtgcgcgcgtgggcagaggaactatatggaattgggagtgaggaggaaggtgtggtgtggctagctagctcgcgacggtgtgtgaaccccggcccggccgg

SEQ ID NO: 22367 - DNA, 1107 bp, Zea mays
tgcagaccatgcacacacacatgtaatgtttgttcaggccgtggtcacgtctcttcgcaacatttactcacccccatttactactacgtactgcgctgcacactgtactactctctaggacgtaccttcctcatgcacgcagcgaccactaattctcacacacacgcgcgctacggtagtagttgcttgcttggagtcagaggagaacggagggtacgtagaggagctgggaggaggaggagcaacagaatggtaggtactttttcccgttgggaaggaagaggcaaccggcaaggcgtgtggtgagatgacaggcagtttgaactttggagtccgtgtcaaaaagctttgaaaagctttgtcttggtttccttttttataaaaaaaatactaatactccaaaccccccacagcaaaggtaagaaaaagagctccgtagctacctagcttccctcgcatggaaagaccgaccgactgactgatcgaggacgacgtaataactcccatatgatggtaacatcatatcatgcactgcacacatggcatcgtcgttgaccacggaggacgagcgtgattgctgattattgcatgaaaagaaaggagctaagctctgactgcaggtggaggggtcactcactaacctccgttgagccagagcacgaggggcttggcggccgcgtcgtcgccgacggcctcggtgagccagtagaagagcgcgcggccgcggtcccggtccaccgccacgtacccggagtactgcgcgaacgccaccgccggctgccccggcagcgcctccacgcggtcgcccgcgcgcgcccggctgctgatgccgccgtcctcgcactcctccgcgccggctccatatggcggcagtagcagcagcacgacgatcgccatgaccagcgcgccgctcgccgccccacccccaccgcgaggccgcgtcgtcgccatggcctttgtgcgcgcgtgggcagaggaactatatggaattgggagtgaggaggaaggtgtggtgtggctagagctagctcgcgacggtgtgtgtttttcgattaggatgttctaggtaatgtttaaacacaataaagttggaacgggaggggggaa

SEQ ID NO: 22368 - DNA, 2123 bp, Zea mays
aatattgtcaatagtaacagtgagaagaacacacaaaatgagggttcttgtagagaagctgttagtctctgtgtttttagcagcattctattcagggtgcatggtcgtgtctctagaatatgatcacacggcaagcatcgagtgccttggcgacccaatgaaacccttgtacaagggcggcattgtccagaacagcgagttcaacagcggactgatgggctggtcgacacaccggaacgtcaaggccggcgtgagcagatcgccgtccggcaacaagtttgcagtggtgcatggggcgggaagctacgtgagcagcagcggcaagctcctaccgtcccacagcgtgtaccagagaatccagatgcagagcgacaggcactactcgctatcagcatggctgcaggtgtcgaacggcacgtcggcacatgtgagggcggtgatcaagtcccccaacggcgaacgcgtcatcgctggtgccatcgttgcccagtcgggctgctggagcatgctcaagggaggcatgaccgcttactcttcgggacccgcagagatctactttgagagccacgcaccagttgacatctgggtggacagtgtctcgctgcagcccttcaccttcgacgagtgggacggtcacacccgccgctccgccgacaaggtccgccggcgaaccgtgaaggtggtcgccatgggcgccaacgacaagccgatggcgcatgccaacgtgagcatcgagctcctccgcctcggcttcccgttcggcaacgcggtcaccaaggagatcctcggcctcccggcatacgagaagtggttcacgtcgcgcttcagcgtggccaccttcgagaacgagatgaagtggtacagcaccgagtggacccagaaccatgaggactaccgcgttccggacgccatgatgaacctgatgcgcaagtacaagatcaaggtgcgcgggcacaacgtgttctgggacgaccagaactcgcagatgcagtgggtgaagcccctcaaccttgcgcagctcaaggcagccatgcagaagcggctcaagtccgtcgtgtcacgctacgccggcaaggtcatccactgggacgtggtgaacgagaacctgcacttcaacttcttcgagacgaagctgggccccatggcgtcggcacagatctaccagcaggtggggcagctggaccgcaatgccatcctattcatgaacgaattcaacacgctggagcagcccggcgatcccaaccctgtgcccgccaagtacgtggccaagatgaaccagatccgcggctacgccggcaacggtggcctcaagctcggcgtcggcctcgagagccacttcagcacacccaacatcccgtacatgaggagctcgctggacacgctcgccaagctgaagctgcccatgtggctcaccgaggtggatgtcgtcaagagccccaaccaggtcaagtacctggagcaggtgctcagggaaggcttcgcccaccccaacgtcgacggcatcgtcatgtgggcagcgtggcatgccaggggctgctacgtcatgtgcctcacggacaacagcttcaagaacctccccgtgggcgacctcgtcgacaagctcatcgccgagtggaagacgcaccgcgcgtccgccaccaccgatcacaatggggcggtggagctccacctgcccctaggcgactttaagttcaccgtaagccacccatctttgaaagccgctgctgttcaaaccatgaccgtcgacaattcggcgtcggcgtcccagcataccatcaacgtcaagtcctaggagacgacatcaggcactctgtggcggatctttaattaatttcttctttatttttcattctggtgaataaataggtcccaaagagagagataaaaggagaaggaaaggagacgtggcagcatggccacgttagtgattttttgttcggtgatttttttttgtaagctatatatagatagagagtagtcatttttaagttattaattatatagttgcaaatgcgcacgttaatggttgtcaatagctttgtcacatctatatggattcctagtaatacacataaacattacagatctttgaactaaaaaaaaaaaaaacaaaaaacaaaagg

SEQ ID NO: 22369 - DNA, 613 bp, Zea mays
ccgtgtgccgggtcccctgcgtcgcccgcctacgcggggagagtcataagccaggtcagactaggttagggtttacctgtgaggcctgcttctcccctgccgccgccgccatgggacactccaacgtgtggaactcgcaccccaagaactacggccctggatctagggtttgccgtgtgtgcgctaacccccacggcttgatccggaagtacgggctcatgtgctgcagacagtgcttccgcagcaacgccaaggacattggcttcatcaagtaccgctgaaacttggggagctccaaagcacggcaataatggaggcacggatggggacctcaaagatagcatgtactcttattcttattataaaaccatgtaatgaattgtttggctttgtgtggacgaagttggtgtattctggatggtactcttgaatcttgatgcttccctgctatgctagctgagcatgtcgaaccgctatggatcagacaatacagtatcattgttaccacccaaaaaaaaaaaaaagtttctgttgttcatgctgttttatttgctgctgcgtatggggtgatctagtcccatatagtctccgctgtgcatatttttgtccatat

SEQ ID NO: 22370 - DNA, 793 bp, Zea mays
ccccgggcccgcccctacagaagaagccgaacgttttcggttccgctcagagtcataagccaggtcagactaggttagggtttacctgtgaggcctgctcccctgccgccgccgccatgggacactccaacgtgtggaactcgcaccccaagaactacggccctggatctagggtttgccgtgtgtgcgctaacccccacggcttgatccgaaagtacgggctcatgtgctgcagacagtgcttccgcagcaacgccaaggacattggcttcatcaagtaccgctgaaacttggggagctccaaagcatggcaataatggaagcatggatggggacctaaaagatagcctgtactcttattcttatgataaaaccatgtaatgaattgtttggctttgtgtggacgaagttggtgtattctagatggtactcttgaatcttgatgcttccctgctatgctagctgagcatgtcgaaccgctatgaatcagacaatacagtatcaatgttaccactcaaaaaaaaaaaaaaaaaaaaaaaaaaagggcccgaaaacaaaaaaaaaaaaaaaaaaaaggtccccatcatctcttccaagcccccccagcaaatccccaattcctccgagttcgagcgaccatgtcggggcgtggcaagggcgggaagggtctgggcaaaggcggcgccaagcgtcaccgcaaggttctccgcgacaacatccagggcatcacgaagccggcgatccggaggctggcggggaggggcggcgtgaagcgcatctcggggctcatcta

SEQ ID NO: 22371 - DNA, 1305 bp, Zea mays
cccacgctttttcgcgggtgcaggcctccaggggcacggcgatgggacagcacgactctcttctctgagaaaacccaacaaaaaccctcgctcgcctcacttgttcgctcacctcggtgcggcgcgtcgttcggacacggagatacagcggcgattccggcgatggagtacgtgaaccccctcaccggcttccgcgtcgacggccgccgccccaacgagatgcggcaactcaagggcgaggtcggcgtcgttgcgcgcgcagacgggtcggcgctgttcgagatgggcaacaccagagtcatcgccgccgtctacggcccgcgagaggttcagaacaaaggtcagcaagtaaacagcaaggaggctttggttcgttgtgagtacaggatggcagagtttagtacaggagatcggaggagaaaaccgaagggtgacaggcgatcaacagaaatttctcttgttattcgacagacaatggaggcaagcatattaacacatttaatgccacactcacagattgatatatatgtccaagttcttcaagctgatggtggaacaaggtcagcttgcataaatgctgcaacactagctcttgcagatgctgggattccaatgcgagacattgccacatcatgtagtgctggttatctgtgttctactcctttgctcgatctgaattacctcgaagacagtgctgggggttctgatgtcactgttggcattcttgcaaagatggacaaagtgactttgcttcagatggatgcaaaattaccaattgatacatttgaaaatgtaatgggacttgcaatagaagggtgcaaagcaattgcaacttacatccgagaggtgctattggagaatacaaagaagcttgagtgtcagcgtggttaaccttaggaggcagtgcaggcaggttgatgacctgaacctacccaacaacggacatcacacagcccattaaaaggcttactggttgtggttgtgggtggctggctctagtgcagtgcacaggaacttccaacggagtatgtgcaagtcgtcagaagttgttcaaggcagcttgtttgtcatcatcaccagggatacaagacatgcttcctcagtaaggtgttatcggaatttttcggttcctgtaaactgatataaatcgatggtggaactgtactgataatcttccgtatggtgttattggaatttgtgtgacagttcctgtaaactaatgcagagagagagatccagcggggctcctgcctcctaaatcactccctcccagattgtggggtttttgtagaagcaaaaaaaaaa

SEQ ID NO: 22372 - DNA, 1395 bp, Zea mays
ggacgcgtgggcggacgcgtggggacagcacgactctcttctctgagaaaacccaacaaaaaccctcgctcgcctcacttgttcgctcacctcggtgcggcgcgtcgttcggacacggagatacagcggcgattccggcgatggagtacgtgaaccccctcaccggcttccgcgtcgacggccgccgccccaacgagatgcggcaactcaagggcgaggtcggcgtcgttgtgcgcgcagacgggtcggcgctgtttgagatgggcaacaccagagtcatcgccgccgtctacggcccgcgagaggttcagaacaaaggtcagcaagtaaacagcaaggaggctttggttcgttgtgagtacaggatggcagagtttagtacaggagatcggaggagaaaaccgaagggtgacaggcgatcaacagaaatttctcttgttattcgacagacaatggaggcaagcatattaacacatttaatgccacactcacagattgatatatatgtccaagttcttcaagctgatggtggaacaaggtcagcttgcataaatgctgcaacactagctcttgcagatgctgggattccaatgcgagacattgccacatcatgtagtgctggttatctgtgttctactcctttgctcgatctgaattacctcgaagacagtgctgggggttccgatgtcactgttggcattcttgcaaagatggacaaagtgactttgcttcagatggatgcaaaattaccaattgatacatttgaaaatgtaatgggacttgcaatagaagggtgcaaagcaattgcaacttacatccgagaggtgctattggagaatacaaagaagcttgagtgtcagcgtggttaaccttaggagtgcaggcaggttgatgacctgaacctacccaacaccggacatcacacagccattaagggcttgttcggttagctcttaatccatgtggattgagtgggattggatgagtttgaatcccaaacaattcaaacttcttaagaattttttccaatcccatccaatccatgtgtattgggaataaccaaacaaggcctaaaaggtttactggttgtggttgtgggtggctggctctggtgcagttcacaggaacttccaacggagttgtgggtggctggcttctgttcaaggcatcttgtcatcatcaccagggatacaagacatgcttcctcagtaaggtgttatcggaatttttcagttcctgtaaactgatataaatcgatggtggcactgtactgataatcttccgtatggtgttattggaatttgtgtgacagttcctgtaaactaatgcaaagagagagatccagcggggctcctgcctcctgaaaaaaaaaaaaaaaaaaaaaaaaaaaaaaaa

SEQ ID NO: 22373 - DNA, 2803 bp, Zea mays
atcgagcatcggcggggtcatctccggccgggaaaaaacgtgcttcagctgggctttcggggttacatcaatatttcccttcctccacttcacatcctgttcgtgactcgtgatttcgccgccggaaagccgagggagagggagcgagatggggttcgtcggcgacacgatggagtcaatccgctccatgcagatccgccaattgctcacgcagatcatcagcctcggtatgattgttacctctgcattaatcatatggaaggggttgatagttttcacagggagcgagtcaccagttgtagtggttctctctggtagcatggaacctggatttaaaaggggtgatatcctgtttttgcatatgagcaaagatcctattcgcacaggagaaatagttgttttcaatatcgatggccgtgaaattccaattgtccaccgcgtaattaaggtccatgaacgtcaggacactgcagaagtggacatcctcaccaaaggtgacaataattttggggatgaccgactattatatgcacatgggcagctttggctccagcaacatcacattatgggacgtgctgtgggctaccttccatatgttggctggattacaattatcatgactgagaaaccatttattaagtacctgctgattggtgcactgggcttgctggtcataacgtcgaaagattagagtgtcaaacttcgcgcagtatagattttgctcttatggtgcaacatcagaggttattggctttgctgcgttaagagaagccgttctgttgcaccatggatcaaacgagaatatttgtttatagactgagagcacctgcccactaattagatagtcggttctcatccagcatccatcttttggtatttttagcctagctaatgagttgaaccagttcgttgttctatttgatgatcactattcattgcagctttccaggaaaccccctaggctagctatttgcaatgaaaaaatctgcgcaccaggacaaatttgggatagacgattgttgcttttgtttcatcttattacaaacgggcacacgtcaagccggcaacaggttccggtaatgtgctatgaacaagcaattaaaacggagattgatagggtgcgtttggccaggtttttggctttggtttcggcttggacttctctcccctaaaatccaaaagtcaaacaaaggactggatttagggagctgttttctctgaaagtcatttttctcacaatgtaaaacagaaagcatctatagacctaattttagcagcttttggatggaactatgaaaatatatatggaagaatttttaatagattttagtggtttttatcaaatttgttagctttttagcagctcacagcatacattttttcacatctaatgttatttttttacggccagtctaacaaacagaccatgtataaacagtaagtattgcttcaagaagtttaattagctcttttattatttgagaaataaatttaaagtttatttgagtatgtgttttaattttgagacatgttactttcaactaaatactaaataaaaaaaattctaagttatgcatcatgctggtctgctggagttattgcttgtgcatttatataaatttactagaccaaactcagattggaatttgaaatgcaaaatagaacaggaaattgaaaagacaaaagaaaaagaaaaaaagagataaacaaaacccctcagaaccggcccactctaacctgcatttatataaatttactagaccaaactcagattggaatttagaatttgaaatgcaaaatagaacaggaaattgaaaagacaaaagaaaaaaaagagaaaacaaaacccctcataagcggcccactttaatctcacgcgtcggccaactttccgttaaagccagccccagaatcctcactggggatgaaaacaggatgggaaaaatctcatactgaccgatatcgtatactgtaataatcgattgtataccgtattcgtaaaaaaatgaacgggaaaattcccgagaaaagtggcggaaacgggaacagaaatggttgaggcattttccgactgtatttatggatctcgtaattatacgggaaaatctcgttaatattcccgttttattcaaacattttagtctacctacatctcgccaaccaaatatgtttcagcccaagtaacaataaccaatatccattcatacaagtccaattatcaagtctatcccgaataccctatctggcaaactagtacatgcacgcataggcacagctgtgagcagccccatccccatccacgtacatgagcactgaattgtgaggtatgtataaactgaattttaaaaactgatccttgcttcaaaactgaattgtgactttgtgaggtatctgcatgttctagtttcatagcatagtcttgctaataacgttatgtgcttgaaaacttgaaatgagaatgctatattaaactactagctaaaataatagagcacatgtttgtaatttgtcagcaaagagcaaacttgcatcgttgttctgattttaattaccggttcccgaccgttatcgatgtgttcccggtcgactgcatcgtttactgtcatcccattactcctgtttccgttttccggaccgacgatccctttatcgttcccgattttgaattaaaaatggatttgaaaatggttagagggttttcccgatcgttactgaccattttcatccctaatcctcacgtgcctggccaccgtcgtgctgatgtcagcattacgtcaacatgacatcatccattaaaatgcaa

SEQ ID NO: 22374 - DNA, 1470 bp, Zea mays
tactaccacaatatcgaccctccgcggtggcatccccgaaaaaaaaacgcgaacgcagaacgccgccggcccgtcgtgcactcgtgtttcccttcctccacttgccttcgtgttcgtgattcgtgatttcgccgccggaaagccgagggagagggagcgatatggggttcgtcggagacacgatggagtcgatccgctccatgcagatccgccaagtgctcatgcagatcatcagcctcggtatgattgttacctctgcattaatcatatggaagggtttgatagttttcacggggagcgagtcaccagttgtagtggtgctctcgggtagcatggagcctggatttaaaaggggtgatatcctgtttttgcatatgagcaaagatcctattcgcacaggagaaatagttgttttcaatatcgatggtcgtgagattccaattgtccaccgagtgattaaggtccatgaacgtcaggacactgcagaagtggacatcctcaccaaaggtgacaataattttggggatgaccgactattatatgcacatggccagctttggctccagcaacaccacattatggggcgtgcggtgggctaccttccatatgttggctgggttacaattatcatgactgagaaaccatttattaagtacctgctgattggcgcactgggcttgctggtcataacgtcgaaagattagtgatgtcaaacttcagggccatgtagattttgctcttatggcgcaacagcagagatcactggctttgtggcgtttgagagatgccgctatgttgcgccatgtatcaaacgagaagatttctttatctactgcgagggcacctgcccattgatcggatagtcggttctaatccagcatccatcttttgtagttgtggcctagctaatgagttgaaccagtcgttgggttctattcgatgaagataactcgtcattgcagtcttgcaggaacctcctaggcaatgtgcaatgataaaaatctgcgcggtcttacgtgctgcttcatcatgctgactgatgagcacaacatgcgcctttgtttgtttccacttatttgacagcggcggtgatgagaatcgtataatctagctaaacacctcatgataaactcgcttctcaccgtgccactgtccagaaccgaaaattgaactggtaatcgacaatcggggaatcgacaataatttgatgatgtgaggaatcgtcgatcgcactgttgtgcagaataaaaaattgaactagtaatcgatatgagaaatcgccgacaacaagaatcgtgtttaggaaaagcggaaacaacatctccataaatttatcctctaatattgtactttatagaatcctctaactttttttcttcctttatatcatacaacctgttcgattggctttaattcgtatcgatttctacttcttctacagtgtttttgttttgtctctatataatgcag

SEQ ID NO: 22375 - DNA, 716 bp, Zea mays
  misc_feature (21)..(21): n is a, c, g, or t
tcggtacccctgctaacatanaagggaaggcgcaataattgtgttagcatacgaccctttcccgaaagaggcctcaggagtcaactctgcgtcgtatgcttttcctctcgctttcagctcaatgagtgagggggcaccccgcacaccgcacacactaatcttcccgtaccatccatgagaacaacctgcaggcaagttttaacaggatggggagacgagatgcaaaagcataaccatgtacagctactgcaagatctatgctcgcagaccaggggttggtcacacagctacgagcatccgccttagaacgctggttccttaaaccaaggatcctccttaacaggtctaaactactgagagcatacccaactagacagaaaagaaaaaaaaaactgcggctgaaacgatgctatggcctgtaagaactcggttactcaggcgccatgcgttggtttcagcttctggatccactgcatgagccgcttcttggggtcctggcaggtgccgctcttctgcgcgtcgaggcagccaccctgcgagaggatggagtgggactgctccaggactttgacgatctgccagaagtcgggcctcttgtcaggctgcaaggcgcagcactgctcgatcaggggcccgagggccgatgggcattctggagaaatcgttggccctaagttctgcggaagaagaaaaaaatagaaatccaatcacgtaag

SEQ ID NO: 22376 - DNA, 1824 bp, Zea mays
ccggcctggccgggccgtgcctgccagaagtagaatcattcgattccccaaagcgaaatccgcagcctcgcctctctcgccattttccaggcgcgcgctcggcgcggccgccgccagcgatacagatccttgcacggacacaagggctccgcgctcccaccggatcggatcccgtcccgatggctcccactcccactcacacggcggcggcggtggcgctcgccgcgcacgactcgtccggccacctcgcgccgctcaccatcacccgcaggagtaccggggacgacgatgtagcgataaagatcctgtactgtgggatgtgtcactctgaccttcacagcatcaagaacgagtggcacaacgccacgtaccccatggtccctggtcacgagatcgccggagtggtgacggaggtgggcaagaacgtgaccagcttcaaggccggggaccgcgtcggcgtgggctgcatggtgaactcgtgccagtcgtgcggcagctgcgacgaggacttcgagaacagctgccgggccgtcatcttcacctacaactccgtcgaccgcgacggcaccgtcacctacggcggctactccagcagcgtggtggtgcacgagcgcttcgtggtccggttccccgacgcgatgccgctggatcggggggcgccgctgctgtgcgcgggcatcacagtgtacagccccatgaagtaccacggcctgaacgtgccggggaagcacgtcggcgtgatggggctgggaggcctgggccacgtcgccgtcaagttcgccaaggcgttcggggccaaggtcacggtcatcagcacgtcgcctgggaagaagcaggaggcgctcgaccggcttggcgccgacgccttcgtcgtcagcaaggacgccgaagaaatgaaggcggctgcgagcaccatggacggcatcatcaacacggtgtcggcgaacctcaccttggccccgtacatgggcctgctcaagcccaacggcaagatgatcatggtcggcctgcccaccaagcctctcgagatcccgccctttgatctcatcattgggaacaagaccctggccgggagctgcatcggcggcatgagggacacgcaggagatgatcaacgtggcggccaagcacggcgtgacggcggacatagaactggtggccgcggactacgtgaacacggccatggagcgcctggccaaggctgacgtcaggtaccgcttcgtcatcgacatcggcaacaccctcaagaattcagagtgatcagacctaaaacgccggcgacacctctactgctgctgcttgttgtgccctgtcggctttatacgatgaaccgcgtccttttttttctgtgtcagtgataatattttagctaaggcagacgtaaacgtagttcgcgaggattgccttcccatgcatgttatggaagttggatgcttttattgttgttgccgtaaaacgagatatgatgcagcatttttttattttccctctatcatttggttgctgcatcctctcggttctaaattataaattatttaagttttttaatgtatatttttcattgtatatctagataatactttatatttagacagtgtcggtcttacaccaactcaagcaggccgtgaaaatggacgtacaaaacattgttttatactgctatagatagtcttgtttgtttcacccttaatccatgtggatttttgtggtattaagtcggtttaaatccatattaaattaaaatacaatcctattcattccaatacatttgaatccacatgaaattggaataaccgaataggctccttgttcgtcgacgcggccg

SEQ ID NO: 22377 - DNA, 2232 bp, Zea mays
tatttaatactcaaaaatgatataaaacccatttgatgtgacacgaactaaacttagtcaggggaaaccaaacactattgtcaaataacatctctgcactgcttctgtttgtcctgtttccataaaagtgcgtatctagtatgctaacctgtggatatggaaggacaggcagtatgtttattttagttgcaatagatacttagcccaatttgttagttgcattagaaaggctttgttgttattgtactcttttcttccctgaataaatcaatccctggagttctcttaaagtcagtttttttttaataaaaaagttgcccaaatttgtagattagagcattaagatttatgaaagcaaatttgtatcattagatatttggattcatgataaagtatatttttcgtaatgtgcttatttggcgtcataggcatttgttctgaatttggttaaacacaaaaaagtttgacttaagccaactcttgaaattgatttattcagggagaggtagtatcaaatttcttgcctggttagccgtgtgggttagcattaggttggttatgcacatggctatttatactgctatctggtgaagtttttgttaactattgaataaaaaaggacagacccagcaccagaggctcccacatcacatgaggggtcaggggaaagggataaaccaacgcaagtcccccctcccccctgctttgaatccacgacagtgagagttgaaaatcctccagtaatcatcatgtgttgatgatgtaggatctaaccagtgtcacagtatttttgatttggcttttgtttttggcacgagccccagcccaactccgatcgcacgagccccagcccccaaacagcctccaggtctagctagggtttcgtctccgccgcttgctctaatcctctcccggcacgcgacacgcgagggcgcagcgtttatggcggcgacaccggcggacgcgaagaccgaggccgccaagatggacctcctcgaggacgacgacgagttcgaagagttcgagatcgaccaagaatgggatgagaaggaagaaggcaatgaagctgtccagcagtgggaggatgattgggatgacgatgatgtgaatgatgatttctcgctgcagctgaggaaagaactggagggaagcaacgcccagaagagctgaagtattatttctccagtttacaaatgatccttctatgccagctacttctggaaatcggaacctttatgtgatttgtgctgctgggagcaatcgaactctggagtaagaaagtaaccataccagtgatttctaagtatgaacggcaggaagttgacggacatcagtcggctatttaaaaaatatctcagttgtggttagaatatgccacagttcttatcttattaaaaacaaatgtttttcccttctctgccaaaacctccgtgctcccaagaaaacggggattgcatgtatctttttttttttaatcttcgtacgccgagacgaccaggaggcaaggtgcgctggatggaattgggccgatgatgtcgttgctgccggacgcgttagcgattgctagtcggaggacagcagacctattcgcagtcagcgcctaacgggcgccatcttctcttgatcttataggtcgtgcttggattagtgtagcgagtcagtataaaggcctagacacgatattatcatcagtccgtacctggcagtagcacggtatgccttagccgaagctatgcttcggtcatgttatttttaagtaaaatggggtagtggtcctcaaagctgctccacgggcgccttagggtgcgtttggttgtaatgataaaaaggaatatgatagtatgaagattgtttagttcagggttagaggttgagatgggactgtctcagtgttatccctagttgtcccttaaaattagagggacaagagaggacgtccatgtcctatctatctcataaccaaccgcatcattagtcaccgaactcggacaaccagaaaaatgagtcatgtaactttatcggtatgtgcaaaaccgtccaaaattaaatttgctcaagtcgaatgtcgacgtggtgcgccacgttggaccatactaatgaaagttcggaaactcaaatgacacatcattatcatatacgtgagcccatgtgacatggtatgaaaagttcaaaaacccaagtgactctaatatgacacgtcatatctgcatccggtttgagcaaatctaattt

SEQ ID NO: 22378 - DNA, 2018 bp, Zea mays
ttttttttttttttttttttatttcatttgatctttaaatatatttttataataatttatgttgctaataatttaagttacaagtttaactataaatattataacgtcaactgttttgggacgcagggagtacatttttacacgaaaattcaggaaataaggcacacagtgctcgtaacaaaattggagcgtttcctccgtgtgtagtgtaagataagtttcagagttcccgataacaagataaaaacgcatatacactttgttatggaagctacttttacaatactggacctcttagaagtctgttctccatactgccgctctcgatgcttaatgtgctcgtcctcgtgggggaaaccgttttggtttattttgatcagtcacaaaccgtttctggttcatgggaaaaacaatgccagcttattcgagctcctgggtccaggtcagttcttgcaaagaatacactaatgacagacgactctcccttctgccattccatttaaaaagaaggcgtgcactaaaccacattctgtgatccagggctacttgagatcgtcattttgtcgcctggctaatcttgaatatagaccacccttctcaataagatcaatgtgtttaccatcctccacaatattaccattttccatcacaataattctatcagctgtttgaattgtagatagcctgtgtgctatgattaccacagttcttttagcctttgaatctcgactaacttttgtgatgacgctcttgacataatgttcactctcagcatcaagcgcactagtggcttcatcaagcagtaagatagatgggtccctcagaagggccctggcaatagcaacacgttgtttctgacctccactgagaagagcatcatcaacgatggtgttataaccatcaggcaaagccattatgaagtcatgagcataggcctgctttgcagcccatatcacttcttcatgactgacatctcttgggcaaccatatttaatattagagctgatatccattcggaataagcgtggttcctgtccgacgaaaccaattctttccctgaaccatctgatatcaagctcagtgagcgggacaccatcaattagtatttgcccatttgtaggttcgtataatctaagtagtaaattgattatagtgctcttgccacttccactaagaccaacaattgcaactacttcgtttggattcagtgttaaattcaagcctcccaaaattggtaccgtaggtcttgatggatatgaaaatgatacatcagcatactgaatttgccctttcaacttctctaacttgaggccttcagagctaagctgcttgctaggaaggagatccattaaacgaaaaactttttcacttgctccgacagactgcatcagggaggaccagttgtccccaatccaccatgtggacaaaattagccattcagcatagagtgtgaattttgtcaactgctcagcagttaacttcccagacatgattgctaggcctccaatcaccaccccacgcgcccgcccacgcctgagtagaatggtatagatagttcaagctcaggctccagcctccataagccactgtctgccgaaagctcacatcatacagcttatcaagccagtttgcataccttttaaactcctgcttttctgttccatatactcgcactgtcctaaccaaagttatcacctcttgagcaacattattggcgtttgcggtgaactcctgtgcaaatttagctgcccttttctgaaaccgtccatgaactagcataattgctgatagagttgcacaaacaaacattgtacacaatccgagaggccaagataagactagcagataaattaatgcacctgcaccctgaagtaaattgcgtgaaatcaggttaaggtcattgcctataacacgagacacttgttggcagtccgaaccaagtctacttgtcagatctccggacgcgtgggcggacgcgtgggcggacgcgtgggcggacgcgtgggcggacgcgtggg

SEQ ID NO: 22379 - DNA, 1411 bp, Zea mays
cattgggaccctcgaggccggccgggcacaaccgctctatacgactcctccatcctccccccctccccgtgatggctgcaatggatggggtaattgtagtggagctgtagaggcggcgggggtgcggttgcgacggactgtgctgcgccgacaagctgggaagaggaggcagcggcggcggggtgggacttgggatgggtcttctgtcgaaccgggtggagcggtcggagatcaggcccggcgaccacatctacacctggcgggccgtctacgcctactcccaccacggtatttatgtcgggggaagcaaagtggtccattttacacgtaagaaagaaactgaaacttcagattcatcagactccacctccagcctgatctcagagatttcatcagagtgccaaacattccctgattgtggatttcagctgtctaatagtggtgttgtcctcacttgcttggactgtttcctccgcaacggctccctctattgcttcgagtatggagtgccatctgcagttttccttgcaaagattcgtggggggacctgcaccattgccgaatcagacccaccagaagttgttgtccatcgagcgatgtacctgcttcaaaatggttttggaaactacgacatgtttgagaagaactgcgaagacttcgcactctactgcaagactgggcttctacctgttgaggagcctggcattgggactagtgggcaagcttcttctgctattggtgtgccgttggcagctcttctgtccactccgttcaagcttctggctgctggtccgcttggaatggccactgtcactgctgggatgtactgtgctggcagatacattactgacataggagtaaggaaggacgtagcaaaagttgaagtggagaaattatcatcgcaccccggtttccaccttgttgaagatgaagaatcagtcaacaagcgatcagaaaaaccaaagaccttgctccctatgaagaggaaacgagaaaggtgactgcgaagcacagcttaggaggatgaacttctcttcccttcaattggtgtcgaattgtggataatttgggatatgataataagactcggtatagatatgtgccttgcgaatgtatcataattggattaggcgcacccctcacctgatcaactgtaactgccttataaattcaatcaaattgctatataatgtagatttttcttctttgtgaggtttcagtcttctgctgcaattaataacagttataatattttttactgatctgggagatcactgtatctgtattctgtagttacaacttacaaggtagagcaaactatcggcaatggcgttttcatcaggtatactgtacgaaaagtgaatataaaaaattgagcagagcttgtttttggacaaaaaaaaaaaaaaaa

SEQ ID NO: 22380 - DNA, 2499 bp, Zea mays
  misc_feature (2418)..(2418): n is a, c, g, or t
ggtgtttgtattaatagtccaagttagatgggcccaacccattacacaggggtgagactgtaattacaaggggctaaccccaaaaccctaacgggtacactaatggcttgattggttgctcgcatcatcttgtcctgggccactatatgcgttgactttgtgcaagcttgtgtttggttgactgtataaggaagacccgacctgtatgagcagatacaaaataagtcattttgagactatttgggtgcatctaagcatacgacggaatctggcgtacccagtcggccaagctcctgcgagcgtggctcggcgtgctcaggcatccaatcaggtggtaatagtatttagtatacatatgcgagtctagtcataggcaaaaactttgggttggagtagagtttcaaatacttccaaaaataccatggtatcagcaaaaccatagtattcaaaacagagttttttacaatgtacccaaacaccttttggcaaaaaagaaaatactatggtattctccaataccatggttttacctcaaaactccaaaaatactttgcttccaaacgcccccttttagtggttgatagacataatttaatagggactccttggtctatgtgaatagactagctggagaacattttttgaatggactattttcacgtcgtgagatgttattacttgtaaaatctttttaagacgttcactcatgttttcttaatgcttcattatttcacaggattgttaactatatgttcactgattcacatgagcgacttgttttatgtgcatactggatatgtgtaatatatgtatcagttagaaggttctacagtatatcaaagcaaagcaagacagagaggattcttttgcgcaagtattatcatcttgtcgctgttctcattttctctcctgcagttatatttcaggtagtttgtgcgtttttaggtttgatttcaatcagtcctaaaacaaggttcaatttccagcaagatattaagtattttggtctgaaaaatattttgcagcctgctttcttggacttggcatttggtgcagcatttgcagttttcttgatattggagatgttacgagtaagagaccctattcttctgtcttcccaagttcttttcctcatttaatttgagtagcccgtccctcatttgcccccaacaaaatgttaaccatgcctcagatttgggaaatataccctcttggacgtgttgtgcatcagtttatgaacgcctttactgatcatcgtgattctgagattcttattgtcaggtaggtgtgctttaataggcttcattttcttcatttcgtatcccacttcttgtcatgttctgtggttgagaacctaatattatcggtgtgcagccatttttcactcttactgggctgtgcacttccgaaatggatgtcatctggattaaatgaccgaccacttgccccttttgccggaattctcagcttggggataggtgataccatggtaagttctgtgtctgatctgttaatcactatctttgatcatatcatgaattcttttagttttcctttttacctaggcatcaatgatagggtacaagtatggcgtgttaagatggagcaagacaggaagtgagtccagtttcttattcgctatgcccttctagtccttggatctctggactcttacgctttaatcttttctgaaatgatagagaaaacaatcgagggcacggcagcgggcataacatcggtgctagcagcctgctcgatcctggtgtcactcttggcttccagtgggtacattctttcgcaggttcggcttcgctcttgcttctaagcttgctaccgacaacaaaaccaacaaagcaagctttaatgtaacttactgaccatattttctctgacacagaattggctatcgctcctgatagctgtcacattgagcgggttattggaggcatacactgcacagctggacaatgccttcatccccctcgtgttctatagtcttctgtgtctataagggtagcatcctgtacatctaactgaccttgatatcctctttttgtttacacgctattagtatatacgtagtgcaatatgttatttcgacattactcacttggtctcctcggcgcatcaactgcctggtgattcagttcaacagatcacattctgtgtaaccctgcctttcggaagttgagaggacgtgctcatggttgagacagtcggtacaggcatatgaccagaagtagaaaaataaaatgttctccagtcgttcagtagagggtgtttttggcggagctgggcagttggatgctgtacataaagttttttttatatgaacctgttgactgttgttgggacgaacagtattgaaacatgctgtgatgctgatcaatttgatcactctatttgctctttctatanaccatttttaaatacctcatccattccaccctctatttctcctgttctctaaccattccctccaaacatttctctctatcc

SEQ ID NO: 22381 - DNA, 1066 bp, Zea mays
aggttctacagtatatcaaagcaaagcaagacagagaggattcttttgcgcaagtattatcatcttgtcgctgttctcattttctctcctgcagttatatttcagcctgctttcttggacttggcatttggtgcagcatttgcagttttcttgatattggagatgttacgaatttgggaaatataccctcttggacgtgttgtgcatcagtttatgaacgcctttactgatcatcgtgattctgagattcttattgtcagccatttttcactcttactgggctgtgcacttccgaaatggatgtcatctggattaaatgaccgaccacttgccccttttgccggaattctcagcttggggataggtgataccatggcatcaatgatagggtacaagtatggcgtgttaagatggagcaagacaggaaagaaaacaatcgagggcacggcagcgggcataacatcggtgctagcagcctgctcgatcctggtgtcactcttggcttccagtgggtacattctttcgcagaattggctatcgctcctgatagctgtcacattgagcgggttattggaggcatacactgcacagctggacaatgccttcatccccctcgtgttctatagtcttctgtgtctataagggtagcatcctgtacatctaactgaccttgatatcctctttttgtttacacgctattagtatatacgtagtgcaatatgttatttcgacattactcacttggtctcctcggcgcatcaactgcctggtgattcagttcaacagatcacattctgtgtaaccctgcctttcggaagttgagaggacgtgctcatggttgagacagtcggtacaggcatatgaccagaagtagaaaaataaaatgttctccagtcgttcagtagagggtgtttttggcggagctgggcagttggatgctgtacataaagtttttttttatatgaacctgttgactgttgttgggacgaacagtattgaaacatgctgtgatgctgatcaatttgatcactcaaaaaaaactttcaaaaactcgagggggggcccg

SEQ ID NO: 22382 - DNA, 1046 bp, Zea mays
tttttttttttttttttttttttttttttttttttttttttttttaaaaatctgaacacaattttccttatatctggaaaccaaagatgtacatggttataatcagagtgaggattcacatgcagcagaaatgtaaatttcctggggccaaagacccagggcgtttgtacaagtgaatgggactaaaatggtcaaacaaaaaagcagtactctcctcaaatccgaaatcctcttcaattcgttatgctcgattcatatactgcccagttcttgaatccaccagaatatcatcgcctacgttcacaaaagagggcacagtgacaacagctccagtttccagggttgcaggctttgttcctccttgcgcactatcacttgcccctgggtcagtatcagttacagtcagcctcacagtgattgggaggtcgaaatcaatgatcttcccattccagtacaacaaattgcagtccatcccctctttcagccatttttgtttgtcaccgacatctgcttcatttaaccgactttcttcaaatgttgtcagatccatgaacacgaactgggagccatccttgtatgtaaattgcttggtctcctttgaaagggatggttcctgtagcgtacttccagcacggaaggttttctcgaccgtgttgccagttacatagttacgcagttttgtcctgacgaaagcagcgccttttccaggcttgacgtggaggaactctagaactttccatggcgcgccgtcgacctcgacgttggtgccgaccctgatgtcattgctggagatcgcataaaccctggtgaaggagccggagcgggagcgaagggggcggaaggggagggggaggcgatggagccggagggaggcggtggctgccgcgacgccgtggtggtggtggtggcaggtggggccggcagcgaggtggcggagagcggccattccttgagccccggcgtggctcctcctcgcctccaatgcaactgctgctcgcgttgcgataaggaggtgtcccggcccgccggccgccccgggcccaatg

SEQ ID NO: 22383 - DNA, 1708 bp, Zea mays
  misc_feature (1580)..(1580): n is a, c, g, or t
  misc_feature (1698)..(1698): n is a, c, g, or t
  misc_feature (1708)..(1708): n is a, c, g, or t
gatcctaaagctcgtgtccaaaagctttaaagaagctgataaccacgaataccttaggagttactgcagatgtgtacggcacgcttcagttagactagagtcgattgaagtggacatggatactggtactcccgtgcaagcaacagcctctgcctgacgagctgcacgtgtcccctttttaaccataattctttgtgcactccacagttccattgaaaagcaggagagcaagagtcatttctagccaaaagaacgatctattcagctaccgagacatactgacatcgcatcttatatctcggggatcagaggtaaccaacttgttgacgaggagccttgaagaaaaaaaaactgcgagcactaggaaatctaaaagggattacactactgcacaatatacagaatagtgaccagtcgactaactaacttacttcagcaaaggatctcccaagctcagaggacggcaggtcatagacatccataacttctaatggcatattgttgaatccaaatataatacaggagtacaggacatcgtcatcactgagaaatgggaatcacctgtgcatctgcattcacagctaccttttcactacaccagtttcaaaaatctggtgtggcagttgaagaagctgcttgtgtgttagtctgaagattgtcacgaaaagttgaggtttgctagtcttgagaacacatatgctcttgaagaacatcatccgtgtatttatgcgaggtgccagtggattctagatattctcctgtattcctgctctcagactgctgtgcataatcttcttccagatcaattacatgaattgtttgcccattaactctagcttgtccatctgcagcctcatctaaaataatttgcccatccttcaaatggtgtatatctcctgcatgttggtctgcatcattattcaggagtacttgcttgctgctcagatagtagttatccaaattatgaacacccaaagccatgggatttggctccatttggtcatgatcatccacactatgacctagcagcaattgttcatgattcacatggtgactatccaaaacatgaacagtagtgacctgatctataagcatctgctcattctccatctgttgctcgtccacattttgctttagaagcattttctcattgttcatatggcaattatctgaaatatgtgcaaccatactatgatttagatgtatttccgcattgttcatttggtgattatcatgtgcaggctcaccagcctcaatgttcatatcatacttcatcaaaccatgcccatcctctggtaggtgattatcctctgcattctcgtcttgaacttgatttacttaagtatcatcccgtgcatgttcatcagcctcattgttcagatcctggtggcccaatttagactcatcctccaacatttgattggcccctgcacgatcatcttgaccatgaatttctgaaagtgtcattgttttcttgttgattcaccagaccaattaaatcaggcacagaatcacaaagatcatctgctggaggactgcgagaaatctcggagaactcacaacccactggagtttcaatngacgttgagatcaaaaattttgtaccaagctggcagctcttgttcatccctactgagatcaccgacgacggtttcaacttcagtttgtgaagctgttgtttcaatacttaattcagangtaatcatcn

SEQ ID NO: 22384 - DNA, 1153 bp, Zea mays
aggccggccggggcgccatttcgcaccccagtccgctccgcccgtgtaaaactccaaccgcgcatcgtcgtcgtcgtcggctgcggcggcggccgggcaacgagcctctcttacaaggagagtttcatcgtgcgctgctacgaggtgggtatcaacaagacggccaccgtcgagaccatcgccaatctcctccaggaggtaggatgtaaccatgcacaaagtgttgggttctctactgatggcttcgccacaactactacaatgagaaaacttggacttatttgggtgacgaaccgaatgcacattgagatctacaagtacccagcttggggtgatgttgttgagatcgaaacatggtgccaagaagatggaaaaattggtactcgtcgtgattggatcctcaaggacctgcacgagggtgaagttactggcagagctaccagcaagtgggtcatgatgaaccaaaatacacggagacttcagcgagtcagtgatgacgtgagggatgaggtgtttatacattgtccaaagactccaagattagcatttccagaggaaaataatggcagtttgaagaagattccgaatctttcagatcctgcacaatattcaagactaggactagtgccaagaagagctgatctggacatgaaccaacatgtcaataatgttacttacattggttgggtccttgaaagtatacctcaagatataattgatacacacgagttacaaacaatcactctcgactatagaagagaatgtcaacacgatgacatagttgattctcttacttacgtagaggaaggagaggagagaagcatgaacggctctgcttcctcagtgccgcacacagaacagcggcggcagttcttgcattgcttgagatttgcagccaatggggatgagatcaaccgtggccgtaccgcgtggaggaagctagctagataaaaagtagtttttggtcatcaatattctgctccattttgcttctcgcggttggcggcccttgtaccacaattctgccatgcgtcgatggcgatttctgtcatttcttgcagttgtaaccgtctgtccgttttgtaccagtggacagtgtctgtgcgacatgcaataacctgcgtttaaaccctacgccaacacaggcaagtca

SEQ ID NO: 22385 - DNA, 1811 bp, Zea mays
ctgcagtgtctacggagattccatcagacccaaacggtcccgttgccatccctaccctgtacgctatacacatgctgtgccatccctaccctgtacactatacacatgctgacactcgcaccgcacaccgcacgcgaaatccagtcggcgcgacgacatcaccaccgccgtagagttgtggaccaccaccggcgcatgcacagggtccagagatttccttgttccttccttttccccaccgccagcacgtcgtccagcacgtcctcgttcctatcgccccgtgcgcccggtccaccgcccgccaccgtccctggcccctttttcatatccactgtgcagtgcccggctgcccgccgcgccaaccccaccccgctccgcccgtgtaaaccaaaccccgcttcggcggcggcggcgactggcccacgagccttctcgaaccgacgcatccgccacccatgctgcgctgccacacgccaccgcaatgcgcccgcgcgccgctccgccaccacggaaggtgggagtcgcctccggcggcggcgcccgcggtggtagtgcggtgcgcgcggggtgcgccgcaggtgtccgggatcgaggcggcttcgccgggccacgcggctgtcacggcggcgttagctaaggcggaagggggtgacgcgcggcccagcctggccgagcggctgcggttggggaacctcctggaggacgggctatcgtacaaggagagtttcatcgtgcgctgctacgaggtggggatcaacaagacggccaccgttgagaccatcgccaatctcctccaggaggtaggatgtaaccatgcacaaagtgttgggttctccactgatggcttcgccacgaccactacaatgagaaaacttggacttatttgggtgacgaacagaatgcacattgagatctacaagtacccagcttggggtgatgttgttgagatcgaaacatggtgccaagaagatggaagaattggtacccgtcgtgattggatcctcaaggacctagctaatggtgaagttattggcagagctaccagcaagtgggtcatgatgaaccaaaatacacggagacttcagcgggtcagtgatgacgtgagggatgaggtgtttatgcactgtccaaaggctccaagattagcattcccagaggaaaataatggcagtttgaagaagattccgaatctttcagaccctgcagaatattcaagacttggactagtgccaagaagagctgacctggacatgaaccaacatgtcaataatgttacttacataggttgggtcctcgaaagtatacctcaagatataattgatacacacgagttacaaacaatcactctcgactacagaagggagtgtcaacaggatgatatagttgattctcttacttgcatagaggaaggagaggagaaaagcatgaacggctctgcttctgcagcagcgcctcacaaagaagagcggcagcagttcctgcattgcttgagatttgcagccaacggacacgagatcaaccgtggccgtaccgtgtggaggaagctagctagataaaagtgttctttcgtcataaatgatctcctccatttctctgctcacggctggcggcccttgtaccacaattttgtgatgtattgttgccctttggaatgtactcagccatgtatcggtgccgatttgtgacatttcttggagctgtagctgtctgtccgttttgtaccagtggacaatgtttgtgacatgcaataaactgcgtttctccggcaaaaataaaaaaaaaaaaaacaaaaaaaaaaaaaagggggcccg

SEQ ID NO: 22386 - DNA, 1455 bp, Zea mays
gcgccaagccgccaaccccagtccgctccgcccgtgtaaaactccaaccgcgcatcgtcgtcgtcgtcggctgcggcggcggccgggcaacgagcctcctcgaaacgacgcgcccgctctcccacatgctgcgctgtcacgcgccaccgcaatgcggccgcgcgccgctccgccaccacggaaggtgggagtcgtctcccgcacccggggtggtggtgcggtgcacgcggggtgcgccgcaggtatccgggatcgaggcggcgtcgccggaccacgcagctgccacggcggtggcggctaaggcggaagggggtgacgcgcggcccagcctggccgagcggctgcgactggggagcctcctggaggacgggctctcttacaaggagagtttcatcgtgcgctgctacgaggtgggtatcaacaagacggccaccgtcgagaccatcgccaatctcctccaggaggtaggatgtaaccatgcacaaagtgttgggttctctactgatggcttcgccacaactactacaatgagaaaacttggacttatttgggtgacgaaccgaatgcacattgagatctacaagtacccagcttggggtgatgttgttgagatcgaaacatggtgccaagaagatggaaaaattggtactcgtcgtgattggatcctcaaggacctgtgtactggtgaagttactggcagagctaccagcaagtgggtcatgatgaaccaaaatacacggagacttcaacgagtcagtgatgacgtgagggatgaggtgtttatacattgtccaaagactccaagattagcatttccagaggaaaataatggcagtttgaagaagattccgaatctttcagatcctgcacaatattcaagactaggactagtgccaagaagagctgatctggacatgaaccaacatgtcaataatgttacttacattggttgggtccttgaaagtatacctcaagatataattgatacacacgagttacaaacaatcactctcgactatagaagagaatgtcaacatgatgacatagttgattctcttacttacgtagaggaaggagaggagagaagcatgaacggctctgcttcctcagtgccgcacacagaacagcggcggcagttcttgcattgcttgagatttgcagccaatggggatgagatcaaccgtggccgtaccgtgtggaggaagctagctagataaaaagtggttttttggtcatcaatattctgctccattttgcttctcgcggttggcggcccttgtaccacaattttgtgatttggggtgcattctgccatgcatcgatggcgatttctgacatttcttgcagttgtaaccgtctgtccgttttgtaccggtggacagtgtctgtgcgatatgtaataacctgcgtttatccggctgctaaaaaaaaaaaaacgacatgagatgcgaacct

SEQ ID NO: 22387 - DNA, 4134 bp, Zea mays
aatcatttcccccctccagttccacctttatggcgtccaacacggacttacattggcccagctcgctataacgctacgacttctcgattcgtgttcattgccaaaaatatcaccaatgcatagtaagctaaatctactcggctttttgggtaagcaaggtcaggtaccccaaatatttgaaaagaaaatatcctgctacatgccagctatttgccacgtgcagaagaagctattatcgtgaagcaacaatgaggttcatctttgcagcggagcatgagtccttttctctcacccgtcagtctagctgatattcagtttctttcatgaaaacacagctagcacacgagtgtcaagtactcaagtagaagcaccataatcgtgcaaatcccatataactataaaattacagctgacttaaaaaactcgcatcgctattgttacgagggaaaaggctccatgagtgtacagatgaccttcccttgcctccagaataatcaaccaccactatagaaaacctctatttgaaaccaaaaccgccgaaaagaaccaaggttcgttcaaatgcaatcatcatgtatctctctttggtgcagcagctgaagtgactcaaacttgttcgtaaatccaaactgcagatcaaagctataacaagaaatggaatgtatgataatcatgagaaaatggatcagctcaaatgtgacagctatggtcgactggtcgtataaaagcagatgcatgcatgaaggttccagtacgacagctttgtatcccatccttttcagaaagaaagtcattctactttgccctaaatcaaatcatctaaaaatctgactaagttattcggatttagttgtttacaatacaagtatcaggaaatatatttcatactatgcttatttggtgtcataaatacaacttcactataaacctggtcaaacttattgggtaatatgcaagtctaaatgcatcattgtagatgatgcttcttaatataatgaaatacagctcacctacgttttcgagaaaaaatgatgatgatgtcataaagcttcgtataaagatgagcatggccagataaaaatttggtagcatatgataaaaagttactattttttctatagaagtgttaaataaaaacagaagactaatgcaaaacttcattgaatcacctctttggtgcacactgaaggacacaaacatagcagtgcatccaatactccgtaataccgatgttcatccagggaaatgagggagacgtctgcagatgaagcgatgaaggcaccctgaacaaagaaacataggagttcaaaacaaatggcatcaaaaagggtaaaaatcaatctgatatattgtgcacctttcaccgctaaggatcccgtatgccaattgtttgcaaaaggagtaaccagtcctgttgaaaactctctcgtaatttgatctgattacttgaactgcacatatcatccattatgttaggaagattaccagcaagtggaacagcaaaaggcaactgcagcctagtacctcttgcgagatgcattctattgacaaaaggtaagcacactactggtgatatgaacataaagctaggccgcaaaatggaactattcgaaagttgggcaagctatttgtatttgggcttcagtttgttgtaaactaacatcttaatatatattattcaaataggcatgtagaaccacatggacatgttgctgcagacatttattgtaaaattaggtatccaacaaaaaatgtatcaacccttcaactaagaatggtctaagcaaaaatcaagagaaacattttaccaaaagtcgcatagctgcaatgaagttctgaaactaatgattctgatagtttgtcgattagatcctcctttcttgtttcattgcaacatccgactgaatgggatgataggtcgtcatcttcaaaagtatgcccatttgatggcagatgaaagaaaaataatccagcaggaaatctgtgcctcctcatcacccatagagttaactcagcataaggagtggattggattagagcaatgacaatttccagcatcacacacacccagataaccgttgttgtcaagatagagaagaatacatagaatacagaagttgtaggtataagaagtaggattggtgtaaacaacagggaaccaaccacgtgctgttcaactgtgtagtcataactatctaacctctgcctaagaggattccatttgcgccctctgttatggcattagcaagtgttagcaaacttacgaagcaaatatgaaaaaaaaaaactgacgggaaacaaacacctcatcagatgctatcgtaacaacttagcaatatttatggcatattaaataaaaaccatagaagagttacaggcaacaaaaatgacaagaaataatattaaaaatagctaatgttttatggtgcaaacattatgcttttacacacattaagttatctggctccattactagcttctatacacggacataagtgaaaagtaatcacagtcaaacttacttatcattcttggcctagttgtattctgccaaagaaaatctggatagttaaatattttatttccaactaaggaaaattggttccggagcatcaaaagataatcgctttcagaattaccatcaatcaacattctgtaagataccatggcaagtacgagactttcaaatttaccactccattacttttgctcctaatggtgctaaatcaggcaatgctagccctcgcctatgaaagcacatctccctgctgctttctatgtctagaaaaatagacaaggcaagaagcagtcaataagcataactacatcctcttcctccggcttatcatcgtggtagtactccctaccatgggctcgtggcagtgaactcaaggttggagtcacatcacaaccaacgtgatcaccacagacttgggtttcgtgatgccaaggtagagtaactgcagcccatactcagggggcccttgcctggagtcacaccagcagatgtgcacgctgtgcaaagaagagggaactactagatctcggtggtgccaagcaccgtcaagcaccatcttctcgtagacaaagcggaggatttggcagagcttcattttgacattagccatcttgtgctgcaggcaggccataatggcctcctggcagcgctggacattgaggggctcctcaacctcggcccacagtgccaatgctgcggactgccaccgcctccgtctccaacagcatgcaccctagtcctatatccacactgtgcagtcctccccctcctggtgattccaatcgaagtgtacaagtgaatttcatgccaaaggcttaagcttttgggttcatctagttagtgtgtccactctaacaattcctttctacatgcttccccactactgccgtcatgtatcagtgccgctatggtgctaccaacctctccttcgagccaccagaccagagcctccccctgcgaatgatcagcacagtgagccatgtcagtcgctggctgccgtagcgggcgacatcaccgacagagtgcagccatcgtcaatctgtttgaccaacctgttctcaatgctcaagtttcagcgcaacgaccacagagcaaaaccattcccttatccatcagctcaaaatggagtgaagaacagcatgtagtcttgtgggcggtaaccgagtgctagaatttgaaatggactcattttgtgccttgtatttttacagagcaccaatattctgatggcaatatccaaagtgattatcttttgatgctatggaaccaattttcccattcccattcctagattcacgcaagttatctcattagttggggaaagtgatctagccagggattttacttttatattacggattattaggattttagtcaagaccgtgccttcaagttaggggctttggaggtcaaggactttcgcccaatcagcctgatctatagttttgcaaaaaaatgtcacaaaagtattggctaataggcttgctatcaggttacttgagttggtgtcaccaaatcagagtgcttttgtgaaaggaataagtattcatgacaatttcattttggtgcagcaaacagccaaagccattcataagcaaaagctctctagagtcctc

SEQ ID NO: 22388 - DNA, 1956 bp, Zea mays
taagcctaaacggcccggagggccgggagggggaatctagagcacgccagcgctcatgtcatgcatgtgttgcgtgcggatgccctcccgaactgtcgtctacacaagattttggtactccgatccgctatcatgtctgttggaccgcatgaggcgtggaacggtagctacacctacacgtacacgtcacgagctggcggttgaggctgagctcgacttagtaggcagcgccacgcttgccatactacactagcaaacattaataacgcaagcggcactgttgtcagtgtcagtgcacagtagatatactgctagctagcttacctggcagccagtgcaactgcactgcacgtctccaatgcgctgctattataacgacgcgaacgccgcgcaggccttccgtggtatacagcagcagaagcagcatcacgatcccggcccggcggcgcgtacgtcgacgaggaggaggaggacgtacgtacgcagagcagctgctggcaccatggctcccgtgagcatcagcgctgttccgttcctcccgacggcggcggagggggagacgaagcgtgcgcgcgtcgttcgtgcgcgaggaggacgagcgccccaaggtgccgcacgaccgcttcagcgacgaggtgccggtggtgtcgctcgagggcatcgacgggccgcgcaggcgggccgagatccgcggccgcgtggccgcggcctgcgaggactggggcatcttccaggtggtggaccacggcgtggacgccgcgctcgtggccgacatggcgcgcctcgcccgagacttcttcgcgctcccgcccgaggacaagctccgcttcgacatgtccggcgggaagaagggcggcttcatcgtctccagccacctccagggggaggcggtgcaggactggcgtgagatcgtgacctacttctcgtacccggtgaaggcccgcgactactcccggtggccggacaagccggcggcgtggcgggcggtggtggagcggtacagcgagcagctgatggcgctggcgtgcaggctcctgggcgtgctctccgaggccatgggcctggacacggaggcgctggccagggcctgcgtggacatggaccagaaggtggtggtcaacttctacccgaggtgcccgcagccggacctcacgctggggctcaagcgccacaccgaccccggcaccatcacgctgctgctgcaggacctggtcggcggcctccaggccacgcgcgacggcggccggacctggatcaccgtgcagcccgtggagggcgccttcgtcgtcaacctcggcgaccacggccacctcctgagcaacggcaggttcaagaacgcggaccaccaggcggtggtgaactcggagtgcagccgcctgtccatcgccacgttccagaacccggcgcccgacgcgacggtgtacccgctggccgtgcgcgacggggaggcgcccatactggaccatcccatcaccttcgccgagatgtaccgccgcaagatggcccgcgacatcgagctcgccaggctcaagaagcaggccaaggccgacaagaagcagcagcagcagagtgccaacaaggagttcgccgactccaagcctctcgacgccatttttgcctgatatggtagagggcgcgcgactaccgatccgttgttattgctgcgtgtgattaattttcatctataagaacatagctacgtgcgaccgcgcgtgtggtgattaattaaggtctgaataaaataatggctgcacaaaactaggaagcgatcgatcacccagataaatgtatgtgcgttcccttttcttctttcaagatgtgtaattttcaacgtgcggttccagatgcatggactggactggaccggagtgcattgtaattcttttgtttccccctgttgaatatgcgagaggtgtgcatgtctttgtatgaacgaacgaactaaacacttgtatc

SEQ ID NO: 22389 - DNA, 3068 bp, Zea mays
gcttaatttagctgattcaaactgggggcaggggcagggcagggcaggcgtacgttcatggagaaagacttgggtccgttgagtactcaagtacacaatgcatggactacccctgcaaggaattcgtagcatcgatctagatggaatttggaacctgcaaggctgaagttgaaccgggaaatcagcaggtacaaatgcgatatgcaattataggcggggcggggcgaggcgtgctgagacatgcagatcatatccaaaactaggaaggcaaggctggtgggtggtccgtccattcgccgtcgctttcagtacaggtcatcgtcatcatcacgctaccggaaggctcgcccgcaatcgatccaccacgtatactactacaacaacgtcgtcgatctccatcgtctgccaaagtcaacctatatatgatatcagtgcagcagcagcagctccttaccaccaccttcatgcatacccggtacggttttgcaaaatctagccgcgctgaagccggttttgcatcctccaggccggccaccggagttgattcccatccatccctcaaaaacccaagccgggggcgggtcaccggcaccagcatcgcaccgcgcacagtgccgcccgtcgacgtcgcgtttgcattgcccattcaggcgcaagttattagtcgtgggagggaggcatctgtacgcacgcacgtcatgataacgattttttactagggcgaatttgtcgacagtctcgggcagcagcagtgtgcccccatcatctcccatgtccacgagtcaatcaatcgctgccgcctgccgatggccctttttgcgtggaaacgatcgagcctcccagtctgtacgctacgctctcgagagagagagtctactgtttcctgcatgaccgcccgctgtgagtgcacagttgatccgtttcactctcccctccccgctcctggctcatgcatgccgatggtaggctcgccgccgctgctacactatttgtaaaagacctgcagattccagcaaagtgagagcccgctggacccagattcccatgtgccctgccccccccccccccctacgggtactgtggctactgcaccccggtcctcttccgccccctctgccttgcactttcctgccatccattccatgcccaccttttttttttctctctctctctcgctccagagcttttgttcaactaaaattcatctcggcggtgtggatataattgtggaccattggtagatagcacgaacagctggtaaaaactagttcatcctttttgtccatccattgagttggtctacaatttaaaatcaagatatagctaaaatctactcccttttttttacagtgctggcaacctagtagatgcacagagactgcgttttgttgtagctaacgagactcaaatgctgcatatatcgctcgctcaccggagttgtgtttttgtgtttggttcacgcatgaaacatgtgaaccatctacaatatatgctaccgcgcgtacgtatgcctaggcagtgaaattccactagtagagtggtaaaacacacacttttcaagtctccatcaactccattataaatctagctacccggggtgtccctctccccaatcacctcaaaaacctctccagccccaccggtccaccaccgccagccaccccccccacacactctctctctctccagccagcccccaacacgacgaggcaggaaggcgccatggccaccacccgcgaggtctccagcagcgccgccgccatgttccacgtctaccagacgataccgatgccgacgccatcgacggcagcggccggcggcggcggcgccatggtgtcggtgtcggcccccgcgaagccgggcaagaaggagggcggcggcaaggaccggcacagcaaggtgaacgggcgcgggcggcgcgtgcgcatgccgatcgtgtgcgcggcgcgcgtgttccagctcacccgcgagctggggctcaagtccgacggccagaccattgagtggctgctccgccaggccgagccctccatcgtggccgccacgggctccggcaccaccccggccgtcttcgtctcctcctccgcgccgtccgcggccgccgccccctcccactaccaccaccagcagcagcaggccaccgtcgtcctcgtcaagcgcccgcgcgaggaaggcgacgccgcggggtccgtgttctgggccgcgctgccggcggcgccgcgggccacggaggcctggggcttctcgccgctggaggcgcaggcggcgtcggccgcggccgcggcggcgtacgtcccgatggcgcaggcgcaggcgcagcaccaccacctcaacctgctcgccgcgctctccggcgccgcgaggcgcgccgaggaggagacccggtgactccgccgtggcttctgacacgtactgctaccacgtccgtcgctcgcgcgcgcttaattatttgatcgctgtccgcgtgttcctgcaagcgctacgttcttgattctgtgtgtgtgctcttgtgatttccctttcaccagtccaaggcagtgtcccgtggtcgaggtttgatgaaagattgctgtggtgctaaatttaaatacgagtccttgcttagatcttactgcattctgtgttgggttttctgcgcctttatatttggattccatggaatttgtttcggttagcatcatcttgtctgtatcagcccaatgagtcatttattagtagtacaagcataaagctcaaaaaaaaaaaaaaaaaggtcatttcttattgctgtattcaattaacgatggaattctctattcgaacgcaaacggtaatcataagggtccgaccaaaaaaaaagctcattagagtaaaatttatagacttcttttgacacctcctcctgctgctgctgcacgagaatcgatggcatctgaaaaacgttcagatgtgccatgcccatcatcagtacaggcttatagctgcagatgagcagattacagcaatgatagccgccggcctgcggagaggggagaaaagaaagaatcaaagaattccctttcgccccgtcggtcgcttttcctcgtgag

SEQ ID NO: 22390 - DNA, 1767 bp, Zea mays
  misc_feature (26)..(26): n is a, c, g, or t
actagcaaacattaataacgcaagcngcactgttgtcagtgtcagtgcacagtagatacactgcgtgcctcctggccggccggccagtgcaactgcactgcacgtctccaatgcgctgctattataacgacgcgaacgccgcgcaggccctccgtggtatacagcagcagaagcagcatcacgatcccggcccggcggcgcgtacgtcgacgaggaggaggaggacgtacgtacgcagagcagctgctggcaccatggctcccgtgagcatcagcgctgttccgttcctcccgacggcggcggagggggagacgaagctgcgcgcgtcgttcgtgcgcgaggaggacgagcgccccaaggtgccgcacgaccgcttcagcgacgaggtgccggtggtgtcgctcgagggcatcgacggcgcgcggcgggccgagatccgcgcgcgcgtggccgcggcctgcgaggactggggcatcttccaggtggtggaccacggcgtggacgccgcgctcgtggccgacatggcgcgcctcgcgcgcgacttcttcgcgctcccgcccgaggacaagctccgcttcgacatgtccggcgggaagaagggcggcttcatcgtctccagccacctccagggggaggcggtgcaggactggcgtgagatcgtgacctacttctcgtacccggtgaaggcccgcgactactcccggtggcctgacaagccggcggcgtggcgggcggtggtggagcggtacagcgagcagctgatggcgctggcgtgcaggctcctgggcgtgctctcggaggccatgggcctggacacggaggcgctggccagggcctgcgtggacatggaccagaaggtggtggtcaacttctacccgaggtgcccgcagccggacctcacgctggggctcaagcgccacaccgaccccggcaccatcacgctgctgctgcaggacctcgtcggcggcctccaggccacgcgcgacggcggccggacctggatcaccgtgcagcccgtggagggcgccttcgtcgtcaacctcggcgaccacggccacctcctgagcaacggcaggttcaagaacgcggaccaccaggcggtggtgaactcggagtgcagccgcctgtccatcgccacgttccagaacccggcgcccgacgcgacggtgtacccgctggccgtgcgcgacggggaggcgcccatactggaccatcccatcaccttcgccgagatgtaccgccgcaagatggcccgcgacatcgagctcgccaggctcaagaagcaggtcaaggccgacaagagtgccaacaaggagttcgccgactccaagcctctcgacgccattcttgcctgatatggtagggggggcgcgactaccgtaccgatccgttgctattgctgcgtgtgatttcatcatctataagaacatatatagctacgtgcgaccgtgtggtgattaattaaggtctgaataaaataatagccgcacaaaactaggaagcgatcgatcaccccagataaatgtatgtgcgttcccttttctttcaagatgtgtaattttttcaacgtgcggttccagatatgcatggactggaccggagtgcattgtaattcttttgtttcccctgttgaatatgcaagaggtgtgcatgtctttgtatgaacgaacgaactagacacacttgtatctgctcccttcgttcaataaatatacgacgccgccgttgatttttttttttcaaaaactcgaaaaaaaaaaaaaaaaa

SEQ ID NO: 22391 - DNA, 1867 bp, Zea mays
  misc_feature (1865)..(1865): n is a, c, g, or t
cgaaaaaaaaacacaaaaactgcagatgaatgatcggccaacagtgtttcacattgctaccactacagctaaaatctcgatgatgatacagttgacccatcttacaacaccagaagaaaacaatcctgaggatacacaaggcaaggatgtacaaacgtaaacagcacacattgatagaccttcgaatcgaacgacaaatcctagtgcttgcctgacatgcagcgcgagaaaaatagagaagatagagaaataattctgattattccaagttgaagcaactcctgcaacatttggtatccgacaagcacccactcatcacataggctaaactagttcgctacaataagctcatcttcaggattggcattttgaggtagcatcgtcaattcatcgtcatttgcactgaaatgatatttctctccaacagctctcagaagctggtaaacttcaaacattgtaggcctttccttcggagaagaaagcacacaagagcatgcaaccttcatgcactgaagcagctcagcatcgttgtcctttccaatcaaagacttgtcaactgcatcctgaagtatagagttgtttgacaggtacgttatccaatccaccaaactccctttgaagttctctggcgcattcgacacatgtgtgggctcttcacgagtaacaagttcaagtaagacaactccaaagctatacgcatccccttttggagtggccacaagagtgtgtgtatactccggagctacataccctaagtcaccaaactcaccattcacaaatgtgctcaggtgggtgtcgatgggattcataagccttgccaagccaaaatcggaaatcttaggctcatagtcatcatcaagcaatatgcacttggaactaatgttcctatgaagaatgcgagggttgcaactgtgatgaagccacgccaaacctctagcactcccaatggcaatttttagcctcaatggccattccaatgcctttttgtcactgttttgctggtgtaaattatcataaagtgaaccctttggcatgtacttatacaccaagagcctctcattcttgacaatgcagtatcccaaaagtggcactaagttacgttgccttacacttcccagagttgacatctcagatgtaaattggtcctctgaatgctgagtgtcctgcaacctcttgatagcaaggaatgaaccatctggaagtgttgctctgtacatagttcctgatcgaccagttccaataatattgtcctttgtaaaatcatctgttgctttcataagatcattcaagttcatctttgaaactgatttctcaaacaatgatacctttgctccttttgctcccttaatagtctttgcccacttattttcttctacatcctttaacttcttcttcttaggcattttccgcaagacaatgaataaaataacagcagctattattaaagttataactgcaccaccaacagcagaaccaacaattatccccgttcgactgcttgaattggcagtgcaatcattgcttagaggcctcccacaaaggtcttgatttgcaaaatcagaggctggaaacttgttcaaagatgaaggaatctgccctgacaattgattgtcagcaacattaaactgggctaggcgactgagtgcagcaagctgaactgggattgttccagtcaatttgctccgctgtaaattgacaatgttgagataagaacaattggctagcgcttctggtatctctcccgagaagctattaaatgacagatccccggctgtaacaaatggaagtctcctcgagatgtcagccgggatagggccagagaggctgttgcttgacagacccagcgaagtcatgctactacaatnca

SEQ ID NO: 22392 - DNA, 1996 bp, Zea mays
ggtaaagccgactgcagattaataaagccgactgtttggactgctacaattacaattctagacccccctcgagcgttttttctgttgttgctagaataaagaggcgtcttgttgtggcaaactgacacgagggttaagtgatacgtacttccaatagctctcatgcagtgcaactcacagttactaaatactgaaacgatctacgtttccaccttcgatttctgattctcaagcgagcaggagcaaccgagtgagccttcactgtcatggcacaagtctggtaactccgttctcaaatatttgtcgcgagctagcttatttttaaactaaaacgcgacaaataaataagaacggagagagtgctgtgttagttagaacatctacgttgctccacacttcactaggtcccaagtcgtctggttacacaaaatcaggacccaaatgctgtcttctcgcccgctctgcaccccttcaaggcgaccccgacgagctagggaacctgcaggatccatgacttgggtctttgatagtctgctctgcgaggttgttgaagtagcacgtcgctccagtcttctcgaactgctgccagtacgaattgaaagcatagctggcgtgcgccgccgttgtgttgggcgtgtagcacgttttcccgggctgaatggcgtcgcaggtcccgtttccctgcccgcacgcgtacgacagcgcgttccccaccgccgtctcgttcagcttgttgctggcggcggccgagagcacgcaccatatcggtcctttgtacggtgtgttgttctccggcgccggcaggggcgggtacgaccccagtggccgccgtccggtgaggtcgatctcgtagactgccgtgccgttggcgtagtacagtccccagtgtcgctcggtgcccggccctggcttgaggtcctcgttgtatagagagaacacgaacaccggcatcttcgcgcccggcctcaccggcgtgcccgggttcttagccatccgcgccgcgaggttcctgttgtagatggcggcgttgtggacgttgccgccaatctggttgtagtcgcagccgttgggccacccggtctccgcgatggccagcttcacgtgcccgtacccaagcttcgccatcgcgatgaccaccgcgtcgagcatttcgtcgagcaggttggtgtacgtgagcccggtgcccgggtcgacgtagcgtgtgcgtccgccctggaagagcgcgtagtcgagcgagacggtgaggttgttgtcggcccagacgaagtaggggtacgcgtcgacgaagtagtacgagttggtcccgttcaagaagtgcagcagcgggcgcacgactgcctcggcgatgtcggcgcggaacgcggcggccgacggtgggcgcgggaaggcgccgtcggcgagcgcgtccatggcgagcgtggtgccgatcttgacgctgctgatgctcctctttcggaggctccggtggatgttctccatcgccgggacaaggtgtggccaggtggagttcgcgatggacaagtcggagaggatctcgttccccacgagaaggaacttgacccgtgtcgccgggtagtaggggaccaggttctcggcgacccaccggtccgccgcggccgcagaggcggcgaggtccggtatgatctggtttggcaccatgatggagacgggccagcgcgtcccagccagcgcgcggagcacgcccgggttggcgtcgtagatcttgaccgacccggcccccgccgcgcggagcagctccacggagcgccacggcgaagggatgtcgtccgccacccggccgtagttgacgccgagcccgtagccaccgcttgccccatacgcctcgctccaggcgacggcgacgcagagaaggaagaagaaggggaagctcaagagcggcggaccggccatggcttctctgctatgttggcgtttgcctgggcgttctgagacctcggggttgccgacttgccgtcttcccgtcgggcagcggatt

SEQ ID NO: 22393 - DNA, 767 bp, Zea mays
  misc_feature (687)..(691): n is a, c, g, or t
atagtttatagagataaaaataatgtagaagcaatagaagccagtataaaccaaagccacatgttaagccgccttgtcgactgacacgagggttcagtgatacgtactcccccaagaggctcatgcactgcaactcacacgtactgaaaactgaaacgaactacgtttccaccttcgatttctgattctcaagcgagcaggagcaaccgagcgagccttcactatggcacaagtctgctgaatccgttatcgaatatttgtcgcccgctaactcatttttaaaacaagaacggagagagtactatgtgtctgtgttagctagaacatctacgttgctccacacttcactaggtcccaagtcgtctggttacacaaaatcaggacccaaatgctgtcttctcgcccgcttctgcccgtcaaggcgaccccaacgagttagggaacctgcaggatccatgacttgggtctttggtagtctgttctgcgaggttgttgaagtagcacgtcgctccagtcttctcgaactgctgccagtacgaattgaaagcatagctggcgtgcgccgccgttgtgtttggcgtgtagcacgttttcccgggctgaatggcgtcgcaggtcccgtttccctgcccgcacgcgtacgacagcgcgttccccaccgccgtctcgttcagcttgttgctggcnnnnnccgagagcacgcaccatatcggtcctttgtacgggatgttgttctccggcgccggtaggggcgggtacgaccccag

SEQ ID NO: 22394 - DNA, 1672 bp, Zea mays
cgaggcccggccggggatccacctttccaccgtcaccatggccaccgccactacgtccgcctatcattgcaacgccgtcctccaccttcccagacctccgcagttccgccggctcctgccccctctcccctccctcgtcacccgcagagccgcgagcgtcgggctgggggtcgcccgtctcggttcgagggcgagggcaagggcaagttccgtaccgccaccgccaccattttttgaaaccgtggaggaggaggaggaggaggaggaggagcgtgggtggtcggatgcggaggcgggattcagtgacgaggcagaggatgagcaggagtggtcgggcggcaacggcgcggcgcgcggggaggacctgggcgcggacgccggcgaggaccttagcgggtgggcgcggcagtggccgcgcccgcgggagctgttcgtgtgcaacctcccgcgccgctgcgacgtccaggacctgctcgagctcttcacgccccacggcaccgtcctctccgtcgagatctcacgcgatgccgagtccggaattagccgaggaacggcttctgtgacgatgcgatctctagcagaagctcgggcagccatcgacgctctggatggattcgacatggatgggcgtgaggttttcgtgaagctagcgtccgacgtcatttccaacaggaaaaacgtgaacctggcccacataacgcccacgaaggaccacatcttcgagaccccgcacaaggtctacgtcggcaacctcgcgtggtctgttcagccgcaagacctgagagagctctttacccagtgcggaaccgttgttagcacgaggctgctgacggaccgcaaagggggcaggaaccgagtctatgggttcctctcgttttcttccgcccaagagcttgaggaagcgttaaagctcgacagaacggtcttcttcggacgggatatcgtagtgaaggaagcccatgtagagcgccagacgcgctgagccgctgagtgttacccttgagaactgcactttttttgtctgcctcgttgactgactaagctcatgctccaggcacaagctacacagctgacgaagaagcaattgagcggttcatcgcgaaagagttaaaaaaaaaaacggtagtgtaaattagtaccattgctgcaactttgtcagcgccgccgtggatgctggtgtgagaaattctaggacgaactgagaactggtattgtagtggtaatacatgttgttttagcttcttataataccctccatacagtaatagtgctccttcaccacacgtttctaatgtctcgaatttttgtttgtgaaagggattctaattgagttggtcagattgtagaacacccggctctggttgtggtttgctgcacttctaaggctatctctagcaatctattcatctccatctctcatttcaaactttactattttaaacttgcaatatatagtgtaaaacaatgttttgcatgattatatgtacaatttagttatagtctaataccctaatatcttcaagtacacaaaggtcctgtgagttgttagatggcttgagtagaagtccggtattggtggtagtcgttctctgtagtttcctgtacatagacgtggcagtggtcgttctcacatgctacggtttcctgtgtgaagcagatgctgttagctgtt

SEQ ID NO: 22395 - DNA, 3761 bp, Zea mays
  misc_feature (3194)..(3194): n is a, c, g, or t
gatttttctatactataattttagtcaaatttaattgtttgctctagaaaactaaaaatattcgtcggttcatctactgggcaggatgcacacgtggctccgcatccaaccgttcctgggtcgcacagcccatcccgccgcgccgtctccctctcgccccaaacccctctcctcctctctttctctatccacctttccaccgtcaccatggccaccgccactacgtccgcctatcattgcaacgccgtcctccaccttcccagacctccgcagttccgccggctcctgccccctctcccctccctcgtcacccgcagagccgcgagcgtcgggctgggggtcgcccgtctcggttcgagggcgagggcaagggcaagttccgtaccgccaccgccaccattttttgaaaccgtggaggaggaggaggaggaggaggaggagcgtgggtggtcggatgcggaggcgggattcagtgacgaggcagaggatgagcaggagtggtcgggcggcaacggcgcggcgcgcggggaggacctgggcgcggacgccggcgaggaccttagcgggtgggcgcggcagtggccgcgcccgcgggagctgttcgtgtgcaacctcccgcgccgctgcgacgtccaggacctgctcgagctcttcacgccccacggcaccgtcctctccgtcgaggtacgctatgctagagcccgacgtaggataatcctgagctgacagctgagcttctctatgccgatgcttactgtgtatcgatcagcaacggcttccacacaggcaactcacttgttgaagatgcttgtatagctgtataagcaccctgccaaataatgcatcagcaacagagcaagtctgatatttctgaactcattagctgaacgaaacaagcaggattttcaacagaaccatgctcttgacatcttttctgttgacaatgtattagctgctactactatttgattgggtggatgatccattttatgatggactagtaggtacattgcgagtagaggctgtgcttgcttgtgttgcttaaactcgacgacattaacatttttatttgacgctaacacttcaagtcatttacgcctcgcagatctcacgcgatgccgagtccggaattagccgaggaacggcttctgtgacgatgcgatctctagcagaagctcgggcagccatcgacgctctggatggattcgtgagtcgtttacacccccatatatccagatgaaacttttacggcgtatctcagtccttctcgagcctctcaactcacgacgccgtgtgttttttttctctcgtaggacatggatgggcgtgaggttttcgtgaagctagcgtccgacgtcatttccaacaggaaaaacgtgaacctggcccacataacgcccacgaaggaccacatcttcgagaccccgcacaaggtctacgtcggcaacctcgcgtggtctgttcagccgcaagacctgagagagctctttacccagtgcggaaccgttgttagcacgaggctgctgacggaccgcaaagggggcaggaaccgagtctatgggttcctctcgttttcttccgcccaagagcttgaggaagcgttaaagctcgacagaacggtatggttcaattcaagtttgaagtttcctgttccagtagcttgtttttttgtttttcacagatttgatcagctctggttactgctgttaattagtctcgcatgatggcgttgttatcaatgatagaggagaacttaaagcatgtttgttgtataaattgtcataccttatctaacttttctgtctaagatcaattcggacgactaatcttagataaagtatgacacagttagtcacgaaccaaacagacccttggatttcggttgacttgtactggctcctttaaaattcttgcgtaatccgcgacccgaatggcgcagttctgagaactccagccgccctaccactattcttctagataaagtttggatgactttgcccaccggacaagaagagtaatgactgtttgtggtaatttatagtaataaagagagttagtcatgtttagtagccccaggtgcccaatttaactccctgatccgaccacctgctgctagtagcccagtatggttctctacttgtgtggcttgtcaagttgtcctcctacccaatgatattgctcagcaccttggcttacatcacttctttgcttctgcaacaggtcttcttcggacgggatatcgtagtgaaggaagcccatgtagagcgccagacgcgctgagccgctgagtgttacccttgagaactgcactttttttgtctgcctcgttgactgactaagctcatgctccaggcacaagctacacagctgacgaagaagcaattgagcggttcatcgcgaaagagttaaaaaaaaaacggtagtgtaaattagtaccattgctgcaactttgtcagcgccgccgtggatgctggtgtgagaaattctaggacgaactgagaactggtattgtagtggtaatacatgttgttttagcttcttataataccctccatacagtaatagtgctccttcaccacacgtttctaatgtctcgaatttttgtttgtgaaagggattctaattgagttggtcagattgtagaacaaaaaaaaaaaaaaaaggtttgctgcacttctaaggctatctctagcaatctattcatctccatctctcatttcaaactttactattttaaacttgcaatatatagtgtaaaacaatgttttgcatgattatatgtacaatttagttatagtctaataccctaatatcttcaagtacacaaaggtcctgtgagttgttagatggcttgagtagaagtccggtattggtggtagtcgttctctgtagtttcctgtacatagacgtggcagtggtcgttctcacatgctacggtttcctgtgtgaagcagatgctgttagctgtttgccatttctccatccttttcaagtattgccttttctgtatcccttttcaagtattgctttttcccctctatccttttcattacctagcaatctagcgtgacatctctctctggattaccttttgagttttgacataaactagtgtattgtgcgctcttgcgcgtgcgtattccagcataggttttacgaaggaattattgatattagtggctggtgagccgatnaaggacgagatttgatatgtaatttaagcatatataagattatagaaatgaaataagtaaatatggagataattaattttatgaggaatttgttaaaacatgtcactctttattgccgctatacaaaatgggtcacgcctcgtcacagttgtcaaaatagaccgttctggtcgtgtatgtttgtcaaaataatcacttctggatagtggtagcaaactgaatttcatttgtcatgcagttgtaatcttgaacatggctgaattctaaaaggtggtggcaaactgtttcatggtatcaaactgattttctaaaattttggatggtgctagcaaatagaatattatggcatcacgtttgttgtcaacttttgtttggtttttcctttgtcatgcagttgtaatcttgaacatggctgaattctaaaaggtggtggcaaactgtttcatggcatcaaactgattttctaaaaattttggatggtgctagcaaatagaatattatggcatcacgtttgttgtcaactttttgtttggtttttcctttgtcatgcagttgtaatcttgaaca

SEQ ID NO: 22396 - DNA, 2246 bp, Zea mays
  misc_feature (1711)..(1711): n is a, c, g, or t
cagtaactcaaaaactgactaatgtagattgtgcaattcttgagttctttttgtgctatctacgcagctgttgacttatttgtgcttttgggggtgaatataaagtttgatctttttcattaaaaaatcaaataaatgctacagcatatcctcatactttgtttcttctaaatgaaatgctgtgaagctcggttgtgttcaagaaaaaataaagctacgtaatagcataatttatctgtaaaacagcactgaacatgaaaaggcgtcagaatggtatcacattccttcacttcgttttgatatgtttttatgattaactcaatagtatcacttatataacttgccaaaacttcatcatcatcaccttattgacttgtgggctaaatctacatggcacaataagggatataaaggaactatacactgtacagcgacatataaggaatcagttctatgttccttcgatttctgttttctggatggcacaatactaccatctttgctggtcatacttgaactccttttacatttcatcaggtatttgcccaaggtttttgaaagatacagtggtgctgatggatttgtgttcctccaagaccacatggttcttaactactggaacctgatgcaagctgacaaggaaaaactttggattacaaataaggtctgtatattgtctgttttctgtttccccagctatttttattaatcagtgcaagtgcaaattatactgtaaattcacactgtactttccgatgctgcaggctgcacattcttgggttactgttccattggagacgaataaagaggaatggtttgtaaagcaaggtgatatggtcaagcaggtcattggcagttccccagttcatttccaaacaaactacaaggagagcatgggcgaagataaaattatattctgtggtagtgaactattctacgtgccccggcggtttgttgaggactttggtgaccttgtgggtcttgtcggcaatttggatttgcatcacaagattgcggtcccaatgttcttcttggcaatggactcgactcaaaattttgactctgatgctctggctggaacagtgttcaggccacagttgccagctaatgcgacgttctcgtctatttatacagctcaagcacctgctgttttccctgtgaaagttatgaatgagattgatttcataaaggtgattcggctaatgtccataggagacccacttctgatggagttggtttaaaggtgtaatgtgtagttgaagtgcaagcttatccttgtggccatgaggacagagtagaaaaggcatagttttgtgttttctggtgtttttgtaatttcatttattttgttcattctgtagctgtttattcctctgctgttgtatattggtgtaccattagtgacaaggttacttgggatctgctcggtccagctgtcctgctgaaagaaaggacggcctgtcagatacgagtcacggagaagagcttcgccctggccagctacatttttgcaagattttttggttgccaatagtaaagatccacacttgggcaatttgttgtaccattcaaactgatacaaactctcagaggaatattttgttttgtgctcgttgcagaaagcattgatataatgaaaatttgtaagtttgagccaaaaaatcttgatttgattagaatctattatctctgttctcagatatttatcgtncgatagtttatttttgaactaaaatgctacaaataaaaaaaaatacggaaggagtacaacctcaactcacctgcaaaggttatcagctcccatacatctcaaataattaattaggatattatttatagcccctaagaaggcatatagttgttgcatcatcaacagttaactaaagtttctcagctctcatacatctcaaataatcaaataggatcttatttatagccgctaagaagacatatagttgtcgcattctcaacagttaactctgcataccgtcaaaccatctgtcgggtacactattgggccattatgttaaggtccgacatctcccaatggctacaatggtagcactattgtcgacagttggagacatgcactatggcatatagtccgacgctaccatcaaatcagcctgactccctatttccttctctataacttctcttgtgaccatctgattctatctctgatggtccgataaccccctaaacataatttgtctgatgcttctgtctgtgagcatgaactgtgg

SEQ ID NO: 22397 - DNA, 1359 bp, Zea mays
ctcatgtcattggagattgataggcagcgtgcaaccatcggagaaggtgacatgaaggagtttgtgcccaagaagctgccatctgtgcatccaggaattcggcacgagggcacagttaactatgagattggaaatcttattaagtggagaaagaactttggaaatgttgtgatgatcatgcacgttagtgggcctgtggatcgcacagcacttgagtggaggctgctttatggaaggattttcaagacggttatcattcttgctgagcagagcaatgcagagcttgctgttgaacgctgcacgttgtcacacgcttataagtatttgcccaaggtttttgaaagatacagtggtgctgatggatttgtgttcctccaagaccacatggttcttaactactggaacctgatgcaagctgacaaggaaaaactttggattacaaataagattgcacattcttgggttactgttccattggagacgaataaagaggaatggtttgtaaagcaaggtgatatggtcaagcaggtcattggcagttccccagttcatttccaaacaaactacaaggagagcatgggcgaagataaaattatattctgtggtagtgaactattctacgtgccccggcggtttgttgaggactttggtgaccttgtgggtcttgtcggcaatttggatttgcatcacaagattgcggtcccaatgttcttcttggcaatggactcgactcaaaattttgactctgatgctctggctggaacagtgttcaggccacagttgccagctaatgcgacgttctcgtctatttatacagctcaagcacctgctgttttccctgtgaaagttatgaatgagattgatttcataaaggtgattcggctaatgtccataggagacccacttctgatggagttggtttaaaggtgtaatgtgtagttgaagtgcaagcttatccttgtggccatgaggacagagtagaaaaggcatagttttgtgttttctggtgtttttgtaatttcatttattttgttcattctgtagctgtttattcctctgctgttgtatattggtgtaccattagtgacaaggttacttgggatctgctcggtccagctgtcctgctgaaagaaaggacggcctgtcagatacgagtcacggagaagagcttcgccctggccagctacatttttgcaagattttttggttgccaatagtaaagatccacacttgggcaatttgttgtaccattcaaactgatacaaactctcagaggaatattttgttttgtgctcgttgcagaaagcattgatataatgaaaatttgtaagtttgagccaaaaaaaaaaaaaaaacaaa

SEQ ID NO: 22398 - DNA, 3511 bp, Zea mays
gtcatcaatggcttctcaatccctggaagaacaatgggaaccatgttagaatgcatggaagagaatggtatacgaatctgtgagacctaaaattgtgttatcccagtattgttcctgatttcaaaattatttgttttcaacatgaaaaaagaactggcaaagggacagagacaacagactaacttaccatatttcgtgtggttggcaacaagatcatacttgatagcgaacatatccacaaagacgatagtcgaacttttcagtgtcaaacgcagctcgtccaaggcttcactcagcaaggaattgaacttcttgcagacattattaatgcttgcgatgcatccatgctcatcgaggtcgctgtcgtcatccctcggcatagaaagcttctgaggcatgcaccctaatgctcccgttccatgtatccagaacttcctggctccattctcctgccacccctgcagttttgcaaggatacaacaattagttattacggaataaatagtgtgtaaaaagagtcttgaaaagaaatactattcggagttcagagattagggtttgtagaagcaatgcacatctgatctgtgaataacatttacctcgatggctttcttgatttcagcaattactggggggagattttcgagcattgtatgatagggcaagtggagaacaccgtttatatcgttgtgcccgatgtccatggtgtatatagcatctgggaacgccttctcaacaatcggggcactctcacctgggagaagatgggcaaatcccgtcagataagaaaaccagacaacatttgtttttttttcgttcgtcagtttgagtaaaaggtgaagggttcagggaagccaaaaaaaatagatgacgattgtttgataaaaaaaacagaagcgctgaacaaaccaaacctctctcgatggagtcgaggcatctctccttgaagaagacgaactgatccacctgcacgtccagcgagaaggtggttactcccggcatggccgtggaccctgcaatggcgaagttgacgccgttggagaagttggagcccagcggcttcatgaacggactcaggtgcggcgtgcccaggctctcacctgaatcggagtgtcatcaaaagcttctgtcagttttgcttttttttcaaataataatccgagccagctggcatatactgctagattccattgcatatagaggaatgttgagggaattattcagtcattcagaaaggcaggaaagctctgcgtgcgatgctttggcagcactgcagcgcctcccgtgcggtgctggaaagcgcgttggagacagcacacgcatggtggcttgtgtttttgcttataagataataaaggaataatgaccataatatcgcttgaacatgcattccatgtgtgcccgactgagctgcatcatcatattccaaaggttcggtgctttcataccccattgaaactgctttctcgcagaacagaaacaaaattacaaaagaccaagtggccatgtgcaggcgcacttgggcgttgagtgtactgtgtgagtatgaccatgcggtaagttggtgccagcgttgagtgtgactgaggcccggtttgtttcattgctaaattatataagtcagattataataaaagggtagaaatataaaatatcactttagaatcataaataagctgaaataagctacctaatactagcttatttcaacttatttatggtcacaaagtgatattttattctccaatctaggagggaaacaaacacaccctgaagagtagagtacaccagaagtacgtccattgtactatagtggcactaattactgaaaactaagggtctgtttggaagtagagtattttctctgtttttagcagtggcgtatctaaagggtgggccccaacgcaccctctgattttgatctgctacagtatataggtggttttgattttttttcctcatgttgtagtacttaaaatgcaaactcatttatttattttgatttgcataagattggaccatcctaactttaaatcctaggttcgtcaatggttttagagaatactgtagtatttaagatattgtggtatttttttaatacagtgtttgctagactcttcaaaaaactctgcttgcatgcctgcagttttgactatgctgtaaaacttagctcgagaccaaagttctccatatagtggtaaaaaaaattgtgggaatgtcttggtatttcaaaactttagtattctaaaactgtagtagttttcaaacactttatttccaaatagagcctaatcggtactaaatactagttagtggttgcaactgcacaggatcaaataatggagtactctgtgggagatgcatacttgcaggcaggcaggctgcttacttgcattgaatgggaggtgccaagaaatgattgcacttgcgcacaaaggaaacgagagattgatgagaagccgcacgagctagccaacaagcgctgagttggcgccggcgtgctcctcgcccaacacgaaaacgttgttgactgacttaatggctgagcacccgaccgacggcatctctagtgtgatagagataccggacacggccaacctggactacgacgaccaaacaccaagcgttaggtatatggcatccacgttcatacacggagcgttaggagggttgtgtaatcaggtcagcagggacccgggcgtggaggcgctgaacaagatgcacgacgacggcggcaggccgcgcaacttgcgccctggcgagcgagagaacacgaggctccaacgctcctccagcaccgcggtgacgggccgggcctccgtcaattggcaagtggcacccagaatccaaaacgtggcatgccaacccatgcttgccagtgccaggctcctgacacacgggcacgtcgggcagggggcagatactggcgggcgcgctgtgcgcgtcgtgtgctcggctccgccgatccaaatccattaagtatattctacggcgcggcatgacaccaccccatcccgtcggcggcgtccagctccggccgggcgcgctaaccacctcgacctcgcgtcgcacccgtttgccgctgcccgctgccatggtgtttggctgtttgttccgggagcgccacgctgactgatatgattctacgaaatattctttctgactacaaggcacgctacgctggattgttccagtactactgctacactatcacaggaagagagccattgtttctccataatagtagtaataataataaaataaatctaccgacaacatttgctctcgatattctatacaccaccttcaaattcttgttgcactccagacattcttgattcttctctgaaaaaatatgtgtgtttgagcatttcgatttcaagcacgtgggctgtgcaagcagacgcagctcagcgacacctacacgcgggcacacaaatcacaggcgatatttgctcgtcctggccgcctgggcctcggcgccgtgcgcactgatgcccgccgcgcaacc

SEQ ID NO: 22399 - DNA, 1887 bp, Zea mays
taggggccttttttttttttttttttgccaacagacccaaaattcaaaaagaaaattatacatggtacagacacctgcatcgccatatattaaccctaggatatacatatgcgccgattgtacaaaaagagaagtaaacaaaaggaaagtcttcttctacaatggatgtaacgtaagaacctcaaaataattaaacttcggtggtgtcagttttgttagtagtttcatcttcatcatccttgataggccaaactaaaggccaattaaggtgctgcatcaccattaatcgtcagattttggaacggggacgaggctggccagcttgaccctgggaatgttgtactcaccactgagtactttggaagccacaatgccatttgcagcatcagtgaagtgaaccccgtcccagcttatgaacttttcgccaagcttgcacaggtatttgtccgaagtcatgcagctctccttggggtcatagttgtaaggggggcctccatgaccacaacatgtcatcaatggcttctcaatcccatatttcgtgtggttggcaacaagatcatacttgatagcgaacatatccacaaagacgatagtcgaacttttcagtgtcaaacgcagctcgtccaaggcttcactcagcaaggaattgaacttcttgcagacattattaatgcttgcgatgcatccatgctcatcgaggtcgctgtcgtcatccctcggcatagaaagcttctgaggcatgcaccctaatgctcccgttccatgtatccagaacttcctggctccattctcgtgcaacctctcgatggctttcttgatttcagcaattactggggggagattttcgagcattgtatgatagggcaagtggagaacaccgtttatatcgttgtgcccgatgtccatggtgtatatagcatctgggaacgccttctcaacaatcggggcactctcacctctctcgatggagtcgaggcatctctccttgaagaagacgaactgatccacctgcacgtccagcgagaaggtggttactcccggcatggccgtggaccctgcaatggcgaagttgacgccgttggagaagttggagcccagcggcttcatgaacggactcaggtgcggcatgcccaggctctcacagatgaagtcgaggatgacgcgtccgtcggagagccgccccgtggggtggtggaagtaggccctgccctccggcggcgcgatgcggatccccatgaccgccgccacgccgcccgtgtcgctgttggagtcgccgaagttgaagagcacgaccccgtcacccttcttcttcctcctcctcctcctcctctgcgcctgctcatcctcccccgtttctacctccacggcgggcacgggcacagggacggccgcggctgctggggccgagcgcacgacgccgcctccgctggtacgggcggtggtcgccgggacggctggccccggcatgtagcgcagcgtggccagcaccaccgccgctgccaccgcgcccatcacgatgtagtactgtacccggagcgggcccatccgcttcagcgacccgccgccgccactcgccgcgctcgccatggccgccgccctggctctctgcgtgctgcgctgtggcgccgctcgctagcccccgccagccagccgctcaggctgtgtcccctgacctgacctctgtagctgcagtttaaaatcgactgctgtgtgctcctcagagacggacggacggacggccaactaaagcgtgtggggggttttctgctctgcttgtttatttcgaccaaattttcgattcactgtctccccgccggcccatcaagcgtatatgtagcttcgtctctccgcgtccgcggctgggggcgcgaggcttggtccggccgg

SEQ ID NO: 22400 - DNA, 3112 bp, Zea mays
ttctgggggtaccgcgccctcttcgagtttttttttttttttttttttttttttttttttttttttttttttttttagacagcaattcaatcttttgacgaacatgtttttactatattaaggaggtaaatgtcgtcccttctcattcacaacagggtttaacaagaacatgaacacaactattgggcaaatgtcgaaatgaaagaaattttttgatgctggaccagcactgcctgccagagatacattagtccatgggagtagaggacagcttttgcttcgggcaaaaattccagcactcctgccatgtagacttctatgcagtcctttctgatacacgagagaccatagacaatgaaatccaagacacatatttacctcagggtttcagattcgatgcacagttgctttcaatgcatctagtatagtagacctgagtatccatttgagtttcgaccggtgctgattgccttcctcttctgtccaccactatccagcaaaactctctttactagtctcactcaaatggattcctaggtggaaaagctccttgatgtgttgaactcaacatgtgagagtcctgtcctgccacataggataaacctccttgaggcccagaaggaatatatgacatagtggaattctgagaaatccatggctctgttaagctccccgaataatctgtgagagtgtgatgatctggtaatgtttcttgcagtgaggtcaaatccatgaacatgtcattggcgtcaacgtcggattcaaatgccatgtcaaatggatttgttgatttttcaggatgagagaccatgccacccaaatggggctggagtgatggagacgatggtccaaccacctcaacatgtgaaatattgaagccagaaaacacatccctaggagttggcctttcaggctcatccctaactaaatcctgtggaattctggattcaacatatggaccacttggcatagagaattgatgagcttctacttgagacatagtattaaatgtgaacagatcatttgatgcgctctgagtagattcaccaaaggcattccaagactgagaattttcgttgaggacagggatcttcacttcctcagcatttaaactccagttatccatcatagccggagaattttgtgacccaattacatttggtggcgaagttggtaatgttaattggtcaattcctttagcaataccatcagctggagagaatgcagcaggcacctgaccttgcacatttgaaacagatgtcaacaatccatgttgcacgtcaaagaaagcccatccatcattagcaggaaatggaactgccgatggaattttctgaacagtagacaaatgcggcaaatgttggtcaaagccagcaaacagatctattggctgagagggtgagggtgttgctggttcctgcaaaattgacagactgaacaaatcttggtgcacagcatgagatgtggcgagtgcttcagctgatggcattatgcccttctgaacaacattatgggcaggttctttagcaacaacaaaatgactggatacaccatctgtattatgagaagctggtaactgttcattaaagccagcaaacagatctatcggcgcagcagatgtgacaggctgttgcacagttgattgatcaaagaggccaagaggtgtggaagtcgttggttgtactggagcatgcatcggcaccacattttcaatctgagcgcaactatgttgcactggtttcctggtggcaacaatttggctacctaaatcagcaggtttgtgaggtatcaagttgtgattgtcggatggggaggtatattgttgtgtcgaacaagcctcaggagaaggtacagtctgatggtttacagcacaatgcactgacttttctgttggtgcatcaggtgggtaacctgattcaattgatttgttggaaactgagctaccatcgaatgatccaaaacttccagaagaagttgttcgctgtggacgtcgaactccattgaaatctatttgtgaagctgcgttaggacatttctgggtttgaggattgtcagcagagacatttcttgaatggtggactgagggactactgtagcctgtctcttgagagctaggagaaagcacatcatttctaaagtcgccagtgcttgaggctgagaagtcagaaaaccttgatcctgaactttccgcccgcgaacgcgccccattcatctgatctcgcaaacgacctggactgaatagtaggttgccaagtttcccatcgaagagcgccctatctgaaggccttcgagcaagtgtgttcacttgcttaccatatcgtctatcttcatattgaaaatcatagggtgggctctgggaatatgaatgataagaactaggtcttctcatgtcatggtcattgctcttcatactctcactttctgtggctggtttgttagaggatccaccagcatacttcttatccacataaacagccctgataaattcccttatcctatccggattggtgttgataggcaacctcattcgttgccaatcccaatcctttaggtagatgtcacgtgctcgctggttacccccctgttcgagggcctgcacttcttgggtagtaaatttggacattgacaccgacttaacacggtgagtgaattcacggtgaattccactacatgacaggcaaatgaaggtccagaaattggtacacacatactgtggccccacactgttgcaattgatgcacttgcggttgggcggcaacttcatgagcccgcggatgatcttctcgttcctctcctcctcccttctgctccccatcgtgcgccgcagaaatcaaaatatcccctcaggataaaccaaaggattcaccagaaaagaccggccgaaatttcaacgagcccggccagaaattggcgagccctagctcgattggggccggcaatcgggcgctggtaggggattggaggggtcggcggctagggttttgcgggggtggagaagaggaggggagggcgaatgggaatagcggcgatggcgagcctcgtcgagagagatgggagagggagaggcgaaccgcgtgccgaggctttaaacccggcgagcccgagggtaccc

SEQ ID NO: 22401 - DNA, 2261 bp, Zea mays
  misc_feature (748)..(748): n is a, c, g, or t
tgcaagtgggctagcccgtgaacccgcataaaggcttaactttgtggttgtggccttgtgggtagctcgtggcaacccgcaaaattaaacctttatgtggttcacgggatagctcacttgcatccgtagctgtgagttcttccacccaatctgggacaaggagtatgatttggatgtttagatgcctgatacgacagcagaaagctctgtttgggatgagttgagttaattctggaggcagtcgagcaatgtttttgaagatagtagatcgcacacctgcaaggatatagttcgattcaagggtccctccctaactaaggatgacggtaacaggcagcgcttgatggttttcaaaccaaaccaaactggaacacaaccttatagttggtttgatcctggttggtcttggattggtgttgcagtttctgcagttaaccaaacaacaaacaatattgtgaccaccaacaatcagcagttgtggaaatagaagtaatccttgtggaatcaacttaatggtcatgtatcatcctcatcttcagcaacctagcactcctctcagtagtgatgcacccttttgtgatgaatgactgcttcttgaatttaccagattaagttcatctattggagtattgggtgtgtgtcttatccatctctaagcaagcagagcaaagcatgtagattttttattatataagatgatgtgctctagcatttaaaaaatgcatatattcctgcacaaaaatgagtnaaaaaaatctcctgatcccagaagtggaaaaactttcttgtaatcagaccacttgagttcctttttgctcaatggattaacttccacaactttatatggtatatcatgataatctaaaaaggctctgaccttgttgcagaaggggcacgcctggtactggtacagcaccacgttctgcggcaacagatccggttgcggtcgctccttggccttggcctccgccgccgctacagtagcgaaggtaagggagaaggatactgcgccggcaaccccggcaggcatcaccctcgaggatggaagcggcgaacggggcggtggcgccggcgctgcacaccaccgcgcgcccgcggcggcggccgtggcgggggaggctgcgccgcttagatggcgcgctgagaaaagggaacgggagactagggtctgcgccgctcgcaacgacctcatcttggcaaggttctagggtttggcctggtcgccgccggtgaacgacaatactagatccgaagggctctaaacccagtgccctgtttctctgaaccaaggctcgtcgtcagacttcagctgtttggttggttcgcggcctgccagcaaaggttctgggcttctggccgccgggcgaccagaatcaaccgtggaaagatggacccataagcaagagctttctggcgaaccaaagacgttcataggtcctaccagcgaatggagatagcgacgggtactcgtgagtcgcgacccgatatatcgacgggtacgcaattaggatatgtatataggtttacctgttgatctattatttaacaaaaatctttatctaatggttaaacgggtattagaacattgcaccctcactcatacgcgttaacatgtgactataaaatacataacataaatttaactcaaaagcatgaacttgtgcttcagtcatattttttactattttaacgacattttgggccatagtgtcatagaatgcttaacaaatatttgatgaccatataatggaacatgtaatgcgttatgtggttgtcggcgttttggatccgctaggaccctcaaccgaccagtgaatttgatgttgcgtgtccctgcccagatgggttgatgcaagattaaacacaagaggagggatgaggcttatattatcttgcacacggggtgctcgcagtaggggctacaagcttcgtgagagagggaaccagccctaggcctcttgagaagcctagtgttgcagagtggagttcgatgtttgagtgagtccgtctccgtcgttcttaccgcccgtgcctccctctccctcttgagaaggccctgggcatccccttttatagatataaggggatggtccagtgaatcgatgaacttcactggttgatgtctgagtggcaaaaggaagataaaagtgatgagtgactgatgctgtcatcagaggctaatgacgcctgctcgggcttccagttcatgttgcatctttccacgtggccatggacgtgtccatgggtaggagcccaacagt

SEQ ID NO: 22402 - DNA, 630 bp, Zea mays
taacactttttatgttgccttgttcttaactcgccccgccggcccttttgtctcttattatatactcactgcattaatatatatagcggtgtaaacaggttgatcgttggagagtacacatgaatcaacaacccaagacacacacacacactctcccaactggcgactcgcgtgcgtgaagcgatcaaaacacacccaagatgaaaatactggtaaaattcaagtacaagaagcgatgaactggtatatattattatgtatcactccgggaccgggggcggcaacacgcgcgcggccggccctgcagccggaggagctcagctgaagaggtacccaacggcggccacagcgagcgtgccggcagcgagcgccgggccggtgacggcggcggcggcggccccggtggagctggcgggggatgggcccggtgcctcggacgcggtggccacgccgacgagcgacgaggccacgacggcggcggtggcggccgcggcgaggatcctgagcctgagggtggccgccatctcgctagctagctaccttctcggtcggtgctcgagagatggaggggaggagaggaggagcaggaagctagcgagccgggcggtgttggaatcccgcccggccggc

SEQ ID NO: 22403 - DNA, 1609 bp, Zea mays
aaaaaagaaaaaaataatttaaaaaaaaaaataaatatataattaatttgtcccagtcaataagccacatgagtttgtcattaattaattaaacaaccatgaatctatcgcttcggcagatccagcattccgaaattctttaaactgtacgcaaggcacagcagaatcgctgatgctgaatcttcaaaaccacatcgcagacaatacagacgtgaacagctaggggagcaaaaccttacacagtaacacaaccaagttcccaagtcaaacactgttcctcaggtgctagtatacttaataatctggcagagcattattgcatacacttgattctggcaaaaaatttgaatagcctccatgcataggcacggataccgctaaagtatttaaaagaatgttgtcaaaattctagtttccttctgcatcctgtattcttgatggttctccaactgcgtcttccatgcgtcggtaccaatcgccgatttcagtgttctcaaccatatcttttcctgctctcaagtatcggataggtctcagaacaccgaagacggcaagatctgccaagttaggcttggagccacccaggaaatctcttccgttcagtgcgtcgatccatgtattggcagcatcatacaatgaagcacgctcgtcagttatgttgtatttcttctttagtttcttagataccatgtacatggccgcagcaccagcatacttcacggcaaacctctctgtaaaactgaaattaccatgttttgcaatgtagtcaaaagattctagagcttctgaagttgtccgatatatgttaggagataagacatgcacaaggtgctcatcaacccaccttcgccattttgcttcctcgtcattagtgagttcgtcattggggttgatcctgctctgtagtatattgattatatctgatgaatcaacaagctgttcaccatctactgtcaatattggaactttcttgtaatcagaccacttgagttcctttttgctcaatggattaacttccacaactttatatggtatatcatgataatctaaaaaggctctgaccttgttgcagaaggggcacgcctggtactggtacagcaccacgttctgcggcaacagatccggttgcggtcgctccttggccttggcctccgccgccgctacagtagcgaaggtaagggagaaggatactgcgccggcaaccccggcaggcatcaccctcgaggatggaagcggcgaacggggcggtggcgccggcgctgcacaccaccgcgcgcccgcggcggcggccgtggcgggggaggctgcgccgcttagatggcgcgctgagaaaagggaacgggagactagggtctgcgccgctcgcaacgacctcatcttggcaaggttctagggtttggcctggtcgccgccggtgaacgacaatactagatccgaagggctctaaacccagtgccctgtttctctgaaccaaggctcgtcgtcagacttcagctgtttggttggttcgcggcctgccagcaaaggttctgggcttctggccgccgggcgaccagaatcaaccgtcccaagccggccccctaagcaagagctttctggcgaaccaaag

SEQ ID NO: 22404 - DNA, 884 bp, Zea mays
tttttttagtgtccttttttttttttttttttttttttttttaggggagcaaaaccttacacagtaacacaaccaagttcccaagtcaaaaaacactgttcctcaggtgctattagcctattatgcttaataatctggcagagcattattgcatacacttgattctggcaaaaaatttgaatagcctccatgcataggcacggatacctctaaaatatttaaaagaatgttgtcaaaattctagtttgcttctgcatcctgtattcttgatggttctccaactgcgtcttccatgcgtcggtaccaatcgccaatttcagtgttctcaaccatatcctttccagctctcaagtaccggataggtctcagaacaccgaagacggcaagatctgccaagttaggcttggagccacccaggaaatctcttccgttcagtgcgccgatccatgtattggcagcatcatccaatgaagcacgctcgtcagttatgttgtatttcttctttagtttcttagataccatgtacatggccgcagcaccagcatacttcacggcaaacctctctgtaaaactgaaattaccatgttttgcaatgtagtcaaaagattctagagcttctgaagttgtccgatatatgttaggagataagacatgcacaaggtgctcatcaacccaccttcgccattttgcttcctcctcattagtgagttcgtcattggggttgatcctgctctgtagtatattgattatatctgatgaatcaacaacccaagacacacacacacacacacactcccaactggcgactcgcgtgcgtgaagcgatcaaaacacacccaaggtggaaattctggttaaaccttccccggccgccggttggaaacg

SEQ ID NO: 22405 - DNA, 1055 bp, Zea mays
gttctgacttccgacgagcggcaccacacctatttttgggccccgcccccccttttcaccacttgctgcgtcgcatgatggatgcatataaactctgaccaaatattgtagcagcagttcacagggttcagccaaaaactaagacagcacaactgtttttgtatcctttacttcaataggcagtgagtggttcgacctccagattttacaccaaaaatccaagggaacgtctagcctagctagataccgtggacacccatggcgcggagcaaagtcaaatgattcttcatggcttcacttcctctgcagccgcaggagctgcttcctcctccttgctctcttctgtcttacctccttcttcatctttgttagcactttcaaccacatcatcttcatcatccccaatatcgtcgtcatcagcacctcctatgtccagtttcgagaagtccataccaccaaagtcattaaatccagcgtcttcatcatcctcgtcctgccatttgtcccaatcaaccttcaagaacacaggtggtttgccctcctgcttcagcagccttggccaccacccgctcttagctttctttatcaggtagcatatggtccttggggcaatagctgctttgctctcctccacattcacagcatcaaacagctcaatgtcaaactcatagcgcaagtcatctgagcccttagctgagaagttgaaatggccttcaggcttcaagttcagcttcacatcctgggcgtcgggcagctctatcgtcaagaacaccctgtcggacctctgtgcccacttagtgatcgggtggcgactcatgcttccgcctcgtgaacggaggtgcgcgtcgtgtggtctgcgtcggggatttagggattggggtttagacgtcttgggggaagactgccgatggggagaggatgcggccgcggcctgggtgcgaagtcagcagtcccgtcagcaggaggtataaaaagacgaagcggcggagcgggagagaatggagggcgacgggggcaaactcgtcaaactgcgggattgcgcgagtgctgctggt

SEQ ID NO: 22406 - DNA, 1208 bp, Zea mays
  misc_feature (107)..(107): n is a, c, g, or t
  misc_feature (116)..(116): n is a, c, g, or t
agaatcttaaaaattaacagactatctcatgcagttaaccaaaagcaaaatagaccagagtttatgcttcctcgcctttgggacttgctacttattgtttgcaacangcaaacagnatcagtcttcagcctattaagacattccaaggcgatcttttactcagacggaacagactgcaatcctatttctcaatatctatggacctgtcaaaattttacagaacctaacgagcacgcccagctataggcaaattgagagacatttagcattttttttgtttatacagaatagttattaagatacataaatatgcctcccaaaaaggcgaaggaatagcacagagcaacaatgtcaactagatacaaaatgcacagctctagaagggtactcttctacagaggactggacagagtcattcatggagagtctgtacatagtgagagtggtactgtgaagcgttcatttgcaggtttatgacagatcaaccagatggtctctggtagatatgctttgttcttgggtcaacgattatgccctttccaccattcacttcaaggtcatgctggaacacaaaatcaggaatggtgagctgttcacgtggtacatatctgaatagctgcacaagtctgtcgacatatacaactttcttccagacctccccgtcaacaaaaagttgcatcgccataacggctgttctcagtcccagtgtcgggtggagtatgtatatagtatgaagattttttttatgcttccgacctagtatctgttgtaaccgtttcatgaatcctaaatcaggctgtggttgtaatgatgccacagagtggaaatagacaattgtgtaaggcttctgaatcagagattcaaattcctttactacatatagaacaaatcgttccagatccaagcagcgaagaagaaagtgagcaccaacaatgaccataactggacgcccttcactatcaactcctccacggtaaattattttcatttcagcaacatctgacagattcatagaattcgctttagcaaggtatcgtgaatgaagtgaatattcttcagcagcctggtgccgaattccgccaagatcaccaaacccaagcatgttagccaagttaagtcccttgtttgcctgagatttttcccattgctccttgcgtcggaaatcaggatcccggccgccctttttggggccaatcgcccataggagt

SEQ ID NO: 22407 - DNA, 1912 bp, Zea mays
ttttttttttttttttatgagtacaaacttattaccagaataaaagacacatggcaagggcagattaacttaattcaaatgcatataagcgtattaaagcatgacacgtcgccaccacattgtgtttacacgatgaacaccagctaacacaacaatatgatacgcatagattacgtcagatcctatcccttagttataatgcaaagagctgatgcctttctccagttggacctaagccccctcttagaattcccgaacaacacttaggctagtttggcacctccatttccccaaggtattccctcccaggggaaaatgaactaatttttcttaggaaaatagaaatcccttaaaaaaataaggttgtcaatccttggaaaaatgaggtggccaaactagccctgaggcaacgcaatctagtaccctaaatttcaaggaggcttccttgctcctagtaccgatcacggcgttcatgacgcccagatcgatcataatccctagaacttccccttggtgaatatgacctgcggtggcttctggaatcataactacgagactgcctggaatctctctctctttccctgtcatggtagcgatcatggcttcttctgcggtcatactccctgtcacggctgctgctgcggtctatgtagcgatccctgctcgaatccctggcacgttccccgctcctttccctggaccttctgtcatactcagctcggtctagcttccgttttttgttcttctcttcctgcagttcagacaatctctcacgtataagcatataacccatatgaagtttccctccaaaatgatctgccaagcgacggtcactgtcatatacgctcaagaatgctccacatatgtcacacaggcgcagcttttggtcagttatctggacatgagcgctcatttttgtagagtctggaacagcctgtggtcgggtggccagcttcttcagagcttccgcctcatccaacaatttttgggcttcatcaaccatcccattctcacctagttcttctgcctttttcagtttctcgtttatcatttcttgtgtccgtgcatccggagcagcaggggggacaggtgtagttgtttgagtggcattttgaagagagtttattaaagaagcacggtctttgttgaaagcttcaagtaacatctttgcctgctcttctgccctttgttcttttagcttgtcaagttcttcagtggcccgaattttcccctcggtgttaccctcaagatcaaaagcatcaatatccttcatcttctgcctaatttgtttggataactccattacttctttagtctgtgtaacctcagtaacagaaatagcaatagctgccttagcatcctcttcctccaaccgcttaagggctctctgaatctttggctttggcttcttcatattctttgcgcagttgcagcgagtgcagcttcgggcacgggcccatgtccatcttggtaagctggaagaggtcgtgggggcagaggccggcgaggtagaggcggcagacgtcgcgatcatagtacttgcggctgacctcccgtacatcgccgttgcggttggcccccatgagctggtcgagctgcttgcggatggcgtccatgttgccgtgcgtggattgcgctcccgtcccctagactagggttttcgctggcgaagaggacgagacggggcagcggcagtgaatcgggggttcgggactgttcggcgaaccagacttccgagacgagggagaggaatacaaagataggattgggctggaatactggatgcctctagaatggcggtggttctgttcgagtgttcgacacgagcccctgcccatccaccacggcgcaataagtgacgacttctatgtaaaaactccacaggatgcgagtttgagtgtggtatgagggt

SEQ ID NO: 22408 - DNA, 1872 bp, Zea mays
ccgctctagaccactctcttttttttttttttttttttttttaacttaattcaaatgcatataagcgtattaaagcatgacacgtcgccaccacattgtgtttacacgatgaacaccagctaacacaacaatatgatacgcatagattacgtcagatcctatcccttagttataatgcaaagagctgatgcctttctccagttggacctaagccccctcttagaattcccgaacaacacttaggctagtttggcacctccatttccccaaggtattccctcccaggggaaaatgaactaatttttcttaggaaaatagaaatcccttaaaaaaataaggttgtcaatccttggaaaaatgaggtggccaaactagccctgaggcaacgcaatctagtaccctaaatttcaaggaggcttccttgctcctagtaccgatcacggcgttcatgacgcccagatcgatcataatccctagaacttccccttggtgaatatgacctgcggtggcttctggaatcataactacgagactgcctggaatctctctctctttccctgtcatggtagcgatcatggcttcttctgcggtcatactccctgtcacggctgctgctgcggtctatgtagcgatccctgctcgaatccctggcacgttccccgctcctttccctggaccttctgtcatactcagctcggtctagcttccgttttttgttcttctcttcctgcagttcagacaatctctcacgtataagcatataacccatatgaagtttccctccaaaatgatctgccaagcgacggtcactgtcatatacgctcaagaatgctccacatatgtcacacaggcgcagcttttggtcagttatctggacatgagcgctcatttttgtagagtctggaacagcctgtggtcgggtggccagcttcttcagagcttccgcctcatccaacaatttttgggctttcatcaaccatcccattctcacctagttcttctgcctttttcagtttctcgtttatcatttcttgtgtccgtgcatccggagcagcaggggggacaggtgtagttgtttgagtggcattttgaagagagtttattaaagaagcacggtctttgttgaaagcttcaagtaacatctttgcctgctcttctgccctttgttcttttagcttgtcaagttcttcagtggcccgaattttcccctcggtgttaccctcaagatcaaaagcatcaatatccttcatcttctgcctaatttgtttggataactccattacttctttagtctgtgtaacctcagtaacagaaatagcaatagctgccttagcatcctcttcctccaaccgcttaagggctctctgaatcttcctttcacactcaacaattagtctttcaatggtttcttccaattcacggtcatagttatcagtacctttggctttggcttcttcatattctttgcgcagttgcagcgagtgcagcttcgggcacgggcccatgtccatcttggtaagctggaagaggtcgtgggggcagaggccggcgaggtagaggcggcagacgtcgcgatcatagtacttgcggctgacctcccgtacatcgccgttgcggttggcccccatgagctggtcgagctgcttgcggatggcgtccatgttgccgtgcgtggattgcgctcccgtcccctagactagggttttcgctggcgaagaggacgagacggggcagcggcagtgaatcgggggttcgggactgttcggcgaaccagacttccgagacgagggagaggaatacaaagataggattgggctggaatactggatgcctctagaatggcggtggttctgttcgagtgttcgacaccag

SEQ ID NO: 22409 - DNA, 889 bp, Zea mays
gggtaccccgccgacgccaaccgaaaacacaccatctccacctcgccgccgccgctcggatttccctctacctcaccctgtccggctccatggcgaccgccgcggtggagagcaagaggggcagcgcccggggccgcaaggcgctcgtggccgtgctcgacaacgaggctaacatctccgccgggaaggccgcccaggccgccgatctctcgtcctgctcagcgcagaagaaggcgaagcgggcgccgtcaaggagcagcaaggccaaggccgccgcggcgtcggcggccgtggtcgtggacgacatagccgagctgcaggggatgctagagcgcctgcggctggagaaggagaaggcggaggagatggttagggagcgggatgaggtcatccggaagaaggaggaggagatcgagaccagagacaaggagcaggagcgtctccaggccgagctcaggaaggcgcaacgcgccaaggagttcaagcctaccgtgagcttccccctcgtcaagtcgttgctggagaaagagcaagaagcagacgacaagggaaagaagaagaaggggaagggcggccacgagaggaagaagccgtgcccggcgtacgtgctctggctcaaggaccagtggaccgaggtcaagaaggagaaccctgaggccgacttcaaggaggtgtccaacacgctgggcgccaagtggaaggctctgggcgccgaggagaagcagccctatgaggatcgataccgccaggagaaggaggcctacctgcaggtggttggccaggagaagcgcgaggccgaggcgatgaagcttctcgaggagcagcagatgcagtggaccgccaaggagctgctggatcagtacctcaagttcaggcaggaggccgagga

SEQ ID NO: 22410 - DNA, 572 bp, Zea mays
gaattcggcacgaggtcggcacctcgaggacgaagatccaggggagcggggtgcttgtgtttcttctccgtccagccatatggtatggatcctagtgggcggcggtgcttcttcttctcttctgtcgtagccaaaactaatcatctgaggccagcgaggaagaagggtttcctcgcaggcaattgagttctgtcgtcgtgtacgtggagtctgattagcagcagtccagtatgcttggttggcgagtcaaactaactttttttaggggggagggcgcaaattatgtagtgacctgcctgtgggtggtcctggccgcggggtggtccgtccggtcaggctgtgtaccctttttccttcacatctctctttatttattagtacgatgagatggtgtggttatgttctacacaagttttatgtaagccaaaacttgtatgcaatatcatggtttgagtttgttttttttcctctcccattttctggctgcccactcccacaacttttttgtaatttaaccattttttggttttattttcacatatataccctttttagtaaaaaaaaaaaaaaaa

SEQ ID NO: 22411 - DNA, 4105 bp, Zea mays
ataccgtccttcgttagtgaatatactatattcttactaacactacagtccaatagcatttaggtacatttttacttgcttgctttcgcctgttattagttctattaaaaagttcaaagccatttcagcctaaaacaaactagcttcagaaaatgaagggaaaacaacgaacttaaaatgcatctatttgtttatattttccggccaggtgagatggcatatctccacgaaattaaaaggggaaatcaaagggcatgatggcatatgggggggcgcctctttgagctttcggtggagattaaagaaaaaaataaaggtagccggagacagacagtgcgaatgaatctaaatctaagcaggattagaaggagcggtgtggtactgtggcgtcttcctccatctccaattctccatccagcgggcaatgggaaacgtcggcgtgctggctagccgccgtcagggccgcccgaagcttctctaacggcgccgtcagggcgcggcgcgggcccacgtgccagggctggctagtcagtcgctgcgctgcgctgcgctgctgtgctgtgctgtgctgcgtgcgagacgtactgtcctgtcctgcctgtacctggtgtgtagtaggtcaagacaccccctttttttcccctctctgtagttgcttgctgttgccacttgtgctgggaaaaatccgagcaaagctaaagcccaatgcaaagagggccggaagcagaagatagctcatcttcgtctagattgccggctgtaacgtctcgcgtctaataatgctagtaccctctaatctaaccctaaatccacatcaaggtatcctagaccgacccaaaactacatcaaaaaagcgagacagagagagagaaaaagcagcaggttgcaacttgcaaccctagaactaggaggagccagcactagggtaggcggtaggcggtagcctcaccaagggcggtgacgggaaaacctagcagtataacccctgctcgcagtcgtccacactcccgctgcttcacgcagtcggcgcctccactctgctccctcgctcgccgtcttcttccatccaggcccctcagctttccctgtttcccatatattctcgcgcggctccacgctctcgctctccacactccacaccgcagacgcctggggggcgctcctactcctcctctagggaaggaggggctcgaggttccaccaattcgccgacaggtcccttgcgtgccatccccgccgcgcgcgcagctccagaggcctccatcccatccatggacgccaagaggcagggcttcttctccgcgctgcgggaggaggtggcgcgcgggctgtcgccggggcgcgcgcggcggcggtcggcgtccaacgccgcggaggtggcggcggcgctgcgccgcctcgggggcggcggcgaggcgctcgcgccgctcatggagggcccggatccggaggcgggccccggcgcgacctgcggcggctccgcgaggaaggaaggcgggtggggggcggtgggtgcgcggccagctccagctcacgcgcgcgccggcgctggaggccggggccggagctggctccggcgccgccgccgccgccgccgccgccggcaggcgcaacgacctcaggctgctgctcggcgtcatgggcgcgccgctcgcgcccgtgcacgtctgcgccgctgagccgctgccgcacctcagcatcaaggacacccccattgtaagaaactacgaaccagagctcttccgcctacatactccatgcctcttccgcctgcgtgctctactgctctcgctctagattggaccccaaccgcaaccgggtggctgctcggtggaattccggaaccgaaaaaaggtgaccttttggggggaggggttgcggttgcggcgtcgagatttgggttctcggtagctaaaatgcgcctccaatccagctgctgtcttcttctcctgagcttccctgctccagtttgccgtccgaagcttttgtccccatgtcccatgtctactactctgacatctcgctcggcagtcggcaaaccttgttgcctgggctctctatggtaaaaattgggggcatccttgatgtgatgcgttttggagagttcttgcatctctcctaaaccacattgcggctgtaaaggtggcttcccttacctgttttgacatgacaggcaacggacggatgtttcccgtaaccgtttcctgtttttttcccaaagaaaatacatttgctgtaaatttcggtttttttattagtgcgtattgtaaccgtataactcatggcgtattgtacgcgcgcgcgcaggagacgtcgtcggcgcagtacatactgcagcagtacctggcggcgtcgggcgggcagaggctgctgtcctccatccgcaactcgtacgccatgggcaaggtgcggatggtggcgaccgagttcgaggcgggcggccgcgtcgtccggaaccgcatggcggcgcagcgcgccgagcccgggcgcttcgtgctgtggcagatggcgcccgagatgtggtatatggagctggccgtgggcgggagcaaggtgcacgccggctgcaacggcaagctcgtctggcgccacaccccctggctcggcgcgcactccgccaagggccccgtgcgcccgctccgccgcgctctgcaggtgagccacagcacgcccgtccgtccccgtacgctgcgtgtgccgtccgtgtttcagaggaacgttaaatctgagtgagactctctgctgctctcgtccttgcgttttcgtaattcgtagggcctggacccgctgacggcggcgagcatgttcgccggcgcgcggtgcatcggcgagaggaaggttaacggggaggactgcttcatcctgaagctgagcgcggacccggagactcttcgggcgcgcagcgaggggctggcggagatcatccggcacgtgctgttcggctacttcagccacaagtccggactcctcgtgcacctggaggactcgcacctgacccggatccagtccgccaccggcggcgacgcggtgtactgggagacgaccatcagctcgtccgtcgaggactaccgcgccgtggacggcgtggtggtggcgcacgccgggcggtccgccgtgaccctgttccggttcggcgaggcggccgtggggctgggccacaccaagacccgcatggaggaggcgtggaccatcgaggaggtggcgttcgacgtccccggcctctccgccgactgcttcatcccgcccaccgacgtcgggcccggctccgtcagcgaggccgccgagctcccgcggggcgagcggagcaaggccgccgccggcctcgtcctcccgtgccaccgcgctagggtcgccgcgctcgagaaggccgacgacggtggcgtcgcgtggagcggcgccctgcagctcgggtgcaagtgattcgtggtaccccgtgctctctcgcagccgtcttgcatttcctgactgactggttttggtaggagacacagaggtaaggtcaggaggaggacttggaggagctttaccattccaagtttccctctgtaaataggaagctcacatcgccttccgtatccctgcctcgtctcgtccggagatctggtagtaggtagtctttgtctgtaacgctgtgtcggcacctcgaggacgaagatccaggggagcggggtgtttgtgtttcttctccgtccagccatatggtatggatcctagtgggcggcggtgcttcttcttctcttctgtcgtagccaaaactaatcatctgaggccagcgaggaagaagggtttcctcgcaggcaattgagttctgtcgtcgtgtacctcggccgcgaccacgcgcagtccagtatgcttggttggcgagtcaaactaactttttttaggggggagggcgcaaattatgtagtgacctgcctgtgggtggtcctggccgcggggtggtccgtccggtcaggctgtgtaccctttttccttcacatctctctttatttattagtacgatgagatggtgtggttatgttctacacaagttttatgtaagccaaaacttgtatgcaatatcatggtttgagtttgatttaaaaaaaaaaaaaaaaaaaaaaaa

SEQ ID NO: 22412 - DNA, 1674 bp, Zea mays
  misc_feature (1618)..(1650): n is a, c, g, or t
ccggccgggaccccgcgcctccgcatttagatagaagtagagcccagaggggagggtctgtggcgccgctcccgtcccgccggagacccaagcgagaaccgccactcctcctccttccctcattttgaaatcgatttcggcggcctctcacctccgcagcccgcaccatctctccgcggctgctgcgctacttaaccgcctcgatctgctccccatttccccgccgccgccgccgaggccgagcgctgcgcgtccttctccccgccgcgcgccgccgacgccgagtccaactccgcctcctactccccgccgcgcaccacagccgacaccgctttctccgcgccgccgcgcgccgccgacgccgagtccaactccgcctcctactccccgccgctcgccacagccgacaccgctttctccgcgccgccgcgcgccgtggcgcccgccgacctccagctctccgggtcctacgcctccgacatctacacctacctccgctccctggaggtggatccgcagcggcggtccagatccgattacatcgaggcggtgcaggcggacgtcacggcccacatgcggagcatcctcgtcgactggctcgtcgaggtcgccgaggagtacaagctcgtcgcggacacgctctacctcaccatctcttatgtcgaccgcttcctctccgtcaacgcgctcggccgtgacaagctgcagctccttggcgttgcctccatgctcattgccgcgaagttcgaggagatcagcccgccgcacccggaggacttctgctacatcacagacaacacctacaccaaagaggagctcctcaagatggagagcgacatactcaagcttctcaagttcgagttgggcaatcctaccattaagaccttcctgaggcggttcacaagatctgcccatgaagacaagaagcgctccatcttgttaatggaattcttggggagctacctggctgagttgagtctactggattatggctgtctccgattcttgccatcagtagttgctgcttcagttatgttcgttgctaggctgaccattgatccaaatgccaatccttggaacatgaagctgcagaagacgacaggctacaaagtttctgaactcaaggattgcatcgtagccatacgtgacttgcagctcaacaggaaatttccatcattaacggcaattcgagacaagtacaagcaacacaagttcaaatgtgtgtcaacgcttcttccccctgttgtggtccctacttcatactttgaagacttagctgagtagctgctcttggactgcaccactgtgaggctaacaatctgagctctccttgagctcttagggacgggagaataactgtgttatgagcttcttcttagttaagtagggttccaaaagctatttaagtgaggttctttagtaatcgcagctgagttactagtagtgaggccaggcattctcttgttttgtgaattgtattctttgtatgatatcctagtcacatcttgccttggtctgttgcccacaatgtaatgtttgatacgttagacctttccgtctgattgatctcagtaacaaattctgttactcaaaaaaaaaaaaaaaaaactcgagagtnnnnnnnnnnnnnnnnnnnnnnnnnnnnnnnnnattctagaacggccgcgggccctc

SEQ ID NO: 22413 - DNA, 817 bp, Zea mays
ttttttgtgtacgtatatctctattattatttcttgttacaaaatatatagcctttatgaattttgtaacaagaaataataataagatatatttttatttctaatttagaaactatacgtgaatcagttataaccaacataattaaaattatgaaaacatgtacttatgaggctagcaagacaaaaacacaattatttgaactctatttaatcctttttataaaatgaaaaatatcacaatactaaaacacgattaatcatagactattggaggtagggtgtaaaaattggacctttttctatctttgtaatggcagcagtgcagtgggctgagcatcagcgatagggctatggcgcctgactgcacggaggggaaacgatggcgaaggtggacacgatgctgacgagcaggggcaactccgggtgcgggcggtttgtgcgaatcaccggcacaatcgtcgtcgccctccagcgaagggactcagcgagaagcagcacgacaacaacatgatctccgacgatgatgacgctggcagcatggcacaagctacagcttcggggcttcgggcgtggatacaatggaccggtgcaaggacgacgacacgacaagggacatcgaggcgagcttcagctcgatgtcgcggcttcatcaacgacacggcaagacagcggggtgggcgcgcctagaatgcgcatagctgcatagcagcataggagagagcgagctagcaaacagggaagagacgatcccaaagcatggcttatataggcgacgaaggggatggttgaagggcgtcggtgggaaagcagtagcgtc

SEQ ID NO: 22414 - DNA, 721 bp, Zea mays
aggctaggcaagggcatcctcaataagcacggccagatagtcaggggggtagggtagggagaaggatggcgatggcgatggcaagtatgccgccggcttgtgcggcaaccgagctggtggccaaggggagggagtcggctgccgttctcaaggccatcctcggccagcttcctgcggcggcgacgccccatgatggtctccgggatctggccgagcaggtcctccgctgctgcgaccgagctctggcggccttgctcagaggcgcggcaacggaggaggctgcctgcagcagttcggccaggaagcgccgcaagcagccagcagagcggcagggcggcctggctcctcctcctccttctcctgctgcgacgggatccaagaggatgaggatgagccgtggagagcgggggacacgagcggagaagaaagaaacaatggaggacggcttcatctggaggaagtacggccagaaggacatccacggcagcaactaccccaggctctacttccgctgcctggccaaccgtttcgccgcgctgctcgccgtcgccgcgtgatttataccggtcggcgggccggttggtcgagttgcgttggatttgagttcgtgaatgtccgtcctgtacgcgtgttgtctcgtgtgtgttgtcgtttgcagcgaatttgcaagtaataataataaaaattatgtccggtaggttgtgcaaaaaaaaaaaaaaaa

SEQ ID NO: 22415 - DNA, 1468 bp, Zea mays
acctcgagccggccggaccccggtcgttgtcagttgatggtcattgatcccagccacagcccacagcttccttgctcgcttccctgcctctcctcctacctaacctcaccaccacctgcaacaacaaagcacacgcccggcactaccatccatccgcgcgctcttaatttagcttcctcctcctcacctactagcaggcacaggcagcagcatcgatcggatcggagcagcacagcgcgcgtcaccgcaagctcaagtgtcttcttccttgcttgctcgcctgcttacctctcagttccccactcacgtcccttgccgtacgtacgtgcgtccaacacacaccaggtgaaaatgggctcggagacggagacggtcaacgtggaaggcatcccgttcccggcggagatcaccgtcgggaaccctctctccctcctagccacaggtatcacggacatcgagatccacttcctgcagatcaagtacaacgccatcggagtctacctccacaacgccggcggcggcgacagcaccacgctgctgggccacctcggggcctggaagggcaagacggcggaggagctcctagcggacaccgccttctgggccgcgctggtcgcggcccccgtcgagaagctgtttcgcgtcgtggtcatcaaggagatcaagggctcgcagtacggcgtgcagcttgagagctccgtccgcgaccgcctcgccgccgccgacctctacgaggacgaggaagaggaggcgctcgagaaggtcgccgacttcttccagtccaagtacttcaagccgggctccgtcgtcaccttccacttcccggcaccggcctccgcctccccgggacccgcggcggagatcaccttcgcgacggagggcaagggcgacgccaggatcgcggtggagaacgggaacgtcgccgggatgatccagacctggtacctcggcggcgactccgcggtgtcccccagcaccgtccgcagcctggccgacccgtttcgccgcgctgctcgccgtcgcagcgtgatttatatgatgctcagtctgctttaatctaatttccggccgggtggtcgggttgcgttggatttgagttcgtgaatgtccgttctgtacgcgtcttgtctcgtgtgtgttgtcgtttgcagcgaatttgcaagtaataataataaaaagagtatgtcgttgtggaaaaaaaaaaaaaaaattttttctccacctccatcacccgcctccactcccccctcccaggtgctgcccaggtaagtcggcggcggcgatgacaacgcgcttcaagaagaaccgcaagaagcgcggccacgtgtccgccgggcacggccgcatcggcaagcacaggaagcacccgggaggtcgcggtaacgccggtggcatgcaccaccaccgtattctcttcgacaagtaccattcgggctacttcggcaagggtggcatgcgttacttccat

SEQ ID NO: 22416 - DNA, 1559 bp, Zea mays
cgttgtcagttgatatcccagccacagcccacagcttccttgctcgcttccctgcctctcctcctacctaacctcaccaccacctgcaacaacaaagcacacgcccggcactaccatccatccatccgcgcgctcttaatttagcttcctcctcctcacctactagcaggcacagcaggcagcagcatcgatcggatcggagcagcacagcgcgcgtcaccgcaagctcaagtgtcttcttccttgcttgcttgcctgctgcttacctctcagttccccactcacgtcccttgccgtacgtacgtgcgtccaacacaccaggtgaaaagtaagtacaccgccgtcgacttccgatacatcatctcagttctgcatgcatggtttatttcaccgtatggacgactgtgacgaagagcaacgtcgttgcgcagtgggctcggagacggagacggtcaacgtggaaggcatcccgttcccggcggagatcaccgtcggcaaccctctctccctcctaggcacaggtacgtccgcccgttcgtcttcatcgtttcagccgtgcattcaataattcccttggttcgtttgctgctactcactgtacctgtacgtctcacttgtactgtacgtctgtaccgcggctgccacgccgtcgatcgcacgcaggtatcacggacatcgagatccacttcctgcagatcaagtacaacgccatcggagtctacctccacaacgccggcggcggcgacagcaccacgcccacgctgctgggccacctcggggcctggaagggcaagacggcggaggagctcctagcggacgccgccttctgggccgcgctggtcgcggcccccgtcgagaagctgttccgcgtcgtggtcatcaaggagatcaagggctcgcagtacggcgtgcagcttgagagctccgtccgcgaccgcctcgccgccgccgacctctacgaggacgacgaagaggaggcgctcgagaaggtcgccgacttcttccagtccaagtacttcaagccgggctccgtcgtcaccttccacttcccggcaccggcctccgcctccccgggacccgcggcggagatcaccttcgcgacggagggcaagggcgacgccaggatcgcggtggagaacgggaacgtcgccgggatgatccagacctggtacctcggcggcgactccgcggtgtcccccagcaccgtccgcagcctggccaaccgtttcgccgcgctgctcgccgtcgccgcgtgatttataccggtcggcgggccggttggtcgagttgcgttggatttgagttcgtgaatgtccgtcctgtacgcgtgttgtctcgtgtgtgttgtcgtttgcagcgaatttgcaagtaataataataaaaattatgtccggtaggttgtgcagattgtcgttgtggaaactgtaatatgagatagaaaatttgacggtctctcgacctcgaatccatggatcatggatgcactacacttctcaataaacgctcttcataattttacctcccaaaatctgtgtatatgcaaaaaaaaaaaaaaaaaa

SEQ ID NO: 22417 - DNA, 541 bp, Zea mays
atccatccgcgcgctcttaatttagcttcctcctccgatcctcacctactagcaggcacagacagcagcatcgatcggatcggagcagcacagcgcgcgtcaccgcaagctcaagtgtcttcttccttgcttgcttgcctgcttacctctcagttccccactcacgtctcttgccgtacgtacgtgcgtccaacacaccaggtgaaaatgggctcggagacggagacggtcaacgtggaaggcatcccgttcccggcggagatcaccgtcggcaaccctctctccctcctaggcacaggcatcacggacatcgagatccacttcctgcagatcaagtacaacgccatcggagtctatctccacaacgccggcggcgcgacagcaccacgctgctgggccacctcggggcctggaaggcaagacggcggaggagctcctagcggacgccgccttctgggccgcgctggtggcggcccccgtcgagaagctgttccgcgtcgtggtcatcaaggagatcaagggctcgcagtacggcgtgcag

SEQ ID NO: 22418 - DNA, 1103 bp, Zea mays
  misc_feature (492)..(493): n is a, c, g, or t
gggtacctcgaggccggccgggaacgatgatgaaaagctctgtgacgatgggtcgtcacgttgtcaccttctccgatgatacgagcacctctgagctacaggcagcagcatcgatcggatcggagcagcacagcgcgcgtcaccgcaagctcaagtgtcttcttccttgcttgctcgcctgcttacctctcagttccccactcacgtcccttgccgtacgtacgtgcgtccaacacacaccaggtgaaaatgggctcggagacggagacggtcaacgtggaaggcatcccgttcccggcggagatcaccgtcgggaaccctctctccctcctagccacaggtatcacggacatcgagatccacttcctgcagatcaagtacaacgccatcggagtctacctccacaacgccggcggcggcgacagcaccacgctgctgggccacctcggggcctggaagggcaagacggcggaggagctcctagcggacacnncgccttctgggccgcgctggccgcgccccccgtcgagaagctgttccgcgtcgtggtcatcaaggagatcaagggctcgcagtacggcgtgcagcttgagagctccgtccgcgaccgcctcgccgccgccgacctctacgaggacgacgaagaggaggcgctcgagaaggtcgccgacttcttccagtccaagtacttcaagccgggctccgtcgtcaccttccacttcccggcaccggcctccgcctccccgggacccgcggcggagatcaccttcgcgacggagggcaagggcgacgccaggatcgcggtggagaacgggaacgtcgccgggatgatccagacctggtacctcggcggcgactccgcggtgtcccccagcaccgtccgcagcctggccaaccgtttcgccgcgctgctcgccgtcgccgcgtgatttataccggtcggcgggccggttggtcgagttgcgttggatttgagttcgtgaatgtccgtcctgtacgcgtgttgtctcgtgtgtgttgtcgtttgcagcgaatttgcaagtaataataataaaaattatgtccggtaggttgtgaaaaaaaaaaaaaaaaaaacaaaaccc

SEQ ID NO: 22419 - DNA, 3135 bp, Zea mays
gtgtcccggtgtccgtagccgaacaaacatagtggttttagttcctctggaaaccgttagcaagttgcgttaccgttccggtacttcatgttgaaagaaagaaaaacaacacctcaatgttatattgtcacgagtgacatccaatcctctgcataaaaaaacataatagcggttttttacggtgtagatgagaaattttgacacgaaatgggtaaagttatgatgttgtggctgtgtcgctgttttccgctaacccgtgggcgcgtaggctcgaccaaaacaaccacaccgtacctgcgtgcaagtgaaggtgccagacagcaaccggtccagttggcccaaatcgatcgctttccatgtccgtcgtctatctctgctggtactgcctagtacctatatactaggataggagggattttccgtgccgatccaggcatagcaacggcactactccgtactaccaagcaacggcattcataacagcgcaacgcaacacccccgcaggatggagcagcggcgcgtcaggctccgccgcccgtgccgtagcatgcacccgattcagagccccgtcgtcttcgtctgcttggcatcgtcgtcgtcggctcgtcgccgcacatgcactgggtccacacgccagcatccacaccacaccgtgcctggccgcccattggatttggatctccctctgtgctgccctttgtgctagatcacatcggcagattcgatgcttcagtctgcagaattgaataatcacccgctttatcagagtaccaggactgacgctacctacgccgcgtccggccggcgcgctgtcttgtccacccgggccgggaaacggaaacctgccattccaaaccaagcaacacgaaaccgcgggacgaagtttcgttgctgctgctactcactccactccagtccggtccaactgctgcagaattccacatggaatgtgggctccatccagcttcacccatttcacctgcaatgcaaggtgtgtgtttttggtgcgaattccagtataaatagccagctacccatataccttcctctcatgcagcagcgaacaacacaaattaagtagtggagtgtcagaacttgggaggcacaaattaagtacaaagcagtctaattaatgacgggcccgatggagattccggtgatcgatctcggcggcctcaacggcggcggcgaggagaggtcgcggaccttggcggagctccacgacgcctgcaaggactggggcttcttctgggtaagcagagcaccaacgaatgcttgcaattaatatttgacaacttctttccatatgcatgcgcgcgggcgtacgtacgtcattatgatgcgccggcgccgctcgcatccgcatcgcaggtggagaaccacggcgtggacgcgccgctgatggacgaggtcaagcgcttcgtctacggccactacgaggagcacctggaggccaagttctacgcctccgccctcgccatggacctcgaggccgccaccagaggtgacactgatgagaagccctccgacgaggtggactgggagtccacctacttcatccagcaccaccccaagaccaacgtcgccgacttcccagagatcacgccgccgacacggtccgtatatatactgctgtgctgccttcgtcgattcgacctcaattagttgttgccgcacacccacacaccatgcatgcttcgtacgcgctatcattcttcatcttcatgtaacacgcagagagacgctggacgcgtacgtcgcgcagatggtgtccctcgcggagcgtctggccgagtgcatgagcctcaacctgggcctccccggcgcccacgtcgccgccaccttcgcgccgccgttcgtgggcaccaagttcgccatgtacccgtcctgcccgcgccccggagctggtgtggggcctgcgcgcgcacaccgacgccggcggcatcatcctgctcctccaggacgacgtcgtgggcggcctcgagttcctcagggccggcgcccactgggtccccgtcggccccaccaaggggggcaggctcttcgtcaacatcggggaccagatcgaggtcctcagcgccggcgcctaccggagcgtcctgcaccgcgtcgcggccggggaccagggccgccgcctgtccgtggccacgttctacaaccctggcaccgacgccgtggtcgcgccagcgcccggcagggacgatcagggcgccggcgccgccgcgtaccccggtccctacaggttcggggactacctcgactactaccagggcaccaagttcggcgacaaggacgccaggttccaggccgtcaagaagctgctcggctaagcgaacagctgcaagtaggcagaggcagcttagctcgtggactatgcatagtttcaagcttgctgcttgcttcttgttcgatccattgtctgcatgcgtactgttgcgtgtttaaatttagcaaatcttatacgtagtcgttactggtactacgtattctgtggttgacaatacattgttgcggtttaagggcgcatccgtttggtggacttgcacatgccattcgacaaaaaagttggctttccttcgcaattaatagtcaactagtcacaatgacacgcaaatattcggtaagcacacatgtccacatgttgaaaaaacatctgcaagcttccgttcagtttacgtgaaaatcaaaggggttaccggatcaagaaaaaaaaatataaaactaaatatatccaacacgaatgagctcaaatatttacatgttgatcaacgttagagacataggtttgtttgccatgtcagagacaaactgttcgccgcaaactagttatacttatgaacaatcgtgttacgtgtgcggcggtagggaggaagatgcaagggatcggtcggcggtccctggcttcgcaggtgatgaggactatattgacaacaaaggggaaagaccggattaggagagggggcggtttggaaataacttctttcatgattccttaatctgactctgcttacatttatataggccagctgatggccgacatctaatctgttaaaaactttcaactactaatctgctatcctttcctagattctttcaactactaatttgctactaagagcaactccaatagttatg

SEQ ID NO: 22420 - DNA, 1331 bp, Zea mays
acccccaagatgacctagaggctagggggccccctcggccaggcgggatatcccagccacagcccacagcttccttgctcgcttccctgcctctcctcctacctaacctcaccaccacctgcaacaacaaagcacacgcccggcactaccatccatccatccgcgcgctcttaatttagcttcctcctcctcacctactagcaggcacagcaggcagcagcatcgatcggatcggagcagcacagcgcgcgtcaccgcaagctcaagtgtcttcttccttgcttgcttgcctgctgcttacctctcagttccccactcacgtcccttgccgtacgtacgtgcgtccaacacaccaggtgaaaatgggctcggagacggagacggtcaacgtggaaggcatcccgttcccggcggagatcaccgtcggcaaccctctctccctcctaggcacaggtatcacggacatcgagatccacttcctgcagatcaagtacaacgccatcggagtctacctccacaacgccggcggcggcgacagcaccacgcccacgctgctgggccacctcggggcctggaagggcaagacggcggaggagctcctagcggacgccgccttctgggccgcgctggtcgcggcccccgtcgagaagctgttccgcgtcgtggtcatcaaggagatcaagggctcgcagtacggcgtgcagcttgagagctccgtccgcgaccgcctcgccgccgccgacctctacgaggacgacgaagaggaggcgctcgagaaggtcgccgacttcttccagtccaagtacttcaagccgggctccgtcgtcaccttccacttcccggcaccggcctccgcctccccgggacccgcggcggagatcaccttcgcgacggagggcaagggcgacgccaggatcgcggtggagaacgggaacgtcgccgggatgatccagacctggtacctcggcggcgactccgcggtgtcccccagcaccgtccgcagcctggccgaccgtttcgccgcgctgctcgccgtcgcagcgtgatttatatgatgctcagtctgctttaatctaatttccggccggttggtcgagttgcgttggatttgagttcgtgaatgtccgttctgtacgcgtcttgtctcgtgtgtgttgtcgtttgcagcgaatttgcaagtaataataataaaaagtatgtcctgtaggttgtgcaaaaaaaaaaaaaaaattgggccggccctcgacctcgaatccatggatcatggatgcactacacttctcaataaacgctcttcataattttgcctccccaaaaaaaaaaaaaaaaaa

SEQ ID NO: 22421 - DNA, 1471 bp, Zea mays
ctgccattccaaaccaagcaacacgaaaccgcgggacgaagtttcgttgctgctgctactcactccactccagtccggtccaactgctgcagaattccacatggaatgtgcgctccgtccccccgcccccaggccggctctcatgcagcagcgaacaacacaaattaagtagtggagtgtcagaacttgggaggcacaaattaagtacaaagcagtctaattaatgacgggcccgatggagattccggtgatcgatctcggcggcctcaacggcggcggcgaggagaggtcgcggaccttggcggagctccacgacgcctgcaaggactggggcttcttctgggtggagaaccacggcgtggacgcgccgctgatggacgaggtcaagcgcttcgtctacggccactacgaggagcacctggaggccaagttctacgcctccgccctcgccatggacctcgaggccgccaccagaggtgacactgatgagaagccctccgacgaggtggactgggagtccacctacttcatccagcaccaccccaagaccaacgtcgccgacttcccagagatcacgccgccgacacgagagacgctggacgcgtacgtcgcccagatggtgtccctcgcggagcgtctggcggagtgcatgagcctcaacctgggcctccccggcgcccacgtggccgccaccttcgcgccgccgttcgtgggcaccaagttcgccatgtacccgtcctgcccgcgcccggagctggtgtggggcctgcgcgcgcacaccgacgccggcggcatcatcctgctcctccaggacgacgtcgtgggcggcctcgagttcctcagggccggcgcccactgggtccccgtcggccccaccaaggggggcaggctcttcgtcaacatcggggaccagatcgaggtcctcagcgccggcgcctaccggagcgtcctgcaccgcgtcgcggccggggaccagggccgccgcctgtccgtggccacgttctacaaccctggcaccgacgccgtggtcgcgccagcgcccggcagggacgatcagggcgccggcgccgccgcgtaccccggtccctacaggttcggggactacctcgactactaccagggcaccaagttcggcgacaaggacgccaggttccaggccgtcaagaagctgctcggctaagcgaacagctgcaagtaggcagaggcagcttagctcgtggactatgcatagtttcaagcttgctgcttgcttcttgttcgatccattgtctgcatgcgtactgttgcgtgtttaaatttagcaaatcttatacgtagtcgttactggtactacgtattctgtggttgacaatacattgttgcggtttaagggcgcatccgtttggtggacttgcacatgccattcgacaaaaaagttggctttccttgtcaattaatagtcaactagtacaatgacacgcaaatattcggt

SEQ ID NO: 22422 - DNA, 1479 bp, Zea mays
agtgctctaactaaaccaaatatggccatagtactagagaatccccgacaggatttagcactccatacattttccctgcaactcggtcggttctccttccccatatcgttcctctcctgatacgtggcgaaggaggaactgaacgtctgaatctgaaccctttcgttcctctcctattcgaactcctcgcagccaaatccgatggcggcctcatcatcagcgggaccctcggcggtagacgcggcctctctcgccgcggtggcggaggcggcgccgccggaggagatgacgctggtggtgaagtggcgcgggcaggagcaaacggtgcggatggtgggggacgatacgctcggtgagctcaaactgcgcatctgcgaggtcaccggggtgctccccaagcgtcagacgctactctaccccaagctcatacttaaggacatggacgactccaccctcctctcctccatccctttcaagcccaacgggaagatcagcatgatcggtacaattgaagaagaaatatttgtcggccaagaagatgatccggagttacttgacgattttgactttgagcagaatgaagctacacccattaaggataaagatgtctacaagcaaaaattaaagcgacgcgcaagtcgttataagatcaagctcttgaatccgtgccgcaaaggaaagaagctgcttgtccttgacattgactatactctgtttgaccataagtcaacagctgagaatcctatggaactcatgcgcccatatcttcaccagttcctcacagctgcatatgcaaaatatgacatcatgatatggtcagcaactagtatgaaatgggtggagttgaaaatggaacaacttggagttcttagcaaccctgacttcaaaattactgctcttatggatcacttggctatgataactgtgcaatctgaaaatcaaagtagaaagaagacttttgactgcaagcctcttggtgtcatttgggctcagttccctgagtactacaacgaaaagaacaccataatgtttgatgatctaagaaggaatttcgtcatgaatccacagaacggtctcgtgatcaagccattcaggaaagcgcactcgaacaggcatgatgatcacgagctggtaaagcttacacactacctgctttcgatcggagacctagaagatctcagcaagcttgaccacggtaaatgggagtcctttgtagatgagagcgtaaagagacgcaagcgctcttagtttccgtcagtatagtgactgtcagaaagaaaaacagaacacccattttcttttcttttcagtgctatggatacctcgcagattagagtaaccgaatgaccaggatttactttgaacaatctggggcttcagcctcgtcaagttacagtgcttcctgaatctataatctatgctcaaaacttttaatcttgtccaaaaaaaaaaaagcggccaaaaaaaaaaaaactcgag

SEQ ID NO: 22423 - DNA, 942 bp, Zea mays
  misc_feature (777)..(777): n is a, c, g, or t
  misc_feature (871)..(871): n is a, c, g, or t
actccatagggcgattgggttcctcgaggccggccgggaaaaaactccccggcgcccactcgctgcagtctggcactgttctcgggagaggcgtattgctgtcctcccgcaccgcaccgcaccgcaccacgttagcggctcggggtcgggggtcgggccaatcccttccccggcagacggcagtcgcatcgcatcccctccgcctcgttccttgctcggctcgccccaacttcgctgccggccgccgccgccgcattcccctcggctactcgctcctcgtcgctccccggtgatgtctggcggtaacgcgtggtcgccactgccttcgcacggatttggatccgagtctagcggcatggcgaatcgcgccggcgagcctgtggcgaggaccaacagcgatggcggcggcggcggcagcaaggactcgggcagcttcgagtgcaacatctgcctggacctggcgcaggaccccgtcgtcaccctatgcggccacctcttctgctggccctgcctctacgagtggctccacgttcacgcgcactctcaggagtgccccgtctgcaaggccgtcgtcgaggaggggaaactcgtccccctctacggccgtggtggcagctccgccgtaccccgtgcaaggtcggtggccggtgtggaaatcccgagcaggccgaccgggcagcggccctccactgccccgcagccggaccacaataaccattacccgcaccagaacccctggttcaatggtgctggcgccccccctgtggctaatggtanggtgggggagttacactttctcggccgccatcggagggctgttcccgttgctgagcttccaggtgcacggattcccgcaggcgactgcctatgngcctgctgcagggtttccttatgggtacggccattcttttcatgggtggcatggccatggcttcccgcgcc

SEQ ID NO: 22424 - DNA, 3359 bp, Zea mays
tggggccccggcccacacgttcacggttcaccagtctcgtcgtgtccgttcgcgatcgggcaaacctgcaaccctttcctcttcgtccccccgctatctcgttgccccaagccggagtacggagtacggcagtcgcacccccgtcgtcccgttccttgctcgccccaacttcgccgccgcatccccctcggctgctcgctcctcgtctgcccctagtgatgtctggtggtaacgcgtggtcgccgctcccttcgcacggatttgaatccgactccggcggcatggggagccgcgcaggcgagcctgtggcgaggaccaacagcggcggcggcagcagcagcaaggattcgggcagcttcgagtgcaacatctgtctggacctggcgcaggatcccgtggtcaccctctgcggccacctcttctgctggccatgcctctacgagtggctccacgtgcacgcgcactcccaggagtgtcccgtctgcaaggccgtcgtcgaggaggggaagctcgtccctctctacggccgtggtggcaactccacctcaccccgtgcaaggtcggtggccggtgtggaaatcccgagcaggccgaccgggcagcggccctccactgccccgcagccagaccacagtaatcattacccgccccagaacccctggttcatgggcgctggcgccccccctgtggctggtggtcggtgggggaattacactttctcggcggccattggagggttgttcccgttgctgagcttccaggtgcatgtattcccgcaggtgtctgcctatgggcctgctgcagggtttccctatggatacggccattctttccatgggtggcatggacatggctatggcttcccgcgccaggcaccacaaggccagcaggttgatgcgtacttaaaggtgcttctactggtagttggtgtgcttgtaattgccagcctgatcgcattttaaattatgtaaggctggcgatattgctgatccgttggtgtgtaccatagttctagcatcattgcatcttagatagctcccaaagtttgatgtcagcgtggagataagtagacaagttgtgataattggtggcagctggtattcattgtgtaaagttgctatcgaaaattataggtgcatttgttgtgttcttgcgttgaacattctccatgttcatgtttcttccaagaaatttgcctgcaatgttctcttcttcaaaaaaaaaaaaaaaaagggtaacacattgccagattatgctgcctggcctttgtgagacatattttttttctgcatttctaggtcataaatgaattcttattcatggggaagtacatcctaaagtgttcagtttgcagttcaatctttactgaattaaaagatgtcactgtcagcgtatcctgcctttggatttgtccatgattctgaatcataatatttttactttatctgtatcagcttcttttttttcctatataaataatgcatataaagtccaatatgagaacatgaacctcctgcttggttcatagtagtattgaatgtggggaacctaataggtcctaacattttctttgcttagatttcagatttcagagatctgttataggaatttaaaattatataattacatactccacttagtcctgctgcaatgtgtcatggaagtgtgatactattgctgcttctaaaaatcagcaataaactgatgaataagaatatatttctattgcctgaactactaatagagtgtatgccgtgcatcaagaatatttgaatcttttcttcacatgctaatatatgattggtagcatccatcatttccaagttattttattattttaattatattcaatgtcattgtgcccaaggtattctattcccttttttattcaatactattttgcaataacatcttttttcttgatcgacgctctacgtatcatttctattatttcattaaatttctatcatttcattaagaagaaaaaaaagagagaaataagacatatcaactcctggtataagaaccatgcccagtttacataaaaaacgcgccacactcggtcatactaaggttgcttcagtggatcgtgtaaaatagagaacacgaaactatagataattccgtttgacgctctgagtgaaacttgaaatatgggataggatatgagatctgctaataacaacactaaacccgactaggacaacaaggtgagtttacgtaggagtagctctttaagagcagaagctcatggatgaacttgaacgcaagacctgataccctaaaaaaatacaagagttgtgatgtttgtagatttccatcgtccacacaactgcggacgcaaggcaagaacaatatccagctgagctcaaaatatccaagatatgacaacataagcattcaaaaaagaaattaaagaactaacaaactaataatagcacatgaagtcgaagctgctgcagcaagagatgtggttcggtaatgatgacagttgtcgagacccccttattcgtggaccggattgtttcggaggtttgggcatctgccggaggcaggacggaggtttaagctcgttggtgaatatcggtgctgccttggtgctggctcgcatgtggtgtgttgaggcttggcaatgacgtcgtactgcaatcttcctccttctgtgctggtgtttggatgtaggcatcgtcgtattttgtttggctatgtacggctcgtcttgcggagtcggaactgattgtcccttaggtcaagctcggcaacgataactttggataggttatatgtggggtttctattgtatgggttgtttatgcattctgtataggtttcatgcccgattttccttaaaactgattcaattctattattattcttaattgaaaggcaaacccttgccgttacgtttcaaaaaatagcatgtgtatcaagtttggcaaccaatgaatcagtgacagtgatcgtatgacatcaatgtgggatttttaaaattttgaaaagtgaaatttgtgtcatgtcaaaactcaatcttttaaaaggtttaccgggtattttacctgaaacttgaagattacactagtttctaaatgcctggctaaaattacaaaagttattagggcatgtttgtttccttacaagattatataatccaccttaccttatatagattatacaatccaatttatataatactattagagatgtttgtttacataatttattagtgggtagaaagtcaaacaatattctaaaataagcacctaatgatctacttatgaattatcatactataggtatatagattatataattcactttaataatctatgttgtttgtttgcctctcaacttatttaaac

SEQ ID NO: 22425 - DNA, 1525 bp, Zea mays
gttagcggctccgggtccgcggggccggcccgggcttccccggcagacggcagtcgcatcgcatcccctccgcctcgttccttgctcggctcgccccaacttcgctgccggccgccgccgccgcattcccctcggctactcgctcctcgtcgctccccggtgatgtctggcggtaacgcatggtcgccactgccttcgcacggatttggatccgagtctagcggcatggcgaatcgcgccggcgagcctgtggcgaggaccaacagcgatggcggcggcggcggcagcaaggactcgggcagcttcgagtgcaacatctgcctggacctggcgcaggaccccgtggtcaccctatgcggccacctcttctgctggccctgcctctacgagtggctccacgttcacgcgcactctcaggagtgccccgtctgcaaggccgtcgtcgaggaggggaaactcgtccccctctacggccgtggtggcagctccgccgtaccccgtgcaaggtcggtggccggtgtggaaatcccgagcaggccgaccgggcagcggccctccactgccccgcagccggaccacaataaccattacccgcaccagaacccctggttcaatggtgctggcgccccccctgtggctaatggtaggtgggggagttacactttctcggccgccatcggagggctgttcccgttgctgagcttccaggtgcacggattcccgcaggcgactgcctatgggcctgctgcagggtttccttatgggtacggccattctttccatgggtggcatggccatggcttcccgcgccaggcaccacaaggccagcaggtcgatgcgtacttgaaggtgctgctgctggcagttggtgtgcttgtaattgccagcctaatcgcattttagattatgtatggctggcgatgtcgctgatccttgttggtgtgtaccgtagttctagcatcattgcatcttagatggctcccaaagtttgatgtcaatgtgtagagtattgtggatgcttcggctagtaatagtacttgtgataattggtggcagctgttattcattgtgtaaagttgctatcgaaaattataggtgcatctgttgtgttcatgccttgaactttggtcatgttcatatttcttcaatgaagtttccctggaatgttctgttatcaaaaaaaaaaaaaaaccggccgcattgccagacggcagtctgaccattgtgatttgtgagaagtattttttttctgcatcgtcttgttcatggaagtacatcattaagtgttcagtttacagttcaacctgttactgaattaaaagatggcagcgacaaaaagaaaacataactgctatgcttttggatttgtccataattctgaatcgtattatttttactttatctatatcagcttattttgtcctatatgaagagtgatatgaagtccaatatgaaaacacgaacctccagactctgcctggttcagattagtatgaatccgggaaccctaataggtccgacctga

SEQ ID NO: 22426 - DNA, 1146 bp, Zea mays
  misc_feature (11)..(11): n is a, c, g, or t
  misc_feature (114)..(114): n is a, c, g, or t
  misc_feature (126)..(126): n is a, c, g, or t
  misc_feature (132)..(132): n is a, c, g, or t
ctacgccaagncgcgcaattaaccctcactaaagggaacaaaagctggagctccaccgcggtggcggccgctctagaactagtggatcccccgggctgcaggaattcgcacganaccattacctanaacatnctaatagaaaagcaccagtccacgccccactcccagtctcccactcgctgcagtctggcactgttctcgggagaggcgtattgctgttgctgtcctcccgcaccgcaccacaccgcaccgcaccacgttagcggctcggggtggggggttgggccaatcccttccccggcagacggcagtcgcatcgcatcccctccgcctcgttccttgctcggctcgccccaacttcgctcccggccgccgccgcattcccctcggctactcgctccccggtgatgtctggcggtaacgcgtggtcgccactgccttcgcacggatttggatccgagtctagcggcatggcgaatcgcgccggcgagcctgtggcgaggaccaacagcgatggcggcggcggcggcagcaaggactcgggcagcttcgagtgcaacatctgcctggacctggcgcaggaccccgtcgtcaccctatgcggccacctcttctgctggccctgcctctacgagtggctccacgtccacgcgcactctcaggagtgccccgtctgcaaggccgtcgtcgaggaggggaaactcgtccccctctacggccgtggtggcagctccgccgtaccccgtgcaaggtcggtggccggtgtggaaatcccgagcaggccgaccgggcagcggccctccactgccccgcagccggaccacaataaccattacccgcaccagaacccctggttcaatggtgctggcgccccccctgtggctaatggtaaggtgggggagttacactttctcggccgccatcggagggctgttcccgttgctgagcttccaggtgcacggattcccgcaggcgactgcctatgggcctgctgcagggtttccttatgggtacggccattctttccatgggtggcatggccatggcttcccgcgccaggcaccacaaggccagcaggtcgatgcgtacttgaaggtgctgctgctggcagttggtgtgcttggtattgccagcctaatcgcattt

SEQ ID NO: 22427 - DNA, 1559 bp, Zea mays
ctgcagtctggcactgttctcgggagaggcgtattgctgtcctcccgcaccgcaccacaccgcaccgcaccacgttagcggctcggggtggggggttgggccaatcccttccccggcagacggcagtcgcatcgcatcccctccgcctcgttccttgctcggctcgccccaacttcgctcccggccgccgccgcattcccctcggctactcgctccccggtgatgtctggcggtaacgcgtggtcgccactgccttcgcacggatttgggtacgtttcctcaaccaattgtttctgcgatggtttgttccattgtctgttcggatccctttcgtctatatgctctccgtgatccacgcatcgtgtattgaacgaatcgtatctagaaatatcctagattagatgactttggcggatttattcagcgttgtttggcacaaactgtacaatcgattgaaatgccggatcggagtcggggcatgttccccgaaataatatgattcctgattgtggcagcgacgcctcctgcttctcctatttatttcgctcgtgtcgtcggatcgtggcttgattggtccccgcatcccgcagatccgagtctagcggcatggcgaatcgcgccggcgagcctgtggcgaggaccaacagcgatggcggcggcggcggcagcaaggactcgggcagcttcgagtgcaacatctgcctggacctggcgcaggaccccgtcgtcaccctatgcggccacctcttctgctggccctgcctctacgagtggctccacgtccacgcgcactctcaggagtgccccgtctgcaaggccgtcgtcgaggaggggaaactcgtccccctctacggccgtggtggcagctccgccgtaccccgtgcaaggtcggtggccggtgtggaaatcccgagcaggccgaccgggcagcggccctccactgccccgcagccggaccacaataaccattacccgcaccagaacccctggttcaatggtgctggcgccccccctgtggctaatggtaggtgggggagttacactttctcggccgccatcggagggctgttcccgttgctgagcttccaggtgcacggatttcccgcaggcgactgcctatgggcctgctgcagggtttccttatgggtacggccattctttccatgggtggcatggccatggcttcccgcgccaggcaccacaaggccagcaggtcgatgcgtacttgaaggtgctgctgctggcagttggtgtgcttgtaattgccagcctaatcgcattttagattatgtatggttggcgatgtcgctgatccttgttggtgtgtaccgtagttctagcatcattgcatcttagatggctcccaaagtttgatgtcaatgtggagagtattgtggatgcttcggctagtaatagtacttgtgataattggtggcagctgttattcattgtgtaaagttgctatcgaaaaattataggtgcatctgttgtgttcatgccttgaactttggtcatgttcatatttcttcaatgaagtttccctaaaaaaaaaaaaaaaa

SEQ ID NO: 22428 - DNA, 1351 bp, Zea mays
gtgcatagcctggaacaacgctagcgagtgctgtctgctgtcacgaaattgaattgcacgcgtcggtgaacggggaagcgaacacagacacgctacatatgatcctcggccgcggcgccccagcccgccacgttcacggttcaccagtctcgtcgtgtccgttcgcgatcgggcaaacctgcaaccctttcctcttcgtccccccgctctctcgttgccccaagccggagtacggagtacggcagtcgcacccccgtcgtcccgttccttgctcgccccaacttcgccgccgcgtccccctcggctcctagtgatgtctggtggtaacgcgtggtcgccgctcccttcgcacggatttgaatccgactccggcggcatggggagccgcgcaggcgagcctgtggcgaggaccaacagcagcggcggtggcggtagcagcaaggactcgggcagcttcgagtgcaacatctgtctggacctggcgcaggatcccgtggtcaccctctgcggccacctcttctgctggccatgcctctacgagtggctccacgtgcacgcgcactcccaggagtgccccgtctgcaaggccgtcgtcgaggaggggaagctcgtccctctctacggccgtggtggcaactccacctcaccccgtgcaaggtcggtggccggtgtggaaatcccgagcaggccgaccgggcagcggccctccactgccccgcagccagaccacagtaatcattacccgccccagaacctctggttcatgggcgctggcgccccccctgtggctggtggtcggtgggggaattacactttctcggcggccattggaggggttgttcccgttgctgagcttccaggtgcatggattcccgcaggtgtctgcctatgggcctgctgcagggtttccctatggatacggccattctttccatgggtggcatggacatggctatggcttcccgcgccaggcaccacaaggccagcaggttgatgcgtacttaaaggtgcttctactggtagttggtgtgcttgtaattgccagcctgatcgcattttaaattatgtaaggctggcgatattgctgatccgttggtgtgtaccatagttctagcatcattgcatcttagatagctcccaaagtttgatgtcagcgtggagataagtagacaagttgtgataattggcgccccccggtattcattgtgtaaagttgctatcgaaaattataggggcatttgttgtgttcttgcgttgaactttctcccatgttcatgttttttcccaagaaatttgccagcaatgtttttttcttcccaaaaaaaaaaaaaaaaaaaaaaaaacccaccac

SEQ ID NO: 22429 - DNA, 790 bp, Zea mays
actcgctgcagtctggcactgttctcgggagaggcgtattgctgtcctcccgcaccgcaccacgttggcggctccggggtcgggctcggggcctcggggccaatcccttcccggcagtcgcatcgcatcgcatcccctccgcctcgttccttgctcggctcgccccaacttcgctgccggccgccgccgcattcccctcggctactcgctcctcgtcgctccccggctactcgcggtaacgcgtggtcgccactgccttcgcacggatttggatccgagtctagcggcatggcgaatcgcgccggcgagcctgtggcgaggaccaacagcgatggcggcggcggcggcagcaaggactcgggcagcttcgagtgcaacatctgcctggacctggcgcaggaccccgtcgtcaccctatgcggccacctcttctgctggccctgcctctacgagtggctccacgtccacgcgcactctcaggagtgccccgtctgcaaggccgtcgtcgaggaggggaaactcgtccccctctacggccgtggtggcagctccgccgtaccccgtgcaaggtcggtgggccggtgtggaaaatcccgagcaggccgaccgggcagcggccctccactgccccgcagccggaccacaataaccattaccccgcacccgaacccctgggtccatgggtgctggcgccccccctgtggctaatggagggggggggagtacaccttttcggccgccatcgagggctggtcccgttgctgagccttcagggccacggattcccgca

SEQ ID NO: 22430 - DNA, 1782 bp, Zea mays
gaggaagattttgacttgttagtgatttaaccccatccaaacctctgtagtccccaccaaatctaacaacgatttcgtggggcatgtatatgtatacatgagatcattgacattagatagctagagctccccacgattgcgtggagagcaaggcattctaataggggagaataccacagtgaggggagcatgatctgagaggctgtagttttctggccacatgcccttctctacttctgggggaaagagaacagcttccttcacggtgaagccgaaggcttcgttgtttgcctcaaaagtgtccagactttcatcagtgatgtcaatttcagtatcatcctcctcttgactacagcagtttgggctcaagatgcactgaaattctttgtagttaataacaccatcgccatcacggtcagcttcactccacaactcctcaatttcttctgattttagtctatcaggatggaccattcctaactgacacaatgcctggtagaaacttgaatatgtgatgtgatcataaaggctgtctgccttcaggagtgcaaatgcattctcctcggaaaggaatgcaacttggaggaagtacttaatgataccaaaaacagcttcattccagctggtcttcaggggcttcctgcacttatcaggatttaaaagccatatgaaatcaactccgcagatgttccctcgatggtttcggtgactgacccacttatgtgcatcttcttcgctgtcactgtattgatgagcagtgtcatacgatgaaacaaacccttgcgagcgaaggaacttgtaaacttggccacgtttacttccattccaatccccacaaaggatgattggcagtggaccaagtttatgctcttctaggtaagcctcaatatactgaaggatcttatatacctgtcttaagcgaactattgaaaggctgtgatcatgagggaacaacaaatgagtgttgacaatgaggctctgctggtggacacagctggtgcttcgattttgtaagaatggcatcgctgattccacatgcaacagctgagctacccgatcaccgatgtcattgaacagcagttccctataattcaaaacgttgaagtagtttctatgtacagcagtaagaagaccgtctccacgattgttggtgcgtgcaagcttgaagagcatgtaattggcgtctcccagacgcttctggtacatgtcgaccagctcgtcgttccccaaccatacctcctgaaggcagatgatggaggagtgatcagcgagaaggcggtcaataatcttctcgttgcggctgaaccagtaggccctgtactggctctccctgcaattctcgttgtccatgcgcttgtagatcggcgccaggatgttaaacgtggtgcaggaaacgcagcgctcgtcccgcggctgccgccggtgatggtggtgtcggtctcgccgtcgcatcgcccccgcctccctccgctgcttcttcgtctgcacaaaacacacacacagcaggacctcacctcagcaaacaaccgggccgtcaatccaagcccacggcggaagaggctatgcgagcagtaagccacacatagctcgacggggtcgccgcgggcgaatactcaccattgcgatgattcgtagggcgtggaatctgatacttggtggaggccgtgtggcctcggctcctcgtcgatttggcggctactagcggaggagaggaatgggattgatggttttcgctggcttcgggctcaccaccgtcaaaatggttataaagaatctttgcac

SEQ ID NO: 22431 - DNA, 1788 bp, Zea mays
ggccgcttttttttttttttttttgaatgctaaaggtccaagtttctattttctccaaaagtaatcctctatagaccaggaaggaggagatcaaagggttttgaggaagattttgacttgttagtgatttaaccccatccaaacctctgtagtccccaccaaatctaacaacgatttcgtggggcatgtatatgtatacatgagatcattgacattagatagctagagctccccacgattgcgtggagagcaaggcattctaataggggagaataccacagtgaggggagcatgatctgagaggctgtagttttctggccacatgcccttctctacttctgggggaaagagaacagcttccttcacggtgaagccgaaggcttcgttgtttgcctcaaaagtgtccagactttcatcagtgatgtcaatttcagtatcctcctcctcttgactacagcagtttgggctccagatgcactgaaattctttgtagttaataacaccatcgccatcacggtcagcttcactccacaactcctcaatttcttctgattttagtctatcaggatggaccattcctaactgacacaatgcctggtagaaacttgaatatgtgatgtgatcataaaggctgtctgccttcaggagtgcaaatgcattctcctcggaaaggaatgcaacttggaggaagtacttaatgataccaaaaacagcttcattccagctggtcttcaggggcttcctgcacttatcaggatttaaaagccatatgaaatcaactccgcagatgttccctcgatggtttcggtgactgacccacttatgtgcatcttcttcgctgtcactgtattgatgagcagtgtcatacgatgaaacaaacccttgcgagcgaaggaacttgtaaacttggccacgtttacttccattccaatccccacaaaggatgattggcagtggaccaagtttatgctcttctaggtaagcctcaatatactgaaggatcttatatacctgtcttaagcgaactattgaaaggctgtgatcatgagggaacaacaaatgagtgttgacaatgaggctctgctggtggacacagctggtgcttcgattttgtaagaatggcatcgctgattccacatgcaacagctgagctacccgatcaccgatgtcattgaacagcagttccctataattcaaaacgttgaagtagtttctatgtacagcagtaagaagaccgtctccacgattgttggtgcgtgcaagcttgaagagcatgtaattggcgtctcccagacgcttctggtacatgtcgaccagctcgtcgttccccaaccatacctcctgaaggcagatgatggaggagtgatcagcgagaaggcggtcaataatcttctcgttgcggctgaaccagtaggccctgtactggctctccctgcaattctcgttgtccatgcgcttgtagatcggcgccaggatgttaaacgtggtgcaggaaacgcagcgctcgtcccgcggctgccgccggtgatggtggtgtcggtctcgccgtcgcatcgcccccgcctccctccgctgcttcttcgtcattgcgatgattcgtagggcgtggaatctgatacttggtggaggcctggcctcggctccttctcgtcgatttggcggctactagcggaggagaggaatgggattgatggttttcgctggcttcgggctcaccaccgtcaaaatggttataaagaatctttgcaggagaaaatgggtgtcccggccggcctcgaggtcccaatg

SEQ ID NO: 22432 - DNA, 1421 bp, Zea mays
atgttttttttttccaggaacatcccttccagcaacttttataccttcagcagagcaatagcactcacgagtcacgacacagttgctagcacaaaagatgcaacttccagcagaggtcaacaaataggtcactagagctcaccggtggtgctgcaatagaatcagctacacacaactagctcaaccaatgtacaaaagaactgaatacctaaattgccaaaatcacaaatctggactcctaaactagatagctataaaagctactggaagagttcaatatggatctaagctatatcagtaagcacaaagcccttccacactgaattgctaagctgtacataggagatagagcaccgctgcttcaccgccgcgacaatctgggtcagaacctcaaactgtatttgttcttttcccagtaagaatacgggatatctggaggcccctgctaaaaccttcattgaaaagtacccttgtctgcatttcttgaaatcccggcaaccaggacagcaatgcaactggtgccataatgaacactccaagcagtatctcatacaaacgagccacagaaataatactgtcccagaccacagtggattcgatgaatggccgaattacttgagcgatcgaaatcaagccccaaccagtaggaataaatgccaaaagactagtgaagatgtcaatgatttgaaattccgtgaacttcagaaacaaaaccagcactagcactacaagagtgatgacagcagtttgaacaacccggtagtaaaggtgctgctttgcggcatacttgtctcgagcataggacattagcacgaacagaccaaaaatcacagccacacatatccaggaaagcagatagacagcaatacttctgctattgtttgctatcttcagctggtatacaaccccatactggaaaaagaagtacctgagatctaacagtatctccaaaatctttccccaaagaccagtggtccgtagatgatcttgctcttcataccaccacacttcccagctctgctcaggcttagaaaagagaccaccaggataccatatccagttcatgaaatcatcaaaatcgtacactgttttcaaccaatcaaaaccagacggattaaaagcaaatggagccataatccatgataccaccagaaaccagctagatatattcataattatgtaaacaagtgtattcttggcaataacactgtgtgcagcatacacagtcaatattattccaagctctattgcctttatgaagtggctcctagcatacagcctgtaattttcagcaaaactcttgtgctgcacaacaaaaccacggccagtagcacggtattttgcaccaccatgaaggattgtccggccatagtaatggctcttgttcccatgaaaatggtagaacacagataaaattcccg

SEQ ID NO: 22433 - DNA, 2478 bp, Zea mays
  misc_feature (363)..(363): n is a, c, g, or t
aagtatgattggcacagaatcacaactagtgctatttcagtagcacttctactaccacattatggttgcgtcactgtagacataagttacacaattcaatatgagatgtaatgatgtggaggatactttaggccttgtttcgatctcaagttttatgaaaactggatttcttaaagtcagtgtcaatttgttatttagaaaaccattttgtttgacatgaagataagcaaacatgctttctagtaaattcaaaattccaagttttagcaaaatctactgtgctcatttctatggccagaattcttcacactaccattcattcaatcattcacataactaactcagctttgatggtgaggatantttgcatggtgactaacactgtcagttgtgtaacataaaacatgttgagcactttcaatccgaaaacataaatgtataaaccaacaatgacatagtatctactttagacttgttttctctctctctaaatttcctaacagaaaatgttctctgagaactggtttctaatcttgaaatccatgcaacaatttactgtctgtattcttgaatggtttgttgtctgactcctattttattcagttaccatggcagcgatgaatactggtatgggaggtttaggtggcaggccgatacatccacaagcaaatccttttggaactgccttgcagggtgctggaccaggattgatccgtactgggctagaaacatatggcggaaggattttagattcaagttctgagtttatgcagagcaatgtaaatttgtgcacatgttttttgtttagaggtcaatgattctatattaaaactagaaaggctaaaccccaatcaattttttgtcagataacacaatatttgtccgaccctcagtactactttcaagtcaacagccagtatgtgaggaacaaactgaaggtcatcttgttccctttcttgcacagggtaagagctctacctttaatttatctttgcaggattttgcatattgtgatcctgtgaagtctcaacatttctgacctttattgtcttccttaagggtcactggacaagaataactgaaccagtaggaggaaggctatcctacaaacctccagtccaggatatcaatgcaccggacttgtacatccctttgatggcatttggcacctacattgtagctgctgggtatgccttgggtgttcttggaaggtaaatacactgtgaacgacttcttttgtttcatctggaattagagaagaacattgtaatagcagcacacaaggaatgcaaataaatttatgaaccactgtgtcttgaatgattgcatgctttgtgatgcaggtttacccctgaggcactgaccctacagttttctaaagggatacttgggtggtttctgcaagtcgtcctcatcaaaggtctgctgtactccctgggaagcggcgaagctcccttgctggacatcgtggcgtatgctggatatggcttcgctggcacttcccttgcaatggtggcccgcatcttctggagctacctgtattacttcatcatgccatggttctgcctctgcacgggagtcttccttgtgaagaccatgaagagggttcttctgggcgggccaaggagctacgagagacaccccggccggaaccactacttcctgatcttcttggcggtcgtgcaattccccatgctgttctggctcggcaacatatgtggctgacctttgatcctattggtcgggccacagacctgtttcttcttcttcttcagaataggcatgtgctacttctggcttgctgatgaatcttaggtttatcgtggagatggtacagaactattagctatagatatctgggcaatcgaattataaactgtttttgtttctgttagctatagaggcgaaaagtaaaaacgatcgtttgggataggataaagatgaactgcttcgtgtgtacccttttgtgtcacgagcggctagccacgaccctgcaatctgacttgttttttaatgatcactgctacttgatctttccaaaaaaaaaaagctttgggtcgatattttcactgccggtttatttagtggccagatgtatgaattgcggtgttgtttggatgatctaattgcgttgctttccagagttcaaacgtggagggaagcagcgagctttatttagggcctgtgttgtagttgtagagcagcaaggtgcttaggctatctccaaggacacggtaaagctctcccagccgcacatacggggtgaaaactgaaaagtactacaaacggttatctgcaaagggttctcgtatatataggaagattgaatgtccgtagtaagtaatatgctcactctatactttaattacattatttcttatacttcaattacattgttttacattatttcttatactttaattacattgtttctttacgatattaattatatttaagctccgtaacataataataatg

SEQ ID NO: 22434 - DNA, 1290 bp, Zea mays
attgaaattttccgtttgcaccctaccgagaggtgacgacgagtgaggagtctgtgtgaccagtgctcggcgtcgtcccctgcctctgctagccgctaggcgacgggcccttcgccgggcgacgagcacaccggccctgttaccatggcagcgatgaatactggtatgggaggtttaggtggcaggccgatacatccacaagcaaatccttttggacctgctttgcagggtgctggaccaggattgatccgtactgggctagaaacatatggcggaaggattttagattcaagttctgagtttatgcagagcaatataacacaatatttgtccgaccctcagtactactttcaagtcaacagccagtatgtgaggaacaaactgaaggtcatcttgttccctttcttgcacaggggccactggacaagaataactgaaccagtaggaggaaggctatcctacaaacctccagtccaggatatcaatgcaccggacttgtacatccctttgatggcatttggcacctacattgtagctgctgggtatgccttgggtgttcttggaaggtttacccctgaggcactgaccctacagttttctaaagggatacttgggtggtttctgcaagtcgtcctcatcaaaggtctgctgtactccctgggaagcggcgaagctcccttgctggacatcgtggcgtatgctggatatggcttcgctggcacttcccttgcaatggtggcccgcatcttctggagctacctgtattacttcatcatgccatggttctgcctctgcacgggagtcttccttgtgaagaccatgaagagggttcttctgggcgggccaaggagctacgagagacaccccggccggaaccactacttcctgatcttcttggcggtcgtgcaattccccatgctgttctggctcggcaacatatgtggctgacctttgatcctattggtcgggccacagacctgtttcttcttcttcttcagaataggcatgtgctacttctggcttgctgatgaaacttaggtttatcgtggagatggtacagaactattagctatagatatctgggcaatcgaataaactgtttttgtttctgttagctatagaggcgaaagtaaaaacaatcgtttgggataggataaagatgaactgcttcgtgtgtacccttttgtgtcacgagcggctagccacgaccctgcaatctgatttgttttttaatgatcactgctacttgatctttccgctttgggttgatattttcactgccgggttatt

SEQ ID NO: 22435 - DNA, 1227 bp, Zea mays
ggtaccctcccagtctcgccggaattgaaattttccgtttgcacctaccgagaggtgacgacgagtgaggagtctgtgtgaccagtgctcgccgtcgtcccctgcctctggccctctgctagccgctaggcgacgggcctttcgccgggcgacgggcacaccgcccctgttaccatggcagcgatgaatactggtatgggaggtttaggtggcaggccgatacatccacaagcaaatccttttggaactgccttgcagggtgctggaccaggattgatccgtactgggctagaaacatatggcggaaggattttagattcaagttctgagtttatgcagagcaatataacacaatatttgtccgaccctcagtactactttcaagtcaacagccagtatgtgaggaacaaactgaaggtcatcttgttccctttcttgcacaggggtcactggacaagaataactgaaccagtaggaggaaggctatcctacaaacctccagtccaggatatcaatgcaccggacttgtacatccctttgatggcatttggcacctacattgtagctgctgggtatgccttgggtgttcttggaaggtttacccctgaggcactgaccctacagttttctaaagggatacttgggtggtttctgcaagtcgtcctcatcaaaggtctgctgtactccctgggaagcggcgaagctcccttgctggacatcgtggcgtatgctggatatggcttcgctggcacttcccttgcaatggtggcccgcatcttctggagctacctgtattacttcatcatgccatggttctgcctctgcacgggagtcttccttgtgaagaccatgaagagggttcttctgggcgggccaaggagctacgagagacaccccggccggaaccactacttcctgatcttcttggcggtcgtgcaattccccatgctgttctggctcggcaacatatgtggctgacctttgatcctattggtcgggccacagacctgtttcttcttcttcttcagaataggcatgtgctacttctggcttgctgatgaatcttaggtttatcgtggagatggtacagaactattagctatagatatctgggcaatcgaattataaactgtttttgtttctgttagctatagaggcgaaaagtaaaaacgatcgtttgggataggataaagatgaactgcttcgtgtgtacccttttgtgtcacg

SEQ ID NO: 22436 - DNA, 1519 bp, Zea mays
cggacgcgtgggtttttctttttttttaactctgaatctcttatatgtgtagtttacttgtttacatcatattatcccttaggagctcaatacatcgtcagatgccaatttgtcataaactaagattcttgaggtttcatgacaaaaggcataagagagcacatttaaaataggtgcatggacaatatactgttttaaattcagtatattgtttgtgttagtttgtgtctataggctatttagtaagtgtctctttgttaaaagctactattatatctacctatatcttgtctgatagagtcctgctttaaaaattgctggcttttgcatgtgcccaagtcctctgagagcgtctcacacaactttctgtacagggagcagtctccagatgacttctttagttcgacaacataaagagattcattgatctcaaacacctcagcagaaattaataatgactcttgccctcttgaatttgctagtcccttgcagtcttggatcacttttagcttgccgttgctcttatgtacctggaaccccatttttctgacaatgctctcaatcttctcaaataaataagctggggaataatttgatgcaaatctgattttcctttcagaaacatcctctttctcaaaaaatccggatagatcaaggcaggaggacattccaatgagctggaaagcattgatttggttgattgctatcttgtcttggatgtcattatgctcggtgatgtttaggctgtcttcatccatgctgatatcttcttcatcatcgctaaatggcatagctggagcatagccttgcttgaaccaatcatgtgcccttattccatccacatctatgcgtgtaaccgggttaggatccaggatttttctcagtatatcttgggcaccttgggagagccactttggaatgtgagcattccccttgagaatcttctggtaaaggacaaccacattttggtcgtcgaatggaagattccctgtaagcattacatatagaataacaccacaggaccatacgtcagatatcgagccgtcataacctttgttcagaaggacctcaggggctatgtagttagggctgccacatgtggtatgcaacaaaccatctttttgttggttctgtggaagggcacttaatccgaaatcagaaacttttatgtttccttttgcatcaacaaggacattctctggcttgaggtccctgtgataaacccccttctcgtggcagtatcccacggcatctatgagctgctggaacagtttcctcccttccttctccgtcagcttacccttcaacgcgatcttgtcaaacagctctcctccattgacgtactcaagcaccatgtatattttggtcttgcttgcggaaacctgcccgagcccgggtgtccggccccgacgttggggtgcttgacagcttcagcgtcgcgatctccctcttgatctggtcgtggatcttcatggcgaggatgcgctggcggtcgaggatcttgaggcgaagggcacgg

SEQ ID NO: 22437 - DNA, 1252 bp, Zea mays
tattttacttgtttacatcatcatattatccctttggagttcgatacattgtcagttgccaatttttcatagtctaagtctcttaaggtttcatgacaaaaggcatgagagagcacatctgtaataggtgcatgcccaatatactgttttaaattcagtatattgtttgtgttagtttgtgtctatagcctatttaacaagggggctcttagttaaaagctactgttatgtctacctatctcttgtctgatagaatcctgctttaaaaattgctggcttttgcatgtgcccaagtcctccgagagcgtctcacacaactttctgtacagggagcagtctccagatgacttttttagctcgacaacgtaaagggattcattaatctcaaacaccttgccgttgctcttgtgtacctggaaacccatttttctgacaatgctctcgatcttctcaaacaagtaagccgggggataatttgatgcgaatctgattttcctttcagaagcatcctctttctcaaaaaatccggatagatcaaggcaggaggacatcccaatgagctggaaagcattgatttggttgattgctatcttgtattgaatgccattctgctcagtcatatttaggctgtcttcttcatccacgttgatatcttcttcgtcatcattaaacggcgcagaaggagcgtagccttgcttgaaccaatcgtgtgcccttatcccatccacatctacgcgcgtgatcgggttaggatccaggatctttcgcagtagatcttgggcaccttgagagagccactttggaatgtgagcattccctttcagaatcttctgatagaggacaaccatattttggtcgtcaaatggaagactccctctttgttcagaaggacctcaccggggctatgtagttagggctgccacatgtggtatgcaccaaaccatctttttgtcgttggttctgcggaagggcgcttagtccgaaatcagaaacttttatgtttccttttgcatcaacaaggacattctctggcttgaggtccctgtgataaacccccttctcgtggcagtatcccacggcatctatgagctgctggaacagtttcctcccttccttctccgtcagcttacccttcaacgcgatcttgtcaaacagctctcctccattgacgtactcaagcaccatgtatatttcggtcttccttgcggaaacctgcacgagaagagcaaggtcaaataatggcacagtccct

SEQ ID NO: 22438 - DNA, 2058 bp, Zea mays
cccccctcgggtcgacccccccaggcccgatctccctctctctccccaatcctccccgcctccccctaccaaatcagcaccacccaaggcgcatccgagccacggccgcgcaatgccgccctctgtcgatgcaatgccggcccccggcgacgccgcgggcgccggcgacgtgcgcatgatctcctccaaggagctccgcgctcacgcttccgccgacgacctctggatctccatctccggcgacgtgtacgacgtcacgccctggctcccccaccacccgggcggcgacctcccgcttctcaccctggcggggcaggacgccaccgacgccttcgccgcctaccacccgccctcggcgcgcccgctcctccgccgcttcttcgttggccgcctctctgactacgccgtctcccccgcgtccgccgactaccgccgcctcctcgcgcagctatcctccgcgggcctcttcgaacgcgtcggccccacccccaaggtccagctcgtcctgatggccgtcctcttctacgccgcgctgtacctcgtcctcgcatgcgccagcgcctgggcgcacctcctcgcggggggtctcattggcttcgtctggatccagtccggctggatgggccacgactcgggccaccaccgcatcaccggccatccggtcctcgaccgcgtcgtgcaggtgctctccgggaactgcctcaccggcctcagcatcgcctggtggaagtgtaaccacaacacgcaccacatcgcctgcaacagcctggaccatgacccggacctccagcacatgccgctctttgccgtctcccccaagctgttcggcaacatatggtcctacttctaccaacggaccctggcgttcgatgccgcctcgaaattcttcatcagctaccagcactggaccttctacccggtaatgtgcatcgccaggataaatcttctcgcgcagtccgccctgttcgttctcacggagaagagggtgccgcagcggttgcttgagatcgcgggggtcgccacattctgggcttggtacccgttgctggtggcttccctgccgaattggtgggagagggtcgcgtttgtgcttttcagcttcaccatctgcgggattcagcacgtccaattctgcctgaaccacttctcgtccgacgtgtatgtcgggccacccaagggcaatgactggtttgagaagcagacggcaggcacgctcgacatcctgtgctctccttggatggattggttccacggtggcctgcagttccagattgagcaccatctgtttccccgcctacctcggtgccaccttcgcaaggttgcaccggccgtccgcgacctttgcaagaagcatgggctcacttattctgcagccacattctggggtgcaaatgtgcttacatggaagacactcagggctgctgcattgcaggccaggaccgctacaagtggtggtgctccgaagaatttggtatgggaggctgtgaacacccatggataaatgggatgaagatacgggctaatggcaacttctggtgttcagcttggtgcccatgtgattgtctggatgcctttcagttatttagagatattgatcattcaacctgcctgagtcaggttggaattttcgtgttgacaagtggctgtctatccagttggagagttcatgcttcaatagtctggttgttcacgggatgttctgttctccctatcacggtaactatatgatgatgatccttgctttaattcatgaacacttgtttcaagattatgtccattacattttgcttgcattgtcaagattgtggattcttggtgttcatgacgttgtaatgttaatgaacggctggtaacgccatgtggtactggtacccctgtattttcagttgctgtggcaccttggctctctctttgaaaaaccagtatgtatatgacaatgatcaatttattcatattcctacttcattcccaaaaactgatttgttcttaagacggggaaaaaaaaaaaaaaaaaaaaaaaaaaaaaaaaaaaaaaaaaaaaaaaaaaaaaaaaaaaaa

SEQ ID NO: 22439 - DNA, 959 bp, Zea mays
  misc_feature (912)..(912): n is a, c, g, or t
  misc_feature (919)..(919): n is a, c, g, or t
  misc_feature (922)..(922): n is a, c, g, or t
gcggtacgcacggatattcgtctttttccctgcaataaaacattgggtacctcgaggccggccgggctcaagatccgatctccctctctctccccaatcctccccgcctccccgcctccccctaccaaatcagcaccacccaaggcgcatccgagccacggccgcgcaatgccgccctctgtcgatgcaatgccggcccccggagacgccgcgggcggcggcgacgtgcgcatgatctcctccaaggagctccgctctcacgcgtccgccgacgacctctggatctccatctccggcgacgtgtacgacgtcacgccctggctcccccaccacccgggcggcgacctcccgcttctcaccctggcggggcaggacgccaccgacgccttcgccgcctaccacccgccctcggcgcgcccgctcctccgccgcttcttcgttggccgcctctccgactacgccgtctcccccgcgtccgccgactaccgccgcctcctcgcgcagctatcctccgcgggcctcttcgaacgcgtcggccccacccccaaggtccagctcgtcctgatggccgtcctcttctacgccgcgctctacctcgtcctcgcctgcgccagcgcctgggcgcacctcctcgcggggggtctcatcggcttcgtctggatccagtccggctggatgggccacgactcgggccaccaccgcatcaccggccatccggttctcgaccgagtcgtgcaggtgctctccgggaactgcctcaccggcctcagcatcgccctggtggaagtgtaaccacaacacgcaccacatcgcctgcaacagcctggaccatgacccggacctccagcacatgccgctctttgccgtctcccccaagctggtcggcaacatatggtcctacttctaccacgnaccctgncgntcgatgccgcctcgaaattctcatcagctacagcact

SEQ ID NO: 22440 - DNA, 3764 bp, Zea mays
gcatattttggagactgtcattattctatattctatttgacttataatttggatctgaagagagtaagattttataaatagtaattttacaagttactaatttgtaatgctaataaatcaagcatgtttttattagagtgcgacatgcaaagcactgagaaagagagaagaacagttcatctccttatcttggttttaatccgtatgagcttctaccgatttttcaattttttatctataaattacagcagtaaaaattgaaataattgaagtctctatgaattgcatctgaaaattgcgagcgtggtgtattccttttccaggctagcgcgtgacgcgtcaggccgtaaccgaaccggcgcgaccaccgaatagccagcccatcaaacagcgggccctcctggccgccccgcggcaggctccgatatttgttttttccccaacaaaacaccgccaccttttatagatccaatctccccacttccacaattctccccgcctccccctccgaccctcccaaatcagcaccacccataggggccacggccgcgcaatgccgccctctgccgacgcaatgccggcccccggagacgccgcgtgcgccggcgacgtgcgcttgatctcctccaaggagctccgcgagcacgcgtccgccgccgacctctggatctccatctcgggcgacgtgtacgacgtgacgccctggcttccccaccacccgggcggcgacctcccgctcatcaccttggcggggcaggacgccaccgacgccttcgccgcctaccacccgccctcggcgcgcccgctcctccgccgcttcttcgtcggccgcctctccgactacaccgtctcccccgcgtccgccgactaccgccgcctcctggcgcagctctcctccgcgggcctcttcgagcgcgtcggccccacccccagggtacagctcgccctgatggccgtcctcttctacgcggcgctctacctcgtcctcgcctgcgccagcgcctcggcgcacatgctcgctggggggctcatcggcttcgtctggatccagtccggctggatgggccacgactcgggccaccaccgcatcacgggccatccgctcctggaccgcgtcgtgcaggtgctctccggaaactgcctcactggcctcagcatcgcctggtggaaatgcaaccacaacacgcaccacatcgcctgcaacagcctggaccatgacccggacctccagcacatgccgctcttcgctgtctcccccaagctgttcggcaacatatggtcctacttctaccagcggaccctggccttcgacgccgcctcgaaattcctcatcagctaccagcactggaccttctacccggtaatgtgcatcgccaggataaatcttctggcgcagtccgctgtcttcgtcctgaccgagaagagggtgccgcagcggctgcttgagatcgccggtgtcgccgcgttctgggcttggtacccgttgctggtggcgtgcctgccgaattggtgggagagggtggcgttcgtgcttctcagctttaccatctgcgggatccagcacgtccaattctgcctgaaccacttctcgtccgatgtgtacgtcgggccacccaagggcaacgactggttcgagaagcagacggcaggcacgctcgacatcctgtgccctccttggatggattggttccatggcggcctgcagttccagattgagcaccatctgttcccccgcctgcctcggtgccaccttcggaaggttgcgccggcggtgcgtgacctttgcaagaagcatgggctgacctattccgcagcctccttctgggacgcaaatgtgcttacatggaagacactcagggctgccgcattgcaggccaggagcgccacaggcggcggcggcggcgctccgaagaatttggtctgggaggcattgaacacccatggatgataaacgggacgaggatatggctgaggggaaggcaacttctggtgtttcagctttgtgccgacgcgattgtctggttgcttctaatctcagttgtttagattgtattggtcattgaacccgtccgagtcgggctggaatttttgtgttgacaagtgaccgtctatccagttgaagagttcatgcttcaattgtctgggttgttcgtcggctgttctattctgttcctcctatatcatggtaacgatatcgtgatccttgctctaagtcatggacctctgttttattaaggttatgtccattcgatttctcgctggcattgccaggattgtggatgcttttttatgttcatgatgttgtaagcttaatgaacggctggtaatgttatatgtagtaccaccaccccctgtaatctcagttgctgtggcagctttgactctctttggaatactagtatgtactccgtatatgacaatgatcaattcatccatattcctacagcatttcccattttctgttttgttcatgccctattctttgctcctgtaaaaaaaaagcgatgctgtctttgtattcgcctacgcattactctaaatggaagtttactttcatggcttctatttccgtcggtttgttgagtgcttcttgctaggatcagtgtattttcgtatatgcttaagccactataatttctgcatttaccgctactgctacccttacgacagtcagaacatcaccaatgggacatgatctacagatgtgcattgtgtgtttttttttctttccatgacgcgcgtacggttgtccggaccaggtttggagtgcattggtgtggcctgtgggaaacgcattcagctgatgatcgtgtccggttcctgcggtagccccccgtggccctgtctgccccttgagccgcgattcttggattgtggttcagacttcagagacgcagcacatggagcatgtcctggcatactcaggggcccccctgtctttttgtaacagaaaatggcatgtactacgacgtatggcttctttcttgctgtcaaccacaccacgcgaccacggatggtgctgccagtgccatgccaagagcatccacgctcgtgcgtctgtggacgccactccggctttgctgctcaggcattcatccatattatattccattccattgggacgacgacgggaggcaaaatatctcgtcgccgggccggatgcctcgacctcgacctcgacctcgagagccgccgatcttgggagggtcacgacaccacgtccacttgctccctagtaatctttgcaagaatctttatcatgcccttggaggacagagcatcctatcctacaccgacggtggcgacgaggcagtgcctctacttgtaaagattccccaggtcaggtgactcaccagctcgtgacttgctacttccagtttttacacattgtgatatgttcaacttgcagtcttgccttgttgagtgtcgaccaaagcttttatatatatattccctccgttcacaaatatatacgacgtttaacttttttattctcaatttcaatcgctcgtcttatcttaaactatttaaaagaagttcgctccagtttggtttagtatataataaacctcaagtgtaggtataaatcattacagaattttaatttttttgaataagacaaatggtcatagctaagactaaaaaggtcaagcggtcatgtatttgtgaaccgatgtagtatatggaaatgttgaggagaaggtcttcggttaatgccggtccctagataatcaaaataattttcagtttttttcaagataaag

SEQ ID NO: 22441 - DNA, 1423 bp, Zea mays
acagagacaatgtcctcttcacttgattgctcttttaagatataaattatactgagtaatatcaccggtcgctgggcggacccgtggaagtaaaaatacgggtgagacagacgatttttattctgtggttcagacaagcctacatttgtagtgtcctcttttggacaagggttgcactcaactcctctcaagtgatcacgtagtaacaaacataacgtacatacaaacatgagtttattgctgttatcggcaacatattttccacgaaacagacaaaaagcgtattgtcatatcaaactaatcaaaagggtcaatccgtggatcatgctcacttgccatcgccattcctgtgcacaagcacgtcggacacatcacctttccagctccagaacaattctgacaccttcctttcattgaccacatattatgccccaataatgaaaactgctttgtgttcaataacatcccactagcagaacagcgagcacatggcaagtacccagtcccatggcaatatgtgcatcttttcttctcttgctgcctgacatttctcacttcgaccaacattaaagctgagataacaccaactgcgccacctgaaaatgatgccactataggatctacctgactcaattgaagaggtaagtgcaaggtccttataaaatcttcataagatgtgccacccagccctagtttcagttcaagtactggggctatcaagcctccaaaaatgattatcccagatatgacagagaacgatgtcatatagagttgcttcatagtctttggtgacgcatcaggcataaatggaatagttgatggaatctcaggcatttcatttccttcagtgttggcatctttgctttcagaagttcggatacgctgctgcactcgcaaccgtctaacctcttccatcagaaggaaaattttgttgcgtcggctcatgatgttgtcttcaatctcctgcgattgcatttgagcaaagtcctcgatcgtctctggaccttcaattatacagaagctggaaaggccgccgtccccggacgccctggactcgccagctggggagcaccgcagcagcgccagctgccgccggccgcacccggcttctcgccctccagtcccccgcaccgcgtaatgcaggccccggcacggcgaaggcgagcgcaaaggagcggcggcgcggagcatgcgctcccccgcctttggcggtgcagccggcggcgccgcgaggcaggacatggccggccagaccagcgccgcgtggctgcttggtcgcgtggaagcgtccgtgacggatttggataggcgacggccggagaagagggtcgggtacaccgttcacgggggaggggacgttacgccctacgccgttactgcgttaccgcgggtacatgacaaatgtggaaagccgaagcatctc

SEQ ID NO: 22442 - DNA, 1609 bp, Zea mays
ctgcagtcaaagtatttttttgtaagtggaattttgcttttcaatcaggctaaaaggatggatgttgtatggggagagactgctggtgttgaaggtcaattgttgctgttgtgccctctcctttttctattgcaggtattctttattctgatggctgcatgctgttgaacacggcaacatgcagttatctaagtaaccacatctaggatgtatgttgtaaacttggttttcctatttgactcgtgaaattgtctttgcatatatttaaatatttttattacatacaagattcttttctgacaattttttgatgattgtgccaattcgtcttctatatcgaatactccctctgttttaaattgtaagacaatttgacttttctagatatattactcttactatgcatttagacggagtgtatgctaagtgcatagcaaaagcaaaagccaaaatgtcttataatgtggaatgggggggggtaatatttttttgtgctattgattgtcttatgattgcatcagataggatcttctaataaatacaagcatggccattggagtaaacatctgattgttctttttccattttgtttagggatttgagggttatgttgggtttttacttcttcgcacagctcatactggtgtcgtccctgagtggcaggtcagagactctagctgttaatgcaaccaggattccattgtattgttacttgttagttgataaaatgctaccaggatcgcttcgtattttatcctgtgttatatgctttgtcctctgtcactgcggctcgtcggtgggatcctgctgatttccatggcaattggcaacttcgcaaacacattggatacattgatggccaagtctcggttcaaagcgaagatgaagaaatcaaagggcaaacgggatcttgacacgtgcccctcaccaacaggttcgtcgccgacagattcagcaaccagagcatgaaaaggtcaagagggccagttgcttaccctatgaccattgcccgtgtttaaccagggctggtcaccattgtaaatcattagtgttttctggccatcagcccctaatccttactgtctctgtcagagctcatactcatgtaagcatcaggcaactaggttgctgatggtcctaggctgaaaaaggatactgagaataaacttctggtgtttgtttatacctatatcctgaacatggagtggagtagatgagctttaggactgcaagtcttagcagaaaatttcccagtatagttgtgaagctgtgagacatttgtcacaatgcgaagctgtatacaggttgaggcactatattgcttattattctgccctcggtgtatgattgatgaaatggagagtgcagaacagcgctgacactcagttccccatgattgccattggtatatgccagtgcacccatacagtagctataatagctagaggaaacgtgtgctacatacgaataatggaatcgaaaccaaagtaattgacgagggacgtacacagacaagctaagagcctaattggctgatgaaaaaagtgctatgagttgacagccgtaaaaaggctaaaaactgtttgattaaagtaagtgcaaaacatat

SEQ ID NO: 22443 - DNA, 2341 bp, Zea mays
acataaattatcgtgttattatacggttccgtcgcaacgcacgggcacacacctagtgaaaaacaatgacaagctgtatcgctaagaccacaagtccacaacctcatgttcagcatttcatcagggagaagtgaaactgatttaagaaggcaacaatgcaagaaataaaagaaccgaacaaatgttaaacacccaaaccaagaggaattcctcaggcaccaacatatacctatacaaataagaggagaccaggaggttcctcatccaagaatgcttctactgcacctgaaaactaaagcctaatacttaggcagtaatacctgggcctgccttgcctctgtcacctaccagcatcccctatcaggacagcaatcaccttggtgattaacatcgtttctgagacagttcctgatatagcttagatttccaggcctcatggttgagatctgtcagatatagagcttccagtcctttctaccttctttccaaactccgcagagttggaaccctctgcaatggactcaatatccatgcttccagtgcgacttctacgatttctccgatcctcccggtatggtacttcttctgactcaagcatcctaacaacctggcccatcttaggtctcttttcagagtcaggatcaacacacctcagtgccaccaaaagagcccgcttgagagcccggatactgggtctagcctctaagcttggatcagccacttcctctgccctccgattggccaccattgttttaagccattcaacaagattgacctcattggaagatcggctgtagtcaacaggattccttcctgtcacagtttctaacaagagaacgccaaaactgtaaacgtcactcttttcatttaacattccagtattagcatattcaggtgcaacatatccaaatgttcccatcactctagtagtaatgtggcttttgtctgatcccaaaagtttagccaatccaaagtcagatactttgccattaaattcatcatcaatcaatatgttgcttgattttatatctcgatgtacaacttttggctcaatagcttcatgaaggtaagcaagcgcttttgcagtgcctgttacaaccttcatgcgattttcccagctaaaaacaccacgctgatgcatagctccatgaagccactgctctaaattaccattgttcacgaactcatatactagcatcctgtttacgccctcaacacaatatcccaacagccgaaccaaattcttatgtcggacatggccaatagcctcaacttccactctgaattctttttctgcctgccccatgttgttaaagatcttttttattgcgacttcagttccattcaccagacgtccacggtacacaactccataaccaccctccccgagcacattctccttagagaagcggttggtagcaagttcaaggtcacgctgagtaaaccagtgaccccaaccaagatgcgagaactccggaaggccaaccaagggcgaagctgacacgaacgccgcaggagagttgggtttcctccgaggtcctgagctcccatcctcaccggagtgcatgctgccagtgccagcacggtcagcattgcaaaccgagctcccctggctcatgttgtcatgatccgaggacttgctgagtgccaggtgccccacagccgccccggccggctcccggttcgcgtacttgtccggcggcggcaagctcggctgctcgcgctcatgcattgtctgtgccaggctgcgcccgccgacccggtcgatggggatctccttggagtagatggggatctgcgtctgcctcaggctgtccatggttctcttggtcctcaggcgggacgccacccaaatgcagatcatcagcaggattgccacgagaagcgcgaccacgccgatggcaatccagacccacagcgtcaggccaagaaccgtcctctccatctccgagctcaaatcgccggaacccatgatgccgtcaggctcgaacttatccagtcgatcttgtgggtgtcagctgtatattatcagcacggatcctctaatgcacatcagcagcacgtgcagatgaagtcttctccctctttctgcagcgaggaccggccttccttccactcatcccacaagcaaagaaccagcaaggccaaggcagcaacctcgcgcggcgcggggatagacagcagaaaaagcgagggagagagaaaaagaaagagagaggtcggagactgcgcggagactgcgggagggaagaggaaggtagtgatgtatagcaggtggtggcattaatggctggaccagcgaggagtgaaggatggaggggtgcgacccagcccggccggc

SEQ ID NO: 22444 - DNA, 1054 bp, Zea mays
gttcggtgatcaagcatcagattttccgcgaaaggacaagaaagaccgatgggtgttccacttcatctttagtataatgcagcgataaggaaaaggagcatgatcatgtagctaagctaacccctccatactagtctgattacaatattacttcagttcaaatgaagtttggatggcagataagatgttacggctatttctcaacattaccagttgcaactaaggattccaatgccgcttaatcatcactcatgtgtgtgcttgcctcaatttgcttggcagtcaacagggttcgaacttcggtgtcttggtcagccatatcagcgggtgtctgcccgtaagtgttctccttcttgggggacgccccagcctggagaagaagcttgacaacatccaaatgttctcctctagcagcatgatggagcggcgtatcgccttcagaatcaatagtgttgagcattctcactacgcaaccatccttgttggcagcaaagttgagaatatattggaccagctcagtgaagcctccagcacaagcatcgtgaagaggaatagcaccttcttcgtcttggcattccaagctagctccacgttccagcaatagctgcacacaaggaagatgaccatataagcatgccagatggagcaaagtatcaccatcttcaactggaacatcaatactgccatcatgattatcgagggcagccacaagggcggtgacgtcgccggactgggcggcgttggcgagggcgcgaaggtgggggggcacgtcctcgtcgtcagagacgccgccgaaggcctcggcgtgctgggccatgtcgtcgtcctcgtccctgagtccgttgcggccgccgggaactgccatctgctgcgaggactgcttgggattggtccggcgagcgttcaagatggtgaggaacccttttggcggcggctgtgggacttcgggtcaaggactcaatggctactggcgcctggcggtctggcttgttgaaaaaagaaatacctagctgccggctgaaatgggtgaatatggtgtccactatggcactat

SEQ ID NO: 22445 - DNA, 1517 bp, Zea mays
ggaagatcaatgtttgatgaaactgacaaaaagaaattacttaccaaaacgcaaaaacaattagaaatacacctgataaacagtaaaggttgctaaatagagaaactaaatcaaccttaatgcaccaacccattaccaactattaggtgacaagtctttaataagaaaaaaaaatggaagacgcccagacttctaggtatataccatgatgaggagaggagggtccagcgatctccatcccaggacctcaataacataaaagcaaaaccattcaattgatacttaaatgttggcgcttaagcatataaagtgtacacacagcagaggccctggcagaatcaagcaacagaacatatccaaatgataagtgcatgcaacaaggtctgcagatagccatctcttcgatagttccgtgcttcatccatgtatttgttctcagagctcccaggacacaagacagaaacgtcgatgattagacaagagaaacccaaattgtattttacagtgtagatgctaagttcaatatcaagaggaatcagcatcttatgtcacttgccagtgataaatggatggctaagtgcttgtgatacggttatcctcttttctggatctaatataaacattttatcaagaagatctttaaaactggatagcatttttggatcctcgccaggagagttcaaaatcaaaaaaccgacatcctttggtttaatgttcaaaattaaccttctcacagccgtttttgtcacaggatcctcctcggtagcatgaaaattgagatcttgatcaaagtgttgcatagtaaaggcaccctttcgaagcatcttcttagggaatggacccttcaattccatatgaagccgaagcatggcattgtttgatggaccaggaaataagactttaccggtataaagctcatatagacagcagccaactgaccacatgtctaaaggatgatcataggctaacccaagaatgatctcaggtgcccgatagaaacggctaacaagataaggcgtaacttcattcataccagcaagcatagcattcccaaaatcacatagcttgagcacattcttagcctcattcaccagcatattgtcaggtttaatatcacagtgcaaaactttgcagttcttcaggtgcttcagggcgatgaaaagctgctttgaatatgccctcaccgcagtcagtttaagcccaatattacgaccaaatttctttaaaacctcacgaagattcatattgagagattcaaaaactaagcaaagatggttccggtacatgaaactagaaataaaccgcacgcagtggcgtttgtcctcacggtccacacttgcaagtttttccagtattgaaacctcttgcttaccagccttgtacattgtctccttgttgcgaataattttgatagcaacttcttcaggatcatctttactcgctttaagatcttttgcccgcacgacttttgagaacacacccttcccatgtgctgctatgatttcgtaatggccatc

SEQ ID NO: 22446 - DNA, 904 bp, Zea mays
  misc_feature (10)..(10): n is a, c, g, or t
ggtaccgcgncttccccccgaggggcctttttttttttttttttgagagagacaaatgacagttctatctttattgcagcaggggttatgtttatatacatatgaaggggtgagttcacaaggggtgtgtcccttgggaattatctgtcgcaccccttggattgatcacaaatacaataatttgtaacagccaagatgccttccaatgatctcaataaaaaattgtggggcactacaaatttcgcctgcgtgcttctatgtcccagatttattgagacatgtagccactcgatttgccaatgcttttcacttctgcttttctcacgaatacaagcataaggccttgttcgtttacatcggattgcacccggaatcattccggctaatcaaagtttatataaattaaagaagcaatccggctcggattcgttccgacccatcaatccgacacaaacgaacaaggcctaaggatgctttgagccaactttttttaagtggtgattggtcaagtccaaattggcttccatagaggcgaagatgaaaatctgtgagattttgctttctatacgattctgacatgttgtggaggatcgcattaggacatctgagcctttgttaatcacatggagcactgttgatggggatgagaagccatgatgaggagaggagggtccagcgatctccatcccaggacctcaataacataaaagcaaaaccattcaattgatacttcaaatgttggcgcttaagcatataaagtgtacacacagcagaggccctggcagaatcaagcaacagaacatatccaaatgataagtgcatgcaacaaggtctgcagatagccatctcttcgatagttccgtgcttcatccatgtatttgttctcagagctcccagcccactt

SEQ ID NO: 22447 - DNA, 2484 bp, Zea mays
gcgtaatatataaatctcaaatcgcggaaggcaacatcgcgttgctgtcgcaccggttttcttcttctgtcttggcatcgtgttagcttattggattaaaaatgaaacaatggcaaatgctataaaagggcaattccgttgaacaaatcttgccctgtcagcattacagttgaactgtacatatacacccgctagctacgcctatgtcataacttacaggctcatcctgcctatgaagccgccactgaagttacaataattagaagaatcagtgtgcactggcgttcatccgctggattccagattgatcggctgcattaggtgagcagatgaccttcgccttcgtttcccatctggggtcagcctggtcgctgtcttgactggaatcttgccatttttacgcaacggcttgttgggacactcatgttgtgccagggaggactcaccgtctttgcctgcattttgcagtggggacttgactctcttccgagcaaagcgtgcctccatttctggcctccggttgggaccaataagccttacatgaaatggattctctgctgtgtaacacaccaactcattcgtggcttttcctttatccagatcaacacttctgccgttcaccagctggagaagggcagagaacgttctggcaatctcaaactttggtctgccgctaacaatctcactaaaagatgcagttcctgtattgttagttcttgatgaaagtgtgtcaagtatttgctccccatatgaaccgatatcaaaaggtgggtttctatcctgctcttccaaggcaatctcaattctttctttccatgttgaaacacgagcgtccatctcactctgcttttcaacctcagcaatgctggcaaggagagcattcagatgtgaccgacacaagtcgtcgaggttttcatgtgtatctatgtcatcctgtgtacctttgggagttatagcaataatctcatcaggacatgttggaacatcaagatcaatatctatgtcgtttggcatgtctgggtcatcataatcaaaattaatgccagtattggatgcattgtcatctttcaaatctccaaacacattgggattttcttctcctaattcaaatgatctcaaaaacttttcaaaacgagggggtgattgggaaccataatgttcctcctgagactgctgtgcttcaaaagatttagcatgttcaggtatgacgacaccaaccatctttgcaataggaaacagtgatttgagagttttctttttcgaaatgccaataacaccccgtggagaacctttcactctcctgtaaggccgaatctttaaattgccaggttcatgtggattcaaaggtttccatggatcctcgtcatcagaataatctccaacagggtcctctatatcatctgggggatgcatttcaacatcatcagcaaagctaggttcaacaggatcagaccaatgtttgttatctggactggtttcttgagttgaagattggttctcctgagttggatctagacctcctaggacttttccaggggctgatttacgacctgtgcccactgatcttgcattcggggaagtgaaaatattggcttggcttttagaaggtgctgcactgccttgatgagccacactattttctttaccagaatgttttccttgcagaaagtcaaaaacagctggtgcatcacaaggatccagcagaaggaaatctccataaaaatcacatgttgctaacaaatatgaatctagctcgcttgcttcactatccagacagtccccttcaaacaccagtaggtttgctggtggcctcacaatttttctttgtaaatcatctcgatcgacattgttatccagagatattcttgtttccactgggacatcatctagcccaataaatatatcatcttcttcactgggaataatgctagggttgttttgattagcttgagctgagccattttccagttgttcctgtttcttttgcgagaggaactctaacgcgtgaagcaacaacgagtacaagtactccaccttcctactgtacacttgaaccgatccttggagtaataacgccgcttcggcaaagttgacagagtgggccccgtcctcgccggagacctcccctgagcagatcttgagcaggtaatcctcgaggctcttggcaacgtccacctcccaattcgactcggggtccctgttcgcctgcagaatagggaacctcccgccgctcgagcccccctccccgccgccgtccatgcctccgccccaggctactaggcgcaagaaagcatcattctgcggtagggttagaaacctggttctagaagcttctggaaattgggcgggagacgaaggcgcgagaaatcggaggtgtgaaggctgaaggggaaggaggctagccggctagggttgggacttgggagggggtttggggaatttttttttttttcgattaggatgttctaggtaatggtctcgtgc

SEQ ID NO: 22448 - DNA, 2095 bp, Zea mays
acccttgcgagtgttcaatcacaattttaagaacaataaaagcacctcgagcttttcttttttttttttttgaaccaggaaagaatctaccaatatcattagctataaaacggcaagtcggtagacaaatcttgccctgttagcattaggcttgagagctgatacaaatacgtacaaaacagcacaatgaactattgtacatgttacatgtacacccgctagctaggcctaatgtcagcagtacgccatctgaaccaggaaccatggtcactgtctcgtcaagagagctgattgcacagcagtcgttgcctgccaatgaaaccgccactgaagttgcaacaattagaagaatcagactctagatgcccatcagtcagtctgccattggcgatcaggctctagatgcccatgagtcagtctgccattggcattcatccgctggattccagattgatcggctgcattagatgagtgactgaccttcgccttcgcttcccgtctggagtcaacctgatcgccgtcttgacttgaatcttgccatttttatgcaatggcttcttggggcactcatgtcgtgccagggaggactcaccacctttgccagcgtttcgcagtggggacttgactctcttccgagcaaagtgtgcctccatctctggcctccggttgggaccgatgagccttacatggaatggattctcagctgtgtaacacaccaactcattcgtggcttgtcctttgtccagataaacacttctgctgtttaccagctggagaagggcagagaatgttctggcaacctcatacttcggtctgccacaaacaatctcgctaaaagatgcagttcctgtgctgtcagttcttgatgaaagcgcgtcaaggatttgctccccgtatgaaccgatatcaaaaggtgggtttttatcctgctcttccaaggcaatctcgattctttctttccatgttgaaactcgagcatccatctcactctgcttttcaacctcagcaatgctggcaaggagagcattcagatgtgaccgaccccggccgtcgaggctttcacgtgtatctctgtcatcctgtgtaccatgagtacctttgggagttgcagcaataatctcgtcaggatatgttggaccgtcagggatcaacatctatgtcgtttggcatgtctggatcattataatcaaaattaatgccaatatcggatccattgtcatctttcagatctccaaacacattggaattttcttctccaaattcaaatgatgccaaatacttttcaaaacgagggggtgattgggaaccataatgttcctcctgctgagactgctgtgcttcaaaagatttagcatgttcaggtatgatgacaccaaccatctttgccacaggaaatatagatgtgagagttttctttctcaaagtgccaataaccccccgtagagaacctttcactctcctgtaaggccgaatctttaagctgccaggttcatgtggatttaaaggtttccacggatcctcgtcatcagaataatctccaacaggatcccctatatcgtctgggtgaggcttttcaacatcatcagtaaagttaggttcaacaggatcagaccaatgtttgtcatctggactggtttcttgagttgaaggttggtcaggattcttctgagttgaatctagacctcctaggacttttccagaggcggctttacagcctgtgcccgctgatcttgcatttggggaagtgaaaacattggcttggcttttagaaggtgctggactgccttggcgagccacactattttctttaccagaatgttttccttgcagaaagtcaaaaacagatggtgcatcacaaggatccagcagaaggaaatctccataaaaatcacatgttgataacaaatatgagtctagctcactcgcttcactatccagaacgtccccttcaaacaccagtagatttgctggtggcctcacaatttttctttgtaaatcatctcggtcaacattgttatccagagacgtccttgtttccactgtttaccattccatctttgcttctctccatctcgtctccttcctttcacatgag

SEQ ID NO: 22449 - DNA, 2038 bp, Zea mays
gtgacactatgcaagagctgtgacatgcacgcgcacccgttcgttggctcgtatacagctcgtgttttttttttttttttttaggactccgaaaataactcccaatttatttccactgtttccaggcagagaagccacgttggttatttatttgaatacatggatttatttttttatgccaaaatgcctccgtttcaggtcgtagtatgtaccggtacattactgggtcatcgcatatgcaacaagagcagctctggcttctccacgaggctcttccattcattacagaatcttgcaaccgtggccccgtcaacaactcggtgatcggctccaacagtaacattgattatggatgaagggtaaacgttttcgtcatcatcgaagcgaggaagcttttgaatccgcccaagggcaatgatggcaacttcaggtaggttcagaagtggagagccaaacttgccaccaatggcacctatgttactaagtgttatagtgccaccttcaatatctgcagcgcttagcctgttttgtgatgccatctcatgcaatcgcgccaattccttcgtgatctccaatattgatagcgactgcactttcttgatgtttggcacgactaatccatgtgttgtagccatcgccaccccaatgttgtgaggccccttgaacacaacttcgttagtttcctcaatgaaagaactgttcaacatagggtatttactcagtgccatagaaagtgactttatgaggaacggaaggaaagtgtgcttgatagtttgatccttgttctcattttgaaatgtggtttttagttgcacaagagaatcacaatttatctcctctagataatgaaaatgtggaacttttgctgccaggctcattgatttgaccattgatctctggtatcccctgagaaggattttcttatcttcatagaagtcctcatcgagtaatgctttcccttcctctagtaactcaacttgaccaatgttcccttccgaagctaacgattgttgtttgcaaacacctttgctgacagcataattcaacacatcttctttcaaaaccctaccatctttccctgtcccaacaatttcatttatgctgatcccatactgctttgctagatgcctaacagctggtgtagagagatttccaccaggaacattgccttcacttgagaaaactgcagactctactccaagggacttaccagcggatggaactatattatctggggaaacaatttggctgtcacccacaaccattttcagtaaagtttcaccaaccttcactatgtcaccagggacaaagtgaatcttatgtactttccccttgaaacgacttgttatctcgatagttgctttgtcactctgtacttcacagagtggctggaattcatctacttggtcaccctcggcgacgaaccagcgcagaagctcgcactcggcgatgccttccccagtctgcgccagtggcacatccaccagctcagacgcctcccccggcgtcgcctgcgccgggtaggcggcgctcgcaaagcacctcctgccgtgcccctggcgccagcgggcaccgagcagccacgcggtcgatgctgagggcgtggcgtcagcaaaccggtgccgcggaagcaggaggagacgccggagcggtggcgcggaggtggccgcaggtaccgtgcgtgtggtaggtggggacggaggcggaggcggagccggtgttgaggcgtgtcgggatcggccggcggcggaggccgcggggcgcagacgggagcgggaggcaaggcgagcccaggccatgtggagggggaggcgccgtggggagaggcttcgtctcgtcagtcgtcacgtctcccgctgaagcgctggtggtgggtgtggcggtcttgatctgcgcgcaatggagtttgcgcggtggccggtggcagttgcgtgcgctgtgcaggacgaaacgagaaggaagagaagtgcgggaacgggacgctgcaagtgcgagcagctgacaaggaggtaaagtcccgacccgcccggctaccccc

SEQ ID NO: 22450 - DNA, 2165 bp, Zea mays
aacggccgcttgtttttttcttgttctctagcaaatgtgctggagtgaattatcacaaaagcaagacgtataatggttgtacgtagcggtactgccaaggaaaaaacatcaaataaagaaaaaaaaaaacaaatggtgcctgcaatccacctggatttatagtcaggtgaaattattatcagcatttacaaccttattcgtactcgcgtccgtccatacaaatcaaacctaataaagcacaatgccgttttcgcccaactaaaacccagccaaatacacaccacagaagaagcctaacggcagttggcagactgactacgagcgtcagatgttcctagaatgtacgtcatccgcaagctacgcctgttccttcggatatacaaagaactagaagaactagccaaccccctacaaggaacaacaagtcacttcagatcttgaatctatgcccgtcttaactactttcgaccgaactccaccttggcctcctcatgagcaaccttcatcctccggtactcctgctgcgcccgatgagaacggaacaaagcttggacacgtaccactgatctattgaacctgtcctcggcttgttgccgaccaacctggtagtagtcctcctctgcagtgcttgctgcttctgcgtctgtggccattgctactggcattccagttgcaatgccacgcaggccttttctcttcttcctccaccgcaagatagctttttccactactccaacggaccataataccttgcggtactgccttctcacttggtgacctctgtatgcagcttgtattttgatagcttgtcttcgcatgttcatgaagttcctcctaatctgccatgttcggaaatgactctgtattcttgcagcagctctcatcattttctttctgttgtagttccggtatgcgtgctgaatcctcatagcagcaactattgcagatgcatcattctcgggattggccaactgaattgcttttgtttgaagcttaagagttcgctccctgagtgcggcttgtatgttgctagcagcatcagcagcattgcggtaggctgctaaagattctcgtaagcacaattcttgttcactaaggttttcaaattccttggtattccgttttagtgactctgtccttgatgttgatcgcttacccttggacagtgacatagcctcaaaatgagcagtcagccctttctcagaaagatatgcagctaagccatgataaccttgtccagcagccagatcaccagcagtttgtccaccagggacatcatgagtaggatctgtaaccaagcttggatttgctccagcagacaaaagagcagcaaccattttttcccttccacagtatgcggcccaatgcaaagctgtccaaccagaagaatcacggaaatccaaggagaatcctgacaaagaaaataagtgaatggcccaagtatagcccaagcaagaacacagatggataggcccttgtcctagatcatcgcggccagtcgacttgtggccttcaattaatttttcaacaagccactcttgcaatctattacgcagtactagttcaagcaatccctcagtggccggaacataagtgcctttagaatcagtaacaaattttgacagatccatccattccttctctgtcgatgctgataagagattggaaaccttgcttccttctacaagtaacttgggtgctatctttttcttgtttgtggtgaacaacaatcgagctagtctcatctgcatctgaagctttgacttttggggctcatcctcagccaagttttgactgtcaggcaccatacgatagtgaaaactcaaaacctcactgattggtgttttcccatccaaagtcaaataaagattgactcgtccaggagcatgtggtctagcaatgaaacggtaaacgccagtttgaacaatatttgcatcaacacactggtcaccaatgacacagaagagattggtcccagccagatgtctgtagttctcatggaaacatccaaccacaaggacctttgtgtcctcagtacaataagcccattctgaggatatctcagtgatctgaaagggtatttcgccagtcacctgttcagtggggagtatgcccgagcttggaatatcatctaaactaatatcatcatccaagtatttcccccg

SEQ ID NO: 22451 - DNA, 1419 bp, Zea mays
aaccctgcttccagtgcaagtgactgaccccgtgacccgacccatcataacaaatcaaaccatcacccgatttgtttacccccgaaaatttgccgtcttctcgtctcgctcccctctttgcgccgcccccagatccggcaccgcccgctgctcgaacccgcaccccacgcccgcaggccgggaccggtgggcgcgcgccgggcagtaggagggagaggaagggcggcatggcggcgccgccggcgagggcccgggccgactacgactaccttatcaagcttcttctcattggggatagcggtgttggcaagagttgcctcctgttgcggttctctgatggttccttcactacaagctttattaccacaattggtattgactttaagatacggacaatagaattggatggtaagcgtataaagctacagatttgggatacagcgggccaagaacgcttccgtactattaccactgcgtactaccgtggagctatgggtatcttgctggtttatgatgtcaccgatgaatcttctttcaacaacatccgaaactggattcggaacattgagcaacatgcctctgataatgtcaacaaaattttggtgggcaacaaggccgatatggacgaaagcaagagggccgtacctactgcgaaaggacaagcacttgctgatgagtatgggatcaagttttttgaaacgagtgccaagacaaacctgaacgtggagcaagtgttcttctccatcgcacgtgacatcaagcagaggcttgcagagactgattcaaagccagaggacaaggcaatcaaaattaacaagccagaccagggttccgaggcaccagctgcccagcgatctgcatgctgcggttcataagcagacgcacgatagccataatcattggttatttgacactatttatttcctgcttggcttttataggaagaatttgaggaagccacttatgatatactgatgatgtggttgtactcttgtttgcttccactcttcgaagcaaacacctcttgctgttgacgtagctattgcactctggacatccgttggaacaacctctctcctccctacagactacagtgtgtaatggacgaattccatgccgttgggtttgcattatcgatcaatgcatggattaacgtatcgcccttgtgtggattgttgtgttttttttctctcatgttgctgttcctttagattgaatttgttgggaaggaaaatatattttccttttcttatgtatatcaggtgcatttttatcttttgtacctggaatgtatgtatccacggaaagcgtgaatcttcaatttagaaaagaagaaaacttatctggaaatataagaccagtgcatgcggtattgtttgaataaaaaatataataaaacttatacatttgtatatctct

SEQ ID NO: 22452 - DNA, 1285 bp, Zea mays
cggggccttgggtaatacctgcaccgagggcccggccgcggtcttccaatgcaagtgacggccccgacccatcatgcgccaggcgaatcaaaccactacctgatttgtttaccccccgaaaatttgccgtctcctcgtctcgctcctctccctgcgcagcccccagatccggcaccgcccgctcctcgatccccgcaccccacgcccgcaggccgggaccggcggggtcgcgcgccgggtaggaggaggagaagaggaagggcggtatggcggcgccgccggcgagggcccgggccgactacgactaccttatcaagctgctcctcattggagacagcggtgttggcaagagttgcctcctgttgcggttctctgatggttccttcactacaagctttattaccacaattggtattgactttaagatacgaacgatagaattggatggcaagcgtataaagctacagatttgggatacggcgggccaagaacgcttccggactattaccaccgcgtactaccgaggagctatgggcatcttgctggtttatgatgtcaccgatgaatcttcttttaacaacatccgaaactggattcggaacattgaacaacacgcctctgataatgtcaacaagattttggttggcaacaaggccgatatggacgaaagcaagagggctgtacctactgcaaaaggacaagcacttgctgatgagtacgggatcaagttttttgaaacgagtgcgaagacaaacctgaatgtggagcaagtgtttttctccatcgcacgtgacatcaagcagaggcttgcggagactgattcaaagccagaggacaaggcaatcaaaattaacaagccagaccagggttccgaggcaccagctgcccagcgatctgcttgctgcggctcataagcagatgcacgatggccatagcctttggttatttgacattatttatttcccgcttggctgttataggaaggatttgaagaagccacttatgatataccgatgtggttgtactcgtggttgcttccattctttgaagcaaccacctcttgctgttgacgtagctattgctattgctgggagctattgcactcttgcattgggatccgttggaaaaactctcccctccctacagtgtgtaatgaatgaaatccatgtcgttgggtttgcatggaataacgtgtcgctcttgtgtgtgtgttttaagtgtcgccgttccttgataatcgaatttgttgggaccaataatatatctacctggaatgtctgtatcc

SEQ ID NO: 22453 - DNA, 690 bp, Zea mays
aaatcaaaccatcacccgatttgtttacccccgaaaatttgccgtcttctcgtctcgctcccctctttgcgccgcccccagatccggcaccgccgctgctcgaacccgcaccccacgcccgcagccgggaccggtgggcgcgcgccgggcagtaggagggagaggaagggcggcatggcggcgcgcggcgagggcccgggccgactacgactaccttatcaagcttcttctcattggggatagcggtgttggcaagagttgcctcctgttgcggttctctgatggttccttcactacaagctttattaccacaattggtattgactttaagatacggacaatagaattggatggcaagcgtataaagctacagatttgggatacagcgggccaagaacgcttccgtactattaccactgcgtactaccgtggagctatgggtatcttgctggtttatgatgtcaccgatgaatcttctttcaacaacatccgaaactggattcggaacattgagcaacatgcctctgataatgtcaacaaaattttggtgggcaacaaggccgatatggacgaaagcaagagggccgtacctactgcgaaaggacaagcacttgctgatgagtatgggatcaattttttgaacgagtgcccaacagacccttgaaggtggaacaaattgtcttctccatc

SEQ ID NO: 22454 - DNA, 3750 bp, Zea mays
ttttttttttttttttttttttttttttttagcagctttctttttgcttttgagggttcaaaagcattctttattttattttacaaaacagttcatgattacaacagcaacaaaacagaacataaaacatacacagatccgaagcaaacaagtcattacaacaaaatacaaacagattgtctcatgaaacagaaacattcaactagagatatagaaaccaggacaccatatcactcttcagcttcctcgccttggtgctgctgttccattttgttggaccctgcttcaccctgctgctccggtttcgtcgcaagcgcgcctccttgtctgtatgaaagccgataaacaggttggagctgctggtaggagcggacaaagcctgcatttctcagttcctgttggatgccttccggcgcatcgtttgtatttgtcaggctgagctggacaaggtttggacggacgaagcgaagatcattaaactcagcgacaggcggccattgcacagttccatccagctctacagtctgaagatatcgaaggcgttctccggtgaagacgcagcaagagatcttgtcgcctttgagcttcaagtggccaaggagatgcatttgcccgagggcagtgatcagcgcagcgccgtgtctggcgccaatgagtccgtgcagctccagcgaccggagtttggacatcttgagcagtgggcagttatcttgatcccattcttcttcgctgggctttacaccacgcagcgtttgcagctcgcccatttcttccttgatagatggcgggagcgtgagcttcttggcaatcacatgccgcagcgtctttatctcccagaaggacgggtggatctcctcgacttcggtgtcccttatatccagtgtctgcaggttgggcagcctcgcaatgctggccgggagctccttgaggtgctcggtgtttacacgtaagtaccgcaagtggatcttgttgccaatttcattcggcaactccttgatccttagtcctgatatgtagagtacacgaagcaaatctgaaccatgcaggaagttgagatcatgccatcgttcctcctcattgttcacgcggcctctgctgccaatactattgtctgaatctttctcattggcccagcatatgaaggagcgcaacttacagaacctgttagtgaatgtggtatatccgtcttggaagctcatgaaagagaggcggcgcaccgatggtgggacaaagacgtcgttcatgtcatggacgtcgatgaagccggcctcacgagcctccgagtgcaggaacccatggagccttccgtgaacaatgacattggtgatgccgccaacctcgttcatccctgaaacctgaacgaggcatctcaaggccagctccttgaaatagtcgtggcccagctcctcgatggtcttgcccttctgtggcctaatgaatccctcggccatccacaaccgcactatactgccggtagacaggaaggtgcccttggggaaagcagccaagtagaggaagcatgacttgagggcgttgggaaggtcttcaaagcttgcccagaagaccctctcaatcgacgttcttgtggacagctggttgttggctgcttgtgttgtacttgtaggggcgctcatcgtcttctcctcggtatggccgccttggtcgtcttgctgatgcgcttcttgatctgctgctgctggtccagacgacgtcgtcctgagctgctgcagcaccgcgttccattgccctggcttctccttgaaccgtaggagtccggccaaaaccactatagccagagggtagccggaagttatattgtacacaacttccctgtacttgctcatcatgctgttcactgtggtttcatctgacagatttgtcctcaaggccctcatacagaacaactccacactcttgtcttggtccagacggttcaagtggtggattaatccgtggctgatgcccgtcgtcttgttcatggcattagcatgccacgctacctcttcgttctcgatgtccaatacgagcactaccctgcttccattgttgtcgtccggtaggcttgccctgacacagttgagcatggtcttggaggatatgccaacgagaatcagcaggtacttcttgttggctaggaggtgacgacggagcacgtcttcgatatcgtcgtcgtcgcactcgcactcgcacggctgatgccgccgctgtcctcctcctcctgcttttttgtagatttgcttgaggaggttttccgtggtggaacccgacggcatgttgtaccagactcggacgtcgaactgcttgttcttctccatgtcatgcaagagaatacgtgacagcgtttgctttcccacaccgctctctccaagtatggagataaacgtcagctgagggcgacctttaccaagcagcatttcctttagtgtctccacttctttctcaaaacccacggcgttcttgtaaccatcccgcctgtgtgctcatgcattgagtagtattgttagtaatggaagctggctcatttagctacctcatgatgcaattgcaagttaagttttccatgactctagtttaggcatcttaagaaaaggttaaagcaagtgtttgacaaatcatgctgaagtgaagtgataaattaaagatggacatatatacataccatgctgaagtggctgtagtggaagacgtgagtactgtcgctgatggtgtaggctcgaccttgtactccttttggttctccgagatctgatggagcctgctgttaattttttcgaggcgaccagacaactcatgccggagaatgatttcgggcccagcagcctagcaagcatttcttgagccatgtgatccagcgttggtaacccatgccttccatgtcaacctgttaattagatgttcaccagaaattcatgtagatgtttagttttgccaccttccttatttttaactttagtcgtattttttttgctcagttttgtattctagtctatagcacttgaagagcaaaattaagcaaaaaaaatatgactaatgttaaaaataaggacaccaaccaaaacaagggcaccaccttaaaaaacccataaagtttccttaacaataatgttggaaacataagattttgagcatataaacttaattagctagtacacacgttttgctacaaattcttgaaacaaaaccgatactatttcacgtgatctttggtttatttctctccactatatatatgtaagtgaaggttaccgtacgacctttttcttcagatgaatagatgaaattaatggtggtaagaactacgtacggcaagcaatgcaagcaactaagcaagcagaggagggggcggaattaaattaattaaaggagcgagaccttgcggaagaactcgtcgacggcgtcctccgcctcgaaggcgacgtcgcgcatctggcgcacccagacgcgggtgaggcggtcgtcgccggtgcggcgcttgtggtcggcgtcgcggaggaaggcctgcagccacgcgaggcggtcccgcagcagcatcatgtcgtctcccacctccagcagcaccttggcctcgctcgccgcgagccctccgaacttggagagcaccgccgcgatggccgtctccgccatgttcttctctctggactctggtacgcgcctgttatcttgctgctggccctgtgcactcctcggaagccatgctacttctcgtgttcttgtacactactgtgtacgtaccgtcgtaccgtacgtaag

SEQ ID NO: 22455 - DNA, 1463 bp, Zea mays
aagaagactatgggcttctagcaattcacgtggttgaagacgtcttgtcccgttccagaacactcgcgctctcgcacgacggcacgagcgcgctactgccatagtgccatggcgagcggcggcggtgctgcggcgcggatggacccggaggtagcaacagagctggtgcggaagggtgccaccctcctcctcctcgatgtcccccagcgcaccctcttcggaatcgatacccagatgttctctgttggacccaagttcaaagggatgaagatggtgccaccgggagcccatttcgtctactactgctccccaaacaggcatgggaatgagtttgcacctactgtcgggttctttcttactacacaccaatctgaggtgattgttcgaaagtgggatgtgcaagaggaacgattaatcaaattatcagaagaagaggatatcagatactcagaagctgtaagacattttgaatttgatgatcaacttggaccatacaatttagattcttatggagattggaaacaactttcggactacttgtcaccgaatgtcattgagcgtcttgaaccaattggaggagaaatcacaattgcgtgggagtcatcatggatggataaagctccccaaagtgacatggagagacgtttggtggaacaactaagagaaggaaagtttgcaaagaatgctcctgtacagtctgggcggagaggatgctactacacaagtatccctgcttcagttaagcataaggacatctctgggggtgacttgacagccctaaacttggacaaaacaagtttgctggagactattttggccaaaaattatgaaggtcaagaagatctattcttgggggagcttcagtttgctttcatagcttttatgatgggtcaatcactagaggcttttatgcagtggaaagcactagtcagccttcttttgagctgcagtgatgctccccttcatacaaggactaacatgtttataaagtttataaggacattatactatcaactcaagcatggttttcaacatacccaagattccaaaagtggggatatgggcaattctctgtgtttggatgaaacatggttttcaagagacatattcctgtaccgtctttcaaaggatttctttacagttgtatttgaagccccagtcgtggatggagaccttctgtcatgggctaggaaactaaaatcgcttctggagactacgtttgggtgggatcttgaggacgacgcagtgaaccttattgatgaagatgacgagtttgctcctgtcgttgtggagatggatggatcataagctaatgaagccagattccatgcagagaagtcagcagttgttcagcgtttctaccttttggtacagtggtgcgctgacttgtatgaagttttactgcttgtgctgacattgaatatacgtgctaattatagaaaaaaaaaaaaaaaaactgttta

SEQ ID NO: 22456 - DNA, 867 bp, Zea mays
gcttaaataatatatatctaaattatagttatcagaatgaatcgatctcaaagatccaaacggggctaagggaaaaaaaaacatttccaaccgaagacttttttttatttttttagaccaagacaatataatttttattcactgcgtgctgtctgaaacacagtaaaactaatactgtactgcaacacggcaaaagcagcactaaacgtccttctataccatgtacattgcacccccaatagaacagactgaatgccaaccaactcactcagattcctgggctgattctggaaaatgagctctttcgatctgccgtgtgatctgtgaaacagcatactgcgagccagttgatgccgcgtagtaagacgtcactgtgagctgaacaaaccttggaagtgcatatgcaccaaatacagcactggcacctgagaatatcagcagtggtggcaccccaacgagcaactgcagccacttcggccccttgacatgcttctggacaaaagggatccctgtgttaaacccgtgcacagcactgagcaaagcgccggcaccggaaccagccacggcagtggcgtcgtgcaggacggaggtgatggcccagtccctctttcccgcggtggggttgaggagggagaggcatcgcgggcaccggggcgagccgaggcctgggttgatggtgggatcgcggtggaggtgcgcaccgctgcggagcttctcctcgtacacctcccgcgtgcccatgccgattgctggagagggtagtgccgccgccgccgctcctgttcggttgtcgggggaagtttttgggccgcggattggactgaggcttgagcgcgggctgcatatgaaccagctccacttgttagg

SEQ ID NO: 22457 - DNA, 5102 bp, Zea mays
caggcttcctgatggtagaataaaggtctggatacatgttgctgacccaacatgcttggtcaaacctcatagcatcattgatagggaggcaatgcacagaggaacatcaatctttctaccaaccactacttttccgatgttcccagagaggcttgccatgaattctatgagcttgcagcagggtaaagaatgcaaatctgtaactgtatctgttattttaaacctagacgggaggtaattttctacttacaactcattttttctgctttctgagtgggttcttttcttgtttcctttgagcttgacttttctttttcttttttttaaaaggaatttcttaagaatgtagtgcattcattgacattcctcattctgtttgtgctgtgaatagtattgcagaatatactttagaaaattcagtcatcaaacctacttatatgttgacgtatgagagtgcaactgaattgctttacatgaacctggaagaagaggaagaactaaggattcttcaagaagctgctaggattcgtgaacagtggcgtcgtagccagggttcaatagacactgcgatgatagagccacgtataaaggtgtcaaatcctgatgatcctgaaccaaatatcaatctatatgttgaagatcaagccaatccagcaatgcagcttgtatctgaaatgatgatactttgcggtgaggcagtggctgctttcggttttgacaacaacctccctttgccatatagaggtcacccccagtccaacacagcagtgtcagtgttctctcatctacctgaggggcctgcaaggagctttgccaatatcagcgtgctccgtgctgcagaaatggattttcaaaaacctgtaccacatggtgtacttggtattcctggttacgtgcagttcacctctcctatccgaagatatgttgacctgctagctcattatcaggttaaagcttttcttagaggtgactctccaccatattcagctggcgatctagaaggaatgacatttattgcgagcatgcatgttaaagtagctaggaggcttcatagcaatagcttacggtactggctgttggaatacttgaggcgacaaccaaaggggagaaagtacagagcactgattctgaagtttgtcaaggatcgtatgggagctctgcttttggtggaggttgggatgcaagttacaacgacaatttcacgtgggaaagcgggagatcaagtcagtgttactgtggaaacagctcatccacgtgatgatatattatcagtcagagaggttgtagaggacaccaaggattctgagtaaatgcatgtgacgatagcttatcagacaaagaggttatagaggacaccgaggattctgagtaaatgcttgcaaagctcactcgcactttgcagtcttgtgttcctctgccgtttactgctgttcatttttgtggcagtgatataggcgatttattaccttggaaaatatctgctgattcttcaagttagcgacttgcgtagcatggctacaatacaaatggtaaaaggactagggtattggtcttggtgccaaagctcattccaattcgaggacgaaatgatgaaatcataggtggttttcattggtatacagaatacagtccgacagttcgtttcttccgaggtaggttctctttgtgccgaacaaggttccaagtgctgataactgggaattttgtatagctgaacacgcatgcaacatttttgtacctgaatttggtacctctgacgttgtcggcacattctgctatatttgaacactgaggtggatgatcgatgtacagaataataataattccaatatcatttccttatatgccctcaatttatttaattgtaatatactccttcggttcttttttatgtgtcgtggtttagtttaaaataaactagcgggatacgacaaatattcgaggttattcgaggttcttttttatctgtcgtggtttagtttaaaataaactagcgggatacgacaaatattcgaaagcggaggtagtactagtttgaacactgcagggaatgtcctattattcagcactttataagggatacccagatgtttctagggtgcagccgttcagggtgctattatcattggactgtaaaaaatcacattgtgcctgaagtgaaaataaactagcagaggtgttcggttctaaggttgtggataaattctatttgttggatttagattagacgaatgttatttgttgtttaaaaataaagcaaaaaatcaggccactttcgtataaaatatcccctcatgtatgccgtagatcccattgcatgcaagtttactttttaattgggttgcttgcatgctccttttgaaatccattcaaaagtagggttttatctgtgggctcctattgatgttgctctaaagaatctcttggaattgttcagttaacgtgccaacttattaactggcttcttgttggactgttggattgagtgagtattcatccccgaccatcctctcgggtacatggaatctgtctccctagattcgttgttcattgttacttcttatcaaccaaatggtaatatcttagatttagagtcccttgggaattaactatatacctattctccaccctgttccccactgaaattaactagaaccatttctgacacagaatcaagaagcttagggagtcgatcaacgggtttgaccggtcttcagtacagacatgatttccaacgagatatggttggattgaatcattgaattgaaccctagaaatgttaggcacagattgctcgtggacataaacaaaaactacatccaacccgaaacaccaccaagcaaccaaagaacttgagagagtccacgacgcctatcactttcactgattaaagctactgtgcctccatcctccaattgctcctccatcttcctgaacctgaaatcgcgggcggcaacaggcatccgattaaactggcgtgtcaggaggagaaactcagcggcggcacgtagcattcgattggctccaggcctccaaacacgctggcatccatggccacgaccacgacgcttcgaagcaaataccgtacgtacgtacctgggtctgggtggaggtgaaggtgatggcgaccttgatctcgccgtggtacgtcttgtcggcgaggaccacgttgtgcttggccgcgttgaggtggtacgtgccgcgctcggcgcccaggctgacgatgtccgtcacgtcgatcctgcaggggcgcggtcgcgcagacggcagacacctcgatcagttcagtttattcgaccggcggtgcggttgcggttgcggttgcaggacccctggtcctgatggcagtggcagagacgcagatctcattcgggcaggtaggcactcacgtcgcctcgccgaggaagtcgtcgctggagaagttgtcgtggtccatgatccggaggatgagcttgtgctgcacgttggccgcggccgagttgatctggaacttgaacacctcgttccagcacgggttccttccttggtctgtgggaaaccgggatacgatatatacacacgcacagaggtcaggggttgttcagttattagaggatagatcacgatatcggggtgcgttaggaagaaccggcacgcacgcacgccccgaccccgaaccctgccgcctgataagaaggaacacaagaagcgctagcgctgacctcgggcgacgctgctcttgcgctcctggctccggtactgcatgatcacgtaggggtccagcttccctgcagtagcagcggcgacaacacgatgcgcagctcaacgtcaggacaggacaccggacgaacaaccaagaacacacgccccaacgcgaacgcagttcacgcgcgcgcaagggggagagagtgggagaccgacccacgcactgacgcacctaagaaatcgttgccggagagccccttggcgtcgacgaggtgcacctccaggacgcccttccccatgttcttcttcctcctccccctccctggcgcgctgtcctctcctccagggggcgctggaggcgcgctctcctctcttgcggcggcgcggctctatgtaactaacgaagatggctgaccgggagcgcgcgcgggcgcgcgtatttatcgccgcctcgcctcactcccgctgccttggctagttggctggcggcctggcgctgtccaagtcaaagctctgaaacggtctcgcaagacccgccatcgcgaaagcagagcgaacgcacgcctttaatcccagtccacctcatcgaccctttctcgtccatgcaaagatgcgttgcgcttgcgcggcgcgccctccgtttgttctgccaacttggcctcttctgcgcgagcaactcgccgtgcgtcgtgttgtcttcttcgtggaagccacggccccaaccaccggatgcttcgttgtacatatagacccgcggcgaaaacatacggcgcctcttgcgcggtgtatactccgacgtcgtcggttcatacacaactttccagcaaaaataaaaaataataagtaggtacaattctaccgagttgaagtgtgtatttatatagaaaaaacattaatatgtagtactgttaggttttttaattaaatatatttttatcagtatacctgttcttgtcaaaatgatattttttccctatagtctagttaaatttagatggttttattaataaaaaattaaattgtacgcttttttttcccggaacagcgattggatttgttgtcacggtgcaggaccgtcgccgtcggtatgtagtacgcacgcgcaatctgtacagcgttacttgtagttcggactgtttgatttgtgggctataataaaaaatctagagacgtttgatcattcttacgcgggtaatttgtttgttttttaggtcgctacggagaatccgttcaactaaaggctactcggtcactagtctctggtcatctctacacaatacacataagatttgctggagtggcgtctgtatcttacgtcacctatcattggtttacccccgttttttctatgaaaataaatggattttttaagacaacatccgaatttatttgactatacgaaagctagatacgacgga

SEQ ID NO: 22458 - DNA, 2166 bp, Zea mays
aaataatccagtattccaggcgttcttccctctccctcctttgctatttttctgctgctcctccacctcttctgttatgtttggtgaagggctgaaggtaagaagctgggaacgtgcagcaaggctgcaaaaacatgtccattaatccagtcagggttcccttggatgcatatatgatggactttgtcttctctgagtcagaaggtggaatatatgacaataggaatgggatggactatcatattcctgtgtctgattctgttgcaagggaacctccaatgcatattgtacacattgcagtggaaatggctcctatcgcgaaggtcggaggccttggtgatgttgttacaagcctttcacgagctgttcaagatttaggccataaagttgaggttattctgccgaaatatgattgtttaaaccttaacagtgtgaaggatttacgctaccaacaaagttttacttggggtggacagagataaaagtatggtttggaaaggttgaagatctccctgtttatttcttggaaccacaaaatgggatgtttttggggttggatgtgtctacgggaagaatgatgagagtagatttggcttcttctgtcattctgctctggagtttttgctccaaaaaggatcccctcccgtccgcccacgcggccgcccatggtcaagtgctcccgttgcttggctgtacaaggaacattatgctcttaatgggatcggaaatggtcggattgtatttaccatccacaatcttgagtttggagcgcatcacattggcaaggcaatggcacattgtgacaaagctacaactgtatccgatacatactcgaaggaagtggccggacatggagctattgcacctcactactataaattccatggaattcgaaatggaattgatcctgatatttgggatccatatactgacaaatttattccggtccattatacatcagagaatgttgttgagggcaagagtgctgcaaaaaaggcattgcagcagatgcttggattacagcaaactgatacccctgttgttggaatcatcactcgtctaacagttcagaagggaatccaccttatcaaacatgcaatgcatcgagctcttgaacgcaatggacaggtggttttactgggttctgcaccagatcctcgcatacaaagtgactttacaaatttggccagtaagctgcatggtgaataccatggccgagtgaagctatgtctaacctatgacgagccactgtcacatttgatatatgctggcgcagacttcattctcgttccttccatcttcgaaccttgtggtctaacacagcttattgctatgcgctatggatccatcccagttgttcggaaaactggaggcctgtacgacaccgtttttgatgtcgacaatgataaggatcgggctcaagcacaaggtctcgagccaaatggattcagtttcgaaggagctgatagcagtggtgtggattatgctctcgacagagccataaccacattttatgatgcacgcgactggttcaattccctttgcaagagggtaatggagcaagattggtcatggaacagacctgccctagactacatggagttgtaccattctgctcgcaaaagctgatacctttttatcactagggaaaacaggctcgttttgcccaggttaggagcatctcagcctcaggccttgtgcaaattcatttgtgcactgggaagaaaagagtaccgactggccttgagcatgcccgccgtccaaggatgcaacacacaccgtgtatagttagagaatgctactcgtcgtacgtttcatgcatgtgttttgtgtatacacctcaggtagcttgcaaaacaacagtacgacgtatcccggccgtctaccatgcctgaggcgtatataggctataggcttatgcaaagcatgtaccattaattaattattacatagtctttttatgtcaaagttgtggtggcaaccatgatcttccttcaccgctcctcccccctgttctatccccggtggttgatggtatgtcggttgtaccagactcagagtaacagatgtcgtggccctcgggtacccttcctcctttctcctctcggtggttgttggctccatgttgtagcaatgattgttgttgccgtaaatttagatttatgt

SEQ ID NO: 22459 - DNA, 1581 bp, Zea mays
tcgcgtccgcccgacagctcgcctgcctgcctctccgtcgtcgccgagtccctcgccggctctaccaggcggtggcgaaggcacttcggcggggacgctcaaccgccccgcgggcggcgtcgacggtcggttcccggcggcctcgcggaggttgcatcccgtgtcgaatcgaggtatttgtcgtgcaggcaggatcctacgccaaatgcctctctttgataagaaacctttctccttgctggagccccctaaggacttggattcaaaggagaaggtgttccaaattcgattcacgaaggagatattccgagattatgaagaatacctgaagaggctaaacctttatcgtcaaagagtttggacatgtaatatatctggaaaatctaatttaacttttgaagaagctttggtatctgagcacaaagcgatggagaaggctcaaaatttgccaactgagctaatggctcaagttcttcggatgactcaatacagccctcttggtttatatgaacttgttgataagatatatgctagtctgctggaagaagtatttgagggaatagaattacatgctaataaggatggtaatgtggcaccttgcaagattttgaagattttagattctggtggcacaaagatgtgtgaagttggttggattcggaagggtaaggctataaccaacacatcagtaatcaaagctgcagatctgttttaccggagggcacctgttagcaggaatacgctgaagttttttattagagatgctacgtcacaaagtaatccatgggttatccatgagaatcttgccaaaaaatttggcataaccatcgagccccctgatagtgtaatgaagaaagggagaaaaagacaagagaatgaaactgttgaagatggaaggaaaaagctcaagacagatgaagaacatgcttatgtgctgattaagtatccaatagatgatctgctagtaaggcccaatgcagatgatccgtctttatttaagagacctcttctggctacagattttagagtaccaagatgttctgtgggagatctccttatggtatgggacttctgctcgtcttttgggagggctctgaatctgtccccatttccgctaacagatctggagaatgcaatttgccacaaagaaagcaatgttcttcttgtggaaatacatgcagctttgtttcacttgcttatgaaggatgaaggtgactatttcactgttccgcagaacaagaaacagaagttaaaggtaagttcagtaacatgggctgagtatctatgtgacttcttggaaatgacaaaaaatgaagaactatccactaacattgcaacagtaagaaggggatattatggtcttattgacactaatataaagcttaagatccttcgggcactagcggaagaagctattgacacctctgccataagggagatactaagggatcgtgtgggaccagaaccacgcccttaattgcaatccaaatgagagaaccccctaaaaggaccaaacaagagtaaaatcctgaaccctcgaaaatggcccttgaaaaacttggggagaaaccagcacctatg

SEQ ID NO: 22460 - DNA, 1200 bp, Zea mays
ggtttatatttttatattgtatacttataaatggaaaacatacttttttattttagtaaagtttaaaataaaagaaagagatttgttatctgctcgagataggttaattaaagcagtccttccgttggtgacattgcgccaccagtccagacagccccgaattggcagcgcagaggctgcgttaatgttactctactcctatatagcagccccactattttcctcctttccccacttccacttcgctctgtcctcccatgcgccggattaccactgaccacttcacagtcacagtagtacagagcggcagagtggagaagtagactctaggtgagatggcggccgtggtggcggcggtggaggcaggggtggtggcggtggcaagcgggaggggatgcagcagccggctggtgcggggcctgtactggcgccttcgcgcggttctgcggcggctgcggtcggagcgggccaggcgcggccggaggttcagcttccactacgacgcgctcagctacgcgctcaacttcgacgacggccgcgccgcccccgccccggcccccgccgcggccgacctcgtccttgcccccggcgacaacgacgcgctacggtgaatcggcgtccgacgatccgctgccaagagccagctggggtctctcttccttgctccggacgccgctgccttttccactctcctgtggtttcgctttttcgataaatgggggttgtgtaatggaaaaaaaggaagatggtagggtggtgtcgcctccgcgttctgcgattctttgcattgacgcgcagctagctagctagggggattgcgcgggctcccggtgatcaggaaagcagcgcttcggcgctgcggtgacgccgtgatttgcagggagatcgagagaaacacatgtgttcttcttcgccgtctcggtgcttgcttcctttctcgagtagtattatttcttgcttgtgcttcagaattcctcgtgtggttcgatcctgcaaattttttccccaaactcaaaatgagataacccgtatacgaaggtttctatcagctgtgtcgcgggttaaagctactgaatcgaaccattattggaggaaggttggggacaacttttgttaggcgactgtctctccgctccaaagtcttaacgctatcgctaatagtagtatgttttgcgcacaaaaagaagaagaagatgaaga

SEQ ID NO: 22461 - DNA, 1216 bp, Zea mays
  misc_feature (10)..(10): n is a, c, g, or t
  misc_feature (107)..(129): n is a, c, g, or t
  misc_feature (222)..(222): n is a, c, g, or t
  misc_feature (304)..(304): n is a, c, g, or t
gacgcctganagattcgaactctcgcggggaaaccccatgtacttagcaggcacacgccttaaccactcggccaaagcgtcagttggtgcagtacagaatatttgannnnnnnnnnnnnnnnnnnnnnntctctccgtgtgctgaagcaggtggcctccgccccgcccgccggggcccctcactcccgaaacgccgaaaccccaccccgcaccaatcatggnacgccgccgacgcgcgtccatcggcaccgtcggccgctgctgccgcagtcgccggggcctccgtcgcggacgagccccgggnacgcgcgggtggtgcgggagctcctgcgctcgatgggtctcggtgagggcgagtacgagccccgcgtcgtgcaccagttcctggacctggcctaccgatacgtcggagacgtgctaggggacgcccaagtctacgccgaccacgccgggaaggctcagatcgacgccgatgacgtccgcctcgccatccaggccaaggtcaatttctccttctcccagccgccgccgcgtgaggttctccttgagctggcccgcagccgaaacagaatgccgctgcccaaatcaattgctcctcctggctcaattcccctcccgcctgagcaggacactctgttggcccagaactaccaactcctgcctccgttgaagccgccacctcaatatgaggaaaccgaggatgagaatgaagaatccaacccaagtctgacaccgaacccggcaaattctaatccaaccttctcgcaggatcagcggagtaacgagcaacagcacactccccagcatggccagagggtttcattccaactcaatgctgtggcagctgctgctgcaaagcgacctcggatgaccgtcgaccagctgaacatcggctaaccatcattcaacgttatcgttggttagactgtagtatctttttccccatcttcttagtctggtgaatcatgtttcgaagagatttagtgttgtagtggtatgatcttatttaccacccacctatttaaccacgagatgtgcagtacagcagcagcatcataaagtttctgactgcaagaacgttgctgtagggaaggaaagtaactgtgctagtagtgtacttgcttacttcaaggttaatatctgccaaaattgtatctgggtctacatattcttagcattcatgtcaagagggcaaaaattgcattgtcagtattgc

SEQ ID NO: 22462 - DNA, 1229 bp, Zea mays
  misc_feature (42)..(42): n is a, c, g, or t
aaaaagaaaaagaaaaacaatttaaaaagtccgacgcctganagattcgaactctcgcggggaaaccccatgtacttagcaggcacacgccttaaccactcggccaaagcgtcagttggtgcagtacagaatatttgacaatataaggtagttaaaaataatctctccgtgtgctgaagcaggttgcctgagcccctcgacacggtgacaccacactcccgaaacgccgaaaccccaccccgcaccactcatggacgccgccggcgcgcgtccatcggcaccgtcggccgctgctgccgcagtcgccggggcctccgtcgcggacgagccccgggacgcgcgggtggtgcgggagctcctgcgctcgatgggtctcggtgagggcgagtacgagccccgcgtcgtgcaccagttcctggacctggcctaccgatacgtcggagacgtgctaggggacgcccaagtctacgccgaccacgccgggaaggctcagatcgacgccgatgacgtccgcctcgccatccaggccaaggtcaatttctccttctcccagccgccgccgcgtgaggttctccttgagctggcccgcagccgaaacagaatgccgctgcccaaatcaattgctcctcctggctcaattcccctcccgcctgagcaggacacactgttggcccagaactaccaactcctgcctccgttgaagccgccacctcaatatgaggaaaacgaggatgagaatgaagaatccaacccaagtctgacaccgaacccggcaaattctaatccaaccttctcgcaggatcagcggagtaacgagcaacagcacactccccagcatggccagagggtttcattccaactcaatgctgtggcagctgctgctgcaaagcgacctcggatgaccgtcgaccagctgaacatcggctaaccagttatcgttggttagactgtagtatctttttccccatcttttagtctggtgaatcatgtttcgaagagatttagtgttgtagtggtatgatcttatttaccacccacctatttaaccacgagatgtgcagtacagcagcagcatcataaagtttctgactgcaagaacgttgctgtagggaaggaaagtaactgtgctagtagtgtacttgcttacttcaaggttaatatctgccaaaattgtatctgggtccacatattcttagcatgcggccccagagggcaaaaattgcattgtc

SEQ ID NO: 22463 - DNA, 1119 bp, Zea mays
gtcccgaattggcagcgcagagagccagaggatgcgttaatgttactctactcctatatagcagcggcactattttcctcctttccccacttccacttcgctctgtcctcccatgcgccggattaccactgaccacttcacagtcacagtagtacagagcggcagagtggagaagtagactctaggtgagatggcggccgtggtggcggcggtggaggcaggggtggtggcggtggcaagcgggaggggatgcagcagccggctggtgcggggcctgtactggcgccttcgcgcggttctgcggcggctgcggtcggagcgggccaggcgcggccggaggttcagcttccactacgacgcgctcagctacgcgctcaacttcgacgacggccgcgccgcccccgcccccgccccggtccccgccgcggccgacctcgtccttgcccccggcgacaacgacgcgctacggtgaatcggcgtccgacgatccgctgccaagagccagctggggtctctcttccttgctccggacgccgctgccttttccactctcctgtggtttcgctttttcgataaatgggggttgtgtaatggccacctcaatatgaggaaaacgaggatgagaatgaagaatccaacccaagtctgacaccgaacccggcaaattctaatccaaccttctcgcaggatcagcggagtaacgagcaacagcacactccccagcatggccagagggtttcatttcaactcaatgctgtggcagctgctgctgcaaagcgacctcggatgaccgtcgaccagctgaacatcggctaaccagttatcgttggttagactgtagtatcattttcccccatcttttagtgtggtgaatcatgtttcgaagagatttagtgttgtagtggtatgatcttatttaccacccacctatttaaccacgagatgtgcagtacagcagcagcatcataaagtttctgactgcaagaacgttgctgtagggaaggaaagtaactgtgctagtagtgtacttgcttacttaaaggttaatatctgccaaaattgtatctgggtctacatattcttagcttcatgtcaagagggcgaaaaaaaaaaaaaaaa

SEQ ID NO: 22464 - DNA, 4058 bp, Zea mays
  misc_feature (2939)..(2939): n is a, c, g, or t
ttggcattccacaaacattaacaacagatcaaggagctgcttttatgtctcacctatttaaagattttgccaaatctttgcggatcaagttattgaattcgtcgccgtactatgcgcaagctaatgggcaggccgaatctagcaacaaagtgttgatcaggttgataaagaagaagattgcagaagaaccgaagaggtggcatgaagtattgtctgaggcgttatgggctcatcgggtatctcgacatggagcaactaaagtgacaccatttgaattggtttatggacaagaggcggtgcttcctatcgaggtgaatttacaggcttgtagagtagcttgtcaaaattcgttatcgactgaggtatatggtgagctaatgctagacagaattgatgggaataatgaaagtcgattaacaaccttaagggaaatagagaaagaaaagctaagagtggcgagagcttataataaaaaggtgaaggagaaatcatttcagattggagagttggtatggaaaacgattttacccgtgggagtcaaaaataataaattcggcaaatggtcgccgaattgggaaggatcattcaaagttgtaggtattgtgcacggaaatgcatatttcgttgaggacttacaaggaaggagattacccaaggccctcaatggtaagtatttgaaaaaaatactatcctagcatttggcaataggcatgctaagatttgaaactagaagtggagctaaagtctcattatagctggagccgggtataatctaataatgcttataccggctaaaatgagcagatcgtatgggcacgtaatagcacatgtgaaatcagtttggttaggaatatacttttgattagtgctctatgaagtaggggcgagcttggttggtagtagacggtcagcttcaggagatgtggatcgagacgtccaggaggtctgaatcgacgaagtcgtttcaaccaaggggccggagcagacgcgcggtgggaggttgctcaggccgaagacgacagtatcacctggaaccgcgtgctcgagccgtcgccgggatggtgatgcttcgcgtgacggcggtgtgctggtgccctcaccagacgctggtgcttcatgcctcatgcggccgtcgtaacgctggtgtgccacggccacggtggtgctgatcgcgacctagggtggtcacgacgcacgacgcgccgaggagactccgtgccgaggagggcttcgttgctaggcggggcatcagacacgggctgaagcggaagaaagaaagaaacaattggtcgcatatgtgagtggggccattttggtttaggcactttgcggggatgtgcctaaggttgctgtgcacctgtgcacttgagatatggccggtgagcagatattgctaaaaataataataataggggtgtgagtaggtattgctaaaagtgtcatatgagccgattcgatataagaatcgatgatgaggtgtttttcggcacattatatttgctcgaaaaacagggaggcatgtgttgaatgtgaaatttatgatctgttggtgcagggctgtagaaggtatacgaagttgcatgctgcaaaataaaaaagaaagcaagtttttaacaggcatataaatgagatgcacggcgatatatgaccagtaatacataatcaagaggcatgtcaggataatcacgcaaggctacaaaagtggaatctgttagaattattcctattgtttaggctaattcctattatttagtgaagatagctcctgttatttagattaagttagttattaggcttcggaatcgactatataaatatgttgtaagctacagtaacgccgacagaagaaaaaaggagcctacaattatcatttttttcaatctgttatctattttctttcccttgctgggaggccttagtctcccttctctttctctcccagccgccagccgccgccgcactctcccagccgccagccgccgccgccgccgccgcaaaaaaccctaacccccaatccaccaatggcgtcgagcagccccgaccttgccgacgacggcttcgcggcgccgcgcctcttctcgcagggtgtctcctacacatacgacgacgtcatctttctcccgggctacatcggcttccccgccgacgccgtcgacctctccacccgcctctcccgccgcgtcccgctatccatcccctgcgtcgcgtccccgatggacactgtctccgaggccgctatggccgcggccatggcatcactcggcgccgccgccgtcgtgcactgcaacaccgagccccactcccaggccgccatcgtacgcgctgccaagtcccgccgcctccccttcgtttcctccgtgcccttcttctccccgtcctcctccccgacgctcaacgatttcgctggcagcgagtacgccctcgtcaccgagcgcggagattcgctctccaggctcgtcggcatcgctgtcgcggccgatgctgcctcccgcgaggttcccatctctgtctcggagtacatgcgaccgacgccgcgctcagcctcctctgccttcgacttcgaggaagcagcaaccttccttgccgatgagggtctggattacgctcctctcgtatccgatgatggtgaggttgtcgatctcatcaccgccaaggacgtggagcgcatccggagttatcccaagctgggcaagccgtctctcggagccaacgggaagtttgtagttgcggcttccattgggactcgtgaggatgacaagggaagactggagcaactagttaaggcgggggcaaatgctatcgtgattgatagttcacaggggaactccatataccagctcgatatgataaagtttgcgaagaagatgtatccggaggtggatttgatcggtggtaatgtggtgacaattgcacaggcccagaatttgattcaagctggntgtggatggattgcgtgttggaatgggatcgggctcaatttgtaccacccaagaggtttgtgctgttggaagaggacaggtaaatgctaaaatcctcatgaactcttgttttttctgtattctaatgcatcaccatcagcttacttcatttagcttgctgtcaaatttcttggcttaccctaccattagatatttaggtaggtagggtaggatcagcacacacgctcttttttgttgctctctgagctgtcttatgatctgaagttatattagatggccatgaccaaggtggaaacaaattttgtctgtccttggctccttattaaacatcctgaaatcattgctatcagtgcatgcatccaattctgatttgatgacatcagagcatctattgtctttgcctttctcagctaggtagggcatatgtagtcctcttttcatctgcttggaagacactgatgtgtacttggtctaattttgagcttttaactttacctttgaactttatatgaagtaattaggacattgaaaattgttgggattttttattaggtgctgtcaccttccattcatattcttgctgcttgctggttgcgtaccgtgtttatacaggatatcatggtcatagatttgtctagacctggtacagtgctttgccctatggtatattgtagtgacaaaataatttcaatactgatgcttgtgtttgatctttgatgttctttttgtgttggtggaccaggcaacagcagtatataaggtttcatcttatgccaaggatcacaatgtaccggttattgctgatggtggaatttcaaactctgggcatattgtgaaagctctgtcgctgggggcatccactgttatgatgggcagctttttagctggtagtcatgaagctcctggtacttatgagtataaggtagacaatttgtatattaaagtttttgctattttgaaatgagttaaagttctggtttttcttttcgtttaagtgactaccataaacaaaatatttgtatgcattttgatctttctgaccgtggtgactgtcaaatttctatagccatttagagcgtgagattttcatactgaagatcacatgccatccacatgcag

SEQ ID NO: 22465 - DNA, 745 bp, Zea mays
agaattcccacgagaggacaggcaacagcagtgtataaggtttcatcttatgccaaggatcacaatgtaccggttattgctgatggtggaatttcaaactctgggcatattgtgaaagctctgtcgctgggggcatccactgttatgatgggcagctttttagctggtagtcatgaagctcctggtacttatgagtataaggacggcctccgagtcaaaaaatacagaggcatgggctctcttgaagccatgacaaaagggagtgatgcaaggtaccttggtcgtacactgaagcttaaagtcgcgcagggcgttgttggagcagtagctgacaaaggttctgtactgaggttcattccttacacaatgcaagcagttaagcaaggattacaagatcttggcgcagattctctccagtcagctcatgatcttttgcgatcagagacactcagattagaggtgagaaccggtgctgcccaggctgaaggaggtatccatggactggaatcatacgtgaagaaggcattctagtttcataaataaacaaagaagtattgggacgatagtggttagctgcatgatatgtaaggggggcaagtgtacctgacaaaagctcagcagcttgtcagcaaagcttgtcgagttgggcagcaagtgtatcatctgcttggcgtcataataataataataaacctctggcatcggaactgttgtggtttcatacgttcaaaaaaaaaaaaaatca

SEQ ID NO: 22466 - DNA, 1996 bp, Zea mays
ccggccgggggatgaatctctagcgcgcgacctgctcctcctccgtctcccccgcgccgcgtgccctagagacgaaattctctctctcctagagccgccgccgcagccaaaaaaaaaacccctaaacccccaatccatggcgtcgagcagcactgaccttgccgacgacggcttcgcggcgccgcgacttttctcgcagggtgtatcctacacatacgacgacgttatcttcctcccgggctacatcggcttccccgccgacgccgtcgacctctccacccgcctctcccgccgcataccgctatccatcccctgcgtcgcgtctccgatggacactgtctccgaggccgctatggccgcggccatggcatcactcggcgccgccgccgtcgtgcactgcaacaccgatccccacgcccaggccgccatcgtccgcgctgccaagtcccgccgccttcccttcgtttcctccgtgccctttttctccccgtcctccgccccgacgctcaacgatttcgctggcagcgagtacgccctcgtcaccgagcgcggagattcgctctccaggctcgtcggcgtcgctgtcgcggccgatgctgcctcccgcgaggttcccgtctctgtctcggagtacatgcgaccgacgccgcgctcagcctccgccgccttcgactttgaggaagcagcaaccttccttgccgatgagggtctggattacgcccctctcgtatcagatgatggtgaggttgttgatctaatcaccgccaaggacgtggagcgcatccggagctatcccaagctgggcaagccgtctcttggagccaacgggaagtttgtagttgcggcttccattgggactcgtgaagatgacaagggaagactggagcaactagttaaggcgggggcaaatgctatcgtgattgatagttcacaggggaactccatataccagctcgatatgataaagtttgcgaagaagatgtatccggaggtggatttgatcggtggtaatgtggtgacaattgcacaggcccagaatttgattcaagctggtgtggatggattgcgtgttggaatgggatcgggctcaatttgtaccacccaagaggtttgtgctgttggaagaggacaggcaacagcagtatataaggtttcatcttatgccaaggatcacaatgtaccggttattgctgatggtggaatttcaaactctgggcatattgtgaaagctctgtcgctgggggcatccactgttatgatgggcagctttttagctggtagtcatgaagctcctggtacttatgagtataaggacggccgccgagtcaaaaaatacagaggcatgggctctcttgaagccatgacaaaagggagtgatgcaaggtaccttggtgatacactcaagctcaaagtcgcgcagggcgttgttggagcagtagctgacaaaggttctgtactgaggtttattccttacacaatgcaagcagttaagcaaggattacaagatcttggtgcagattctctccagtcagctcatgatcttttgcggtcagagacactcagattagaggtgagaaccggtgctgcccaggctgaaggaggtatccatggactggtttcatacgagaagaaggcattctaggtccataactaaacaaagaagtattggaacgatagtggttagctgcatgatatggaagggggcgatgctcatttatcctacctggcaaaagctcagcagcttgtcagcaaagcttgtcgagttgggcagcaagtgtaccatctgcttggcgtcatataataataaacctctggcatcggaactgttgtataagctcacagcttgtcatctaaacatttttcccaattttgttaaaagagtaaaacatcaatggttgattgatctactttgccgcgccatgttttaacctaccacaatgccgtaccttgtattattatgtgttcaaagaatggttgatgatagtggtttgtctct

SEQ ID NO: 22467 - DNA, 1115 bp, Zea mays
tacctagaacatcctaatcgaaaatatagttcacaggggaactccatataccagctcgatatgataaagtttgcgaagaagatgtatccggaggtggatttgatcggtggtaatgtggtgacaattgcacaggcccagaatttgattcaagctggtgtggatggattgcgtgttggaatgggatcgggctcaatttgtaccacccaagaggtttgtgctgttggaagaggacaggcaacagcagtgtataaggtttcatcttatgccaaggatcacaatgtaccggttattgctgatggtggaatttcaaactctgggcatattgtgaaagctctgtcgctgggggcatccactgttatgatgggcagctttttagctggtagtcatgaagctcctggtacttatgagtataaggacggccgccgagtcaaaaaatacagaggcatgggctctcttgaagccatgacaaaagggagtgatgcaaggtatcttggtgatacactcaagctcaaagtcgcgcagggcgttgttggagcagtagctgacaaaggttctgtactgaggttcattccttacacaatgcaagcagttaagcaaggattacaagatcttggcgcagattctgtccagtcagctcatgatcttttgcgatcagagacactcagattagaggtgagaactggtgctgcccaggctgaaggaggtatccatggactggtttcatacgtgaagaaggcattctagttccataatcaaacaaagaagtattggaacgatagtggttagctgcatgatatggagggggggggggggtgcgatgctcatttatcctacctggcaaaagctcagcagcttgtcagcaaagattgtcgagttgggcagcaagtgtaccatctacttggcgtcataataatattaataaacctctggcatcgtaactgttgtataagctcacagcttgtcatctaaacttttttgcccaattttgttaaaagagtaaaacctcaatgttgtaccttgtattattatgtgttcgaagaatggttgataatagtggtttgtctctaaagtcgacatcctggatagtgcgttactcccaattgtaaggctttcgt

SEQ ID NO: 22468 - DNA, 3412 bp, Zea mays
tctttgattttggacttggaagatataatgcatatactaattacttgtatatgtttccaaaaactctgtgcacccggacttgcagcaaatggcacatacctctgtgtccgtccgaaactatactcgctatgatgtaaatggatatcgcttccgaaccgcgaaattggagaagagtcgaccattggcagccaccaccaatagtggtgtgttggcaagttcatatgttgacgatgacaaagtagtggactattacggtgttcttcaaaacattgtagagttgattttcgatggccccaaagaacttaaagtcgtgtttttcgagtgcgactggtttgatgctcatagtgggactcgtgtcgacaagtatggtaatgtcgaggtgaagcatagctctaggattccgagcagtatgagcgatgttgtccttgcaaatcaggcaaaacaggtgtactacctgccatatcctcacccaagccttagggcttggtgggttgcaatcaaagtcaacccacaagtcgtcgctccagagagtgctgactacgtgagtacgagcagggacaacgatgatgctttttcagggcacctcacagagccgacagaggcagcagcaacttctcgactgtctagacgaagtgcagggtgaggagggtgagcaggagactcctcagcaggatgctcatgtgcagggtgaggagggtgagcaggatgaggagggtgagcaggatgaggaggttgaccccatgggggcaggcagcgcgggcgacgcgtcagatggttctacgtccttcaggtattattatgcatattagtttaattgatattagtttttaatcatttcatcatattgaatttacttgtatacttaggtataagaagagcaatgcacttggtccgagacctgccgagaggaggctcatccggccgcatggagaatggtggggcttatttctgttgtgttaattttttaatgtgaacgtgattgccctggtttacttgttttattaatgtttgtaggtcatgggaagacttgacttgggacggtacaggcagacgtcccaaggtgaacgcggtgttgggtagcctctgtcgcttctactaccctggcatggtggagctcaatggcgagaggttcgcggctatgcagtgggctgactggggtctaaaggactatgtccagccaggggagtcaggggaaagcagtagcggagggggaagttcggaaaaaaaacgaaggacttgtcaggtggctgtgtgggacgagttctgggtgagtttactttcgtatataagcaattcactgaattattgcttctcctaatcttactttaacttaacttctccattgatatgtaggggaggttccaattgccggatgacatcgaggacgatcaggctcagtgggcacgtgtgaagaggcactttcggaagtgcgctgataaggtcatcaaggatgccatgtacaatgctcgcatcgcggccgtcaactactactacaagaagataaaggggcagaaaatgagcaaagcattaggggccaatgagatctacctcacagaggagcagtacctggagagcgttgtggattggctggcgaaggacatggaagcctggaggtggttggcaaagagatgggcgtcgcctgagtggattgcagagtccaacaagcaccgtgtcaaccgtggcactgaaggaccggggcataggtacggcgccgatggacaccttggtaccgcacgccgcatggtaagtatataaatcaaacttgtatgttacatctatgaaaattatatggtttaactcttctttttcatgcaggaagctgaaagtggagttgctccaagttttatggaggtttacgtccgtggtcaccgtggccctgatccggcgaaccctgatgagctatgcagcgaggcggcaagggagaaaatggtaaacaagttgtatttacgaattaaattgcatgttttgtgtctaactccaactctaactttctttgcagaatgcatatggggaggaaatgactcaacgccatgggcctgatttcgactggatgcattcagacttagatgcctcggcgttgtaccacagtggtgggggtagaaagcatggcaggtgaggtggttgtctttgattcgacaatttcattaacaagaatgtgtccacttaatggctcaactatgtgtatcatgcaggtttgcctttggcaccggcgttgtggagtacaacaggacattaggtcaagggaaagcatcgtcttcggcagggagttctcgctcctccaagtctgctcgagaggctcagctggaggaggagactcgggcagcacaggagcaggctcgagcagcacaggagcaggctcgagcagcgcaggagcaggttggacagctgacgcagtatatggcttcttattttcaggtaatccgtctatctcatcacgtgtcgtcattgaattcaaagtataatgttgcgattctaacgtttcatccatttgcaggaaatgactactcgactcggccctgatatgaacttgccagcttttcgccctccccaggtaacactatctgaacacttcaattccatagcaactctttttttattatcaaaaatggctcgcaggcacaaggatggggacagtggccaggacaagctccagcgtcgcagccacagtggactggtgttgggtggacgcaggcacctccaggcacttggacacctccaccaccccaaggatcgcagccagtcccgggatgggtgccaccggtcttccagccaccggcgggctctcaaccatttcaagcgtggatggcaccgccaccgacggggtgggtgccaccacctcaggggtggccagcacaacagtacccgtggatgcatgcacagcctcctcctcaccatggatcacaggtgacgttccatgtttagttttatacaaatattgaccaaacacagccttatttgaatgattgatgaattgcagggttcagcgtcacatgctcagggatcggagggtgctgtcaacgtccaagacttcctcgtccatggttctggagggagtggccaccttcctggtggcggaggagggagtggccaaaactcacatagcccgccggagtgagtagtgactttgtttatggactatgtatggatatgtatagactttgtttatggttctggagggaatgactttgtttatgtatggactatatatggactatatgtatggaatatgtttgaaacaattatgtaattgcttgtgaatgttgtttgtgaaaactgtattgtttgtgaaatctgtatatatgattgtgtatatgtttattttgctgtgaattaataaaaggtgcagaacaatctgttttttggggggtatcatgaattttcgtcggcctgggtggtggccgacgaaaataag

SEQ ID NO: 22469 - DNA, 1866 bp, Zea mays
ggagaaaatgataggtttcaaggctacggggaggaccacaactggacccatatttcatcaatatgggaccttccgtatgcaaaagccttgatcatgccgcacaacatagacttgatgcaccaagagcgtaatgttgctgaaagcatcataagcacatgtttcgatgtgactgataaaacgaaagataatatgaaggcaagaaaagacatggctgaaatttgtaagaggccgatgctcgagttgaaagtaagcgataaagggcatgagagtaggccgcgagctgattactgcctcaagccggatgaaaggaaagaaatatttaagtggttgaagaatctgaaatttccagatcggtatgcggcaaatctgaaacgggcagtcaatctgaagaccggtaaattgatcggtttgaaaagccatgactaccatattattatggagaggctgatgcccgtgatgtttcgaggctattttaaggatgagctttggagcatatttgcagagctgagttacttctatagggaagtatgcgcaaagacggtatcgaagaggttgatgcagaaatttgagaaagaaattccaattcttatttgtaaatttgaaaaggttttcccgccaggattcttcaatgtgatgcaacatctaattgtgcatttgccttgggaagctttggtaggcggaccagtgcaattcaggtggatgtatcctatagaaagggcgttgaaaaagctcagggcgtctgttcggaacaaggctagagtcgaagggtgtattgcggaggcttttgcccttaaggagatatctcaattctcaaccaggtatttcgctcgagccaacaatgtgtttgcgccttcagtgcgacttcatgtcgaaaatgaatcaccccaaagcacccttcaaatttttgcgaatccgggtaaagcagttggaaaagggagtgtacgtcacattgaagcatcagatttgaacacgctaatgctatatatgtatagcaatattgacagcacacaggaggcgttcgagtaagttttcctcatagttacgtccattttctcatctcataatttctatagtgtgtaatctccatgtttctaatatgtccagcatgtttgatgaagaatgttggaaatctactagtaaacctacggccatccaattagaaaatcttcgacgtgatgggttgaaaggtggaccaaacttcgtgcagtggtttcgtaattatgttagtaattgtcgttctctcattgtccatacttaatctttgaattttggacttggaagatataatgcatatactaattccttgtataggtttccaaaaactctgtgcacccggacttgcagcaaatggcacatacctctgtgtccgtccggaactatactcgctatgatgtaaatggatatcgcttccgaaccgcgaaattggagaagagtcgaccattggcagccaccaccaatagtggtgtgttggcaagttcatatgttgacgatgacaaagtagtggactattacggtgttcttcaaaacattgtagagttgattttcgatggccccaaggaacttaaagtcgtgtttttcgagtgcgactggtttgatgctcatagtgggactcgtgtcgacaagtatggtaatgtcgaggtgaagcatagctctaggattccgagcagtatgagcgatgttgtccttgcaaatcaggcaaaacaggtgtactacctgccatatcctcacccaagccttagggcttggtgggttgcaatcaaagtcaacccacaagtcgtcgctccagagagtgctgactacgtgaatacgagcagggacaacgatgacgctgtttttcaaccagaagcggcgtcgaatcaagacata

SEQ ID NO: 22470 - DNA, 4241 bp, Zea mays
ctcccggagaatcatgtggccccaggatttggtcctccccaaggaggtgctggctggtcttgggatgacatatgagaagatcgacgtgtgtcccaacagttgcatgctattctttgaggaggatacgtcacattgaagcatcagatttgaacacgctaatgctatatatgtatagcaatattgacagcacacaggaggcgttcgagtaagttttcctcatagttacgtccattttctcatctcataatttctatagtgtgtaatctccatgtttctaatatgtccagcatgtttgatgaagaatgttggaaatctactagtaaacctacggccatccaattagaaaatcttcgacgtgatgggttgaaaggtggaccaaacttcgtgcagtggtttcgtaattatgttagtaattgtcgttctctcattgtccatacttaatctttgaattttggacttggaagatataatgcatatactaattccttgtataggtttccaaaaactctgtgcacccggacttgcagcaaatggcacatacctctgtgtccgtccggaactatactcgctatgatgtaaatggatatcgcttccgaaccgcgaaattggagaagagtcgaccattggcagccaccaccaatagtggtgtgttggcaagttcatatgttgacgatgacaaagtagtggactattacggtgttcttcaaaacattgtagagttgattttcgatggccccaaggaacttaaagtcgtgtttttcgagtgcgactggtttgatgctcatagtgggactcgtgtcgacaagtatggtaatgtcgaggtgaagcatagctctaggattccgagcagtatgagcgatgttgtccttgcaaatcaggcaaaacaggtgtactacctgccatatcctcacccaagccttagggcttggtgggttgcaatcaaagtcaacccacaagtcgtcgctccagagagtgctgactacgtgagtacgagcagggacaacgatgatgctgtttttcaaccagaagcggcgtcgaatcaagacatagctcaccgattccatgtgaccaatggagaaggacttgaaaatctctgttgcaattcaagcgacttaattgaagaacctaggtcaaagcgcaaacgacctgtcgtcgttagaagatcagtaaggatccaacgaaatcaagagcgtatgaataaacaacgagccgaagaagcatcatcggatgcggatgacttttgattagtatgtttcttttagttaatcaattaagctatgtattccaatttccacattattaattttcatattatttgtttcatatactgtggtttgacattaatttatctacagttgaacatgttcaagcataggagatcgaggaggagtgggggcagcgcggccagcgaggacagctcgggcagtgggctttttcagggcacctcacagagccgacagaggcagcagcaacttctcgactgtctagacgaagtgcagggtgaggagggtgagcaggagactcctcagcaggatgctcatgtgcagggtgaggagggtgagcaggatgacgagggtgagcaggatgaggaggttgacccaatgggggcaggcagcgcgggcgacgcgtcagatggttctacgtccttcaggtattattatgcatattagtttaattgatattagtttctaatcatttcatcatattgaatttacttgtatacttaggtataagaagagcaatgcgcttggtccgagacctgccgagaggaggctcatccggccgcatggagaatggtggggcttatttctgttgtgttaattttttaatgtgaacgtgattgcactagtttacttgttttattaatttttgtaggtcatgggaagacttgacttgggacggtacaggcagacgtcccaaggtgaacgcggtgttgggtagcctctgtcgcttctactaccctggcatggtggagctcaatggcgagaggttcgcggctatgcagtgggctgactggggtctaaaggactatgtcgagccaggggagtcaggggaaagcagtagcggagggggaagttcggaaaaaaaacgaaggacttgtcaggtggctgtgtgggacgagttctgggtgagtttactttcgtatataagcaattcattgaattattgcttctcctaatcttactttaacttaacttctccattgatatgtaggggaggttccaattgccggatgacatcgaggaggatcaggctcagtggacacgtgtgaagaggcactttcggaagtgcgctgataagataatcaaggatgccatgtacaatgctcgcatcgcggccgtcaactactactacaagaagataaagggtcagaaaatgagcaaagcattaggggccaatgagatctacctcacagaggagcagtacctggagagcgttgtggattggctgtcgaaggacatggaagcctggaggtggttggctaagagatgggcgtcgcctgagtggattgcagagtccaacaagcaccgtgccaaccgtggcactgaaggaccggggcacaggtacggcgccgatggacaccttggtaccgcacgccgcatggtaagtatataaatcaaacttgtatgttacatctatgaaaattatatggtttaactcttgtttttcatgcaggaagctgaaagtggagttgctccaagttttatggaggtttacgtccgtggtcaccgtggccctgatccggcgaaccctgatgtgctatgcagcgaggcggcaagggagaaaatggtaaacaagtttgtatttacgaattaaattgcatgttttgtgtttaactccaactctaactttctttgcagaatgcatatggggaggaaatgactcaacgccatgggcctgacttcgactggatgcattcagacttagatgcctcggcgttgtaccacagtggtgggggtagaaagcatggcaggtgaggtgtttgtgtttgattcgacgatttcattaacaagaatgtgtccacttaatggctcaactatgtgcatcatgcaggtttgcctttggcaccggcgttgtggagtacaacaggacattaggtcaagggaaggcatcgtcttcgggagggagttctcgctcctccaggtctgctcgagaggctcagctggaggaggagactcgggcagcacaggagcaggctcgagcagcacaggagcaggctcgagcagcgcaggagcaggttgggcagctgacgcaatatatggcttcttattttcaggtaattcgtctatctcatcacgtgtcgtcattgaattcaaagtataatgttgcgattctaacgttgcatccatttgcaggaaatgactactagactcggccctgatatgaacttgcccgcttttcgccctccccaggtaacactatctgaacacttcaattccatagcaactctttctttattatcaaaaatggctcgcaggcacaaggatggggacagtggccaggacaagctccagcgtcgcagccacagtggactggtgttgggtggacgcaggcacctccaggcacttggacgcctccaccccaaggatcgcagccagtcccgggatgggtgccaccggtctcccagccaccggcgggctctcagccatttcaagcgtggccaccgacggggtgggtgccaccacctctggggtggccaccacaacagtacccgtggatgcatgcacagcctcctcctcaccatggatcacaggtgacgttccatgtttacttttatgcaaatattgaccaaacacagcaatgtatatgtatacagccttatttgaacgctccatggatcgcagggttcagcgtcacatgctcatggatcggagggtggtgtcaacgtccaagacttcctcgtccatggtgctggagggagtggccaccttcctggtggcggaggagggagtggccaaaactcccacagcccgccggagtgatcagtgaggagtgagtagtgagtagttagtagcttatggacttatggactctagacttatggactagagttttgtgaattgtgtatttgaatggacaatggacttttggacttatggatactctaaacttatgtgaatggactatttatgtatatgtgaatgtgttttgtgaattatgtattaggcttgtgaatctgtatatgtccattgtgatattgtgtatattgctgtgaattattaataggtgcagaaaaatct

SEQ ID NO: 22471 - DNA, 3027 bp, Zea mays
atgtatagcaatattgacagcacacaggaggcgttcgacatgtttgatgaagaatgttggaaatctactagtaaacctacggccatccaattagaaaatcttcgacgtgatgggttgaaaggtggaccaaacttcgtgcagtggtttcgtaattatgtttccaaaaactctgtgcacccggacttgcagcaaatggcacatacctctgtgtccgtccgaaactatactcgctatgatgtaaatggatatcgcttccgaaccgcgaaattggagaagagtcgaccattggcagccaccaccaatagtggtgtgttggcaagttcatatgttgacgatgacaaagtagtggactattacggtgttcttcaaaacattgtagagttgattttcgatggccccaaagaacttaaagtcgtgtttttcgagtgcgactggtttgatgctcatagtgggactcgtgtcgacaagtatggtaatgtcgaggtgaagcatagctctaggattccgagcagtatgagcgatgttgtccttgcaaatcaggcaaaacaggtgtactacctgccatatcctcacccaagccttagggcttggtgggttgcaatcaaagtcaacccacaagtcgtcgctccagagagtgctgactacgtgagtataatcagggacaacgatgatgctgtttttcaaccagaagcggcgtcgaatcaagacatagctcaccgattccatgtgaccaatggagaaggacttgaaaatctctgttgcaattcaagcgacttaattgaagaacctaggtcaaagcgcaaacgacctgtcgtcgttagaagatcagtaaggatccaacggaaatcaagagcgtatgaataaacaacgagccgaagaagcatcatcgggatgcggatgacttttgatttattgaacatgttcaagcataggagatcgaggaggagtgggggcagcgcggccagcgaggacagctcgggcagtgggctttttcagggcacctcacagagccgacaaaggcagcaacaacttctcgactgtctagacgaagtgcagggtgaggagggtgagcaggagactcctcagcaggatgctcatgtgcagggtgaggagggtgagcaggatgacgagggtgagcaggatgaggaggttgacccaatgggggcaggcagcgcgggcgacgcgtcagatggttctacgtccttcaggtataagaagagcaatgcgcttggtccgagacctgccgagaggaggctcatccggccgcatggagaatggtcatgggaagacttgacttgggacggtacaggcagacgtcctaaggtgaacgcggtgttgggtagcctctgtcgcttctactaccctggcatggtggagctcaatggcgagaggttcgcggctatgcagtgggctgactggggtctaaaggactatgtcgagccaggggagtcaggggaaagcagtagcggagggggaagttcggaaaaaaaacgaaggacttgtcaggtggctgtgtgggacgagttctgggggaggttccaattgccggatgacatcgaggaggatcaggctcagtggacacgtgtaagaggcactttcggaaagtgcgctgataagataatcaaggatgccatgtacaatgctcgcatcgcggccgtcaactactactacaagaagataaagggtcagaaaatgagcaaagcattaggggccaatgagatctacctcacagaggagcagtacctggagagcgttgtggattggctggcgaaggacatggaagcctggaggtggttggctaagagatgggcgtcgcctgagtggattgcagagtccaacaagcaccgtgccaaccgtggcactgaaggaccgaggcacaggtacggggccgatggacaccttggtaccgcacgccgcatggaagctgaaagtggagttgctccaagttttatggaggtttacgtccgtggtcaccgtggccctgatccggcgaaccctgatgagctatgcagcgaggcggcaagggagaaaatgaatgcatatggggaggaaatgactcaacgccatgggcctgatttcgactggatgcattcagacttagatgcctcggcgttgtaccacagtggtgggggtagaaagcatggcaggtttgcctttggcaccggcgttgtggagtacaacaggacattaggtcaagggaaaacatcgtcttcggcagggagttctcgctcctccaagtctgctcgagaggctcagctggaggaggagactcgggcagcacaggagcaggctcgagcagcacaggagcaggctcgagcagcgcaggagcaggtcggacagctgacgcagtatatgacttcttattttcaggaaatgactactcgactcggccctgatatgaacttgccagcttttcgccctccccaggcacaaggatggggacagtggccaggacaagctccagcgtcgcagccacagtggactggtgttgggtggacgcaggcacctccaggcacttggacgcctccaccaccccaaggatcgcagccagtcccgggatggatgccaccggtctcccagccaccggcgggctctcagccatttcaagcgtggatggcaccgccaccgacggggtgggtgccaccacctcaggggtggccagcacaacagtacccgtggatgcatgcacagcctcctcctcaccatggatcacagggttcagcgtcacatgctcagggatcggagggtgcgtgtcaacgtccaagacttcctcgtccatggttctggaggggagtggccaccttcctggtggcggaggagggagtggccaaaactcacatagcccgccggagtgagtagtgaatttgtttatggactatgtatggatatgtatagactttgtttatggttctggatggagtgactttgtttatgtatggactgtatatggactatatgtatggaatatgtttgaaacaattatgtaagtgcttgtgaatgttgtttgccaaaaaaaaaaaaaaagtc

SEQ ID NO: 22472 - DNA, 1752 bp, Zea mays
  misc_feature (46)..(46): n is a, c, g, or t
ctcgaggccggccggaaaaaagatccttaatctaagggaacatatnacacatttgagttcttcaaaaaaaaaaaaagggtacccagagggcagcccggagccgcagccccagccgcagccacagccacagccgccgcgctcctcgcccccggtctaaagctctgcgcgggccgcgcgcgcgtctcctctccctccggcctcccaccccgccgcgtcactgccatggcctccgcccccaactcctccttccgcccagaggaggcgcgctaccctcccgccctcgagctcccgatcccgccgctctccaagttcaaggtggcgctgtgccagctctcggtgacggcggacaagagtcgcaacatcgcgcacgcgcgagcggccatcgagaaggcagcctccgacggcgccaagctcgtggttctccccgagatatggaatggcccttactcaaatgacagctttccagagtacgccgaggacattgaagctggcggagatgcagccccttcattttcaatgctgtcagaggttgctcgcagtttacaaatcactcttgttggtgggtccatagctgaacgttctggcaacaacttatacaatacatgctgtgtctttggttcagatggccagctgaagggtaaacatagaaagatccatcttttcgacattgacattccaggaaagatcactttcaaggaatcaaagactcttactgctgggcagagccctactgttgtagacacagatgttgggcgcattggtattggtatatgctatgacatccgtttccaggaactagcaatgttatatgctgcaagaggtgctcatttgttgtgctatcctggtgcattcaacatgactactggaccactgcattgggagttgctgcaaagggcgagggctgcagacaatcagctgtttgttgcaacatgcgctccagctcgagataccagtgcaggctatgttgcttggggacactccactcttgttggacctttcggagaggtgattgctacaacggagcatgaggaggcgaccataatagcagatattgactactcactgattgagcagaggaggcaatttcttcctctgcaacaccagcggcgtggcgatctctatcagctggtagatgtccagagactgggttctcagtagcgagcctggatgcggctgtgtgcccgctctgcaggcttgctcgtactacttcggctctgcaggcttgctcgtactacttcgttcatgagatgcatgtctatgggttctagagatcgaccaacatgatgagtgaaggcggagaggacgcaataaggcgactgtagttgtaccttcagtggtgtctccagttgccaaataaattggttactttaacgtctgaagaaaacctccctccatgggacgaagataaaacggaggactgcgacttccctttgggcccgactagtttgaagtttgtactagcttcgggggtgtctgggagtcaagttttttttcacagttttggtagaatactgtagtattctcgaatactacggtattatatacaaaatgttgtttggcaatctagataaaatctatgtttttaaaactgaagtattgcaaataccttagggcatgtttggaaatgcggttttgaaaaaaaaaaaaaaaaagataccatagtttataattgtacatgacataaatactacggtattgctttaccacagtaaaactacagtattgcctaaaaaaaaaaaaaaaaaagcggcc

SEQ ID NO: 22473 - DNA, 899 bp, Zea mays
  misc_feature (811)..(812): n is a, c, g, or t
  misc_feature (823)..(824): n is a, c, g, or t
  misc_feature (834)..(835): n is a, c, g, or t
  misc_feature (859)..(859): n is a, c, g, or t
  misc_feature (870)..(870): n is a, c, g, or t
  misc_feature (894)..(894): n is a, c, g, or t
acgccgtccgcggattgggttttggtttatgttatgacatccgtttccaggaattagcaatgttgtatgctgcaagaggtgctcatttgttatgctatcctggtgcattcaatatgactactggaccactgcattgggagttgctgcaaagggcaagggctacagacaaccagctgtttgttgcaacatgcggcccagctcgagataccagtgcaggttatgttgcttggggacactccactcttgttggaccttttggagaggtgattgcaacaactgagcatgaggagacaactataatagcagaaattgactactcactgattgagcagaggaggcaatttcttcctctgcaacaccaacgccgtggcgatctctatcagctggttgatgtccagaggctgggttctcattagcacagggacgaagcaggagagcagttgactctgcaggcttgctcgtactacttcgttcatgagatgcatgcccatgcccatcgagagatcgatcaacttgatgtgtgaaggtggagaggacggaataaagcgactatagtttgtaccttcagcgctagtttggcaactctattttacaagagattcttatttttctaaggaaatattaattaatttttcttaggaaaatggaaatcacttgggaaaatatgattgccagactagccctcagtgtaaatgtctccagttgtcgaataaattgattactttaacctatgaagaaaacctttctccatgaaacaaagaataaacgggaggatcttctcccgatttccctttaaaaaaaaaaaaaaaannaaaaaaaaaannaaaaaaaaannaaaaaaaagggggcggtgccgttnctagaggaatnccaagacttacggtacggcggtgncatgc

SEQ ID NO: 22474 - DNA, 2328 bp, Zea mays
gtcgacctgcagatcaccaggtcagcggcacctggggttgagcattgagtatctgatatttgaacatggattatcttatgcttaaaatatgataatattatctgatgcttaaaatatgataatattcgattagtttgacaagtccaatatagacagagggttagtcaacaatggttgattactgtctaaataaacctgaaattaatataatagattaaagctagttgttcgaactattgcgaccgtaattcatagcgataaaacagaaacaatataaaccggtattgattaaagccaaacaaacattgcctctgttttttctccttccctctctaattatcaagaccactcagcaaacattcaatcaagcttgtggagacggaaactcacgacacacatcacaatgatccgagccgcaggacggcgtggacgccgccgccgatcggccggcgaccagattggcatgggaaatggacatcccttggtggcgccggccggcagggcctttcccgtcagaacggcaccaaaagtgctgtgccaccagccccccccggtcggcccgggcccacgacgtgctgatacccatccatccaccaacaactcccgctccggtgtccagtcgccgtcgcgactcacgcaacctcctcggctcgctagccgctacgctactgtctacgccgccacggcgccacgacatctcccataagatggtagccgcagccgcagctgcagccacagccacagccgccgcgctcctcgcccccggtctaaagctctgcgcgggccgcgcgcgcgtctcctctccctccggcctcccactccgtcgcgtcactgccatggcctccgcccccaactcctccttccgcccagaggaggcgcgctcccctcccgccctcgagctcccgatcccgccgctctccaagttcaaggtggcgctgtgccaactctcggtgacggcggacaagagtcgcaacatcgcgcacgcgcgagcggccatcgagaaggcagcctccgacggcgccaagctcgtggttctccccgagatatggaatggcccttactcaaatgacagctttccagagtacgccgaggacattgaagctggcggagatgcagccccttcattttcaatgctgtcagaggttgctcgcagtttacaaatcactcttgttggtgggtccatagctgaacgttctggcaacaacttatacaatacatgctgtgtctttggttcagatggccagctgaagggtaaacatagaaagatccatcttttcgacattgacattccaggaaagatcactttcaaggaatcaaagactcttactgctgggcagagccctactgttgtagacacagatgttgggcgcattggtattggtatatgctatgacatccgtttccaggaactagcaatgttatatgctgcaagaggtgctcatttgttgtgctatcctggtgcattcaacatgactactggaccactgcattgggagttgctgcaaagggcgagggctgcagacaatcagctgtttgttgcaacatgcgctccagctcgagataccagtgcaggctatgttgcttggggacactccactcttgttggacctttcggagaggtgattgctacaacggagcatgaggaggcgaccataatagcagatattgactactcactgattgagcagaggaggcaatttcttcctctgcaacaccagcggcgtggcgatctctatcagctggtagatgtccagagactgggttctcagtagcgagcctggatgcggctgtgtgcccgctctgcaggcttgctcgtactacttcgttcatgagatgcatgtctatgggttctagagatcgatcaacatgatgagtgaaggcggagaggacgcaataaggcgactgtagttgtaccttcagtggtgtctccagttgccaaataaattggttactttaacgtctgaagaaaacctccctccatgggacgaagataaaacggaggactgcgacttccctttgggcccgactagtttgaagtttgtactagcttcgggggtgtctaggcacagttttggtagaatactgtagtattctcgaatactacggtattatatacaaaatgttgtttggcaatctagataaaatctatgtttttaaaactgaagtattgcaaatacctagggcctgtttggaaatgcggttttgaaatactgtagttttaagataccatagtttacaattgtacatgacataaatactacggtattgtttatcacagtaaaactacagtattgctcaaaaaaaaaaaaaaaaaaaaaaaaaaaaaaa

SEQ ID NO: 22475 - DNA, 1729 bp, Zea mays
aaggcctttcgccctttcccgtgtcccgtcaacaggcaccaaaattgctgtgccagtgccaccaccaaacattgcgggcacaacggactgacaaaccggtcccactagctgctgatgcgcatccatccggcaactactcacgctcaggtcgccgtcgcgactcgcgccgcctctcggctcgctagccgctacgctatctacgccgccccggcacctcccatgagatgagagccgcagccgcagccacatccacagccgccgcgctcctcgcccccggtctaaagctctgcgcgggcggcgcccgcgcgcgcgtctcctgtccctcccgctcccgcctcccactccaccgcatcgccgccatggcctccgcccccaacccctccttccgcccggaggaggcacgctcccctcccgccctcgagctcccgaccccgccgctctccaagttcaaggtggcgctgtgccagctctcggtgacggcggacaagaatcgcaacatcgcgcacgcgcgcgcggccatcgagaaggcggcctccgagggcgctaagctcgtccttctcccagagatatggaatggtccgtattcaaatgacagctttccagagtacgcggaggacattgaagctggcggagatgcggccccttcattttcaatgatgtcggaggttgctcgcagcttacaagtcactcttgttggtgggtccatagctgaacgttcgggaaacaacttatacaatacatgctgcatctttggttcagatggcaaacttaagggtaaacatagaaagatccatctttttgacattgacattccaggaaagatcactttcaaggaatcgaagactcttactgctgggcagaatcctactgttgtagacacagatgttgggcgaattggtattggtatatgttatgacatccgtttccaggaattagcaatgttgtatgctgcaagaggtgctcattttttatgctatcctggtgcattcaatatgactactggaccactgcattgggagttgctgcagagggcaagggctacagacaaccagctgtttgttgcaacatgcggcccagctcgagataccagtgcaggttatgttgcttggggacactccactcttgttggaccttttggagaggtgattgcaacaactgagcatgaggaggcaactataatagcagaaattgactactcactgattgagcagaggaggcaatttctccctctgcaacaccaacgccgtggcgatctctatcagctggttgatgtccagaggctgggttctcattagcgagcctggatgcagctgtgagtgcctgtgacctgtgacgaagcaggagagcagttgactctgcaagcttgctcgtactacttcgttcatgagatgcatgcccatgcccatctagagatcgatcaacttgatgtgtgaaggtggagaggacggaataagtcgattatagtttgtaccttgagggcaactctattttctcaagagatttttatttttccaaaagaaaatgatttaatttttcttaggaaaatggaaatcccttggaaaaatatgattgccaaactagccctcagtgtaaatgtctccagctgccgaataaattgattactttaacctatgaagaaaacctttctccatgaaacaaagataaacggaggatcttctccgatttccttttgggccgtaccaatttgaattttgaactagcttgtgcc

SEQ ID NO: 22476 - DNA, 1504 bp, Zea mays
ggccgcttttttttttttttttttaataatggcacaagccaaacatgagcatgattcagcattcaaagatcgtaatctagccctgcagggcgttctgcgttcttctaaacaaagaggtccagattccttcatatatgacatcgggaaaaaactatatatacaacaattgcccggcgatagcttgtatacctccgcgggagaagagaagcccgcgaagagactagctagacggctgaaaccacacacctaaacgtggtttctctcgaaccagttaacaaaaaaaaaaagccctatgcccctatcaaagagggctttaatttattatatagctctaaacacatttcgaatccagcatctctctcattgtacagtcccagcatctgtcatacttcggttaacttcaagcgtggtactacattcattgcatgcaactcctggaatagaagcttgcaagcgtatggcagcctcatcttggccatgttttccccattcttgcacattgaacagtatgaagtcttcagtttgtgattgtagtagcctaacaagccacattttctgcaaacctggacttgataaggatcacttgataacagtagacgttcaaatattagcatgctcgcgccatatgcaattagacaatcacgttccatctcaccaagacgcaagcctccatcacggcttcgcccctcagttggttgcctcgtcagtaacacccgcggtccactagctcgagcatgcatcttatcaagaaccatgtgctttagtttctgatagtagattggtcccatgaagatgtatgcctcaagaggctgaccaagaatgcctgagtacaagaaatcttttccattatagctgaaaccatgcttgattagagtagagcttatgtctgcaaccttgtcagcattaccacttggctcaccaaatgcactgccatagtgaaaccgtccacaagaaacaccagcctttccaccaagaagttcaatcattttacctattgtcatacgacttgggaaaccatgtggattcatgattaaatcaggacagattcctctctcagagaaggggaagtcttcttgctgaacaatcgtaccacagacacctttctgcccatgtctgctactgaatttgtcaccaacctctggccttctagtgtaacgaataatacacttaatggataacttatcatttgtatctgagcacagcattacacgatctaccacagtagtctcaccatcaacacctttgtacaaggcaggtgagtccttgtagtcactttctctcaatgccctaccaataccttttgaagtgtttttgggagttcgcttgtttacatagatatcatgattgcgaataatttgaccaggtccagcaattccatcctcatcggcccctcccatattctgtttaatcaaaacagcattatctctttggggttcaaccttgcttgcatcttaaggggcaatcatagtgatcacatttcaaggcaaaaaaaaaaaaaaaaaaa

SEQ ID NO: 22477 - DNA, 2537 bp, Zea mays
  misc_feature (1009)..(1009): n is a, c, g, or t
gtccctccttcccatcgcccgccgccggccagatccacgcccccaacaacacctttgctcactcaaaaccggaaccgccctactcgcaaactcccgccgcaccagcaggccacctcgactggcacaattccaccggcggccgcctgaaccggcatactcggggcccgaattcgccgcaggagttcctgttgctctccactccaccccgggtgcgcgtcctctaccaaccttgtcgctctccccccgcgtgtttttactccactaccatcaccttcttggcctttattttccgtgagcgcgttggaacggcgaagcgaaagcgagcagaaaagggcgaagaggcgggctcgtagctttgccagaggccagagcccagcgaatgcgcgaaaggagcctgcttggattaaaataaatcaaacatctagtaataatttaaatcaaaccttcatttttttatctctactcgtgcgtatcttgagtttttggctcaattttttatgtgcaatagtccgcatgatatcgtatatgttacagaaataaatcaaactattttgagacgatcctcaagcatctagtaataatttaataatggagattaaaaaggcttatagataatcatgaatctctctcaaagatttttctgtttttacaaacgacggtaacctctcgcgggtgacaaaaccgagaattctatcacatgtttcaactactgttatagaaaactgtacagaaaaaaagagtcgcttaatgttctgaaaactggactacagcataacagcaagcaagatggtcaggatcccagtttgtaaaagttgcttcaggaaacaggaagccttgtcactgccgttgtttttggagcttctgcaggtagaatcatgcatatatcaaggcctgcctcattagaagtgcaaccctacttctgatgcatataatccttgtaggctggctgaatcatgcatacatgcattcaggtcatccaactcagccatccatacacgaaagaatagtngcaaaaccggagcaaattatttatttatttttactgaatcaatattaactaaaagagtagcaggaagctatattaacttttttttttttttttgatgtaatgggctaatactaaaacggaggtacattaatccagtatggttctgtgtgcacgaccttagaatctagctggtcgtgaacctggacagtctccatggactgctcctggacatcatagatgtatagatctctgtcgccaagtaagaagtggaggaagaagtagagggtgctgcctttcaggttattggtgcttgcagagcaccaagttgccatgttggtgcccgtcaagagaaaagccctgtcaccgatatcatccacccggtaccaggccacggtttcctcgccgcaggagtcctccatcttgaagattccagcggcactaacgttggtgggatcaaaaccgacatagaagacgcagacggcaaaaagctcgtccatggactctaccaagtggatggagcagatgccgtcaggaaacttgatgccgaactctggggagacatcaaactcgtggaactctgcggtgggagggtgaccatgatcggacgggaaatctaagtcaacgacgcacatcttgttttggtgcgattccatgaagcaaaaatgcagcttccctttaagcgcggcgacgcttccgatgactttcttggtgggcgtagagggggtgcggaactcatcgaggaactcgtagtcgccaatgtcgtaggtgtgctgtccccacctccggtcagccccgccattgacacggcagaaccacatgagaggatcggcgacgtcgaggagcaccacggcgcagtccgggtgggcggcggagttgtgggtgagcaggcacttgcagttggtggggatgtagtggtcgtcgtgtatgggtgggagggtgatggtctccccggtgagcggatgccacatggaggcctccgacgtcacttgtccaaggatgaccagccagccttgaggcgtgctgaagaagttgccctccatggcctgaggcctgctgtcgtgcgtgtagacgatgctccgctcaggcaggctgtacatgagcatctttgcggcagcggtaggagtagagcctgctggatgaacaacggcgggatcctcgtactcgtagacgagtaagggaacagaggagaggacctgcggtggtgactggatgctagtcctcctgccgccgcggccaggccgccggccggcgttcaatagcatgcccaccatgatggtaggttgtacctgctgccatgattcaaaatcgcaagcgtaagtataaaatctaagcaaaacaggtattttgtacattggggatagctcaccagcaagatgtcgtcgaatcgattcgtgggaggcagaggtgctacagctaatggatctctaatcttgagacgcagaggtgctacagctagacgccgattggctcgcttttatattgtcctccgccgccggatcggatgggaggagttccgctcgaatcggggaattgcacgccccgcccaaac

SEQ ID NO: 22478 - DNA, 1546 bp, Zea mays
ggggaaaccaactagtccccaaagtcaataaagcggctacacgtttcgcccgagggcaaatcccatccagagattatcgaagcaacgagcgccgctccccttcacccctccgcctccctccaaaactcaaattgacctagcgagaagcagaagaggcgaagagtgataacgaacctctcccacatcgatttccccaaatcgcctggcgcgatgaccacggcaggagaggtggattcggcagcaggaggtgaggacctggagccgctcttcgactacaagcgagtgcagcccaggatgacgttctgctttgacgacagcgacttggaggtggccgacatcttcaaatactgcaacaagcgcccaaaggtccacacctccacggaggaggagggtaagcctgacgaggaggtcgccgctgccaaggtggtggtcctcgatgaggaggattggttgcagccaccgccacccaaggccgcattcagggcaacggcagaggaagatagtgcgtttcgggaactgaggttgaagaaacaagagtgggcaaaattcgctgaatcagctgaggatatattgcaaaagctggatgaaatcacgaacaaagaagttggtcccaaggaaccacctgaacagataattctagatgaggagtctgaacctcaagtcgagaaagccagggaaaagatagtcatatcaatccaggacaaggatgggcagcaacagatgcgtgtatacaaggacgaaaagttcgacaagcttctcaaggtgtacgccaagaaggcaaagctcaacccatctgatctgtcttttgtgtttgatggtgagaagattaatccatcatctacacctcaggaccttgatctggaggacgaagacatgattgaggtgcgtcgtaagcagagttgaggtcatcctcgatatatgctggtttagacaaactcagccttttcgctgtcttcttttgcttccaacaaaggcttatttgtctatatatcatataacaaagacgttgaggccatccttgatatatgcgtgaaaccctcgagatatattgcagctgtaccgtgtacgtgggggtttggttggcaaaagccatctgcagaaatgccagagcagcctctgttattggatgtcagtatacaagacgccagtcagctagcaatgccaacagaagtgactaaggaaggcgccaactgtagctaataatcttcttagttttggttactttctaaaaataacatattgattttcaaagttacgtgctggtttctaggcctcaagtcgtctcgcaagacatagtttgtattaaaattattaaagcatgtccaatagttcctcaaaaaactctttaaatagggtgttagtaatcaaaaccattctataacagttctttaaatgaggtttctaaataaactaaattcttaaatatccctatttagttctcaaactttaggagttgttttgcactttcaataacttgttttgcttatcaatcataccataaaatcacttgtctgctattgagtttgcacatgtgtacagtgatgta

SEQ ID NO: 22479 - DNA, 858 bp, Zea mays
tttttccctgtttttttttttttttttttttttttttttttactgataaaccataataataagacgtagtcaagggcattttagcagttccaataagctgcactttagcagttccaacaagcgtacggctaactagacaccatagttaagcacgtcatgaacaagttccactacaccaaagtgagtgactacttggttagcagcaattgtgttgcagaggtccacggctacacgagcgacggatacctcttggcttgctcacggacgcgtctcttgtattctggcatattctctgcaaaaacatcgtaagcaaaatcctgtgcgggagaggctgggtttgggttctccagcagctcctggatgcctattagaatttgccgcactgtgatagaaggcgcccatgcatcaccaagtattgacaggcatacatccccagaatcatagacattgacatggaaaaaccttcgtgggaacttgcaggttggggggttacttgggtaattttcagtgaaatggagagtgaccgggaaatatccaccttcccaatcagtgccttccttgccggggacgacgcagttccagagcatgagattgacagaaccatccggcagcatcgccggcttggccacaaagccgaggggatggctcttgcgccacgccttgcgctcctcagcaaggcgaccgcgggcggcgcctccggacgccatccaacgagcccggctcgggcgcacaatgccgggtggatggcgcgatggcgcgagcgcagtggtcggaatcgggatcgacggatgtttgcttgacgctccggttcggctcgcggtggggtgaggccaggtttatgccttttattaggcatat

SEQ ID NO: 22480 - DNA, 1904 bp, Zea mays
ggccctagggtccttttttttttttttttttccataggcttaatagcaaaaaatatatgggcttagaactcatagatgaaatgaattcataagtagagcaccacagcaaagtaaattatttgcacattttgcgtcaaataagtacacagtacaagcgcaaaactaacaaataactgaaatagctgatgctatctatcaattgatagtttcttagaatgattgacctagagttacaacaataccaaaacagagccacagcttcaactactttgcattcccaaataatattcttcgagtaaaatcatcgtcagaacatgtttcggagcgaaaccaactaagttctggtaattccgtgagctgtcccactgcagccagagcaatatccttatcaattatgtactccttggcagtttccattactgtagcacagtcaacagcatcaatgcgtgcaaaaagctctaggaacggcatgactcgcccataagttagcatctggcgaccattattctcagtaactgcagtggatccatcaatgtgaagtaacagagaagatttcagctgattgcgggcacgggcaacctctgtttctgacacctgggatgcaagtcttctaaactccgccattattaaccgtgacaagtcttgcagggtgtcaggcggagcaatagtataaatgccaaatattcctgtgtcccgatagttagtattgaacgccatcaggctctcagctaaattagcattgctgataccacgagctaaagaagaccctgagcagttcccaaccccaatgctcctgttccaggatcccaatatgctttggatcaccataaggggaatggagctagggtcagtccatgatgaacctttgaaagctattgcgatgtgtgctagaggaaactctgcattttctacacgaacctcagatccagtaaaaatagctgggttcgcctgaacaagctgatcagcagtagttggatcagtggagaattctgtgaataattctttcacttgatcaacaacctcatcgtgactgacacttccagcagcagatacaaccattcgaggacaggtatagtgagttgagatatattgctccaaatctttcttagaaatggacctaatattttcttcaggacctaatattgtgtcccctagtggatggccttggaatgctgctgcatgcaagtgatcaaatatcacctcttccatcataccttgcacctcctccatctcacggaggatgacgccgcgctcccgctggatagccctttcggggaatcgcgggtgctgtaggatgtcgctgaggacgtcgagtgccgccggaacgtggcgcgcctgcacgtcggcaaaaaaggtggtctgctcgcgggaggtatacgcgttgaggcgcgcgcccatgtcctcgatctccacctcgagcacctgcgcgttgggccggcgccgtgtgcccttgaaggccatgtgctccaggaagtgtgcggttccgttggttccagggagctcgaagcggctccccgcatcgacccagacgccgacggaggcaatccgtgtggcgaccgggtaggcctgcgtgacgacgcggaggcctgaggggagcgtagagacgcgcgcggcggggaaccgaaggtaaggggagtggtcaggggtgcggggcaccggcgaggcgtggcggaggaagcggctggtggagggcgacggggagacagcggttgtggacgcggagtggaggaggcggtacagatagggaaggagccggcgcctcgagcgggcggctgaggcgagagcggccatgtgttcgacggaatctctctaccgtcgcgccgccgaacgggggagacgaggagggctccgggttttcctgccggctccgggctccactgctgtttatcttcccggcccggccg

SEQ ID NO: 22481 - DNA, 2661 bp, Zea mays
cttttattttgtcgaccatgttgagaacgacgtaaataaaaaataatttatgtcagttgatctgtagccgacgtaaaataacttttctataccggttttcttatgagcagacgtaaattagtttggctaacatagatttatctgttttctgtagtggttttgtttttctccgggaagttgacagtgtgcattgcttttagtgatctaataaatggagctacaccaaaagatgaatatcatatgactcttgccaatatgtttattgcatgaaattgggttataaattaaccttcatacgcctattgccaatattttttttcttttgtaataagtgtggcaaaaagaaatcccttcatgcagcagggtacagtgttcatagaagaaacggtggtgggtggctcaacttaggtcatcgccatccagcagaggctcgatctgccactcgctgccatagtaggagttgggcaggccaagccagaacttgaaggcctcggcggcacgcttgcgctctcggcgccggtcctggcgcgcttgcgatgcatgcttgctggtgaacatcctggagtgcatctcaatgtacatcttcttgtacttggtcttgttgggagcgatgcccttctcctccatgcacgccacgatctccagcgccttcttgaagaaggccgccctcacgcacacgtccgccagcgcccccagcagttcctcgtcggcctccttcaggcaccgctccttcacctcgttccagagcacaagagcctcccctggcttgcgcgccaccgcgatgcccttcgccatgctgccgtacgtcgccacgtccggctgcacgccgcgctccttcatcctctccacaacctgcttcgctgtctccactagtcccagccggcagtacccctccaccagcatgttccacgccgctctgtccaccgtcaccctggggtcccgctccatctcctcgaacaccttgtgcgctaccttgggctgccccgacacggcgaacgccttcatcaacgtcgtgtagctcacagtggacggcgcgatgccccgtgaccgcatctcgttgaagaaggctagcgcgcccgcgctgtcgtccgtgagaacgcacccgtccatgagggtgttgtacgtcaccacgccgggctggatgccggcgtccgtcaccatctcctcaaagagctccctggcctggccaatctgcagctgctggcagtagcccttgagcaggacgttgtaggtgacacggttggctggaactctggccgcagccatctcgttcagcacggcgcgcgcgcgcgccatgtcgcccgcaccaacaagcgctgatatcaccgtcgtgtaagtcacatggtccggccggcttgcgggtgccgtctgcgcctcttgccgcatcgcgcgcagcacggccaggacatcgtcgacgcggcctgcgttcgtgtaccccttcatgagcgtggtgtacaccctggcgttgggcggataagccttggggagcagcggcacctcatccgagccctgtccctgtttggccccggcaacaatgtcgtcgagcagcacggcaccctcctcgacgtcggtcacaccgtcgcagtccatagagacagccctgagcagtaagcatatgtctttgcgctcttcccgcatcgcctggacgatcctctccgctgtggcgatgtcaccgaagccgacgaacgcggcgacgagggagtggaaagtggtggcgcagggggtgaggccggagaagagcatgcgctcaagcacgcgcgcgacgaggtcctttcggccggcgcgcgcgcacatcttgatgacgacgttgtaggtgagcgcatcggcggcggcgctccattcgctcattgcgtcgaacagctgccggaatcggcggcaatcccccgcgtcagcgcaggcgctgagcgctgcgttgaatgcggccgcgtcggggaggcaggagggggagacgagctctggtggtgcgctgcggaggttgcggaggacggcgtcgaagaggcggagcgccttggtgggcggcgtgaggcgggagacggcggcggtgtatgcgcgtcggtcggggaggaggccctggcggagcatgtagaggaggagggaatgggcgagacgggcgtcacggcagcgggcggctgccgcggccgcgagggagagggagttggcgtcgaggaggtcgagggcaccgcgggcgcggaggctctggaggaggcgggcggcgcggggaaacccatcggggccgttggaattgaaggagagctgcgcgaggaggcgagacgccgtggtgggggaggaagggaggagagacggcttcgaggagaagaggctgtaggcggcatcggtgtcatgggcgcggaggagcgccaggagggcgtcgtcggagggaccatctccgtcatggtcaggcgcatgggtgagtggtgtgctggagcgggaagtagctggggacagagcggctggctgatggagcctctggtgctggttgccgaaggaggaagaaggcggggagcacgggcatgagcaagagcaggtggcgccaccggggaaggagggatggggttggagcagcgggaccgagtagcgcgtgcagcgtagcatccctggagcaggtagtggcgtggcaatggccgtattgtccgtgtgatttgttcccccagcccggccggc

SEQ ID NO: 22482 - DNA, 1929 bp, Zea mays
  misc_feature (1489)..(1508): n is a, c, g, or t
gcacgagggaaaattccttgggttcctcgaggccggccgggctctttatcttctgcatcccactcccattctggccgggttgttccgttttctaatgagccaccgccgtcttccttatctgctgcatcccaatcccatttaaattttgtcgtcaacaatttcgtcttctcggtttctgacttattccggggcattttttttttcttgtttcgagcctgtgagtctgattccattttgacccatggcggcggcggcggcggcggttcatgagccggaggtgatccgcgacaaggcggcgatgcgcgcgtggtcgcgccgccgccgcgcggagggaaaggccgtcgctttagtccccacgatgggcttcctccacgagggacacctctcgctcatctccgcggccgtggcggcctccgccggccccatcgccgtcgtcgtctccatctacgtcaaccccagccagttcgcccccaccgaggacctcgccacctacccctccgacttcgccggcgacctccgcaagctggccgccaccggggtcgtcgccgcagtattttgtcccccggacctctacgtccgcggcagcgctgatcgcccctccgccgccggcgcgtccgggggcgcggtgtcttgcctggaggatgcaggtgggcatgcgcacgagacgtggattcgggtggagcggctggagaaggggctgtgcgggagcagcaggcctgtcttcttccgcggcgtggccaccgtggtcgccaagctgttcaatatcgtggagccggacgtcgccgtgttcgggaagaaggattatcagcagtggcgcgtcatttgtcggatggttcgtgatcttgattttgccatacagatagttggttcggaagtagtgcgagaagctgatggtcttgcaatgagctctcgcaatgtaaatctgtcagaggaggatagaaagaaggcgttatcgatcagtagatcgctggtggatgctagaaccgccgccctcagtggaagcaaccgtagccaagaaataaaagatcaaatagtgcgtacaattacagaagctggcggtcaggttgactatgttgagattgtggggcaggaaagcttggtgcctgtggagaggatggaccgcccttgtgtaatttgtgtcgcggcatggtttggaaaggtcaggctaattgacaacatcgagatccatgtagatagctctactgttttgtctatctgatgaacgaagatgtttagacacacggcaaaatggcataccactttctacgtagcagtagcagaccaagaataaatagcatgatgggctgaatctggatagaagaccatgagctcagtgctagccattcttgaactgctagaatgcagagaataagtactttcacagtttcagtcaagctaaggcagcacaaatgaaaaataggcatctctaaagtactcaacacatggggaaaaaaaggacattaatgactgaatcttcgaagcttgtggnnnnnnnnnnnnnnnnnnnnaaaaaaaaacagattttacattagcctctctcgttagtcaccagatgcactctatagttaccggaggctcaagggcgcttaaaatctcaagcatgagcaatcaatctggccggacatcttggttctcaactgcccattgatacttgattcaagcactctgccaataacaaaactactcgaactccagcagctccctgtctcgctcactatcttaaactccatgcggtgaacagtataaaaacagtgttttgtacgtccatatacatgatccgccgaagacggtctaaggttgcataaacagtgttttgtacgtccatatacatgatccgccgaagacggtctaaggctgcataaatgtatttctctttttgttgtttttctctaaacaaattataaaagctctatccttcaattaagacag

SEQ ID NO: 22483 - DNA, 2001 bp, Zea mays
ctggccgggcaatggtggtggagttagcagctgggcatgcattaacttctcacgaaatgtgcaagatggtgctgctaggagtttctgtcatgatctcgctttgatgtgccaagtatcaggaatggattttgcacttgaacctgtgctgccccctgtctatgcgaggcctgaacatgttgaaagagcactaaagagactttatcaagatgccatgagcatactcaggcctcagggccgagagcttgacttgctgatggtaatactgcctgacaataatggctctctttacggggatctcaaaaggatatgtgagactgatcttggattggtctcccaatgctgtctgactaaacatgttttcaaggcgaacaagcagcagtatcttgcaaatgttgccctgaaaataaatgttaaggttgggggaaggaatactgtacttgttgatgctttggcaaggagaatcccccttgtcagtgacgtagctactattatctttggtgctgatgtgacccatccccatcctggggaagattctagtccttccattgcagctgtggttgcttctcaagactggcctgaggttacgaagtatgcaggattagtgagtgctcaaacccatcgccaagaattgatacaggatcttttcaacgtacggcaagatccccaaagggggactgtctctggtggcatgattagggaacttctcatttctttctggagggcgactggacaaaaacccaagaggatcatattctacagggatggtgtcagtgagggacagttctaccaagttctgttgtacgaacttgatgccattagaaaggcctgtgcatcattggagtctgattaccagcctccagttacttttgtcgtggtccagaagcgtcatcacaccaggttgtttgttaataatcacaatgatcagcgtgctgccgatagaagtggcaacatactgccgggcactgtggtggactcgaagatttgccatccaaccgagtttgatttctacctgtgcagccatgctggcattcagggaacaagccgtcctgcccattatcatgttctgtgggatgagaacaactttacggctgatgggttgcaaactctcaccaacaacttgtgttacacgtatgctaggtgcacacgctcagtatcgattgttcctcctgcatactatgctcacctggcagccttccgagctcggttctacatggagccagatacgagtgacagtggatctatggcaagccgtggccctccaccaggggggcgcaacaccaaggctgccggtgttgggaatgttgctgtgaggccattacctgccctcaaggaaaacgtgaagcgggtcatgttctactgctaagactgatgctattaaggcagggctaccttttattattacagtatatcgtgaagactagagtattttttttccatgtacttgatgatgctgagctaccttttattatgtcgtacgatatatatgggtggtattgtatactggttacagtaactttagttgtgtgttccatcgtgctagtctctagctggtgggcgggtggtgttacgtgaaaaacattctcctctaaaattcatcaaatttggacatagacttgaacatatcacgaaaaagagtggatgtatttcacttaccccatcctcacttcttgggcctcgtgatgaaaagagcttgattaataaattcggaaggcaatgatattttgaacggaaagaccttggcatcgtcagccgtaccgtaggtattatattatactaaatacgtaattaattaggtgactgaaaatatgacgattgaggtgacgcatgttcgtctcgtctgttgactgcgaatagccgccggctgtcggcggcgtgcagcggcctgccttcttcctcacttttcatctttcttttggctgcagcatcatcatcgtcgactctataaattaatgtaatggctgtccatctctcctcacattgcttaccttcgttgctccattc

SEQ ID NO: 22484 - DNA, 2016 bp, Zea mays
caggcacaccacttgagcggggttgcatgtgggccctgagcgaggaccaaattatctgcctatggagggctgtcagatagctgaggggcaccgctactcaaaacgacttaatgataaacagagcactgctctactgaaggtgacttgccaacgtcccgcacgagaccattacctagaacatcctaatcgaaaacacaatgcctactccaaggatccttatgcccaggaatttggtataacgattgatgagcgtcttgcatcggttgaagctcgtgttctgcctcccccaaggctgaaataccatgatagtggcagagaaagggatgtattgccaaaagttggccagtggaacatgatgaataagaaaatggtcaatggtggtagagttagcagctgggcatgcattaacttctcacggaatgtgcaagatggtgctgccgggagtttctgtcatgaattggctttgatgtgccgagtatcaggaatggattttgtacttgaacctgtgctgtcaccttgctatgcaaggcctgaacttgttgaaagagcactaaagggacgctatcaagatgcgatgaacatactcgggcctcagggcccgagaactcgacttgctgattgttatactgcctgacaataatggttctctttacggggatgtcaaaaggatctgtgagactaatcttggattggtctcccaatgctgtctgactaaacatgttttcaaggtgaacaagcagcagtatcttgcaaatgttgccctgaaaataaatgtgaaggttgggggaaggaatactgtgcttgttgatgctttggcaaggagaatcccccttgtcagtgacatagcgactattatctttggtgctgatgtgacccatccccatcctggggaagattctagtccttccattgcagctgtggttgcttctcaagactggcctgaggttacaaagtatgcaggattggtgagtgctcaagcccatcgtcaagaattgatacaggatcttttcaaggtatggcaagatcccgaaagggggactgtctctggtggcatgatcagggagcttctcatatctttctggagggcaactggacagaaaccaaagaggatcatattctacagggatggcgtcagtgagggacaattctaccaagttctgttgtatgaacttgatgccattagaaaggcctgtgcgtcattggagtctgactaccagcctccagttacttttgtcgtggtccagaagcgtcatcacaccaggttgtttgctaataatcacaatgataatcgtgctgtcgataaaagcgggaacatactgcctggcaccgtggtggactcgaagatctgccatccaactgagtttgatttctacctgtgcagccatgctggcattcagggaacaagccgccctgcccattaccatgttctgtgggatgagaacaactttacggctgatgggttgcaaactctcaccaacaacttgtgttacacgtatgctaggtgcacacgctcagtatcgattgttcctcctgcatactatgctcacctggcagccttccgagctcggttctacatggagccagatacgagtgacagtggatctatggcaagccgtggccctccaccaggggggcgcaacaccaaggctgctggtgttgggaatgttgctgtgaggccattacctgccctcaaggaaaacgtgaagcgggtcatgttctactgctaagactgatgctgttaaggcagagctatcttttattattacagtatatcgtgaagactagagtattttttccatgtacttgatgatgctgagctaccttttattatgtcgtacgaatatatatgcgtggtactggttacagtaactttagttgtgtgttccatcgtcatgctggtctctagctggtgggcaggtggtgttacgtgaaaaacattctcttaaaattcatcaaatttggacatagacttgaacatatcaagaaaaagagtggatgtatttcacttacccccaa

SEQ ID NO: 22485 - DNA, 965 bp, Zea mays
tcgagtcagctacgtaggcccccttcccccctttctttctcgagggcgactggacaaaaacccaagaggatcatattctacagggatggtgtcagtgagggacagttctaccaagttctgttgtacgaacttgatgccattagaaaggcctgtgcatcattggagtctgattaccagcctccagttacctttgtcgtggtccagaagcgtcatcacaccaggttgtttgttaataatcacaatgatcagcgtgctgccgatagaagtggcaacatactgccgggcactgtggtggactcgaagatttgccatccaaccgagtttgatttctacctgtgcagccatgctggcattcagggaacaagccgtcctgcccattatcatgttctgtgggatgagaacaaatttacggctgatgggttgcaaactctcaccaacaacttgtgttacacgtatgccaggtgcacacgctcagtatcaatcgttcctcctgcatactatgctcatctggcagccttccgagctcggttttacatggagccagatacaagtgacagcggatctgtggcgagcggtgctacgacaagccgtggccctccaccaggggcgcgcaacaccagggctggtgctgcgaatgttgctgtgaggccattacctgctctcaaggaaaacgtgaagcgcgtcatgttctactgctaagattgacgctgcgctgatgctgtgagcaagcaattatcgttatggtggtgatgctaggacaccgttatgcaccggtaactttaataccttttgtactgtaactacttgtatggcattggaaactgtttgcgatatactcctattaagatgggcttgtcgtggattagattgcactattggaagccatccggcctcgtcccctccgtaaattatgtaaaaaaaaaaaaaaaaaaaaaaaaaaactcgagagagggccgcggtaccca

SEQ ID NO: 22486 - DNA, 3746 bp, Zea mays
ttttccacgcgttcggccgccccgtcgctcctcgaaggcgaagcaaagctaccaacgcatacaagagtgagagcagggagcacgagcgctctgagtgagtggaagacgagaggagttggagtcccccagggctagggtttcattcgccacccgcgccgcccttcccttccccagcatccgtccgccatggtgaggaagaaaagaactggccctggagagagttctggggagtcttctggagcgcctggtcatggctcctcacagcgtcctcaggcaacacaacagggtacccgtggtggagggcaacaccagggccgtggtggatatctgggccctggagtgccgccttcacagcacccaggtggtggcccacctgagtatcatcaaccgcttgactaccagggacgtggtggatatcagggccgtggtggaccaccttcacagcatcctggtggtgggacaccccctgggtctcaaccgcgtggctaccaggggcacggtggataccagggccgtggcgggccaccttcacagtatcctggtggtgggacaccccctgggtctcaaccacgtgactaccacggacgtggtggtccgcgtcccagagggggaatgccacagtcataccgtggcgggcatgtgggaggtagtgttgtaccaagtgttccttcaggtccatctaggccagttcccgagctgcaccaagccccagatgtccaacatcaagcccctgtggtggcaacaccatcttcgccaggagctggctcgtcctcgcagcctgggaaggctgaggtgagcgctggacaagtccagcaacagttccagcaacttgcgattcgtaaccaaagcttagccagccaagctggtcagatggcaccagcgtcaagcaaatctgttaggttcccattgcgccctggcaagggtacgcatgggtccaggtgcattgtgaaggcaaatcatttctttgctgagctgcctaataaagaccttcaccaatacgatgtatcaataacacccgaggttacttcacgcggcgtcaatcgtgctgtcatggcagagctagtaaaactttacagacactcccatttggatgggcgtctgcctgcatacgatggaaggaagagtctttatacagctggagcgttgccatttgcttcgaagacattcgaaattactctgcaagatgaggaagacagtcttggtggaggccaaaggcgccagagggtatttcgggtgaccatcaaatttgctgctcgcgctgatctccaccatttggctatgtttcttgctgggaggcagccagatgcccctcaagaggctcttcaagtacttgacatcgtgctacgtgaaatgcctactgccaagtattgtcctgttggtagatcattttattctcccaagttagggagacctcagcaacttggtgaaggtttggaaacttggcgtggtttctaccaaagcataaggcccacacagatgggtctttctctgaatattgatatgtcctctactgcattttttgaggccctccctgtaattgattttgtttctcagcttcttaatagagatatctcagttagaccattgtctgattctgatcgcgtgaagattaaaaaagccctacgaggtgtgaaagtggaggtcacacaccgtggaaacatgcgtaggaaatatcggatatctggccttactccacaagcaacaagggagttatcattccctattgatgatcgtggtactgttaagactgtggtgcaatacttcctggagacttatggtttcagtattcagcacaccactttaccttgtttgcaagtgggcaatcagcaaagaccaaattatctgcctatggaggtctgtaagatagttgaggggcagcgctactcaaaacgacttaatgataaacagatcactgctctactgaaggtgacttgccaacgtccccaagcacgtgagaaggacatcttggagactgtgtatcacaatgcctactccaaggatccttatgcccaggaatttggtataacgattgatgagcgtcttgcatcggttgaagctcgtgttctgcctcccccaaggctgaaataccatgatagtggcagagaaagggatgtattgccaaaaattggccagtggaacatgatgaataagaaaatggtcaatggtggtagagttagcagctgggcatgcattaacttctcacggaatgtgcaagatggtgctgccgggagtttctgtcatgaattggctttgatgtgccaagtatcaggaatggattttgtacttgaacctgtgctgtcaccttgctatgcaaggcctgaacttgttgaaagagcactaaagggacgctatcaagatgcgatgaacatactcgggcctcagggccgagaactcgacttgctgattgttatactgcctgacaataatggttctctttacggggatgtcaaaaggatctgtgagactaatcttggattggtctcccaatgctgtctgactaaacatgttttcaaggtgaacaagcagcagtatcttgcaaatgttgccctgaaaataaatgtgaaggttgggggaaggaatactgtgcttgttgatgctttggcaaggagaatcccccttgtcagtgacatagcgactattatctttggtgctgatgtgacccatccccatcctggggaagattctagtccttccattgcagctgtggttgcttctcaagactggcctgaggttacaaagtatgcaggattggtgagtgctcaagcccatcgtcaagaattgatacaggatcttttcaaggtatggcaagatcccgaaagggggactgtctctggtggcatgatcagggagcttctcatatctttctggagggcaactggacagaaaccaaagaggatcatattctacagggatggcgtcagtgagggacaattctaccaagttctgttgtatgaacttgatgccattagaaaggcctgtgcgtcattggagtctgactaccagcctccagttacttttgtcgtggtccagaagcgtcatcacaccaggttgtttgctaataatcacaatgataatcgtgctgtcgataaaagcgggaacatactgcctggcaccgtggtggactcgaagatctgccatccaactgagtttgatttctacctgtgcagccatgctggcattcagggaacaagccgccctgcccattaccatgttctgtgggatgagaacaactttacggctgatgggttgcaaactctcaccaacaacttgtgttacacgtatgctaggtgcacacgctcagtatcgattgttcctcctgcatactatgctcacctggcagccttccgagctcggttctacatggagccagatacgagtgacagtggatctatggcaagccgtggccctccaccaggggggcgcaacaccaaggctgctggtgttgggaatgttgctgtgaggccattacctgccctcaaggaaaacgtgaagcgggtcatgttctactgctaagactgatgctgttaaggcagagctaccttttattattacagtatatcgtgaagactagagtattttttccatgtacttgatgatgctgagctaccttttattatgtcgtacgatatatatgcgtggtactggttacagtaactttaacctgggttgtgtgttccaaccgccagctggtgggcaggtggtgttacgtgaaaaacattctcctctaaaattcatcaaatttggac

SEQ ID NO: 22487 - DNA, 4489 bp, Zea mays
ccagcgcttcgccatgcgtgccccaccgccccaccgcgcgcctgggcagggtggtaccacgcggtgctcgccatcaagcgccgctgctgcgagcacctcgacccgcagccgataaacccttttctcggcgtgcccaagtccttccccggcgtcaagccggagttccgcgacgcacgcgcgcccgcctcctcatcgttcgagcctctcctccaccgccgcgggtctctggagccagaccgccgcgcggtcgtccttcttaacaaggcagacctggtggacccatccgaaaccgaggtaaccaggcccctcctcctcagacccttcgttgtttgtgcgctgcgtcctgggtggggcggctgcttctggaccccgcatgcattaacttctcacggaatgtgcaagatggtgctgccgggagtttctgtcatgaattggctttgatgtgccaagtatcaggaatggtatgcgtgtcactcggaacttgaatatacatctgtttgtcattttgattttcatttgtgttatttgctcttcttactctcttttaggattttgtacttgaacctgtgctgtcaccttgctatgcaaggcctgaacttgttgaaagagcactaaagggacgctatcaagatgcgatgaacatactcgggcctcagggccgagaactcgacttgctgattgttatactgcctgacaataatggttctctttacggtatgttttcttccaaaaggcttgggcatttgctcaatgaataagctttgctattaattttcttctcattcttcaggggatgtcaaaaggatctgtgagactaatcttggattggtctcccaatgctgtctgactaaacatgttttcaaggtgaacaagcagcagtatcttgcaaatgttgccctgaaaataaatgtgaaggtatgtagttgcgctaactcttctaatcttgattttaacaccgattctcctcttaaagttatcatacttttaaggttgggggaaggaatactgtgcttgttgatgctttggcaaggagaatcccccttgtcagtgacatagcgactattatctttggtgctgatgtgacccatccccatcctggggaagattctagtccttccattgcagctgtaagtgaagacctatcctgacaaagaaatgctacctttcagttgaagctttactatttttttctcactgtttttctcctaggtggttgcttctcaagactggcctgaggttacaaagtatgcaggattggtgagtgctcaagcccatcgtcaagaattgatacaggatcttttcaaggtatggcaagatcccgaaagggggactgtctctggtggcatgatcaggtatgatctttattaagataagtgagatgcattcgctcctactcttacacgcttggattcttccagatacataacttttgttggttgtgcagggagcttctcatatctttctggagggcaactggacagaaaccaaagaggatcatattctacaggtttgtatcctttcatgagcaccttctctgactgccactccctgtatattaaacactttatcactttcagggatggcgtcagtgagggacaattctaccaagttctgttgtatgaacttgatgccattagaaaggtgaacttgatttgaatgcattagtttggtaactggcttcactttattttttatctctgaccaccattgtgaaactatggatataggcctgtgcgtcattggagtctgactaccagcctccagttacttttgtcgtggtccagaagcgtcatcacaccaggttgtttgctaataatcacaatgataatcgtgctgtcgataaaagcgggaacatactgcctggttagttctcgatgtgtccttcgttgcattttaagctttattttataatctgaaattctgaatgtcctaaaactctttttttttgtggaaatataggcaccgtggtggactcgaagatctgccatccaactgagtttgatttctacctgtgcagccatgctggcattcaggttgggtttccctgtcccatatctgaatctcattacttgttttaccaagctaatggggggtcctttcagggaacaagccgccctgcccattaccatgttctgtgggatgagaacaactttacggctgatgggttgcaaactctcaccaacaacttgtgttacacgtaacgttttactgctcccgtccattgctttagttcttttgattgatttcaaagctgaagatgaacctttttcaggtatgctaggtgcacacgctcagtatcgattggtaagttctagttggcatttgagttcaatttcttggtcaccgttgaggtacacagaatgctgacccgcaatttggatcggttgcagttcctcctgcatactatgctcacctggcagccttccgagctcggttctacatggagccagatacgagtgacagtggatctatggcaagccgtggccctccaccaggggggcgcaacaccaaggctgctggtgttgggaatgttgctgtgaggccattacctgccctcaaggaaaacgtgaagcgggtcatgttctactgctaagactgatgctgttaaggcagagctaccttttattattacagtatatcgtgaagactagagtattttttccatgtacttgatgatgctgagctaccttttattatgtcgtacgatatatatgcgtggtactggttacagtaactttagttgtgtgttccatcgtcatgctggtctctagctggtgggcaggtggtgttacgtgaaaaacattctctaaaattcatcaaatttggacatagacttgaacatatcaagaaaaagagtggatgtatttcacttaccccatcctcacttcttgggctcgtgatgaaaagagcttgattaataaattccgaaggaaatgatatttttttttttttttttttggcatcgtcagcggcggggtcaccgtaccgttggtattatattatactgaatacgtaattaattaggtgactgaaaatatgacgatgaggtgacgcatgttcgtctcatctgttgactgcgaatagccgccggctgtcggcggcgtgcagcttcctgccttcttcgtcttcctcacttcatctttcttttggctgcagcatcatcatcgtcgactctataaattaatgtaatgactgtccatctctcctcccattgcttaccttccttgctccattctatacgtacatagtagtactgaatcatcagatcacaccgaccatggccatggagacgcagacgcccgagaccatcgtccctccgaccaccatccctcctcttctgaccccctacaagatgggcgcatttgagctggaacacagggtggtgctggcgccgctgacgcggcagcgctcctacggcaacgtcccgcagccgcacggcgccgtctactacgcgcagcgcgccacccggggcggcctcctcatcactgaggccacgggcgtctccgacacggcgcaggggctacaccgacacgccgggagtgtggacgcccgaccaggtggcggcgtggcggcccatcgtagagccgtccacgccaagggcgccgtcttcttctgccagctctggcacgtcggccgcgtctccaccacggcgctccagccgggcggggccgcgcccatctccagcaccgaccgggccgtcgcgccgcagctcagcttcgacggccacctcgagaagttctccccgccgcgccgcctggaggcgcgcgagatccccgccatcgtcgacgacttccgccgcgcggcgcgcaacgcgctcctcgcgggcttcgacggcgtcgaggtccacggcgccaacggctacctcatcgagcagttcctcaaggacagcgccaacgaccgggacgacgagtacggcggctccctcgagaaccgctgccgcttcgcgctcgaggtcgtgcgcgccgtcgccggcgaggtcgggccgggccgcgtcggcgtccgcctctcccccttcaccgactacatggactgccacgactccgacccggaggccctggcggggtacctcgtccgcagcctcagcgacgtcggtgtgctctactgccacatgatcgagccacggatggccatcgttgacggccgacgccagatcccgcaccgcctgcgcccgttcagggaggcattccggggcaccttcatcgccgccggagggtacgacagggcggagggggacaaggtggtggaggaaggctacacggacctcgtcgcctacggcaggctgttcctggccaacccggatctgccccggaggttccgcctccccgacgcgccgctcaacaagtacgaccgcaccaccttctacacctccgaccccgtcattggatacacagactacccctttctcgccgacgccgacgccgacaaatttttcgtccagcttccgccgccgactcgccgcgtgcccctcccctcccggcctccccagtcc

SEQ ID NO: 22488 - DNA, 964 bp, Zea mays
  misc_feature (941)..(942): n is a, c, g, or t
  misc_feature (945)..(950): n is a, c, g, or t
  misc_feature (952)..(953): n is a, c, g, or t
  misc_feature (963)..(964): n is a, c, g, or t
atgtgagggtgacaggtttttggccaagtttcggattgtagcggggcttgagtgcccattagagaggggccgtgggctttcttgggggtggtgatgtgccagccttgcaggttgctttgtgtggtggtccaagaaggcgtcatcagcggcaggttgtttgttaataatcacaatgatcagcgtgctgccgatagaagtggcaacatactgccgggcactgtggtggactcgaagatttgccatccaaccgagtttgatttctacctgtgcagccatgctggcattcagggaacaagccgtcctgcccattatcatgttctgtgggatgagaacaaatttacggctgatgggttgcaaactctcaccaacaacttgtgttacacgtatgccaggtgcacacgctcagtatcaatcgttcctcctgcatactatgctcatctggcagccttccgagctcggttttacatggagccagatacaagtgacagcggatctgtggcgagcggtgctacgacaagccgtggccctccaccaggggcgcgcaacaccagggctggtgctgcaaatgttgctgtgaggccattacctgccctcaaggaaaacgtgaagcgcgtcatgttctactgctaagattgacgctgcgctgatgctgtgagcaagcaattatcgttatggtggtgatgctaggacaccgttatgcaccggtaactttaataccttttgtactgtaactacttgtatggcattggaaactgtttgcgatatactcctattaagatgggcttgtcgtggattagattgcactattggaagccatcaatccagttctcttctgaaaagtatgtaggtacgtacggttttcaacctaaaaaaaaaaaaaaaaaaaaagctcgagggggggcccggacccaatcgtggggggaaaaagagaggaaaaaacnnccnnnnnntnnttttgttttnn

SEQ ID NO: 22489 - DNA, 1985 bp, Zea mays
ggccctaggggcctttttggcttttttttttctcattttttttttcttttctatgcctggcctagcaattctctgaaaagctttattacatgttcatcgagtcgtaactcgtaacaccgtgtctcaccagcaagcggagcgcccatacaaggtaaataacgtatggtcgccagatgaggttttcagagcctaagaccaggaccttttctgagcctacaaacatccagaggtacatgctcgaaatgtcatgagcagcatgtgtgttttgttacattgtaaaatcaagcctctgggagcttgaagatggctccgaaaggtttccagaagtccacctcttcagcatctccagagcagccttcggttgatccataggtaccatgtgaccagcatcgtgaaccttcaagaaactcaaaggaccgtggctctttagaacgccagcttctttcccgtcgactgtgaagggcttctcggatgaggacacaaaagcttcctttccagaccattccatagagtttacccaccttgagttcccaagccagttacatatgaggtcatactctccagcataaatcaacactttgatgtcgctctcaaggagttcagggattccaacttcaaggttcctcatccaatctaatagcatggcctcatagacagttgggctgcatgaaacaaactctatatctccaacccctaggctctctctgacagatttgaggttgagaaatttctccaaattagagaaatcatagcataggcttccgatgcatggtttcctgatgtcataataatttttattgcctatgattgtcctgatggcactgaatattgtattgcagacaaagtacgcagcaaggcaagatacagttccagaagtaccacaaagcttgaccgcgaattcacaagttggaactattttattgatcctgttaaattgtgtttttgtaattaatcccatatccaatgcgtaatcagggtatgccttgtactgtattgctggatctgttagtccgttgccaatagcaaaacccttcaagttaatgtgaatgccctcattgttcttgtttccctggtgcacacgacttgcaaaggcaggaatgtaatgcccagcatatgattccccagttatgaagaaatcatttttagcatactttgggtgctcagcaaaaaaggcctgcaggaagtcatatagatcattgctaatagtagcttcgttgtggcgagtgtcacgcgaatccgagctgtaactaaacccagttccagtgggctggtcgacatagataagatttgatgccttgtcccaaccaaaatcattccagacgagcgacaagttgtccgctatgttgaaggggccgttctcgtagaagagcgcgagctcgctgctgcagccgggcccgcccgtgagccagatcaccacggggtcgtccttgtggcccctcgactcgaagaagaagtagaacatcctggcgtcgtgggtgttggggaggcggtaataccccgcgtggtggccgaggtcctccaccgacgtggcggcgcctccgttcgcgaaggacgcgatgcggatgggcctctcgacgagggtccccgcgggggcgagggcgccctctacgccggcggtggagaggggaggggacgcgtcggcggggtggaggttgagcgcgtggatcaggtcgacggccgcggagcgggggaaccggcgcggagacgaggaggggaggcggaggatgctcccatatccattctcccacgagccgccggcggcagcgacggaggcaacggccaggaggaggaacgggaggagtagctggtcggcgggccgcatgattggtccggcctccggcgacatatggcgatgtggggggagtgaatcagaagcgggggcggagtcttccttcaagagagcggtagcgcgagaggagccagccgccgcgtcactggattttgctcgggccccaccgcccacaccggccggcctcgaggtaccc

SEQ ID NO: 22490 - DNA, 2155 bp, Zea mays
aatatcgcatatcatacaaacaaattctaattacaagttactacaaagcaagactacttgtgctactccagcatgcattttctctgtaaatgtaaattgtgtaggtacacgctgctgcatctacagtacgtacgggcacaagcacaaccaccatctttacaatcacaaacccaagaaactacaagctcgactgaagattcaccgtgtaaaatggaacgtgcgtggaatcgaatcacctgactacagctcgacgaacactcagatcacttctccgtcgggtggcggtaggcggtggccggcccccgcctaccgtgtctcggcgccgagggacccgtccttctgaagcttcaggctcaggttgctgaaccgctgcctcgagtactgccgggatgccttcctccagtcagtgccggccttcatcatcgccgcgaactcgtcgtagcttattttcccgtccttatctgtgtccacgtctcggatgatgccattgatgatgtcttcatcggttccctccagttcatcagccagtgcctctctaagctcttcgatctctatgtacccgctcttattccggtcgaagtatgtgaaggccttttggatgtgctcatcgttgcctatttttctcacatgaacagacacggtgacgaattcctcgtaatctagggtcccgtttttatcgatgtcagcggcatccatcattatctgaagatctgaatcaggcatttggttccccagtttacgaaggcccgccttgaattcctcgaatgttagcttgccattcttgctcacgtccatcttgtcaaacatttgctttatgtcagctacttcctccactgacagatgctcggcaatcacccttaatgctttcttctttaacttgttcatcgcagcaaattgttgcagtcttgctcggacagtatcaccaagagaaatgtctggcatctttttagagtcatgtaaccatggatgctcaagtacttgtgctgcagtaaaccgtgtcaatggatttgggtccagcatccgcctgacaagatctttagcaggctcagatactctgggccatggttctcttttgaaatctaccacagatcgtataattgcctgtgctactccctgttcagtttctgcccaaaatggtggtacaccacagagaagtatgtaaagtatcactccagcactccaaacatcaacttcagggccatagtttcgctttagaacctctggagccatgtagtatggactgcctacgatttcagtaaatcgctcaccaggcctgaagaacactgacagcccaaaatcgattgctttcagaggggaactctccttcttgtttgcatataaaaagttctctggtttaagatcccggtgcatgacgccatgcctgtggcacatctggacgacctcgacgatggtgcgcgtgacggcggcggcggcgcgctcggtgtagtggccccgggcgacgatcctgtcgaagagctcgcctccctcgcagagctccatgacgaggtgcacggcgtcctcgtcctcgtaggcggcgcggaggctgacgatgttggggtgcggaggcatgtggcgcatgatgtccacctcccggcgcacgtcctccacgtccacgggcgtgcgcagcttgcgcttggagatggacttgcacgcgtagcgcgcccccgtggcggactccgtgcacaggtacgtgacgccgaactcgccgcggcccagctcgccgcccagctcgtactgcgcgccgaggtcccgccccgtcgggtcccgcagcaccaccaggcccgggcgcgccggcgccggcgccgccccgcggttgtacgccacgttgtaggggttcgtcttctgcttcggcttcttctggcggctcttgccgctctcctccgtcgtcgacggcgtggcgcagcagttgcccatggtggtcgccgcggcctcctatcagcagcagcagcggaaatttgggggaaatcggccggacccccggcgagctggtttttcaagtttcggtttcagcggcgacggcggcggcggcgactgactggaagcggacaactcgaattggaggtggggggaattcccgtggccttggtccggggcctggccggggggccgggggcggagcgggggcgagtccacgattctttccgacccggccggc

SEQ ID NO: 22491 - DNA, 1929 bp, Zea mays
ccggccgggatcaaattggtgattgaagaaatggtgaggaagcaggaagcaggaagcagcagcgctggtcatgctcgtgggctcgtggcatgataaaatttctgcccttccttaccttcaggttaacttttcaagccaggcccaagggtaaagctggtgggccgacgattggaacccacacccaactcccaagttgcttgcttgatttcgccgagcagagatcgggtcgagtcctacgccgacgccggcgacgaacaaggatggtgaaggcggtgctcggcgacgaggagcacctcaaggcctttgaggaaacgctggcctcgccctcctctcctccatgtcaagcccaggtgggcctcgtcgtcggcaagctcagctcttcctccgaccgtgccctcgtctacgcgttgctccccacgccgctcaccgacgccgccgcccccgcatgctctctccgcgccgcccccaagtccaagccttccaagggcggcggcaaagctccttcctcctcggacgcctctctcgacttcgatgtcgaatggatcgccgagcacgcgcggcaggtgtctaggatgctgctcggtggtatgagtgtcatgggtgcttacgtatgggcttccgaggcatcattcaaggccacatcccctgctgtcctgtcgcaggtcattcgagcgatttgccaagcttgctatggcagtgcatccggtgtgaggctgctcgtccacatttcttacagtcctcgaagatgggcctgccgtatatgcgaggttgcatcaggaagtctgcgcccgtgcgattttaagtacagcaaactattagcttctcttcaaactttcagatgcacatataattttgagataaggttgacatctgttcaagctgagccgtttaagaaaattattttgaaggcaatcagtcatctcacagaggaagtgcagaatgccagagctttggtagatgggcaactgttttcagaagagatgaacataagtacagaggacccacaccaagttgattttcttgtgccattcaagaatgctgtgcctgttgaagaatgcagtttagagggagttgctgggctcattcgctttattggatctgtcagcgccttggcatatttaggccctaaagaatctatttcagaagctatatctgatctaaaggcggacatcgttacaagtctaaaaagccggttggatatcatccttgatgaggcagatgatggccctgccactgctgaagtggagaaatcaccatctcagaaggccactcaagttatatttcatgagttgagagaaccttacagtttttcattcccgagaagggtcctgataccttggctgagcggcacctatgtttgtgattacttgcaacaaccagagacagcagaggatgcagtggatcgcttcaaggaagtgataggtgcactggaaacagccgtggagaggtcttcaatcctggaaccagaaagcgcagcagcagcttgtagcgtactagaatccttttgggatatggtgcctggatctggcagcggaggacaaggtggatccagcaagctgaaggacagtcattctatacagaaggatgattcaagcaaaggacaaggcggtttgaatttcagtatcgtagccgctctgattgtgctactggttgctctgatagctggactgctcttcactggttccgccggatacccaatataatacctacgtaactaactgcgctgtaccccaccagtagatgcgaaaagcaaagatgttagaaactgttgaagtggagagttgaatttatttaatgttagaagctgttgttcacatctctattgtgttgtgcctgcctgtctaggctatttttgatgagctattggggctcccatggacgagagaatccatacgtcattcctccaaaaaaaaaaaaaaaatttaggac

SEQ ID NO: 22492 - DNA, 2087 bp, Zea mays
  misc_feature (1921)..(1921): n is a, c, g, or t
  misc_feature (1942)..(1942): n is a, c, g, or t
  misc_feature (1968)..(1969): n is a, c, g, or t
  misc_feature (1980)..(1980): n is a, c, g, or t
  misc_feature (1983)..(1983): n is a, c, g, or t
  misc_feature (2030)..(2031): n is a, c, g, or t
  misc_feature (2040)..(2040): n is a, c, g, or t
  misc_feature (2047)..(2047): n is a, c, g, or t
  misc_feature (2050)..(2050): n is a, c, g, or t
  misc_feature (2080)..(2080): n is a, c, g, or t
gcttttttcttttacaaattcttcaacaaggatactttactgaataaatgttgcaacaccttcaccgttgaatttacaatccatactagtcctgaagtacaagggaatgagaatgccccatgccatagatcacgggttttgttttctaggagtacgagctggcctcttattaacttacaagcacataattacggagtattgcctaaccactatacatgatacattggattttgatggtacatcctactatatacatacaccctactataaccaatataaatggctgcatcttatcgaccaaatgtagaagctgaaagcagcatcaccagattgttttactgctcatggaagtcctcgtaagatgacctggaggagtcactttgatatggagttgtttcccgcggactagatgggagtgaatcttgcatcgacagacctgggttcttttgcacccttggacggaacttccttcgtatgagcttcttggcctttgtaattgtaagctgcctcgcaaaagggtattcaccatcgctctcgctccattcgtcttgatattcgtcattatgcccttcaccgcgcattgtccgaatcacaaaggccttcgctttacggcgctgtgtattgaaaagccccctaattgacgtgacaaatccatcacctgcaccatcgcctggccggacgcgtgggaagctgttaattgatcatgtcttccaggttgaccaacatcactgtcactcaagttaagatcattttcaggaatagaaccctcaagtgtttccctatggttgctaaacttcttcccctgctcaaaattgacaccattagttaccctttctgaagtaattattggggaagggttttccctaaaaacctgaagaacgctggtatgaacaaaaccaccagacagtttggaataatataaccaaaaatagtagttatgttgtctagatttttcaaacagagaaggtaccatgtgatttcagtaactcttaagactactgagtatcgactaaaataacatgaaacagcagagatttagatgttagcacaagaagcattacacagttaagaggcaaggataatttttcagagacaggcccagtaaagttgcagaaagagaaaacccacatggaaattaccacttaggttgtcgaaccaacaatcttaacagaagtacagaacaagtgcttttgacatatataaagggataatgtggatctaagcattgtgcgcaaagattttgtaataacaaaatccgtgcccacacagagcacttgcctgcattccggttaccgacttcaaaactccccagatgatatgttttttgactctagagaatagtcgcctccatgtaccagtaaattctgccttgtggaaagtatccataagcaaccttaggtcattaatagcaagccttgatccctcgtatgtaacaagaagttcaacctagaacatcagcagcatttaagacaatctgaatgaattgttataggaccactggatgcagtaataaagttcataccttgccattcttgatgttatgaaatttccattgacttccgaggttttgtcttcttttcatcattagacttcccaagcttcttttcttcgtgagatagacgtccagacttggcaggcttagaatctttcgttttacttctccacatctcacttcccacaacagggttctctaagacagaattgctagcatctacttttgaagaaacaattgaagaattcaggagtgataccacatcattacttgcaacactttctgcagcgctttcttcccaattcctttcaaatgaagacgaccggtgcaactcttgatgcgaaccacataccatatttgcttttatactctgaaactttgacacacctcgtgaggttatcgctgagggtatacccttgccaaccttgnaaacatttgttgatggtagantacagttgtacttgatttcccaggannagttcatgatnctnctgacagaatagctgctagaagggtaacaggcatcgacaccagaagnnagagccttncttgttnttnctaggcccgggttggatgttgaaactactnccaaacc

SEQ ID NO: 22493 - DNA, 1592 bp, Zea mays
cacccgtgcggtgccggtgaggtcacctccatcgtcagtgaaatctttcgtttcttcaccactgttaagttcgccggggccacgagcgcccgtgaggtcacctccaccgctaacgaaattatcacctcctccaccaccgataaggtcgccacccccaccacaagcaaactcacctcctccatcagctccacgcggcccacctcctccttcgatgcaatcccctccaccgcctgctccagtcagctcaccaccaccacctataaaatcaccaccaccggctccagtaagctcaccacctcctctggcgcaatcccctccaccacctgctccagtcagctcactaccaccacctgtaaaatcacctcctccaccggctccagttagctcaccaccgcctcctgtgaaatactcttcaccacctactccagtcaactcaccgccaccacctgtaaaattacctcctccactagctccaatggtttcaccatcgtctcccatgaaatcccctccaccaacggcacccgttagctcgccgccaccgcctgtaaaatcacctcctccaccggctcctgtgatttcaccatcacctccggtgaaaatccttccaccaccggcaccagttagctcacctcccccgccagttcccgtgagctcagcacccccatttgcaaaatccccaccgccacagttcaaatcacctgcaccaccaacttcgagaagatctccacctccaccggtgaagcccccgccaccaccgccacttgtaagctctccaccactgccaccaatgacctccccacctccaccaacaccggcgagctcaccgcctcctccagtgaggtcccctcctccaccggcgccaatcaactctccacccccaccggtcaaatccccaccaccacctgctccggtgagctcgccacctccaccagccgtcccatcaccacctccacccgcaccatcatcacctccaccgtcggcacctgaggagttcatcttgccaccaatcatggcgcagcagtatgcgtcgccaccgccgcctcagttccaaggatactaagcggtgatcacagcgcgctctactgacgatgagagtaatcgcgatgagggaggccaggagaagcagtgacaagtcgatcgcaccatgcaatgctctagcgacctgaattgaatgctatcggataagcgcatgtacgtttgtgcgtaagggtataacagcataggtaatgtaacgagtgtgtgcacatgtaacatgatgaccgagaagagaaacatgcaaatggagaaggaattgtttctgcctttctaaaaaaaatataaaaaaaacaggaaaaacttttgcacttagcagagttgcgaagagttgtggctcactaaaatgaaaatggttttgccccgagttcacactttttggccgccatgaggttctcctttgtaacggcaaacctatttgcagtcatctaaatagcaggctgctttcagacgaagaagaacaggagctgcagatccttcctgtgccttctgacatacacgtctgcatacatggatatgatcaccgtcatcttcgtagcaatgctcttctctggggactt

SEQ ID NO: 22494 - DNA, 1030 bp, Zea mays
gcgtggtcgcggcgaggaagatgaagacctggagcgcggctcgggccgaggaacaagaagacggggattgcgcctagctagcagcctgacgccggtatggttggcaattggcatctcaggcagcaagaagttactgctggagagatgcatgcatctctgactgacaccaacgacagagaggaggaggtggtgatgtggtggcctcgaaagcaacatgactaatgtttgtggtatacagtcactaaatctctccaagatagcacttgcacacacaccatgaactaactaactagccatgatcgatatatccatgtgtctgtgtgccactgccagcaacggggattcatcagactcaaccgtacatgctatgcgacgccaccacacaaaaccaactgcaaaaaaaaaaggtttcagggctagtatatatgtagtgatcgatcatagcaggttgcatgccgcgcgcctcggcagatcgagttgtctcgcgccaagagcttgctttgccatgaatgaagaagaagcctgggagtatatattatgtactggtgcattggatcggccatggacggcggatcgagcggatgtgaaggtccgtgtgtggcggtccggtcacgaggcgctgcagatcctggccttgtcgagcatggaccacatgacctgcacgtcctcgtacgtgcacgccatcacctcgccgtagagctgcgacatgcttatctccatctcgccgctgtgctcctcctccatggctgatgaagaagaaggagaaggagaaggagattgctgctggcgtcgttggtggtggtggtggcggcggcgcggcgtcttcttgccgtcgcgctgttgcgggctgagcatcttccggaagggcgacgtgatggtgcgcacccaggaacccatgttgatgttgatgctacgctagatcgatgctagcttttctatcgtacaaacaaaaggactatacctagctagcagctatagggatctgtcgaacgagtacactactgtgctgtggtaagcacaacagctccct

SEQ ID NO: 22495 - DNA, 1697 bp, Zea mays
atctacaaatctgcctaaatgtcgtttttattctgctgttgcttcagttaataatcgacacctacaatgtcatgcgcatgggggtaagtcgatgatgagctgttggtgcagaaaataatggagcaaccccaaggtcacacaaataaggcagggtacagacatgccaagtttttttttttttttgcaaaagtgtggttactatttctaccatagcatcagaagcctcatgtagtcatgtttctgctacaattgtcccgttgttttaacaaacaacagcaagcacgagcacggagcacagaacagtggtcagagttcaacaagttccctgtacattcagttcagagaccagaaagcaaggcatcataaaacccattccaagaggggcttctttgtctacaagatcttgtccgctgcgtcttcacaagggggatcagattcagatggctcgtgccaaaactagaacaaaactcggtccatcggaatccgaagttcccttatctgacggctcatcatcgctgaaaactctctcccttgccttctcagacatcttctcccagttgctgaagaacgttatgacggcaagaagcaagaactgcactatggagccgcaggaaatgcccatccaaagccctttcgcttccatcttcagaacgaagccgaggaagagtgctgttggaatcccgacgaggtagaacgagcccaggttgacgtaggcgcccaagtgctgccacccgcatcctcgggcaacacctgacgaccagggaaaaaaacaagagggggttagcatttactaacaccaatgtatcttgagaacaatcagaatgcttctgctgtgaagttcagtggtgtcagtcatcaagcatcacaacatgacagccacactcttgcatgtagtttcaagttcaggtttagctgttcacgtgcccaaacacacttcagaagaagtaagccaaaacatgtagcagacagaaaataccactaacagctaggagggaaaggtgtaatttgcatacatagtgacgtggagcctgcttacggtaacatctctgctagatgcgtgtcaatgaaaacaccggcatccatgttcacgtaagagcccatttttcgaagggacaaacaagtgactccccgagtaacaaagtattgcttccacaacacagaatagcattagtatcgtggaacaaagtgaaaaacagaatgggcatcttacctggtatacatgacattggcatgactgattgccacctgacagggcttgttaccaaaattaagaggagcacaccgattgaattaatgcaaatcaaactatgggggtaaaaggtgcagtagtttggtatggagagcaaaaaacgagtttgtttgtttcataacttcacaggtataattcgaagatgcgtttgcgaggttccgaaaacatgaaaatacttttccttcatactttgatttgatttgaagagagagacagataaacgattgaaggaagttaagagatgtaacctgatagaacaccttgtagactgtcagcagcaacggagacgcacacaaagggaaccattgcattgacatacgcgacgacatccttgtcgctgctatatgcgtagcccaagatgtgctgtgacgctaacaatatgactgtgaccataactgcttccatcactggcatacacatgatggcacgaacagatgatcgagctcct

SEQ ID NO: 22496 - DNA, 1984 bp, Zea mays
  misc_feature (1489)..(1489): n is a, c, g, or t
aatataagcgctttccaggccgcgtactagaaaatcgggatggacgttgtattttggatggtgggctaagcggcttgagaattaagcaaggtgtttgggtggacttatggcttagtttcaccaataagcgggaaataagcagatacaaacagggccttagtgaaggtaagcagtaggcccatgaacaatggattgtcaatacctttttcttcatatgcatttggactttggagatcattaccagtgcctgcttttggcaattctttcctaagtaaatatggcacaactactttctcttatttgtagaagcaagcttgatttgaacatcatctgtctagatcatttttgtcgcactatttgcctattgcaggaagacttcatcggacttgttaattatgtttatgtcttcctggccaaccattttgctttcttgtaaatatcagatggttccacaagaaaggcttttgtcgtgttggtcaggaaaactgggtgagctatttactaagttgtggcctaggaaagatcttatgttcttactaatatgatgtacgaacgctggataagttgtgtaagttggtggtgtgctcagtaggttggtagaaaaggttgtggtgtgttggacttttaagcagagtctcaaattatgttatttgagcatgtgtcacttggtccttgaacttgcctgtgatgtaccaagtttgcatgtgaaatttaatctctaaagagatgaaactgtgcactgccggatgaaaattcatctatctcctttctgctctacatagtcatcaatccattcataaccaagcaggaagccttccctgcaaaaaatattctaactgccaagtgccaatcaaggaaagacttggttatgcatactgcatggatgcaacgactgtgggcatgcagggatgggatgaaactcgcgggaaccggcgcggtgctgtgaaactgtgcattggatctgacctggtgcagctttgggagtccagggagacacgccggccagtcattacaccgattctcagggagatagaggagctgactcttgcatgttactagtatagattatgtaatagtattgcccatgagattgctaggcaggctattggtatgactggaacggcggaatggcattatattctgaagccccggccagcatccgtaacctgttggagtctctgattgcaatcaggatgtctgatagcgaatgaatctcgaaaaaaacaagactgcgctgctgttgcttcggcaggcacactttttaacttttaagcatgcattatcagagacggcaccaagctcgatgctgttgccatttgccaagaacaagaacccttaaaacccatgcatgcatactaggatggccggcgcgccacctctgttcatcttgttgcatctgtctctgctggtcatggttccctttatttcttgagatcttgcggaatgctgcagttggaatactatggaagtgcaagcggattggcatcgnaatttatgtgaagaaaagaagatgcttcgggatttatctctgctatgttttatcttcttattaatagatgagtgcccgtgcgttgtaatgagaacatataatatcactataatttatatacaaatgtgcgttatactgttataagaaaatgtttcataatctatttatgatcgtaaccaaacataaatttggttattttaatctagctatttcaccattacattgcaaccatcaggatcatacagccttatatatatatatatatgttagttgagtgccgtgagttgtaacgggaccactacattgcaaccatcagtaccatgccaactactatatatgatagtacaatacacgtgtgttgcgtcaatacataaaattattgataaaatattaagactatatagaacaaaacaaacaaacaatacaaacaatgttgcaagggttccatcaaacaatgtaacacacactaacaagtatgtcaccatatgaaacaaa

SEQ ID NO: 22497 - DNA, 2216 bp, Zea mays
aaatatttattcccttttcccccctttttttttttttttttgaggcacaggaatgatcaggacatatcattaatacaacctagaaccttgtgttgtaatcacagtatataatacatacaaaagcaatgaactgactaactccagacacaaccaagaaatgaatatcgaactgggggcggcaaagcgcccccaaacacaccaaacgctgcaaagttaactgggttctacttctaacatccatgtccgtggtaaccaacattctcggctttgaggtcacgtagttgataatatacaccatttgcagctcctcagctctttgaaaagatttggtttcgttcatatacatccgtacgacgctaactgaactatcactcaggggggaaatgtgatgaatcattttgagagctggaacctccctgttggcttcttttttctccacccaaatatagcatagtagaagagtgtgaggatggcaagagcaacaaagccatactggaaaacattgtacttgtaaagatacttaattccacgaagggattgcaatgtgtggccaaagatctcttgagcagcagttgcttgtgcataataggcaaaagccgtggcacagaactgaatcacactgatggagcaaagtagtatgagcccaacattaaacagaaaggagttcattaaagtgcctccccatttcattgggtgaattgtgatgaaaacaagtttcaaaccaagcatcatctccccagcaatcactgcaataaggagatagaagcaaaagaatgcgaaagcagcagtcccaaggagaccccaaacaccatccaactttatgaagacttcattcaggaaagaagatagaggaggatcaatcaacaagtatatgacgatatgtgcaacccaagctattgaaacaattaacccaacaacaccaaatataagttttccaatgtacccaaggactgtgaacgcccaagtagcctctgcctgttctccttgaggatacatctcttctagagccttcatgtcatcttccagaagtagtaactccttctctacagccttcacgttttttcgccatttccggcccttgttcccacttctttcttcttggtgaagagcttcagccgcctttttcagctccctggccttcttccccaattcagttgcttcctttatatattgtgagcgtgtaattacagcttttggacgccgaacaaatgagaatataagtcccaatggaaggcaggcaattccgacaccaccaaatatcgtgaaaagcacagatccaacaattgtagtaagagcaaccacatattcagggaaggtagcacgcattgtccaagttgtttgcgagttagccggtgcagtagaagccgcacactgacgagtcaatggactaatgcacggctggccacttgagaatccagaaaatgagtttggaaatgtctggaccgaggaagataggtgcctgacagtgaagtccactttaccaacaagtccgtataggatgccgaggacgaggccgcacactaccgcggacgcgacgacccagatgagcgcggtcctgagcctcttcccgacggacttgtcctggtcgccctcgtagtagaacattgcgaaggggatgacgaggaagacgaggacggcgtcaacgatgtaaacgacgagccagagcgtcctcatggggagcgtgaggctgcaggcgccgttgtagacggccttgcggcatgcctggcggttggcgacgtcggcggggagcatgaggatggagaggacggcgacggtgaggccgagcacgacgacgagcttggggaagtaggcctggttgacgtcgtcggggtgctggtagttgacgagaaggtagacgctgacgagcagcaccagcacgctgaccaccgccgccacgatcaccagtgccacgttgaagtcccccatcggggcggcctccgccggatctcgcccctccgcctcctactgctagtcctagtagggtttgggcagtccccctcgctccggcggcgccagcggcgggagagtgaggactgaggagggcaccaccggcgagcgggatctgggtaggcaggtagcgccgcggggatgtgggtgcaggaagcgagggagttgcgggctagcagcagcgggtgcggtgattgacgaccccggcccggccggccccccgctccccggggcgaggcgacttccggccggcctcgaggtacccaatg

SEQ ID NO: 22498 - DNA, 4068 bp, Zea mays
  misc_feature (3082)..(3082): n is a, c, g, or t
  misc_feature (3398)..(3398): n is a, c, g, or t
ggatcagcctacttaggtaaacacacaccatcacaaaactgaaaaggtttgacattgctgaaagttaggaacttgatgatatctgtttatcatttgatgacataaatgtgtatccataatcatcgcatgttgttaattatcagaaatttgtgcaataggatctgtatataaggtaaaaataaggtttccatcaaggcataccatcctgcgcattgcaactaccaaaaaagttgtacagttttgtctgacggtcatataactgtaaaacaaggagacaagctaatcttgttccgtaaactaaataaaatcccctgagggaaagaaacacatatacacagtagaaagaaatataaaccaagttcatgaaacacgggaagagaacaaggtaactgaattctgggtttgggcagttgtaggcttgtagcgataaaagattgaattaggatagggaaaaaaaggttcggagctcaaagatgtcgcttcaatccgaacaccaatgcagggaaacgctggaatccaccacaaggttcgggcaaaggacaccacttttttttaattgaactacactagaaatggtactccagtagctttcaggatgtcactccaatcctggagaaatcacaagagcattctgagtggaggaggtgagagagaatgggagaagcatggattggtccgcgcgcgcgcaccgtataggatgccgaggacgaggccgcacactaccgcggacgcgacgacccagatgagcgcggtcctgagcctcttcccgacggacctgcagggaaggcgggtccaaatcatcagcggacggatggaagaagagaaggtagggaaacagcgaggggggtgaggttacttgtcctggtcgccctcgtagtagaacattgcgaaggggatgacgaggaagacgaggacggcgtcaacgatgtaaacgacgagccagagcgtcctcatggggagcgcgtgcctgcaggcgccgttgtagacggccttgcggcatgcctggcggttggcgacgtcggcggggagcatgaggatggagaggacggcgacggtgaggccgagcacgacgacgagcttggggaagtaggcctggttgacgtcgtcggggtgctggtagttgacgagaaggtagacgctgacgagcagcaccagcacgctgaccaccgccgccacgatcaccagtgccacgttgaagtcccccatcggggcggcctccgccggatctcgcccctccgcctcctactgctcgtcctagtagggtatgggcactccccctcgctctggcggcgccagcggcgggagagtgaggactgaggagggcaccaccggcgagcgggatctgggtaggcaggtagcgccgcggggatgtgggtgcaggaagcgagggagttgcgggctagcagcagcgggtgcggtgattgacgacaccgaggggagggagacacggtggggcgaggcgactgagagaggagaacaacagcgtgggctaggctggcgcctgtgagtgtgcggtggggtgcgttgggttcgccgctgttggagcggacggagttggggggccagcgcacgccgttttggcgttaatgactggaaaatcgttttacgggttctacagaaaatcccttttgtatcatttgatacgatttcttcctcttctatgtcattatcagcggcatagaaagattagaacatgcaaatttcgtactcttaaatactacccacgataacacagaggataagaaaatacatccaagtggcattgaaggtatcaacaatgacgatatgataatggataaattataatagcatgtaaagaattttctctattatctttatgcctgtactactcttcaaatactcatctcgtgatatctttgtgttaactagttctccccaggatgtctttgaagttaatacgtctactccattgtcataaattaatatttcttatgccctaaaataaaattcgttttagataattattaggtacatacaatacttgatgtgtattttatatatatgtatctagattcatcatcatttatttgaatacagatataaaaaccaagtactaaaataaatactattttagaacggaagaattataaaagatgacaatatggtggaaaagaaacaacaaggaaagcatgagagaaattagacagatgagacactttaaggcctcctttagaacacaggaatattagagaaattatacatgaacttcacaatattctgttcatcttcacaggaaaaaaacaatcaatggaaaaaaaatcgcattccaaaaagggcctaagtaaatttccgtcaagtatcaagtgatgtggagatcatctcgacacatgtaaaactttattcacagcggtttgaatttaactatgcccttcaatatataaatcgatctatctttcttcaaaattttcacacattatgcaatgattatcctaccaaaaatgagctgttcatacagtccacattgtagttaaaacatcaggtttacttgattatgaataggttatgtactatcttagaaacaagcaatcatataaacaaaattgtgataggatataatctatcaaatttatcttgcgtgcaaaaaatggctcagaatttatctatatgcaaaaaccatatgtccataggaccatatactagtaagggatgtatatctatatgcaagaaccatatgtccatatactagtaagggatgtatttatatgattaattgataataccttgagtaattggtgttggcgatgaccgcagcactgccattaggtcatctccaacattaggtccaggagaggagaaaacgaatgggattgtgtattccctaatatttctcttcctacagttttgctttgggtacccagtcatctaccttctacaaattttcattctgaatatatttttcaatcctctgctacatgatcgcatttctataggaccagccggtcgaaagactgcccatgactcgcacttggattctttagttacctcctgcagattacatcctctctgccaagttaagcacaaatcgttttttccctttcactcgtattttcccggaacgaancacactaagggcttgttcggttattcctatcccatgtggattggatgagattggaaaaaattgtgaaagattttgacttgtttaggattgaaactcatccaatcccacccaatccacatggattgagagcaaaacgaacaagccctagcagagtgttggaaaatgctttccccgcaacagagaacgtagaaacaaacaacgagagtatgaagttgctactctttagaacctatgatggacaaaggatcgaatatcttcgatcttttttatttgtgagcaagaattgagcctacaacacgctccaataattatactngatggctcgaacttaaggacctaataaaaactagatatacagcgttgatattctcctggtcgttggtgccctttggaactaaaggttaaggacatgtacaaagctaattaaggttgtcttcagtaatatcccctaaattttagaggcacacttacattagtattgttggataggtatagaatatcatcaatctataaatatctaaatatagcagagaggagcatatatcggacgttgtcgaagatagtctaataactcgtgttttgagtcgtgtctagagggctgattgtaaaaaaaaaacaagatacagatcttgttgaagccaccgctctagctcattgctcgagactgaagaaacgacatcgttgttgtattgtatgtgtcaaccactgtctttcagatcctacaatatcaataccaacgacagacacgttatcctcagctgcatgctcttcgtgtagctgagttcgtcgtggcacggtggcagccgcaagccgcgacatgtacccggcggccaataccttacgtctctgccgacctatatctgatgtccctgagctcgccgtggcggccgtgatgtctgtcgaggctgtgaccgtgagctttatggccccttgcgtgcaatgaatatgatcacgaactcacaacatgttcaagctcacctgcgcgc

SEQ ID NO: 22499 - DNA, 1867 bp, Zea mays
ataattagatccaaacagcaccaggacactaaaaatagtattatttattagaaacacactaaaatggttgtttttatcaatggcgcaccacaataattaaaaaatttatttcaaaaaagattttttaataaaatcttaccaaaaataaaaatttttgtagtgtgccactaataaaaaagcgtttcccaatgtatccgtgataaatagtactatttcgcgtctcaaagctaaaatcactctttgtcaaagtgccacagttaatttctcttttttcttaactatctcctttgcagatgattttgtaacgctgcttcccccatacaaaaacaatctagggaagctagatgagacatcgatgatgttatgatgagacaaaaaaaactttgggcaaccaaggcgttatagttgggacatccatgttaacaagtggcactggcgagagacaacagtggatccgcgtgccctcgtgccgcttgctgtgttctctgtctagcacatgaatgatcaaggcatcattaatacaacctagaatcttgcattgtaatcacagtatataacacatataaaagcaatgaattgacctaactcccaacacgaatgaatatcaaaggggggctaagcgcccccaaacacaccgaacatctctcaagaataacatcatcatccaatcataaaagcgataatacagacgtaaatgaagagccgatacaagaaatgtgtacattgcaaagtcaactgggttctactttaacatccatgtccgtggtaaccaacagttgccccattcttgccttcaaagtctcagagttgataattctggcctttaaggtctcagagttgatcatttgcagttcctcaactctttgggaagatgatttggtttggattggtttggttttgttgatcatatacatttctaagatgctaactgaactaccactcagggggcacatatgatgaatccgtcaaacttcacttacagagcaaatcaatttgagagctggaatcttcctgttggtttcctctttctccatccaaatatagcatagtagaagagagtgaggatggcaagagcaacaaagccatactggaaaacattgtacttgtaaagatacttaattccacgaagggattgcaaagtgtggccaaatatctcttgagctgcagttgcttgtgcgtagtaggcaaaagccgtggcacagaactgaatcacactgatggagcaaagtagtatgagcccaacattaaacaggaaggagttcattaaagtgcctccccatttcatcgggtgaattgtgataaaaactagcttcaatccaagcatcatctccccagcaatcactgcaataagaagatagaagcagaagaatgcgaaagcagcagtcccaagcagaccccaaacaccatccaactttatgaagacttcattcaggaaagaagatagaggaggatcaatcaacaagtatatgacaatatgtgcaacccaagctattgaaacaattaacccaacaacaccaaatagaagtttcccgatgtacccaagaactgtgaatgcccaagtagcctcagcctgttctccttgaggatacatctcttctagagccttcatgtcatcttccaggagtaataactccttttctaaagccttcacatttttgcgccatttccggcccttgttcccacttctttcttcttggtgtagggcttcagcagctttttttaactccctggccttctttcccagttcagttgcttcctttatatattgtgagcgtgtaattacagcttttggacgacgaacaaatgagaatataagtcccaatggaaggcaggcaattccgacaccaccaaatatcgtgaaaagcat

SEQ ID NO: 22500 - DNA, 2608 bp, Zea mays
ttttaaaaaaattttcatttatatttaattttttttttctttatataatatttttttttttttttattctttttttttttaattttttttttttttttttttttttttttttttttttttttttttttttttttgttttttttttttttttgatcaaggcatcattaatacaacctagaatcttgcattgtaatcacagtatataacacatataaaagcaatgaattgacctaactcccaacacgaatgaatatcaaaggggggctaagcgcccccaaacacaccgaacatctctcaagaataacatcatcatccaatcataaaagcgataatacagacgtaaatgaagagccgatacaagaaatgtgtacattgcaaagtcaactgggttctactttaacatccatgtccgtggtaaccaacagttgccccattcttgccttcaaagtctcagagttgataattctggcctttaaggtctcagagttgatcatttgcagttcctcaactctttgggaagatgatttggtttggattggtttggttttgttgatcatatacatttctaagatgctaactgaactaccactcagggggcacatatgatgaatccgtcaaacttcacttacagagcaaatcaatttgagagctggaatcttcctgttggtttcctctttctccatccaaatatagcatagtagaagagagtgaggatggcaagagcaacaaagccatactggaaaacattgtacctgcatgttttgtggtaaaggatcagaatacagtcgaaatttaataatgtctacaacacctgtaaaacagagcaactaaatctgctcttcatttgggagactaacttgtaaagatacttaattccacgaagggattgcaaagtgtggccaaatatctcttgagctgcagttgcttgtgcgtagtaggcaaaagccgtggcacagaactgaatcacactgatggagcaaagtagtatgagcccaacattaaacaggaaggagttcattaaagtgcctccccatttcatcgggtgaattgtgataaaaactagcttcaatccaagcatcatctccccagcaatcactgcaataagaagatagaagcagaagaatgcgaaagcagcagtcccaagcagaccccaaacaccatccaactttatgaagacttcattcaggaaagaagatagaggaggatcaatcaacaagtatatgacaatatgtgcaacccaagctattgaaacaattaacccaacaacaccaaatagaagtttcccgatgtacccaagaactgtgaatgcccaagtagcctcagcctgttctccttgaggatacatctcttctagagccttcatgtcatcttccaggagtaataactccttttctaaagccttcacatttttgcgccatttccggcccttgttcccacttctttcttcttggtgtagggcttcagcagctttttttaactccctggccttctttcccagttcagttgcttcctttatatattgtgagcgtgtaattacagcttttggacgacgaacaaatgagaatataagtcccaatggaaggcaggcaattccgacaccaccaaatatcgtgaaaagcacagatccaacaattgtagtaagagcaaccacatattcagggaaggtagcacgcattgtccaagttgtttgcgagttagccggtgcagtagaagccgcacactgacgagtcaatggactaaagcaaggctggccacttgagaatccagaaaatgagtttggaaatgtctggaccgatgaagataggtgcctcacagtgaagtccactttaccaacaagtccgtatagaatgccgaggacgaggccgcacaccaccgcggacgcgacgacccagatgagcgcagtcctgagcctcttcccgacggacttgtcctggtcgccctcgtagtagaacatggcgaaggggatgacgaggaagacgaggacggcgtctacgatgtagacgacgagccagagcgtcctcatggggagcgtgagactgcaggcgccgttgtagacggccttgcggcaggcctggcgattggcgacgtcggcagggagcatgaggattgagaggacggcgacggtgaggccgagcacgacgacgagcttggggaagtaggcctggttgacgtcgtcggggtgctggtagttgacgagcaggtagacgctgacgagcagcaccagcacgctgaccaccgccgccacgatcaccagcgcgacgttgaagtcccccatcggggtggccgccgccggatctcgcgcccttcctcctagtctccaactcccactagggtttgggcagtccccctcgctccggcggcgccagcggcgcggggggaggggagcaccaccggcgagcgggatctgggcaggacggcagcggtgggtgcaagaagggaggcaggtagctgcgggctaccagcagcgcgtgagggtagaggtggggtgcggtgggtagtgggttgacgacgtcgaggggggaaagggacgggggcgactggccgggccggcttcaggcacccggaggccccccgcgtgggctaggctggcgccggctcgggcggtttc

SEQ ID NO: 22501 - DNA, 6594 bp, Zea mays
cttttctcaagcatgaaaaatggtcgctgttgtacttggcatccatccatccatccatccatccatccaataggcggtccccatgttgagctcacactcacagcagcacaaatcttttgttgccccattgcttgccagatctgtgtggcagtgtgaaagtaagaggcggcctatgcgttgtaaccggcccatcatgggtcgtgcatcggtgggggccatttgactctcgtgctcgcctccgtgtgcgagtcagccccacttgattttttgtgctcccggccccgggcttgttcgtttcctccgtttggccccccgaaaacgctcccaagaaaacgcagcttttccgcggtttcacgctggttgggtttccatggccagacacccagactgcgcttctcttcggcggtgcacgacgccgtctctttcatctgccccggcgaggccagccagatagagcgctagctgctgctgggcttccctcgtagactagctcgctccacatgtcccctccccgctttattatctgccagcctctcgagctctctcgcacctctccgttgctgtcgattcttccgccctcttcgtgagtccttcccctaggcgctactcgtctgctctcctctcttctttttagtagctcgctcgccaggccgccaagccacatgcagcatgtggcggagcgcaagtagatagctgctgcgtcttcctggcctgagggtttcggattcatcagccgggccgccggggtcgccatcgccgccgttgggacggcggcggcggagtttggcgtcgagttcttcagagggttaggttaggtgcacgcgtctctcgcgttcctccttcccaaccgacagcaacttctttccatacccgtccccatgacgttccttcttccatgattcccttccatatttgctccagccaggccatccgcgggctgcgtggctgcgctcctgctattttaatgcctgccttctctccctctcacgcctcataaaaaaaactaataattccttgggatctgaggggatccgcgtggggttggtaggatcgcgggcagagattttagccaggactggaggaaaaccagtccgctctctctccatgagcttcggcggcatgttcgatggcgccggctccggcgtcttctcctacgacgctaccggcggcggcacgggcatgcacaaccccggccgcctcgtcccggccccgcccctgccgaaacccggcggattcggcgccacgggcctctccctcgggctggtacgcactcgctatactccatgcgccggcagtgtggctgattttcctgtgtgctcatatatgtctgactgattttgttgtgttgtagcaaacgaacatggaaggggctcagcggggccgcttgggtcgtatgggcctgattggcggcggcgggagcgggagcggaggcgacggggactcgctgggccgcggccgtgaggacgagatcgacagccggtcaggcagcgacaacgtcgacggcgcctccggtgacgagatcgacccggacaacagtaaccctcgcaggaagaagaagcgataccaccgccacacaccgcagcaaatccaagaactcgaagcgtatgtcgccgcgccgcctaacatctatcacaaaacccggccagaccatgcatggaagaaatctctcttttttcacgagtttttatatatagacctataataatagttataagcatatgcacgcagtgtgttcaaggagtgcccccaccccgacgagaagcaaaggatggagctcagcaagcggctcaacctagagagccgccaggtcaagttctggttccagaaccgccgcacgcagatgaaggttcggacttaattgggagcgcgaaccagccacagtcaaccagacatgtgtcgggcggctgcgtacgtgtgtgatgacaattttatgtgtttgcatctcgtcgtgatgagcagacgcagatcgagcggcacgagaacgcgctgctgaggcaggagaacgacaagctgagggcggagaacatgacgatccgggaggcgatgcgcaaccccatctgcgccaactgtggcggcgcggccgtgctcggggaggtgtcgctggaggagcagcacctccgcatagagaacgcgcggctcaaggacgagctggaccgcgtctgcgccctcgccggcaagttcctcggccgcccaatctcctctggcagctccatgtcgtcgtccctgcaaggctgctccggcctcgagctcgccgtcggctccaacaacggctacgggcccggtcccctcggcgcgtcagcgctgcagcccctccccgacctactcggcgccggccttccgggccccgtgggctcggccgccatgcgcttgcccatgggcattggcgccctcgacgttgcgctgcacggggcggccgccgacggcatcgaccgcaccgtcctcctcgagctggcgctcgccgcgatggaggagctcatgaaagtggcgcagatggacgagccgctctggctccgcagtcccgacggcagcggcttggaggcgctcaacctcgacgagtaccaccgagcgttcgccagggtgttcgggccgagccccgcgggctacgtcaccgaggctacccgcgaggccggcgtcgccataaccagcagcgtagacctcgtagacagcctcatggacgcggtacgtacgcacgcacctcctcctatatactagacacgtgtacgtgtcagttccattccgtacgtgccgctgcgccatgcactggcacgacggtgacatacatacatacacatgtttcgtgcaggctcggtggtcggagatgttcccgtgcatcgtggcgagggcgagcacgacggacatcatctcgagcggcatgggcggcacgcgcagcgggtcaatccagctggtgagctagtcccactcgtcgcccacacgtactatgcacgcactttggtgacgcgcagtaccaccatgctctcgcacgcacacgcctgtgctagtaataataaaaaaatagcctgtgctagtaataataataataaaaatatgcatgtatacgacgtatacgtgcgtgcttctgggatgcatccatgcagatgcacgcggagctgcaggtgctgtcgccgctggtgccgatccgtgaggtggtgttccttcggttctgcaagcagcacgccgaggggctgtgggccgtggtcgacgtctcggtggacgccatcctccggcccgacggcggccaccaccacgcgcagaacggcggcggcgccgggtacatgggctgccgcctgctccccaccggctgcatcgtgcaagacatgaacaacggctactccaaggtacgtgcccccggctgttaccatgggtgttgtgttgtgctccaccgtcgtccgattcgactgccataaatccgcacggccgggccgggcgcagcggcatgtgcgcggctacagtgcgcgagttacgcccgcatttatagagcggccgcggcccagtattttatgctgccccgacgcgtgctcgtacgtgggcaggcgagtcggcggctacagctgcctgcgcacgcaccaatcgatgctcccaggcgcggcaggtcaatgctctcgtagccagggcgccgagacgtgtgcgcgacgatcagttggtcgccgtgccgcctcgcggaggctcacagacgcggtggccgccgtctgacccgcaggccgggagcttgacctgtagcatgggcatctagcctagggtatcacatgattttcttagccaaacatttcgatgcttccgctaccgtacgtgcgccgaaatgctagctcgaggcggccgcttggtctcgtagatccagttttttagggcatatatcatcatgttgtttaatcgtcggggcagcttgtgagtgcggcctgtaataatgtataacgacgttgtggggtcgatatgatatccaaatctctcatgacccctgaacatgtctcggtttgtagatcttgtttgtttgctgtgcgtcgttaacataacgttttacctgcaataatgtactagagctagcagtatacctagggtttgcaccttgcagtggtcaaactgggtttcttgcgcgtctgtgccttccgtcccacagcccttttacctgcttcgggcggcggcaagtgccaagtggccatggccaacgtggaaggaaggggaaaaaacagccgtgagcgacggcacacatggtagctgctgcccgtgtgctaacgctgctctgtactgtgtgcgtgctgaccacaggtcacgtgggttgtccacgcggagtacgacgaggcggtggtgcaccaactctaccgcccgctgctccagtccggccaggcccttggcgcgcgccgctggctcgcctcgctccagcgccagtgccagtacctcgccatcctctgctccaactctctccctgcccgcgaccacgccggtgagtaataacttactaatcactccatcgttggtgtgagtaacttgcacgagatggttaaccaatggcgacggcgccgaccctcgccctgcccgcgtccacgccgcgatcacgccggtggggcggaggagcatgctgaagctggcgcagcggatgacggacaacttctgcgccggtgtgtgtgcgtcggcggcgcagaagtggcggcgcctggacgagtggcgcagcggcgagggaggagacgctgctgggaacggcggatcagcagccgcgggcgagggcgaggagaaggtgcggatgatggcgcggcacagcgtgggggcgcccggggatccccccggcgtggtgctcagcgccaccacgtcggtgcggctgcccgccacgtccccgcagcgcgtgttcgactacctccgcgacgagcagcgccgcggcgagtgggacatcctggccaacggtgaggcaatgcaggagatggaccacatcgccaagggccagcaccacggcaacgccgtctccctcctccgcccaaatgtaagcactactactgccctcctccttacttcaatttttactgccgtttttaccgttgcgatcaatgaatcatctctttgatttttttttggtcccacattgtaatgcaatactgtttctcatcaagtgtagtacagtaccgtggtgccggatttgtgtttatatgcatgcactgcagtattgcatgggttgagggacaccatgacacagagaaaaggacaaaccggaaaaggttaaaacactggcagtttaccagaaactggtccatggttgacatttgtgagggaaagctcctgtcacttttgtgtgtttggaaccacgcaggctgcccttgtccttgccttcatcatccctctctgatctactagtactcaacagtctatttttagaattttaagttttaattaaaccaatttaaaagtttaatcaatacaaaaatagtatgacaatattatatatatctaaacaacatgcagtataaataagttcgcaatacatattttttactctcttcattacccctgatgaatttctgatgagatgtgttgcaggcaactagtggcaaccaaaacaacatgctcatcctgcaagagacctgcaccgacccgtcaggctctctggtggtgtacgccccggtggacgtgcagtccatgcacgtcgtcatgaacggtggcgactccgcctacgtctctctcctcccctctgggttcgccatcctcccggacggccactgccagtcaccaaacactgcacatcagggttcaccaagctgcggcggtagcagcagcagcagcagcacggggtctctagtcacggtggcattccagatcctggtgaacaacctgcccaccgcgaagctcaccgtggagtcggtggagaccgtcagcaacctgctctcctgcaccatccagaagatcaagtctgcgctccaggccagcatcgtcacgccctagctattagcgggcatttgacatggattccggccgccggttctcagaaaaaaggacggagtagtcggatgccatgtcaaatgcttagctagaggacgacatgctgtgacggcgcagatgctaaacaaggctgtgctcgtacgtacgtcgatcgcttcacatcagaccggcggggaactggtgcttgagaaggcagtgaaagaaaataagggtattaaaataaattatgtagtagtgtggagtatttattgcatagagcaatatatatatggggtgaggtacacagggattaagtcaagaacgaaccgttcgctaggctttgattgcttgagcaaacacgttttgctatcgctcaagcttgttatatgctcatgtggtggttcgggtattgacttaagtctctggcaaaagaaagtgaaacaccacctattagggcttctcctatatataaaatatatatgtagcagtttgttttcaaccatcttgtgaagagttctgttcttttgtttctccgatatagcgaaatatagagatgagaatgtctctgtgtttgtaacgtttgtgtagtgttatttcgtttgagttgatatatatgacatgtacgctttgttcatgtggaaggaaaaaatatgttccagtgcagctcactaaatatcatgcgcccctttttaatagaga

SEQ ID NO: 22502 - DNA, 3597 bp, Zea mays
ggcacgagctctcctctcttctttttagtagctcgctcgccaggccgccaagccacatgcagcatgtggcggagcgcaagtaggtagctgctgcgtcttcctggcctgagggtttcggattcatcagctgggcgccggggtcgccatcgccgccgttgggacggcggcggcggagtttggcgtcgagttcttcagagggttaggtgcacgcgtctctcgcgttcctccttcccaagtcgagttcctttctttccatacccgtccccatgacgttccttcttccatgattcccttccatatttgctccagccaggccatccgcgggctgcgtggctgcgctcctgctattttaatgcctgccttctctccctctcacgcctcataaaaaaaactaataattccttgggatctgaggggatccgcgtggggttggtaggatcgcgggcagagattttagccaggactggaggaaaaccagtccgctctctctccatgagcttcggcggcatgttcgatggcgccggctccggcgtcttctcctacgacgctaccggcggcggcacgggcatgcacaaccccggccgcctcgtcccggccccgcccctgccgaaacctggcggattcggcgccacgggcctctccctcgggctgcaaacgaacatggaaggggctcagctgggcgacttgggtcgtatgggcctgattggcggcggcgggagcgggagcggaggcgacggggactcgctgggccgcggccgtgaggacgagatcgacagccggtcaggcagcgacaacgtcgacggcgcctccggtgacgagatcgacccggacaacagtaaccctcgcaggaagaagaagcgataccaccgccacacaccgcagcaaatccaagaactcgaagctgtgttcaaggagtgcccccaccccgacgagaagcaaaggatggagctcagcaagcggctcaacctagagagccgccaggtcaagttctggttccagaaccgccgcacgcagatgaagacgcagatcgagcggcacgagaacgcgctgctgaggcaggagaacgacaagctgagggcggagaacatgacgatccgggaggcgatgcgcaaccccatctgcgccaactgtggcggcgccgccgtgctcggggaggtgtcgctggaggagcagcacctccgcatagagaacgcgcggctcaaggacgagctggaccgcgtctgcgccctcgccggcaagttcctcggccgcccaatctcctctggcagctccatgtcgtcgtccctgcaaggctgctccggcctcgagctcggcgtcggctccaacaacggctacgggctcggtcccctcggcgcgtcagcgctgcagcccctccccgacctactcggcgccggccttccgggccccgtgggctcggccgccatgcgcttgcccatgggcattggcgccctcgacgttgcgctgcacggggcggccgccgacggcatcgaccgcaccgtcctcctcgagctggcgctcgccgcgatggaggagctcatgaaagtggcgcagatggacgagccgctctggctccgcagccccgacggcagcggcttggaggcgctcaacctcgacgagtaccaccgagcgttcgccagggtgttcgggccgagccccgcgggctacgtcaccgaggctacccgcgaggccggcgtcgccataaccagcagcgtagacctcgtagacagcctcatggacgcggctcggtggtcggagatgttcccgtgcatcgtggcgagggcgagcacgacggacatcatctcgagcggcatgggcggcacgcgcagcgggtcaatccagctgatgcacgcggagctgcaggtgctgtcgccgctggtgccgatccgtgaggtggtgttccttcggttctgcaagcagcacgccaaggggctgtgggccgtggtcgacgtctcggtggacgccatcctccggcccgacggcggccaccaccacgcgcagaacggcggcggcgccgggtacatgggctgccgcctgctccccaccggctgcatcgtgcaagacatgaacaacggctactccaaggtcacgtgggttgtccacgcggagtacgacgaggcggtggtgcaccaactctaccgcccgctgctccagtccggccaggcccttggcgcgcgccgctggctcgcctcgctccagcgccagtgccagtacctcgccatcctctgctccaactctctccctgcccgcgaccacgccgcgatcacgccggtggggcggaggagcatgctgaagctggcgcagcggatgacggacaacttctgcgccggtgtgtgtgcgtcggcggcgcagaagtggcggcgcctggacgagtggcgcagcggcgagggaggagacgctgctgggaacggcggatcagcagccgcgggcgagggcgaggagaaggtgcggatgatggcgcggcacagcgtgggggcgcccggggatccccccggcgtggtgctcagcgccaccacgtcggtgcggctgcccgccacgtccccgcagcgcgtgttcgactacctccgcgacgagcagcgccgcggcgagtgggacatcctggccaacggtgaggcaatgcaggagatggaccacatcgccaagggccagcaccacggcaacgccgtctccctcctccgcccaaatgcaactagtggcaaccaaaacaacatgctcatcctgcaagagacctgcaccgacccatcaggctctctggtggtgtacgccccggtggacgtgcagtccatgcacgtcgtcatgaacggtggcgactccgcctacgtctctctcctcccctctgggttcgccatcctcccggacggccactgccagtcaccaaaccctgcccatcagggttcaccaagctgcggcggtagcggtagcagcagcagcacggggtctctagtgacggtggcattccagatcctggtgaacaacctgcccaccgcgaagctcaccgtggagtcggtggagaccgtcagcaacctgctctcctgcaccatccagaagatcaagtctgcgctccaggccagcatcgtcacgccctagctagcgggcatttgacatggattccggccgccggttctcagaaaaaaggacggagtagtcggatgccatgtcaaatgcttagctagaggacgacatgctgtaacggcgcagatgctaaacaaggctgtgctcgtacgtacgtcgatcgtttcatagcaggtcggggaactagtgcttgagaaggcagtgaaagaaaataagggtattaaaataaattatgtagtagtgtggagtatttattgcatagagcaatatatatatggggtgaggtacacagggattaagtcaagaacgaaccgttcgctaggctttgattgcttgagcaaacacgttttgctatcgctcaagcttgttatatgctcatgtggtggttcgggtattgacttaagtctctggcaaaagaaagtgaaacaccacctattagggcttctcctatatataaaatatatatgtagcagtttgttttcaaaaaaaaaaacattaattaattgttggtaaaaaagaaaaataaaa

SEQ ID NO: 22503 - DNA, 2205 bp, Zea mays
gcgcggcgctccgggcggccggccgggaatctcgataggggtgcgcgaggacgaggagaaaaaacagaggaggaaaaaatatcaccttctcttcctgcattcccctgctcgatccccggcgaggaattcgcccccgaatccatcgatttgctcagtccagtccgccgatccgtggatcgattcgtgcgtgggctctgtcctccccggggttccgatctggtcctcgcctcgccggaggaggagctggaggagatgaacggcaccgggggcagccaccaccagcagcagcacaggctccggcagcagcagcagcagcaggcgctcctgatgcagcaggcgctgcagcagcagcagcagcaacatcagtaccagtccggcgtcctcgccgccgcggcagccgcggccatgacccagatggaacctatttccaatggcaatcttccacctggctttgatccttccacttgtcgcagtgtgtatgttggaaacgtgaaccctaatgtcacggagagccttttgattgaagttttccagagtgctggccttgtggaaagatgcaagctcatacggaaagagaagtcatcctttgggtttgtggactactatgatagaaggtctgctgctctagcaatcatgacccttcatggccgtcacatatatggacaagcaatcaaggtgaactgggcatacgcaagtacacagagggaggatacgtcggggcatttccatatttttgttggtgatttaagttctgaagtgaatgatgcaactctttatgcctgtttctcagcatatccttcttgttctgatgctcgagtcatgtgggacaacaaaactggacgttccaggggttatggttttgtctccttccgtaatcaacaggaagctgaaactgctataactgaaatgactggaaaatggcttggaagcagacaaataaggtgcaattgggcaacaaagaccaattcagaagagaaaccagaaactgacaatcataatgcagttgtactaacaaatggtagctccaccaattcagcaacagatgcaagccaggatgcaggaagtaaagagaacccagagaacaatcctgattgtactactgtatatgttggcaaccttggacatgaggttaatcgggatgagcttcaccgccacttctataacttgggggtcggggcaatcgaggaaatccgtgttcaacaggataaggggtttggatttgtgagatatagcacccatggggaagcagcattagctattcagatggccaatggattggtagtccgtgggaaatcaattaagtgctcatggggaaacaagccaactccacctggcaccacctccaagcccctaccccctccagttgcttcataccagcctgctgtagcaatgtcaggtgtcccacaaggtttcacagcagccgaacttcttgcttaccagaggcagcttgccttaagccaggctgcagcagggcagattgctggccagcatggtctcgcgggtcaggtttctgcaggtcttcttgctgctgctggttctcaggccctctacgatggctacccgaaccagtcatcagcccagcagcttatgtactacaactagagttcaagaggacggcgttggccatcgtcgccctgttttttattttgtggttcatgtactatttgtgtgagagttcttgatctcttgtcgccgcggaattgtgttactatcttattactgtaccattgaccatttttcttgtgagattcatttgagtagtcactttaacagagtaagagatgtattctatgtgacttcgcgattgattaatgtaatgctcccctgtgcatcggctttggtcgctgggctggttcctaacctggtgctatggtgcggttggacattgagagttttactcgtttgtagtttggtgttctggttcgtgagtctcatgtgtggttgcatatgttcacctaacctcagaaattcatcgttgtgtccatacaacaagatggaatttattttgcaacctgagatgccatgagagccctttctggtccttctggaatgtaggtctgtcagtttgccatgggaactgttcactttccgtcaggcgtaaatcatcactggatgtatcacactgaaattcagagttccagatatgcctgtgactgaaggttcagtagtcgcaatcccattctgcgatggaattttctgggcagc

SEQ ID NO: 22504 - DNA, 2061 bp, Zea mays
cattgggtacctcgcggccggccgggagaaaaaacagaggaggaaaaaaacacccaaaaaaccaccttcttttcctgcgttcccctgctcgatccccgacgagaattcgctcccgaacccatcgatctgctctccgcagtccgccgatccgtggatcgatccgtgcgcgggctcggtccgccccgggttccgatctggtcgccgcctcgcctgaggagatgaacggcgccgggggcagccaccaccagcagcagcagaggctccggcagcagcagcagcaggcgctcctgatgcagcaggcgctgcagcagcagcagcagcagcagcagtaccagtccggcgtcctcgccgcggcggcggcggcggccatgacccagatggaacctgtttccaatggcaaccttccacctgggtttgatccttccacttgtcgcagtgtgtatgttggaaatgtgaaccctaatgtcacggagagccttttgattgaagttttccagagtgctggccttgtggaaagatgcaagctcatacggaaagagaagtcttcctttgggtttgtggactactatgatcgaagatctgctgctctagcaatcatgacccttcatggccgtcacgtatatggacaagcaatcaaggtgaactgggcatatgcaagtacgcagagggaggatacgtcagggcatttccatatttttgttggtgatttaagttctgaagtgaatgatgcaactctttatgcctgtttctcagcatatccttcttgttctgatgctcgagtcatgtgggacaacaaaactggacgctccaggggttatggttttgtctcattccgtaatcaacaggaagctgaaactgctatagctgaaatgactggaaaatggcttggaagcagacaaataaggtgcaactgggcaacaaagaacaattcggaagagaaaccagaaactgacaatcataacgcagtcgtactaacaaatggtagctccaacaattcagcaacggatgcaagccaggacgcaggaagtaaagagcccccacagaacaatcctgattgtactactgtatatgttggcaacctcggccatgaggttaaccgggatgagcttcaccgccacttctataacttgggggtcggggcgatcgaggaggtccgtgttcagcaggacaaagggtttggattcgtgagatatagcacccacggggaagcagcactcgcgattcagatgtccaatgggtcggtagtccgcgggaaaccaatcaagtgctcatggggtgtcaaaccaactccaccggggacaggctccaagcccctaccccctccagccgcaacgtaccagcccgctgtggcaatgcaaggcgtcccgcaaggtttcacgacagcagaactcctagcctaccagaggcagcttgccctgagccaggccgcggccgggcagcagcatgctggtcttgcgggccaggtttctgcagcaggccttcttgctgctgccggttcccaggccctctacgacggctacccgaatcagtcgtcagcgcagcagcttatgtactacaactagtagagctcaagaggaaggaaggcgtctgtagtgttcagcttgtttttgcgcaagcttgggtcatcctcgccctgtttttttctttattattttgtggttcatgtactatttgtgtgagagctcttgttctctcttctcagccgcgggattgtgttacttactgtcttcttactgtaccattttccttgtctaattctgttgagtaagaggtgtattctatgtgactttgcgattgattaatgtaatgctcccctggggatcggctttggtcgctgggctggttcatgatcccggcccccgggccgattggacattgaaaggaggtttactggttcatgatctggtggtgttcgagatcagggtttatgaaaccggttctagggctaaaaccggccaccaccgataaccgatttatcgcgataaactggcgaaaaccgagatgtgcctgactgctcagcagttgcaatcctgttatgtgattgaaattatctggactgca

SEQ ID NO: 22505 - DNA, 1876 bp, Zea mays
ttttttttttttttttttctatgcatggattttcatactgctatatatcaatttccagtacattttcattcaatccgggttatcccatttccatgtcaaacacggaactaatttgcccttctgtttttttggacacagaacaaccaaagttcgaccagataagaggccgaaccaatctaaatcacctgtgttatgtatcaaattccagcacatatatctggcagcaatgttttccacagaacagttctccagcagaaataaataatacaacagctggtgttcaaaaatacatgtgattaactagatggcgaagtcttcattcatgccaatttggtccttgaaaatactgagcggagggcattatcttggctagggaaattactgatatctagcattggagagttctcaaatccaatcctgctcctgcaacttaagaggcaggtagacctcggtgaggtactggaacccgaaggaactgagggcctgtatctcagccttttgcttggtgcgcagcatcgtctccagctccttcacccagccctcattctgcttcacgaagtcctcctcgagcagctctttccccaccttgatatcgtgatcggtcatggggagacggcactgctccggcactctgtacttgtccaggtcgctcggccggacaccgagccacttgatgtccggcgtcgtcagattggcactgtcatacgacatgttcttggaaccacacatgtacaccgacaagatcttgagcccgtatggatcagaatccaccagcgcgagcactggcagcttcagctcaaccttgagcctccgcaggaacagccgggtggcgacatctggctgccccttggccgtcagaatgatgcaggggaagcggttgtagaacctgtcctcggcgagtcgcatgaatgcagcgtccttctccaccaggaggatgaagagcgcgtcgctctcgatgcccgagaccctgtcgacgttgggcggaatggccttgccgccgacgcccatgcgcgtgcagtcgatccggtccccgtcgtcggcgaagacaaggcggccgacgacgacgcccttctcggaggcgacgacgtggagcgaggacctggtgcatccgagcatgcaggagacgtcgtcgaggacggcgtcagactgggtctggtcgccgaagagcttgacgtcggtgtagaagaggtcacgcttggtgacgtggatgcccctgccgaggacggcgtggacgagggagaggactcgcgccgtgatggtggccttccgcgcggtggcgacgttggcgaaggggcgcgcggactcgcggcggacgagcacgatgcggtcgaggtccgggaggtagacctggttagaggcggcgcgcgagggcaccgcgaaggagaagccccggccggagaggatgctgcgcgcggcggcaaggacgaggcggttgatgcgggaggtgacggaggtggagtcctggtcggccaccacgatgtacgaggaggcggggtccgcgcacgggtcgtggtccgcgagggacctggcgtcggccttggatttggaagcggaggcagaagcgagggagcggagggtggccaggatggaggcgtcggggcggagcttcgagcggagggactcggcgtacgacgcggccgaggaagcacgcggcttcttggagctggatgcggcgccggccgcgctcgcaccggcgcggcgctttttctccgacatggggaggagcgagagatcggaaggcggcggagggaaatacggggttctggggcgcagatgacggcgtcggcggcggggcttgagctcgagcgcgactgcgatttggtctggtggtgaggactgtcttgcatctaggatgtcctaggtaatggtctcgtgc

SEQ ID NO: 22506 - DNA, 5099 bp, Zea mays
  misc_feature (1917)..(1919): n is a, c, g, or t
tgcagcagctgccactgtagaaactagcagccgaacaagccctgtataaaccttgagaccacggaatacgccttgaaatttcccgtcacctcttcaaactttgggcggcctctctcgctccctctagccagatttcccgctcgaagtttcaccccaaacaatcagcttccctcgtctccccgcctcgtcgctgcctctcctcccattttcccgaccccgagctcgtcgaccccgcgtctacgcttctcggcctgctggtctcccttatcgactgggcacagccgccgccgcagccaccagatcgctttagggccttaggggggaggggagagggtgtgtctgtgcaccgccggtagctggggtaactgccccacccgccgtaggagcttcagcgagcgatggaaccgaggcggcgccagcagcagcagtcgatcctctcatttctccagaagcagccgccgtcatggagggatccctccggggagggcacgcctcccgagaagccgccgcggccccctatggggtccgtcgccgggatcatggagaggctagtgcgccctcctcctcctccgcaggccagtcacggatgggcgcggtaatcactcgctctgttagtgtgacgggaggctagggttttgcggtttggttgggcgtcggttaggccgtccggttgggtcgccgcgaggcacggtttgctgggctgggaggagtttcgggttcgagtgatagtgcggatctgacccattagtgctgcgtttaaggacgtgcattcttcgagttagcgactgtctagagattttaccgtattattgctcatctgtttctactgcagctctgcctgtgattaatcagtctggcttccattttgtggttattagatatttcctccatctcagtatataaggcgtactatgtatttgtattgcacatatgcaattaggtaactctgtctcagtgttgattagcctcaaagtatattaggttttttatttttgaattcactgccgtgccctgctgagctacatgcccataattttttagagtagagcttgtaactccgtcccagtgatgattagcctcgaagtatattatatctttttttgaattcactgatgtgctctgctgagctactagcccatagtgtttagagtagaacttgcactgtcatctcatgtgattttttttcttggttagatatagctttgctttctagtattttgcatttcagacatgccattaactcctaggcagaccaagcatttgctgaattatctttctcttgcaccttattttgctatcctgaatatgcttgattctcttttatgcagaaatcaatacgattcccaggttagacattcagaggggaaaaacttgcctgtggaaaatcaagttctctcaaatgagtgcttaggtgcattgttctcaagacctatttacggcgaacacagcagaacaatcctttccccagaaggaggtgcagatatgtctccctctcaggagccccaaaagcactcactgaggtcttccactgatgaatctactagagcaaccaaagaagttattctggagcatccaaagaagttattctcagagtctcatactaattgcattcatgctacagccttaaatgagaactttggtgtgcaaactccttcccaggttgcctcaaagaaaatcttcccagggcttgctcatggtgctgatacacctttaactggatatggttcagaacaaactcttttgcagcattcatcaaagaagttctcattggtttctgctaatggtaaatacactagagcagcggtgacaccgtttgagcaaaattcaaataatacccgtgcagaggaactttcaaagatgcgctcagggtcttcagacatgttgtatcttaaaccaacaaatttgtctgcaggtcgnnngacaaatggaaccccattgaagaatcactcaaagaattcctccttgcttatggacggtaaatataacataacatctgctgcactatttccagaacttgactctagtcctctgaaaccagaaacaccagcaatgcaggcagctattcctcgcctgaagcgagttcaggaagaccaaggtgtggatgccaacaaccaatgccctcctttgtgggccatgaacaagaagatgaaatcagctcattgttctattgaaaagaaggatcatgatgaaatggctggtagcgcgcgtagcaaatttgagtggctgaattcatttgccatcagagatgcaaataaaaggcggccaaatgatccactttatgacaagagtacccttttcattccacctgatgcattgagaaaaatgtcaacatctcaaaagcaatactggaatattaagtgcaaatatatggatgttgtcctctttttcaaagtggggaaattttatgagctctatgagctagatgctgagattggccaaaaagaacttgactggaaaatgactgttagtggggtgggcaagtgcagacaggttggtatttcagaaagtggtatagatgatgctgttgataagcttatagctcgggggtataaagttggaagaatagaacaaatggaatctgcaaaccaggccaaagctagaggagtacattctgttattgaaagaaagttggttcatgtgtccacaccatcaaccgcggttgataacattggtactgatgctgttcaccttctggcactgaaagaggtgaccctagcttctagcggtttccaagtctttggatttgctttcctagactatgctgcccttaaaatttgggtgggttcagtccaagatgatgactcgtctgcagctttgggtgctttgttgatgcaggtttctcctagagaattaatctatgaaacctcaggcatctcaaaagaaactcaaaggacaataagaaaatatgcctcagcaggatctgtgaagatgcagctgacccccctctccgggatagatttctctgatgctgcacagattcgaaatttaatacattctaaagggttctttaatgcatcaacagagtcatggttatctgctttggattgcacaatgaatcaagatgtagttatttgtgcacttggtggacttattggccatttgactaggctcatgttacatgatgccctgaaaaatggggaagtcttaccataccatgtgtacaaaacatgtttaaggatggatggccagactcttgtgaacctcgagattttcatcaacaatttcaatggtggttcatctggtactttatataagcaccttaatcactgtgtcacagcatctggtaagcggatgctaagaaggtggatttgtcatccacttaaagacattgatgctatcaataaaaggcttgatgttgttgaggggtttatccaaaactgtggactaggccctacaacacttgggtatctccagaaaattcctgatcttgagagattattaggacaagttagatccactgttgggttatcatctttgcttcaactgccctttattggagaaaaaataataaagaaacggattaaaacatttataatgcttatcaatggcctccgcaatggtattgacttgctaaatgatttacaaagagcggaccatggtatcttggcgctttataagattgtggatattccatcattgagctatcttcctgagttaatccataagtttgaagagagaatgcaaaatgagtttccatgtggccaggtttctgatgtcaatgccaatggtgccaacgatttggctgctctgatggacgtttttatcggaaaggcttctgaatggtctttggtgatcaatgccgtcagcactattgatgtgcttaggtcctttgctgcaatgacattgtcatcatttggtgccatgtgcagaccacaagttctgctgaaagatgatgtgcctgtacttcgtatgaagggtctgtggcatccctacgcttttgcgggaaatgcaaatagtctggtaccaaatgatttaacccttggtcaggatttatctggtctcaatcgttttgcattgctgttaactggtccaaatatgggtgggaaatccacaatcatgcgtgccacctgcctggctgttgtacttgctcagcttggctgttatgtcccctgcacgtcatgtgagttgacccttgcggattccatctttacgcgcctcggtgcaacagatcggattatgactggggaaagtacttttctcgttgaatgtactgagactgcctctgttcttcagaaagcaactgtggactcgcttgtcttgcttgatgagcttggcagaggaactagcacatttgatggatatgcaatcgcatatgctgtgtttcgccacctagtggagcgagtgcgatgccgtcagctctttgctacccactaccattctcttacaaaggagttcgcctcgcaccctcacgtgagcctccagcacatggcctgcatgttcaagccaaggagcgacggcaacggccagaaggagctgaccttcctataccggctgacctcgggggcctgtccagaaagctacggcctgcaggtcgccgcaatggcagggatcccgaagtcgatagtggagaaggcgtctgtcgcgggccaggtgatgagggctaagatcgccgggaacttcaagtcgagcgaacagcgagctgagttctcgaccctccacgaggaatggctgagggcggccctggcggtgagcgcgatggacggacaaccggacgacgacgacgtcatggacacgctgttctgcatccagcaagagctgaagtctcacttcaggaaggcgagatgagcattcgccgccgccgctgatcgcgtacgtgggagtactaattatcaagggtttgcctagattcttcagtgatgtcgtatctttacaaccatggtagatataatgtaatccgcgttttttttccatggcacgaatcctgtactttaaacaaagtatcttgtgtatatatgttctgtgctatgtcttgtttgcattgggcatcaaggaccactatccttaatcacttccaccgtttacgtgcatcatatacatttgtgtttggtttgaggaataaaatagtttattatcttttcaaaaaaaaaaaaaaaaaaaaa

SEQ ID NO: 22507 - DNA, 3395 bp, Zea mays
  misc_feature (32)..(32): n is a, c, g, or t
  misc_feature (3136)..(3136): n is a, c, g, or t
gaccaacctgctgctcgagctcgaccaacgangcgcgcgcaccaccacccacacccccacccgatccccgatctcaccgtctccaccccgaccccctcccaccaatctccaacagcatctaatcaatcaagacagccccgcgctagctcacccgccggggctcgccacgatgagaggcctcctcgcgtgcgccaccctcgcccgccgcgccgccgcctccgccgcgcccgcgcgcgtccgccacctggcgggcgccgcggaggcggcggaggccgagctcaagaggacggcgctctacgacttccacgtcgcccacggcggcaagatggtgccgctcgccggctggagcatgcccatccagtacagggactccatcatggactccaccgtcaactgccgcgccaacggcagcctcttcgacgtcgcccacatgtgcggcctcagcctcaagggccgcggggccatccccttcctcgagtccctcgtcgtcgccgacgtcgccgcgctcagggacggcaccggcaccctcaccgtcttcaccaacgagcagggcggcgccatcgacgactccgtcatcgccaaggtcaccgaccaccacatctacctcgtcgtcaacgccggatgcacggacaaggacctcgcccacatcgaggcgcacatggaggccttcaacaagaagggccgggacgtcaagtggcacatccacgacgaccgatcgctgctcgcattgcaggttgatgaatcataagagacttaagagagacttcaatgctgtttagttgtatcactagttgatttaggtatcaaacattggtgcttgcttgatagtagctaaatcaaatcttgattacttcagagtgccttctttgcttcacttgattggtttatcttaggtaacagttgagcaggtctgactgtccttttcttggtcggtggaagtaaagcttcctccatggtcttgcttttgtggttaagaaatgcctggtgttcactgtaaaaacattcaattccaatgtcctgtgaaattgttaatgcaacacatggaactgggttcctggtgaactttttttttaaaaaaaaatttaaacctgattcatggttcacaaatcgtagtttcttcatggggtaggtagctagttgttgacactgctaatcatgggtggactcaatctgcatgatccgtatatgtttttttaccttcaaatctatactctccctaagcatatcatgtaacagaagcatccaactttcactttaatggcaagttgaaagttcatttctagagtcctgatgtgtaccaggttccaagttcataaaagggcagcattataacttgtttattgatgcaaatgtaagcagggtcctcttgctgcacctactctgcagttgctgacgaaagaagatttgagcaaaatgtacttcagtgacttcaagatgattgacatcaatggatatgcatgctttctgacgagaactgggtatcacttcgattctagatgtaaatgtaagcagggtcctcttgctgcacctactctgcagttgctgacgaaagaagatttgagcaaaatgtacttcagtgacttcaagatgattgacatcaatggatatgcatgctttctgacgagaactggctacaccggcgaagatggttttgagatctctgttccgtcagagaatgcagtggatcttgcagaggccatcctagagagatcggaaggcaaggtgcggctgaccggcttgggcgcccgtgacagtctccgactggaggcaggcctgtgcctgtacggcaacgacatggagcagcacatcacgccggtggaagccggcctctcatgggcgatcggcaagaggaggagggcagagggcggtttcctgggcgcagacgtgatcctgaagcagctccaggaagggccaaagatcaggcgcgtgggcatggtcacgcaggggccgcccgcgcggagccacagcgagctggtgagcggctcgggggagaggatcggcgaggtgaccagcggagggttcagcccgtgcctgaagaagaacatcgctatgggctacgtgaagtcgggaatgcacaaggctgggacggagttgaaggtggtcgttcgcgggaagtcctacgacgccgtggtcaccaagatgccgttcgtgcccaccaagtactacaagccctcgtagattatattcttgtacagagggacgccttgcgtttctcttttgtcgttgcggcttgttcttggcagattggttaagcattgcaactgtaacttctgtgagattgtcttacggttcacatttcatgtatgcctgcctaataagccttcttttcccaaatacaaagcatgcatgtgcctatgtgaagaatcgaatcttgctggttggacaaatcatttttgtgctcgtatagtagaggagaggacatgtatagatatatagatgttcttggccgggggacgatggcaatcatggacgacgaccgtatgaatctcaaactagctagattgcgaccatatatatgtcagggatacaaaatttacaactagcaggttaattgcgaccgtacatatgacgaccccagcattgcatctatcatcgtctgtcaggactgaaacgtctcaaatatatatgtagcacagtactacgtcgtccatccagggcatatattaaccaacttagggattgcagatgccaatacacaatcaatataatcataatctgcgtcctaattaatcctctctacgtcgtccatgatttattaggaaagcgataacacgaccgataaaaggagacaggggggagcacgaaattttatcacccaaatatatatatgtacacaatgcagtgcgtggggtcctctccaaacaaacaaaacaataatgcagagacagataaacaagaggtttccatgttttcttgttacactggggtgtatttcgatctgctgatcgataatcaagcatgtcagtgaaagtctagcaacatagtacgtactgtcaggaaaaggctagggtgcacatcctcgcagaacgaacacagtgtagctagcaacaaacaatggcaataatacgcatgtatcctagctagcctttctgtctctctacatactatacataaacatcgcgcgcttttgctcctntaactgatacacattattaggtctctccaagagagaactgcatttctgtgctgttcttcgaaaacagcatgcatgcatgctagctatacactgggcatgaactgtcgttgatgtatgtactagctagctagctatatctagcatttccacccctgcacactgttagctatatatgtgcaaagaaaaacaagggaatagtttcgaaaaattgtgcttgctacaaacacacaatttcgaaaaattgtggtagtaaattctg

SEQ ID NO: 22508 - DNA, 1620 bp, Zea mays
aaaacctgctgctcgagctcgacctacgagcgcgcgcaccaccgcgcccacccacacccccacccgatcccgatctcaccgtctccaccccgaccccctcccaccagtctccaacagaccaacagcatctaatcaatcaagacagccccgtgctagctcacccgccggggctcgccacgatgagaggcctcctcgcgtgcgccaccctcgcccgccgcgccgccgcctcctccgcgcccgcgcgcgtccgccacctggcgggcgccgcggaggcggcggaggccgagctcaagaggacggcgctctacgacttccacgtcgcccacggcggcaagatggtgccgttcgccggctggagcatgcccatccagtacagggactccatcatggactccaccgtcaactgccgcgccaacggcagcctcttcgacgtcgcccacatgtgcggcctcagcctcaagggccgcggggccatccccttcctcgagtccctcgtcgtcgccgacgtcgccgcgctcagggacggcaccggcaccctcaccgtcttcaccaacgagcagggcggcgccatcgacgactccgtcatcgccaaggtcaccgaccaccacatctacctcgtcgtcaacgccggatgcagggacaaggacctcgcccacatcgaggcgcacatggaggccttcaacaagaagggcggggacgtcaagtggcacatccacgacgaccgatcgctgctcgcattgcagggtcctcttgctgcacctactctgcagttgctgacgaaagaagatttgagcaaaatgtacttcagtgacttcaagatgattgacatcaatggatatgcatgctttctgacgagaactggctacaccggcgaagatggttttgagatctctgttccgtcagagaatgcagtcgatcttgcagaggccatcctagagagatcggaaggcaaggtgcggctgaccggcttgggcgcccgtgacagtctccgactggaggcaggcctgtgcctgtacggcaacgacatggagcagcacatcacgccggtggaagccggcctctcatgggcgatcggcaagaggaggagggcagagggcggtttcctgggcgcagacgtgatcctgaagcagctccaggaaggcccaaagatcaggcgcgtgggcatggtcacgcaggggccgcccgcgcggagccacagcgagctggtgagcggctcgggggagaggatcggcgaggtgaccagcggagggttcagcccgtgcctgaagaagaacatcgctatgggctacgtgaagtcgggaatgcacaaggctgggacggagttgaaggtggtcgttcgcgggaagtcctacgacgccgtggtcaccaagatgccgttcgtgcccaccaagtactacaagccctcgtagtagattatattgttgtacagagggacgccttgcgtttctcttctgttgcggcttgttcttggcagcttggttaagcattgcaactgtaacttctgtgatcgagattgtcttacggttgacatgacatttcatgtatgcctgcctaataagccttcttttcccaaatacaaaaaaaaaaaaaaaaaaaaactcgagggggggcccggtaccc

SEQ ID NO: 22509 - DNA, 994 bp, Zea mays
agagtaaaaaattcaattaccaatggaggattactgctgtagtgctgcatagcctaaacgtcctctggtcagcaaatacagtattctaaccactaaataatggcctcggttttttttttttttttgcaaacagaaaagaaaattctgacatttatgacaggcaaacatgtacaaagagaattttttttacaagaagatttatatattaaggtcaataggattcgtgtacaatgcaaatcctagctcattcctcatacagactttcccatgaaataagcgactgcacagccaacaagtgctcctgcaaaaacctgaagtgggctgtgtccaagaggttcccgtagtggcctaaaggttgaaatgattggatgttctgctgggaattcacagactatttgatttaacaacgcagcttggcggcctgtgtgccatctaattcctgatgcatcatacattacaactgcagcaaaaaccaatgcgagggcaaatgcagagctatctgcgccttctcgttgacccacagcaacggccaagctccccacagttgcagaaagagatgacatgactccagctgaagtaagaaatttccttgcatcccacctcttctcttttaaccagatggagaggaggttgatgaagttggcgcaggcgaaggcgaggagagcgacggcgagggggaagttgccgcctccttcgcccacgccgatggcgcccgagcccccggctccggcaaccaggtccgccgccgctgccgacgaggaggaggccgtggacggggccgtgccggtgccccccgcggcggtcaacatctcgctgcccctcattgccgctggacctagtaggtgggtagtctggctcgctcactggctccctcggtccctcccctccctccgttccgtgccttcgtctcgtccccagtcgtccgtccgcttcgctcgcagtttgttggatcgaggacatcggagttggttggttgttcgccggacggcgtggg

SEQ ID NO: 22510 - DNA, 4240 bp, Zea mays
  misc_feature (1550)..(1550): n is a, c, g, or t
  misc_feature (2206)..(2206): n is a, c, g, or t
  misc_feature (2705)..(2705): n is a, c, g, or t
  misc_feature (2940)..(2940): n is a, c, g, or t
tgattagtgggtggcggccgatgcacgtccagttattatatactctctctccatcatactaaactattcgtcttattggttttttttgacgtccagttatattctctcttcatcacatttaactatttgtctttttttcaaataataaaataaataaaccattatcgaagtatctctagtactataaaaattatttataaaaatcttaaataagatgtctaaaagattaaaaaaaatatggtgtattttgagacggtgtggtatcagataaccatgaaaagcatctttcttcgtttcaggtccgggtcaaatctgcggcgtcccccgtactccccgcctttcgcctgcacagcgacccacccacctgtaaagccggccccaatttggatgtccccttatcttgccgtccctatatatgcccccaattcgcttcatccacccagcaaatcccgatggaacaaacaagtttaaaaccgcgatgttgtttgacgatgttctaggtagttcaagattttttttagatatttttcatgtaccttatgttttctccaagctacgagccaaatttcgtgtcggcatcataaactgcagttgcgtttcattttctcccgtctcattcagacgcactgttgggttgatgctgacgaaaatttttgggcacagctccatgtcaccgtcggatctagagaggcgaattcgcccggagacttcagattccaaacagatgggatgcgtgatacctaaccaagtagccaagaagctcatgcgcatctttttcagacaacaaggtaaaaaaaaaactgaaaggcgcacatctgaataaactttgcccaaaagttcaactcgaactaagagtttcttgccaaaaccccgatttcaaagcgaactgctgattacatgactattgcaaaaccttgaaagagaaaaaatcgatacagcaattcactagtagggactaaacgcagcggtctctcttcatcggtcaacgagtatttgcacaagcaagcagacctcaatccatgatctatgttagtgggtagaagacagggatggcgaaagaacaatcactattgatccactcagaaagaattacacgaggtaaaaaaatcatcacgaaacaccctagctagttagatctacgaaatttacgacgacgacgaggaggaggattacaatggccttgaaccagaggcatcaagacctctgctctggctgttgttccagctggactggctgaaatccgtcgtgaaatcttggctgccgaacgccatccgctggaacagcctgatctcggccgcgctcgcgacgttgaacatctcgctcttgcctggctgcacgccgttagttagatcgacatcagcgagactgtcgagcacccgcacgacctgggaggaggcaagtggagggggggaaaatgtcaggttctggtctgtgtccggtactctgatgagatgctcacgcgctcttcttttatccttgtatacctggctcatcctcggtctcctggatgctgaatgccgaatgcaagctgcagcagcttcgatcatacngaacatctcgacttcgttgtagttcttgttaagccgggcgtccaccagctccccggcgttgccggtctcaagcgcctgcgtgagcaatggcctagcctgcaaataactgtgctgtcacaaaaattgctggtccacatggtttaccagtattataatttctccagaaatatcacacttcgagggctggatacagtcccatactgaattgaatgtaaccagtgaatgagttataagtctacttaagattttgaattatgcagataacttaagatatggttactttccatttgctactgaagggtaagaaaactggtaaccttttcgtgaatcaagttactaaaaactggtatagcttacccacttaacaaggctctcgtcacccaatggctttgatgcgtcgacaggctttctaccagtaataagctccaagaggacgacaccgaatgagaatacatcagatctctcagtcaacttgccgcttgacgcgtactctggagcaaggtacctaaataagaagcgtgtgtcagattacaagcaggttttaactgttctcttgaacttgccgctgttttactaacccgaaagttcccatcactcgtgtggttacatgagtgcaagcatccatagctaaccttgcaagaccaaaatcagcaacntagcaaatgggcaccgatgcagtgagtgatataactccattataagatgttactgaaatcatgtagaaagcattctgaccagtgcttcaaagttattatccagcaagatattggaggactttatatccctgtggattattctgggttgacctgccgaggaaaagaattacgcaacagagcatgagtagtgaaaatcatcacacaaaaacaggtgaaaggaatgaaaaaaatgtcattacaatcttcgtgaagataggctattccacgagccgaaccagccgcaattttaaccctagctggccactccaaaactggtactccacgtcctatgatgaaaaatcaatgcgggtatgcattaattgtttagtccggacaaagaactacctctgttcctaaataattgcagttctgcctatgtaacaagacaaatacttgcccaggtacatagctagaacagtagaactacatatatattggaaaacagaggctgtaaaaaaanttctcttgcacaatatataaaaagcacagcataccatgaagatgatagtgaagtgtgtcgttgggcacaaaatcgtagacaagcaatctctggtcatctgaaatgcaataccccacaagagaaactagatggcgatgatgcacacgactgataatatccacctcagcatggaactcacgttccccctgcccgccgccatctttcagtttcttaaccgcaacctctcttccatcanccaagcaacccttatacactgatccgaacccaccttcccctagcaggttctgtgatgagaagccatttgtgatctgatacaattcctcataagtgaagaaccgacaattgctcatactgaactctggcattgaatctttcgattcaggactcccggcactgaagtttgttttggccgaataccctaaacaagaaatgagttttagttcatttcatgactcaggtacatataaagactaatcttgactttccagacgtgtaattgctgcaaatgcactttatcaaagccgaataccctaacacttgtgtaggagtcgaggccggtgaaggcattacaaaaccagcatggtatccatgcactctcctccgtttcttcttgtaccaaaatgctgctccaaccaaactaagcacaataatggcaacgactaccccaatgcctgcctttgcaccagaagacagtccaccactgtctactgaggagctgctgctctgcgaggctggactcgacgacttgttggaaccttggcccccggttgttaccgggctaactgagtcacctggcgttgctggggctggcaccgatggagtgccatcagagcctggtgtagacggtgtcgtccctggagacgaggggctagagggagtggggatcgaaggatctgcggacgtcggtgagggactggttggggaaggttcgacaggaattccagaaggtggtggtgccaggggtggaggttctgtctgaggcgatcttggtggccggcgccgtggcggaggtggctgtgctactgtcggcggcgttgggtccgccggcgggttgggcgctggcagattggatgggggtggcgacgcggccgcaggggggcgtataggcgacgcctttggcggggcagcaggtgtaggcggtgggggtactgcagcaggcgacgagggtggaggcactacggctgctggggcgggtggcggagtggcaacgacaaccggcggtggtggcacggcgtccggagggggcggaggcaaggagggcggtggagaagggagctgtggcggtggcgtggacgcgggaggcgggaggggaggaggcgcggccggcgatgagggagggtcggccggggtagcattgggctgcgtcaccggggccggggaatccggcttgggcgtggtggttgccggcgacggggttgcggtggaaggcggcgaggtggctctgatggtgatcggggaaggcgaaggtgaggacgccattggagcccaggccagcagcaggctgctagagagcactacactgcgggctgtcactt

SEQ ID NO: 22511 - DNA, 1534 bp, Zea mays
gaaagagaaaaaatcgatacagcaattcactagtagggactaaacgcagcggtctctcttcatcggtcaacgagtatttgcacaagcaagcactcctctcgccctggtctcggtttttttttttttttttttgttggcgaaagaacaatcactattgatccactcagaaagaattacacgaggtaaaaaaatcatcacgaaacaccctagctagttagatctacgaaatttacgacgacgacgaggaggaggattacaatggccttgaaccagaggcatcaagacctctgctctggctgttgttccagctggactggctgaaatccgtcgtgaaatcttggctgccgaacgccatccgctggaacagcctgatctcagccgtgttcgcgacgttgaacatctcgctcttgcctggctgcacgccgttagttagatcgacatcagcgagactgtcgagcacccgcacgacctggctcatcctcggtctcctggatgctgaatgccgaatgcaagctgcagcagcttcgatcatacggaacatctcgacttcgttgtagttcttgttaagccgggcgtccaccagctccccggcgttgccggtctcaagcgcctgcgtgagcaatggcctagcccactcaacaaggctctcgtcacccaatggctttgatgcgtcgacaggctttctaccagtaataagctccaagaggacgacaccgaatgagaatacatcagatctctcagtcaacttgccgcttgacgcgtactctggagcaaggtacccgaaagttcccatcactcgtgtggttacatgagtgcaagcatccatagctaaccttgcaagaccaaaatcagcaaccagtgcttcaaagttattatccagcaagatattggaggactttatatccctgtggattattctgggttgacaatcttcgtgaagataggctattccacgagccgaaccagccgcaattttaaccctagctggccactccaaaactggtactccacgtccatgaagatgatagtgaagtgtgtcgttgggcacaaaatcgtagacaagcaatctctggtcatctgaaatgcaataccccacaagagaaactagatggcgatgatgcacacgactgataatatccacctcagcatggaactcacgttccccctgcccgccgccatctttcagtttcttaaccgcaacctctcttccatcagccaagcaacccttatacactgatccgaacccaccttcccctagcaggttctgtgatgagaagcaatttgtgatctgatacaattcctcataagtgaagaaccgacaattgctcatactgaactctggcattgaatctttcgattcaggactcccggcactgaagtttgttttggccgacccccccggccccggggtacccgtcgaggccggtgaaggcattacaaaaccagcatggtatccatgcactctcctccgtttcttcttgtaccaaaatgctgctccaaccaaactaagcacaataatggcaacgactaccca

SEQ ID NO: 22512 - DNA, 1040 bp, Zea mays
  misc_feature (7)..(75): n is a, c, g, or t
taagggnnnnnnnnnnnnnnnnnnnnnnnnnnnnnnnnnnnnnnnnnnnnnnnnnnnnnnnnnnnnnnnnnnnnntgacactctaacactaaaagtgctactcttttttctttccggctcggctaaaggtattttcatataccattatacaagaaggccaacaacaaatcacagcttagaaagaacaaaagatcgatctaccgatgcatgtacaactactgatgcatcagtacaaaagagaaacactcggattctaaatttcattaaaatacaaaagagtacaagaggtgaccagaactctagtttaccgaaacatacagatacagtctcttattattaccgtaaagtactaggtgacacggatacaaactccaggctaaatgactgcataaagctcacgccttggggaggttaatcggatgcagtagcctcataaacactagttgtagtaggcttaattcactggagcgaaataggcatgtattttgagttctgagatcctggtattgtctttgtacacaacttcagtgcgtttgacagtacccattgccatagtaagttgtcctgtccctccaacaatgctccactcgccatttatttgggaggtcccttgtatttggagtgtggacccattgaaccttttatcctcgaacactaatcccagggagtagtggtacaccacaacgggagtattggctacttgaacactagtgccctggagttggccgacgatgttcgcatcaggtgttggcccatcggctacaggccacgagaagacccaggttgtgcccatgtttgatctctctgtgatggttactccgttttgatctggcccagaacgatacacctccttgtttgtgtatagagtcatcttaagctcagaatattgaggtggtgcagatggagcaaatgcgcaataggccatgcctagccagacagggtggttcacttagggacctgggagagagcgggggcgtgttgtttggatcggtcagctatgatttgctcttatttgcttgtgtccgagggcgccccggccg

SEQ ID NO: 22513 - DNA, 1565 bp, Zea mays
aaagaaactgcgttcggcccttaggttaactttgaccactccataatattcgtaaagacaaagcaaactatactaacaaagaataactcatgcttgtactagcagctagttttgacgggtcactagattttctatctataaaagtgcatacgcttatcaaatatgcttaaattccaattccaaataccaaaacaaaggtttaaatttctacaagttgatctaacagtacttcctaatacagaaaactgagcatattgaacttcagtgcatcttttagatgcagatgatctcttgagcacacatctagaattcatcttctgcaagcttctctagcaaacagcagcactggagattttctatcttccatatggatggtaacgaccagcagcaccactgccgccactgccaccatagcctgtcctagcaccatagagtccaccggtgccaaacccatcaccagtattagcccaggaagagtcataactacgaccatagctagaaccaccatagcccccagcatcacgctcatatgcaccagctaatccaccatcataactaacaccaccatacccaccaccaaggctgcctccataagtgctaccatagcgactagaataaagggaaggttcacggtatcctactaatgctccaccataagtagcatagccactaccataatcaccaggaccataagcactactgtagctgctaggcctagcgccaaaacttcgaggtgatctatagggaccaaaactaccaccataattgtaagagctgccaaatccatcataactgtctgcatatggacggcccctaggctcactatcaagtgaacgaggtggttggttagagggtttctttggttctgccttcttgatctccacctgagaaccatttagatcaatcatattgcccttcttatgtaataaatcatctactgctttttctgcatcaaagactataaaaccaaatccacgtgaccggttggttgcatggtcacggatgatttcatgctccacaaccttcccaaacttggaaaagaattccttgaattcatcttcttttagagctgagggtaatccaccaacaaaaatcttcttcgtcttgaaatctttcaaaggagcagctcccttagggatcgttctcttaatttcaaccggttttccattgataacatgttcatcctcaatcactctgtcaacaacagtgggatcagcaaaagtaataaagccaaagcctctgggcttttgtgtgtagcggtccttcattatgacagcatcaattatatccccatacttcccaaaatgttctttgaatgtactcatgcttgtatccttggagagcccgccaatgaagatcttggcagggctggcgccgtctaactccttcatcttgccggccatctcgtaccagatcggagctagtcaaggatggggtttcgagtgcggagagaagacgggtgccgtcgacttcgaatgagggctaataagcgtaggcgcgtgcgtgtgatatccacatgttccccgcccgacgtgcaacgtcccggccggcctcgagggtcccaa

SEQ ID NO: 22514 - DNA, 2274 bp, Zea mays
  misc_feature (1552)..(1552): n is a, c, g, or t
aaaagtaaatactctttattacttcttgcttgactattaattacaaaggccttggttttaaagacgccggcccctacagaatccccctagatatgagatctaacaactaataatatctaatgactaggactttatccaaacaaaccgggctgcacaatatcctaacacaatatcctaacagattgtccctattaggcggattgcccctggccatccttagtccttctattgtagccctttccagtcataacacatgaattctgacaatgcaacagaattagatccttcgatccgaatgaatgtctttctacagaacagctctgcttccccaatccattttacccagtgcagagaaaaagccctatacgttacagtatcgcacagtgcctcttagcggaagatggccaaatgagccctcagagctgcctgaactgatgtagaacgatgatgctacccaaatgtaattaagatgtaattaccagcgtgatgatatcaagatcaccgattacataatgaatggggaaaacaacatcggcatgttaaacggtgaaagcatgcgaaccactataaaaagaccaatctagttctaagtacaacttaatccatcgaactccaaacaaaacctacgcggaacaagataaagaaacaagataacacttctgtaactacatgtaaagaaactgcgttcggcccttaggttaactttgaccactccataatattcgtaaagacaaagcaaactatactaacaaagaataactcatgcttgtactagcagctagttttgacgggtcactagattttctatctataaaagtgcatacgcttatcaaatatgcttaaattccaattccaaataccaaaacaaaggtttaaatttctacaagttgatctaacagtacttcctaatacagaaaactgagcatattgaacttcagtgcatcttttagatgcagatgatctcttgagcacacatctagaattcatcttctgcaagcttctctagcaaacagcagcactggagattttctatcttccatatggatggtaacgaccagcagcaccactgccgccactgccaccatagcctgtcctagcaccatagagtccaccggtgccaaacccatcaccagtattagcccaggaagagtcataactacgaccatagctagaaccaccatagcccccagcatcacgctcatatgcaccagctaatccaccatcataactaacaccaccatacccaccaccaaggctgcctccataagtgctaccatagcgactagaataaagggaaggttcacggtatcctactaatgctccaccataagtagcatagccactaccataatcaccaggaccataagcactactgtagctgctaggcctagcgccaaaacttcgaggtgatctatagggaccaaaactaccaccataattgtaagagctgccaaatccatcataactgtctgcatatggacggcccctaggctcactatcaagtgaacgaggtggttggttagagggtttctttggttctgccttcttgatnctccacctacaacaaagcaaaaaagtcaaacctatatttctttcagatttgtactcccatgattggagtgagaataacatgccatataagagcaaaattaaagcaactgaaacaaaaagacccaatcagatgtgctaccacaatttgttattgtgtgcagtcttgaccacaggaaataaaattcacaaagctcagaaaaagctacaaaatgcatcacctgagaaccatttagatcaatcatattgcccttcttatgtaataaatcatctactgctttttctgcatcaaagactataaaaccaaatccacgtgaccggttggttgcatggtcacggatgatttcatgctccacaaccttcccaaacttggaaaagaattccttgaattcatctgtcaattcaaattataccaacaaattcaatttactatgcaggacaaaaaagcgcatttgccactatgcagccaaggaaacacaaatataccttcttttagagctgagggtaatccaccaacaaaaatcttcttcgtcttgaaatctttcaaaggagcagctcccttagggatcgttctcttaatttcaacctgcattttagagtaaatgacatttcaaactacacaaacaagcgcttcttattgtttactatatgttttcgtgaaacatgatgtacattgagctaatacagagtgagacaaagatataaaccaaagacaaaaccaaaaag

SEQ ID NO: 22515 - DNA, 1076 bp, Zea mays
atcagtgcttgaaggatagtggatatttgactcctcccacttattagatatctgaacatcagctgatctagcaggctctatatcatcatcgtcatccaacagaactacatcctttttaatctccaagggtgaggccttatttttggcaaggttccacctcctgttactaccaaacgtggcattggtgcatttatcaatagtactattttcctgttgatttatgtgcgggctctttaaagttgttgttttcttctgtcaatatccatatttaaatgttcagagcatgtactctttggaagataagcgcacgtttttgattgatgcctcaacgactcttttgaaatttgaccaccattctttgggtaagcatatttgccatggcttaaagaactttgttcttcatatgcagctcccttaacctgggtataggtctttgtagatgtagtacaacttgagtttggatagtgtttgctagccgtactgtccatggtctcatcatcagactttaagttgtagatttctccactgctgccaccagtacgcttagcttgcactgtctgtctcaagggcgtgacatccatcctctgtctggccctccgccgctcgagctccttcttcatccggaggacaagtgactgcatcttcttgccaccatccggcatcctacggagtacaccctgcagagagggcccttcccactctctgatatggtcctgtaattctcgatcagttgaagaagagaattccgcggtgcatccgtcatgatcgatatcggcgtcggcgagcgccgctgcagcgggacatggcctgatggacggagaagatgagccgatgacctccaactccacggccgggggatcgggggacatcgcctgtcggcaatcgatgatggtcccagcgttctgcgcggccattgccgcgcgcccgcgccgccgggcgggtgcggcgggggaggcttctgttcaagctaacaaacggggttttcgattaggacactagatggggatgagaggcggcgtaaagttcgcgaagtggaaaggtgaataagttcccggccggcctcgaggtacccaatg

SEQ ID NO: 22516 - DNA, 1712 bp, Zea mays
gtgaatctggattttattgatctaaaccctaaaccatttagctaaattttcgtaaatatatttttgttgaatctgaatccggttccaaacaggcccttagataacgttgaactgtacatttccaccgccgaatgaacgagcgtgtaaacaaaagtgtgtagccaacggggcgcattccctccacggccaaacttcacttgggagtgaacgaggttactacatattcaatcaaagcagcaacagcaggctcagtccatctgaatgtccttgtcttcaagctctgcctccgatggtccatcgtcgtctagagcactatgaaatagatcaatcagtagcgcccgtatccctccccgaaacgctgaagcctcttcatggttgaaccatctgcgtccaaacatgccaaggccctcttttgtcaacctctctggcgcatcttgaataaacctgtcaatatagtaaagcataaagaggccacaatcatactcgttaccctgacgtggcacctcaatcttttccctattgatattttttgaaagacgcctccatatcctccctgaaaatggaatatcataagacgaatccatccctaggtgccaccgttctgcttgaatatacctcgcaactatgtcaaaaagcttttgactggagtgaagaccaagagagtccaagtgaagtattattggcccagaatctgcctcttttgtaggcatgcaaacaatgatcaagctccagtgcatcgattcattaatcggcaaaattatgtacgctttcttaaaaatatctacacctctccaccatctccgtaacttgctgaattctgagtcatggtgacccggcatggatagtgcttcttcgagtttgctataaaaataggtgttaaacatgtgtaaatccctgcgaggtcttgccttcttgaggtactgaaggtaaaaatttataacaggtgattttaaatattcttctggttcaagacatttcatgtcagagtaggtcagttcaaccgcttctggatcagtgcttgaaggatagtggatatttgactcctcccacttattagatatctgaacatcagctgatctagcaggctctatatcatcatcgtcatccaacagaactacatcctttttaatctccaagggtgaggccttattttgggcaaggttccacctgggtataggtcttcgtagatgtagtacaacttgagtttggatagtgtttgctagccgtactgtccatggtctcatcatcagactttaagttgtagatttctccactgctgccaccagtacgcttagcttgcactgtctgtctcaagggcgtgacatccatcctctgtctggccctccgccgctcgagctccttcttcatccggaggacacgtgaatgcatcttctcgccaccatccggcatcctacggagtacaccctgcccataggacccttcccactgtctgatatggtcctgtaattctcgatcagttgaagaagataattccgcggtgcatccgtcatgatcgaaatcggcgtcggcgggcgccgctgcagcgggacatggcgtgatggacggagaagatgagccgatgacctccaactccacggccgggggatcgggggacatcgcctgtcgacaatcgatgatgatcccagcgttctgcgcggccattgccgcgcgcccgcgccgcctggcgggtgcggcgggggaggcttctgttc

SEQ ID NO: 22517 - DNA, 1284 bp, Zea mays
taatttaaagggaaacataagggttgcggcataggaggaaatgaaataagttaacaatacaaatgtacttgatgcaagcccaggaaatagcaatatataacctcagggtagtcttttttatttactcatgttagccatcctgacaaaaaaacaaaaactctcctttcaagtccaaacaaacaacgtcgtgggaagaaagatgcttatatctccacttaatcttttattgctaatccatgatattatcatccggatctttcagtctctcaataacaaaaaaccaaattttattacaacaaacaaacatctcattttatccactgaagaactgaacctagaccatttgctgagtaaaatgtacacctctctaactccaatttggatggctatttcttctaaatggaaaagacacctcgttcctcctgggatgattctaattgcagatgtaatttcaattgctcgctgaaagcaacgaaaaaaacagcatccatccataatcttacactaaaacccaacatttgggaaatctttgtggcatcctacccatgattcagaccaatcaccaactcaactgtccgtgggcctgatatcaaccaagcccaaaacagaaagggagaaacactaaagcaaacccgaagctattacgcgaagtccacattttcctcaccatcctctgtctggccctccgccgctcgagctccttcttcatccggaggacacgtgaatgcatcttctcgccaccatccggcatcctacggagtacaccctgcccataggacccttcccactgtctgatatggtcctgtaattctcgatcagttgaagaagataattccgcggtgcatccgtcatgatcgaaatcggcgtcggcgggcgccgctgcagcgggacatggcgtgatggacggagaagatgagccgatgacctccaactccacggccgggggatcgggggacatcgcctgtcgacaatcgatgatgatcccagcgttctgcgcggccattgccgcgcgcccgcgccgcctggcgggtgcggcgggggaggcttctgttcaagcgaacaaacgagggttttcgattaggactctaggtggggcccggccgccgcgtaaagttgggaaagtggaaaggaagaaatgtcagagcatctcaatgaggtccccacaaaatgacacttgaaaatcaattttaaatgacatctaaaaatgagtggggttcaattttaatccttttttaaccgattagggcttttctggttagctctttgtcggcgtttcggacccgc

SEQ ID NO: 22518 - DNA, 1832 bp, Zea mays
ggccgctttttttttttttggcttcgtcaacacagaatcttatttatacccaaatcaggttaaaaaaactgacatgacagtaacaatctagcagatgccctcacgtaagcaaaacatgaacaaggaaaaagtctgattctaatctatccccgtcacaacagcaacagcagaatctacaggatatctgaaacaggaagctgctgcgagtttttttacttactattaccatcaccatctcggcacaacagatgtgaaacagtaacgtctatacccggataaggaaactctacagcatctctagaatgagaatacatacactagtacatcgtgtgtaaccctgctaaatgctaacattatccaagagggtgatggtaatctagcacttcctgatataatatatatacactaccaagttcgatattttaaatacgataaagtgctagtttggcaaccccatttttcaaggatttttattttaccaacggaaattagttcatttcccaagggaaaatggagttggcaaactagccctaaaatgtaataaatctgccgaactagtgctgtctgccagcgaagctctatgtactccctcttccatggataaaacggaaatacaacatattctcaacagccttcaaatgtcctcggaatgagccacaaaggaagatgaaactcagcaatctacatggtggatgatgctaccaatttatatacttggcaccattttgctatataccctactctgcaactttgttatttcgattcgcttggaatgaatggatatccttgcggaagttctctagttcctctgggttaaaccagccatcatcaaacagctgggtaaatttttcttccaattttttgttttcaagaacttctgtcagttttttgttcagtagaaaacagcggatgaaataaagaacataaattccacattcatccccattttgctgtggcactttgggaaactcgaggcagattttgtttatgaactgcttgctttcttcccgctcctcagtcttgtaaatgtcaataatgaattttctgattgctgatcgcaaccttgtcggatctgtcgtattgagtgagtccagcaccatcatccgtggtcctttcttaatatccgaacagtttgcatcaccaaagtggcataagacaaggaggctccagtgtccaaaacaaacaataggaacaaaaacatattgtcttgaaaatattctcttagcttttatccatttaaggacattaggtttattactcccatggtaatacatgttaaaccataaagaatccaagtacgcataagcactcttcttatcttcatcaatgtgcttccaaagatcttccatgtataattcaaaaatatcagtatttagcttgtcttgatttgtcttgttcctcctgctagttgcatggcgtgaggctctgccctgggggaggttatcataaaatgaaggcaatacatttttggatctcctcccagatgtcttcaatgttgttgttaatacatttttcaatctcccagatgtcttcaatgttgttgttctacttgtttgagaacccttgctttggcactcgtcttcggcgtcgctgtcgaggtcgatgagcgcctgccccttgtcgcggcggcggcggggcataattgtccgcttccgcccgctcgccgtcggggaaatgccgatcgccttctctagggtttggcccggcggatttgggggagtagaggacgggcgggaaggcaagtagtggagtgcaggagggagaagcgggttttccttttgccggttgctttttcccggccggcctcgagggacccaatcgcccataggagt

SEQ ID NO: 22519 - DNA, 763 bp, Zea mays
  misc_feature (691)..(691): n is a, c, g, or t
cctcgaggccggccgggccggatgacaaggggctcggttagtccacagccctagaggctgcagctgcacacttctcttctctgttttcgccggttaaactttccccacttgttgctggccttcgaatctgtggtttgtttgagcttgtaaggatctcttcttcttcactctagcagggaagcgaagaacagggaagcaaggacatggatgctttcagtgcagtgatggacaaggtaaagagccacccagaaatgatggagaaggtcagtgcagtgatggacaaggtgaagaagagccacccagaagcggtggaaaaggtcaaggacgaggtgatgagccttgctgatgctctccatctgcgtagacatggatccaaagataaagaacctgagtctgaagagaaggccgaagaaggcgaggcagcgcagagcgtcgaagaggaggagggtacctctgctgacaagactgcagaacctaatgtgttggagcaggccgtacaggagattcaggctgtcgccgcagctttgcagcagacagcacctgaaactgaaactgaaattccagttgagactgctgctgctgctcctgaaacttcggctgaaggagacaagcctgaagacccaaacagggaggtggagaaagatgacccaaagaagcggctcgatttcgccgggttcttcgccatgctgtnttgaagaggttctgctccccggccaacaagaagaaagactgagtgattgcaggtcagctgtggatttctcgt

SEQ ID NO: 22520 - DNA, 1141 bp, Zea mays
cccacgcgtccggaacacaggctgctgcgccgtgcaaggcacgatcgtcgaccaaccaccatgaatgcctgcagtttgcttgcgtccatttcgctgtcactctgctgcactgtcgccctaccatgtagtattattatgcatggtgctccagtttgtcattagtccatgacaaggggctcggttagtccacagccctagaggctgcagctgcacacttctcttctctgttttcgccggttaaactttccccacttgttgctggccttcgaatctgtggtttgtttgagcttagcagggaagcgaagaacagggaagcaaggacatggatgctttcagtgcagtgatggacaaggtaaagagccacccagaaatgatggagaaggtcagtgcagtgatggacaaggtgaagaagagccacccagaagcggtggaaaaggtcaaggacgaggtgatgagccttgctgatgctctccatctgcgtagacatggatccaaagataaagaacctgagtctgaagagaaggccgaagaaggcgaggcagcgcagagcgtcgaagaggaggagggtacctctgctgacaagactgcagaacctaatgtgttggagcaggccgtacaggagattcaggctgtcgccgcagctttgcagcagacagcacctgaaactgaaactgaaattccagttgagactgctgctgctgctcctgaaacttcggctgaaggagacaagcctgaagacacaaacagggaggtggagaaagatgacccaaagaagcggctcgatttcgccgggttcttcgccatgctgtttgagaggttctgctccccggccaacaagaagaaagactgagtgattgcaggtcagctgtggatttctcgttttgtgatcttggacgtggaaattacattttacttgatgtatttattgtgggtggtgtacagtctgcacttgtgttctattaagataaatctgctcttgctttttttactttcttttgtgatgacagggcaatgattacattttacttgatgtatttattgtcgcccttgtggaattgatttaatttatgtgaacgattgatttatttagggttaagataatgcagtgagtgtgtgatgccttgtaaaaaaaaaaaaagaa

SEQ ID NO: 22521 - DNA, 1060 bp, Zea mays
gggtacctcgcagccggccggggctgttctctgctgcactgtcgccctaccatgtagtattattatgcatggtgctccagtttgtcattagtccatgacaacgcgcgccggccggccgcagccctagaggctgcagctgcacacttcccttctctgttttcgccggttaaactttccccacttgttgctggccttcgaatctgcggtttgtttgagcttagcagggaagcgaagaacagggaagcaaggacatggatgctttcagtgcagtgatggacaaggtaaagagccacccagaaatgatggagaaggtaagtgcagtgatggacaaggtgaagaagagccacccagaagcggtggaaaaggtcaaggacgaggtgaagagccttgctgacgctctccacctgcggagacatggatccaaagataaagaacctgagtctgaagagaaggccgaagaaggcgaggcagcgcagagcgtcgaagaggaggagggtacctctgctgacaagactgcagaacctaatgtgttggagcaggccgtacaggagattcaggctgtcgccgcagctttgcagcagacagcacctgaaactgaaactgaaattccagttgagactgctgctgctgctcgtgctcctgaaacttcggctgaaggagacaagcctgaagaaacaaacagggatgtggagaaagatgacccaaagaagcggctcgatttcgccgggttcttcgccatgctgtttgagaggttctgctccccggccaacaagaagaaagactgagtgattgcaggtcagctgtggatttcttgttttgtgatcttggacgtggaaattacagggagtgcatgggattgtgggtggtgtacagtctgcacttgtgttctattaagataaatctgctcttgctttttttactttcttctgtgatgacagggcaatgattacattttacttgatgtatttattgtcgcccttgtggaattgatttagtttacgtgaacgattgatttattttgggttaagataatgcagcgagtgtgtcatgccttgtcccc

SEQ ID NO: 22522 - DNA, 1310 bp, Zea mays
aaaaaggatcctgattgggcttcagcttcagatgattctgatggctgctgctcggcagatagttcaaatgggcctttgtgcaagcaggaacatgaggactatcctgagaggcctgaatgccctttccttcttagatttggtaattgtaagtttgcatcatcatgccaatattaccacccaaaagacaaattttcaagtacctaccatccagaagacaaattccaaagtcgataccatcaaaaagaaaaatcaagtcgacaccatccaaaaaaagagccagcactgtcaggagaactgatggtttatcctgacagacctagtgaacctgactgccccttctatgtgaaaactgggtcctgtaaatttggggcaaactgtaagtttcatcacccgaaggatataactccaaacatgcagggtccagcaagtccaaaaaggtcggtcgctgcaaaagagcaccacccagcagctagagcgacattacaagaccagatgtaccagcaacaaaaattccctgagcggcctggccaaccagattgccggtactacatgcaatttgggaaatgtaaatttcaatcagcttgtatattcaatcattcaaaagacatactttcaagtgggtggcatccagcagaatgcccattctacatgaaaactaggacatgccaatttggatcagcttgtgagttttatcacccaaaagatcggtgctcaggcagagggggagtgattgatggtactgactatggacatgattttgccacgaagtcacggaatgttctgcaggaactggcaatatatcctgaaaggcctgatgaacttgagtgttctcactacatgaagcatggctactgtaaatataagatgaactgcaaatttcatcatccaagagatcgtcttccaaagaaataggaccatttgctacaaccactgttgtaactggctgtcgttgatgagtggaccaagtactgatgatgggatgatgatgggacagaaatgcaggaaggaagccatagtcttcctttttgaagagatcgattctactcatgtctagtgtcgttagagttctcgtaccagatgcgaactgcctggtggcttcccaactaccgttcattcatatactaccaaacattgctgtgatctaggccgatgcggcgctaacctgagattgtgggttactgtagctcagtatgcagctcaggtacctgcacttgctcaagattgcgataacgatcagattaaaatagcagaccacgcatattctgcaacttgcgacttttaaaaaaaaaaaaaaaaaaggcccctaagcc

SEQ ID NO: 22523 - DNA, 1079 bp, Zea mays
  misc_feature (1076)..(1076): n is a, c, g, or t
tccaaagtcgataccatcaaaaagaaaaatcaagtcgacaccatccaaaaaaaagagccagcactatcaggagaactgatggtttatcctgacagacctagtgaacctgactgccccttctatgtgaaaactgggtcctgtaaatttggggcaaactgtaagtttcatcacccgaaggatataactccaaacatgcagggtccagcaagtccaaaaaggtcggtcgctgcaaaagagcaccacccagcagctagagcgacattacaagaccagatgtaccagcaacaaaaattccctgagcggcctggccaaccagattgccggtactacatgcaatttgggaaatgtaaatttcaatcagcttgtatattcaatcattcaaaagacatactttcaagtgggtggcatccagcagaatgcccattctacatgaaaactaggacatgccaatttggatcagcttgtgagttttatcacccaaaagatcggtgctcaggcagagggggagtgattgatggtactgactatggacatgattttgccacgaagtcacggaatgttctgcaggaactggcaatatatcctgaaaggcctgatgaacttgagtgttctcactacatgaagcatggctactgtaaatataagatgaactgcaaatttcatcatccaagagatcgtcttccaaagaaataggaccatttgccacaaccactgttgtaactggctgtcgttgatgagtggagcaagtactgatgatgggacagaaatgcaggaaggaagccatagtcttccttttttgaagagctcgattctactcatgtctatgtcgaatttctgccctagtgtcgttagagttctcgtaccagatgcgaactgcctggtggcttcccaactcccgttcattcatatactaccaaacattgctgtgatctagatctagcccgatgcggtgctaacctgagattgtgggttactgtagctcagtatgcagctcaggtacctgcacttgctcaagattgcgataatgaccagattaaaatagcaggccacgcatattctgcaacttgcgacttttncat

SEQ ID NO: 22524 - DNA, 1924 bp, Zea mays
aggggaaatcggtgatctcctttttgtctttcataaaaactctacatctttgtcattgattttttatgcgttaaaaaaataagtatttctatgctttacagaaaaacataatacacggtaaactatggaaggatcatgatagatacgtctaatttacaacctgcaacctttcttaccatgtccataatactaactaatgtgtgtgtatatttttaccatggttcaaaaatctgaaaaggagcctgccaatgctaataatataaacatatcagcaaacatgttacgtcccaaaccagctgatcaatattaaaaagcgggatcgacagctgatcaatattaaaaagcgagatagaatgacatgttgcctaccttaactttggaggatgctaaacttctatatcttttaatctaaaaactcaaatacagtaacatctaccctatttaatcgaacagagtaacatgaagtaaacagactatgctcaattacaatattgtatgcatatcctagtgacagaataacactaactgaacacatgaggtctgatacagactgcaacctaaagaacaagacaaatgagatattataaaatctgaaactctaaccaacttcacattgaacataggctgcaaaagtttgaaagaaactataaaaaaccaaatacatttgacaattcctgaatccagtaccccctaatatatagcatatttgattcatattattgaagaagttactaagcaacatctttttgacaattgttaaacaaatgtagacttgcatatctgtcagttggtactttagttgttttaaattgggaacctactgaccatatagactttgtaaaccaacttaactcccctccctgcattgctagccacaagataattagttgatatacatgaagtgatgaagagctgcaacacttgcagcatcctataatgtggtcagattaaataaccaatttgactcaccttgcctagcaaggtatgccttgcgaccatgcccaaccttgcaagcacggctagtaggcaaagttgagcaaggacaccaagcataacaaaaaaaggagcagtaaatctattgaatatgctcttggttccagaggccatattagtaggtatgatgattcatgattggccgcttttggccttcggtgcctcttctataacaagatttgcacaaatgtattggctattgtgttaagagtgctgagtgcaagcctcagatctcgactcgtacaacaattgctcattgccccatgccatctcgtacaacaatagcctcagatctggctattgtgttaactgaaacggatcgcagattggagaaacaataacctcactgaagcacagatctcaactcgtacaacgattcaaaccattgaaattctaatgcttactctatcggtctgcctcgggctcgtaagagaagagatcgggatcacagaagggagggggagtctaggaagcgcatggagaggtacggacctgcgccttatcaatgagcctaagcgcaaacatggagacggggagcggtgcctcatagacaaaggagtggttgatgcactcgttgtagaggaagcgcgataggacacattcgtcggcggtgaggccaacgagcactacccaacttgctcagtggtgcgaagcaccttccgctagtaggagagctcggaggtgggcttgctgacggtggtgagaaccacggtgagatccagtagtcacaacggcgctgcgctgggtggatctgaatctgggcagtgtggtggtttgggtcgaagagtggggctcaatagcatgggtggaggtggccggtgcgaaggtcgctcgcgttcatgtcaagtggaaccgtcgccgctaaaaccctagttctttgcacacaacaactgccgtgaaggttggacagaacggtcggtttttatacgat

SEQ ID NO: 22525 - DNA, 2044 bp, Zea mays
agtccttattcaccccctactcttaggcgtcacctggtttccttcaaactgtcaacacattacatgctatctgttgaaaaattgactacctatatattctatatatgtttttacattttatttgtagtgtgatgtgtggtgctacatttctaagattacaatatttgcaaatgcaggtcatccaataggtgcccaacatgcaacatgtgcaggtgaggatgtgttttgatgtaatgagtgtcaatacgggtgggtatttgttgcacccgcgaggtgtccacccattgtcatagaaagtgcattttattaacggaggggtacatatgggtggtaatgaattctaaattttacactattaaatttaatgatatgatcggaataggatcgactcatgtttctattcatttttttactaaaaatatttaagagcttaaataaattatgaagaaacatttggactgtgagtcattagcaccctaggggtacatgcatgcgtagagaaatgagccaaacaatgtagcagtttaaaagattctttttactacaatcttacaaaagttatacagttaataatatacggccgctgatttggccggcaatttttttttttgttttgtgatttaatgtagatcttcccagctccactgaatatattagcgaccgagcaatcagtacatacagacgaataataagcatacatatgtccctggcctggactgatcaactccgacccaattgtgaatcaaaactctacgttggcctggtaggttgcggactttatgttgggtttcttcttgggcgagatgctatcgaggacgagcgcgcagtgcacgttgactttaatctggcggaggtcgacggagccgagctgcagctccacggggacgctgacgaagatgtcgagcgggatgtccccggccttctcgctctcctctagcgcctgctggagccccgacccgaagccgtggcggccctccatggagatgtccatgacggtgacgttcttgtagccctggaagaaggccgggagcttcccggagcacagcggcgtgccgcggtaggagaccacggtgtgggagccctcgccgtacctgatggtgatcatctcgttggggttctcggcgcgcacggaggcggtgagcttgacgtacagcgtcaggtcggaggtgctgaagtcgaactgcgagacggacatgttgctcacggagtaggacggcgccttgggcttgtacacgaagaagaagtaggcggccgtgccggccagcgccgccacgatgaacaacaggaagcagcagcaccagcacaggcagccgcagcagccgcctttgtcctcgtcctcagggtaccgagggacgctgcgcttgcccatggcttatatattggttatgtatagtgataaattattagtatttattagggacgacgtcgccctccggccgccgggctccgactctccgagcgggtgaggagagaggccggcgtcgacgggtggcgggtggggtaggagctgaggccgtgccccggccggcggcgaggaacccaatcgcccttaggagtggggtcgcatttttgtaggccgggaaagactctctggttgggaggagaagccgggaacatgttggaggtccaataacggggagttagtctgctaaatatgtcaacgtccaagattaattaagcttcacgagggtaaagggaactagaaatttgtcatgcctctcctagattaatatagtttcagcccattttcagctcgtcccataaataagtggcacatactctgaccattttatttacactaataacacatatatattgaggggatatatattaggagctcagggcttccaatagttaccccggtgccccctcccctcccacacgtgcacaaccaaccatctcacacatgtggtcacgtccctgaggaaattagggttttaattagaattttttttatggaaattacagatatcataaattacgagattttcttttcgttgtgcatgcgaaaaatatgacatacaggacactgggggcgcaaacc

SEQ ID NO: 22526 - DNA, 2171 bp, Zea mays
ctgaagatccccaagaaggggtcgacctcctcctcctcctcctcccgcggcggtcgcgccgcgcccaacgagtgctgcgtcgtcgtggtcgagttccagcacggcggcacgctgaagacgctgctgtacaaccaccgcgacaagaagctttcgtacaggaaggtcgtccggctcgcgctcgacctcgccagagggtgcgtacgtacatcatgagtggcaaccacacgcagcactgctgccgccggtatgcatggtcgctgatggcgctgacgacgatgggatatatatgtgctatgcattgcaggctgagctacctgcacttcgaagaagggtgatgcaccgcgacgtgaaggcggagaacaatgctgctggaccggaagcggacgctgaagatcgccgacttcggcgtggcgcgcgtggaggcgcagagctgcgaggtgacggggcagacgggcacgctgggctacatggcgccggaggtgctgcaggggaagccgtacgaccacaagtgcgacgtgtacagcttcggcatcctgctctgggagacctactgctgcgccatggcctaccccaactacagcctcgccgacatctcctaccacgtcgtcaagctggtagctagctagctagctttgccgacaccaccttcgcgcgcgcgcgcgcgcgttacatgaatgtttaatttgctgccatgcatgcatgcagggcatccggccggacatcccgaggtgctgcccgcgggcgctggtggagatcatgacgcggtgttgggacggcaacccggacaaccggccggagatgtcggaggtggtggcgctgctggagaagatcgacaccagcagcggcaagggcggcatgacgcccgtcgacgacgtcgcgcaggggtgctcctgcttcggcttcaaccaccgcagcgtcgcctaggctagctcccgtcagctgacaccgcagttattaagttattattaataataattaagctacatacacacgtactacctaagtatggccggccatgcccatgccccctcatctcgtcggtccgccggcgagcatcgatcgatctttttctttgcatgctgtcggtcgtccccatcattgtgcggatgtgtttaaagcgccgtggacttgcgtgtaacctgtaactcgtcttgtgttctgtggtctgacgtataatctgtgtcggcatcccattctgataatctccaagaccgcaacgagagggcgaccttggcaattctgaccggtttggacatctcttgattagacgctgaaaggtcagaaaacttcattatttggcactccagttcatgtttggatcggagtcgaatttggctaagatattcggaacaaaaagctatgtaccacagaagataaaggttattaggataggcagtgtttggataggaaactaataagacgtataattccaaggagagcagatactttcatggattcatcgctaggataggatgctgtaaacttttggtctttgttaatgctaagataagaccagggcatatactttcatgggattcatagtttatttttgggagatcaggagggttcataatttatttttggtggtatatatagaaacaataaggaaaccgaaggacctccaatataatgcatttatgtaactataacaagtcgctttcataatcaaggaagacatccaactcgtcaaacaaggttcatttcgagagccaaagtttggctagaagtcgaccaacaaattctgatgtctttttcaacttgtctgcatttaaaaaaaacagtcatgttttggctccacccaaatgaaatttatgtctagtactgcctttcaaaataggttgtgtcatgacaatttctcctatgctgacagagtactctagtggttgcacaagtagaagacacaatcactactcatcaaacttgatatctcaaatgagtttcattctactgtggtgtctaggatcgattcctaagcccctagaataccgatccgtactgaaaatactttgatgatgagtagatcaaatctactgagaggtttaggtgaacatacattcattgttgttgtttatggccgcggcggcgatggcggcggtgtcttgcatcgcagtctcgcctcctccgtggccatcacctccctctattgtgttttgtcgcaatggtggaggata

SEQ ID NO: 22527 - DNA, 1084 bp, Zea mays
agcagttcctcagacgcaaagaagatcgagtctgcagcccacaccatagtgcgagcagattgcgtccaataggcgcaaagggagatgggggtggcccagctgaagatccccaagaaggggtcgacctcctcctcctcctcctcccgcggcggtcgcgccgcacccaacgagtgctgcgtcgtcgtggtcgagttccagcacggcggcacgctgaagacgctgctgtacaaccaccgcgacaagaagctttcctacaggaaggtcgtccggctcgcgctcgacctcgccagagggctgagctacctgcactcgaagaaggtgatgcaccgcgacgtgaaggcggagaacatgctgctggaccggaagcggacgctgaagatcgccgacttcggcgtggcgcgcgtggaggcgcagagctgcgaggtgacggggcagacgggcacgctgggctacatggcgccggaggtgctgcaggggaagccgtacgaccacaagtgcgacgtgtacagcttcggcatcctgctctgggagacctactgctgcgccatggcctaccccaactacagcctcgccgacatctcctaccacgtcgtcaagctgggcatccggccggacatcccgaggtgctgcccgcgggcgctggtggagatcatgacgcggtgttgggacggcaacccggacaaccggccggagatgtcggaggtggtggcgctgctggagaagatcgacaccagcagcggcaagggcggcatgacgcccgtcgacgacgtcgcgcaggggtgctcctgcttcggcttcaaccaccgcagcgtcgcctaggctagctcccgtcagctgacaccgcagttattaagttattattaataataattaagctacatacacacgtactacctaagtatggccggccatgcccatgccccctcatctcgtcggtccgccggcgagcatcgatcgatctttttctttgcatgctgtcggtcttccccatcattgtgcggatgtgttcaaagcgccgcggacttgcgtgtaacctgtaactcgtcttgtgttctgtggtctgacgtataatctgtgtcggcat

SEQ ID NO: 22528 - DNA, 1554 bp, Zea mays
gcgctgtccaggttctcaattcttcatatagccatggttcatgaccttatctttcgctagctcgccatcctcaccaaggatggacttcctttttcgagttttttttttttttttttttttttttagtttgaaatagtgagtggaatagagaggctgctggagataatcttatattatcaaaattacagtgctcaatgcatgtaactccatccattccaaactaccataagaaaacatcatattgttttgctacaggttctcattggctgaaccagtaacgatgtccaaacagtttatcgcatcagggcctgtccacgttacacttcacataaaaagctcacacgccacagtgtccggcatcactcaagtcatttccgttacaaagcgacaactcatctggtgcttcgattatttatccgcgacgccaagtcagtcaacgctggataccctcctcaagccccatatttaggcgctttccagagcttaaatgccacctcgtgcaggaagcgctcagcaagcatggcaaggtttccaccacgcttcataaactcctcaaaagagaaccctttagccaaatcaacacgtgttactctgtcctgccactgtgccagcaaaattggatgatgaagtctgacatcatctaatgtacgccctgttttcattgtgtagctctggcgtggacgcagtagattcaagtctgaatctgtttcggttgaagaggttaaaagggaaaactcatccttatttccagaagcagacccatagctcaaaatcacagatacatgaatacgcgaagcaatagctgaaccaacaggcgcagattccaagactgcaccaactaatttgtcgagccgattgatatctgtcttcattcctaactttcctaacttgctgcttgtgttctccatggcaacatgcatgaagactagatcgaattcagatgtttcctgcacatccccatccgagaatcctagaagatcaaatgctcttttgattaatccatcctctttagtaatgctggacgagccagattgtggggcaaaatcattggttttaaaaacatggaaaccaagattcgctgcgaaggagctgacatgggggcaactggtgaccaaggcagctctcaggcccataaacctctcaaacagcttgggaaccacgagctcctgtggatccacttgggcaacttcttgaccactttccgcattctttccggggtagagatgatcgtaaacgtcgagcagctgcgccagttccaaaatcgtgctgctattatcctcggtgccggtcgtaggatgggaagtcggcggggagcgtagggtgagaaggccgcagcaggcgcgggaggcgaacgcgtcgaggtggctccccgcggctgcggagcccggcggggggatgagcgccgcggcgtggccggcggcgtagacgaccagcgcgcggctcggcttgtccgccatggccgcacccgcacttctctcgccggagtcgcctacttgcctcctttactctctgtctgccccctccgcggtgccaccacgcgtctggacagggccc

SEQ ID NO: 22529 - DNA, 1325 bp, Zea mays
aggcatgaaggccacgttacctgttcgctgcgcattaaagccggctatttagactgttgcaactacaatccattgagacaaaaacaatgtaaaagtagtagaagccggtacagattagtcaagtgaacagaccctatattctccagaggaaccatacagggacagtcacatcaagcatgaatgcgtaataactacttaaccccactcaagttcttacaggaaaactgtttttgacagcaaaaagacttgtgtcaaatgttattttacgcatttacagactcagaactaagacgatcaatcatggaaaattagctcatgtagccgcacatctcactcggtttcatttgagaacaagcttggtgactttgtgattatatcattcgcctcaggtagcggtgaatcctttgcatcagctgcataaagtatcttccggaccgccttagtcatcggtagatgctctaactcaggccgttgacacagtatctcaatatcacgcaacttcgagaagtagaagtctctttctttttcagtactatcgacagaaactttcaggtctgcaatcttttcagacaacttctgaatctgttctatgtaatgctcttcagaaaaagtgttacatactttcccaactccatggcctccatctgttggatcagcaccagaaagcctattggcttgcaatgatttagatggcttattggaaccctttgagacacgttctttgcatccctttgacctcctttctacagggttgtaattttcgttcataattccaccattcacagaatcacaatatcttttcaaccactgaaggaactccaagttgtccaatggccgtcctttaacaagcttgttgacctcaatattcttgcctatccgcagcttgttgaacacgtcctgaagaaccttgtagttctggatcatgtcatattctgtcttcgcatcgaaattgaccttatgcatgggcaccactccagggtgaaccatatccatgagctggcactgcactgcgccagacgctgcctcctcgaccttggcgagggagagctggagggtcgcattgatccagtgcaggatctcgcccctgccgacgaagtaggcgccgtccatgatcccgatgctcgccgccatggttttaggcctccacactcctcagtcctcaccgctcgcgaaacagactttttcgaaacgactcccacgcgaaacggcggagcggcagggagggcgttcgcgtgcgggtcttggagctttgctcgcgtcgggtcaccgtgccttaagtaacctcacagcggggtggcttccttaccgtttgaaacgcctcgagc

SEQ ID NO: 22530 - DNA, 1135 bp, Zea mays
agtcaagtgaacagaccctatattctccagaggaaccatacagggacagtcacatcaagcatgaatgcgtaataactacttaaccccactcaagttcttacaggaaaactgtttttgacagcaaaaagacttgtgtcaaatgttattttacgcatttacagactcagaactaagacgatcaatcatggaaaattagctcatgtagccgcacatctcactcggtttcatttgagaacaagcttggtgactttgtgattatatcattcgcctcaggtagcggtgaatcctttgcatcagctgcataaagtatcttccggaccgccttagtcatcggtagatgctctaactcaggccgttgacacagtatctcaatatcacgcaacttcgagaagtagaagtctctttctttttcagtactatcgacagaaactttcaggtctgcaatcttttcagacaacttctgaatctgttctatgtaatgctcttcagaaaaagtgttacatactttcccaactccatggcctccatctgttggatcagcaccagaaagcctattggcttgcaatgatttagatggcttattggaaccctttgagacacgttctttgcatccctttgacctcctttctacagggttgtaattttcgttcataattccaccattcacagaatcacaatatcttttcaaccactgaaggaactccaagttgtccaatggccgtcctttaacaagcttgttgacctcaatattcttgcctatccgcagcttgttgaacacgtcctgaagaaccttgtagttctggatcatgtcatattctgtcttcgcatcgaaattgaccttatgcatgggcaccactccagggtgaaccatatccatgagctggcactgcactgcgccagacgctgcctcctcgaccttggcgagggagagctggagggtcgcattgatccagtgcaggatctcgcccctgccgacgaagtaggcgccgtccatgatcccgatgctcgccgccatggttttaggcctccacaccacactccactccactcctcaccgctcgcgaaacagactttttcgaaacgactcccacgcgaaacggcggagcggcagggagggcgttcgcgtgcgggtctt

SEQ ID NO: 22531 - DNA, 1125 bp, Zea mays
gacataaaaacaatcgacatatactcgtgtcatcaatacccaaaataatctgatcccatcgtagccgtgagcatagttccaaaccacaggtctccagcgaagtttacaaaaggaagtcaaacatcccatttcctaagggcatagggattgtttggatgcgcgtgtatatatttcaattcaatccatataggttggagtagtttggtttggattcaaaccactcaaccatgtgcgttgaggtgaagagatgagcatccaaacaaccgtctaagagaagaagaaaaaacacgcacaaattcaccaatgaagcaagaaaccatacagcctctccaaggcatccaccgtgtatggatactgcagcaggtgcagtcagccagtcctcttgatgatgtgcaccccgctctctgtatcaaccacgtcgctgatctccccgaccttcagagcaaacgcggccttctcaaaaggcttctgcatcttacccctcccaaatgaaccgaggtcaccgccgcgcttggccgagctgcagtcggagttctcggcagcgacgtcctcgaactcgcggtcaccggagacgatctggtcgcggagcgcgcgcgcgaggtcggccgcgtcgtcgcgtgtcgtggcggagatggcgacgccttcgggatcccgccacgaggccttgcggcgggagccctcgtgcttgatcaggatgtgagaggcgcgcaccttctcgtcggccgaggacggcgggcggcggccgtggtggtggtggtggcggtcgcgggagcccgcggaggaggaagaagggtgctccgggcggcggcgcttgtcggctggccccggggtggggccaacatcgccgctgggccgcttgcgcgcggcgtcgccgacgccgtcggcggcggggctttccgaccctatcttgtcggcccgggtcgcgacgcgccgcggcaggcagcaaagaaaagctcgggctggttggtggttttgggctgacacacctagcttgtgaagctggcccccggccccggtgcagtggtaggtatatatgcaggaggcggtggcggttgaaatggcgattgcgccggcatggattggatacagccatgccggtgatgagtgggatagaaagaagattcc

SEQ ID NO: 22532 - DNA, 5694 bp, Zea mays
ttacaattatatttagctctaatgtctctcaaaataaatgtttttgtcgatcatttcttgaagcaaaatctataataaattatataaaatcctcaagggtaatatttagatcaacattttctaatatatccctctcaatagattatataatttttcaataactttaactttgagaaactcctttcagctaaggctacagtcatataaatagtcaataaaattcgatatgtaatagagatatttgggtagcaatctgcaactataataaattgaagaatctcatgcattgatatcaaatcgtttggcaaagttacttgcaacacctataattcactgataaaatcattgatatcaacatcgatgaggtataatgagaagaagtttgcaaaaatagcgcaacacttccacatatcatctactttatgttcttttgagtttaataagaaagcaaattggttttcaaatactttaaattgctcgaatcgacattcaataaattaattgtcatatcaatcacgacaaaaaaaaaactccaagttgccttcaattgctcgacattaagttttttttctgtttttcatcatttaattccgtggtacataaacaaggagctggtttatttaaaatcctgagaacaaaatcaaaaggcttaaaattaaggataaggataaaatcataatagaacctagaggatgagacgaaacaccaaattcgtaaaatttccttggcctaagtccaatccaatatattgatttgaagtgtcttcatactaaaaactaacggatggtccatccaagcccaggcctggcctgaaaatgaagagccaacgcacactatgaacgtaatggccacaatttcttggcatgaaatgaatgagctttctctggcaaacttaaaatatgcacaggtctaattatgtagaggacagcgcacccttaatccatgtacagaatgtaaggaaacttggagctattatcagttcgtatttgacatcagtttgtttgaaggcagtgaattagccaaatgcttcacatttacgatacacggttcgtcttgctgttgtgcgcaatcaaacaggcgagacatgatgttggggggcaggaaggcaacagaccgcaaaagctatcctttgcacaccgcagctactttggagaagtgagtttgttagggtcgttatcgtgcttcagcgacgagtccccgctcaccaattcatggaaagcttctactttgacaggtggcattcgcatgccatatgcactcctgcaatggaaatcatgggctaaatcagatgaaaatacaggagcagtcaaaataacggtctgggcggttgatctttacattgatgagacttgtttgaactgctgtgctagttgtgcattctgatttcctgacatggtcatctgctgctgttgctgctgaagttgttgctggtttagttgctgttgctgttgctgttgaaggtgctgctgctgattaatctgctgtagttgctgctgctgttgttgcaattgctgttgctgagtgaactgctgctgctgttgttgcaattgctgctgctgttgctgcagttgctgctgctgctgattaagctgttgttggtgttgctgctgctggagctgttgttgctgttgctggagctgctgctgttgaagctgttgctgctgctgatgcaatagttgctgctgctgtcttatattaaattgctgttgtctagtaaaagacccatatgggacatcgatttgagaatccatagtattctctaccttcacattcaccataggctggttcttgtctgccatagtaagaggaccacgggggctgcataactggttgcgcctaagccactgctgcgcctgcagaagctgctgctgttgtggtgtcaaattttgaagctgctgctgttgctgtggtgtcaaattctgaagcatttgcggaggaaactgccttggaagctgacaattgtggatatgcagtgttaaaacgaatgggagcaacataaacaacattatcgtgctctcaaagacatttcaacgactggttgtagtctcaaacacgaatggctatatttatgcagacaagatatattattatcaatttatcatggccaacaacaaaaaattcagggaacagttgttccaaactgcttaggtagttgaaactcgaaaaaactatgaaatatgaattccaaagaataaacatactagaaaagtttcttatagaggtgctgactgaccaattgctgctgttaactagactagctagttgcccgtacatttgttacgatttttataaatcatatagatagaccttacttaaacaagataattattcaaacacgattatgtttttcccttgcttctcaagggcgctggttcgaatctccccacgcagatttttccacaacgacgcgcgggagaggagagaaaggacgacacgcgaagaaattcgtgctttaaaggtgtagcgatgttcaagaccagaatggtttcacggaactctacgattcagtgggtaaaacaaaacgttaagcatgaaaacccattctctgttaaaacttcaattgggcaggtggtccaaatgtatggaatatcaaaataagcgctaactgagaaagggtccacaaatggcagtcctcatttttaatactctcttccaaattataagacgttttagcatttctagatgcatcccttttactacgtgtctagacatagtgtatatccaagtgcataacaaaaactatgtatctagaaaagctaaaacgtattgtaatttggaattgagggagtagttaccagtgttgtcactcttgcagagattcatacgtttcttgcactaaagggatctattccagattcagattattatttgaagagaaaatgataatattgaagacatctgagtacggagtgaacaaatcaggcagatttaagctaatccactatggcactacctgactagttactaaacaaaaatagcaatgtcaaccaagaccgttagttttcattggtaggtgataaccaccatattacacttgtgttgggggtccaaataggatcgagagtttaaatagagttcctctgaaatccagtttgtagaacgagggtatcttgtccttgccgtcgatattgacaactaaccaatacccactcacatcagttgactcaagaggcagccagcctagatcaccaaagggcctatttatggctaaatccactcacgctcggttacggatagatgcagtatgagcaaacaaaattttgaactattgggactactcttctcaagaagaaagttacatatgcaatagaaaaaaaattagtgaacataaaccaaattgcaaatgactacctgctgtgcatgaatggaaattgcattttgtgtctgaagaacttgtgcatcttgatgaatagggtagttggccactctgttccccatctttgtgatctccatcaaggatccaatgttactacatgttacataaaaaacacaatcaaggtccaattttagtgtgtctctgcaatcatgactagtatagagtgaacctacatcaagatgtccagctatgtctgtctggttattttagccttttggagttaaggttcactctacggcaaggtaatatattatgagcccaacccatgaatgaaccagtacattagcagtgaagagcaagaagctagtactaggaaacacagcacgaagataaccatatgaatctcaaatttgacaatacaggtccatataccagtcagttgtttggaatgtgacagcgtgaatctctcctctgaaagcttactgaagaggtgttaagatgccatgggaaatttggtcatatggtcctgtaaaatcagtatgtgcaggaatgtctaaattgtgcctggactcggttaaatggggatgggcaaaagacaacagtccattttcctttcctgtttctaagttcaacatgaatcgaattagatggaacataaggcaaggatgtaaggctgtcttcaacaacaatgcggatgcggtcgcggatcccacacatttgcgagacggagatcgttgcgcaaaagatgccgtttccagcagactgcagatacctttgtgcatctattcaatatacacctcgcgcacgaataatcaaagccgtgggttccactgtgcgacgctgagatgttcagttttctgcgatgggtgcgagcgcgcaaatatgcatgtcgcgagtaaaggctgtggattttgcgcaaccgcatgcgcgagcttctggacacgtgaacagtagtgatttcttactcattttccgcatccgcgacctgctggagacagcctaactcatagctacaggaatataacttctggtgtggaaatgcatctgatttctccaattcaacttcaccttttagttatacataatgcttacaatgtgtcaaattaaccaaaaaaaacttatgatagctctttgcactattctagttgcatctattaaaatctatctacaatggactgtgaatctatcaaaatggttgaaacagaaatcatatggatcagggtataaactctgatatgaattatcaagccagttgtacaatataccctgtgagttcccaccagaaaggtataatcaccgaaaaggacaacgaatacaaacgatatggacagatacacacttatagtagtacataatagaattggcatacctgtacccaacagtttgtaggaacatcttaaggagttcaattgatgaaaattgcttcctgtagctgtcagttagaagcttcaagttgcgtcccaatttacatatgtgcttaattattatttctgaaagaacatcaatagagaccacagttccactttcaaagcctgaatttgccaagtagcgagcaaccaactgttttgtcatgagcaatgcttgctcttggcttaaagatttcccttctactctagatccatcttttcctctatatttgtttcctgtcttgtaatattcaggcaccatgccaaacctttcaagcattgcagtgttgcggttagatggtgctggcaaattatcaagaactccatgaacttctattttgttagccctagatatcccacttgttttaggaattgcgctttctggaacacagtcagatggaaatctaatttctggaattaattcgtctgttgaattgctgaattccccagcattctttgagtgcagggaagggccattttccaatatgggagcagatatgctgggatcatccataaacacagccctctccttttatgtacactgcaaatcttaagatagtcagacattccctctggtgttctctttggtatttctttgtcacctgagtgaagcttgctgtgccatatcctgaatttgtcagcatatggcttgtaccatgtgtcaggcaattcttcataccgattatgccgttgagacaacatggaaccgtccctgcttggactgaacgcagttctagaatgcacttgatgttgagtgttgtcttcctgctcatcttccaaagagaaataaatatcatctccatgaagtcgcagatagttggcgttgatggaatggaggctgacaggggccgcgccgcgggggggcaggaggagcgcggccgaggccttgtcgaagaggagcgcgcgaacgcggagctggaggaggaggagcgggcgcgggggcggcgatggggaggcggcggggtagaggaa

SEQ ID NO: 22533 - DNA, 5335 bp, Zea mays
  misc_feature (4218)..(4218): n is a, c, g, or t
  misc_feature (4732)..(4732): n is a, c, g, or t
tgcagctaggttcaatacttttgaaaggactgggcgtcatgtctgatgatgtatccttcttgagtaagcttgtgagggactcaatggagctacaagctcaggaagcactgaaagacattggggaccaagaagttgatattatgaagcctcttcaggttcgtaaaatctgaaaaaacattctcaaattcatagcattttcccttatgtgccctttttttttcttaatgaacggatacacagctctcctacgtgtttgagaaaaaaacccatagcatttccatttctcatctgatattatgaagcctcttcaggtaagagtgtcagatttagtggagagcaatggtaatagttcaagaatggtagccccagagcagtcgttaagtctaagtagccgcccagacataaaggcaataaaaccaccagtggcgaatgggatacctgatatgaaggtggaaaatgacaagacaggatacgattttgacagggtggattctgaaaatggtgtgacatactgtctattggaatctgatgaccaaagcgatgaagcctccagtacaagcaaggaaatgatcgatcagtctgctgatacaagggttaatgtcaatgataagaagatactctagctctacttgtaggatcaagttcattggtgattggctgatcgctgggctgatcagaactgccgcatttcttgcagctcctataggtttcttgaagcacttctaaagactgcaatactgcatttaagttcctggtacatggagtcctacagaatagcaaccataaacacttgtgtcatgtggagatattgcggaaccgaccagccgtgcagcaaatctaaaggctgaaaatactgagcttgagttgtgcaggtgtacagcagatctaaagccatgcagcaaccataaacagttgaagattttcagctggcaaatttgccaacgcagctgagtgcatgcatggctttggcaggatccggttgtaactagcaacatttcagaatttagaatatcattttttcacagctcagattatatttgactgaagccacaacataataaagggacttccattgatagatacattcttgtacaatatctgtatctgattcctagtgtgtactagatggtacatacctgagcagtttattatgtatcatcatcatccaataaagtgctgaactaaattttgggtattgatcaatccagtaaaccataatagcctctgctctgacgaattattcacaaataatggggagaattaaatacataccatgtctcttggtgccaaccaagctggatgcagatcagtagtccatggagccgaaatccggctccggcggcctgggaagcatgatgaggctgtcggcccggacggatcgctggcgctgcacgccgcgcatggcgttcttggcgaagcgcgacacgaggagcgtggtcttgaacctgctcgtggaaaccccggacgagtcggcctccatctcctcctcccggcgccgctgctcggccgccttccgcttgaggtacctcctccatgcggcctgtatgaagcaggaggcccaggtgcgccactgctgcgagtagaagcggaaggtctgctgcagctgcttgctgtgcaggcgccggaactgccccgccacgaacttgagctcgtcagcgcgcagcgcgaacgcctccacctcggagatggccctaacggtgcgcgtggacagcgggaagttggcgccggcctttgggtcgagcgcccacgtgagtagctcctccccgcagaagtcgccctccttgagcagcccccggttgtagaaccccatccggccgccgtcggtggtggagctctcgaggcggccgcgaatgatgaagagcatctcgtcgacggggtccccctcgcgcacgatgtaggtggactcggtgcagaggctgggcttgaggcgctcgcagatagcgtcgaggaggcgctcgtccatgttggcgaagagcgggacgcggcggacgaggcggaggcagaggtgccgcttgacgtcgcggcgcaggtccttgggcaggctgcgcacgaggctgtcctcgtcgacgccgcgcgtctcgagccacttgtactggttgtgccgccacacccgctcccggagctcgtcggggaggacgcggtggtgcatccactgctccgagtccctgcgcttgaggcgcatctcctccaggcgcagcgtcatggactgcaggtacgtctgcatgttgccgatgaggagcgccatgaggatgaggcccagcagcgcgagcgtgatggagaagagctgctcccccttgtagtgggtcgtctccaggccctggccgatggtgctcaggttctgcaggccccaccagaggcagaagaggatcttggccgtcaggttctccgtggagtagacgcccgactggatggccgtggtgtagatgccgtaggggaaccccgtgccgctgccgtcgacgggggcgcactcctgcgccagcacctgccggatcatggtgcgccactcgaggaagcccgactggccctggctgccgccgccgcagtacatgtaggtgcggcactggtggaagttgaggttggtgcacttgtcccgccagcagtcgtccagccgctcgatggccagcaggtaccagaaggcccccaccatgtggctggccagcatgtagagcagcaggtagaaggcggcgccgccgaaggccgtctcggcgaacacccccgtggtgcgcttcagctccgaggtgatggggtagaagcgcaccaggcggggcacgtactgcgacagcaccgtgaagagcagcgcgttcttggtgggcagcaggtccgcgcccttgggccggttgaggaagttccagatggagacctgcggcagcggcagcacggacagcaggtcgacggcgaagaatcggcgcaggtagcggcgcgcgatggcggacgagtcgatgaccagctcgccgcgcccgaacacgcgcgacgacggcgcgatgtacgccgtccggaactgcagcgcgatccgcgccaggtagaaggcgtccacggcggtgcgcaccacggtggcgacggtggccaggttgcggtcgaagccgatgcaggtgttcttgtccgtgtacttgacggccaggaggtagaggaagagcgggtcgatggccacggacacgatgcacgcgaagacgaaggcgcggttcatgcgcgccaggaacgcgtcctgcgggtcgaacacctgctgcgacatcttccggaagtcctcctggaacacgaggccgatgctcctcagccgctccgaccggttcatcacgcccgccgccacccgaaccgaccgcgcacggaacttggcggcggccgccgccgggttgcccgagaagtagctgtccatgtggaacccgccgccgtgcccgtgcccgtgcccgtgctccatgctggcaccgccgccgctgccggaagtggggctggacgccgaatccgccggcgcgtctgcctcgacgagcctcacgaacttctccctgcgcccgttgatgaactgggtccggtagccgcacccgaacatctatcgccttcttgctcccggactacgggacatcatctatccaacaccactgatcgggacggcgccagtttacttggtcgatcgatgatgcagcaggcaacaattaagttgctcgatctcttctccgatcctcgtccctcgatcgatcttgcaggaaggagcgccgcgcgtgaaagaaggcgaggccgtgagcgcaagtgacggcggttaaagaatacgcgaggcacctaaaaatggacgtgaaaatttgtatgttcctcatagtttttagagatttttacatccgtccccattgctaaaaaattattctccaaaacattatattgaggactgctgggaaaaaaatctactaagagttagtttgagagctacattttcttaatagatttctatttttatcaaatgaaaaatgaactaatttcacttaataaaataaaaatccttttgaaaaatagttcccaaactagccataaaaatacttaactcacatcagaatactaataagtagttcttaaaacttttaaaggccaagtcatcaccccatggtgttgctgcatcacgcgtatttaagttgttgcatcacacattcatgttgagctcttgggtggttgacgagaaagaaggccggtgtgaccatcgcgttggacagagagggcgaggcgagcggtgaccgcagnggggactacagacgccgacagagaagaggtgggcaaatccgacagagaagaggacatgctctcactcgctgcgcggtcagggtggcgccgaggaagaagcgcgacatggcccgagcgagaggaggcgaggagaatgatagcgcgtggaggtggattgcggacgatgttccctcgcggatatttgaaggagattagaactggaacgagggatgcttgtaatttggggaaaggaaaggggaactgttgaacgaaggaaattttagttttcaacctaaaaacagattttcggattggttttagtgtcctcttggagatgctttcgctgctcagttttctccttagatttatggatttaaaaaataacgaaatgacaaactaagggtatggatttaaataactagattttaaacgtgctcagtcttgcctctatttgttacacgcgtcctcgtgggtgcccttacggagcgtttccgtccacccgggccgtcactaacagcgctggtccacctcttcncctccgctccgactagctgggtccactgttaggagccgaattgttcccgtttgcgcctgaccctctccagccatttttgccgccgctccacgtgtcgtaggccaaacatttcgatcccacagcacccaagactgcaaaaataagcttaaataaaatcgctttattattgtacaaataacattcacgtagtataatggtgtgtcatagctcggtagtttgtaaggtgttgggttccttgatgccttggcccactttttgcatctttttttcttctcgtgaacaaaatagcctacactatggcatctattcataattttgtataatcttctaagtttttttatcccaaacaactaagaccaaattatgactctataccaagtttcactatttttttgactatatttagtatttatttatttttggcttaaaaagacatttaaaccatataaattagtaaataatcaaaaggggcatctttacttgaagtaagttaataacatttagatgaactaatggtgcacttttgaagcgaaaaagacaaaagtaagaaatatagctcaaacaataatgttatagttcaatgctatgaaacttagtgagaca

SEQ ID NO: 22534 - DNA, 2370 bp, Zea mays
ccttatttattttagtaatatctccagtgaaagtttataggccaaaaaaatacagtttaaatgttaatgttcctagatggaaacccctcaaaaatcacattttactcttaaaacatgacatacagctcattgcctcagggcaaaagtgtgtatatatatatatgagagcttacacaacaatgttttacatctgcaaatctagcgaggtgtactatcctaataaacatgtacattgtacaggctgcggccttcagatggttatggttctgatggtcatctcctttagtgtagtaatggatctgtggaacaacttcagactacgtccaactttgtcctctttcaaatgctctagtctctccagcacaggaaggagttcatcagaaaatgaagaaagaccttttgcagaagcatcgtcctgaaaatgaatgaggagaatagtaacggcacattccgttatttggagtagaagggtaatgagttggtctcggttgccagccatgcaacacaaatctatcattgcaatgtacctccttttacggatgttatcgttaggagatatgcaatcttgcttcatgcacacttttattatctcatcaacctcctttctggacaactcatttaagtcacggatcttgtttaaaagcatatatttttcttcaccaactctttctagggcaagtgttgctgaattcagaagatcagaaaccatttgtagtgttgggtgctgctgatcactgttacggccatatgaaacttgaaatcgcatgtttttccttgtagcgagaacataaaggtaagagacaaggctgaagcaaagaccaaatgctatcaattctgacttctgattctcaatcatgtttggtgattgcataaaatttagaatcccaaagtcaacgctaaaaagagaatgcatcaaggaaaatagatcttgaatgtagctgcattcctcattttcctcatacgcccaaaccttgctgagaatagaaaccgccatgctaagctgctccaacgtgagcaaattagttccagtcatgttctcccttaaaatgctattaaaaactgactgatgctgctttgcgaagtccactatctctcgtacaatcttgttcttcacctcgagaaaatcagccgagtccactagcgatgtaaaagaggtgactattcgcagtacaggtgtaataagtgacctcttgtcaatttcaccagtccgttcttttgcaattttagagattgcccttggatttacctttttctggccacccatgaggttgcatgctgaaagattttgtaaagcacccatggacaatagaatctgagagccatgtttgccataatgatggcttaatctcagcagtaatgaaaactgagcatccacagtgcaaaaccgctgtgaagattctgatgccaatgacgaatcctttgacaaatagtttgcaacatcactcaggcatgatctaaggatccctcgactttgaagttgatttagaaaatacttttcatggtcaatactaattaatgcatcaagaacataaaaggaaagtgctttcccagcttcactaccatggaaagcatccttagtaaccaaatcaacgatagcttgagcttccttccttatgatggaaaagttggcatgtgctaattcattgtgctccttgagaaccttttgaagagtgatgtcctcatcatcaccatcttgctcctccagtagcaagaaccgaagaacagatggagggacatcagagtccagaatgctgctacaatactgaaaataactcagtaataatgcatattgccgtcttctcaagatttcacccgcgcctccgcccacgcgtcccatcacaagcttgaataacaatgagttacaagctgcatttggtagctgctttgacgaaataatgtcaaggcaagtaaccgcatcagaatctgtaccagctgggcatatgaatctttcatcccgcagtttcgccatacaggtcaacgatacattagttaaaacatatgccattttcactgaacaatctggagatgttgtggcattcaacgaagcatcaagcagttcaaacaatagctgagaacagtcctcgaataatgacatccttcttgatacagcaacctcaacaatctgtgaccagccagtcaacatgtgaagttgggcagcctgctcttcaagatttttgttatatcgccacgcccatttgagcaaatgatgaactgattcttttagtccagctttctcaggctcggttaattgtgagttcaattcttgtgaaatctggagaagtttttcacggaaagcatcaagatcaatcagtcggtcacctctctctgaataattatttacaccaccattttcgaaagtggcagagttcc

SEQ ID NO: 22535 - DNA, 1180 bp, Zea mays
  misc_feature (1076)..(1173): n is a, c, g, or t
  misc_feature (1175)..(1179): n is a, c, g, or t
tggggccccccaggccggcaacgagcagagaggaagcgagaggcgaggagagagaaagttctcgagctagacgagcgccgtgcgaggagagaagcgagatgagcggtgaggcggcggccgtgggcggaggcgaaggagaggcgaatggcatcccgccgaacgtcaccatctatatcaacaacctcaacgagaagatcaagctcgaagaacttaagaagtccctaacagccgttttttcccagtttgggaaaattcttgatgtgcttgctttcaagactttgaagcataaaggtcaagcttgggttgtcttcgaagatgtcgcatcagctactgaggctctgaagaggatgcagggctttcccttctatgacaaaactatgagaattcaatatgccaagaccaaatcagatattatagcaaaggctgatggcacctttgtacctcgagaaagaagaaagaggactgatgaaaaatctgaaaagaagcagaagcgcgagcatcaccatgatgctggtgctagtcaaattggcatgggtgtaactgcttaccctggtgtttatggggctccacagctcacccagatacctatagcaggaggacaaagggtcatgatgccagagattatcgtaccaaacaacatcttgtttgtccaaaacttgccacacgagacgacgcccatgatgctccagatgctcttctgccagtaccctggcttcaaggaggttcggatgatcgaggcgaagcctgggattgctttcgtggagtatggagacgagacccaggccactgctgccatgaacaaccttcaaagcttcaaaattacaaaagaaaaccagatggtcatcacatatgcgaagaagtaatgagctcccgagcaatgtttacctgatgtgtgagatgttgtattccgagttttacacaactggtaaatttccttcatgtgttaggtagacagcatcctgaacaacctgttaattgtacccactgggctgcagctatgtgcacttcaggaacggagatgaaatgcaaactgttattatttggtctgctcttgtattcaaaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnt

SEQ ID NO: 22536 - DNA, 2367 bp, Zea mays
tccctatccaaagaatttgttgtgacgcagaggggggacacccggactcagagagagagagaggggcattcgcccgttcgaattctctcgcctcggcctcctcctcacctgcctgctcggctgctcgccagaccaaccacagccgtcggcgctgcagaccgcggcgggcaggatcagcggtgcgtagcctgcccatttcgcgaggaccatataattccaagaccctgatgatggccacaactgcttatatcgatgattcctgttcggaggttattgatcccccgaagactgaggtgctggatgttgctgaactccctggtgaccatactcagaacccaccaaaaccgaatgttgtggtgtctagcagtgtgcgtgaacttctggaatgtccagtctgtttgagtgccatgtatcctcctattcatcagtgctctaatggtcatacattgtgttccggatgcaaaccaagggttcataaccgttgtccaacttgtaggcatgaactgggtaacataaggtgtcttgctcttgagaaggtggctgcatctcttgaacttccatgcaagtaccagtgctttgggtgcccaggcatttatccttactacagcaagctgaagcatgagtcgcagtgccaatatagaccttatagttgtccatatgctggatctgaatgcacagttgctggtgacatcccatatttggtgaatcacttgaaagatgaccacaaagttgacatgcacaatggctgtaccttcaatcatcgctatgtaaagccaaaccctcatgaagttgagaatgccacatggatgcttacggtattcagctgctttggccagtacttctgcctacacttcgaggccttccagctgggcatgtcacccgtctacatcgccttcctgaggttcatgggagacgacgcggaagcgaagaactacagctacagcctggaggtagggggcacggggcgcaagatggtctggcagggggtgccccggagcatcagggacagccaccggaaggtccgggacagctacgacgggctcatcatccagaggaacatggccctgttcttctcgggcggcgacaggaaggagctcaagctgcgtgtcaccgggcggatctggaaggaacaatgagcttgatgggtcagctagtacgtctgtcccgctccgctgctgccctgaactcatgaatcgcatcgcaaagagcttttgccagtcgtaggaatgggcgactctgtggttcgttctgtgttttcagcttcttctcgcttgctattgtcttcatggttcctgcagggtaggtaggtgctgttggatgtgtagatcatgtagaggttggaggttgctaccgatgcagaattcgtggagatttcctattttattgaactgtctttagagcagcttcaagagatgagctattagtgttgtcgagtaaaaaatttggatgcccttcccgcgcggaagcatctttattcccgcacgtagccaatatcggtgctgcgagtagagatggcaacggctataaacccattgtatttttgccctctcaaacccgtacatatgaaaaatatctatgcccattaaaaaaccaatacttataacggatttgagattttgctcaaacccgtatctattgggttagcgggtacccacaggttacctgcgggttttatttcctatatacttgttcttctcataatcataagtatcgtaataattaatgagatttggtccaaaatttatgtgatgaacaacaagttcatgattcggtataaaaattactagtagagagaatgaaatataaataataagttgtataattaagtgaccttgtactaagttattcatccaccacatatatagcgctagaaaaaactataatagcaagcaagcaacactctcaccgactacttatacattcaccatttgataaaaattaggaagtaaataaggaataacaagtttgttgttcgtttataaaataaaatgacaatgtacaataggtttggtcgggtttaaaaaatccacgggttcacaggtttgggtactttagaaataaactcgtatccataaacccgttagatatagatttatgcccattaacaaactaatggtatgaaaattgatctaaatccgtaccttaatagattaaaaacctatcgggtttcagatttcaggtatccattggcatctctagctgcaagtgctgcaggccgccgcgattcctgccgtgctgcagctgcaggagatgttggtacagtccgacgtccaggagaagacgcatgaggtgctccagctccagccatatctgattgtgcctgggacttattttttctgttgatttattctttcaatgtaggcatca

SEQ ID NO: 22537 - DNA, 5084 bp, Zea mays
ccgagagagactgcggtgctttcctcttgagcaaattggacaagtttttgggcggagcggccgtgcgcagcctcgactcttacggccatcgcatggtcttgaggactgacggagtattataaaagggaaagaaacttgggctgctcaactccctgggccctttgagctgccagttgccaacgccggccgttcacatgcatcgatccaccagacgcagcgatgagccactgcacagccggctctggtagcgctagcgcgcacgaaacggttctgctaatcgattctctgaatctgacgtgtcggttgttcccgcgctggagggagatcgctgaaaccagtaccagcatcccttcccaaatgcacggtctttattaagacatcattcaggtaggtgaggtccagtccagtcgctgagaaccagtggctccggcgaggagaagtgcagtcgccgagaccgcgtgcccactgcagccagcgaagccgtgcacggacgagaaggccggctgggtgtcaccttgcttgcagagttgcagttgcagttggctcgtgccgtcagccgagccacgggcaccgcaggtgcgagtagaatatgcagagggcggcgaggcaagtgtatagtaactgtgtgtgtgtgtgtgtgtgtggcgcgtcgaagtcaaagcacggggcgggcgggcgggcgggtactctttgtccctcgcggccgggaagctctcccgtgggcgtaggtgaccgcggccggcaagcaactgccaacggatatcccacggccgctcccgctcgcaggggtgttggccggccgcgccgccgtcgcctataaatggcgagcgagagaccacgcaaaggtcatgccattccgtggtcccgaacgacgccctcgctcgtgcactctctggtctctttctcttcgcctgaccctgagcacagcgccacagacacaacaacctcggactcgggagtacgtgtagctaggcccggtactgtgctgcacgccatggtccattgctagctactagagctctgttgctctgtactgtagctagtacccctgtcgtcgtcattgcctagacacgtacgcagtcgcgttgctgatggtttgctttgcctgcagatcggtcgagactgagtgcctgccgtgccgagacaggatgaccaaagccaaactggccttctggctcggatggattgctctcctgcaaggtacgacgtatagtagcggtataggtactccgagaaactcgattgccctggcctgtaactgacattgcattctgcttctccggtccgatctgcaggctgcatggtgaaatcatctctcccgtacgagtacgactactctgcaagcatcgaggcaagtccctgtgttccctacatgactgcgtggtcctggtccagccgaagcttcacccgccgccggcttagttttagcaaaacaatattttaaccattgccaattggctttcccttgtcacgggccgcacgataatccaccgcacgcacgcacgcaattcgttcccgccgtcgtcagcttctccatggtattaattcccatcgttgatcgtcgtccccccggccctttggtaattaaattttcccctgcatatatatatgtgacatatgcttttcagtgccatgcacgacaactgtacgtgcccgtcgacgtcgagggtgtgtgtttacgtgtcatgtaagccacgccaagctcgacaacaaaacaaaaaaaacgcatacgtcatctagcattttatactacttcttattagtttatctttaaactaacacacgacaaataaaaaagaacggtgcttctaaaccactgttagaccgatcgacatcgactgtctgatagtctcaggaacacgcatgcgtgtttctagctacacagcaaagcaaagcatctgcttattgccaagatcaaagcaacaggcctccgttaaggattccgatgggaaacttgcagctgcatgccatgcatccgccaaatcgattgattcaaatttaacggaaccaaaaaaaacacaaaaaaaactgatggttgcgtgctcgctgcagtgcttgccggagccgctggagccgcagtacggcgggggcgtcctccagcaacgccgacttcagcgcgggcctgcggggctggtccgccttcggctacggcagcatcgccgagagcacgtccgcggcgggcaacgggttcgccgtcgcgctcaaccggacgcggccgtaccagagcgtcagccagaaggtgtacctgcaggccgacacgcactacaccctctccggtacgacggatggatcatggtcatggatcgtcgcgtgcatgtgaacatgtggtactgaaactgaccagcccggttgttggttacagcgtggttgcaggtcagcgacggaggcgccgacgtgcgggccgtcgtcaagaccgtcggtgacttcgtccacgccggcggcggcgtcgccaaggccgggtgctggtccatgctcaagggcggcctcaccgccgcgtcttcgggtcctgccgagctctacttcgaggtaggaacaaggtcgtccgttgattgcttttgtttcacggatgtgagagagcgagtgagaccgaggcagccaatcgagatggatatatgatacgatcgtgcggccgtactactacgtgctgcagagcaacgctacggtggacctgtgggtggacagcgtctcgctcaagcccttctccaaggacgagtggacggcgcaccgcgccgagtccgtggccgcggcgcgcaagaaggcggtgaggctccaggcgtcgggctccgcggggaatccgctgcagggcgcggcggtgtccctggacgcggtccggaccaacttcccgctgggcgcggccgtgagccggtacatcctcaccaactcggcgtaccagacgtggttcgcgtcccggttcgcggtggccaccttcgagaacgagatgaagtggtacagcacggagcctgcgccgggccaagaggactacacggtcccggacgccatgatggcgttcgccaagtccaacggcatcgccgtgcgcggccacaacgtgttctgggaccagcccagccagcagccccggtgggtgcagtcgctgccgtacccgcagctgctggcggcggcgtcgcgccgcatccgctccgtcgtgtcgcgctacgccggccaggtcatcggctgggacgtcgtcaacgagaacctgcacttcaacttctacgagggccgcttcggctgggacgcgtccaccgccttctacgccgccgcgcgcctgctggacgccggctccgcgctcatgttcatgaacgagttcaacaccgtggagcagccgggcgacatggccgcgctgccggcgaggtacctgcagcgcctgcagcagatcatcgccgcctacccggagaacggcgccgggatggccatcggcctcgagggccacttcaccaccaaccccaacatcccgtacatgcgcgccgccctcgacaccctcgcccaggccggcatccccgtctggctcaccgaggtcgacgtcgcgccgggcccgtcgcaggcgcagcacctcgaggaggtgctgcgcgaggcgtacgcgcacccggcggtgcaggggatcgtcatctggtcggcgtggcggcccgaggggtgctacgtcatgtgcctcaccgacaacagcttcaacaacctgccgcagggggacgtcgtggaccgcctcatcgccgagtggcgggcgactccgcgggccggctccacggacgcgcagggctacttcgaggccgagctcgtccacggcgagtataaggtcaccgtcagccacccggcgctcaacagctccatctcccggagcgtcaaggtggagctgggctcagggagtgaccactacttcattgacatgcaggtctagctgctagaccacctggttcttcagttgctaggtgtaatgtaatgtaagattacctgctgttgtcacagaactgtgaaagcttagaagcttagtcattcgtgtgtaccagttttcaccttggataattgcaacggaaggcaaaggagaacaccgtttttaatcccgatctccaagattattccaaagtaaaatgttccattttcatccctttccgtttctttaaaattaaaagcttatccctccattggttgtggctaaaggtcaacgttaactgcctctgtcgccattttgatgccacaggaataacttcaaacatggagctcgacttttgtgttattgggtagaacattcctctgcccataaatatgtccatagcaaatttaggactagtcgcttgcgcgcgccagcgcacgttcacctctagattttacatgaacaaaaatagacacaaccatacaaattaaaaagagcagaaaaggatcatttatacaaaggccaaggaaattgaagacctgtatacaaatatttttacttgtcctattatcaatcttcctatgaaatatcttggagtcccaattgataacaagaagattaataaaagtctctgggatcccatggtggagaaaatgagaaaaaggcttgctcgatggcaaggcagattcctaagtttgggtggtagattgactttgttaaataattgtctttccaatgtgccgctttatatgctttctatatatcctattcctaaatctgttattagaaaagtggatatttacaaaaaacgtcttttatggcaaggtgggtatcagtcaaaaaaatttcacctggttaattggtcatctgtgtgttctcctaaaagtcagggaggtttaggtgttttgaatcttgaattcatgaatgattctttattaactaaatggctttggaatattgagaattcaaatggtttatggcaaaaaaatcatttctattaatggcatgaaaactagtttatggaaatgttcttggacaggaagcttacctttggctgtcaaattccctattctatttgacttggcttatgacaaagacatttctgttaataaagtcttgggttccaattttgaagttctttcgtttaggagaaggattactcgtaatttgagcgtgttgtttgaggatcttttgggttgttgtaataatctttctctatcggatc

SEQ ID NO: 22538 - DNA, 1658 bp, Zea mays
  misc_feature (1507)..(1511): n is a, c, g, or t
aacagcgcgaaacatctgtcagttttccttcaaaaatggaaaagcgaaggcaaaaccaaagtttgttgtgggagtgggacgtgacaccccgcacacatcagttcatttcagtttcagcaggtcagttttcgtcctgatactctgtcgctgcagcggtgccggtgcagcgctagctgcagttgggttgcggccgcagagcagcagcaggaaggatggcgaccaaggtggtggtggacctgcggtccgacacggtcaccaagccttccgaggccatgcgcgcgtccatggccgcggccgacgtcgacgacgacgtccggggcgcggacccgaccgcgcgccgcttccaggaggagatggcggcgctcatgggcaaggaggccgcgctcttcgtcccgtcggggaccatgggcaacctcgtgtccgtcctcgcgcactgcgacgtccgcggcagcgaggtcatcctcggcgacgactcgcacatccacctctacgagaacggcggcatctccaccctcggcggcgtgcaccctaagaccgtcagaaacaactccgacggcaccatggacatcgacagcatcgtcgctgcaatcaggcctcccggcggtggcctgtattacccgaccaccaggctcatctgcttggagaacacacatgggaattccggagggaagtgtttatccgcagaatacactgaaaaggttggcgaaattgccaagagtcatggcctgaagcttcatatcgatggagctcgcattttcaacgcctctgtggcacttggagttcctgtggacagacttgtgagagctgcagattcagtttcggtatgcatttctaaaggtttaggcgcccccgttggatcagttattgttggctcgaaggccttcatcgacaaggccaaaattctccggaagaccctaggtggtggaatgaggcaggttggagttctctgtgctgctgctcatgttgccgttcgtgacaatgtgggaaagcttgcagatgaccacagaaaggctaaagctttggcagacggactgaataaaatcgaacagttcagagtggattcagcatcagtccagaccaatatggtattcttggacatcgtggattcacgcatatcatctaacaagctgtgccaggttctgggaacgcacaatgtgctcgcaagtccaaggagtccaaaaagtgtcaggcttgtccttcattaccaaatttcagatgatgatgttcaatatgcactgacgtgttttaagaaagctgctgaacagctactaatgggcagtactgaactcgagcatttggctgaacagctactgatgggcactaccaagaactcgtacgggcaatagggcaccctgatgcataagctcggtgtggtcttatctgtaatcagctcgaaatattgtagccgcaccaaacctttgctgaataactgttgcttctcacttgtttattggatgtgttcgttcctgtaaaaaaaaaaaaaaaatttagcttttctctgaccggnnnnnctgagaatctggttgtgcgaagaatcctgctatagagagaatctagtatcatggagattacgagtggaggaagatgaaggtgtccatagggttcaggatctagaaagtgatgaatttctactattgcaaagactcggctgattatgt

SEQ ID NO: 22539 - DNA, 679 bp, Zea mays
  misc_feature (655)..(655): n is a, c, g, or t
  misc_feature (665)..(665): n is a, c, g, or t
  misc_feature (674)..(674): n is a, c, g, or t
ggccccgctttttttttttttttttttttgaaacgcgtgtcagtacttaggcaagaaaaaatgatcctcgtccagtacagtgtgccatgaatcaaaattcagcgttacaagatgtgtatacaataatacatgcatgcatgcttgatcgatccagcagtcgatcgtcggatcagtagtagtacgccggcagccagtccttgccgttgatgaagtcgatggtgaggtacttggccgcgtcgtcgggagagaacctccgcgaccatggcacgcggttcgtcacgtcagcgcccggcccagtgcagttgaactcggcgagcgtcaccttgtcggtgctgccgctgtagcctatggttgtccagccggccgggtggatggtcttggagaggtaggtgtcggcgaagatgacgcgcgagtccggcgcggtgacgcggcccaggtacacctccccgacgccgtacaccttgcccttgaggaagacgaagccgctgctgtcctcctcctgccgcacctgcgcggtgatggagccgcggatctccgtccgccggtcaggcctcacgaagatctcggggcactggaagatggactggccgctgccgaagatgaagtcgatgttgccccgggtttttttttttttttttttttttttttttttttnccggccgggncctcgaggnagtac

SEQ ID NO: 22540 - DNA, 3695 bp, Zea mays
  misc_feature (238)..(238): n is a, c, g, or t
  misc_feature (2338)..(2338): n is a, c, g, or t
  misc_feature (2704)..(2704): n is a, c, g, or t
ccgctatcctcacctcccgcgttagcaggttcatcgctcggcgcctgggcgccaggtccagtcaccagtgacgtcgctgctgctccgcacctcctgcgcaaacggcggcgccgtcgctgctgctccgcccttagtgacgccgcctctccccacggacacgagtcgagcatgaagataagctcagtgatgagaaggtaagcacagagagcaagatcaagttaaggaaaaaaaacttttnatggggcgtgagaaggggaaacatttcctgaagcaatgcgtatgcgtgcacaaagatttggagctcgggatcaacaatggaaacgcgtgtcagtacttaggcaagaaaaaatgatcctcgtccagtacagtgtgccatgaatcaaaattcagcgttacaagatgtgtatacatgcatgcatgcttgatcgatccagcagtcgatcgtcggatcagtagtagtacgccggcagccagtccttgccgttgatgaagtcgatggtgaggtacttggccgcgtcgtcgggagagaacctccgcgaccatggcacgcggttcgtcacgtcagcgcccggcccagtgcagttgaagtcggcgagcgtcaccttgctgcatgcatgcatgcgaaccacaaattaaattaaaaagaatcaaccaccgtagtaccatctgatgcaatgcaatgcaatgcaatgcaatgaataatactcggtgctgccgctgtagcctatggttgtccagccggccgggtggatggtcttggagaggtaggtgtcggcgaagatgacgcgcgagtccggcgcggtgacgcggcccaggtacacctccccgacgccgtacaccttgcccttgaggaagacgaagccgctgctgtcctcctcctgccgcacctgcgcggtgatggagccgcggatctccgtccgccggtcaggcctcacgaagatctcggggcactggaagatggactggccgctgccgaagatgaagtcgatgttgccctggatgtagcagctctcgtagtagtggcggccggcgctgtcgaacagggtgtggtgggggctgtagaacgcgcagtggtagaaggccaccttgtcgccggccaccatcgccgccacggaacggatctccgggtcgttcaccaggcccccgcgcgcccggggctgtcgtcaagtttggcgttctagttagacggacgtacaagtacaaacggagggaggcccaggggtacggtcaagtcaagtgcacggacggaccctgaagctgacgccgaagacgatgacgttgtccgagttcacggtgaacgcggcggactcggcgttgtcggaagaggcggactcgtgggagatggaggtccggcctttgccgttgcccctcacgaagatgaagggcttgttctccggtatcacaactttgcccctgcatcatcaaccatgcatgcattgcgcgtgatggtacgttggaaatcacaatagaaatatagtaacaaggtcgtgaagagagagagagagagagggagggaaattaattaatacaacagcgatcgaggcaggaaaatgcatgcctgtgcaggccagagcggaggtggacgatgacccactcggcgtttccggcgggcaccgcgtcgatggcggactgcacggtcttgaactcctcgtccggccccacgatcagcgtcttcttcgcctggatcttctcggtcaggaggggcccgttcacgacgtcgtcgctcttcttggcgagcttcgacttggcgagcgcgacgccgggcaccgtggtcagcacggccgccgcggcgagcaggaaggtgaggaggaggcgcggccgggccatcgtcgtcctggtcctggcttctcgctcgcgcgtacgtgcgattctgcgacgacagcttagatggtctcgaggagacaaattaagcagcggatgcaccggaactcttaacgcagcgctctatttctggccgctcgctgctgggatgcgggggaggctcggagttgaaagcgttttttcttccagacctgcttaaaatagggaagaagccagttagttacccttcccgcgtgtcgttgactcgctgtgcgatcttccgtggcatatgcttactctcaattgttttctccgcatactacaacagatgtatatttgcacggttctgtgatgtctaaacgtcactaaaagcaagtacatcggtgctttaaattttacaccgcgagaaagcccactttaaaaaaaaagttgcttccttgtctataccttttggtttagcttttggttttcatggattaaaaagtcaaagccaaaatacaaaccaaacataccattagacatatacgcaatgcatatnattccaacccttattggtactaaacgaccaagttatctaattagacttccctctcttcaaattatgaccatctatcataaattcaatcacgctaccagtaaaacaaaattccctagcttatacatttatttgcctttagcccttacatttttctttttcttctttctccctttcatgttgagcacttcatcatcctttgtggcctccaccatccttctcatggttgcctaccatgctcaaccttggatgtgaatttaacctttctcaaatgcaacactagagtagacgttagtccacttagttgtctcgattaccaaaaccatacataggatttcaacctcctcatttttgataattgatgacaancatacaaagataggaattaaattttgaactctaaactagtacttcatatatatataagtatgagttactaccctagtttagatttgagtagcctatctaagcattttaagtacttgtaaatatttagacaagtttctcaaattcaatttttgtagtattagctcccatatatatgtgctagattctttgaatatcaaacttgcacatatgttggatttggatttttggaacaagcaatgttgccaaatgatgctaaggttttaagatatacgttgaagtgagtatacttgcttgaataccacttagattggtagttcaacaatcatagcaatgacaacattggtagttcaacaatcttagctacaccttagtcttcgtggccgaaggggtatcgcgagattctggtcgtctgatcagagatggacgcgccatattagatctgggtttaaataactcagcgtgcacccacgaccgccagatcagtaaccaacggtctggatttaaatatctagaattgagttctgggcgcacaattcaaatcaacggccaaggtttaacgaagacctaatccgatccctaccatcggatcactaatcgacggtctcaggagaacgcgactgaatcggtatccggatctaatcctagccgctagctaaccatctaacggtcgagcggcagtatcctcacctcctacctcgcgacggtagcgctgcccagaacgcggcggagcacacaccggcgaaacctcgatcctataaacctgaacgccgcaccgattctactggctcaaaatgaagcagacgaccatgcgaacatggagggcggatactcaccgaaagtcacggcgcagaaattcccggtgacggcgcggtgcggaattggggcggcgtgcgatcgacgacgaggaatttcgtgcccgcagggacgctccaacctccgccaatgccacggttacttccgtcatgccctgacgaagcttttctaccgccgc

SEQ ID NO: 22541 - DNA, 1392 bp, Zea mays
ggccgcaaattttttttttttttttttgcgggcgtgagatggggaaacatttcctgaagcaatgcgtatgcgtgcacttttttttttttttttttttcaacaatggaaacgcgtgtcagtacttaggcaagaaaaaatgatcctcgtccagtacagtgtgccatgaatcaaaattcagcgttacaagatgtgtatacatgcatgcatgcttgatcgatccagcagtcgatcgtcggatcagtagtagtacgccggcagccagtccttgccgttgatgaagtcgatggtgaggtacttggccgcgtcgtcgggagagaacctccgcgaccatggcacgcggttcgtcacgtcagcgcccggcccagtgcagttgaactcggcgagcgtcaccttgtcggtgctgccgctgtagcctatggttgtccagccggccgggtggatggtcttggagaggtaggtgtcggcgaagatgacgcgcgagtccggcgcggtgacgcggcccaggtacacctccccgacgccgtacaccttgcccttgaggaagacgaagccgctgctgtcctcctcctgccgcacctgcgcggtgatggagccgcggatctccgtccgccggtcaggcctcacgaagatctcggggcactggaagatggactggccgctgccgaagatgaagtcgatgttgccctggatgtagcagctctcgtagtagtggcggccggcgctgtcgaacagggtgtggtgggggctgtagaacgcgcagtggtagaaggccaccttgtcgccggccaccatcgccgccacggaacggatctccgggtcgttcaccaggccgacgcgggcgctgttcctgaagctgacgccgaagacgatgacgttgtccgagttcacggtgaacgcggcggactcggcgttgtcggaagaggcggactcgtgggagatggaggtccggcctttgccgttgcccctcacgaagatgaagggcttgttctccggtatcacaactttgcccctgtgcaggccagagcggaggtggacgatgacccactcggcgttgccggcgggcaccgcgtcgatggcggactgcacggtcttgaactcctcgtccggccccacgatcagcgtcttcttcgcctggatcttctcggtcaggaggggcccgttcacgacgtcgtcgctcttcttggcgagcttcgacttggcgagcgcgacgccgggcaccgtggtcagcacggccgccgcggcgagcaggaaggtgaggaggaggcgcggccgggccatcgtcgtcctggtcctggcttctcgatcgcgcgtacgtgcgattctgcgacgaccgcggccggggtctcgaggccaccccggccggcctcgaggaacccaatcgcccataggagt

SEQ ID NO: 22542 - DNA, 2510 bp, Zea mays
  misc_feature (2510)..(2510): n is a, c, g, or t
ctcatcattgatcaaatcatacatcaatgcaatttaccgatcacttttatcagccctagcacttggatcacgtaaaacaaattcacaagcatacaatttctgcgcacaacttcatgtctgaacaagcaacgcatacagttcccgcgcacaacactaagcaaagcggactataaaataatgtgcttacactagtgacctaccaacagcacaagtcatgcacaggtcaatcacacagatatctcatgtgtgcacctacttcccaaggttgattaaatccaaaaacggccccccccccatttttttttttttttttttaataaaaagatgcatcaacgtcattggtggtacaatatttttaagactacataacactttaaaatgttcaaaaagaatagaccaatatgtatctcatttgctaattcctggacaggctagtcaactagatatcaccatttggtcacacgcccgaagggcttggtgtgcgtagtatcttacatctacatctgggtcctcactgagctcaactaagcatggtttcactgtcttctccacaacagattgatcaaggattggtacaagtgattgcaggactttagcgacattgaatttcatgttcggaaccctgtcctttgaagaagcaatgacgacagggagcaactgttggcatgtgatatcaggacccatgacaggagctagcaaagaaatagcttgcaaagtggtcatccgatacagataatgtgggttgtttatcttctccaaaacctggggaattatatgttgcatcgcccactcagggccaaattcctctgtcaaacgctttaaattattggcaccagcatctctgatcgagaaaaccttatcttccaaccactgcatgcaaagtgcccctaacttgtcatcaaaaaaaccaacacctaactggctggccaacaaaggtatgtactcaattatggcaagccgaactctccagtgcctatcttcagagagctctacaatggctggcagaagtgattgcgacagcaagtcaattccaataacctggttaacttgatcaagtttgcttataatgttgagtcgaacatcagggaactcatccttcagcaaagaaagaaaaatgggaagcagttgttcaagagtggcgtcctttcccaatacaggagccattcccataataaccgatgccaaagctgaacgaacatgctgagatgaatctgatgataattccttgatacacggaagaatatgttcaattgcaatttgtgggtttaatattttgcagaattttgtaacttttccagcagctgcaatccgcacttcagcctcattgtcacagagaaggcgaacatacgctgacaccagatcaccccttgtgggctcagtaccaacagcttcacatagttcatacagttgatttgccaccatatagcgcacacgccaagatttatcctgagagaaatttacaataactgggagaatatgtgctgcacaatcttggggctccaacaacttcccaagagcagcacaaccctcaactgccaatagtcgcactgaatcttggtcatcttgagttagatcatcaaacattgacatgatttctgtcttcaaatgactttgttccactgttgcagcaaacttcccaagattagatgcagcagctcttcgtaccataggcatgtcgtcttgacataactggccataaattgtcctcagttctgccttcagttgttcaggtgcactaggataggcgatatgaaaaaggccacatgaagaaactcgagctgtgaaccactcacctaccgccaacctctttacgacatgggcaaaccagtccacaatatcattttccttcatctgtgctcctatctgacaaagtgattcaacagccttgtctctgacgcaggtctcctccacagtacacaatgtttccagtggtggaagcaaaacatgtgcatgctctactcctccaacataaggaataaaaacgcccaactcttctgccattgcaagaagcacctcatcttcatcatcgttgttttcactaaggaatggaatcagctctttccttgttctttcttcacccaatgcccgggcaattgtagaaagctttttgatggagttaaggcgcaactgaatatcttcatttttcagttcatcaatcagtacagcaatcgggtagagaggttcatcaatcatagccattattatgtttggctatagattttttttccagctggtgggtgctcgtcgccggcgaagagatcaacgaagacctcggcacctggcgtaaggcggcgccagcgccggcggcccactagtcgtcgtagagcgagggggcgagaggtgcgcgagtgaactgtgcgcggcaggggaatacggcgagcgacggtacgcgagtgaacgggaggggaatgcgggggacggccgttcgggccgggggccgcgcccgccgcggggcccccccttctcctgaaccgcatttggctattccctttttttgtgaaatttctttn

SEQ ID NO: 22543 - DNA, 1471 bp, Zea mays
ataataaagctcatcattgatcaaatcatacatcaatgcaatttaccgatcacttttatcagccctagcacttggatcacgtaaaacaaattcacaagcatacaatttctgcgcacaacttcatgtctgaacaagcaatgcatacagttcccgcgcacaacactaagcaaagcggactataaaataatgtgcttacactagtgacctaccaacagcacaagtcatgcacaggtcaatcacacagatatcatgtgtgcacctacttcccaaggttgattaaatccaaaaactaaactaaacctaaatcaaaaaacacataattaataaaaagatgcatcaacgtcattggtggcacaatattttttaagactacataacactttaaaatgttcaaaaagaatagaccaatatgtatctcatttgttaattcctggacaggctagtcaactagatatcaccatttggtcacacgcccgaagggcttggtgtgcgtagtatcttacatctacatctgggtcctcactgagctcaactaagcatggtttcactgtcttctccacaacctgcaaatacgcattcaattggggcaggcaaaaagccaaatattgataaaaataggatcgcagcaacagagttgatgactacaacttacagattgatcaaggattggtacaagtgattgcaggactttagcgacattgaatttcatgttcggaaccctgtcctttgaagaagcaatgacgacagggagcaactgttggcatgtgatatcaggacccatgacaggagctagcaaagaaatagcttgcaaagtggtcatccgatacagataatgtgggttgtttatcttctccaaaacctggggaattatatgttgcatcgcccactcagggccaaattcctctgtcaaacgcttcaaattattggcaccagcatctctgatcgagaaaaccttatcttccaaccactgcatgcaaagtgcccctaacttgtcatcaaaaaaaccaacacctaactggctggccaacaaaggtatgtactcaattatggcaagccgaactctccagtgcctatcttcagagagctctacaatggctggcagaagtgattgcgacagcaagtcaattccaataacctggttaacttgatcaagtttgcttataatgttgagtcgaacatcagggaactcatccttcagcaaagaaagaaaaatgggaagcagttgttcaagagtggcgtcctttcccaatacaggagccattcccataataaccgatgccaaagctgaacgaacatgctgagatgaatctgatgataattccacggaagaatatgttcaattgcaatttgtgggtttaatattttgcagaattttgtaacttttccagcagctgcaatccgcacttcagcctcattgtcacagagaaggcgaacatacgctgacaccagatcaccccttgtgggctcagta

SEQ ID NO: 22544 - DNA, 859 bp, Zea mays
aaaacaaattcacaagcatacaatttccgcgcacaacttcatgtctgaacaagcaatgcatacagtttccgcgcacaacactaagcaaagcggactataaaataatgtgcttacactagtgacctaccaacagcacaagtcatgcacaggtcaatcacacagatatcatgtgtgcacctacttcccaaggttgattaaatccaaaaactaaactaaacctaaatcaaaaaacacataattaataaaaagatgcatcaacgtcattggtggtacaatattttttaagactacataacactttaaaatgttcaaaaagaatagaccaatatgtatctcatttgctaattcctggacaggctagtcaactagatatcaccatttggtcacacgcccgaagggcttggtgtgcgtagtatcttacatctacatctgggtcctcactgagctcaactaagcatggtttcactgtcttctccacaacagattgatcaaggattggtacaagtgattgcaggactttagcgacattgaatttcatgttcggaaccctgtcctttgaagaagcaatgacgacagggagcaactgttggcatgtgatatcaggacccatgacaggagctagcaaagaaatagcttgcaaagtggtcatccgatacagatatggggggtttggttatcttctccaaaacctggggaattatatgttgcatcgcccactcagggccaaattcctctgtcaaacgctttaaattattggcaccagcatctctgatcgagaaaaccttatcttccaaacactgcatgcaaagtgcccctaactgggatcaaaaaaaccaggccggcctcgaggtacccaatg

SEQ ID NO: 22545 - DNA, 1838 bp, Zea mays
cgatgatgtggggtgagcaataccaatccatggatgagaattgttgcactacgtggatacagatggaaaccagaaggaatgctgcatagactttctgacagtgaaaccatacaaatacaaactgctaactacgatataacaagacaaaggcatgcactggtactaattattactcgtgatctactccttcctgaaggttttaccactctcaggattccttagttattgagcctactcagctaagtcaactgctaacaaggaagctgcgaaacggcacccatcagtcggtcatcatctttagatctggatcataacggctttggtcctctgatagtgaccaaccaactgcagcatatgtggagtgcaggggaagccccgcgctggtgaatgcactgccgtttggtcccatggggctcccgggatcatcggagtgctcacttgatgtgccatccgatggggggctggcagtcgaggccgccccaaagacagctgtgtgcggtggcaccgatgttggctcacgtttgggttgctcttcttttggctttttagcttcagcaatgaaactgccaactacaacctgcacaggtgtcgctgccatcagcattccagcaacacaacctccaactatgcgtccatcacttccagccagtgccacgctcaaaccacctgttctgctgcgagtgtcaccatcctctgcaagcaagaatgagcccgaaagagagagtatatcgaagtggccctcatatgtcactatcccaccagaggttgctggttgccgcagtgttgccgtgcacagagcaccatttgccgaaattatgcatgtagtgcgcgggccttgttgggaaaaagccattattttggacgcaacatcctcattgggcttcacagttattatgtggggagtaaacgacgtccccgaagatcccaaagcatccagctgtttctttttgcctgacccaggaggacgccctctacgcttgccgtcggggttaggggtagacccgcctccaccggactgggcacccgtcgcttcagtgacccccgccgcggcggtcttgagtcccaagccgatgctcccatctgggccgtacttcctcggcctccccctcttcttcttcacaaggtccccgccgctgacggcgacgatagcaccaccgctggcaccaacgccaccggagccgggctgctgctgctgcaagcccgtcgcgccggaatcagggcggtacatagaccccagcggcatgtccacaatcttcatgctgcttatgggtgacgaggcgtccggcgaagccatagggttaaaggcaagggacatcccgtgcataacgttggccgccgaggcctgcggcaacccggacggcggcggcgccgcgccgaacgcggcggcatgctgcatcatgacaccgccggcgccggcctgcggcggggatcccacgcgcggcggagcctgctgctgctgcggctgctggtgcaggtcccggacgtccatctcgcggcagggcggtgaaaaccctagggctggtgctccggcgcagctcccctcacccgtgccgcagcgcgcctcgtcgggcacagttcacatgcgcagttcgcggcggttggacgtgacctttctccctgtgcaacagaaaaccgacctcgaaatcgaataaaatacggcggaaatggggaaagcagatggagaaaatcctgccgcgccgaaggggaagggaaaaaagaaaattgggagcgaggaaggaggaggtggcgaggtgggagtgggagggcggagagtctttgcctggcctgaggggtcggatcagatctgttaacctcgggccgccccacggtacccaatg

SEQ ID NO: 22546 - DNA, 3200 bp, Zea mays
caataggcatgccttggattctttttctgggtccttcacatgaagaggtcactcaagcacacccactgttgtagatgtagatatgcagaaaattgtccaggaatttcaaccgaaatctccagtttgtgtaggcaacagttttgctcttatgatacacagaaattatagaacagaatcaaatttttttatataaacagatgtcgtgatttagaggcaattataaatttaataatacataaaacagatgaatgaccatctttttttgttgcattttcatctgaaaatgaatcatatatagtagctagaactctttcactgcggatcatgatacaaaaaaaagcatcaggcaaaaatgccaagatttggaacatgcgggcatgtgcattggtgcatgcatgcatggatcctcatctctgtgcgagaaaaatggaggtgatgaaatggttggcctgttctggcggagactaactatcctgttgtttgtgtggggacaaaggttttgctgttgattcaggcgtcagcgtactgagctccaaataaatcaaaatatggccctgtttggcatagctgctgcttgttgaaaaagcagcttatctaataagctggtgaaaagcagcttctgcttgttggctgcttttagtgtattctgagaagcagctgaactgataagctgttgcataagctagctgtttggcagaacttctgcttaaatttgtgaagaagctgaaaataagctgtgccaaacagggcctaagtctattacacaacgataaaacagtaaatgatatgcactaggtaatttatataagccgaaagcattagatccagccttatcgtactttatttacaaacctgccgagaagatttgttttgatccgacggttttgcctcaaaccagcctaatatattaggttcaccgaccacccaatcagtaaagtctagatttggttaaaaatattagaagctgtagtttaatagggttttagactggatacgagacttcaaccttaaaaagtagaagccgtttcgaaacaaggcaacatgctagtcccctgttcaaagctcaaataagaaatatgtggaaaatcgcaaccccccccaccccacacacacactttgatcaaacgtcacatttttttaaggaaacggaaggcaacaatccaatatcaacaaactcgcaatagcgtgtgatcaatttcaatgcgaattttccatacaatacaggagcatcctgtgcaatagttttgtaggttctatcggaattagaaccatggaaagagctccacttttctctgtaggaagctgcattctcaagagacagaatcagctgacctttccaatcagtgcatcagatctgcagacatcgccacgacaaagtggacaaaccctgtgaatctcctttagccatttatctacacatgttagatgaaattcatgatggcatggaagtatacgaagacaatctccctcttcatattcaacaaggcaaatatagcattgtgcagcttcctcactgtggtatttcaatggtctcctatacacttttgcaggaagacgctcaacaatctcccttggagcaggaacagatccaattgaagaaaacgctgatcttgatgacgataacgcagcagattggtggtgaatttcatccagaacctcaaatagtgcttctgctaacataacaattcttgatatgctagcccttgtgctagtttcttcatcaggattgccttgtcgactacctgttctgcagttgcaagttcctgttctatgctgaccagatagtatgcaggacctctcatgaccagataaattttcaaacctgctgcccaacctttgcagagctctgacctgagaccgtatcctccgcctcctctcaagaaaagctgatctacgctccagtaggtcactattactggcctgcctctcagctcaagttgtacagaccattggttgaaggatcagagcgcgattctgaactcctgtctgaattagtcctttgcattactgctgaatcttgcccagcactagcattaccagacaaccataccgccctatcgtaaagaagggcaggggtgaataacccatctgagaatggaggccgtctgaggactctgtcccgaagccgcccaacacttaatgttcggctaaaccgaacactgccttcaaaaggttcctgagatcccatccttctgtaggagttcctcaagatagcatcttcagattctagcagatttcttctagcctgacgagctgctctagcttgtgccgtgacactatctctaagcatgtctagagtcgaatcaatcccagcagttggtgcactaccctgctgggagatgactgtatcagaagagtcatccacatcaccccgaccttcacctgggttagcagaagtcgggaggccagatgacagaatagagcaggctactgatgatcccaagctgacagctctactcaacccaaagttgataccaaaacgtggccttgacctcccagaaggatctgtcaattgactggctgctgttgaagtgttagtggcagcagcattctgtagcacgccatcatcttgatctctttcgctatctgatgaaggtagtgctatctcttcaccgggatgagacttaggcgttgcaagaacatcttcatcagattttgtagtgtgagtgagtgaaggtaggcttgcagtctcccctcccttgttagactcgacgtccaccgccactgcggaaacgtcgcaatcgcaaggcgtcgtggagccacggaagcaggaggaactcggcagcggcagcaggctcctccccctcctcgccttctcgctaccatttggcctcttaacctcgccgcccgcctccgccgccgtgggcgacgtggaggaggtggttgccttgctgctcccagatcccatcacgcaccgcgcctacagttgcacggatcggtccagaccgcccgccattgctccgcctccacgcctcgctcccccgggccagtgcctgggtctgggtgcgggtggccgcatgcgcgacgcctcggtgggcgggaacggggacctcggcagctgtagcttcgttcgtctttccttccaccgcttcagacgctagcgtagcttggctacatacacgctaggcgaagagagagatggttcggtaaaactacccgatacgatgcgtccttgcgttgattggagtgttgtttgattt

SEQ ID NO: 22547 - DNA, 1823 bp, Zea mays
caatcgcccaaacggaagccaataatccattatcaacaaactcgcaaacggaagccaataatccattatcaacaaactcgccccaccacacaagaatcctaaattcaccatggcatgtcgtcatcagtttcataataggatgactgcgatgctgtactgaccataagagagggggaaatgaaaataacagctgcagaagtttggcggttctatcggaattggatgagaaccatgccaagctctccaattttctgtaagaagctccattctcaagagacagaatcagctggtctttccaatgggtgcatcagatctgcaaacatcgccacgacaaagtgggcaaaccctgtgaatctcctttagccatttgtctacacatgttagatggaattcatgatggcatggaagtatacggaggcaatctccctcttcatattcaacaaggcaaatatagcattgtgctgcttcctcgctctggtatttcaatggtttcctatacacttttgaaggaagacgctcaacaatctcccttggagcaggaacggatccaattgaagaaaatgatggtcttgatgacgataatgcggcagattggtggtgaatttcatccagaacctcaaaaagtgcttctgctaacataacaattctcgatatgctagcccttgtgctagtttcttcatcaggattgccttgtcgactacctgttctgcagttgcaatttcctgttctatgctgaccagatagtatgcaggatctctcatgaccagataaattttcaaacctgctgcccaacctttgtagagctctgacctgagatcttatcctcctcctcctctcaagaaaagctgatctgcgctccagtagatcgccgttgctagcctgcctctcagagctcgagttgtacatatcgctggttgaaggatcagaccgtggttctgaactcctgtctgaattagtcctttgcattactgctgaatcttgcctagcactagcatttccagacggccatactgccctatcataaagaagtgaaggggtgaatagcccatctgagaatggaggccgcctgagaactctgtcccgaagccgcccaacacttaatgttcggctaaaccggacactgccttcaaaaggttcatgagaccccatccttctgtaggagctcctgaagctagcatcttcagattctatcagatttctcctagcctgatgagctgctctagcttgtgccgtgacactatctctaagcatatccagagttgaatcaatcccagaagtcggtgcactaccctgctgtgagatgcctgtctcagaagagtcatgcacatctccccgaccttcacctggattagcagacggcgggaggccagatgacagaatagagcaggctactgatgaacccaagctgaccgctctactcaagccaaagttgacaccaaaacgtggccttgacctcctagaaggatttggcaattgattggccgctgttgatgtgctagtggcagcattctgtagcacatcatcatcttgatctctttcgctatctgatgaaggtggtgcttccccttcactgggatgagatttaggcattgcaagaacatcttcatgagactttacagtgtgagtgagtgaagtcaggcttgcagtctcccctcccttgttacactcgaagtccaccgctgctgcggcagcgtcgccttcgcacggcgtcgtggagccacggaagcaggaggagctcggcagtggcagcaggctcctccccctcctccccttcccgctcccattcggccccggcccctcgccgcccgcctccgccgccgtgg

SEQ ID NO: 22548 - DNA, 1112 bp, Zea mays
  misc_feature (1102)..(1102): n is a, c, g, or t
aaggagagaacaggatgataatctaaccttataaccgttcatcttccatgagcccaataattataccaacaaaacaaacttgtacaggagaaaaaccagctgcagcagaccaaatctgaagagaatctgcatagcatagatccttctactaaatactaaagctcctatttagttaactgtctttttcttttgtttttttttttttttttttttaaacgtaaatcgtctgcattcatcatctctgtcaatcagtcaacagaaagtgtacaacatgcgactggtctggaaattgttgtctgttctaaatgttgcttctgttgctaatatgccttgagagcatctccacatggaaaactcaacagctcaacaattatttgtcctcctgcacaggagtaaaaagaagcaagaaaactcttgcaaatattttgtcctcagctcgtggcatatgaaactctttggttcttcaactgtggtgttatttaatattctctctcgttatggggaacaccgtagaactctgccaggtactccaaagcttcatgattcccatcacaaaccttccaaagtgatgcaacttcgcccggagcaaccgtgccccactcctggcagtcattcagaaattccaaaagcttggagtaataagaatcgtagttgagaagcaagaccgggaccgggagcgctgacccgatcctctctagttgaatcagcgccaagatctcaaacagctcgtccagcgtcccaacccctcctggcagcgcaaccacagcggttctgtcagtagagctgctccgcaccgcagcatccaccaggccatgcttcctcgcagagaagaacctgcatgtgaggtaggtctccggtggcaggtaaggatggaagcctgagcttgtccattcacccgcttcctttgcaatcctccccccacccccaggcttgtctgcctcaaaggcgccttggatggcagcatccatgagcccagggccggctcccgtccatgtggtgcagtcgagcagccgagctatcgaggcggcggacgaggtccacagcaccgggcctctcctccctcccctcccccgggctgctcctcggaggacccaagatcgtnccagctccgc

SEQ ID NO: 22549 - DNA, 3631 bp, Zea mays
  misc_feature (261)..(261): n is a, c, g, or t
  misc_feature (515)..(515): n is a, c, g, or t
ccgccgctgccattgataggcgcatgggcattgcaggctgcaagcctgcgacgtcgtcagactcttatagttatagtgtgtttggtttaatcaatgaagtgatacaactttttctcacttctcacttttttatttagtttatgaaatagaatgggttgatccatcatcatcacattccttataagctaataattagtatataaatgaggaatgagttggttccactaaaattgatggaatgaacttatgatgcatcacctnataaagcatagagtgactccacaaaccaaacacacgattagagttgtaatgacagaataggataggacgatccttttgattcagaggcagtggttaaaacagaattatctcagtgttgtatggacgccaagagacgttcctatcctatctgtcaccagctggcccgcaaccaaacacatccttactcttgcgctaggtacgtcaattggattccatatttttcaccatcgtgagaccacacacaagaggtattnagaatttcagataagggagcacacgtaggtcgatggcgtttcactaccggtaacttgaactcgtccgcatctaactgttcaagttcaatacattacatgctacaacttacatcatatagtgacaaattggaacgagaactgtttacaggtaatttatatcaggggtaaacacccaaaaccaactgacaggatggctggagtgttggccttttgacttcttcttctttttttccatcaagatgtgaattgtcaactcaatgaagttgttgtagcatatgttttatttgcccattcagtcatcagctgacaggagggtctggactgcatgttccatagtcggtcttttgcttctgtcttcctccaagcaggagaccgccaatttgatcagtgttcttgcttgcacatagttgactggacgattcagttttgaatccagatacccatcaatccacgattgttcctccccttcaagtttggcagaaagcatcctgacaagctttctaagcatactatgcacctcatctgtgcctcccaccaactctgaaactctggtgcctgtcaatagctccagtagcacaaccccataactgtatacatcgacttttgctgtgatcgggaggctggaaacccactcaggtgcaatgtaacctagcgttcctctgacatgggatacgttctgggtggaccctcctctgttcagcaacttcaccaacccaaagtcagtgatcttgggctcaaaagcttggtctaacagtatgttctcaggtttcacatcacagtggatgacccactctaagcactcatggtggagataggctaacccttttgcaacacctaacgcaatgttgaaccttccctcccagtccaataagatgttgcctccttcactgaacaaaatgttagccagtgatccattctcaacatattcggagaccaacaacctatgagatccctctgaacagaagccccatatcctcacaaggttcatgtggttgatcctcccaattacacttagctcagcctgaaacacttccttgccttgccttacattctccagcttcttcacagccacatgcctatcatcttctaggacacctttgtacacagtgcctgattctcccctccctagctcaaccttgaattttctggtcgccttcacaagttccctgtagctgtaccttctaaaattactagtcattgctttgtaacctttctcagacgcccatagttcagatggcctgagttctctcttcaaaacaaagaaccacgcaaacgaaatgaaggaaacttcaacgacaaaaaatgcagctatgaacccatagaagtaaaaccatttcgattctcctccgccggtcttgtgcacatctggaaacggttctctgatgcttttgttcatccgatcgcagtcgagacgacggggcacggaatcgaacacgtcggaacgtggaataagggcatttgaaacactgacccctgttggaagcttgagatatatcgttcgcacgtcagatgttgggtaggttcttccactgaaaagataagcttttggatagcatgatcctgtgccttcctgatactgaaagcctttacaggtgcagtcactgatgcagatatccctacaagttcgaagagaaaccgacagaagatgttgctgatccgacccccaaaaatccgtattgggaagtcgcacaaatctcatagacctcttgtcatagcggtcacaggttgtgttgacaatagccatacagccttcagtccagttacccgggttcctcgtcgcataacctggtgggcacgaacatgtaggtgtgggtgagtagtggcagatgccattaggaccacacaaaccgtgaatattgcaaggctgggtcattgctaccattgaaactgaccatgacccatctgaatcgttcatgctgtacagacggagattgccatcagggtcaagagttagccttctcttgacgcccggccctacgtcggaggccacaagcgcctgaccatcagcgaagtcgctcgaggcaagcaccccgctatcagtaagcattcctaacctcgtactgttatactggttccggccatcctggtagaggttctggtcagggtctggccagtatatgtctgagacttgaggcacgtggtatataagcgacagcactgagaggtcgctgaagcggaagatgtagttaccaggactacgcgattgggttgtggggactaatctggtcgcagcagtgatgagctgcgtcggcaggaaagtgtccgttggggaatcgaaactctgccatacagtgttacctcctgagtcctcgatgacgaggttcccggtgtccaggagccgagcacgctggacgccggtgaagttgttgccatcagctcgccacacggctgcgccgtcgtagtcggtgagcaccatgttgccgtccttttgcagggttagagccgacctcctggcatggacagggcggtcagggtttgcgctccacacgatggtcttgttgttggccgccgccgcctccgtctttgagtaccatactgagaatgtgaaggcatgggtgtagacttcgtagaagccagaggagaatgtcccgtctgatgattgtaaggtgctggattcgtaggactcgactacgagagaggaacccagtggtaggatgtctcgggatgatgcagctcttggaaacagagcgatgaagaaggagaggatgcaagcggtagagaggagagctgcaagaggacgaggcatcgttgctgagatggggttttcgtcccgctccgcgcaggcgcagctacttgtatccgtggtgtgccgagtttctgtctcagtcctgatagcgaaacgccattacctggtcaaattcagagtgctatggagttcaagttgtttaagtttcctttatgcgcattgatggtgaagtatacagcagccattctagtcaatctttgctactgctagagctcaagaaaagtccatttcttggacagtgcattgaaaagaaaaggatacagtacaagctcaaacctactccctctctttgtctctaaatataattgtcgtttccgtttcccgataagttaaacaaactataatttataatacataaataatgtattag

SEQ ID NO: 22550 - DNA, 2515 bp, Zea mays
  misc_feature (1)..(6): n is a, c, g, or t
  misc_feature (154)..(154): n is a, c, g, or t
  misc_feature (186)..(186): n is a, c, g, or t
  misc_feature (210)..(210): n is a, c, g, or t
  misc_feature (232)..(232): n is a, c, g, or t
  misc_feature (234)..(234): n is a, c, g, or t
  misc_feature (261)..(261): n is a, c, g, or t
  misc_feature (263)..(265): n is a, c, g, or t
  misc_feature (271)..(273): n is a, c, g, or t
  misc_feature (279)..(280): n is a, c, g, or t
  misc_feature (282)..(282): n is a, c, g, or t
  misc_feature (290)..(290): n is a, c, g, or t
  misc_feature (306)..(306): n is a, c, g, or t
  misc_feature (309)..(310): n is a, c, g, or t
  misc_feature (314)..(315): n is a, c, g, or t
  misc_feature (321)..(321): n is a, c, g, or t
  misc_feature (328)..(330): n is a, c, g, or t
  misc_feature (335)..(335): n is a, c, g, or t
  misc_feature (341)..(341): n is a, c, g, or t
  misc_feature (344)..(345): n is a, c, g, or t
  misc_feature (349)..(351): n is a, c, g, or t
  misc_feature (353)..(353): n is a, c, g, or t
  misc_feature (356)..(356): n is a, c, g, or t
  misc_feature (359)..(363): n is a, c, g, or t
  misc_feature (365)..(467): n is a, c, g, or t
nnnnnngttgtacccccttggagggagttgataccgctctccgcagcggaatggcccgagcgcagtgagtcattgaccgaggaatcggaagaacgctccataggcaaaccgctctacctcgaacgttggcccattcattaatacaactaccacnacatttttcccccctcgaaaacaaacaattanctcaacccaattaatcacaattanccccctcaccaggcaccacaancnttacaccttaaccctccgacccacaancnnnaaaaannnccaccnnanaccaacancacccacaaaccaccnaannccannataacnccaaacnnnaaaanaaaccncannaaannnancanaannnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccccggtcattcaaaagtatgatcatcaatgatgtttggtctatgtaggcctcatcattcttctttcttgctctgttactgtaagctgttctatgaattgtggcattcttttataattttactttatgatttttgcaaattcgattctggttattactgattagttgtacatgtaacagaagtgtaacagaagtgtatttttcaccttcacttgttgtacatgtaacttaggttgcatcatcgtgctgggagtaatccacttgagctgcatgggagtgtatatgaggtaatttgtttagaatgtctgaatgtggtacatccatcagtcaagaatcattccaggaggaatgtggtaaataacattgacccttgttggaagcttgagatatatcgttcgcacgtcagatgttgggtgcagtcactgatgcagatatacctacaagttcgaaaagaaaccgacagaagatgttgtcgatctgacccccaaaaattcgtattgggaagtctcacaaatttcataaacctcttgtcatagcggtcacaggttgtgttgacaatagccacacaaccttcggtccagttacccgggttcctcgtcgcataacctggtgggcacaaacatgctgtacagacgaagattgacatcagggtcaagagttagccttctcttgatgcctggccctacgtcggaggccacaagcgcctgatcatcagcgaagtcgctcgagtcaagcaccccgctatcagtaagcattcctaacctcgtacggttatactggttccgaccatcctggtagatgttctggtcagggtctggccagtatatgtctgagacttgaggcaagtcgctgaagcagaagatgtagttaccaggactacgcgattgggttgtggggactaatctggtcgcagcagtgatgagctgcgtcggcaggaaagtgttcgttggggaatcaaaactctgccatacagtgttacctcctgagtcctcgatgacgagttcccagtgttcaggagccgagcacgctggacaccggtgaagttgttgccatcagctcgccacacggctgcgccgtcgtagtcggtgagcaccatgttgtcatccttttgcagggttagagccgacctcctggcatggacagggcggtcaaggtttgcgctccacacgatggtcttgttggccgccgcctttgagtaccatactgagaatgtgaaggcatgggtgtagacttcatagaagccagaggagaatgtcccgtctgatgattgtaaggcgctggattcctaggactcgactttgagagaggaacccagtggtaggatgtctcaggatgatgcagctcttggaaatagagcgatgaaggagaggatggcagcagtggaaaggagagctgcaagaggacgagacatcattgctgagatggggttttggtcgatgaacgcgcaggcgcagctacttgtatccgtggtatgccgagtttctgtcttagtcctgatagcgaaacgccattacctggtcaaattcagagtgccatggagttcaagttgtttaagtttactttatgcgcattgatggtgaagtgtacagcagccattctagcgatgtgaaggccatatttgctcagctacttaccactcaggtccactcacatttatgttccttgttttccaattgatctttttttggtgaagccttgaaaaaacatcgatgtcatgtttagtgttcgtatcaatagataagttggtagttgattataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacccccggggggggggcccccccccccctcccccccaaagggggggttttaaaatttttgggggggcgtttttaaacccccggggggggaaaacccccgggggccccccaaaaaaacccccgggaaaaccccccc

SEQ ID NO: 22551 - DNA, 1532 bp, Zea mays
ttttttttttttttttcgcgtaaatgggtatgaattttagcgtaaatcgtcacaaaacacatcaataaatgtcgtaaattggcgtaaaacatatcaatagatctccaggacagatcttgcgccatgcagttctgaaccatctcatggaacgccagggtgtcgtactgcttcagggctcgcgtgacggttgacgctactgctgtcacgtcggctgggtctacagtttcactctcgacattgaaagaacccatgtggaatccggtgacaccctcctcaactgtgtcgacaagtcctccagtggatgaacagatggggatcattccatatctcatcccttgcagctgaatgagaccacatggctcaaacctgctcgggacgataatgaagtcagcctcggcaaacatcatgtgtgccaatggaacattgaatttcgctatgcctccatcttcttctttcccgtgccaagaacgattatctggacattctcgcccacgaactctggaattgttgcaatgagtatgtaggaccctttctgttcttcgagacaccccacaaaaactataacagggatgctcgagtccacacgcaatccaacttcggcttgcaacctctctttattgagagtccttgcttcagttaccgttgttgcatcatatttcacgcttatgtacttatatgttgaaggatcccattcataaacatccatgccatttacgattccaatttctagaagctttgcgcgaaggacaccatccaactcaacacccttatctgggtcagatgtgagtttcttgaaataatctggactgactgttagagccagatcactctcaatgattcatataataataggcacaccctgctaaagttctgttgccgggacgtggggtcagtaaggcgtccaggccgcggacggcggtcgcgtggcctcggtcggagccgcggcgaatggcatgaaggtgggattttcgttgccgtcggggtcgaagaagaagtcgaggagaggaggcgggtgcagcgtgcggaagcgacggcggaaggcgcaggaggagcggacggcggccaggatggcgcggcagctgaggtaggcgcagacgagtgaaggaagggaagggaggcggaggaggatctcgcgtgaggtgcgtcatcaccaccgcaccgtccgtggccgtcgacgccaccagcgacgccatgcctcaccgctatgggagggaggcaaaggaagcacctggagcagccttggggaagctggagatcggcggcgtcggctgacggccaagaacacataatagatctccgcgtccctggcgtagctctagatcttggcatccctggatctcggcatcactaacgtagcctcgccacatgcccctcgacgacgggactgggccactggggactggggagaagatcgagatggactaggaaggaaacgtacctgcaggctggcgccgccgcatcggggatggaggaggagtcgagggggagtggaggaggagccaccatgtccgagagctctaaggttggcgact

SEQ ID NO: 22552 - DNA, 2183 bp, Zea mays
  misc_feature (1903)..(1954): n is a, c, g, or t
  misc_feature (1956)..(1965): n is a, c, g, or t
  misc_feature (1967)..(1969): n is a, c, g, or t
  misc_feature (1971)..(1972): n is a, c, g, or t
  misc_feature (1975)..(1979): n is a, c, g, or t
  misc_feature (1981)..(1983): n is a, c, g, or t
  misc_feature (1988)..(1988): n is a, c, g, or t
  misc_feature (1990)..(1991): n is a, c, g, or t
  misc_feature (1997)..(1998): n is a, c, g, or t
  misc_feature (2003)..(2003): n is a, c, g, or t
  misc_feature (2015)..(2015): n is a, c, g, or t
  misc_feature (2035)..(2036): n is a, c, g, or t
  misc_feature (2039)..(2041): n is a, c, g, or t
  misc_feature (2046)..(2046): n is a, c, g, or t
  misc_feature (2053)..(2054): n is a, c, g, or t
  misc_feature (2073)..(2073): n is a, c, g, or t
  misc_feature (2091)..(2095): n is a, c, g, or t
  misc_feature (2101)..(2102): n is a, c, g, or t
  misc_feature (2116)..(2116): n is a, c, g, or t
  misc_feature (2130)..(2130): n is a, c, g, or t
  misc_feature (2177)..(2178): n is a, c, g, or t
aaacaaccactgagaagcgtactatgcacaagaacgagccatttcaaacaattccatcgtgaccctaccacttgggatgattcgagctgcccgctagcattcgctatatttacataaccgttgtcgaccgaacggaagcgagaagtgtatgttccgcaagaacagaagaattagaccaggcatggcattttttagaatgccaaggattatattacaatgaagtagtagtggtactgtggtagtagaggcgaaaccgtgtctgactggacacctcactccaccagccacaaggccgcccaggaggatcctagaagacgcttcctatcaccaacgcgtgtttccgagtccgaggcaccaccaagccctcacggagtggctacgttttccttggcaagtggggcgatctcctctgcgtcgtcgataccagctcgactcccctcgactccaaggcccagaagcacctcctcccacttcttcgcaggccccttccaggacaggtcttgcgccatgcagttctgaaccatctcatggaatgccggggtgtcgtactgcttcagggctcgcgtgacggctgacgctactgctgtcacgtcggctgggtctacagtttcacactcgacattgaaagaacccatgtggaatccggtgacaccctcctcaaccgtgtcgacaagtcctccagtggatgaacagatgggaatcactccatatctcatcccttgcagctgaatgagaccacatggctcaaacctgctcgggacgataatgaagtcagccccggcaaacatcatgtgtgccaatggaacattgaatttcgctatgcctctagcgttgtttggatatttcacttccagctgcgttagttcctcctccatcttcttctttcccgtgccaagaacgattatctggacattctcgcccacgaactctggaatggctgcaatgagtatgtcggaccctttctgttcttcgagacgcccgacgaaaactataacagggatgctcgagtccacaggcaatccgacttcggcttgcaacctctctttattgagagcccttgcttcagttaccgttgttgcatcatatttcacgctgatggacgctgcggttgaaggatcccattcataaacatccatgccatttacgatttccaatttctagaggctttgtgcgaaggacaccatccaactcaacacctttatctgggccataagtgagttccttaacataatgtggactaactgttagaaccagatcactctcaacgatccctgtcttcatccagttaatctttctccctagaacaggcttaacatgtccatcaataaaatcaaatgatggtaagaaactgtcaggtagattaagaagatcgaagtctgctctggcaaatctaccttgataggcaatattatgtatgcagaacgcaacctgctgtgttctggatgaatgatgaccaagttcctagaagacaatgggctattttacgtaaatgatgtcctcctcatctggctcatctacatcccagtcaccatcttcttcttctgatatacatgaaccatccacatcttcctccccatattttccttcttgttgctccctttcctcctttagtttgtcaagtatagcaaggatctaccttgcaccggagttagcagaagcagaaggtgtcgaggaggctacgtcatttgaagttgtaaatgcctccactaagtattcaagctttatatctttgttgccaatctccactcgtataagatcatacctgcattgaaaagaaaaggaaagaatatgagtacagacctcacacttatcttagtcatctaagaaagaatcagaaatgatgaaacggtgcacgcttggttgtccatccactatctgatggtatgatggggggggggggggnnnnnnnnnnnnnnnnnnnnnnnnnnnnnnnnnnnnnnnnnnnnnnnnnnnnannnnnnnnnnannnannaannnnnannnaaaanannaaaaannaaaanaaaaaaaaaaanaaaaaaaaaaagaaaaaaannaannnaaaanaaaaaannaaaaaaaaaaaaaaaaaanaaaaaaaaaaaaaaaaannnnnaaaaannaaaaaaaaaaaaanaaaaaaaaaaaaanaaaaaaaaaaaaaaaaaaaaaaaaaaaagaaaaaaaagaaaaaaaannaaaag

SEQ ID NO: 22553 - DNA, 2428 bp, Zea mays
atgctcttgttcgtgcctttccaaacaactccatcgtgaccctaccacttgggatgattcgagctgcccgctagcattcgctatatttacataaccgttgtcgaccgaacggaagcgggaagtgtatgttgcgcaagaacagaagaattagagcaggcatggcattttttagaatgccaaggattatattacaatgaggtagtagtagtagactagtagtagaggcgaaaccgtgtctgactggacacctcactccaccagccacaaggccgcccaggaggatcctagaagacgcttcctatcaccaacgcgtgtttccgagtcgaggcaccaccaagccctcacggagtggctacgttttccttggcaagtggggcgatctcctctgcgtcgtcgatgccagctcgactcccctcgactccaaggcccagaagcacctcctcccacttcttcgcaggccccttccaggacaggtctttcgccatgcagttctgaaccatctcatggaatgccggggtgtcgtactgcttcagggctcgcgtgacggttgacgccactgctgtcacgtcggctgggtctacagtttcacactcgacattgaaagaacccatgtggaatccggtgacgccctcctcaaccgtgtcgacaagtcctccagtggatgaacagataggaatcactccatatctcatcccttgcagctgaatgagaccacatggctcaaacctgcttgggacgataatgaagtcagccccggcaaacatcatgtgtgccaatggaacattgaatttcgctatgcctctagcgttgtttggatatttcacttccagctgcgttagttcctcctccatcttcttctttcccgtgccaagaacgattatctggacattctcgcccacgaactctggaatggctgcaatgagtatgtcggaccctttctgttcttcgagacgcccgacgaaaactataacagggatgctcgagtccacaggcaatccgacttctgcttgcaaactctctttattgagagcccttgcttcagttaccgttgttgcatcatatttcacgctgatgtacttatctgttgaaggatcccattcataaacatccatgccattaacgattccaatttctagaggctttgtgcgaaggacaccatccaactcaacacccttatctgggccagatgtgagttccttgacataatgtggactgactgttagaaccagatcactctcaatgatccctgccttcatccagttaagctttctccctagaacaggcttaacatgtccatcaataaaatcaaatgatggcaagaaactgtcaggtagattaagaagatcgaagtctgctcgggcaaatctaccttgataggcaatattatgtatgcagaaagcaaccttagcatttttataaattccatttggcttatacatgctcttcagataacatggcaaaatagcagtgtgccaatcattggctacgaagacaacatcttccccatatggtccagagaaatattcagaattgttgaaattgagaactcttggagcctccaaagcagcaaggcacaaaaggcagaacctcaactggttatctcgatagtcagttccagtagtaggaccatacaattttgctccagtcttgccccataccttttcaagaaacataggatgatcaacaaaaacacgatcgactcctcttttgtagcagtggaagaatcgaacagtttctaccgtgtcaccaatatttacctcaacaaggacacttgtatcccatgcatccttgtattgatcataacgaggagctattgtcatgacacggtgtcccatagcagccaaagctgggggcagtcctcctacaacatcaccgaggccaccagttttgcaccatgggtgcacttcagttgcaacaaatacaatagtcatcccagcagaacatacaataggtgcccgatgtcccgtagtctttggatgaattccattatctgtagctcttcttttagccacctgtatcttacttcgcatggattgggagtgcttgcttaagaacctaagtccaccgttgcaacattgttggaattgcatgtgaggtgcctgctttagtgcactgggcctatttgtttggtaagaaccgttggcagatattgaacccatcgttgcagccattcaatgatgacctcgcgctggctgcagccgcggaagaaggcggagcggctgtttgttggctttggctccgggtcgggggactcccggccggcctaggcggcactcaagtagaggaggaagcaagcggcgacgcagcgcgccgaccgccgagggccaggaaaaatatcgcccacgtgacaggcggcgtgcgccccgcctagtggctagcgcacgggcgccactttttgattaggatgttctaggtaatggtctcgtgc

SEQ ID NO: 22554 - DNA, 2246 bp, Zea mays
ttttttttttttttttagagcaggcatggcattttttagaatgccaaggattatattacaatgaggtagtagtagtagactagtagtagaggcgaaaccgtgtctgactggacacctcactccaccagccacaaggccgcccaggaggatcctagaagacgcttcctatcaccaacgcgtgtttccgagtcgaggcaccaccaagccctcacggagtggctacgttttccttggcaagtggggcgatctcctctgcgtcgtcgatgccagctcgactcccctcgactccaaggcccagaagcacctcctcccacttcttcgcaggccccttccaggacaggtctttcgccatgcagttctgaaccatctcatggaatgccggggtgtcgtactgcttcagggctcgcgtgacggttgacgccactgctgtcacgtcggctgggtctacagtttcacactcgacattgaaagaacccatgtggaatccggtgacgccctcctcaaccgtgtcgacaagtcctccagtggatgaacagataggaatcactccatatctcatcccttgcagctgaatgagaccacatggctcaaacctgcttgggacgataatgaagtcagccccggcaaacatcatgtgtgccaatggaacattgaatttcgctatgcctctagcgttgtttggatatttcacttccagctgcgttagttcctcctccatcttcttctttcccgtgccaagaacgattatctggacattctcgcccacgaactctggaatggctgcaatgagtatgtcggaccctttctgttcttcgagacgcccgacgaaaactataacagggatgctcgagtccacaggcaatccgacttctgcttgcaaactctctttattgagagcccttgcttcagttaccgttgttgcatcatatttcacgctgatgtacttatctgttgaaggatcccattcataaacatccatgccattaacgattccaatttctagaggctttgtgcgaaggacaccatccaactcaacacccttatctgggccagatgtgagttccttgacataatgtggactgactgttagaaccagatcactctcaatgatccctgccttcatccagttaagctttctccctagaacaggcttaacatgtccatcaataaaatcaaatgatggcaagaaactgtcaggtagattaagaagatcgaagtctgctcgggcaaatctaccttgataggcaatattatgtatgcagaaagcaaccttagcatttttataaattccatttggcttatacatgctcttcaaataacatggcaaaatagcagtgtgccaatcattggctacgaagacaacatcttccccatatggtccagagaaatattcagaattgttgaaattgagaactcttggagcctccaaagcagcaaggcacaaaaggcagaacctcaactggttatctcgatagtcagttccagtagtaggaccatacaattttgctccagtcttgccccataccttttcaagaaacataggatgatcaacaaaaacacgatcgactcctcttttgtagcagtggaagaatcgaacagtttctaccgtgtcaccaatatttacctcaacaaggacacttgtatcccatgcatccttgtattgatcataacgaggagctattgtcatgacacggtgtcccatagcagccaaagctgggggcagtcctcctacaacatcaccgaggccaccagttttgcaccatgggtgcacttcagttgcaacaaatacaatagtcatcccagcagaacatacaataggtgcccgatgtcccgtagtctttggatgaattccattatctgtagctcttcttttagccacctgtatcttacttcgcatggattgggagtgcttgcttaagaacctaagtccaccgttgcaacattgttggaattgcatgtgaggtgcctgctttagtgcactgggcctatttgtttggtaagaaccgttggcagatattgaacccatcgttgcagccattcaatgatgacctcaaatgcaaaatgccagccaggtacctcgcgctggctgcagccgcggaagaaggcggagcggctgtttgttggctttgggctccgggtcgggggactcccggccggccccggggaccccaaggcaagtagaggaggaagcaagcggcgacgcagcgcgccgaccgccgagggccgccggcccggccggcctcgag

SEQ ID NO: 22555 - DNA, 1931 bp, Zea mays
ttgggtaccgggccccccctcgagttttttttttttttttttcttttttttttttttttttttttttttttttttttttttgacacaaaagggaggttcttgttacaagcgcagtacatcgtctatttaggaggcaaaaggtctagcaataaaaacatggacctcttaattcatcctttatcactggaatttgcttcggagttcggaccccccccaggaggaggaaaatgttgtaaaggggaaactgggtctgactgaacaactcactccagccacaaggccaggaggatcctaaaaaatgcttcctatcaccaacgggggtttccgaggcaccaaggggcatggagtaactacgttttccttgggaaggggagcgatctcctctgcgtcgtcgatgccagcttgactcccctcgactccaaggcccagaagcacctcctcccacttcttcgcaggccccttccaggataggttttgcgccatgcagttctgaaccatttcttggaacgccggggtgccgtactgttctaggcccgtgtgatggttgacgctactgccgtcacgtcagctaggtctacagtttcacactcgacattgaaagaacccatgtggaatccggtgacacccctcctcaaccgtgtcaacaagtcctccaggtgatgaacagatgggaatcactccatatctcatcccttgcaactgaatgagaccacatggctcaaacctacttgggacaataatgaagtcagacccagcaaacatcatatgtgccaatggaacattgaatttcgctatgcctctagcaatgtttggatatttcacttccagctgcattaattcctcctccattttcttctttcccgtgccaagaacgattatctgaacattctcgcccacgaactctggaatggctgcaatgagtatgtcagaccctttctgttcttcaagacgcccgacaaaaactataacagggatgctcgagtccacaggcaatccaacttcagcttgcaacctctctttattgagagcctttgcttcagttaccgttgttgcatcatatttcacgctggtgtacttatctgttgaaggatcccattcataaacatccatgccatttacaattccaatttcaagaggctttgtgcgaaggacaccatccaactcaacacctttatctgggccataagtgagttccttaacataatgtggactaactgttagaaccagatcactctcaacgatccctgtcttcatccagttaagctttctccctagaacaggcttaacatgtccatcaataaaatcaaatgatggcaagaaactgtcaggtagattaagaagatcgaagtctgctctggcaaatctaccttgataggcaatattatgtatgcagaaagcaaccttagcatttttataaattccatttggcttatacatgctcttcagataacatggcaaaatagcagtgtgccaatcattggctacgaagacaacatcttccccatatggtccagagaaatattcagaattgttgaaattgagaactcttggagcctccaaagcagcaaggcacaaaaggcagaacctcaactggttatctcgatagtcagttccagtagtaggaccatacaattttgctccagtcttgccccataccttttcaagaaacataggatgatcaacaaaaacacgatcgactcctcttttgtagcagtggaagaatcgaacagtttctaccgtgtcaccaatatttacctcaacaaggacacttgtatcccatgcatccttgtattgatcataacgaggagctattgtcatgacacggtgtcccatagcctcaaatgcaaaatgccagccaggtacctcgcgctggctgcagccgcggaagaaggcggagcggctgtttgtggcttggctccgggtcgggggac

SEQ ID NO: 22556 - DNA, 1342 bp, Zea mays
ttgcccgcggttctcttggtctgtttggccttatgtaactttgtcctgttcgtttttgttagatcagatgagagagtgataaattatcattaaaatcatactgatgctactctattacataatggcttatagaaagacgaaatactgtaccaaaaccatagaagaaatggagactgaaatacagcaagataactaggcaagtacaaattaaacaagtgctagttaacataacagaggaatgagcatcagcccaaactgtcttgcgtcaatggtcagatatcataatccagtattccagtggacagggaaaaaaatactcttccaaattcctctttgaaatatcccccgcattgaaaagccataaaaaaggacatgaccagcttctaaatggcagcaagggtgtgatatgtcctgcttcaattggcaaaagagatgtctctgtagacctcttcaagtgctgatatactttggagtgcttcgacaagcaggcgagcagtgaacttcactgaattaaactctgaagaggactgttgtgttctggatgaatgatggccaagttcctagaagacaatgggctattttacgtaaatgatgtcctcctcatctggctcatctgcatcccagtcaccatcatcttcttctgatatatatgaatcatcatcttcctccccatcttttccttcttgttgctccctttcctcctttagtttgtcaagtatagcaaggatcctgcttccacgctccatagactcatcctcgatgaaccttatctccggcgtgaggcgaagcttcatcctcctgcctatctggctcctgacgtacttggtcttggccttgagcccctcgatggccaccttcttccccctctcgtccccaaacacggacacgtacactttgcacacctggaggtcgttggagagctcgacgtcggcgatggtggtgagcgacgagaggtagcggtcagcgccgagcgcggcttcggggagcacggcgcgctgcagcacggggtcgcgggtgagcatgtcggcgagctcccgctggatctgcttcgccaccatccgtacccgccgctccttcgccatgcaccgcaccacgcgcagcgacgacgacggcggccgcagcgacgacagtggaagccgcgcgagggaaggggcacgcggcaggtgcggcggagccagggggcggcacgggaacatcgcgccggaagacggaagcttcgatcgatccgtggagactggagagcgcgggtgggatggagcgggagcggcgccggcgaaaggggatagtgttgccaggtccggcccggcgagcccgtgggtacccccccggcccgccggctcga

SEQ ID NO: 22557 - DNA, 1380 bp, Zea mays
  misc_feature (1350)..(1350): n is a, c, g, or t
aaactggcgatagataaccggccacaagtatgctgatgaaatgaataagtgttgtcaaactgtaataacagatacacgcattttaactaaatcgacagtgacaacccccctcctctgtttttttttttctttttttaacacaacaactcgatctttattccaagctaattcgtcaaagaggttattcatcaacttcgaccaagcaaaacacaactgaccacgacagagttctaacgaccaagtcacgaaccgtacaccaaggttttccacacgaccagacaagcatcgcgattctgcttcggcggcagacaaacacaaatgaaaacacacagcagttacttcgctctaagctcagtcttgcacaagtttcagattgccttgtccgaaccaccatgcaatcaagcccgctcgaccatgtattccacgagaggtttctgcagtctcccctccgtgccctctataatggtgagcctccgtgctactttcatgaagtcattgaacggctcttcaccagtatgcctgacagcaccagcagcatcacggtagcaaaggtgcctcattatttccgccttctcaattccaaacatgtccgctaactggccgtacagctcttcgtacgaaccaaagacagataggtcaatggtgcggccaacatcctctgattccataaacaccttgcagtgcccgtcttctagcccaagctcagaagccttgcggtcttgggataggccttccctcgatcctccagaatccatctgctgctcagtaaggataggctttccgaacagcattatgtggggtctctttatgtcatcagatttctctgtggcctgtggtgtgccgattgtcagcaagcaagagacactctcactggctggtgcgctgctgatcacaaaacccttggatatacggggcgtcggagtcatagcaccaagccggttgaaaccgaggtgcagctggttaagctggtagtctgttaggggtaaaccaaattgagcatgcctggctccctgtatgcctgcaggagcgatgtccgagaaacagcgaagtgggctgttgcttggaccaagtgggttgccatggaaaattggattcaacagctgaccctcaaatggaaagtctggatgttgggccacccgcaacttctttctaggtggagaaaatgtccctaggtgaatcggtggaatgcttgatacaatctccaccaagcccatggattgacacatttcccattctgcggccggctcggggtcatcccatgacacctgaagaagcctccacggtgaatttggccatctgattgggtcagcaacctgagcagaagctatcgtccccataaaccagctgatncttgacgcccacgcggccgcggacgctggg

SEQ ID NO: 22558 - DNA, 1791 bp, Zea mays
ccggggcgcgtgctccttgctgctgttctgctgactggtctcaccatctcatctcatcccaccaccaccaccaccaccaccaccaccaccatctttaggataagatagcaaatatatggccatcatactcgtacgagcagcgtcgccggggctctccgccgccgacagcatcagccaccaggggactctccagtgctccaccctgctcaagacgaagaggccggcggcgcgccggtggatgccctgctcgctccttggcctccacccgtgggaggctggccgtccctcccccgccgtctactccagcctcgccgtcaacccggcgggagaggccgtcgtctcgtccgagcagaaggtctacgacgtcgtgctcaagcaggccgcattgctcaaacgccagctgcgcacgccggtcctcgacgccaggccccaggacatggacatgccacgcaacgggctcaaggaagcctacgaccgctgcggcgagatctgtgaggagtatgccaagacgttttacctcggaactatgttgatgacagaggagcggcgccgcgccatatgggccatctatgtgtggtgtaggaggacagatgagcttgtagatgggccaaacgccaactacattacaccaacagctttggaccggtgggagaagagacttgaggatctgttcacgggacgtccttacgacatgcttgatgccgctctctctgataccatctcaaggttccccatagacattcagccattcagggacatgattgaagggatgaggagtgatcttaggaagacaaggtataacaacttcgacgagctctacatgtactgctactatgttgctggaactgtcgggttaatgagcgtacctgtgatgggcatcgcaaccgagtctaaagcaacaactgaaagcgtatacagtgctgccttggctctgggaattgcgaaccaactcacgaacatactccgggatgttggagaggatgctagaagaggaaggatatatttaccacaagatgagcttgcacaggcagggctctctgatgaggacatcttcaaaggggtcgtcacgaaccggtggagaaacttcatgaagaggcagatcaagagggccaggatgttttttgaggaggcagagagaggggtaaatgagctctcacaggctagcagatggccagtatgggcttccctgttgttgtacaggcagatcctggatgagatcgaagccaacgactacaacaacttcacgaagagggcgtatgttggtaaagggaagaagttgctagcacttcctgtggcatatggaaaatcgctactgctcccatgttcattgagaaatggccagacctagccaccagagaagctgcaatgcaaggttcaggttaggctagatagaaagttaaatggggcaacatcaggaggccttgatgaaaaacagacaacctggtgaattgttgttgggatcaggcacagaacagataagagccgcgcagccaacctagatggatacggaacattcgcctcttattcggagcaatatatgtctctcaaggaaagagcccaacatgtatactgccttctttttctcatcccagatttgggggaaaaacaatgtaaatgccaatggtatcgtaggaagattactagaagtaaatgccaatgtaaaaacagatgagttggcatttacatgataggatggtgggatcatcagactgaaaatgataggggattgtgctcccctgcgactccaactattaaacaaggaatccgtcagcagcagaaaaaaaaaaaaaa

SEQ ID NO: 22559 - DNA, 1843 bp, Zea mays
  misc_feature (822)..(822): n is a, c, g, or t
  misc_feature (839)..(839): n is a, c, g, or t
  misc_feature (932)..(932): n is a, c, g, or t
  misc_feature (1774)..(1774): n is a, c, g, or t
  misc_feature (1795)..(1797): n is a, c, g, or t
  misc_feature (1809)..(1812): n is a, c, g, or t
  misc_feature (1826)..(1826): n is a, c, g, or t
  misc_feature (1829)..(1829): n is a, c, g, or t
gcacgagaccattacctagaacatcctaatcgaaaaggccatctctagagtcgcccggctacctgccgcgccgcaaacccgagccactcgcctgccgcgctgattagatttctttgcatccgccagtggagtcgaatcgatggcggcgtggtcgtcgccgccgtcgcttcgccacctcctcatgctccgtccatgcttgcccctcagccccacctgccttgctggctccttgcgccgccacatccacagccgctgccgcctcttctcctccgccgcatcctcctcgacactgacccacggcgacatcgcctcgacgcacggtgacgccgatggcgtcgtcgaagtcaaccctccgcgcggaactagggatttcccgccggaggacatgcggctccgcacctggctcttcgaccaattcagggaggtctcccgcctcatggccttcgaggaggtcgatttccccgtcctcgagtcggaggctctcttcatccggaaggcaggggaggaaattacgcagcagctctacaacttcgaggacaaagggggtcgccgtgttgttctcaggcccgaaattaccccttccctcgcgcgcctagtcataaagcaaggaaaatcagtctcccttccactgaaatggtttactataggacaatgctggcgatatgagcgcatgaccagaggaagaaggcgggaacattaccaatggaatatggatatatttggtgtgcctaaagttcgggctgaggctgagcttcttcatgctattgttctcttatttcaacgtcttggaattacatcttcagatgtggggatcagggtgtncagtcggaaggttcttnaggctgttttgaacatgtactccatcccagagcacttattcactcaagtttgtgttattgttgataaattgggtaaaatgactagggaagaanatcgagaaggaacttgtttcaactgggttgtcatctgaagctgtacagggtatcatcgatgtgctttcaatcaagtcattgtccaaacttgaagaggtgttaggctctgatgttgaagctgttgctgacttgaagaaactcttctccttcgcggagcaatatggttatgctgattggatttgttttgatgcatcagtggtccgtggccttgcatactacacaggaattgtatttgaggcatttgatagagaaggaaaactgagagcaatttgcggtggtggaaggtatgatagattgctttcaacatttggaagtgaagatataccggcttgtggctttggatttggagatgctgttatagtggaactgctgaaagaaaagggtctcttgcctgatatgtcacgccaaattgatgacatcgtcttccctttggacgaagaacttgaaggaccagcatccagtattgcttcctctctgaggaagaaaggccgatctgttgaccttgtagaagacaaacgtctcaaatgggtatttaagcatgcggagaggatcaatgcgagccggctgatattggttggaaattctgagtgggagcgaggcatggtacgggtaaaggtgctatcaaccagggaagagtttgaggtaaagacaagtgaactagagtgattgtagaaatgttacgttatgctagcctcggctaatgcttgtgagatgatacaatcaaacagtagctagctatttctggagagtttaaacttattgtaacagtctgtaacaactattcatattcatacagaatggatgggcatgatccttgccagctagtatgctcaaaaaaaaanaaaaaaaaaaaaaaaaaaaannnaaaaaaaaaaannnntaaaaaaaaaaaanttnaaaaaaaaaaaaaa

SEQ ID NO: 22560 - DNA, 3651 bp, Zea mays
  misc_feature (3061)..(3061): n is a, c, g, or t
tgggaccctcgaggccggccgggccgggttccccagacccctccggtttctctctctaccgggtcgaagcccctctcctctctccccgcctcgtcctctcccctacaggatctagggtttgcttcgctcggccttcgtccttcttgggccgagccctaattcttctgccccgccaccaagcaagccgagcccccggtttggttcgcctccgctgcgccccgcttcctccccggattcttggattctattggcttctatcttcagcatgggtgagccaaacagcaatgataatgcaatggtgcatgacaatgagatgatcgatggcaatggggtgatccatggtagcgagatgattcatggtagtgtgatgatacatggagatgagatgccccatggcaatgagatgatccatggaaatgagatgatccatgggactgagatggttgaaggcagtgagatgatccatggtcatgagatggttcaggttaatgatctcatccacggtaatgagatggttgccgttaacgtcatggttaatggtgatgagatgccccatgttaatgaattcatcaatactgaggtgaccccgcggagacgtcggaagaagaagtcgcttgtttgggagcacttcactatagaacccatgccaggggggaactcaagagcatgttgcaatttatgcaagcaaacctttgcgtatagttctggctcaaaaatcgcaggcacgagccatctgaagagacacatcacgctaggctcctgtcctgttatgaaagatcaagaccgcaggctaacactgcccctagcagggggccatgccactgataatgatggtgagggtacagtagagcgtcctactaagaggcgttacagatacactggttatgcaaatgctacttttgatcaggaacggagctcctcttatttggcgaagatgataattttgcatgactacccacttcacattgttcagcagtcatcctttacgaagtttatcgagagtctgcagcctcgtttcagggttgtagatgtggagacaatggaaggagaggtgtatgctgttttccagaaagcaaaagaaaacctgttacaagcattcagcactatgccaggaaggatcagcctcactataggactctggacaaccagtcagactcttggctatgtttctcttgctgggcagtttattgactccgattggaaagtgcaccgaagaatgctcaacttcatgatggtgtcttctcctcattcagagaatgcacttagtgaagctattagctcgagccttttggagtggaatatgaaggacaggctattcactatcacattggataatgattgctcttcccatgatatttacagtgcaaatcttagggatcacctgtccaataagaacaacctcatgcttaagggacagctgtttgttgtgaggtgttatgcacatatcctcaatgtagttgctcaggatgtaattgcttcaattcatggtgtgatttacaacatccgtgagagtatcaagttcataaaagcttctccaaatcgtgaggagaagtttgctgagattgctctgcagctggagattcccagtaccaagactctctgtttagatgttacaacccagtggaacacaacttatttgatgctgctggctgccttggactataagcaggcgttttctacactggagacatgtgatgataattacaatgaatctccttcagcagaggactggaagaaagttgaggctacctgtaattacctgaaactgctatatgactctgcacatagtgtcatggcttcagcaaatcctactgcaaacatctttttccatgaagcttggaaaattcagcttgagctagccaatggcacagaacatgaaaatcccatcttcagcagtattgccaaggatatgcatgagagatttgacaaatactggaaagattgcagcctggtattagccattgctgttgtcatggatccacgtttcaagatgaagcttgttgagttcagttactctaaaatttatggtgctgaggctatgaaatatgttaaggttgtcaatgactctctgcatgagctgtataaggagtatgtggcacaaccactccccttgactcctgcttatgttgaagctaataatgtggctgctaacgcaagtgtgaaccagggaaatccttcttccactggtgatggtcttcttgattttgatatgtacctttctgagattcaaagtacccagcctgcagcgtgggcgcggccgcggtacttggaggaatccctcactccacgtatccaagagtttgatatccttaattggtggaagcttaacacactcaagtttccaaccctgtcgaagatggcccgggatatcttggccatcccaatgtcgatggttagcagtggcagctccatattctctgctggaactgggaaccgcatgctcgatgactacagaagctctcttcgtccggagactgtggaggcacttgtctgtgcaaaagactggctccagtattcaccgcctgcaactgaggtgctaggttctgagatgatcaaggcagaagcattgtagcttgccgatactgcttccatgatgaagcacaaataagattgtgttattttttagtgtagttaaccgtaggcatattttaggcagcaattgcagacatatatctcttctggcattgatcttatagttgtaatttgtcatgtcgaactcagtttaactcattatagtgtgtattgagtttagctgtggtctgagggatgtctaagggattgaggtggtaaacttatttccagattctgtctattgttggctcgggcattcaggtgatacacttatttccagattttggttattgttggtgctgctgtttatttcccttcctttaggtcataacctctgttttgtgccatggattggtatctatttacacttttttttgattgagacaaagtgcacacttcagagcagaaaattacaaaaatatatatgtatatatatatatatatatagttatagtatttagagccctgggctctctctagttagagaaanccctaatcatttaagaccaggtaaaccagacgtaccaaaaaaaaaacttttataattagttatacaagcatttcttttgtattcgttttagaaaaaacgcagaaattgatttatcccacacccgcgcccagctatcggatccgccccactgcgcccccaaatcatcccaagcgctccaaccactcgcaaccctaatctaattcgccgtcttccggatcggcatccgccctcatcccctcaccctcttctccgccttccagccgcaggagccccacatcccctcacactcttctccgccttccagccgcaggaagctcgccgctgattgaggatctcgcggctgccgaagaggccacaacgggaaagcaaatccacgcgcccgagcggcccttcaaggaacctgctcgtctcccggcggccggaatggtcttcatctcgtcgtctacgcgcaagaggagatctggatctggttcgtttgctttcatgcatcctgacgcctcctccctcccctccctgagtcgaatcgcaaaccgaccgctcctacagtgtcccacatccggtccagtaaatccacctttctatacccaggg

SEQ ID NO: 22561 - DNA, 1437 bp, Zea mays
  misc_feature (1369)..(1369): n is a, c, g, or t
cgaccccgcgtccgttcagttcatggtgttgtatacagcattcttgaattcataaagttcataaaagcttcttgggccggtgaagagaagttgctgagattgctctgcagctggagattcccagtaccaagaccctctgtctggatgttacaacccagtggaacaccacctatctgatgctgctggctgctttggattataagcagactttcactacactagaaacatgtgatgataactacaatgaagctccatcagcagaggattggaagaaagttgaggctgcctgtaattacctgaaactgctatacgattctgcacatagtatcatggcggcagcaaacccaactgcaaacatctttttccatgaagcctggaaacttcagctagagctggcaaatggcacaggccacgaagatcccactttcagtagcatcgccaaggatatgcatgagaggttcgacaagtactggaaagattgcagcctcgtgttagccattgctgttgtcatggatccacgtttcaagatgaagcttgttgagttcagttactctaaaatctatggtgctggggctataaagtatgttaaggtggtcgatgatgctctgcatgagctgtataaggattatgtggcacaaccaccccccacgcgtccgcggacgcgtgggagctaataatgtggctgctaacgcaagtgtgaaccagggaaatccttcttccactggtgatggtcttcttgactttgatatgtacctttctgagattcaaagtacccagcctgcaaaatgtgatctggagcagtacttggaggaatccctcactccacgtatacaagagtttgatatccttaattggtggaagcttaacacactcaagtttccaaccctgtcgaagatggcccgggatatcttggccatcccaatgtcgatggttagcagtggcagctccatattctctgctggaactgggaaccgcatgctcgatgactacagaagctctcttcgtccggagactgtggaggcacttgtctgtgcaaaagactggctccagtattcaccgcctgcgactgaggtgctaggttctgagatgatcaaggcagaagcattgtagcttgccgatactgcttccatgatgaagcacaaataagattgtgttattttttagtgtagttaaccgtaggcatattttaggcagcaattgcagacatatatctcttctggcatcaatcttatagttgtaatttgtcatgtcgaactcagtttaactcatagtgtgtattgagtttagctgtggtctgagggatgtctaagggattgaggtggtaaacttatttccagattctggctattgttggctcaggcattcaggntgatacacttatttccagattttggttattgttggtgctgctgtttaaaaaaaaaaaaaaaaaaaaaa

SEQ ID NO: 22562 - DNA, 840 bp, Zea mays
gcgggggcacgagggcccacgcgtccggtaaactgaagccaactgccaacccaacgaaggccagaactgcgcgcgcggaacctgttcgacgaattggcgcactggctatggcgctgctacgcgccgcgctagcccagccgttatcgccgcgccccgcgctcccggtccgccaccctccgacctcgctgacaggctccaggtttatcctcgacttctcgcttccgccacatccaggccccggcgcgccccggcgcgagtaccccaggatcgaggcgacggcgaggcgaggcgcgcgaactgagagcgccaaggtcaggaaccgtcggctgcagaagaagttcaacggcacggcgacgaagcccagactctcggtgttctgctccaaccggcagctctacgctgtgctcgccgacgaccacaacaagaagatcctcttctatggcagcacgctgcagaagtccatctgcggcgacccgccctgtggcaccgtggaggctgcccggaaggtcggggaggagctcgtcagggtgtgcaacgagttgggcatctccgaggtctcctacgaccgcaacggctttgctcgaggcgacaagatgatggcgttcgaggttccggtctcacagcacgggttcctgccaagataggctgcaactgtagtgtcgcccccagaaaggaggcaccagggcttgcattgacagttctcaggagacagggaagttggtcccattccatgcggattctggattctgtatatgatccatcagtccttgatcaacaggcagttcatatttcagtctaacaaggacagtttctccgtacactaaaaaaaaaaaaaaaaaa

SEQ ID NO: 22563 - DNA, 2778 bp, Zea mays
gcacgaaccattacctagaacatcctaatcgaaaagtcctctcccccacaggatctagggtttgctcgctcggccttcgtccttcttgggccgagccctaattcttctgcaccgccacccagcaggcttcggtttggttcgcatccgctgcgcccgcttcgtccccgtacgtattcttggattccattggcttctatcttcagcatggatgagccaaacaacaattttaatgcaacggtgcatgccaatgagatgtttgatagcaatggtgtgatccatgaagatgagatggcccatgacgatgagatgatccatggccatgcgatgttccttggcgatgagatgattcgtgggaccgagatggttgaaggaagtgagatgatccatggtcatgatatggttcaggttaatgatctcatccacggcaatgagatggttccagttcacgacatggtcaacggtgacaagatagcccatggtaatgaattggttaatgctcagatgaccccacgaatatcaagacgtcggaagaagaagtcgctagtttgggagcacttcactatagaactcatgccagggggaagttcaagagcatgctgcaagttatgcaagcaaacctttgcgtatagttctggctcaaaaattgcaggcactagccatctcaagcggcacatcacactaggctcctgtcctgttatgaaagaccaagacaggaagctagcattgccacttgcagggggccatgtcactgataatgatggcgagggtactgcagaacgtcctactaagaggcgttacagatacactggttatgcaaatgctacttttgatccacagcggagcacctcttatctgacaaagatgataattttgcatgactacccacttcacattgctcaacagtcatcctttattaattttattgagagtctgcagcctcgtttcagagttgtagatgtggagacaatggaaggagaggtgtatgctgttttccagaaagcaaaagaaaacctgttgcaagcattcagcactatgccaggaaggatcagcctcactataggactctggacaaccagtcagactcttggctatgtttctcttgctgggcagtttattgactccgattggaaagtgcaccgaagaatgctcaacttcatgatggtgtcttctccccattcagagaatgcacttagtgaagctattagctcaagcctttctgagtggaatatgaaggacaagctgttcactatcacattggataatgattgctcttcccatgatatttacagtgcaaatcttagggatcacctctccaataagaacaacgtcatgcttaagggacagctctttgttgtgaggtgctatgcacatatcctgaatgtagttgctcaagatgtaattgcttcgattcatggtgtgatttacagcatccgtgagagtatcaagttcataaaagcttctccaagtcgtgaggagaagtttgctgagattgctctgcagctggagattcccagtaccaagactctttgtttagatgttacaacccagtggaacacaacttatctgatgctactggctgccttggactataagcaggcttttgctacactggagacatgtgatgataattacaatgaatctccttcagcagaggactggaagaaagttgaggctagctgtaattacctgaaactgctatatgactctgcacatagtgtgatggcttcagcgaaccctactgcaaacatctttttccatgaagcttggaaaattcagcttgaactagccaatggcacagaacatggaagtccctttttcagctgtattgccaaggatatgcatgagagatttgacaaatactggaaagattgcagcctggtgttagccattgctgttgttatggatccacgtttcaagatgaagcttgtcgagttcagttactctaaaatttatggtgctgaggctgcaaaatatgttaaggttgtcaatgactctctgcatgagctgtataaggagtatgtggcacagacactccccttggctcctgcctatgttgaagctaataacgtggctgccaacacgaatgttaaccagggaaatcctcctccaactagtgatggtcttcttgactttgatatgtacctttctgagattcaaagtagccagcctgcaaaatgtgaactggagcagtatctggaggaatctctcactccacgcatccaggagtttgatattcttaactggtggaagcttaatacactcaagtttccaaccctgtcgaagatggcccgtgatatcttggcaatcccaatgtcgatggttagcagtggcagctccatattctctgctggaactgggaaccgcatgcttgatgattacagaagctctctccggccggagactgtggaggcacttgtatgcgcaaaagactggctccagtattcaccggccgcaactgaggcgccaggttctgagatgatgaaggcagaagcattgtagattgccgatactgcttccctgttgaagcacaaataaggttgcagtatctttgagcatagttaacagtaggtatattttagacagcagttgcagacatatatttcttctggcatttatctcatagtggtctaatttgtcatgtcgaacaaagtttaactcattgtagtgtgtgctgagtttatctgtggtctgacccggcacacatggtgtgggtgcaaactgcaaactgcgggattttttagggattcaggttgttgagcaccaaaaaaaaaaaaaaaa

SEQ ID NO: 22564 - DNA, 2082 bp, Zea mays
cactgtcataatccatgaaacagagtaaaaagtaaccaacagaagtactgcagattacattcgaaattaatgttaaacctgtgcggagatctcctcagctgcgaactgcttgccaatcgccgggcaatcgagcttgacgttgccgttgtcgtccctgatgacgagatacgagacctgcttggactcctcgtcgacctcgttcatcttgcggccgatgaagcgcttgacggagaagaaggtgttctccgggttgaccacggcctggcgcttggcgatctggccaacgaggcggtcgccggacttggtgtacgccaccaccgagggcgtggtccgcgccccctctgcgttggtaacaatcgtgggcttgccgccctccatagcggccaccgcggagttggtggtgcccaggtcgatgcctaccaccttctcgcacgccacccgcagcgggcgccatcggcggccgcgggcgtagaccgcggcggagatggagggtcggctccggcggggaccgtggtgggccgcgaagaatggggtcgaggtggggaaggtcgtggtcgccatgggccgacggcggtgcggtgagaggtcgactgaccaagtaggaagggagaggaatgaacaagggtggattggagtgtgtgggcgatgggattttcgtttggttttgggggctgttcaggctgggaaatggcgtgaggttgaggaagagataagggagaggaggattttatatggctcgctagtggggagcccgtgaacgtgaagctgtggctggagcatcgcatctcgaaggttgtatgaggttctggaagcggcgggacgggggcgctcgcaggatgttgaggacagaagaatcagaaacgggctgactgggttgtctgttccatacgagtacaggagggactgggtccatatctctatacacagtgacacagacgtgatgtgctctatatactctgtcaaatttgtgtcttgacgatcagagcagagggcttgagaactgtaaccttgtagtgtcaggagcactgtagcagttctcaccattcagtttcattttaatttatagaaaagtaacggcattctgttcatctaaaatgattatgttcatactctacaactcagggaagatagacccagacaatcagcatttgtccacaagcgagctctgttttagccaaagtatcctgtcagggcatgttcggtttcatcaaaattctcttttggattcatattgattggatgagtttcaatccataccaagtcaaaatctttcatattttcttttccaatccatgatgtataggaacaaccgaacaaggacttacatggttcaagatattgttcagcagcacccataagaaaattcagtcacgaaactaatggaccgccaagcagcttcggaggtaaacatgaggccccaacataacctctcataaaacagtcagttttccctacagcaatttcacaccaacacctcttagagaatctatcacggccttgaccttgccatggtacttctggtctcttgacatggagacagatactgcagggatacccttgaacagcaagcgctctccaagcaacttcccaatctttgcagccgcagcaacatcccgtgtcgactccatgcttggcctcaggagtttctcctgagagcttgcagagcatgcgaccgtggctgtcggtgtgtggatgacctgagcgctcacaaaactgtttgtgaaatgcatcttcaaaatatacggcttgaggaacttggtgattgcaggagccctagctggtggagggataaccatattgcctaatcaagctgaccctgaacaagcccagaaataagacaaaataattaatcaataacgctgacatagcatgcaaaaacttaaacatggacaaggataatcttgtgaaatagaaatccaggaccggatgcaaatatcatatggtgatatagcatgaagggactgaaaggtgaagagataattgtattatagtgtagtgtcttcacagggttacaaagcctaaccccgatggtcctcttgggctgagctctatgcccaagtcaacccaaatcacataacaatc

SEQ ID NO: 22565 - DNA, 1024 bp, Zea mays
  misc_feature (987)..(987): n is a, c, g, or t
caatccactccaagtcaaaatctttcatattttcttttccaatccatgatgtataggaacaaccgaacaaggacttacatggttcaagatattgttcagcagcacccataagaaaattcagtcacgaaactaatggaccgccaagcagcttcggaggtaaacatgaggccccaacataacctctcataaaacagtcagttttccctacagcaatttcacaccaacacctcttagagaatctatcacggccttgaccttgccatggtacttctggtctcttgacatggagacagatactgcagggatacccttgaacagcaagcgctctccaagcaacttcccaatctttgcagccgcagcaacatcccgtgtcgactccatgcttggcctcaggagtttctcctgagagcttgcagagcatgcgaccgtggctgtcggtgtgtggatgacctgagcgctcacaaaactgtttgtgaaatgcatcttcaaaatatacggcttgaggaacttggtgattgcaggagccctagctggtggagggataaccatattgcctaatcaagctgaccctgaactgtggagtctctgggacgagttctatgtcgtcgctgcacaccggcggcggtccaccgggcgctggagacggcagtctcgatgaaacaattaccgcgaaatctgcagtgcgctcaaccagatctggctttttggcagcgggaggagtggctggagaggtgggtgcatggggcttgggggcttgacggcgtagtattctgggcggatcggcgatgagcatccgcgccgccatcttggatccctagaacgacttcttgtttccacgggagcggtgcttctttccacggggacaaacccacgacgggggcatcgggggaaatcgcctaccgctgcgttaaacccagcgcaggagagagagaaatggggagggagaaacagtgttcgcctcgtgccggcagtcgccgtgtccgaganaaatcgcgagggcggctcgagccgaattccgagctta

SEQ ID NO: 22566 - DNA, 1435 bp, Zea mays
gtctagagcgctcgtccggtctgaactgtggtctctgtacttccgttcacttcttcagcggcggcgtgacaacgagagcaagaaagtatcaaaacccgagagcaatggaggcggtggggaagagcgtgtgcgtgaccggcgcgggcggcttcatcgcgtcgtggctggtgaagctcctcctctgccggggccaatacaaggtccgcggcaccgtgcgcgaccctggtgctagcaagaatgctcatctcaaggtgctggaaggagctggggaaaggttgcagcttgtcaaggctgatttgttggactacagcagtgttgcttcagcaattgccggctgtgagggtgtcttccatgtagctagccctgtcccttccggtcggtcctccaaccctgaggtggaggtcataggtcctgctgtaacaggtacaatcaatgtgttaaaggcttgctatgaggcaaaagttgggcgagttgtggtggtctcttcatgtgcagctgtctatgctaatcctaattatccaaagggtaaggtctttgacgaagactgctggtcagatgaagcttactgcaggaagaacgaggattggtattttgtttccaagacactggcggaacgagaggcttttgtttatgcagcaaaaacagggctggatgttgtaactatttgcccgtcgttagtatttggacccttgatgcagcctacagtaaattcgagcagcaaaatcatccttaaatatttcacaggagatcgcgagactgttgaaaacatactcagaaatatggtggatgttcgtgatgttgctgacgctcttcttctggcttacgaaaagccagaagcgtctggacgatacatctgcagttcacatgcaataaaagttgctgatatgataaacatactgaagaccttgtatccatcttacccttatcccaaaaattttgtggaagatgatgtcaactctgtatacagctctgagaaactgcagaagctggggtggagcttcaagcctatagaggaatccctccgcgacactgttgaatcctacaaagcatttggcatcctgaattgaacatccagctacgactgttccatctgctgtttttgcctccgaactctttctgaataataatgtatgtaggcagtgaaacagcattgccagcaggttaatcctggcatcatgctggagcagcactgtagttctctctttttttttcatccccaatactatctagtggttcaggaccaaataagtaggccccgtgctgactggtttatggcttgtggcctattgtcgctgctaaaactagaagcgttcgtactatcttgcactgctgcacttgatttctcatcaaaaaaaaaaaaaaaaatttggcgttattccaaaaccggtccaactcccaaaggggggggcccccggaaacccaaattccccccctt

SEQ ID NO: 22567 - DNA, 1466 bp, Zea mays
aattctgtagaactcgacaagaactggtgccatcacgtgggttatgctccccccacgcgtccgcccgagcgaacgtctagatcgctcgtccggtgtggtctctggacttgcttgccgttcacttctcttcagcggcagcgtggcaaggcaacgagagcaacgaagagtattcaaaccgaaaacaatggagccggtgcggaagagcgtgtgcgtgaccggcgctggcggcttcgtcgcgtcggagctggtgaagctcctcctctcccggggccaatacgcggtccgcggcaccgtgcgcgaccctggtgctagcaagaatgcccatctcaaggtgctggaaggagctgaggaaaggttgcagcttctcaaggctgatctgatggactacaacagcattgcatcagcagttgccggctgtgagggtgtcttccatgtagccagtcctgtcctttcccatcgaccctccaaccctgaggtggaggtcatagctcccgctgtaataggtacaaccaatgtgttaaaggcttgctatgaggcaaaagttaggcgagttgtggtggtgtcttcatgtggagctgtgtatgctaatcctatttatccgaagggtaaggtgtttgatgaagactgctggtcagatgaggattactgcaggaagaaggaggattggtatttagtttccaaaacactgtcggaacgagaagctcttgcttttgcagcaaaaacagggctggacgttgtaactgtttgtccgtcattagtatttggacccttgatgcagcctacagtaaatttgagcagcgaaatgatccttaaatatttcaaagatctcgagactgttgaaaatgtactcagtaatatggtggatattcgtgatgttgctgatgctcttcttctgacttacgaaaagccagaagcgtctggacgatacatctgcagttcacatgcaataaaaatttctgatatgataaacatactgaagaccatgtatccgtcttacccttatcccaaaaattttgtggaagatgatgtcaactctgtatacagctctgagaaactgcagaagctggggtggaccttcaagcctatagaggaatccctccgtgacactgttgaatcctacaaggcatttggcatcctgaattgaacatccaactaggactgtttccatctgctgttgcctccgaactcctcctgaataatgtaggcgcagttaaacagcagcagcactgccgatctctttatttttcaatattgttatctagtggttcaggaccaaataagtaggccaggtgctgactgttgtatggtttgtggcctattgtcgttgctaaaaactagaaatgcgcgtactaatgttgcattgctgcacttgatttgtttgtcgtcaaaaaaaaaaaatatgattcgtgctgtcgaaagatgcagcatatgattgtctgtcacggagatcgacagccagttggggt

SEQ ID NO: 22568 - DNA, 1400 bp, Zea mays
tcacgtgggttatgctcccgctgtagcaataattgaagaaacgtctagatcgctcgtccggtgtggtctctggacttgcttgccgttcacttctcttcagcggcagcgtggcaaggcaacgagagcaacgaagagtattcaaaccgaaaacaatggatccggtgcggaagagcgtgtgcgtgaccggcgctggcggcttcgtcgcgtcggagctggtgaagctcctcctctcccggggccaatacgcggtccgcggcaccgtgcgcgaccctggtgctagcaagaatgcccatctcaaggtgctggaaggagctgaggaaaggttgcagcttctcaaggctgatctgatggactacgacagcattgcatcagcagttgccggctgtgagggtgtcttccatgtagctagccctgtcctttcccatcgaccctccaaccctgaggtggaggtcatagctcccgctgtaataggtacaaccaatgtgttaaaggcttgctatgaggcaaaagttaggcgagttgtggtggtgtcttcatgtggagctgtgtatgctaatcctatttatccgaagggtaaggtgtttgatgaagactgctggtcagatgaggattactgcaggaagaaggaggattggtatttagtttccaaaacactgtcggaacgagaggctcttgcttttgcagcaaaaacagggctggacgttgtaactgtttgtccgtcattagtatttggacccttgatgcagcctacagtaaatttgagcagcgaaatgatccttaaatatttcaaagatctcgagactgttgaaaatgtactcagtaatatggtggatattcgtgatgttgctgatgctcttcttctgacttacgaaaagccagaagcgtctggacgatacatctgcagttcacatgcaataaaaatttctgatatgataaacatactgaagaccatgtatccgtcttacccttatcccaaaaattttgtggaagatgatgtcaactctgtatacagctctgagaaactgcagaagctggggtggagcttcaagcctatagaggaatccctccgtgacactgttgaatcctacaaggcatttggcatcctgaattgaacatcgaactaggattgtttccatctgctgttgcctccgaactcctcctgaataatgtaggcgcagtgacagcagcactgccgttctctttatttttcaacactattatgtagtggttcaggccaaataagtaggcccggtgctgactgttgtatggtttgtggcctattgtcgttgctaaaaactagaaatatgcgtactaatgttgcattgctgcacttgatttgcttgtcgtcattctgatgcaaaaaaaaaaaaaaaattaaaaaaaaaaaaaaaaaaccgatt

SEQ ID NO: 22569 - DNA, 1324 bp, Zea mays
gctgtagcaataattgaagaaacgtccggatcgctcgtccggtgtggtctctggacgacttgccattcacttcttcagcggcagcgtggcaacgagagcaacgaagtattcaaaccgaaaacaatggagccggtgcggaagagcgtgtgcgtgaccggcgctggcggcttcgtcgcgtcggagctggtgaagctcctcctctcccggggccaatacgcggtccgcggcaccgtgcgcgaccctggtgctagcaagaatgcccatctcaaggtgctggaaggagctgaggaaaggttgcagcttctcaaggctgatctgatggactacaacagcattgcatcagcagttgccggctgtgagggtgtcttccatgtagccagtcctgtcctttcccatcgaccctccaaccctgaggtggaggtcatagctcccgctgtaataggtacaaccaatgtgttaaaggcttgctatgaggcaaaagttaggcgagttgtggtggtgtcttcatgtggagctgtgtatgctaatcctatttatccgaagggtaaggtgtttgatgaagactgctggtcagatgaggattactgcaggaagaaggaggattggtatttagtttccaaaacactgtcggaacgagaagctcttgcttttgcagcaaaaacagggctggacgttgtaactgtttgtccgtcattagtatttggacccttgatgcagcctacagtaaatttgagcagcgaaatgatccttaaatatttcaaagatctcgagactgttgaaaatgtactcagtaatatggtggatattcgtgatgttgctgatgctcttcttctgacttacgaaaagccagaagcgtctggacgatacatctgcagttcacatgcaataaaaatttctgatatgataaacatactgaagaccatgtatccgtcttacccttatcccaaaaattttgtggaagatgatgtcaactctgtatacagctctgagaaattgcagaagctggggtggagcttcaagcctatagaggaatccctccgtgacactgttgaatcctacaaagcatttggcatcctgaattgaacatccagctacgactgttccatctgctgtttttgcctccgaacttctcctgaataatgtaggcgcagtgaaacagcagcagtgccgttctctttatttttcaacattattatgtagtggttcaagaccaaataagtaggccaggtgctgactgttgtatggtttgtggcctattgtcgttgctaaaaactagaaatgtgcgtactaatgttgcattgctgcaaccggccttgtttgtcgt

SEQ ID NO: 22570 - DNA, 1475 bp, Zea mays
aatcggcgccatagaccatggcgttgaggtatcaacttcattggcatttggatgctgcgctggcgcttacgtggcgtgacctcggcatcatagatcatggcgccgaggtatcaacctcgctcgtatagctgtccattcgtgctcagctgcataggaaagcagcaatgatagcccggctttcgctgcatcagcagcctcctaggcaatggacaacatcatgacgtcttctggacgtgcaacgcgaggcaataagagaagtatttatttgatcgtctaaatcagaaaagcgcattaaaagtatttatttgtttttgtgtcgattcgctttctaccgtcaagtatttattttctggatcggaaaagtatttatgtgattttttagaaataatagaactatttattttaggacgtcaagagtattcaaataactttaaaaagagccctatagtagtattgtagcacccaacgtagatggtagtgtgtagcccttacaggacctagagctagctactcgatttaaagtgagtagctaatacataagcatgtatttccttcaaaaaagctcagagaactgaaagagtgaggcagaggaattgcagagaacatgatgtgtgtacttgtgcgtttgtgtatgcgtgcttggagccatgcaaattaacgcaatctgccctctgcctcgcgtcgcacgtctagaagacgtcatgttgttgtccattgtctaggggctgctgttgcacgccatcgcctatgtaaatgtcacaaacagcgaaagccgatcattattgctgctttcccatgcagctgaacatgaacgaacaactatgcgagcgaggttgatacctcggcgccatgatctatggcgccgaggtcacgccactttagggccaacacaacaaccagatgccaacgagattgatacctcggcgccatgttctatggcaccgatcagtgttacctcggcgccgtaggtcatggcgtcgagcaaagggtccaaaacgagaatgtcttttagaggtctaaacgtgattttttcgtataaggggctaaaattcaaaaaattcggacatatcgacaaccagctatgatggctggtagacgtgaaacatgaccgtgtggtgtaacatatggatggactgaattgttgaaccttgtatggaacatatgttgtggtcctactttggtatatgcaaatatgtatgatatcggttgtgttccgtgtttgtgagaatagacaaacataacaccgttgcgcgtgtgtcgcaagaggttcctgaataggagggcgcacaaagcgcgcctcctgttctagtaataataatatagagagatatgtgacctatgtcatatcattcactttatttttctagaaaatatagaagaaaggaaaagtttatatttcaagcctccaagggcttcacatctggatacacaggtattagtcgaccagacaaatatcattatcatatatggttcag

SEQ ID NO: 22571 - DNA, 1387 bp, Zea mays
cctggccgggggaggaacatcgcccccccttcctggatcatcctctcagtccttgcttgtcctcccatcccggagatcgacggctgcttgccgcactcgctccagcggccagccggccacaggcaactatggccgcctctgccgccgccgcggggcctgctacctttctcccgcgcctcccctcgccacggtctccgtctcctatgctccctcctctcggacggagagcccatcccgtcgccgctccgctctgtctctccgccaagcgccgcgcctgcgccgccatgggctccagctcctcctccaactcaggaaatcaaacgtcactgatgctgccgttcagctttacattcgatgaagattcttctagttccagaaggctatatagatggaaaagggtattgctcaaagtaagtggggaagctcttgccgggaatcacacagaaaacatcgacccaaagattacaatggctattgcaagagaagttgcttctgtcaccaaactaggtgtagaggttgctattgttgttggcggtggcaatatcttccgtggggcctcttgggctggatgtagtgggcttgaccgctcatctgcggattacatcggcatgctggccactgtgatgaatgctatatttcttcaagcgacgatggagagcatcggaataccgacccgtgtccagactgccttccgtatgtcagaagttgcagaaccatacatacgccgaagagctgtcagacatttagagaaaggaagagttgtcatatttgctgctggaacagggaacccattcttcacgactgatacagctgctgctctccgttgtgccgaaatcaatgcagaggtagtgctgaaagcaacaaatgttgatggtgtgtatgatgcggaccccaggcagaatccaaatgcccgccttctggagactgtgagctatcatgaagttacgacaagagatctctcagtaatggatatgactgctattacactatgccaagaaaacaacattcccattgtcgtgtttaacttgcaagagcctggaaacattgcaaaggctattgtcggtgagaaggttggtaccttcatcggatgcacaagagatcaggagctaaatggaaacacactggttcaagaaagaagattggttaatgaggcgtgatctccagagatgcaagagttgggggggctccctcttctcttattcagtttttatatatacatatgaggtttagggttgggggctggtgctggaattagattagattagctatcaaaatcctgataatagttgtaaccgtgaaataagacacttggacgaaattaaaattttcctgcaaagtgctattgttctgtgcaactaaaaaaaaaaaaaaaaaaaaaaaagcggcc

SEQ ID NO: 22572 - DNA, 2856 bp, Zea mays
  misc_feature (464)..(464): n is a, c, g, or t
  misc_feature (2146)..(2146): n is a, c, g, or t
  misc_feature (2583)..(2583): n is a, c, g, or t
ctcgccgtcggccgctgcagccgtccctgaggtccccgtcgtgggtggacctcccgacattcaagactcgaggcatggaggggggagggggctggaagcctagaatcacgaggatggaaggagcatcgacgttggggcgaggttgggcgcgtcggcgtgcaatcgatgttggaaaataacgtgtgtggcgaggaaggaaagagcgcacaatgttgttagagacgatggcttgggagggggcatggaaggaaggcgcgcacatggttagagtcagacggggttcgagtggggcatggaaggacctgtgtggaccaaccgtgtggacgcgaccgatagggggcgcgcggggggagggagggtatgaacgctaacgctaaacttttaatatagtagtatagatatagatggggttacagttaggtatcagtagctcaaaatggataggtacattcttaagaggcgtncgggtatgaatctctagattgaccctgttttcgtcacttcttttccctccacgtgtcccatatctattttaaatacagggttataagaaaaacaagtcacttcatcaaataccataatctaaacatttaatataaacaaataacataaactagaaaacaacaaaataaaatttatggataacaaccaggtttaatctacatttgaatctaaacataaaacctatcattataacttaatcataaaacatatgcatcgacatgtcgcatacaaatcaagagcagaaactaaatatgcgtttgtaaatgtaaataacctatatagataacttactagggatgcaaaatacaactaacatagactaaatcaatgcatataaattgagaaggagagggagatacctgctctcgaatatctaaaaaaatgttcaaacttccaatatggaatcaatagaccaataaatgttggaaggattggggatagtaagatagaaagagagagaaaaaaatggaggatgggcgtggacaggcgtaggacagggaaaagaagtatctagataggtgttggacctcagtactaagatttgtggcaacgatcttaccaccataggttatggcatcaaagttggagtagaagctataggtcatgccgccaccgactctagggtcaaaaaatgattttaattactataaatctaaacgtgaaattttaataaaaatggaactacaatttaaaagggcgcgcgtgtatgtgtggctcgacatgggccggcctacgccgtatcatattttgaatgtgaaaatcaggcccacaaaacggcactcgagcacactaattcaccgagtggcttcgacaaaatagcctaccagtgtcgtcccagccgccgtcccgtcccgtccgccgtcaaacgtcatccgaatccgcgccgcgaccagcgaagaaggtaggaagcatccggaacggagacgcgcctcctgcctcgccttcctcccatggcgccgcccctcgccgccgtctcatcgtcgtcgcccctattctctccttcatcgtcccgccccatccgccgctgccacgcacctcctccttctatctccttccagacgcggggacgctcgcccacggcggcggcggcagctgagtcttctgtcagcacgcttctcgaggtgcgcggactcaccgcatccgtgaaggagactgggcagcagatcctcgccggcgtcgacctcaccatccgcgagggcgaggttcgtgtgggcagctcgtggagtcgtcggctgcaattttattggcggcttgttattcatgcgattatggggaagaacggctcgggatcgactgatgctagttttatgcctgtgtttgactgtcatagattcatgcgattatggggaagaacggctccggcaagagcaccctcacaaaagtaaggaacttctgttggatgcacatattttttcatgttatatttggaaccatatcagtcgattgaaaaataggacaattgtcttcgggcatgaaagaatataacatgtcagtaaggagcttttgttatatttggaaccatattagtaaggagcttttgttcatcctagttttctctatgttagccaccaaccgtaggcctaccctactgctgtattgctattgcagtaaaattttgctttggtaaaaattgctgcactangcaggatgggcttacacgtgtagtaaaacagtactaacaccatcctgttagttcagtaagctagccctgcatacctttctaataaagtttataagcaaggatatggcctaaatacaaattgtaaaagaccgtgctctttggtctttgctctggtacctgctcattaaactgaatttttcacctttgccttgcaggttctcgttggccatcctcattatgaggtaactggtggtaccattctcttcaagggtgaggacctggttgacatggagccagaggacagatctctagcaggccttttcatgagtttccaagcacctattgagattcctggagtcagcaatttcgattttctgctcatggctgtgaatgctcgcagagaaaggagtggtctaccagcattggggccccttgaggtaaacttcacaattatatgngccaagatacactgtcaattttcacaagagataattataattttaaactgttttaatataattattatacaacataatgatctttagtactgatgtatcgtataataggcaggaaagggatgagcgtagccagtagttgttttgttttggttcatttcattattggttccaaatggagctttccttgccatattgacggtagcattatggttctctcttctttatgtttttttgttttcgaatgtctagtaatacataactttgtaagcattt

SEQ ID NO: 22573 - DNA, 1522 bp, Zea mays
actcctatgggcgattgggttcctcgaggccggccgggaccagtgtcgtcccggccgccgtcccgtcccgtccgccgtcaaacgtcatccgaatccgcgccgcgaccagcgaagaaggtaggaagcatccggaacggagacgcgcctcctgcctcgccttcctcccatggcgccgcccctcgccgccgtctcatcgtcgtcgcccctattctctccttcatcgtcccgccccatccgccgctgccacgcacctcctccttctatctccttccagacgcggggacgctcgcccacggcggcggcggcagctgagtcctctgtcagcacgcttctcgaggtgcgcggactcaccgcatccgtgaaggagactgggcagcagatcctcgccggcgtcgacctcaccatccgcgagggcgagattcatgcgattatggggaagaacggctccggcaagagcaccctcacaaaagttctcgttggccatcctcattatgaggtaactggtggtaccattctcttcaagggtgaggacctggttgacatggagccagaggacagatctctagcaggccttttcatgagtttccaagcacctattgagattcctggagtcagcaatttcgattttctgctcatggctgtgaatgctcgcagagaaaggagtggtctaccagcattggggccccttgagttttactcagttgtatcgcccaaagttgatgccttgaagatggacccaaagttccttgatcgcaatgtgaatgaaggttttagcggtggtgaaaggaagcgtaatgagatattgcagctttcagtcattggagcagatttagcccttcttgacgagatagattcagggttagatgttgatgcacttgaagatgttgctaatgcagtgaatgggctgttgacaccccaaaactctgttctgatgattacacattaccaacgtcttttggatctcattaagcccagttacgttcacatcatggaaaatggcaagataatcaagacgggtgacagttctatcgccacacaaattaatgaaggcggcttcaaatctatcgcccttgtatagcgtgaaagcagtaggtcaaataacagaaatggctcgctgggcttgttcaccagccactaagcctacttgccaggacagaatgcctactgcttggggtttgcactgttgcctactgcattcagaggtgtaccacatacgaatttagtaaaaaaaaaatgagttagtgctctgttcgactaggcatgttgtcttgcctcgtcgagggtggggagctggatacaccacctcctctatgtaagaatgtttggatgaaggtattgatacatgtagtcatacatagggatagcatgccgtgcgtgcatacaaggtccaaattttgtatgtttgaattatgacttattctcccaggcttctggctatcaaggctggtgctgcgtgcaacttttgtaacatttttagcacttcaccgatgttcagacctataaagcaattcagttgttctct

SEQ ID NO: 22574 - DNA, 1269 bp, Zea mays
cctcgaggccggccgagatcgttgggcacctcgaggccggccggcgtcccgtccgccgtcaaacgtcatccgaatccgcgccgcgaccagcgaagaaggtaggaagcatccggaacggagacgcgcctcctgcctcgccttcctcccatggcgccgcccctcgccgccgtctcatcgtcgtcgcccctattctctccttcatcatcccgccccatccgccgctgccatgcacctcctccttctatctccttcggccgctcgcccacggcggcggcggcggcagcggcagcggcagctgaatcctctgtcagcactcttctcgaggtgcgcggactcaccgcatccgtgaaggagactgggcagcagatcctcgccggcgtcgacctcaccatccgcgagggcgagattcatgcgattatgggaaagaacggctctggcaagagcaccctcacaaaagttctcgtaggccatcctcattatgaggtaactggtggtaccattctcttcaagggtgaggacctggttgacatggagccagaggacagatctctagcaggccttttcatgagtttccaagcacctattgagattcctggagtcagcaattttgattttctgctcatggctgtgaatgctcgcagagaaaggagtggtctaccagcattggggccccttgagttttactcagttgtatcgcccaaagttgatgccttgaagatggacccaaagttccttgatcgcaatgtgaatgaaggttttagcggtggtgaaaggaagcgtaatgagatattgcagctttcagtcattggagcagatttagcccttcttgacgagatagattcagggttagatgttgatgcacttgaagatgttgctaatgcagtgaatgggctgttgacaccccaaaactctgttctgatgattacgcattaccaacgtcttttggatctcattaagcccagctacgttcccatcatggaaaatggcaagataatcaagacgggtgacagttctatcgccacacaaattaatgaaggcggcttcaaatctatcgcccttgtatagcgtcaaaccaccaggttgtgttttgttccctgcaccttcccctttttcttctgttggaatattcttggttttctggctgaaattgaactatgcacttacatggtggcaataccaatgacgcctcttaataacagaaattcaatgattgaaagatgtatgtttaggttgatgtgtgaagaagtaaatgaggtttttgaggcctgt

SEQ ID NO: 22575 - DNA, 909 bp, Zea mays
tcgaggctcgcattgggtacctcgaggccggccgggaacagcatcagagctcggtgtcacaaaacctgaccgatggcggcccggtgctccacagctgcctccgtggtcagaacaggatcgcgagacctctccccctccttttccttcacagccgcggcgctcccctcggcgcgtctgaggccggtaggagcgtgggtccgcggtggagggtacacctgcaggctccgcgccgtccgcgccatgggctccgcgccgtcgtcgtcccaatccccgtctccgcacacgccttcaggacaaacccaagggaaagcagattataaatcactgagtgaagaggagtggaagaagcgcctgactgaagagcagtattatgttactcggcagaagggcactgaaagagcattcactggggaatactggaatactaaaacgccaggcatttatcagtgtgtctgctgcgacacccctctgtttcagtcatcaaccaaatttgatagtggtactgggtggccatcctattataaaccaattggtgaaaatgtcaagagcaagcttgatatgtcaatcatttttatgccccggaccgaggtgctctgtgcaacctgtgatgctcatctggggcatgtcttcgatgacgggccaccaccaacagggaagagatactgtatcaacagtgcatctctgaaattgaagccccaatagttgctggatactttagcaagaagtcaactataacgctggtccgccctatgtaaacttcgggtttctgtatataaactactcgagttgtagcatatttattattctctttggtatggaatatatactagaaaaaggaggcgcgcttcgcggcgccctacctccattagtcaaatgcattaacaaactttatccagtacgattcaaagt

SEQ ID NO: 22576 - DNA, 3269 bp, Zea mays
tgtatcagtggaaaatctgaatgtaacaatttcaatattccctccattccaagcaggaacataagctattgagagtgagattttgaatcacacttctggctacaggccaattttccatatttttttaacaacatgggacattgggaaatctgggggattaatttttgttcaattgagatttttatgtaataatgcaaattgcaatccagatttggatctctggttccaagcagtagctagttgtgaaacatctttcattcgaattgcatctaaacagaactaaacagaataaacctaccataccaaagatgattgtgtgcacaataaataaataaataaataatgccagaaaatttctagtcttatgaaaaaatggagtgggctttatgctgaaaatttgacaaaaggcactccagatgttaataagaaagtggcatcagttaagacatcacaaccgtactgtcaagaaagtcccctgccaaagatgttcatatagtgtacactaactcatcatcactaagtttgtgtaggcccatctagcattttaatggatcctttcttcataagtttcttattcacaactcctctagagcacaattgagcaaacaattctcttgcctcctttaccaagccttcataagccaagccttcaacaagtatagtgtaagtcgattcatttggcatgcagccactcgatatcatgtacgcaaacaggtcgatagcgttgtgtgtttcacgccgtttgcagagcccaagaagaatagcattgtacagtgccgcagtgggccttatacccatatcttgcactttacaaaatgttctaaccgcctcctcaatcctgtcttctctacaaagaccagaagctattgtcgaataagtaatgatatctggttggagccctttactggtcatctcatccaacagttctaacgcttcctttgttttgccagccttagtaaggccatcaatgaccgtgttataactaatcaagaccgggctacagcctttgtccttgagttgatgaagcaattcaatagcaacatcaacttccccattgcggcagagtgctgtaagtagagtgttgtatgaaacgatgtctgggtaacaacccctggacaccattagttccacaaattccattgctttatgtatcttcttttgtttgcagaaggcatgaagaagcgggttgtaactcaatgaattaggcgtgcatccgtactggggcatctgctcaagaacttccattgcgggctcaaccaatcctctacgacacaagaaactgatgagcatattaaatgttaccacattcggagggcaacccttgtgtgccatctcttccatgagcttctcggcatcttcccaccgttctgcagggcgcaacccctgcagcacagtgttgtagctaacagtgttcggctcgcacccataggacggtaagttcttcaagaactccattgcgtcctcaacccggccttcctggcagataccattgaggacgacattataggtgacaatgtccggggcgcaccccttgtcatgcatctcatcgagtagcttcatggcctgcttgtacccgctcctcttgcaggtggcctcgagcagaatggtgtacgtgacgacgtcgggcaagcagccgcggcggagcatatcctcgagcaccgccagggcgttgctggttcggccgcggccacagaggcctcggatgagcgtgttgtaggtgtacgcgtcgggctccacgggcatgtccgccacgagcctgcgcgcggcgtcgagctgcccggccccgcagtagcccgccaccatggcgttgtagaccatgacatcaggcccgctcgcagccagcacgcggcgcgcgtccgctgtgcggcccgacgcgcagagcttcttgatgagcgcggcgcagggccccaccgcggctggcgagggcgggttgaggcccgcgagtgagtcgacgaggcggagggcatcgtccagttcgccacggcgtacgagaacgcggagacgttccgtggcggaagcggaggaggctttgcggcgtggggtggccgcggatgcggcggggtatgcggcgacgcgggggacgaggtggagttgagggggcctgggggttgggggcttgggttgcgcggggagggaaggataggagtgagaggagggcaaggtgatgagagcggcggacatgtgggacggcagcgcagcaggcggaggtgcggcggccatcggtgtcgggcgacgaggcagctcccggccggcccgatggggtccccggccgagtgggccgacgcactggtgagctttacggaccgttggctccagagaatgtatatttggcattacactgaagaagtaaagaggacatatctcatgcatatataagtttagtgcacagggtgcacatattaaattattactattcatctcaaatttaacgtctatggttgatcattgtaatttacaaataacaccttctatcactacaccctaccatgtccttagtaaaatatattaaacaactagagatgtcagatctaaaatgagtggtgatgatttaatatgtgcatcatgtgcactaaacatctatgtgcaccatatatattctctacactaaaaggggttcgtaaaattatcattagatctatgagtatattatgataactataacaagaaagcaacattgtgagtggtaaaatatcaattattcgggatagctcaccatagctctgatgtgtaagagcattcttaagagactagctaaatgacttgtcaatctaaaatttaattacttaatagcaaaataactctctaacacactggtcatccaactcgccaaactatccgactctctaaattggctctctcactagccaagtttggctagccactctaaactaacatgcatgttagagagtctgttagaattaaatgctatatatagagtttaatctttgatgaaaaaataaatagagtcaaatagagagttaaaaataaagagtctcttagagatgctctaacaatccatttcaaacgctctagctctattaaatttggattataaaaaatagatttagatttatggagtgtttggtttctagggtctaatttttagtccctaaattgtcaaatatagaaactaaaactctattttagctttcgtatttgataatttatagattaaaatggaataaattgtaggaaaaaaattagtccataaaaatcgaacatcctttaggttttttatgaagttggctaagaggagtctacaaaagtga

SEQ ID NO: 22577 - DNA, 2158 bp, Zea mays
cactccttagggcgattgggtacctcgaggccggccgggacaagcatcagagctcggtgtcacaaaacctgaccgatggcggcccggtgctccacagctgcctccgtggtcagaacaggatcgcgagacctctccccctccttttccttcacagccgcggcgctcccctcggcgcgtctgaggccggtaggagcgtgggtccgcggtggagggtacacctgcaggctccgcgccgtctgcgccatgggctccgcgccgtcgtcgtcccaatccccgtcgccgcacacgccttcaggacaaacccaagggaaagcagattataaatcactgagtgaagaggagtggaagaagcgcctgactgaagagcagtattatgttactcggcagaagggcactgaaagagcattcactggggaatactggaatactaaaaccccaggcatttatcagtgtgtctgctgcgacacccctctgtttcagtcatcaaccaaatttgatagtggtactgggtggccatcctattataaaccaattggtgaaaatgtcaagagcaagcttgatatgtcaatcatttttatgccccggaccgaggtgctctgtgcaacctgtgatgctcatctggggcatgtcttcgatgacgggccaccaccaacagggaagagatactgtatcaatagtgcatctctgaaattgaagccccaatagttgctggatactttagcaagaagtcaactataacgctggtccgccctatgtaaacttcggggttatgtatataaactactcgagttgtagcatatttattattctctttgttatgtaatatatgtgttcacaaaccgatgaaagtatgaaacaaacagccgctacttcactctggtattctggtctagaattaaggtgttgtttggttgacgaattgtaacgtaaatggcaacggtaatggtttgcactcgagtgacagttgacaacggtaataaatttaaatagatctttattaaaaaaaaaaaaaaaatagtgtggtatctgattatgattggattttgattatgattggatttaaacaaatgtgatttaatattatttgttacctattacagtacaattatatgaaccaaacaatacctaagcaagtattcactaccagactaccaatttattatctagtcctacaactaagatcgtttgtgtaatcgtcgcccccaagtgactgcctctcccctatacaagagggtggttgagtgttgtgtagtaaagtgtttgcacgctgtggagtggaggtagagctagtggggacggtgcgagagacgaccgaatctacgaaggtggctcacggaagaaaggagagagttgtggcgagtgtggatagagtacagcgaagcgaaggcgacaaaggttgggggaagagtgccgctaggactccattaaaataggatagatcaagctgctagcctagccccactagtcagttgtaatcctatctcccctaaatataaaatggagaggatgatcctctgtgcaagaggtttccttttctcgcttttagactcactagtcatcttcacgctcgatacttagccgttttcatgcaatacaaaccactcgtatgatattacactctagcagcctgaacctctctacatcacgtcacacaccacgtcacacactcctgagcaacatccttgtcgagtttgtgtgcacgcgtccgctggttagcctccggcatgtctagctctttcgtctctgtcacgttggagctagaacactatcgccaattgagggtgcacccctaaggcgtgatgctgtcacatcacatgcctcctcatcaaccaagcacctcaaacgcttagaatctcggttgagtccaggcatcgggtagcctctacaacatcgagagtgagtccctcccacttcatacatgttgtctgccatcacctcgacttcagggagccctagatgtagggcccatttgtgaccatgcaagcgctgcttcacaacccctaggcctaggcccagagaccgagcaacaatggcgatccgacatcaccaaattcattgctacgcagaatgcccccgagcaatgtgtcgcactcatccgacgacctgcgccccgactgccatgtcgagggtgcccatggaggcccaaatagttcatgca

SEQ ID NO: 22578 - DNA, 1436 bp, Zea mays
ccccgttccaaacagtacctgaatttctgatcaaactctcggctgctaatccattcacttccaggccagtggtaatgttttgtcgctgcctcctgatggtatgaggaagacaaaccataaaaccaacaccaatcacctactacgccgggatgataagagaacccataaaaccagcaccaatcagtcaatcactgttactacgccaaaccagtcaatcactgttactacgccaacaaactgtaactgtcaaagtcaatcactgtttctacgccaaacttttacgagctgtaactgtcaaattgcgaactgaaagaatcgccttgtaacatatcaaccacaccatgtattcaaaacagaccacacgcatcagtctacacaaaatggacttttagcctctgaagacaccgatgataacagatactaaatgttttctggcctcaggacagggagagaagaaaaaaaaacaatccagctcgccgaacatcattattgtatggcaatctaccgcctcttttgagctaatactgcactcaatgactcaagacttacttcacttgatctgtttctaaatcccctattctccacctgtttaactaacactaccaaaaaaaaacaagaaagaccttacattcatgcaaaactatcagaatgaagggaaaaacaaaaagaatgtacaatgggctttcaggtaaggatcgccaggaaaaaggctagccatccacatttgaattgcctcttgtttcatcatgcaggagaggtacaaggccaactttgccgaactaggtgcagactatgttcgccttctcaggcttgtaccctttaggatatataaacacggagtcaacgcacaagccgcctttcatatgtgtgcaatcgatctgcatcattgagaacttgagtttcatgggctcatcggaatttgatatgacaaaatcaccaacatggtaaagcttccagcccccttgttcatgtagatgcagataatattcggatgtcgcctgctgctcatcagaggtcgtgagctggaaccgtgtgggcgtgacatcccaaccatgcacatgctcagttccacaaagccaacgacccatgcgcctatagggtcgacccaggtgaagatgaaaaaaaaggctgtaggcaccagcaggaaagcagaactcaagctccccatctacctcgagccaccaaatctgctggagataggcaacagtatggaatcttgattcctctgtagcgaggtggctccagtacctccgatcatctatcccggtaatagccattgcctttgatgatatactcatgcaaagggctccctttgttcttcagaatccaaaaattcctttctgccgggatcaaagaaagtggatcggcacagaccgaccgaaaattcccttccttgctcaagcgcttggcgctggaatctccatccgccaaagccc

SEQ ID NO: 22579 - DNA, 900 bp, Zea mays
tttttttttttttgttcctttttcttctttttttctcattgtgttcttcgtcagaagagaatgtatttcatttataaaaaattgtggtgcgtattatgaagatggtggaacggaaatggtacggaggagggtcattagtgctaagggtcattacaaatgactacgcgaaggcaccggcgtcagctcccacaccagcaccgactccaacgctagccccagcgttgagaccaactccagcaccggccccaacgccaactccagccccgactccagcgccgatgccagcgccaaggccggcgccagcagcaaggccagcgccaactccagcgccgatgccagcccctaggcctgcaccagcaccgaggccagcgccaactccaacattagcgccgattccaaggtttgcaccaaagcctccgaatccaccgagacctccgaagaatggaatcatgccacccataccgcccagcatgccaccgccaaatggcatcataccgccaccatagggcatcatgccaccggagccaccgtaccgctgtctggggtacccgcgagagggacgcatcgtcgggcgatagctgtttcggccgtacgagccgtaggatggggctgcataatcgctgtacgatggagcagggtcagaatcgtagtcagagccgtaatcgccgccttgtgggtgaggtagggcaatgacgctgctggcagccataagcaaggtgataaaaaaggtggattgcattctcgcggatttaaaaagtgaaaaaggatggtttgttgaatggaatgtttgataaatgattgggatgtttgataaattaggtgaagcgactgaggtctaactggttatgggaagttggaagctgaaggaaatgatccgggactcccccgagggccccactg

SEQ ID NO: 22580 - DNA, 730 bp, Zea mays
ctcgagttttttttccttgttcttctctccttctgtttgttccaacaccaaacacttctgtagtaaataggcctgtgaggcatacacgattcgtcatcatctttagcaactatagtcgttgcttgtcatgcacatggtacaagaaataggtttgttcactcaaactaacactgattgatttacaacacaacactgactacaaagaacttaaaaacaccagctccgtgaacagcagctgcacagagatgcctctgcttctaaacctgaccaagaatggtgccacgattgcactaggcaaagcaagaaccagcatcgtcatcatgccacctcagctcaacccggcaaccatcccatgggcaacggggcttaaggccacatccctgtcgcctgttcacatactggaccatcccaatctttccccttgccaatcacccgctcactgcacaatcccatttttttaccaacactatcagtccttcaacaacagagcccattcaacgagggcaagatgtgctcctccagcatctcaatctgtgagaggaagcaaaagcaccgagaatgaagctgaaagaggggcatgcagggccaccaaccccccccccccccccagcccacgcatcacctctcagcttcttttgtggattaggggggttgtccaataaacctagagctgcttctgtttaaaggagaacagtgcccctcctgcatctcagtatgcagggagcaacta

SEQ ID NO: 22581 - DNA, 1294 bp, Zea mays
gatcctgacaaaacgagcacaactctaggggcgcggcccccatgacacatgcggctatccttcgcgaccagcgggcacgaaagtgataaggagacggtactagtaaactgactaactgctgcccactcgccggagaaccatggccacggcggcggcgtgtgtgcgggtggcgtctccgttcacgggcccacctatctggcatcccagacacgtcatctcaacgaggcggggacccaggagggccgggctggccgtcacggcggcggctgccgccggtggatcgccgcgcactgtgctcgtcaccggcgcgggcggccgaacaggccaaattgtgtacaagaagttgaaggagagggaaggacagtttgtgggacgtggcctagtcaggacgggagagagcaaaggcaaaattggaggcggtgacgacgtgtttgtcggcgacatcagagaccccgagagcattgctcctgcgatcgagggcattgacgcgctcatcatcctcaccagcgcggtcccaaagatgaaaccggggtttgatcctagcaaaggggggcgccctgagttttactttgaagaagggagttatcctgagcaggtggattggattggccaaaagaatcaaattgatgctgctaagagcatcggtgcaaagcacatagttttggtgggatccatgggaggaacagacatcaatcacccgctaaacaagttaggaaatgcaaatatactggtgtggaagcgcaaggcagaacagtacctagcagactccggtcttccatatacaattataagagctggcggtttacaagataaagatggtggcttgcgagagttgattgttgggaaggatgatgagatcctgaaaacagaaacaagaactatagccagggccgatgttgcagaagtttgcatacaggcattgctattcgaagagtcaaagtttaaggcatttgatctggcatcaaaaccagaaggtgaagggacgccaactacagactttagggcactttttgcacaagttaatagtcgcttctaaagacataagattgttcttgccaagaagttgagggcattctttcgtaaagcgatatgaaatgtgtgtttagtaaggttagtttcctgtttactaagttcctaatatattacagttgttccatgtagcatccttttttatctcttgctctctagctacttttggctttatttcctgtctagacagcggattctgcataatgctaatgaactttcatatcaaataagattgctcagttatccataatgttaaaaaaaaaaa

SEQ ID NO: 22582 - DNA, 1632 bp, Zea mays
taggggccttttttttttttttttttgtccaatagatcagcggccacatgatactttctttgtgtcggtacaaccatgggaagaagcacgttaaatgaccaggctgtgagcagtaacggtacgttttgctttggaccagaaggaccagtagccaaagggtccggactaataacattgactactcgttcacacaaaggggtcactgggtaacagccccaactaaggctactcgcccttgctatgaaaacagaacagcctaatcattcatcgcacaacaatcagaaaactaacagaaacattctggtacattttttttctgtatctcaggaaggcgcagatgtgcagctaggttatcctcacaatggtacgatataagtctcccggtcaccagagtctctccacgccctcgggatcctatgatttctggattggaaggtagagcttgaactcaggcggcagctcctcctccgagtagaggcggtcagagaagtagattctgcggagccggcagttcgcatgaacttgcacccgcagcgtctcgacgtaatttgtgccgtacgccctttttgtcagatcagcaaggttcaactggatgttgttccagccatcgtcgagtttcaacggcatcgtgcagatatatggcttcacccttgtgacagattgaaaatttgatgctcgaaatcgacgtcggacattcttgtcatccagaacttggatctcaaacgtgaagtatttcttaagatttttcacaataatagccagaaatggaagcttaatcccaagagtagcagaaggatcagctgggcatgtgatgtaagttgactgtacatttgttccaacaatttcaagtacattagattggatatcttcatcttggggtcgtttaatgtgcccattcacaactgcaaacggataaaacattaagaaacggaaatggtacatttgacacaggttcgtgagaatgaagcacatatgtatttattgtttaggtcccagaaaaagctaaactagcaggttgcagtgtatgtgctgatggacaagtttacactttcatgtcaaatatttcatgaagatttaacattgctgctggaagccaacgatcaataacaatccaattatccaatgatattctagctgatgaagttcatgtttttcaattttcataatctatcccacacacaaagtaaacaaaagttaagaaaggcagcatcagaagcagataatgctttagcaactgaaagctcgaatcctaaccaaattaatcgatgctcttatttcgtgtcagcactcagcagaacaaaatggaacaaaggaaatcagtatttgagcattaaagaggacacatcaagaagatggcaaaccttccttatcccatatctgcaatggcttggtcccgaggctataaagaatggacaggaacccagactgaaatgtattcttgaacatgttctgaagcttgtagatcaattaaactggggaagcaatcgacgaggctagactcgagcacgtggcgtaggggcggcggcggtcgcctagttgtggctgcgccacgagagctcgcgcgcgagcacgcaaggtggacgggagaagaaaactccctaattttttttttcgattaggatgttctaggta

SEQ ID NO: 22583 - DNA, 1183 bp, Zea mays
ggggggggttacttagtggggggcccccctttttttttgtttttttttttgagacggtacaaccatggaagaagcacgttaaatgaccaggcagtgagcagtaacggtacgttttgctttggaccagaaggaccagtagccaaagggtccggactaataacattgactactcgttcacacaaaggggtcactgggtaacagccccaactaaggctactcgcccttgctatgaaaacagaacagcctaatcattcatcgcacaacaatcagaaaactaacagaaacattctggtacattttttttctgtatctcaggaaggcgcagatgtgcagctaggttatcctcacaatggtacgatataagtctcccggtcaccagagtctctccacgccctcgggatcctatgatttctggattggaaggtagagcttgaactcaggcggcagctcctcctccgagtagaggcggtcagagaagtagattctgcggagccggcagttcgcatgaacttgcacccgcagcgtctcgacgtaatttgtgccgtacgccctttttgtcagatcagcaaggttcaactggatgttgttccagccatcgtcgagtttcaacggcatcgtgcagatatatggcttcacccttgtgacagattgaaaatttgatgctcgaaatcgacgtcggacattcttgtcatccagaacttggatctcaaacgtgaagtatttcttaagatttttcacaataatagccagaaatggaagcttaatcccaagagtagcagaaggatcagctgggcatgtgatgtaagttgactgtacatttgttccaacaatttcaagtacattagattggatatcttcatcttggggtcgtttaatgtgcccattcacaacttccttatcccatatctgcaatggcttggtcccgaggctataaagaatggacaggaacccagactgaaatgtattcttgaacatgttctgaagcttgtagatcaattaaactggggaagcaatcgacgaggctagactcgagcacgtggcgtaggggcggcggcggtcgcctagttgtggctgcgccacgagagctcgcgcgcgagcacgcaaggtggacgggagaagaaaactccctaattttttgtgggccgcccgccccgactcgtgcttttccgcgaacccggccggc

SEQ ID NO: 22584 - DNA, 5851 bp, Zea mays
atcattcctaagctaccacagacttagatagttttcgctacttctctaaaatataagagacaactgtttggcaccaccgatcattttagctctttagatgttaaagggaaggtgggtgagaaccaaagatgtccacgacaagatagttgttgatgggagtatgggagtactaatgcccatgtggcaccgaaaaaattctcaaacttccacaaaaacaagttcaagcaagacatcaaacaaaagaacaccactccttttaatcttaataataaataaataagacgagccgatcaaacttggtataaaaaagtcaaacgagttataaattacaacaaagggagtacttatctaagtatgaaatatttattggtaagggcgaaaggcttgtcttcatctgatgcttgctttaaatctatttaccatatgaaccacgatagttagatagatatttggcattcacatttatgacatgtaaattttggttgcttaacacacttagcgggtacgaatttgatttcaaactttgatttgccgaaacctaaagatcgaagagttatcacctagcattgatatatataatctactagttaggtgccccgtacgttactacaatttctatgtatgcttatgtatagagtatgaaacacaaagatatatatgttctattgcttagatgggtgtgaatacgggtttgaagttaataactattgtttaaatcatcatttgtgcttttttgccatttaactaaatgtgagcagcagggggaggagtgaacggaagggaaggggtgacgcacaatgatgatagtgaaaaatagtggtgaactagaaacttaagccttaattgcgttctaacattctattctctcccgaaatgactggtaaattattccatggatgtagaaagaatgaagcaattaacatgccggtttcttctgccggccaggccaacgacacgatgcaatgcgaagttgcaagctactggttgccgaccgcggtgccatctgatgcatggggagcgcgtggacgaataatccccacggccgtccaatcggccggccactattctcacgcgcggtacgtcggcactcgccgccacctagcagcatgtcaactcgcggcgtctcgatcgcgcgacacggggacggagtcagtgacgacggcgacgctggacagtgacggcggcgatcaccaccgtacctctgcaggtgcggctctgcccggaccccggcccgccggcctgtgccgctgacgatgacgccggaaggaacgaggctgacacggacggtgacactgagtgactagcgcgcggcaggatcttggattcgatggatcgatcgatcgcgatccgttcagctagcccgacggaagtgacacatgtacagagagagaccgttgttgcgtgtccccgagtgatgtcgatcgatgaacagcgatggcgcgcggcacccgacaagcacgagcaagcgacggggccggggggcagcggggagagccggcacggccgcatgggccgatgcgtggccgtgtcccggagcggtcggtcggcgctcccaggccccagcggcgtcaggggacccggccggcccggttcaggctggctcgcaaggggcacgtacgtacgctacttatgacctaatcactgcctgcatgcttcaactaatccgtgtcgtctcgattaagagacaagagtagtgtgtgcgcgtgcctggtccgatatgactggcttccgtgtgggccaacgaacgataacgattgatcctgtaacgtgtggtagactggtagtgagtgctgtactaccttgctagctagctaggggtgctcgatctcatgtcatgtgccattcagatgcctgtggggctgcctagcctaggcatgcatgcatgtgaccgcattttgattttgtgtatgtcctacaagctttccgatttatctatctttattcaagcagcatacggttgcacatgcatgttttttgtggattggatcggaagagccttgatgtaatcgaaggtgtatttttatactctacacatgcacgcacgcatgtgtatataaagtgattaaacatactactaagcatcaatcagaggccatgctgcattgcctccctgatgcagtgattctcaccgcagttttttttctctctccacagactgcaaatgcacgcataagattcagtgtacgaagtacggctcggtcaaaacaatccagcggtagcgggtagtacaccgccatgatgcctgccactgccgcgcgcgcattacatttgctgtggcaaagcacagtaacctgagtcaattcagacgcatcgacgcaaaaggctgtgctgcaactgcatgcaaatcgaccacagttgcaacttgcaggcaagagcactcattcaatgcgaacgcagagagagagagcgcagattattgttgttgttgttattacagggacaatataattagagcctgaggcttttcgtttgccagtcgtttgccgtctttaggccttgttcggttattctaattatatatggattggatgaaatttgaaaaaatttagaagaactttgacttgcttggaatttaaacctacccaatctcacgcaaaccacatgtattgagagatggattaagagctaaccgaacaagcccttattagtacgcgaaatgccaggcggtgaggcgggcctcgacgataactctccgtgcatggacatggacctggaccggaccgatcatcctcctccggccaccccgcccgacctcccatcccggcctgccgccggtcagcgagatgcctcgtcgatggtgcctgcccagagtcaaatcccccaacagtgcactccccgtcgctgtccttgtcccactgggacagctccaaccgatcggggccagaggaacagctacacatccgtccgaataataaagcatcttcagaccacgccatctccagcactcccccatcgcgtggacacctgccggtctggtctgaggctctgagcgaggcgcgcagccgcggccgacgggatgcgtgcacggcagacagcacgggcgcatgcgcgaacgcacacgggtgccatctgccatactattactacccggcagcaagggatggccggtcatggagcccgggttccaggtgcatgccgagaaaccgatttttcgatcccgccgcgcggatggacatggacctggtccggttgcatgcgcgcgcgctacctcccatcggctccgtgccactgccacccacggagacgcggcgcagatatggcaggtgccgacgccggcggtgtgtctgcactgtgccgaggagtggccggcgtttgggaccgggcgccggcgagaattgggcgtgaccctggcccgggctgacgctgacgcgacggcgcgaggcttttgggtggggttgtctgtaactgcctaactggtgtcttgttttggccttgcgtcgggtccatggacgctgctgcgctggacgtgttgcctttgcgtgcttgtcctaggatctatatatgctacgtgttgacgccgggtttgccggcctcggccggccacctcttactgtctggtttactttccccaaaaaaaaaaaaaaaaaaaaaaaaaaactggagatggaacttcatttcagttccatttcagcttggatgtcggtatgtgtcgagactacacaaatgcttacttgtttttatctaaggcgaggtagctaacgacttatgactatttaacaagaggtacaactaacacttagctggtctggtctattagctaatccgatctgaacctatctgctaattttagttactggctagtattagttttagaggtttacaacatggccgcccttaataggtgcgcgagcaaacaatgctgctgcagcttcatagtagtgatgctcgcgtcgtagtaaatggcgggcgcccgatgctgcaacaaaagcggtcacgttttcagacatcaactgccggcatcggcctgcgataccaatgcaatgcaatgtcatgccatcaactgccatccgtccgtcatttatggcgcgaggcagacgcgttaccggccacaacggcaagtaaccgacctgctgcctgccgcctgcgccggccgccactcaatacatgcaggtacggcggccttttggcgctactgcggccgcgcacagcgttcacggccacaccccccctgcgcgccgctgcggcacggacggacgcgggcgggggtatggacctgcctgcgcttcgtggtccggcggcatggtgggcgcgggcgcgccgcggcccgggctggcatggcgcgcggccgcggcacatgagccggaccagggcgtgcggtggtcgggtggactcgccgcccgctcgctgtccgcggtgcggcgcctttttactcgcttgttctgttgcgttgcgcgtcccctcccctgccctgcctgcctcccccacgtctctgcgccgtgttccaggcggcagacacggggccgcccggatgcttctgggcggccaccgccggcagcactggttccctgttggccgcagcacgtgtcgcccaaccatttgctggccaactagttagaactagaaagccacgacgctagcttcaaaagcacagcatcagatccttccaacacgaatctgctacccctgcccgacccctgtgccggcagcctgcaatccccatccaaaaccgacgcaatccttgcgcttgcgcccggtcaagatgatttcagaacactttgaattcatacagataacacaaataggctcagatttcggaatcaacaatagacagtgcttccgctggactgcagcactcggcacggctgacgctaaagagaagtgaagcttttaatgcgagtcacgcgtaacatgtatccaatagatcagcggccacatgatactatcatagagacggtacaaccatggaagaagcacgttaaatgaccaggcagtgagcagtaacggtacgttttgctttggaccagaaggaccagtagccaaagggtccggactaataacattgactactcgttcacacaaaggggtcactgggtaacagccccaactaaggctactcgcccttgctatgaaaacagaacagcctaatcattcatcgcacaacaatcagaaaactaacagaaacattctggtacattttttttctgtatctcaggaaggcgcagatgtgcagctaggttatcctcacaatggtacgatataagtctcccggtcaccagagtctctccacgccctcgggatcctatgatttctgtgtggtagttcacgcaaaaggatgcagtagacaggtaagaagcgaagagatgttctatagcgaagtacatgaatagagggagtcctcacctggattggaaggtagagcttgaactcaggcggcagctcctcctccgagtagaggcggtcagagaagtagattctgcggagccggcagttcgcatgaacttgcacccgcagcgtctcgacgtaatttgtgccgtacgccctttttgtcagatcagcaaggttcaactggatgttgttccagccatcgtcgagtttcaacggcatcgtgcagatatatggcttcacccttgtgacagactgcaaaagggtttagaagtcagtgtgattggcatcacaggcacagtgtgcacacacaatttaagtgcctcgtatttttttttaaaataagtggcggaaaaaaccgaagggataaaatacaccagccattcaactcaagtccaaccatgcaaaagaaagtgtcagtcaacccaagtccaccttactaaagaataggtcaaccatcattattacaattagtcaattattttcatcaatgccctacagaagggttggtggggaggtgaaattataa

SEQ ID NO: 22585 - DNA, 2213 bp, Zea mays
ttttttttttttttttttttgccgcctgcaactcttttcatctcgtcacgaggggaaatgtatcacagcgagacggcacggcaacggtgccgcagcagctccttcgcgtgcagagagcactgacgccgaaaccaacacaggctatgcgctgtggctgtccgatctgaaccctcatgtgtcctctcggttttggcacagctgcggacagctagtgagtgagtagtgacccgtaaccgtctaggcatctctctcccaggaacgtctgcctcgtccgtccgccatcaccggacgtgacagctaagataatctttttacaaccgacggacgcgagaggtcaggtcagtttcactcgtacgggttccgcaagttcttgaggagctccgggatgtcgtgagcgagcatgtcgtccaccgcctgcaccatcttcggcttcagcttctcgaacttgtcgatgctgtacccgcccagcacctgcttgaagtgctcgacgtcggggaagtctccggcggggagatgatattccctctgcacctttgcaaactcctcctctaagttgtctatgagtcgctgctgagccttggcttttcccatcactgcaggcatctccttcttcagatggccaattatgtaagcatggatcttggcagctcgggcacgcttaacaaactcattgacccgtcgatcacaagccttcttaggaatgtccttcaggtcacagaggaggtcatcttgctccctctcaaacaagtcttttccaattggcccaacagctgaatcattcactggcttatcattaaatgatccgatatacacacgcacaacctcaggagtatttagcactttcccaagagaccacatcaatgcaccatacactctcataagctgttgtgtgtcaacttggtcggccttgttcaacactacgcgtattttgtcatcatgcccacgtaaagatgaaatgacacgtttgaactcatcacttatatcaagcttgtgagggtcaaacagaagaaggataaggtcacacttggcagcaaaccatgaggtcacaccagtgaaatcatagctacgttgggtccgttgcttttccccagagagaacaccaggagtgtccacaaaggtgatatgctctagcaggggatgtggcatctgagagcattcaaacttcgacagaaacgctcccccaaaggttgtaagaccagtgaatggcatgtcggcttgaacggcaatagtattgccaggaatggtccttccatcagatcctgacatgacaactacgaatctatcagttgttggctctggtccgacgtgagctcctgggtagcttgtctttagcagatgcttaatgaatgttgttttgcctgttgaatactgacccaagagcataaccattggctttgcttcaaagtcactgtttgtcaataatgggtgagaaaaatcattgtatctgtaggcgacttccaaaggcttcagtttttcaacatagagtcttttcaagccatcaattacagaggtaacagcagtcagaggcatctgcaccttctgtgctgattttgaaccaaaccagtgatatatggaaggtgcttgggcctgagtggtgccattgtcatctgggtgaactctctttacaacagccttggatctagccagtagctcatcaacaccttccatcacaggcggatccaaggtgctcaggtcttcacgtttcagactgtcctgtgtgatctcgttccctgcttgggccagagacacgagctgcattgctgtgacgaactcggcgaatccgaggtacccctgccgcctggaatccgcgatcgcccacacctgcttgagatcggcgcgtgaaagcgcggacatggcgaagaagctggtggcatcggcgcccgtgacgcggccgtcgccatctgggtcggcgagggcgaaccactcggcgtagatcctctggtgctccttgcagcaggccacgccagcagccgcccgcgcgatatccatctccgtcccctctcgccgccccgctcaggtgctaggccgccgccgccgccgcagaaacgagcaggactgcaggagcaactgcagcagctgagggccgcactcgcactcgcttcggctttctctccgattaggttggtcggggtaatggtctcgaaacgagggaccctacttcagcgagagtgggagaccggaggcgctcccagtgatttctagtttttgttttt

SEQ ID NO: 22586 - DNA, 4530 bp, Zea mays
gttcttaataagtagtatatattataaatatatatagacgtaatttaaaaaaacaaaatcatgccaaagccggccagcactatgggccaagaatgcagagcagacatgacataggtctactttaaatcgtatcgggtagggccagaccatggtactgttaaataggttgtggctctagtcaacccgctagtcacaacctatttggccatcaattcgtgagcgtgaaaaaaatcaagagaaaagagttcatctcttatctaacctacaccacataccttgccattcacactcaccatacctaatctatatgtatggattatgtttgaataaatatctcgttttaatttaagcaatgtctatctatatgatataaaaagcagtagtgatgcacgagcaactaagtagtcaacatcaaatcacataactacaccatcaactcaaaaaatgtaaggcattataatcttaacaaaattttaacatttctaaaccaagtttataaaaaaaaatggcaccaacatggacaatatattaaattattttaactaaatccacctgaaaatatgccttgatagtatatagatgctagtataatttgcctataagattgggccaatttaaagaaagttgaatataatactaaaaaagaacttgcatatttcgtagtggaggcgggatcagtgagagaaggtatcggatttgatacgtttgttacttccgatggattcttattacccttctggcattagcattacaaacttgcatacagtttgtaatttattggacgttacaacgatcaggtacccgtatactatacagggaacagtagttacaggagaaaagcttatggtaattcgagccactgaaacttgaaagacaaaaaggaataattcccgtcgtacaatcgtgcgtgtcgtcatgcatagatgtactttttttcagggtttgagcgtttagatatagaccataaaatgacgaatcgttccacgtagctagcagcgtgagagctggcgaacgcgtcagttagcaggccgggaacaagatcgcctttcaattctctccttgttctttacccattatatatagagagagagatgtaggagtattatgctagacgtaggcgtaggtactttcctccagcgcatactacagtttgtaaagcccccgaccccgagcaatgggccgggtcggaataaaacaagcatatatgatgagcatatggtagctcagggacagggaagaactgtatgaaccgtttcctggggcaggcagaggaagagaacagcaagaacaaaatcacagagaaaggaacaatctgcttattattggaatatatcaatccgcatacataccatgacccaatgatacagaccgtaagaaatgatcaacttacaatacctgagcaacaaatcttcaatttggtgctgggattcagatatatatacatacatacctcttgctgctactactactacgcacacttattagcgctatgaactcatggagaaaaccaattaacgtacgggatatatatatattgatgaaaactaaagcatcaaacacacagcaataacaatcatagatgcatgcaacttactagctagctttatacagtatttgccgggatcgatggcctgggtttggatcggagctgcttgcatggtagctaagctagctatattaagaggcacccccccccgtagccagcactccgaaacaaggcctgttttatctcgtcggtgcttagaacttgcctcttattattaccgtcctcctcctcctacgtatataataccacaggttattcattggtaaacagatcctttgtgtaatgcatataccatgcatatgcagagattactaacgctagctgtggttgtttaattattactacgtactactatactatacagctgctgtttcatttcatgttcgttctagctgatttatacagtttccagaatgaaaaaggaatccgatcccttaaccatgcatgtagtactactactcacttgtgagcaagaggcctgcatgccaaagtcgctgaagcagctcaccacgcactgctcgatctccaggcccagcacctccagcgcgcttaccgtggacagcagcacctcggggtttgtggcgcagcagatctcgatcctcgtgctcccgttgccccgcctctcgacgtcgaactgcatgcgcatggatggagaatcactagctagttcatcgatccaccaggtactttcaaggtgttgaggatgtgagcagcggaggttcgtacgcgtacctttgtggagttcctcaccatcatctcgttgctgccgctggacgaagaagctttcaaggtgttgaggaggtccaggtcctccgcagaggcgccgatctcctcttccaggactttgatccgctccgtcagctccttcacgtagtcaatggtgtcaccgagaatggatgtcctgtccatctgatgatggaagaacatgcatggccgatcgattctgattagtactagctagcacacaggctcagcccaccacataattgattggttgctttacataccttgctgatcttgggaacaatagagcggagcatggagagacggtcgttgaggcgcttccgccgccgcctctcggccatgagattcttggacggcgcgccgccgccgtggaccttgctcctgtggtgggggccgccggcggcacccctgacgacgacgggcgtctgctcggagctctcgccggcggcaccgccgaacacgaacgtcggggagccgccggctccatattgctgcccctgcaggtgaccgctcgtctcgtcctccaccatggcgtcgtggagagcggcgagcgcccttccgggcaccgcggcggcctcggcccccgttattacggcgacgccgccgcccctgtacgggttgcaaacctcgctgaggcagtcgaagttgaactcctcgtgcgagtgagggtgcgggggcgcctgcacctgcagcggctcctgctggtggaacggcgagagctggtccatgccgccgccgctggtggcagtcgcggcggcctccgtcgtcccgccgtagaagaggaggtcgcccatcatcatgccttgtccgccgccgcccgtgtaggcggcagctgcttgccactgcgcggacgccgccgccgccgcctcccgccgcagcgacatgagctcgtccaagaacgtcgtctcctcgtcaagctccatgggcgcccggtgaccgctaactagtttgctaacgctttagcaacctcgccagaaaccctcgcgcttataacacacacacacaccaaacgcgcgcggccgtcgtcgtcggctggtagcagctagctagcaggccagcagcagcagcacggaccaccaccacatgcgcaacttgtaggcgccagtggccgtgtgtgggggggagccgggagctagctacgagactacgactacgagcagtggccgtgatgagcgcagctgcacagcggtgggccgcggcgtgcgtgtttgtatgtcctgctgcctgcgcgcgcagcctgaccgagcgacaattattccttggctgactgccgttcattcgggttttagggtacggtcggcggtctgctgttccgttgggcatgggctacctggaagtagctcagcacggcggcctaagaacggaatggaatctccgcatttgtttaatccccctgacaacattcggttttcaattatggaccatgtcgttttcgcctgaaatctgcaatctcgcggccccccatttaaaacacctccagtcactggcagggtccgaccggggtcgtccccgcctcccgcgataccacggggtactctatattatcttaatgtacatgtattaaagtgaattgaggtgtaatttaaactaatttacatcttaatttatcttaacacatgtaaattgagatcaatattatagcaataaaaaaaacctacatagccttgtcacggccacctacaggccggccgttgtttaatcccggattgattccccctggccgtttcgacgctcgcgcacggctcggtcggcgtcgcgtcggcgatctacctccctccctccctcacagatcagacgccttttgtgcgctgggggatgaaccgtggacgcggagacggacgtgtgtggcgtgcgcgggcggcgccgcctcgtccgctctgggggagccagccgcggcggacgggccgggagagggcggtcgggccggggcatgcgtgcgcgggcaaaacgcagcggccgcgcgcgtcgctgtcgcttgtgtcgcctccccgagccagatcggatcggctgtcgcctacgccgacggggacggacgcggccagcgattggtacgacgtacacggacgcgattaatcatataccccggcggccggctgctgcccctgctgattagtgtagcgacgaccataccatacataccaataccatcgcgtcgattgcgtgtgtacgtgtaccagagggccgatgatgcatgtcgatgggatgcaaagagatagcgtacgatgcattgcattgcaagg

SEQ ID NO: 22587 - DNA, 1660 bp, Zea mays
ctttttttttttttttttttttttgcgaaaggaacaatctgcttattattggaatatatcaatccgcatacataccatgacccaatgatacagaccgtaagaaatgatcaacttacaatacctgagcaacaaatcttcaatttggtgctgggattcagatatatatacatacatacctcttgctgctactactactacgcacacttattagcgctatgaactcatggagaaaaccaattaacgtacgggatatatatattgatgaaaactaaagcatcaaacacacagcaataacaatcatagatgcatgcaacttactagctagctttatacagtatttgccgggatcgatggcctgggtttggatcggagctgcttgcatggtagctaagctagctatattagaggcacctccctccgtagccagcactccgaaacaaggcctgttttatctcgtcggtgcttagaacttgcctcttattattaccgtcctcctcctcttgtgagcaagaggcctgcatgccaaagtcgctgaagcagctcaccacgcactgctcgatctccaggcccagcacctccagcgcgcttaccgtggacagcagcacctcggggtttgtggcgcagcagatctcgatcctcgtgctcccgttgccccgcctctcgacgtcgaactttgtggagttcctcaccatcatctcgttgctgccgctggacgaagaagctttcaaggtgttgaggaggtccaggtcctccgcagaggcgccgatctcctcttccaggactttgatccgctccgtcagctccttcacgtagtcaatggtgtccccgagaatggatgtcctgtccatcttgctgatcttgggaacaatggagcggagcatggagagacggtcgttgaggcgcttccgccgccgcctctcggccatgagattcttggacggcgcgccgccgtggaccttgctcctgtggtgggggccgccgccggcacccctgacgacgacgggcatctgctcggagctctcgccggcggcaccgccgaacacgaacgtcggggacccgccggctccatgttgctgcccctgcggcaggtgaccgctcgtctcgtcctccaccatggcgtcgtggagagcggcgagcgcccttccaggcaccgcggcggcctcggcccccgttattacggcgacgccggcccccctgtacgggttgcaaacctcgctgaggcagtcgaagttgaactcctcgtgcgagtgagggtgcggggccgccgcgggcgcctgcacctgcacctgcagcggcgcgtgctggtggaacggcgagagctggtccatgccgccgccgctggtggcagtcgcggcggcctccgtcgccccgccgtagaagaggaggtcgcccatcatcatgccttcgtctccgccgccgcccgtgtaggcggcagctgcttgccactgcccggacgccgccgccgccgcctcccgccgcagcgacatgagctcgtccaagaacgtctcctcgtcaagctccatgggcgcccccgctaacgctttagcaacctcgccagaaaccctcgcgcttataacacacacacacacacacacacacacacacacacacacacacaacaaacgcgcgcggccgtcgtcgtcggctggtagcagctagc

SEQ ID NO: 22588 - DNA, 851 bp, Zea mays
aggccttatagtacccctattgggtacccccgggccggcccggatccactcccagtcccaacacccgtcggcgtcgagcagcggcagcggcggcggcgatgacgacgagcctgaagaagaaccggaagaagcgcgggcacgtgtcggcggggcacggccgcatcggcaagcaccggaagcacccgggaggccgcggcaacgccggcggcatgcaccaccaccgcatcctcttcgacaagtaccacccgggctacttcggcaaggtgggcatgcgctacttccacaggctccgcaacaagttccactgcccgtcggtcaacgtggagcggctctggtcgatggtgcccgccggcaaggccgcggaggcggccggcgcggaccaggccccgctcgtcgacgtgacgcagttcggctacttcaaggtgctcggcaaggggatgctgccgtccaggcccatcgtcgtcaaggccaagctcatctccaaggtcgccgagaagaagatcaaggctgccggaggcgccgtcctgctgaccgcttaggtccttttgcatcttgtttcaactatctgcgctaagaaatattctatctttttttgggtggatctatgagaccctggttttgagcacttggtaacgaatatgagttcgattatatcgatgctgcacacctcttgctgcatgtattattcattctatgcagttgcagttcatgtgggctgtgctactgagatatgaaatgttttggcatttttctgataaaaaaaaaaaaaaaaaaaccgcggcccgcggccccccctttttctggtgtattgttgcaaaacacaaaatcaattgatttcatcttgcccacaa

SEQ ID NO: 22589 - DNA, 4314 bp, Zea mays
tggcttaagcactacgactaggtgatgaaatgtgtatacgtgagtatacccgagattgatttgccgagatgataacagtaaaagatactaccgtatatatcgacggattatttggaaccaaacatgaaagttgaaataaaaaattattgatcttatatccgtttatgtgaaaggttctaactagaaaaaaagatctagctggaaaacgtggcagccatccattgggcgaggacgtttatataagcgcactggcactggtccttggctcctcacgtcttctccctcctatcgcgcgctaagtacttgcttcgatcgccatgaataccttctcctcccacaatgcaaggacggcgctgctgctccttgcactgtccttttcattggccgtggcgagcgaccccatgttctcgtgcggcccgtcatctgcgtcgcgggcctaccctttctgcgaccgttcgctccccgcggcgcggcgcgcggcggacctggtgtcgcggctgacggtggcggagaaggtgtcgcagcttggggacgaagcggcgggagtgccgcggctgggcgtgcctccgtacaagtggtggtcggagggcctgcacgggctcgccttctggggccacggcatgcggttcaatggcaccgtcagcgccgtgaccagcttcccgcaggtgctgctcaccaccgcctccttcgatgagagcctctggtttcgcatcggccaggtatgcgatacgcgcctctacctgacatacctggcagtatggtatggggatgcattgcactatatgcttacgtcaataaacgtattggaaacacagatggctagctaggggcagatcgatactgaagcatgcacacgtatattcagttctacagtatgtaatacaaacatgtctatccctgtgaatgtctgacatagattaggcactacaatggtggttagtacttcagtcgccgcggatgcctagacacgaatatggtggttgtaacttgtaactaacgccgtcacgataggtcctgctgtggagtaacagttaggtacgttcagaatgtgactctgataggtcgcaggtgtagtacgatatgttgtggttgcaaaggtatatgcgtcttcgcactatgcaggcctagtgcagtacgctctgatagatcgagcacgaccctgcttttgtttgggcggcctgctccgatctattgattggtatgccaattgccaaccaatatatatacaactgttagagcttccctcagcccatgcggtggggctcggtggtgaggtctggtcgaacacccgaataataaaaaactatggttatgcttactgcgaactggggtgtaagaacagagtaagcatcctgttgtcatcatcattagccgaaagcaggtaccttagagcaatgtggttactgcgtttgaataatatgccacgcaatgacgcagtactgttcatcatttagggtcgcatgtgcctgtcgttgtcacattgctttgcacccgcaccctccatgatcgataaatgagggaacagcagtacaactcacacctatcggttacgaacttgaacaattgccaaagttgcagtcaccaaacttgttgagcgtgcaattcaagcatgtcctacagtcgtgcatgccatgcatggtaatattgtgacaatttgatatattcatctccacctgtcatgcatggtatcgtgcaggccatcggccgggaggcccgggcgctatacaacctgggacaggcggaggggctcactatctggtcacccaacgtgaatatcttccgtgacccgcgctggggccgcgggcaagagacacccggcgaggacccggcggtggccagcaagtacgccgtcgccttcgtccggggcatccaggggagcaaccccgccggcgcggcggccgcgccgctccaggcctccgcttgctgcaagcacgccacggcctacgacctcgaggactggaacggcgtggcgcgctataacttcgacgcccgggtgacgctgcaggacctggccgacacgttcaacccgccgttccagagctgcgtcgtcgacggcaaggccagctgcgtcatgtgcgcctacactgtgatcaacggcgtccccgcctgcgccagctcagacctgctcaccaagacgttccgaggcgcctggggcctcgacggctacgtgtcctccgactgcgacgccgtggccatcatgcgtgatgcgcagcggtacgagcccacgccggaggacaccgtcgccgtcgccctcaaggctggtaagttaaacatccggccggtgctggccggggaacgttttactagtactagtctttttagaggaccccgccgccgtcgccctccaggctggtctggacctgaactgcgggacgtacacccagcagcacggcatggccgccatccagcaggggaagatgacggagaaggacgtggacaaggccctcaccaacctcttcgccgtgcggatgcggctcggccacttcgacggcgacccgcgcggcaacgcgctgtacggccgtctcggagcagcggacgtgtgcaccgctgaccacaagaacctcgccctcgaggcggcgcaggacggtatcgtccttctcaagaacgacgcgggcatcctcccactcgaccgctccgcggtgggctccgcggccgtgatcgggcacaacgccaacgacccgctcgtgctaagcggaaactactttggccccgcgtgcgagaccaccacgccactcgaggggctgcagagctatgtcaggaacgtgaggttcttggccggctgcagctccgcggcctgcggctacgccgcgacgggccaggcggccgcgctggcgagctcggcggagtacgtgttcctgttcatggggctgagccaggatcaagagaaggaagggctggacaggacgagcctgctgctccctggcaagcagcagagcctggtcaccgccgttgccagcgcggcgaagcggccggtggtccttgtgctgctcacgggcggccccgtggacatcacgttcgcgcagtcgaaccccaagatcggcgcaatcttgtgggcaggctacccgggccaggcaggagggcttgccatcgctagagtcctcttcggcgaccacaaccccagcggcaggctgcccgtgacgtggtacacggaggacttcactaaggtgcccatgacggacatgcgaatgcgtgccgatccggccaccggataccccggcaggacctaccgtttctaccggggcaagaccatctacaagttcggatacggcctcagctactccaaattctcacgccagctagtcacaggcgacaagaacctggcccctaatacgagcctacttgcccacctttccgcgaagacccagcatgccgccacgagctattatcacgtccatgacatcggcacggtcgggtgtgagcagctcaagttcccggcggaggtcgaggtgctgaaccacggtccgatggacgggaagcactcggtgctaatgttcctccggtggcccaatgcgacggatggacggccggtgaggcaactgatagggttcaggagccagcacatcaaggctggggagaaggccaacgtcaggttccatgtcagtccgtgcgaacacttcagtcggacgagggcggacggcaagaaggtgatcgacagagggtctcatttcctcatggttggcaaggaggagttggagatcagctttgaagcctgatgccgtaacaggaaaagcgttacaatttacaggtgtcgccgggaaagttggtaacttcagcatacaacacaagaagtcaagtaatttataattcattcatatttgcctcttcaaaatgttggggcttttacatgtgatttattattaagcatatttatctatcaaatgtaatcatgtgttaggcgtagaatacaaaaaaaaaaaaaaaaggaccatggtggtccctaaaatcgcgctcctggatgagttctcttaacagaagtgggggatgtgcacatgtggtgcgacgtttactcgagaaacagaatattagcgtctttttggacaatcactaaacaaaccataaggtcagcgtgcggcacgtcgacaggccacccaaagcccctagtcgatatagagtcgaagaaaggcaaaaattggagattgagaaactacaattagggctaaaactacttctaaggctaatgcatatggcgaataagataaattgatatttgagttcaattgatggatcattcaatcgggtgtaaccctagggagggagccttggacccgttccaagatagaacccaacaaaatcccgtgagatattaggataacc

SEQ ID NO: 22590 - DNA, 1129 bp, Zea mays
  misc_feature (1032)..(1033): n is a, c, g, or t
  misc_feature (1074)..(1074): n is a, c, g, or t
gcacgagaccattacctagaacatcctaatcgaaaaatgtagctaaatgatttatatcactgggagtaaggatatataatcaattagcagataatcggccttcctgtccagctctgcttggcggacagtcatgccggtggagggaaggaagaagggcgtgccggcgctggggtggtggctaatgctggtcggctccctccgcctcgcctccgtctggttcggcttctttgacatctgggcgctccgcgtcgccgtcttctcccagacggacatgactgatgttcatggccgtacttttggtgtctggactcttctgacctgcacgttgtgcttcctctgtgcactgaacctggaaaataggcctctgtatctggccaccttcctatcatttgtctacgctcttggccatttcctcacagagtacttgatatatcacaccatggctgcagcaaatctgagcacagttggcttctttgcaggaacgtcaatcatatggatgcttcttcagtggaattatcatgtgaatccccatggtgcccaagctgtgaagcagtcatgattgatgcttgggctgttagctttatgtggtccagggggaggaaggataccttagaaactgtcagaaaagctcatttcatacttcatttttcatcatgttattttgttgcatgagacatttgtccaactgagtagggaatgaaaattcaaattatttctgccactgattgggggatggaattccaaacattgtaaaaggcgactgtatctagtatgcaggaggcttaacatcgaatttgtgaatattcaggcataccacctgttgagagctgagatacggtagggatatcttcagcaactcttctatcacatctcctatttcaaattctactctataaacaatgttgtctaagtggaaaacagtgttttgtatgatcacacatgatctgttggacacaaccttaaggacaaccttagagagctatatccattttatcaaggtccttctagtcttccttatattttttgccttgnntgatggtgctgcatgttttgttcatgaaataccctgtacgntagcacatcacggtcaatattattcttggcagctttggaggagcattcgtcatgc

SEQ ID NO: 22591 - DNA, 1728 bp, Zea mays
cggcccagcccaacatgccgacgtattcctcacgatctctcgcttcctgggctagccaggagcccggtagcccactagccgcccgcatcgcgcgccggcccgcacgacagcgccgccgtcacgccctccacgccggcagaggctgccggcgacggtggggggtgacttcctctccccctacccttccgatctctttccctctgcgaattgttctattaggtttggtacattctgttcccttgctcaaatctctgtctctggccccgcggggattaaaacgtgaaccaccagccaccatttcatacgatctcatcacacttcttagttaccacatctccagcgaccttcctcgggggtgctagccggatccgcgctcgtcgaaatcccaagctcctccacaggcccgagggtcggtcgtcctcatggcggggatcctggcgtgggcggctgacgtggtcggcggggccggcggcagcgacgacgaggcggacgacgacgcgcgcgccgcggcgtcggccgccatgaccccggcccagcggctccgcgccgccgacctggacgcgcgggcggcttcgctgcgccgcgccatccaggacctccgcctccgggtgcccccgccgcacgtcgcgcagcgcctgccccacctccacgccgactcactcgcgtcgtccgccgcgctcgcgctccagctcaacgcgcactcctccaccaaggagcagacccaacaaagagaagtaactctccaagaagaaaatgcagcctatgagaaagctatatcagagtgtaaacagaaaattcaggaaaagcagatggaggccactcagcttctgagtaatctggaggaaatggaagtaacagagcataatttaaagacacagcttgaaaatgctctgaaggagctagaggctgctcaacataaagcatcaacagcaacctctggaacagctgaaaatgctctactggaagctaagtcagtgactgaccttaaatctaaagatttggaggagaagaaaagggagcttgaactattggataacaaggtgcaaacattagagaaagagtggtctgtggttgaagaagaatctttaaagaaacccactcctgcacaaagggagaaggtcctggagaggcaactgcatagcctcatcgagcagttgacagctaagcaagctcaagctgaaattctggccactgatgtgcattccaaagaaaaggagctggaacggctgaaccatctgcatagaaacctctacggcggtgccaacgaaactggcgcaccccggagccgcctcagcagaggcctcttgagcggccctgaagattactattacgaccctaaagcgggccggaaaccgtaccaggctggcgttagaacagaaggccagaaccggctgatgatccttaggtccgcaattgtactgtatgttctgctgctccatgtcatcgttttcataaagatatcagtctgaaagcagttgagctagcgcttcataagttcgtatagggaaacagatacttgcttttgtgttccaaaccatgcaaacgtttcttgttgtaaataactttgtatgtgagtatgtatctcgtttgatggatctataggagagttatatgaaatacctgttgtcatattttggtactctttctcctgtgcttttgtaaaaacttcatttgaatgagataagaatccatgagtactgtagccccctgcggcggccgccgcctatt

SEQ ID NO: 22592 - DNA, 1541 bp, Zea mays
acagcggcatcaccagctacagctagcatagcaaggaccacgacgtgccgacggcagagaagcgcaactcaactcgtcgggcttcctttgtcccgttctttgaggcgcaaaggaaaaaccaagcaagagggagaaggctacctaacctagctagctaaggacgagcaatggaggtggccgcagcagcgagctacagctactacggcttggaggcggccgacgacgacgtcgacaacctcagggccacgcagctcaggctcggcctgccgggcacggaggcggcggcggcggcggcggcggccccgcaggcccaggagccccggcaggcccagaaggtggcggcgccgccgtccacgcccaggggcaagaagcgcgacggcgtcagcggcgtgaccgaccccgcgccgccggccgccaaggctcaggtggtggggtggccgccggtgaggtcgtacaggaagagctgcttcctgcagcaggcggcggcggcggcgggtgccaagggcaagccagcggcggcggcgccggcgctggcgaagggtgctccgggtccggcgggcggcggggtgttcgtgaaggtgagcatggacggcgcgccctacctgaggaaggtggacctcggcacgtgcgggggctaccgccagctgcgggaggcgctggaggccatgttcctctgcttctccgggccgggctcgggcgacgcgtccggcggcggcggcggcggcagcccctccgacttcgccgtcacctacgaggacaaggacggcgacctcatgctcgtcggcgacgtgcccttcggcatgttcatcggcacctgcaagcggctgagaatcatgaaggggtctgaggccagactaggcctcgggtcagccaagaacaacgactgagggagagggagacgacgaccattgtgcaggcccgaccgagatccacgcacacggcggcgcggcgcggcgcggcttgtgcacgcgtaagcgggggattgttgtgcgtccactccgaggcatggggtagtatgggcttgtgttgtaccatccccacctcgtctgccatcaatggagcagcaagatagaaaagctgcttggaacaggagaagatgaagctgcttgcttggattggaacgagggggcggagatggagagagatagaaaagctttagagggtgtttggtttctacatactaatttttagtccctacattttattccactttagttacaaaattatcaaatatagaaactaaaactctattttagtttctatatttatcaatttatatactaaaatggaacaaaatgaaggaactaaacattagtccctagaaaccaaacacctccttaatttgtgcatccaaccaagtggagtggagtggaatgatgtgtggtcgctttgttcttttgtttttttaattattttgtggtactactagtaggaggggtgttagcaacacaaaaggagtggagtggagttgagagtggaattgaatctccatgcacgcgtgtctgtacaaaagctaaagatcactcttctttccctgtctt

SEQ ID NO: 22593 - DNA, 619 bp, Zea mays
cgaggacaaggacggcgacctcatgctcgtcggcgtcgtgccccgcagcatgttcatcggcacctgcaagcggctgaggatcatgaaggggtctgaggccagactaggcctcgggtcagccaagaacaacgactgagggagagggagacgacgaccattgtgcagacccgaccgagatccacgcacacggcggcttgtgcacgcgtgagcgggggattgttgtgcgtccgaggcatggggtagtatgggcttgtgttgtaccatcccctcctcgtctgccatcaatgagaagatgaagctgcttgcttggattggaacgaggggacggagatggagagagatagaaaagctttaatttgtgcatccaaccaagtggagtggagtggaatgatgtgtggtcgctttgttcttttgtttttttttttattttgtggtactagtagggggtgttagcaacacaaaaggagtggagttgaatctccatgcacgcgtgtctgtacaaaagctaaagatcactcttctttccctgtcttaagttacatatctctattacttattaagttagcaatagtagcctgcctttttgtgttctgtcaaaaaaaaaaaaaaaaaaccgatt

SEQ ID NO: 22594 - DNA, 1423 bp, Zea mays
ccggccgggacagcgccaagggcaccaccagcaaggaccaagacagagcacagcgcagctcgtcggcctctcgacgccggttgctgcaaccaccgcctttattgcccacgcgggccgtgcggaagaagcaagaagacacgccaatggaggtcgccgcagcatcggcagcgggctacggattcaaggccgacgacgacgttgacagcctcagggcgacggagctcaggcttggcctgccgggcacggaggaggaggaggccgaggagtcccagaacaaggcgccgccgccgccgccgtcgacgcccagaggcaagaagcgcgacgtcgtcgccagcagcgggcccgaggatgcgcccaagaagcgcgactgcgagaccgacaccgatgccgcgccgccgccggccgccaaggctcagctggtgggatggccgccggtgaggtcgtacaggaagagctgcttccagcagcaggcggcggccaagaacaagccggcggcagcgctggcggaggaggccccggccgccggcgggctgttcgtgaaggtgagcatggacggcgccccctacctcaggaaggtggacctaaagatgtacaagggctaccgcgagctgcgggaggcgctggaggccatgttcctctgcttctccggcgccggcgccgccgacgcgcccgccgtcaacccctccgacttcgccgtcacctacgaggacaaggacggcgacctcatgctcgtcggcgacgtgcccttcggcatgttcatcagcacctgcaagaggctgaggatcatgaaagggtctgaagcgagagggctcggctcggccaagaacaactgatgatgaggcgtctatcgcatgcttgtgctgtgcgtgcgtgcatgcgccagcaaattcttttgttcttttggggtcttatttcttctccaaggcgtccctgcatgggtgtgggcgtgtggtgttgagtattatgtaccttctcccctagcattgtctgtgccaacaatggagcagcagctagcagcaaaccagagacatggcgaggcgaaagatgaagctgcttgcttggaaggagagagagagagagagagagagagagagagagagagagagagggaagctttgtgcatgcgtggaatgatgtgtggtcgctttgttctttttcttttgtgccccttgtaggggtgtgtgtgtgtgtgtttagcaagacatgcaaaaggagtggagagtcgagttgaatctccatgatgcgtggttgtacaaagccaaagatcactcttctttcttgtctatcagtctattgtctatctatcgatcagcagcctggtcgttgcttctgtaattgcgagtgttgaaattgcaggggaggaattgttttcctctctgtccctggtgagcggccaaaaaaaaaaaaaaaaaaaaaaaaaaag

SEQ ID NO: 22595 - DNA, 854 bp, Zea mays
  misc_feature (18)..(18): n is a, c, g, or t
  misc_feature (22)..(22): n is a, c, g, or t
agttatatgtatcatgancagnctccatgcaataagaccacaagcaccaatggttttccgctaccgttttggcctcaggatcacaattggtaaagtcagtcgctttacttttatctcttagctgtgcatcattacgactcttgacatacctcctatgattctggtaaaagtcatccagctgataatacacaaaaatcggctgcttcatatcctttgtaatcgtcagattccttgtgcagctttttggtatactatcattccggatgtaagcaagcttgtcagtcacaccagcagggacacatgcatcatcataccgatcaacgatctcgacaacctgtcgtgaagcttgcagcgaaacaataccaatcgggacaaaaatcacgccaacaagaacgaatactgaaataacccattttggagtaagaatcggcttgcaagctggaagctcctgctgagtaaacttggaatacttgggcttcctggagctcctcctgggctgcgcgccgccatccccggacccgccggagctcgacccggcggcgtggctatccatcccaccagccgccaagaaaatagcctctacctgccgcccaaacagacctcgggaaaatcaccggccgccggcagcaagaggcaaaggaagcacaacggaaagaacggcgtccccggactccgctgcctcgagatctggtgacggggggaacgaaggcgaggcggggaaagaagcagaagaacacggaaagctgggacctttctgctcctcttgcccaaggttacaaggagagggccggtttgactatacaagaggagggtggccgtggtggtgactggtcccggccgggatgttctaggta

SEQ ID NO: 22596 - DNA, 3755 bp, Zea mays
  misc_feature (3755)..(3755): n is a, c, g, or t
atccacctgcaagcaagagactctgcagccatctgggcgaaaactcaagcacgcggcgatgctgcgccttcgcgcttgcggcggcacggcaccggcatcggtgcccgcgctcgtcaggtcccgcctctccaggagatcctcctccacagcctacgccgccgctaccgtcgcttccgcttcctcctcttcgtccaccctggaagacctcgccgccgagcacagaggtttggcaaaggtcattttaaagaaggggaagacccaaatattccgagatgggagcccaatggtgtatagcggtgctgttgataggataattggtcgacctcctccgaaatctggcgatattgttctagtagctgatggaacagagaaacctattggatggggtctctataactctgtgtctatgttttgtgttcgtttgatgcagctagaagaagaggcaagaagagatcccacatgcgcacttaatatggaaagactgcttgaagcaaggatttcatctgctgttggtttgcggcgcagtttgggtctcccttcaactgacacaaatgcttatcgcctcatcaacagtgaaggggacagattatctggtctaatagtggacatctttgctgatgttgctgttattgcttcatctgctgcttgggttgagaaatataggcaagaaatacaatttcttgttagcacagttaatggcgtcagccctataaagtggaggccatcgacagatattttgaaagaagaaggattggatatatcagagcataaggagcctgcttcaccatgctcaactgttaaggtcatggagaatggcattatctacttagtctcattagaaggtcagaagacagggttttatgcagatcaacgcgaaaaccgctatatcatatcattactttcaaaggatcaaagagtccttgacctttgctgctacagtggcggctttgctcttaatgcagctaagggtggcgctgataatgtcattggcattgattcatcaggatcagcactagaccttgccaatgagaatattgttctcaatgagctaaaccaaggaaaagtctcatttgtaaaaggagatgcaactacattcatgaaaggagctatctcagaaaatgagctatgggacttggtaatccttgaccctccaaagttggcgccacgaaagaaggtgctacaaagtgcatccggtatgtatagaagcttgaacgcacttgcaatgcaagtggtgaagccaggggggttactcatgacatgctcttgttctggagctatgacccaaagtggcatgttcctcaaaaccattcagggtgccgcatcaatggctggccgtaaggttacggtcttacgtcaagctggggcagcatgtgatcaccctatcgaccccgcataccctgagggccagtatctcagcaattacttgctgcgtgtggcatgaaagttatgagttcaaagcagaggcaagtttgtagttgttgcagcgcgcctgacaaaccttcgacgactgatcgcttctgaagagctcaagttcatctcatagcttaggggttgtttggtttctagagactaatttttagtccctacattttattccactttagttacaaaattatcaaatatagaaactaaaactctattttagtttctatatttgtcaatttatatactaaaatggaacaaaatgaagggactaaacattagtccctagaaaccaaacacccctttagtcatgtaggttagatttaattcttttacgaagaagagcaaagcatcgaaactgacattaacttctgattatacaattttggagaacataaaactatttgtttcagtttaatgtacaatctgtgcaaggatggatccaaagttgtcgcacgtatacacatgcctactctgtatgtattctacaccaatgctcatgaataaaaattcgatgtggtacaagatacatctgaaccataaatgaatttgttgtccgtgtaaacatttaacttcaaaaccatatcagcgacctaaagtgggtctgttccatgacaagtagttgttatctcccattttccttggttttatcaagtatagcaaggtgaatgcaaatgccaaaacgaagcagattccaccaacagtgagatatgcaaggcccagaaaatcgttctttccaccaatccaggttgcagtagaaagcaccagcttcttcttgccactgaagctataggtgttgtagttgttctccaactgaactgtaattgtatcgttttccttgagatcaacatgtatcctaccatacagctttctgaatgttggaagcgctgcagtccgcatccaaacaataaggtcctcttgttcactcaacgggatttttggattaagtatttttccaccttgaagaggtcctttctggaagttcgtggggaagacatcactcccaaacttgtggtctctgtcactcttccaagagatgtctttcttgtccactctcaaggttttattgttgtggatgagggtatatgtatcattgaacaggctccatgcaataagaccgcaaggcaccattggccccgtccatctactgttttggcctcgggatcacaattggtagtgtcactcgccttacttttatctcttagttgtgcgtcgttacggctcttgacatacctgaatgtgattaatgtttcagttaagtaggaaaaaaatacatcttaaagagcaagaagacttctcactgacaaagtttaaaacaatgagagagagagagcattggctaaaggttacatacctcctatgattctggtaaaagttatccagctgataatatacaaaaatcggttgtttcatatcctttgtaatctgaagaccatgtgatcaaatatttcagccaattattcatttgatcttatgccaagatgcatacttgtaaagtaactgacatgtatactgtcgctagtcaatgttgtttctactatagtttttccattcccaaaatttcaggttagaagaatacatcggtagtttcatttccttggtaatcgtcagatttcttgtgcaggtttttggtatactatcattctggatgtaagcaagcttctcagtgacattagcagggatgcatgcgtcatcataccgatcaacgatctcgacaacttgatgtgaagctcgcagcgaaacaataccgatcgggacaaaaatcacaccaacaagaacaaatactgaaataacccattttggagtaagaatcggcttgcaagctggaagctcctgctgcgtaaacttggaatacttgggcttcctggagttcctcctgggctgcgcggcgccatccccggatccgacggaactcgacacagcggcgtggctatccattccaccagccgccaagaaacgatcgcctctacctacctctacctgccgcccaaacggacctcgccaaatcgccggcggccggcagcaagaacccaaggaagcacaacgaaaggaacggcgtcgctggctccgctgcctcgcgatttggtggcgggcggaacgaaggcgaggtggggaaagaagtagaagtgtagaacccagaaggagacgggaaaaagctgcgtccttgccggtgtgccccttctgcgaaggtttgtggaaggaggggggtggtttgactatagaagaggaggagagagggggaggtgggcgtggtggtggactggtggtggtcgtgctacccgcgttgaggttgagccggcggagatgaccaactcaccctcgcccgcccgagn

SEQ ID NO: 22597 - DNA, 2168 bp, Zea mays
attgtgttgggctatctcagaaaatgagctatgggacttggtaatccttgaccctccaaagttggcgccacgaaagaaggtgctacaaagtgcatccggtatgtatagaagcttgaacgcacttgcaatgcaagtggtgaagccaggggggttactcatgacatgctcttgttctggagctatgacccaaagtggcatgttcctcaaaaccattcagggtgccgcatcaatggctggccgtaaggttacggtcttacgtcaagctggggcagcatgtgatcaccctatcgaccccgcataccctgagggccagtatctcagcaattacttgctgcgtgtggcatgaaagttatgagttcaaagcagaggcaagtttgtagttgttgcagcgcgcctgacaaaccttcgacgactgatcacttctgaagagctcaagttcatctcataccttagtcatgtaggttagatttaattcttttaaagaagaagagcaaagcatcgaaactgacattaacttctgattatacaattttggagaacataaagctatctgtttcagtttaatgtacaatctgtgcaaggatggatccaaagttgtcgcacgtatacacatgcctactctgtatgtattctacaccaatgctcatgaataaaaattcgatgtggtacaagatacatctgaaccataaatgaatttgttgtccgtgtaacatttaacttcaaaaccatatcagcgacctaaagtgggtctgttccatgacaagtagttgttatctcccattttcctgtgagtgaccagaagaaaatcacatcagtacttcaacgcagcaagaagtgaggcaaccagatatgtcctgtggcatgttgatattgatgtaactgcaatctatgagaactagaaaaccactaaccttggttttatcaagtatagcaaggtgaatgcaaatgccaaaacgaagcagattccaccaacagtgagatatgcaaggcccagaaaatcgttctttccaccaatccaggttgcagtagaaagcaccagcttcttcttgccactgaagctataggtgttgtagttgttctccaactgaactgtaattgtatcgttttccttgagatcaacatatatcctaccatacagctttctgaatgttggaagcgctgcagtccgcatccaaacaataaggtcctcttgttcactcaactgctcagaagaaaaccgagttagggacatcagaggcgaaaggtaccctaaatgattgaaaagggattatcttaatcaatctacttgataactaccgtatgctaaaagcatagtttccctatgatgtgcccaccgtttatgcaaataaatggatgatacagagcaagatccatgaccataccgggatttttggattaagtatttttccaccttgaagaggtcctttctggaagttcgtggggaagacatcactcccaaacttgtggtctctgtcactcttccaagagatgtctttcttgtccactctcaaggttttattgttgtggatgagggtatatgtatcattgaacaggctccatgcaataagaccgcaaggcacaattggctttccatctactgttttggcctcgggatcacaattggtagtgtcactcgccttacttttatctcttagttgtgcgtcgttacggctcttgacatacctgaatgtgattaatgtttcagttaagtaggaaaaaaatacatcttaaagagcaagaagacttctcactgacaaagtttaaaacaatgagagagagagagcattggctaaaggttacatacctcctatgattctggtaaaagttatccagctgataatatacaaaaatcggttgtttcatatcctttgtaatctgaagaccatgtgatcaaatatttcagccaattattcatttgatcttatgccaagatgcatacttgtaaagtaactgacatgtatactgtcgctagtcaatgttgtttctactatagtttttccattcccaaaatttcaggttagaagaatacatctagataatttcattaccgtcagatttcttgtgcaggtttttggtatactatcattctggatgtaagcaagcttctcagtgacattagcagggatgcatgcgtcatcataccgatcaacgatctcgacaacctgcag

SEQ ID NO: 22598 - DNA, 1704 bp, Zea mays
ggccgctttttttttttttgcttcgaaactgacattaacttctgattatacaattttggagaacataaagctatctgtttcagtttaatgtacaatctgtgcaaggatggatccaaagttgtcgcacgtatacacatgcctactctgtatgtattctacaccaatgctcatgaataaaaattcgatgtggtacaagatacatctgaaccataaatgaatttgttgtccgtgtaaacatttaacttcaaaaccatatcagcgacctaaagtgggtctgttccatgacaagtagttgttatctcccattttccttggttttatcaagtatagcaaggtgaatgcaaatgccaaaacgaagcagattccaccaacagtgagatatgcaaggcccagaaaatcgttctttccaccaatccaggttgcagtagaaagcaccagcttcttcttgccactgaagctataggtgttgtagttgttctccaactgaactgtaattgtatcgttttccttgagatcaacatgtatcctaccatacagctttctgaatgttggaagcgctgcagtccgcatccaaacaataaggtcctcttgttcactcaacgggatttttggattaagtatttttccaccttgaagaggtcctttctggaagttcgtggggaagacatcactcccaaacttgtggtctctgtcactcttccaagagatgtctttcttgtccactctcaaggttttattgttgtggatgagggtatatgtatcattgaacaggctccatgcaataagaccgcaaggcacaattggctttccatctactgttttggcctcgggatcacaattggtagtgtcactcgccttacttttatctcttagttgtgcgtcgttacggctcttgacatacctcctatgattctggtaaaagttatccagctgataatatacaaaaatcggttgtttcatatcctttgtaatcgtcagatttcttgtgcaggtttttggtatactatcattctggatgtaagcaagcttctcagtgacattagcagggatgcatgcgtcatcataccgatcaacgatctcgacaacttgatgtgaagctcgcagcgaaacaataccgatcgggacaaaaatcacaccaacaagaacaaatactgaaataacccattttggagtaagaatcggcttgcaagctggaagctcctgctgcgtaaacttggaatacttgggcttcctggagttcctcctgggctgcgcggcgccatccccggatccgacggaactcgacacagcggcgtggctatccattccaccagccgccaagaaacgatcgcctctacctacctctacctgccgcccaaacggacctcgccaaatcgccggcggccggcagcaagaacccaaggaagcacaacgaaaggaacggcgtcgctggctccgctgcctcgcgatttggtggcgggcggaacgaaggcgaggtggggaaagaagtagaagtgtagaacccagaaggagacgggaaaaagctgcgtccttgccggtgtgccccttctgcgaaggtttccgggccggggggggtggtttgactatagaagaggaggagagagggggaggtgggcgtggtggtggactggtggtggtcgtcccgcccgccccctcgtggagccggcggagatgaccaactgaccaaggcaagggaggaccaga

SEQ ID NO: 22599 - DNA, 2069 bp, Zea mays
  misc_feature (2016)..(2018): n is a, c, g, or t
atttttaggatgggagggcctactagatctaggaagcctagcggtagagaattttataataataaccgacgcgactttttctttttgttttctggcggcgtggtgttctttttcactgagaagagaataagggagatcaaacggggccgtggaaaaaggggggttagttttattcgactggcttcgcgtgcgccgatcttctatttagcacgcgacaggagcatctcgttgctcgattcggttttcttcgtgaattcgcccccagcgagccgagctagaattggaattggaactggacttgcggctgctgcgttcggcgggggctggaattctcgccgcatccccgtgtggtggtgagaggccgtggctcgtgttgcggtcgacgcgcgaggagggtcgacggcctcgcgccattggggtacgaagccggccgagactgagcggccgctgatcctggtttgagcgcctcgggttcctcttggatttggttggcgtttttatgggcgggtagatcggtccggtgatttctcagctgctatcggtgcgatggcagctgactccagcatggggtttcaccaggggatcaccgcctctctgtacaaccatcacatgctctcgttccagtccaacagcgacgtcggcatcggcggcggcgacgacgctaccggtggcatggtcatggccccggggagtgtgagtgggggcagtggcaacgccgggctgttcctctccccaaacacaggggtcgtcggcaacgcaccgggggttgccccgttaatgaactcgtcgggggatgcgttccgtggcactgggacgcccaagtataagtatgtcactggttctccttccgattggagtgaccgtgaggtagacatactgaatgaagggcttgtgagatatgctcgtgaacctagtatcatgaggtacattaagatagcagctatgcttcctaacagaaccatcagggatgttgcgctgcgatgctgctgggctacacagggtaaagagagaaggaagaaacctgatggattctacacagggaaaaaaatgagagacgtgaagccaatccaggacaaaatggttgcatcagtcccaatagctaattttcacatgacacctacaaccaatgtaatccccttttcggtatcaacgcagcatccaaatcaacaaagtcaggttcccaaagaagctcctgttgtcgacagtgcaacccagcgtctcctggaggaaaataatcagttgcttaaccagatttctgcaaataatgaaacattcaagacagtggagaacacagatctttttctccgcacgagtaacaacatcaaaacaattttaagcagaatgagcgaaacgcctggtatcatgagtcagatgcccccattgcctttatccataaacgaagaccatataaattctcttattcaactgaacagactggttgcatcatatggcacaacaagcatttcccatcatacgaagcaagagccatgaagctagtctactaaacccagggaaaaatgagaggaccagatggccggacccctcctgcaattctgtaaacgtgctgctgaggaagtcttgcatgttatactaaccaagtgccaggaacagtcactgctttccagataatgttttcgcagtgacctgattgtttccaacccgtctgccagcctgcctgcccaccaattcttgaagcatttggaagaagtctgcagttgtggttcgagagccgcaagctatttgctgctgtttctgtttccgttatccagcatgtagaccagagtatcagacagtggatcctggtctctgcaaatgacctgtaaatatcggacggctgctggcgttccatgttttgtttctctgatcgctcatgaatgtatttcttcttttctcccccacccccggtcaccggacagggttgcattgctcccaatatgtaactgtatacagtagcgactccattttctgactaattggacacggaaacccaaaaaaaaaaaaaaaaaaggcccctannncccgtacccaattgcctatggagcgattcattcactgccgcgttacaacgc

SEQ ID NO: 22600 - DNA, 5793 bp, Zea mays
  misc_feature (841)..(841): n is a, c, g, or t
  misc_feature (950)..(950): n is a, c, g, or t
tgactaaattgattaaaagtaaacacatagtaaagcaacgattaaaagactcctcggtattttaccaaaggcgaaatggtctctatccgagttggttaggtggtctgagtagcactcctcaggtcctcagtttgactccttatgggagcgaattacaaccgtgttgcaatagggagttgagtggttttcccccctcttatttacaaccgtgttgcaatagggagttgagtggttttccatttaaccactatttctggcacttgcacataggattaatttgagtggcaccttatagtaaatgcacatggcagttaatttacaacttcttgcaaatcattcaaacccaaaggttcagttttagtacgtaatcctgagcctgaatgcttaccacatttcttataatttcctggtattatttttggtactctaatctccccataatgtctagaaaacctcatgattcaagctagtgtagggccataaatagattattacaaagagattctaaatacttaatgatcgacgaaaaaatgaattctcacatagatccccaattttctgtgtgcccatacatgtaagctacaatggtgagattgggaaaacatacccaatatatgcgtgggaaatcttttatggattctcacgtactaaaatcatagggaaacttgcacgtgcagtaccaagacaaacattcatcatatcattttgaataccaagacaaacattatggatatcattttgaataccaagacaaacattcatcactataagcacatttgataaattcagtagtgtagaggctaatgtgctcaagcttgagacattattacttaatggtctngtgttgtcagaatgacacgctttaggtcatcaaatagatgcaccatagaagcatattatatcatataaatatgatgtcaataataatgagattacgcatgagcttgaanatatcacaacatcaataaatatgatgtcaataataatgagattatatcaaatctcaaagtggatcatttgaatattactcgaaagtaaatcatctaacaaaatgatcttcacgtaaaaagagaaatggtgttatgtgattcagtatgaaccatgatttaaaccaccaaccaccggtatcatgttagattgaaggttgaagtacaattcatatcttagctttcatgagcactttcttttaaatttggcaaatgatgcccaagcatgatagttgaggccatcaaggatgagttcttcaaactctttgggcccttgacaaccattcaccacttcgcgaaacatagtaaaacatgcagcactcaagcaatatggtattggtaacagtaacacacttatatttgatacatatatggtcacactagtgaccttaataaaagtatgacagcagattttgacgaccagatgtatccaagtgaaagcctgaaaggggatccaggggattcaacaggaggcaggcggcggcggcgggtaccgcggtacataaggaagaagcggagctccatgctcaattggacctggcctgatcgtggctttggagcttgggctcgggtcaacgggttggtagtcgtccgtcctgacattttccaggccccttgtctttcggatggtaaaagtatatcgttcctgaaaatgatacatggaaagtcacttaagaacttgatggaaataggtggtagccgtctctaggtaaaaagatactactgtcaaaaagaattaattactgataaggcaaacactagccactgaggtaatatatttcagttaactaaatggactctcttctggccgtgtatatgcttctgccgatgtgtgcgatacgctgttcgagagcacacaacataccttcagtttcctgtcgtttagatctatgcttccatgtcctggatctacaaggaattcagctaaatgtcagcaataggcccacgggccatatataccccaactcctaaatataatctcgccaattgctcaataaaaagatgctgacagaaagaaaaaaaagcagactaaccaatcatacataccacgcctacaattgtcggacgtgtgtacggttacatcgcattctgtaaaaagctagtaggttttccttcaccaaataggagagagagagagagagagagagagaactgtcggaagtacggtgaaacggttgtgcaccaggtagagtactcaatcaattaagaggtgcacgtattctaggattaaagttccataatctttgatcaataggtagcaaaaaatttcgtagagtacagatttagtgagattggatctgatttgacgtcaataatgccatggtcatgaacaacataatacacgaggtatcgatagttaaggtgtactactagcattattgaaaactgcgctgggccaaatcacatcctactttttgaaaaaaaagacaggcaccaagtcctttttttcgtgcatatatacatgtaggtttgttgtgtaatgtttgctcagtaaatagaaattgttaaagtgaactgctgaggatatccaccactcgtggaaccgtaaatttctacttaaaaaatatttcatcctgattccctagcataggcatttggcgtcgcccagtgcgggcagcctgaagcaattttattgcaacgtacatgtatacaggcgtgtactacgatttattaaaaaaacactacagggctcgtgggggtagcttttggagacctttttccagtggtatatttttgcttgaagagaaaaccactcaaaagagaaggaaagaactagcctttgtctatacgagctatcaatatcagccgatgatttggtcgttatcttcttttctttttagtcctgagtacaatatcggatctcatttaaactttcagcactatatcatgaacgcagggtcgcagggcgagataattgctcaagctacaagcctggaattatcagtcacggcttggctccagaaaactggcgagaaagaagaaaaagaacaggaggtgcacgaagaaagtgataaggggcaaaaacaggaaccgaccggtacggtgtacctgtgttcttgatgcttcttgcgttagaggcgatgcccacgagcagatttcctccagcaaatgcaaatatcagcaaaatcagcacagatggacgctccatctcctaccactatgcaagcagcaagcacaatcccttcaagacttgtgaaatgcttctacggctatgcttcgtttcctttggcttcctgcagctcctcttcttaagatagggagacgtccctgcgtgatgcgcctccattagcattactgctagatgtcagcatgcggattttaaaaaaatgatgtgataagacgggagaatttatgtcatcgtcaacaacgaggagctgcagaaaaatggcctggaaaaacgaggaaggtggcctccatgcattcctgccatcgcccggcacttgctcgcattgatggccatgctgcctgcctgcaggtgttgctcctcactttctaatttcggctgtcgcattcctttttttacccattaccaattactaatttcggcagttgtagatacggatggatcctaaatatccaaattatatcatagatttatctggtgtttgatttaaagaatcactacatccaatacatccaaattaagataatgcatcataggttcattcatcaaatttggtgggatgacctaattcctcatattagtactaactaattaactatgaggaatgaggtggtgatggatcaactcattccattccacaaaccaaacaaaaatagtgaggagtgagaagatgatagactagctcattcctcaaaccaaacaccctattaatttttaacatagttgtgcgtaaaattagatgttgatctttaatcatgttgttaaacatattataaagaccagaataaaattttgtataatttttatgcattattttctctcaacaacaaaaaaaagttgaaaatttaaatctgtatccaaattttatgccgattatttaaaaaagatataaaacgaatttaaagcttattttttatgaataaactcaatgctaaaaacaagaatataaatttatatagctatcatatttattcgcaattgaaaaaagatcagatatttaacatcctaataagtatatggatccatcctagtagaagtgtcatcagcatcttgttttccagaattctatatagaaaggagtacacttctgactcctgtgatacagaaatttaagtattagaaaggacgacacatctccctcccctcgaaaggggagtacacttctgactcctgtgatattataaaaaaactgctcagacataagacggttgcacaaaaatgaaaatctgcacggactggtatgggttatggaagagtcgtcagacatcagactaggcatagacaagtacaaatatcacgagacattcatatcttttactaccaacggtccaacgccaaagatacagaagcatatggacgccctgctatgtcagcacggagtcctgaattctctttcttatctccctggtattgctcaagtgctcatcaatgagtggtattgaaatgaaatcatctacgggtagaaagttcaagcgatttcttggccatgtcatcggtttggcatgatgtcgatgctgccttctagatcacacgagcgctcaggacaatccagtttaccccaacgtgcagttactctttggcagggaaatattggcttcccaaggctgcaagaaaaaacacagaccgatcagataggaaatacataagaacaagctcgtcaggggattccagaagctcaagattctgcaaatcatggtattagaatggaaacatccacacttatgaacatatactgacataccccttattgtaggagtaaaagggtgtgcctcagttttcctctttttggccctgagaccttacttttcctatgattctatataaacatattcaacacttgcaatgccttagaggatttcaaaggcaacaataaacaactgcacaaagttggctgtatggactcaccttcgattaaccacgttatggacataacataaccactgggagaaatcagcctgagatcctgcctgcacaggatttgctctacagaagtacaacacagttaagtcagtttagttttcaagaattattgctatcactgaactatgatatattcagcctgatgaatgagagggctgtcctctacataaactttcagataaccaaaagttagataaaataacacgcaactcagccatgtttccgtatcagatattaacaacatgaaccttcacaaatataaacacaaacaatcattgtgattcattgttatattcaagtcatcaatagatgagcatgtaaagagcttacacattccttattaaaaaaaaagagcttactcaccctgtgcatcatatggacaaaaaactgtgtaaacacttaataaataggtgtatactgtatcaggctaccagccaaacccatgacttcagagcaccagaaactaagattcatgcacagatctcaaactgcaggcaggcgcgcgagttcgtagctaatatgtgctattttgcatcatattataaagcagcaaactgtcaagggaaccatgtgaccacttcacagagagaatacttgtaagttgtaacacaaagaaacatcaaggaatcaagcaattaaaattgatattacaagtatttatccaagttgttggtgagaaatgcttacttcaaaacttccttgaagtgatcaaaacattctttgcaaggatatagtctcgagattatatgcatctgagcagcg

SEQ ID NO: 22601 - DNA, 1833 bp, Zea mays
ctgcaggtgttggtcttcactttctaatttcggctgtcgcattcctttttttacccattaccaattactaatttcggcagttgtagatacggatggatcctaaatatccaaattatatgatagatttatcttgtgtttggtttaaggaatcactacatccaaattgaggtagtgcatcataggttcattcatcaaatttggtgggatgacctaattcctcatattagtactaactaattaactataagtaatgaggtggtgatgaatcaacttattctattccacaaaccaaacaaaaataatgagaagtgagaagatgatagactagcttatttctcaaaccaaacatcctattaatgttttaacatagttgtgcgtaaaattagatgttgatctttaatcatgttgttaaacatattataaagtctctcaacaccaaaaaaaagttgaaaatttaaatctgtatccaaattttatgccgattattttaaaaagatataaaacgaatttaaggcttattttttatgaatcttaataaactcaatgctaaaaacaagaatataaatttatatagctatcctatttattcgcaattgaaaaaggatcagatgtttaacatcctaataagtatatggatccctcctagtagaagtgtcatcagcatcttgttttccagaattctatatagaaaggagtacacttctgactcctgtgatacagaaatttaagtattagaaaggacgacacatcttcctcccctcgaaaggggagtacacttctgactcctgtgatattataaaaaaactgctcagacataagacggttgcacaaaaatgaaaatctgcacggactggtatgggttatggaagagtcgtcagacatcagactaggcatagacaagtacaaatatcacgagacattcatatcttttactaccaacggtccaacgccaaagatacagaagcatatggacgccctgctatgtcagcacggagtcctgaattctctttcttatctccctggtattgctcaagtgctcatcaatgagtggtattgaaatgaaatcatctacgggtagaaagttcaagcgatttcttggccatgtcatcggtttggcatgatgtcgatgctgccttctagatcacacgagcgctcaggacaatccagtttaccccaacgtgcagttactctttggcagggaaatattggcttcccaaggcttcgattaaccacgttatggacataacataaccactgggagaaatcagcctgagatcctgcctgcacaggatttgctttcaaaacttccttgaagtgatcagcacattctttgcaaggatatagtctcgagattatatgcatcaactcctttgcatcccgtctttgttgcctcgtaggttcgtcagggaactgcgctgcgatggtgtgaagcagcatccacgtggcccggccgacctcctccttcgtcagtggcgcctccttggcatccttcttctccttccggacctccggttgcggtggtgccggcgaaggcggggagagggagagcgctagaagggggcggaggcggtggtcgtcgagcccggcgtcgggggcgatgaggatgtggcgggagaaagcggcgacggtctggaggacgggcgccagcggattccagcccgtcagtggcatcgaggtggtggccgcgggctcgcgtgcgtgtggtggggacccggggtagcaagcgcaatcctgcgaaaggcggtggattggtggatggatgaggcggggtccccgccgcgacgccggccgaggccccggccggcctcgaggatcccaatcgcccttaggagt

SEQ ID NO: 22602 - DNA, 3452 bp, Zea mays
ctatatatctacatcggagatgactggattgacgagtagggatggattcagatgtctggagatccgaattattcgtattcgtattcggataaagtgctaatatggatatccgtattcgtattcgattttaatatgaatgttaaatagacaaatctgaattcggtttttctctatccggtttaagattcgtattcgacaacattcgacaaaaccatgaaatatccgatactattcgtatccgaaagaaaaacgtattcgataaaaatcaatttgaatttagttttattactaattattaattacaattgattttaaactttaaataatgcactaaaaactgatgcacaccatttaaaatgttaaagatatttatatcataaataaatgattgtgttaatcttacattattttaattaatattaaaaagtctaattttgaatacattagattattggagtttttagagtccaaaatacaaatatacttaatatacaaaaagattatatttagagtccaaaatataaatatacccgctataaatattttatttaaaatatgatattcaactaagtttcaactaaataatgtagatgtactattgttcataatttacttgtaatatgatttttatcaactataaatccatcgataaaacaaattaatacttgttatgatgttatattccaaatcaagtatttatttgaatgtgaatccgaattcaaactatccattttgtattcgtatccgatagtattcatattcgtatcgaattaaaatatggtaaatagtgacattcagatttgtttcgtattcgtatccgatagtattcatattcgtattcgaattaaaatatggtaaatagtgacattcagatttgtttccatgtgtatccgatccgaatccatccctaccgacgaggacgtgttcaaggtccacgcttcggtgtcggtacataaaatccatgctttttataaagttgatatggacttgattggtttaaaattgcaggttctacggggagataaacagagtttggggattttgataccaaaagaatctcatgcattgtattctctggtggatccaccagcgcacggctgctattacttgctgcacaacaatccacctatctatacaattggatgctttattctccgccacatatcaaactttacacgctgcactagttttcaggggggagggggaggagtaactattaactctatctgtgcccattccagttgtaggtgatggacttcctgaagagactagtgaaagtagtgtttaggaggtgtttagtttctggagactaatttttagtcattctgtttaattccattttagttcctaaattattatatatggaaacaaaactctattttagtttccgtatttaataatttaggaactaaaatagaataaaatagagggactaaaaattagtcccaaaaaccaaacacccccttaatatatgctgaagattttagggttaatttctgacaaagaggactagggaactgaactgcacctgatgtcagttctatggtgtgtagccaatctctttattgtagcttggtaatactacattactgaactgtatgtcgtcatgtcaaataatccaaagcattccatgccagtcagtgccatgaacaataaccatcttgaactaattaagcattatgtttgaaggagtttctaagttattctcggtggtttaaagattgttgaatttcttcatcgaaaaatctctagcaaattatacaacaaaacaagcattactgtttcgaatattgagtaaaagaagctcaaactacaccaaacacatttttacagtatgtggaaatgtaaaggaaaaaaaaagaaagaaacttcctccattttgcatcttcatcgtagacattattctgctaaatggtaaaccttttcctgttcatgtcaatacacaaatgacctccttttaagcccaagtatccagcatacctcagtttttatgccttcttattaatcaagggatcaacaatgacttgaggtttgaaatctggcttcaagtactctgagagcaaggatgcatacatctcatagcgagcagtcatgcggaaggcccacttgtctttgatctggcggcataggttgaggtccatatcggagatgatcaagccatctcggtagcgtgatagagatggggtgcaggaggcatcaggtgctgagaaatggctagatccatagaaatggccaaagtctgcgtgttgcggtttcccatcaccggatgtgaaaggattagggaacacttctgtgccaacccgattaattgatccaacgaagtagctgtttgcaattgcggcgttccttgcctcaatgggccacattggttcactcagttcaccaacagtcgcagatgggttgaacactatttcagctccattgagaccaaacgcaagccaattaaggggatgatgtcttccataacaaatgttcactcctattttgccataagctgtttcaaacactggatgcccagtgttaccctccatgtagtatgtgctctcattgaaatcaccaactcttggaatgtgattctttcgatgaatgccaattatgttgccgttgtttccaataacaacagcagtattccaaatagtctccccatggtttatatccctttcaaggattgggctcactattaccatgttatacttctgtgcaagttcctgaaggaattgagtagattctccatcaactggttcagcaaattcacaccatcttttctcgcgtgtgcagaaggcaaaaggcattgtccaggcttcttgtaagcacataatattgacaccagaagcgccggctgcatcaattagaggttttattttgtccatgattgccttcttttggtcagcaaagtgacaagtagtgggaacagcaattgagttctgaattagacctactcgaacaactcttgattgcctcagaaactctttgtctgcactaaaacggaatgcctgcaaatcaaaactgtgtgtttccgcaagagtggttgtggcgtcaggcagtgagatagcctcaagaggtcgtgcacaattcagtcccagcagcaatcgacttgcttcctggaatagatcgggggaaaggttggcctccaggagcctgtgcagggactcgtacccgccgatcgaccccgcaggcggtggcgtcttcccctcctccccctgcgcgacccctgagccgttgctggtcgccatttcctctcgcttgcgcgcgcgcgccgggagcttcttgccttcttccctcggactggaccgatcgactcggggagagggagaagcgagcaggtctcttcctcaatcaactagtgggagtgtgagacgtcacgacgaaaaacatgtgatgttatgtgatgatcttgattcccggccggcctcctggtcccctggatgataaacaccaaacacccaattccc

SEQ ID NO: 22603 - DNA, 3472 bp, Zea mays
tgcagcagtgaatgattgattacgttgagttgcagcagcctggagtacagagcaaggaaccgttgacaatttgccacttcagaacatagttctgcgccatttttgcgttcgattcactgactccgaatggcaatatttgaagtgaattcagcgaacggagaaggttggttctgccgtgcgtgcaacgtggtggtagactggtagtctttcaatgcagcaggcatagagacacgtggtacccgtggatattggatagaacttcctacggagaagggagttctgcatcaaacggcaaaaggaaaaagatctcgaccgatcttcatttccaccaagcaaaagcaaaaatatacagagtgtcatgcgactatgcgagcagcgcgtcgtcctaactaacatacaatagcgcaacctgtgtactagagagcgaattttacatcttcaagccagccattgcgccatttatttgcacatggagggaatggaccaagaacacggtccattttcttattgatgtcgtatagttgagttcaaatgaacagaatctctcacgctgatcagacctgttgtcggggaagcaaggatatttttttttttttttttgccactgaaatatgtcgaattaatattattgtacatgtttgaaacatgtttgaacaactatatatcccaattaaacagagtttatctatgtgatatatagaatccgtagcaacgcacgggcacatgactagttctagtatatatatatgatctgtcgatgccacacaacgtacaatataatattagcaagttacagtgccgccagtaatcttttctcaagcatggatgttctttaagatgagaggcatcccacatttgggagtgagggagacgacatactttggcttgtgaacgtaggtgggggagagcgagaaggagaagttcctgaggatgaccgccatgacgatctgtgcttctatgatgccgaagctcttgccggtgcaggctctcgggccgagcgagaaagacagcagcgcgtgtggatccgtggcggccctggcgacgccattgctaaacctcaaggggttgaactcgtcggcgtcggagccccacacctccctgtcccgttgcagcaggccgatggggatcgataccacggtcccctcgggcacctgcagcatgcccctgagcacgacgtctgaggcagtcctccgttgtatgtacacgatcggcgggtagagcctcagtgtctccagcagaaccatgtgaagctgcaagcacgcacgcaaccgcaggtcatgcatcttgtacgcatggttttattcgtgtcaatggaaaagagttgcgtacgtaccagcttcagtctggagagggtgtcggtggtggggacgtcgccgcggaattcgcggaggacctcctccctgaccttgtcctgccactgcgggtgcgtgctcagcaggaacatggtccacacgaggagggtggcggtggtctcctgcccggcgccgaagaaggtcttgcactcgtcgatcacctctccggtggtcagcgtcgtcgtcgtcgtcccttcgtcgtcgctcccagcatggcgccgcccaggctccggcgaccacgcctccagcaggaggccgagcaggtcgtcgccgtagccaccgccgcaattggcggccacccgcgctgccatcatcgcagtgatcttggccctcaacagcttgtccagacgtcgcaccgttaggttgcgccgcgtcggcagataccttgtatgtatacagaaaaaaaagtgtgaaacctctcgaaaccaataaacttgcttgtggcgcgtcgtcaatggcatgcatggtcatcatagtatagtactgtacttggtaattaattaccagagtatgggagcatccaccatggccgcggcgcccatcttctgcatctcgtgcatcaggaggaggacctcaccggcttcctggaggctggtgccgaaagcggcgcggccgatgatttcggcagtcaggtcgcagatggcgcggtccacttgtatttccgctgcttgacgggcaccactgtgcagtattagctgctcgcaccatcgctgtgccatctgttccgtagcttccgccgtcactgccgacatgctctgaactcgagaccgacagcaggaacaatgtcatcatcagttgctaaaatctgcctatatatatatgtgcaaaacttgtgatgatgatgattgatgacgaggacgacgaccttgatcctctcgtggttgaaggctggaaggacaactttcctgtgccgtttccagtcgtcgccgtttgctaagatgagcccgttgcccaacaggactttgaaaacggggatcatgaagtccttgccaaacaggcccgtcctgtctgtgagcacttccttaatcaactctaaatcaacggagaagattgcaggtgttggcccgatccagtacaggaatgtcctccctgaatataatgaccaaattaattcatgcatgtagcgggtacgacatgtgattattaacaatgtgttagggttttaccatactcgacgacccatcggtggaacggtggcagcaagatgggcatgatgtcatgtgaagcgacgtccagctgcggaacccttctccggctggcacgcgccagccgcttcgcctccgacaaggatccggccaggaaacagtagggcggcccccggatgccctgcctcgcgaacgaccgcgccacggcccgcggttgccacaccaggcgccacagcgcgagcagcagcgccggcagtagtgaggccagaagcagcagggccggcggcggcggcgtcgcccacggccacggccacggccactggtcggcccccatatatgacacaaccacaaggcggcggctattggatcattggtcagctcgatctcgaccccgaacgtatgcatgcatagtcgtcctctacaagctagctgccagttgttgtacgttgctgtcctcatgagaattgcagggacacccacacgtccgacgtgaccgagatggcttctcttgcagaaactccgtctactgttggttgttgcttgtgtgtgtgtgtggaacgctccggtgctgtacccgcgcgcatatatatcgtgtgatgtgcacatatataccagcataggtctcaaggatgcataacaagtttgaggctcgctacattcacttttgttagtttgtttattagtactaggtgagtgttattactgttatcgcgttgaaaacaaaaaatcttgtggataggtgacaaattgtcaaaataatactactccattcttgattatttgtcatcctctagttcattttaaaactaaaatatggcaaataaaaaagaataggagagtactgtagaaaagtctacgttatataaggggtcactatcttagattatctccaaccatttccccttccaaatcacttatttgtattttccattcatatttaaatacattccctctatttcatctcctctccaatca

SEQ ID NO: 22604 - DNA, 1984 bp, Zea mays
cctcgaggccggcccggctggcaacaccgcgcgcgcaatacacgggacacacacgcagatccgagctaaccaccatcgacgagcgccagccgccagcagccgagccggagcgaccttttcttttttcttttacacagcgggacggagaaaggagtcaatcagccaaagccacccaccgcttttacccaccgatcggcgttgccgccgctagcattgtcggcttcagctccatccaaatccaccgccagcaagcaagcaagcaagccggcgccatgggtctgccgatgaggagggagagggacgcggaggcggagctgaacctgccgccggggttccggttccaccccaccgacgacgagctggtggagcactacctgtgccgcaaggcggcggggcagcgcctccccgtgcccatcatcgccgaggtggacctgtacaggttcgacccctgggacctgccggagcgcgcgctcttcggggcccgcgagtggtacttcttcacgcccagggaccgcaagtaccccaacggctcccgccccaaccgcgccgccggcaacgggtactggaaggccaccggcgccgacaagcccgtcgcgccgcgcggccgcacgctcgggatcaagaaggcgctcgtcttctacgccggcaaggcgccgcgcggggtcaagacggactggatcatgcacgagtacaggctcgccgacgccggccgcgccgccgccgccaaggccggcccgctcggggtaagcccatctttttctcggaattgaagacgggtccgttttaatttgatctgcgctggacgaatttagctaatagtctgatcgaattgaatcgtcgtgcagttggatgactgggtgctgtgccggctgtacaacaagaagaacgagtgggagaagatgcagctggggaagaccgccgtcgccggcgtcggcgccaccaaggaggaggcgatggacatggccacctcgcacacgcactcccactcccaatcacactcgcactcgtgtggggcgagacgcgcacgccagagtcggagatcgtggacaacgacccgttcccggagctggactcgttcccggcgttccaggacccggcgatgatgatgacggtgcccaaggaggagcaggtggacggctgcagcgccaagagcggcaacctgttcgtggacctcagctacgacgacatccagggcatgtacagcggcctcgacatcgagcggccgcccggggaggacttctactcctcgctcttcgcgtctcccagggtcaaggggaaccagcccgccggagccgccgggttgggacagttctgagctgagtcgaggatggagccatggatcaggagatgaagacggttgcgaactctgtaaatacagcataggagtcgaacctgaccctgacccttgttggggttacaaggttttccgagtgtcggtgtagcgtacctcggccgcgaccacgctacgggccggctcattctttagtttcacttccgaagcagacggtagatatatgtgtagctgttcacttaaactctcttcgacagaacaaccgacgaaattttgctcttgtttataagaactaccttgactgtcgcttccctttgtctgtctcttccctaccctgtgttgtgtacttgtattggcatgcttgcagttgcagcgaccacggggacagcggcgggctcaggcctagatgtgtcaacagagatccgatacccgataattttcgaagattttaatctccatgtacagatctggaagaaattcttctccattggatatgagtatgtgtacgaagattttaatccctgagtacaaatttgggagattcttccgtattggatatataagtatggtatgaaaaaacagaactctgaacctaattgtccacggataatattcacacagtaataaaattaggtgtgtatctttataggaaacaagcctaacaactaaccctaactctctcaaccttttaag

SEQ ID NO: 22605 - DNA, 1751 bp, Zea mays
gggtccctcggggccggccgggaatgactgcgcagaacccgcccacaggacaggacacacagagccgagccaccccacccaccatcggcgaccagcagccagccgcgggagcgagctgtttaaagacaccgagtcggagtcggacggaggactggcaggcacaaccgaagccaccgcttctagttctcgggttcatcgccagcaatccagaccacataatgggacagccggtgacgaggaggagggagagggacgcggaggcggagctggacctgccgccggggttccggttccaccccacagacgacgagctggtggagcactacctgtgccgcaaggcggcggggcagcgcctccccgtgcccatcatcgccgaggtggacctgtacaggttcgacccgtgggacctgccggagcgcgcgctcttcggggcccgggagtggtacttcttcacgcccagggaccgcaagtaccccaacggctcccgccccaaccgcgccgccggcgacgggtactggaaggccaccggcgccgacaagcccgtcgcgccgcgcgccgccgccgccgacgcccgcacgctcgggatcaagaaggcgctcgtcttctacgccggcaaggcgccgcgcggggtcaagacagactggatcatgcacgagtacaggctcgctgacgccggccgccgcgccaagaaggggtcgctcaggttggatgactgggtgctgtgccggctgtacaacaagaagaacgagtgggagaagatgcggctggggaagggggcagccgccggcgcagtcaaagaggaggaggccatggacatgagcacctcccactcgcagatcacccactcgtggggcgagacgcgcacgccggagtcggagatcgtggacaacgacctgccgttcccggatccggcgatgatggtgcccaagaaggagcgggtggacgacggcggcagcgccaggaccagcgacctgttcgtggatctcagctacgacgacatccaaggcatgtacagcggcctcgacatgctgccgccggccggcgaggacttgtactcctcgctcttcgcgtcgcccagggtcagggggaaccagcccaccggacccgcggggttgggccccttctgagtgagctcaggcgaggatggaggcatggagatcaggagagaagacggacggcgttgccaactctgtaaatacagcataggacgaggagtcgaacctgactgaacctggtcggggttacaagtcgagtgtgtcggtgtttcgtacatgggaaccgggccttacatgggagccggcccggtcttggtttggcgctggctcattctttagtttcacttcctgcgcagacggtagatgtgtatgcatagctgttcactatcacttcctcttcaacagaaccgattcactccgaaaaaaaaaaaaaaaaaagaatcaaaaaaaagtacctaaaaaaaaaaaaaaaaaaaaaaaaaaaaaaaaaaaaaaaaaaaaaaaaaaaaaaaaaaaaaaaaaaaggataaaaagcacacttgaacctaaaaaaagggataaactagcttcctgcgtgaaatcgttttccgatggcaaactacaaacaaaaaacgaacacgcaagcacaaaaacaaaaaacataggaaaccaaaaagagagagccaactcacattaattggcgataagggtaactgactcacttttcagttcgggtggccgcgtccggccacgcttaattaatagaataaaaccaaa

SEQ ID NO: 22606 - DNA, 1934 bp, Zea mays
gacaacaccgcgcgcgcaatacacgggacacacacgcagatccgagctaaccaccatcgacgagcgccagccgccagcagccgagccggaccgaccttttcttttttcttttacacagcgggacggagaaaggagtcaatcagccaaagccacccaccgcttttacccaccgatcggcgttgccgccgctagcattgtcggcttcagctccatccaaatccaccgccagcaagcaagcaagcaagccggcgccatgggtctgccgatgaggagggagagggacgcggaggcggagctgaacctgccgccggggttccggttccaccccaccgacgacgagctggtggagcactacctgtgccgcaaggcggcggggcagcgcctccccgtgcccatcatcgccgaggtggacctgtacaggttcgacccctgggacctgccggagcgcgcgctcttcggggcccgcgagtggtacttcttcacgcccagggaccgcaagtaccccaacggctcccgccccaaccgcgccgccggcaacgggtactggaaggccaccggcgccgacaagcccgtcgcgccgcgcggccgcacgctcgggatcaagaaggcgctcgtcttctacgccggcaaggcgccgcgcggggtcaagacggactggatcatgcacgagtacaggctcgccgacgccggccgcgccgccgccgccaagaaggggtcgcttaggttggatgactgggtgctgtgccggctgtacaacaagaagaacgagtgggagaagatgcagctggggaagaccgccgtcgccggcgtcggcgccaccaaggaggaggcgatggacatggccacctcgcacacgcactcccactcccaatcacactcgcactcgtggggcgagacgcgcacgccagagtcggagatcgtggacaacgacccgttcccggagctggactcgttcccggcgttccaggacccggcgatgatgatgacggtgcccaaggaggagcaggtggacggctgcagcgccaagagcggcaacctgttcgtggacctcagctacgacgacatccagggcatgtacagcggcctcgacatgctgccgccgcccggggaggacttctactcctcgctcttcgcgtctcccagggtcaaggggaaccagcccgccggagccgccgggttgggacagttctgagctgaggcgaggatggagccatggatcaggagatgaagacggttgcgaactctgtaaatacagcataggagtcgaacctgaccctgacccttgttggggttacaaggttttccgagtgtcggtgtagcgtacatggagccggcggcgcggccgggccggctcattctttagtttcacttccaaagcagacgggtagatatatgtgtagctgttcacttaaactctcttcgacagaacaaccgacgaaattttgctcttgtttataagaactaccttgactgtcgcttccataactctgtctcttccctacccggtgttgggtactggctggggcatgcttgcagcgaccacggggacagcggcgggctcaggcctagatgtgtcaacagagatccgatacccgataattttcgaagattttaatctccatgtacagatctggaagaaattcttctccattggatatgaatatgtgtacgaagattttaatccctgagtacaaatttgggagattcttccgtattggatatataagtatggtatgaaaaaacagaactctgaacctaattgtccacggataatattcacacagtaataaaattaggtgtgtatctttataggaaacaagcctaacaactaaccctaactctctcaaccttttaagctaagcacctatataatatgattatgcttttttattggggataaggacgtattgaagatccaatacccgaatgggatg

SEQ ID NO: 22607 - DNA, 1707 bp, Zea mays
cctcgaggccggccgggagcggggacacaccgcgcgcgcaatacacgggacacacgcagatccgagctaaccaccgcagatccgagattatccagccggagcgaccttttcttttttcttttacacagcgggacagagaaaggagtcaggcagccaaagccacccaccgcttttaccgatcggcgttgccgccaccgctagcattgtcggcttcagctccatccaaatccaccgccagcaagcaagccggcgccatgggtctgccgatgaggagggagagggacgcggaggcggagctgaacctgccgccggggttccggttccaccccaccgacgacgagctggtggagcactacctgtgccgcaaggcggcggggcagcgcctccccgtgcccatcatcgccgaggtggacctgtacaggttcgacccctgggacctgccggagcgcgcgctcttcggggcccgcgagtggtacttcttcacgcccagggaccgcaagtaccccaacggctcccgccccaaccgcgccgccggcaacgggtactggaaggccaccggcgccgacaagcccgtcgcgccgcgcggccgcacgctcgggatcaagaaggcgctcgtcttctacgccggcaaggcgccgcgcggggtcaagacggactggatcatgcacgagtacaggctcgccgacgccggccgcgccgccgccgcccaagaaggggtcgcttaggttggatgactgggtgctgtgccggctgtacaacaagaagaacgagtgggagaagatgcagctggggaagaccgccgtcgcccggcgtcggcgccaccaaggaggaggcgatggacatggccacctcgcacacgcactcccactcccaatcacactctcgcactcgcactcgtggggcgagacgcgcacgccagagtcggagatcgtggacaacgacccgttcccggagctggactcgttcccggcgttccaggacccggcgatgatgatgacggtgcccaaggaggagcaggtggacggctgcagcgccaagagcggcaacctgttcgtggacctcagctacgacgacatccagggcatgtacagcggcctcgacatgctgccgccgcccgggcgaggacttctactcctcgctcttcgcgtctcccagggtcaaggggaaccagcccgccggagccgccgggttgggacagttctgagctgaggcgaggatggagccatggatcaggagatgaagacggttgcgaactctgtaaatacagcataggagtcgaacctgaccctgacccttgttggggttacaaggttttccgagtgtcggtgtagcgtacatggagccggcggcgcggccgggccggctcattctttagtttcacttccgaagcagacgggtagatatatgtgtagctgttcacttaaactctcttcgacagaacaaccgacgaaattttgctctaaaaaaaaaaaaaacggccgggccggctcattctttagtttcacttccgaagcagacggtagatatatgtgtagctgttcacttaaactctcttcgacagaacaaccgacgaaattttgctctaaaaaaaaaaaaaaacggccgggccggctcattctttagtttcacttccgaagcagacggtagatatatgtgtagctgttcacttaaactctcttcaagaaacaaccgacaaaattttgctct

SEQ ID NO: 22608 - DNA, 1707 bp, Zea mays
  misc_feature (1648)..(1682): n is a, c, g, or t
  misc_feature (1684)..(1684): n is a, c, g, or t
  misc_feature (1706)..(1706): n is a, c, g, or t
aatgacagcgcagaacccgcccacaggacaggacacacagagccgagccaccccacccaccatcggcgaccagcagccagccgcgggagcgagctgtttaaagacaccgagtcggagtcggacggaggactggcaggcacaaccgaagccaccgcttctagttctcgggttcatcgccagcaatccagaccacataatgggactgccggtgacgaggaggagggagagggacgcggaggcggagctggacctgccgccggggttccggttccaccccaccgacgacgagctggtggagcactacctgtgccgcaaggcggcggggcagcgcctccccgtgcccatcatcgccgaggtggacctgtacaggttcgacccctgggacctgccggagcgcgcgctcttcggggcccgggagtggtacttcttcacgcccagggaccgcaagtaccccaacggctcccgccccaaccgcgccgccggcgacggatactggaaggccaccggcgccgacaagcccgtcgcgccgcgcggcgcccgcacgctcgggatcaagaaggcgctcgtcttctacgccggcaaggcgccgcgcggggtcaagacggactggatcatgcacgagtacaggctcgctgacgccggccgccgcgccaagaaagggtcgctcaggttggatgactgggtgctgtgccggctgtacaacaagaagaacgagtgggagaagatgcggctggggaaggagggcgccgccaaagaggaggccatggacatgagcacctcccactcgtggggcgagacgcgcacgccggagtcggagatcgtggacaacgacccgccgttcccggatccgccggcgccggcgatgatggtgcccaagaaggagcgggtggacgccggcggcagcgccaggagcagcgacctgttcgtggatctcagctacgacgacatccagggcatgtacagcggcctcgacatgctgccgccgcccggcgaggacttctactcctcgctcttcgcgtcgcccagggtcagggggaaccagcccaccggagccgcggggttgggccccttctgagtgagctcaggcgaggatggaggcatggagatgaggagagaagacggacggcgttgcgaactctgtaaatacagcataggactaggagtcgaacctggtcggggttacaagtcgagtgtgtcggtgtttcgtacatgggagccggcccggtctttggcttggcgctggctcattctttagtttcacttcctgcgcagacggtaggtagatgtgtatgcgtagctgtgcactatcacttcctcttcaacagaaccgattcactccgaatggcaatgtttgaagtgaaatcagcgaacggaaaaggttggttctgtcgtgcgtgcaacgtggtggtagactggtagtcttccaatgcagcaggcatagagacacgtggtaccctaaaagtgcagcaagatagtctaagttcaagctaaaagttaatactttctcagcagaaagtgcagcagaggggatattactgaaccacaaccatgacacacctaaacgaacagatctcctaaaaaatgtttcacatggagctcgtttgactgcactattagactttattctgctattcccattatatatgtnnnnnnnnnnnnnnnnnnnnnnnnnnnnnnnnnnnanaaaaaaaaaaaaaaacccccant

SEQ ID NO: 22609 - DNA, 1661 bp, Zea mays
  misc_feature (35)..(35): n is a, c, g, or t
acgacttgcgttatacgagattttctctgagctcntaatttctttttctttatctcatccttaattgtctcgtactcaacaggagcaactgctgcccgttgcttcttgtatagttcataacgtacaataaatccatgtaaatatgctcttacagcactgctgccaatgtattgagtaaggttcagtcgctccatctcttctttagtcaagaacttgtactcatcaaacagcgttgtatctggtttctcttccatctcctcagttaagttatcaagatgtgaacaccactttggagcagggccgagcgcaggaatgaagtgggcaggtatctggctattgtccagggctaatagcactaaaccactattccggaagacacagacatcattgatagcaccaccatctggttcaatgctagtcatgttatttcctgtattaggatcccagattctcactatgtgcttatcagcagtgatcagtttaggttcagtacaattaagtgtctggtgccatttgatatttaatattgggctaccatacatgtgatccttaactctcagaggagaagacatgcgtaaatcatatattgatatctttcctgtactggtccccactgccataaagtatccttgatcttcatcaaattgcaaagacgtgacctcctgagaataatcttcagaactaacagctggaatattaattctgccaacagaagttttttcctcatatcaaaacactcaaccgcaccatcctcaccaccgcaagcaacaagcccatggatcttacttcgtgtaaccgcatttattgctggtgattcggaggaaagagaagcaaggaatcgtccctgctctaggtttatcctgtacagatctggtgatgaagcagcacatagcaagtcgcaggaccagcaatcgtaggccatgtcccttcccactcttggaattctcaggctataatggcttccatacttagcgtgcaaatttacagaacgatcagcacacaaaaacgcgagtttggaatagtcatcaccaaggatctggaaatctacaatttctgagatcatgtgccgctcgaacttcatcgacaattccttcaactcgtagactttaacttgcggggggtaaatacctgaggcgatcaggtactggtcatcgggcgtcagcttgatcttggtggtggctgtctcgaacctcaggtcgtggatcaaatccagcctccgctgatactctttgtcctttcggagggcgcgcttcttcttcgcgacgacccagggggcgacatagcggccgccggtgagcgagtagagcttgaccccgttgatggaggtggacttgagcgtccccgcgccgtggctcgctgccatctccgacgcggtcgccggagcccctctactccgcgctcctcctcctcgtcggcgctggttgcctgctgctgtcgctagggtttaaggaagttggagggagttggcggctgttcctgcccggcgctcgtcgtgcgcgcgcaggggagaggagactgtcaggtggcggcggcggcgcgacgagagctctcgcagccgttggattggggttgggttctgggtcgatcgatggggagggggtggccggcgtgtcctcactcctcagctcgtgcgtgcgtccacgcacgcattagcgagtgat

SEQ ID NO: 22610 - DNA, 1879 bp, Zea mays
  misc_feature (1124)..(1124): n is a, c, g, or t
  misc_feature (1143)..(1143): n is a, c, g, or t
  misc_feature (1501)..(1501): n is a, c, g, or t
gaaatcctggtaaatactgtttcgcgtcttttctgtaactcatctgatcatacagaaaaagaatgtaaccagtccatgatggagatcaattatatagttagatgcctaacagagtaacagagatgagagatctaatttacaaagaacaatctagtgtgtcaaacaaaggaaagtaccttaatttcaggaattcaaacacctagtcgttggcaaaactaaatgaattgctaactataaaataatccagcacaagataaatgtgtaattcatgtaatgagttgtatgtaaatgtgtaaaagaagccaaatttaccttcttgtatagttcataacgtacaataaatccatgtaaatatgctcttacagcactgctgccaatgtattgagtaaggttcagtcgctccatctcttctttagtcaagaacttgtactcatcaaacagcgttgtatctggtttctcttccatctcctcctataaatggaggaaggcaaatgatgaaatgttcagttaaaaattattagatcaactactagaagccaattgatgcagtctcacgcacagttaagttatcaagatgtgaacaccactttggagctgggccgagcgcaggaatgaagtgggcaggtatctggctattgtccagggctaatagcactaaaccactattccggaagacacagacatcattgatagcaccaccatctggttcaatgctagtcatgttatttccctgcagaaaagatttgagggcatcatggcaccatccaataaagaaattcaaataatgaaaatgcataatgcaattgaaaacatgtaaaggaatgagtttcaccaaagaaattaaaaattaagaaattatacaggtttataaaggactatggcagcccatgagatattgtcatgttatttgcaaattacggttcaaaaagacatgaaccttttcaagcatattggctaatttctaataaatcacattgtctactgatggtgtgtttggtttgaagaatgaggtgatccatcatgtactcatgattcctcacctttttttttgggtttgttatgttatttgcaatagaaaggaatgctgtcaccagggtgggtgaactctcatagatatcaggtgnccacatatatagagtcaanagagagattgagtccgagggagaggggggttttcttggggctcgagagattgaatagatagggccccacaagttggttaattcgccgctggggaattcacacaaaagggaaggacttattctcaacgaaaaaagtgctctctgaaccgaacgtgaaagttgttttccatcagacggctgttcacgtaactccactctcggcttggattatatatccatttggtccgctctcggccattccacacgctgcctagcagagacgtggttatctgaagtggattctctcttttctttgggtgtagtcggacattccactttgttaagttcttttcttttcttttgtattgtagtagatgccnaacctgctgctcagtgggcgggcgcagcagctacatggacccctttctttatgttgttgccagcgctttcccgggccgagccggaattctttattagaacgtcggcaggcaaagcccgaaggaaggctgctatcccctcggccttcttccttttcgatgaaaaacaaatcaatctccgaaagcgttttccttacccttcccccccttcgtcgagcctttcctttagtggtaagggatatgcaccttatctgaacgtcggcaggcattccggaattctcctttttgagccccgggtgaacataggctcaaacatgattgggggggtcctagctacgccatgcgttcaatacaaaaaaaagcctctgggaagcagcagag

SEQ ID NO: 22611 - DNA, 556 bp, Zea mays
  misc_feature (1)..(1): n is a, c, g, or t
  misc_feature (5)..(6): n is a, c, g, or t
  misc_feature (13)..(14): n is a, c, g, or t
  misc_feature (21)..(21): n is a, c, g, or t
  misc_feature (23)..(26): n is a, c, g, or t
  misc_feature (28)..(29): n is a, c, g, or t
naatnntagtcannttatttncnnnntnntcagtgggcgggcgcagcagctacatggacccctttcttttatgttgttgccagtgctttcccgagccgagccagaattctttattagaacgtcggcagggcaaagcccgaaggaaggctgctatcccctcggccttcttcctcatgaagcatgggatgagtccacaaaccaaacgcactgtaaatgcataagagctcccatgtctgtattaggatcccagattctcactatgtgcttatcagcagtgatcagtttaggttcagtagaattaagtgtctggtgccatttgatatttaatattgggctaccatacatgtgatccttaactctcagaggagaagacatgcgtaaatcatatattgatatctttcctgtactggtccccactgccataaagtatccttgatcttcatcaaattgcaaagacgtgacctcctgagaataatcttcagaactaacagctggaatattaattctgccaacagaagtttttttcctcatatcaaaaggggggggggggggggac

SEQ ID NO: 22612 - DNA, 1800 bp, Zea mays
aaaaaccgtgatgacagatccttgctggtaaatttcatgacatgcgtgaaatcttaatttttttttttcacttcctggggagcttaactcccattgttagctaaggcaacaaatgcatatgcatttacagtcttacaggcaacaatggtgaatacaaagaattatctacaacagttggccaattgcacacatgaatgtacaggcatctaccttcctacccaccttcatcatctgaggcttcacggggacgccactctattagagcctgattctgtgacttctcatcaatgtggttggaattgagagatctggcgctgcctgaaggtccttcgatcgagcaattagacagctctaccaacattgcagagaacccacaagagcaagatttgcaaactgtacccaggttcgtcaccgaattcaatctctctaaagcagccttcaacttcttaatctccatagcttgtgtgcgagctagttcatgtgattcctgcaatcgcttaagtgccccactcagttttgtcttctctttggaaacctgagtttccagctcctgaatatgtttaatagctgcctgctcaatgcaagatcgacgcttgtattcttcctcaagcatgcctgttatctggtatcttagttcagccatttcttgggtgagatcttccgcatcctcttttgcctttaacttttgttctcgaagctcttccttgagctgctcaattagaagttcagattcttcatttcgttttgccatattttcaagaattacatcgccactttcgcattctgcatgcacaccgttctccaatgttttgttaactttccatccagatccaggaggagattgtttaggagctcttacaggcaacaactccttcagttgcttattctcccatacaagttgatgaatagttttctgtgcttcatgtagctggagctcatgttctcccagtagtttgtcaaattgagctttgtgctcaccagcatgttgggaaaatctctcagcgtcaaatagtctctgctcaagattagtcaaatcaagtttcaagctctcaatttcgcattgtgaatctaaagctgtactttcaagcttctctatctgtgaggctgccttctgcaactcctcttctttacatctgacttcttccatcagaagccagcactgggaatcagatcgtatcagctcattgtccatcgctctcactctttctgggaacttttcaagttcagtcagcttcagttcaagactgtgaatgtgctctcccatgaagtttgcttcaacgctccgtatatttaactgatcctgcaaatagtcaatttcctgatagcagttcatcaattctgtttctaatttttcaacataatgcctgtccttctggcacacccaagtggctgaatttttgtcgagctgtactttctctttattcttttcttttctatgaagaatctttgcaccattagcaggataatggccgttggagctactagacatctgctacggcgcacgagcgcggcctgcagtgacggcttcgaccgtatccgtctccggcgatcgtcggagagaggcggctccgaggacgggcactggcgtcggcgcgggacacgaggtgacatccagcaggacgacgactcgaggacgaagccccagcggtgatttcgcagcgcttaaacacgattcggaaccctaatcgccgttagcacgggccacgggccggggataaggaaagagagagaccgacggagcctaggagggagaaggatggaccttcctccgtagaaacgtccgcgaaacggagaccgtag

SEQ ID NO: 22613 - DNA, 4687 bp, Zea mays
  misc_feature (2059)..(2059): n is a, c, g, or t
agcgatgcaacatcgaactcatctttggataaactaagttcaaccctcaggttattgcccaccactgcttcaagatacacagtttcataagccctaaaccctaaaaaaactgatgtcattatttagaaccgtgcaatgaaatgaaaccctgcgtgctgagaataacattgtttcattcttagtttcataacatttttaatgatataatagtgttgaaaagatggttacgaaattttcattgacaatagcctaatagcctctctcttcctctgcagcactgtagggccgtggatgtgtaataaacattgccgaactgaataggcactatgcaagagtaacttccattgaaactttacaacagagctgttgagttgttctgtctgctagactgggagacagtgattgcggcaaggggggaggagaaacgtccggacggaattctcgttcatccagaaaacacgcggcaacggcgagacacgcgaaccgcgagcaagatgaatcgtctcaagcacttggctccaccaggccgtcaaaccatctgcatccacgcggacttgcggtcgacgcgaggccactccaggcaggagaccagccaccgttcttcctcctcctcctcctcctcctcctccgtgtcgcgcgccgccgccggcccgaacgcgcagttctccggtcgccgttcacgcgccgccgcatcccgtccctcgtccgcgcccgtgagttcctcgtcatcggcactgatgacaatggctcgcaggaacaggaggagggaagccatcgtccagtggaccgatcgatgggacggaatggaatggatgtactgctcagaacgcaggtggatggagatggcagtgctcgcagctgcccaagcatcagcagtcgtagtaaacggcttcatatagtagtggcctacgagtgatctgacagcgcacggacctatctttccttttttttttaatactggtttcaggtggatctgcatttcttgcaagaaattttgccctgtgttcgtgcagctgtgcgaggctgccttctccggtccatcaggtgcatcacacaaaggccatggtcagcgtccggctgtccgctgggctgtaggtgagctgagccggttggggtgtggttggtgctgggcagtgatgtgaagatttcttcgtttctgcatatgtgctcttgcagtgtgtgcgttacctacttacctacctgactgaattagttttgtgaagctcacttagctagctgaatttcatgtgggtgagctcggtagattcgtgcactgcattggccagtggagtgtacgtcttcactagtgacctcctggtcataccaactgctgcaccggcgtgtttggaactcttccacaacatgttaacaacacagcagcagcagtgggggaccggaagggagaagagaattggagaaagacagcaatgcgttggggaaagagcacggacttcacgctgttcatagcttggaaagggttattagactatccgcaacattttctctaaatttcgcccttgtatattcctttattacggggtctattctggacagaaacagaagatagtctattctgtcctttattacggggtcttgtttttagccgaattgaaacgaatttgatagatccgagattagcctaacaatacattagtgcgttagctaaaaccccatattgactctcctcaatgacgaaacatcgattgtagctctagcaagcaaacaatgaagtattgcctctctatatctatgtttcatgttgtggccatgccaatcaatcactagttagtcatcaataattataagttttcgctcaataatcatatgttttcgcttaatattcacatccccgttcttttccatgcacttgtttatcctctcccgtttctattcgagactattccagatttggtctcatttccggcgacaaaatgtggaaacaaaaatggtagaggttttctcgtccatttccatccgtttttatccatattcacaagaaacacatgccatgagtcacgatacaaaataaacgaagcgcaacatggcatccctgcagtanggcgatagctgcttcccacagaattgagaaataatcgaagtgtttgggtgggactatcgtttatttccagctataatccgtttataagcgggtccaaacaggaccaatgcaatgatgcaatctcctcgaacactttctaaaatactatttcactcacatgaaacagtttttcttctaaaattcgattttcactcagccaggatttacaatacaacctccatccaccaatcaaacattccaatgtatatgggacagtgcagtgcctgttgagattgacacaaaacagtaccaatccgaaggcactggcctagtcaccactacagcaacgagtgccatcaagttctgaccaaatttcacgaaatagctgactgtcccacatgttctaactttcatatcgtgtgccaaaccttccaagacaatgggatgatgcaaacaaccattcggatagacccagcatagcgatatgccaggtttgacaaaaaaaatactaggttcacagaaacgccaactcagggagattttttccaagcagataaaacagtcatacaggtcaatgtttttttatagcatttcagttcagttcgttggaaagcagcttgttacgatgcctgaaacagctccacagtccgttgcggttgtagacgctgcaaagaaagtaattgggagacagttctgcctatatatgaatgcttacctcctcaagctacataacagcaatgggtgataagtaggtctaagcgcaccccgcgcactgattcctcacaaaatcgccctgaaaatttggaacctcttttaggactcaaaagaggaagggaacatttggtcaacattttctaataagacggaggcttcccaagcctgtagctattgacagtcacagctctttaattagcttacctagcaggacaccaattgctcaaacaacgaaatgattatctctagctacattagaactgcagggcttaacatcaaaaatctgaaatgggtaattaactcaataactcaccactattcacagctaatatcgcctataggccctcccaagatcatcatgcctctcatgttgaaactcaccatatgctgcatgagcctttggggctgaatagctatcagaagcatacggatatgtgctcttcgaatccattggttgatgtgtagctgaaatatgtgccgttctctgctcaaaacctagatatccggtttgtatgtatgaaggctgtgcttgttgttgacttttaaaggtgtcaagaaattcttcccacttctttgcatgcacagtcctcaaggtaatcactctctccatgtaattttctctaatcactctcagcgactctcgatgcctatagttctcttcatcctcctcttggtcacgagctctagctaattgtgtagcttcttttttaaactccatctcaagttcttccaaggtctgttggtgggatggcatgtcaaacctaagacttgaactggcatctgctccatgcctctcaattccccagtcattgggcactcgtgatgcagcaaattggttattctcgccatgtgttctaggtaattcatcaagataagaggtatggcgtggagattttgattgggctggacggccttttgctccaaagttggcatgagcttgtggagatcctttcgaaaacttgggcatattgttgtgtaagcgaccatctcgatgtctttcattatagtatcctttactttgagagagtgatgcatttcttggactatgggaccattgagaatcaaaatttcttgggctaggtgagcgatgagaatcagagtgtttggggcgaaactcagtagtgtttcgtacaggcgacctagagcgatcgcgtttcggactgcttggactatgtttacctttaccctcttgaataattttatgcacagcagaaacacctttggataatattaatctatcctttccactgacaaacaggaacttctcatccattctgattttacaccccacatctttctcaatctggcttattaccctctcattgaaaagatctctgacttgcttatctcttgctggaactctttcaaaaaagtctgcatttctcttatttgccccaagtgtggaggggcaaccctgagtaaaatggcctgggtctccacatattttacaaatcatttcttcctccttcctcttcttccagttcctttctgtagccttagctttagcctcccagaccttagcctctcggctagtgaagtccgtgggaacagcattaggatctggggcctcatcttcatcatctgacttatcacgagtcaggggcctcttctcagcatttcctttaggagtcacactatttgtagctgatgcaactgggccgctgtatgctttcccataaacttcattgtaaagttcatcatctatttcaggactcggttctctcgccattggtggaagaatatttgctcaacctggtgtgtaatcgccgccggcgaagacctgacgaagggcggcggcgcccagccctcgacccagaaaggacagagagagacggagaggggggagtggagaagggagagacggagggggaggaggaggaggagagcgccccagaacacacgcgcgggtcgccccagctaggttaagggcagagt

SEQ ID NO: 22614 - DNA, 2019 bp, Zea mays
aattttcactcagccagggatttacaatacaacctccatccaccaatcaaacattccaggacaaggggatgatgcaaacaaccattcggataggcccagcatagtgatatgccaggtttgtctttttttttttctaggttcacagaaacgccaactcagggagattttttccaaacagataaaacagtcatacaggtcaatgttttttatagcatttcagtttagttcattggaaagcagcttgttacgatgcctgaaacagctccacagtccgttgcggttgtagacgctgcaaagaaagtaattgggagacagttctgcctatatatgaatgcttacctcctcaagctacataacagcaatgggtgataagtaggtctaagcgcaccattgacactgattcctcacaaaatcgcccactattcacagctaatatcgcctataggccctcccaagatcatcatgcctctcatgttgaaactcaccatatgctgcatgagcctttggggctgaatagctatcagaagcatacggatatgtgctcttcgaatccattggttgatgtgtagctgaaatatgtgccgttctctgctcaaaacctagatatccggtttgtatgtatgaaggctgtgcttgttgttgacttttaaaggtgtcaagaaattcttcccacttctttgcatgcacattcctcaaggtaatcactctctccatgtaattttctctaatcactctcagcgactctcgatgcctatagttctcttcatcctcctcttggtcacgagctctagctaattgtgtagcttcttttttaaactccatctcaagttcttccaaggtctgttggtgggatggcatgtcaaacctaagacttgaactggcatctgctccatgcctctcaattccccaatcattgggcactcgtgatgcagcaaattggttattctcgccatgtgttctaggtaattcatcaagataagaggtatggcatggagattttgattggggctggacggccttttgctccaaagttggcatgagcttgtggagatcctttcgaaaacttgggcatattgttgtgtaagcgaccatctcgatgtctttcattatagtatcctttactttgagagagtgatgcatttcttggactatgggaccattgagaatcaaaatttcttgggctaggtgagcgatgagaatcagagtgtttggaacgaaactcagtagtgtttcgtacaggcgacctagagcgatcgtgtttcggactgcttggactatgtttacccttaccctcttgaataattttatgcacagcagaaacacctttggataatattaatctatcctttccactgacaaacaggaacttctcatccattctgattttacaccccacatctttctcaatctggcttattaccctctcattgaaaagatctctgacttgcttatctcttgctggaactctttcaaaaaagtctgcatttctcttatttgccccaagtgtggaggggcaaccctgagtaaaatggcctgggtctccacatattttacaaatcatttcttcctccttcctcttcttccagttcctttttgtagccttagctttagcctcccagaccttagcctctcggctagtgaagtccgtgggaacagcattaggatctggggcctcatcttcatcatctgacttatcacgagtcaggggcctcttctcagcatttcctttaggagtcacactatttgtagctgatgcaactgggccgctgtatgctttcccataaacttcattgtaaagttcatcatctatttcaggactcggttctctcgccattggtggaagaatatttgctcaacctggtgtgtaatcgccgccggcgaagacctgacgaagggcggcggcgcccagccctcgacccagaaaggacagagagagacggagaggggggagtggagaagggagagacggagggggaggaggaggaggagagcgccccagaacacggcccggcccggccg

SEQ ID NO: 22615 - DNA, 788 bp, Zea mays
cagcactgtcgtgccgcggatgcgttattttctttgccgttctggataggcactatgcaagggtaacttccattgaaacttaaaaacagagcttgtgcggagctgttgagttgttctgtctgctagactgggagacagtgattgcggcaagggggaaggagaaacgtccggacggaattctcgttcatccagaaaacacgcggcaacggcgagcaagatgaatcgtctcaagcacttggctccaccaggccgtcaaaccatctgcatccacgcggacttgcggtcgacgcgaggccactccaggcaggagaccagccaccgttcttcctcctcctcctcctcctcctcctccgtgtcgcgcgccgccgccggcccgaacgcgcagttctccggtcgccgttcacgcgccgccgcatcccgtccctcgtccgcgcccgtgagttcctcgtcatcggcactgatgacaatggctcgcaggaacaggaggagggaagccatcgtccagtggaccgatcgatgggacggaatggaatggaatgtactgctcagaacgcaggtggatggagatggcagtgctcgcagctgcccaagtatcagcagtcgtagtaaacggcttcatatagtagtggcctacgagtgatctgacagcgcacggacctatctttccttttttttttaatactggtttcaggtggatctgcatttcttgcaagaaattttgccctgtgttcgtgcagctgtgcgaggctgccttctccggtccatcaggtgcatcacacaaaggccat

SEQ ID NO: 22616 - DNA, 6085 bp, Zea mays
  misc_feature (3335)..(3335): n is a, c, g, or t
  misc_feature (5730)..(5730): n is a, c, g, or t
acttgtagcatcagcccagaaaatgtagaccaacttttcttgctcatccacaccaaaatcatagaaaatgttgaatttgcctattctttctctccatttgggcaacaaataattcagcatcagcatccttgattctctgcctaagtccccgataatagttctgaagatcccgcttcatgcagccaatgtagttgattccatcacttacttgaagaagtctatatgcttgtgaggtacctatacttgctttatggcacgtgaacaaggtagtcttgactcgttgactaattgaacggtttgaatgaagaaatgaaattttatcaggagaaaccagcccatgattatgttgctcaaccatggaagcgatgaagtaccttttatccggagccaacttcacatatatatgcgcattacatccacatcttgtctccatgcgcacctttggcttcttttgttccacatagggatgaactttagaagtaacagcaccttcatctttttttttctttgataatccttgtctcgaacacaagaacctcttattttcaaccacatcgagcaccttggtttgggctcctatacgcactgcaaaaccactttcatgagcatatgtcttgtagaattcttcaactgcctctagagaatcaaatggcatgccaacggtaggcttcaatccctcattgcaatcaggtacaaatgatgtactctgcaaaatcaatcgttaatatatcaatacggatatctagttcatcttgaacaacagcttaaaccgatgtaaaattctcactggtgatgttgttcttatacttttttggggtgttctaaattgatcagcactgtaataaggatcagagttgtttagaaccatggtgttgttgcctgcgatatctgtggctacatcacccatgtttggctgcaaaatttgcatggcggtgtctatgctccccgcaacgcctgttggatgtgtatccaatgcggtcagtagagccatgaagccgccgctgtacccaattggcgaggttgcatccatggtcgtgcaaaacctacatcacgatcaatcacctaggtcaatgaacgtggccgccgtaccttacacgaacctgagaaattggagaccgtggtgcactgtacccttctctggaggaacggctcggctccactgatgccgatcgccgcaggccacaagcaggaaacgacgacgcaggcgaggacgagcggtggaagcggtggccatggaatgaggtggaagcggtggccagggaacgaagtggaagcggcgaccagaatacatggggcggcggccagaaataaggatcatagttgtttctggcgcacagggagcttggggggttcatcaaagattcagagggattcaggagaggtggagggtgttttctaataaaatgcggagttgggagatgcaaccgtttgatcgaagattagagactgagatgttatatgtgcactattgcttcatgtgcacaggttacttcgcctttgtaatatgcctttgtaatataggaaatgatatatgtggatatttctgaggaagtgaggacgagaccgagagtagtgggtccagagctgcaaacgaacacgggctgcccgcacatacaagcccgttcagggcttgttcggttacaccaatccccctctggattactgtaaccgaacatgccctcatagtttttcatccaaaactctgactggggaagcggaacaagatcagcatatgctgatgcgcattgacttgcgttgcaagatttggtgacaactgtataatttacagggggaaaaactggcgtaaataacaacatagagggataaacaggctcaattcaacatgcaagacgcagtcagcgttcagagcattttgcaggttttcatgctaaaactgttactccgaatttccttccttaaaaacctttacccacttctcaacactgtcgattacttcaccggtcttgaccaggtatcggaccttggtcccgtcctccaggaatttgtcgcccgcccggcttaccacactcttctccttagagtagagcatcacatttgagctatgaatggggccttcaatctgatcaaagaaaatttaagtctgatcaagagaacgattaggcacctactaaaactacagatatgctcttgaaaccaatatgtgcaaagcatcatgagaggcccaaaaaacaagttcaatagaaattttgctgaccatgacgatttcaccgggttcatcgtctgtgcctttcttgtgcttcgacttcaagttcaggtccttcacgatcaccgtgctgttgtgcttgaaaaggcgtgtgacttctccaacctttcctttctcacggcctgcaataacctgtaccgtgtccccgatcctaacatgcatcttgtgcagcacaggaagactgtttggtttacacttctttcgctcccatctcttaagctgcagtggaaagtgaagttttaggacatttcacattattggataaaaaaggtatcaaatatttggactaaagattttttttactcactctcatttcaattgggcatatcttgaccataaaccttacctgcatattgaacatattaaacagcttgtcagaacttcacatcctaaagacataagattccatttcaaatcaaagagacactaatcagatgcttctgagatatggcatgactcaaacacagtggttacgattcatgttgatctgatcaagacactacaggatccagggctcctctttatgtttgagtaatacgatatcccttaaaatacagtggttctatcacttccttcaacagtgattacttgacctcactatctattctttacttgcttttgcttcttaacagaaaggtttatcctcatccgattcttatcagttgggaattttccaggcacaagtacatacaggtaaggcataataaagatgacacagaaaagaaagcagggttcaaatacaaacatcattatgctcataatacactatttggcgccaaattttgtttccagttagtcatatgtattgtgtgatgtggggtaattcaggcataaatatatataaacaaaatcagtggcacattgagggcaacataatttcttcagttgacattttgaccgcttcaaaagcaacataatttcctcagttaacaaactaaataaagagtactcgaacaaattttaccacatgaaacacagcatactctctattagcactaaaaggcaaacatgtgcatagttgtatatgcaaaaaggacaataccggattaccaatgacaaaggaaattctcttacttaaattaatcccaatcagttaatctatttggcgcantcaaatcttaccatttaagcttccatgcaagataaaaataaaaaaagaaggtagacgaaattcaatatggacacggtctaaatttagtgtgtgtcgtggagcaaatagaaacttaatgtaatatgaaatctaataagggcgagtttggcatagttctactccaaaactttgggtgaagtatatctgctccgaagtgtagattgctttctcataaccagtgcattggatgtgtcttgattgtttttgaaggatttttcaaagtagcaaaaaatgtactccaaaaaattatactacaactctcaaaactctatagagtttgcaactctagaattagggtgtttagttgactttgtccaggtcttccttaaagttttgctctagagtgatgtcaaacacccctaaacatagtcatattagaagcctggtttgtaggggccttttttttttttttttttgacaatgcaaaggtaattttccatttcattgcatccaatccatacagactagctccaaaaccgtaatgcaagctcgaatgtccctagaacaattccatccgaccgcgctttgcaacgctatccagaaactccagactaaaatctttcacctgaacagctacttattatctaccaaaccatcagcagaacggaacggaattgggaagcaggaacagaccccaggctgcggcgcggagtaggtggcgagccggttgccccagaagctgctgctgctcgccgtcgccgcgcctagcgcggagatggagagcgacgccatggcgccctgcagcgatgccatcccagccatcctctcgccgctctccctctctcactggacttgctcagcgcccaaactgctcaaaggataacgcacgcggcttcttcgcggcccggccggcagagagaggataacgcgctcttgtattctgacgctggtgggttgggcctcgtcactaaatgagacaggcctcaggtgaggcacagatgggcctggaagacgcttaggtgatccagtgaggcccatgggtgctcgttctaccgccgtgagaggctacaggctagggcctcggctccacgagcgagctccgcacgcatcagctgatcagcatcactgcatcagctatcaggacgacaggacgaggacggcggggtcaaggctctctttctctctccctccctctctgcgtgtctcctcgcacgctacgcgaggccacgcgagattgcttgggagatgcgtgcccgcctccagattccccgttccagcgccgaggcgcgcaagctacgcgacggttgctgaggcaagcgaaccccctactccagtttttcactttgctgttgtgtaaaataaaattcgcgttacagagacagagacagtttgggcgatggagggtaggtggatggcggtgacatcgaagctttgcgcttttgctgctgcaggtcccatcctgcaccgagaaagggtgggatgtcaatcggatttctctattgcaaatcatggttgcaagttagacgtgtttacctcagatctttttctccagagacattgggtatctcttttctcatagtggactacatttctccccctcgaagtcaatatctctttcttcgacttttcattgctggcagttctgcgcatgtcctaaatccttgaatcatagtaggacatccatgacagatcacataaacaacacggccaatacatcactgggcagttgggcctcggctcctatcgccgtcatctaactaccatctagggaatcaggaatggtcctgccgtgcaagcaaacctttaacgttccccatgggataagcatgtgactatgcaaatgcccgacacaaattatatcttattatggttaagaatcttgtgtttatttttctctttctccttttctattcgccacatgtgttgagataactatgcaaatcgtgacatgaagttttgtttctatgtggcgctaccaaacaaaatggataaggaaatgtgtggcttttttccatgataattgcgacagtttcatttcgtagctatctgttcctcgtggccatagtaatgctttgcactttgttaattttgtaagaaaagaaatggcatgatctaataataaggccttctctctatgtggctaactggcaagggcttagcaatcctccccctttctaactataaccttttaaggcatggatgctggagtgctgggcaaaactcaatctgtctgggcaaagctctacttgcttgcgacactccagatgtggaccattttttttcacaggtttcggagctagacatgtcaagtagtttccttcggttgttgattaatttgcccactgtgatagagattttgcaccttgtggcctccacaagagttacttagtagagacgcacgttggaagggcttccnagacaagtgaagctcactagctcagcgttcagttgcttcccacgcttcaccaactgaacaaggtttatatatatgtcatatgatcctatctagtacttattcttagactaaaaacactatgagttagtgctaccaactgaaggatacgccatggctgttctgacactggttaatatccttatcagcttcgctgcttgtgctgaagctctaaggagagcagacttccctcaaggtttcgtctttggcactgcttcttcagcttaccaggtatggcctctttcatttcatccgatgtgctcttagtttgatgtttgattctgatcaatatgttatcagtatgaaggtgctgtcaacg

SEQ ID NO: 22617 - DNA, 930 bp, Zea mays
cccttttttttttttttttttgaagcggaacaagatcagcatatgctgatgcgcattgacttgcgttgcaagatttggtgacaactgtataatttacagggggaaaaactggcgtaaataacaacatagagggataaacaggctcaattcaacatgcaagacgcagtcagcgttcagagcattttgcaggttttcatgctaaaactgttactccgaatttccttccttaaaaacctttacccacttctcaacactgtcgattacttcaccggtcttgaccaggtatcggaccttggtcccgtcctccaggaatttgtggccaaccctgcttaccacactcttctccttagagtagagcatcacatttgagctatgaatggggccttcaatcatgacgatttcaccgggttcatcgtctgtgcctttcttgtgcttcgacttcaagttcaggtccttcacgatcaccgtgctgttgtgcttgaaaaggcgtgtgacttctccaacctttcctttctcacggcctgcaataacctgtaccgtgtccccgatcctaacatgcatcttgtgcagcacaggaagactgtttggtttacacttctttcgctcccatctcttaagtctcatttcaattgggcatatcttgaccataaaccttaccccaggctgcggcgcggagtaggtggcgagccggttgccccagaagctgctgctgctcgccgtcgccgcgcctagcgcggagatggagagcgacgccatggcgccctgcagcgacgccatcccagccatcctctcgccgctctccctctctcactggacttgctcagcgcccaaactgctcaaaggataacgcacgcggcttcttcgagttgcccggaaccggccgcctcgagggtacccgctcttgtattcaacccggcccgccgcctgagg

SEQ ID NO: 22618 - DNA, 1113 bp, Zea mays
ctgctcaatttaatctagagccggatagattcagacagaaatatatgtccagtaatgtcgattacatatatgactcatgaatcagttctttgacttcaaaagtgtagtcaacatggtgaacacggtttgtactaatcagattattgaatgttcaggttagaaactctaggtatcgactatagcaatgaacagctaaaagtttaattgttcgagtcaaaaaaaagtgagatacagatatccagtgagatcttgtgtacactgtaagactgagaacaaaactataaataattctctattaatataactttgcagcatttttttctctggttgactaaaccaggccttgatgaaggactttgacgattcaaacggatgtccaagctacttactcgctggtggatgggtactcccaccgtcgtctaccggtgaggtggtggttgcagcagaactgttcgtctctagcccaggtccatcggctgagagcccgttatcagtgaccgctgtcccagtgctctcaacagactgctttctttcaatggctcctgactgccttcgttcgatgcctcctgactgccttctttcgatgctggaactgttagatcttgccggcacggtcaataactgacggacagcgtcaaatgtgccttgacactctgagatcaatgttgccccgtccgggtagcatcggccaaaacatgcggcacaataaggatatgcaacctcgatgaatgtctggcatagtgaaaggaaaagggcggactcatttccacgaagcatccgcatagctttgtatcttactagggagtcagagactgcatgtagtcccttgaccgcctcctgagcagggacaactttcaagctcaatggtgcgcgcggtcttaactcattcattgctgctgaagcaccgttgacaaacactgcaagaggtggatgctgcattaaagcggagaggtggagtcacatcatcagaagtgtcgtcgacagcaccatatggttcagaccatgcagatggcatcggaagacaatcagtgtgaatgcgaatatatggcgtgaaaatttcgatcgcggtactcatatctagagaatacccggccggcctcgaggtacccaatg

SEQ ID NO: 22619 - DNA, 3262 bp, Zea mays
tggccgaattcagccgtagtagaggtcaccaccatcgccccgaacccaaactctcgaaggtgagcgagaaagatgatgcctagaataaagattgtgagtggggacgcaggaaaacaaaatgcaaatgtaaaactatgcgcttcttttagaacgtgtttggttatggaacggctagagacagccaggacaactatgtcccattatatcctttctcattcctctaatttattatatcctttctcattcctctaattttaaggaagggctagtcctgttcccatctctaattctgaaccaaacaaacttatctgaggaacgtctcatcctgtcattataaccaaacacactcaatttccatatccttgtccgagggaaaacatggagcacttgcacagcacgctgccccggcccacagcacttctttcctacactgtttatcccccacaaacgttgtcttctccagtcactagcactaaatccgccgcaacactgattcacaaggttgtcctcacaatcatccatatctcttggctttgctctgttttagtctaactactttgtttttggcctatgttatttagcgcatgaagtttaggtttcaattaggttgtctccagcagtttagaccatctcaagcgaaacgtatatatggtcatgcaaaacactgatttatattgtaaattgtattgtttacaaagtgaagtttgaaataagaagtaagatagaagttgagatagaggctgctggagatagccttaccctatctcctatatcttctccaatttcaaacttcactatataaaatagtgcagtgcaaaaagatattttacacaatcacatatacaatctgctggagacagccttagggagagagaataggatgagataagcaaacaacggcatggtatattttagcacatttgatactttacttgcaccctcttttctgctcaatttaaactaaagctgggccgcttctttttgtgttttttatggtcagtagtatcaattacatatatatgactcatgaatcagatctttgatttcagaagtgtgcagtcaacacgatgaacacggtttgtactcatcatattactgaatgttcgggttggacacactctacaacatctaggtattgactataacaatgaacagctaaaaatttaatgagtgataaaaaaataagatacaaatatccagtgagatattgtgtacactgtagaactggagcaaaactatgaattattatcgatgaatataatgtttgcagcaatttcttctctggttgactaaaccaggccttgataaagagctttaacaaattcaaacggaggtccaagctacttacttcctggtggatgggtactcacgtcgtcctctaccggtggggtggtggttgtagcagcatcgttgatctctagcccaggtccatcggctgacagctcgttatccgtgactgctgtcccagagctctcaacagattgctttctttcaatggctcctgactgctttctttcgatactggaactgttagatcttgccggtatggtcaatagctgacggacagcgtccagtgtgccttgacactctgagatcaatgttgccccattcgagtagcatcgaccaaaacatgcggcacaataaggatgtacaacctcgataaatgcctggcagagtgacaggaaaagagcggactcatttccacgaagcatccgcatagctttgtatcttactagggagtcagagactgcatgtagtcccttgaccacctcctgagcaaggacgactttcaagctcaatggtgtgcacggtcttagctcattcattgctgctgaaacaccgttaacaaacactgcaagaggtggatgctccattaaaacagaaggtggagtcacatcatcagaagtgtcatcgacaacaccatttgctacaaagccaacagatggcatcggaacccagcggtgcgaatccaaaacaacctgaaaattttcaaccgccatactcatattctttgagaataaatttagaaccgcgctgcaaaatgcagataacagcatcaataacaaagcccctttagagtcggtgataaaattcaataatttaaacaccaattactcctcaaagattggcggaaggaggccacggaaatccaatccaactaagccaaggcccattgcacaatacatgcattgttcaagaatgttggacagagacccaccttctgttatgcttggtaacataacttgaagagtagcgaggtgattactaacttgttgcattgcccagctgaaaagcagcccaccttcggagttctcatcatttccagatttatcattgttgaatattgctctatattgattaacaacatcgaatagatgtaccctgtggcaagtcaccatgcctttgaggtaatcataaacattcctttggtccagatcttcaagaattccagaaagccaagcttccctgcacctcaggaactgtaagcgcaattctgactcactgaaaactccaattcgacgcagatgtgctacaatacggaggcactcaggtaactgaatatttgatcggagtttctggagaagctgggaaattaatgattgtactgtcttcttgacttcagcagctaatccttggacaacaggtaaatctgggtgcaacttcgatattttgctcacaaaagcttctagatcaagtgcttcatcatagttcccattccgtatacacgtgtccatcaatggtgggatttcaagcaagtcaagcaatgtagtgtggttggctagtaatgtttggttaagcttcctctcctccagaatttgttgtgcagactcaacaaactcagtgcagccagatgttaagtttggtatctcctctatcatggcctcgaggtggccatcgaagctctcgagctgcgcgcggacgaaggagagcgcctcggaggcggcgatgaaggcgccgtagttctccaccgccacctcctgcatctgccgccgcactcgctccgcgtcgaccctcagaagctccggctccttgtggaggcgctcgatggagaaggagaggagctcagagacgtagggctggtaggcagccccggcgagcgggagacccatgtcagaggcggcatgtggggaggagctcgaatccggcgtgtggcggtgcctcgcgtcgaggtccatggcgagcggtgggagatctggagtcgtgagttcgtgagtcactgagaaggtgggtggttttagcagttcccggccggcctcgaggg

SEQ ID NO: 22620 - DNA, 1332 bp, Zea mays
  misc_feature (1283)..(1285): n is a, c, g, or t
  misc_feature (1291)..(1291): n is a, c, g, or t
  misc_feature (1309)..(1309): n is a, c, g, or t
  misc_feature (1311)..(1312): n is a, c, g, or t
  misc_feature (1314)..(1315): n is a, c, g, or t
  misc_feature (1323)..(1323): n is a, c, g, or t
tttttttttttttttttcggtgtgttcttcttgttttccaagaaaaagtgagttcaatttcaacgagtagtgcgcagagcttcatcatgacaaacgaaaactttggatgtaaacgtttggtgaagaaagactgaagacggtatctacaattgccgctcaaacagtgtttccacagaatgcctccagcaattttgaagttttgaaacttgaaggccaattcaaaacgcttccggttagcagaacacatcaaccccagatggactgagttttctggagctatcagaacaaaatatgagttgccatctcactgaatccgaagcagggaacttctcatttctgaggagatttttcttttttgattgtcagaagccttggtctaatattcctctacggtgcagcaacatctgggtgcactaaagcttcagcagctggtgaatcagtggcgaggacgacgatgtccatggcctgctcatcgaaaggcaggtcgatgaccagaggagtcagccggccgttagagccagcccgcacgcacatcgtgatgtctaggacgttggcttcacccacacccagctcggctgctagatctctcctcaggtgcaacacggaccggccatcgaaccatagcatcctccagacaagcgggctgaagttcccctgatcgtctgcccgcacatagtggatcttccgccgaagcaccggttgcgcctggacgacccggcggcgctggcggcggatcgggccaccgatgggcaccgctggaggccaaactacaggcggaagttcaggcggctctgctcttggggggatggcctcgacaatgaattgcatcaaccttctctcgtcgccgtagttgtgccaggtgccgtacacgcgattgcgcatgacgacatcgtcggacccgtcgtccgcgaagcggaactgccacaggacgtcgttctgccctggggcgtcgtaaaggcgctggacggcgaggcaggtgcggcgggcgccttgaccttggcccgaagacggcgccggagtcgcttccatgcttacgatggcgaggtaacggccgtaggcggcgctgtggaggaggacgtagttgacgccgttgcgctcgaggtggtgcaccacccacgcctcgttcagcgtcccacggcgccggcgcagggtgatcctcaccccgtcttcctcggcgtgaaggtacatgccgtggcggctccgcaggcgcaagtgcgccctgtcggggaagaactttttcgattaggatgttctaggtaatcttttttttgttaaaagtcttnnnctgccngcagcctaggactcttgncnntnncgtataanccgccgaac

SEQ ID NO: 22621 - DNA, 935 bp, Zea mays
  misc_feature (1)..(1): n is a, c, g, or t
nccagatttatcattgttgaatattgctcgatattgattaacaacatcaaatagatgtaccctgtggcaagtcaccatgcctttcaggtaatcataaacattcctttggtccagatcttcaagaattccagaaagccaagcttccctgcacctcaggaactgtaagcgcaattctgactcgctgaaaactccaattcggcgcagatgtgctacaattcgtaggcactcaggtaactgaatatttgatcgaagtttctggagaagctgtgaaactaatgattgcactgtcttcttgacttcagtggctaatccttggacaacaggtaaatcagggtgcaacttccagattttgctcacaaaagcttctaggtcaagtgcttcatcatagttcccattccgtatacacgtgtccatcaattgtggaatttcaagcaagtcaagcaatgtagtgtggttggctagtaatgtttgattaagcttcctctcctccaaaatttgttgtgcggattcaacaaactcagtgcagccagatgttaagtttggtatctcctctatcatggcctcgaggtggccgtcgaagctctcaagctgcgcgcggacgaaggagagcgcctcagaggcggcgatgaacgcggcgtagttttccaccgccacctcctgcatctgccgccgcacccgctccgcgtcgaccctcaaaagctccggctccttgtggaggcgctcgatggagaaggaaagaagctcagaaacgtagggctggtaggcggcaccggcgagcgggagccccatgttggaggcggcatcttgggaggagctcaaatccggcgtgtggcggtgcctcgcgtcgaggaggtccatggcgagcggtgcgagatctggagtcgtgactcagtggtgatccggcccggctccggggggcccgaggcccggccggc

SEQ ID NO: 22622 - DNA, 1548 bp, Zea mays
gaggacaaaaagttccatcattttttttcagataaaccgtcacattctaaacaataccagatcccacgaaagaatgaaaagggtcaatcgacctcttctgtaagacgaggataacagaagatcagtgcaagaatcagtcgcagttaaccacggctcgagtcaacgataacattggagaaagcgcaactgcatcatgtgttactgatgtgtttactgatataatggtaacacgggtaatatgctttggttgaatcagaatttcagagcagctctcgccatttccaatgctccctcgtaggtcttgttgcccccaatgaagccactcatgtggacaaacacacagccagggatgccggtttctgctgaaagttcgtcgtctctcatgcccctccacttctctggcagagcctttcggctctcgaacctgtcaggagcaactgcgactgcttggactcgccaactcttgctcctctcatcctgatacagcacatacttggtcagaggatcagtcttcagctcctcttcaagctcaaataaatgaagtttccacgggcagaatctatccaaaaccatgatttctccacttggatcaatgtttccttttgataacaaacactccaggacaatagaccttgccggtaaccatgatttaacatggaagcgaacgctctccataaattcacttccagctagtaccattgcctgttcaaatgccgcattctccttctcaagtgactggtctggatcagtccagtccagattaaagcgtccaacgcgtgaagacaagtgtgtattgttcacatactttggcggttgatctgtgtcatattgattgattccattgtcaatcgcatcaagtgcctcaacaaagcttttatatatcgcgagatacaaacagtgaacatcttcatgatcctcattaaccccaagctccttagcaattatctccttgccgaagtgcttgtacacaagtccagcactgctaagttttgtgttgaatccatgtccaaaaacctcactgaagcccttctggtgatgatcatagcgatgccgactgggatcatagacacccccaacatcaagaacagcatccaatgtatcaaggatctgggaatcgcgggtgcggacgacgtcggcgccggcgaactgggaggtgaggcggatgaggaagcagccgagcgcctcatcgcagtggaagcttccgttgtgggtccccacgcgcttgccgctccccgcgccgtcaccgtcggccgcggcagacgagtagaccctcagcctcttcggcgaggcggctgccggcgagagagacgccatggtggagaaagggtttcggatttgggatcgcccgatgcctaggagaggagacgtgacggctcgctgcgacagcctccaggcggcggcgagcatactactagtcctccccgtgagatgccagcgctgggatgtggtagggttttgtcgggggcttttgctactgtccgtcccgcccggccgcgcgtctgctgtgcacccgttcgtgtatcccggccggcctcgaggtacccaatg

SEQ ID NO: 22623 - DNA, 1189 bp, Zea mays
tgggtacctcgaggccggccgggccgggatccctagaattaaaaagaacatacatcactccaccttagcccaaaatcaattcggatccgcctccatggctgccgcttcgcagctcctctctctgttcttcctcctcctcctccctgcttgtgatgccatctactgcgacgaagacgactgctacgacctcctaggggttaagcaggacgcgaacgcgtcagacatcaagaaagcgtactacaagctctctctcaaacaccacccggacaagaatcccgatccggagtcgcggaagctcttcgtcaagatcgccaatgcttacgagattctgaaggatgaatccactagggcgcagtatgactttgccattgaacatccggaggaggttttctataacacagctcagtactatagggcatactatggacataaaacggatcctcgtgcagtgttgattggtcttcttctaattgtttcagcatttcaatacattaatcagctaacgaggtataaccaggccatgaaaagtgtcaagcaaactcctgcttacaaaaataggttaaaagctttggagtatgagcgaacaggaggaattgctagcaaaaagaagggcatcaagcaggtggataagaaagttgaagaagagctaagtaatgaagttgaattgcaaattcatggggttgaaaaaccgtctgtttggaggctgtttggtgtccaatttatactttggccttactctgttggcaaggcgcttacttggaagatttgttggttttggagataccgggtaaagaaattaccatatacatgggaggatgcttgctacttgacctggatttcactccaaatacctgcgaatgcatggaaaaatatggatgagtccaggaaggaggaccttgtgagaagacacctctgggaaaagagcaacatggagaggtatacttcagggacgaggaaggaaccaaagcgtaggaggtagctgtgcaacatttttgacctgagactacagcaactttaaacaatacaacatactcctatattggagtgaaaagttattgaccaggcttgagttcaccgatagctaattgctagggtccccgggaagtggcatggctaaggaatcatgtttggaggacaattcatgtaataaagtgatcaaggccacttttgcaaaaaaaaaaaagcggcc

SEQ ID NO: 22624 - DNA, 2294 bp, Zea mays
  misc_feature (21)..(21): n is a, c, g, or t
acgagtccacgcattccgctncccttgggccgaacagtcggccccgcggccgcgaggtagcgcccaaccaccccgcttgtcctcggctccctcttgaagagcgtgccccccgcctcataaatattcggcgccccgagcccgcccggggaagaaagctgccggcctgccgctgcctgctcgcagttgccagcccccgccgccgcggaggacggaaggaagcgaatcaaccgcgactgtctccgacgggaataaagcaggcgaggccagccggtcgcggaacccccaattctcagctgcggccggcgatcgagtcggttccgtcccgcgccgatgcggatcccgcggcggaagggcggggccgggccgctcgctgtcggggtgcccagcaggcgggcgcaggtcgccgcggtcttcgcgctcgccgcactgctgggggtctccgtgctctacgacaacgcccacatcgccgcctcgctgcggaggcacggcggcccgaggacgtacgccaagctctcctccttcgaaggcgccaccgctgtccccagcatcgccaaggaagaggcggcggcggcggtggcgcgggcaacggagtcggtgccggtgcacggcgcggatcgggccgactcgcccccgcacgagcggcaggaggagatcgaggagcgcgcatcgaagcctggagcgacggccgggagctccctgcaggacgcgccgctaatcgaggaggtggtgcaaggaggaagcggaggccacgacggcgacggcgacggcgacggcggcgcgcaggcgcaggagcagcccccggccccgcgggcctgcccccggtacaatgggccgctgggtgtacgacgagtcccgcgcgccgctgtacaaggagtccgactgcagcttcctcacggagcaggtcacctgtatgcgcaacggccgacgcgacgacgactaccagaagtggcgctggcagcccgacggctgcgatctccccagatttgaagctaagttgcttctggagaagctaaggaacaaaaggctgatgtttgtgggggattccctgaataggaaccagtgggagtccatggtgtgcctggtccagtcagaggctccatgggacaaaaagtcccttgtcaagaatggttctcttaatgtgttccatcttcaggagtacaatgcaacggttgagttctattggtctcctttcctagtggagtcgaactcagatgacccagacattcatagcatcagtgaccgcatgatcaagccgacatcgatcgctaagcatgcggcgaactgggaaggggtggactacctgatcttcaacacttacatctggtggatgaacacgccacagatgaaaactctgcacggtggatctttttcgaggaaacatgtcaagtatgacgaaatcgaacgtgtggaggcgtaccggaaggtcctcaagacatggtctagatgggtagaggcgcacgtagatcccaagagaacaacggtcttattcatgagcgtgtcaccagtacatatgcagagcgaaggttggggcagccccaacgccgtaaaatgcttctccgagacacagccggcgatcagctacaataagaaactggaggtgggcacggactgggacctcttcgcgaccgcccagcgcgtgacgaggtcgatgaagaaggtacccgtgcacttcgtcaacataactgcgctgtcggagatccgcaaggacgcgcacacctccgtgcacacgctgcggcaggggaagctcctgacgccggagcagaaggcgaacccgaggaagttcgcggactgcatccactggtgcctccccggtgtgccggacacgtggaacgagtttgtttatggccatatcgtgtcgagcaccccgccgccgcagcagcagcagcagcagaagataaccgaggatgaacctcacagatgacggctagaaaatacttcacatggtagcgcaattttagtgagagaagaagatttgtgatcgaggccataagttattttttttgtctgttctaggtttagaagcctatgctatgctgctggttcacctaagcatttgttggaaggtaacaccaagcagccgtgaacagccacggtcacctgaggagccttctcgcagtgtctggatgtggttgtttgagcctctgaggggaaatgccctgcgcgcttctgtgcttctcgtgtttctacctggcaaccacgtgcacataattttaccagaatccgattgtttccattcgtgtagcagtatttctctataaaatgccagaaagtttcaggcaaaaaaaaaaaaaaaa

SEQ ID NO: 22625 - DNA, 1134 bp, Zea mays
tttgtcgtgttcctttgagtggcaaatgtattaggataagttattttgactgactgcacatcacagtttgtccatgaatccataagatattacaacttttgcagttgtaacaaattttgcataggttaccaaacgcccacaagtttgatgggaaaattaccatttacaaagaacaacgacatagcttcattggtccttccataaatgttgtaatctcagctgtactctctctttctttcttcttttttgtttccctcaactggggtctaaactgtactcttttggttatgagggaatttacacatcaaggggcgtgaaattactatccccggaactacttccccttaccttggtacagtattgatccaatcaaaactgcaactccagttactgcaaccgtcaagagcagttgtttgtgaagcgaaccagtagcaggtcgggctggctttggtactggctgctctgctgctgctcgagtcctgtcacttgaaagttctgatgcagcattcaaaatcgtatggaactggagttcatgtccaatccattcacgaagtctgatatacttcctgcaactttgacaatattctgtccgatttccacacagatcctgatgttcaaaaagatcaactgcaggcagttcaaactgacagtattggcacgcgagcatcctttgtgggcattgtatgcctgtatgaagatcccatagctcgcgttctactgtgtgtttgcaaagtgagcaattcatcggagcatggttttcatcgtagtgttcatccataagcttcctggcaaccatatctccgcaatgttcgcacttctgaaggttccgagcgcagtgcgcgctgtgcaatgcaatgtttgaagatggaacctcccgctgacagtgcggacaggtgaaggtggagatgacggattcagagtccgcggcctccatggagcgatggtcggagtctcctccgtcgagatccacgtctcgcccgccagcgccgattcggcgaatcggagcggaggcgatggtgcggacaagaggactccccgccccccgggtaccgcgcagaggacgtacgaggcaggaggacaggctggagggaggaggcggaaacggaataggcttttttcccagcccgccccgcg

SEQ ID NO: 22626 - DNA, 3034 bp, Zea mays
  misc_feature (51)..(51): n is a, c, g, or t
  misc_feature (58)..(59): n is a, c, g, or t
  misc_feature (75)..(75): n is a, c, g, or t
ttccataaatgtgtaaatctcagctgtactctctcttctttcttctttttngttcccnncaactggggtctaacntgtactcttttgttatgaggggatttacacatcaaggggcgtgaaattactatccccggacctacttccccttaccttggtacagtattgatccaatcaaaactgcaactccagttactgcaaccgtcaagagcagttgtttgtgaagcgaaccagtagcaggtcgggctggctttggtactggctgctctgctgctgctcgagtcctgtcacttgaaagttctgatgcagcattcaaaatcgtatggaactggagttcatgtccaatccattcacgaagtctgatatacttcctgcaactttgacaatattctgtccgatttccacacagatcctgatgttcaaaaagatcaactgcaggcagttcaaactgacagtattggcacgcgagcatcctttgtgggcattgtatgcctgtatgaagatcccatagctcgcgctctactgtgtgtttgcaaagtgagcaattcatcggagcatggttttcatcgtagtgttcatccataagcttcctggcaaccatatctccgcaatgttcgcacttctgaaggttccgagcgcagtgcgcgctgtgcaatgcaatgtttgaagatggaacctcccgctgacagtgcgggcaggtgaaggtggagatgacggattcagagtccgcggcctccatggagcgatggtcggagtctcctccgtcgagatccacgtctcgcccgcccgcgccgagtcggcgaatcggagcggaggcgatggtgcggacaagaggactccccgggtaccgcgcagaggacgtacgaggcaggaggaccggctggagggacgaggcggaaacggaataggcttttggagccgagtcccctcgggttcgggcctacctgtcggtacctagtaaatgctcgtttggaagcacggtttggtctagagccaaaagttggaccgtactgtgccttattaaaagatagacttgacccggtctaaagtatgacgggctgataattgtgtcgtatcagcccaaacgcggcacgaacaaaaaaaatatatatatatctaaaaaatatatatttaaatatttataactttgcaattaactaaattctttttgagaaagagccaccaatgttttctataatttttgtgaaaagaaaaaaatattaaaacatgcatttaaacactagttttttaatccgtgtctcacctcatgtcggtccaagcacagactatctagtcatgtcgtgccgtgatacctatcgtgcctaagtttaagacacgatatagctcgcgccatttaggtcatgtcggcctaacccatttctttcatacaatctcattagttttttttttgtgtggtgctggccctaaatggcccggtccaaacttttagatccagtttggggtcgaggtgatgctcctgttggagctgaacgggctatctattttattaggcttccatggctatagactagggctgggcattttaaacccgttaaccgaacccgaaccggacccgaactcgaatagactgaattggtcggtttttcgggtttcggttttcgggtttggtccacagatcgtatcaatttggttctcgggttcggattcggtttttataacgtgttacccgaatagacaaaaaaaaaaccccgaaatacagccgatcctcctctgtccatccacagcagcagcccaactgcccaaagtttcccacgtcccgcgaggccgcgcaggccgttaggcgatagccagccacggcccagcagcccaatgtctggcgattcctccatgtctcagcgtagcgtgcaaagtgccgaggcagccacttgccaatcctagagctactcgcaagcgccgccgcccacgctagccacgcctgcaggaacgtcgcccacggccccacgccgctgcccgccgccagcaggaaggccaatccacccgcaggctcccggtgtccggcgttcggctccactgccctgacgtccgatgttctgctcctgcgcgggcgcggccgcgctgcagctccaactccggcgtccgctccgctgctccagctcccaacttccccccgaccaggtccagtggccagccggccaacgaaccagtatccgctctaacttcgtcctgtgagtgaatgtgtgaccgtgtgtttgcaggttgcttattggattggatgcaaggctgttggcaggctgtaggcgtgtaggaacgccggggtttgcttgttggattggaagtaggtttgcttgttggacgtgtagggctccaggtttgcttcttggattagatgcaggtttgcagtttgtttgttggattgaacgaaggtgcagtggcagtgcctagaccctagtgcagtttgctcaagagtcaagttattcaggttctggaggaaccgaatagaccgaaccgaatttttcggtctatttgggttcgggttcggttcctataattcagaacccgaattttatagaacccaaatagaccgaaccgaatagcccgtattacccgcccagccctactacagactacaacactgtatcggcctgccatgctttagtgggctgttggcccgttcgttatgaactcctcttctctcttctttttttttccccactcaattcaggggaacaggacgcgccgagcccgagagcttggataagaaggcaccgtacgaatcccgaggctggtattgagaaggtgaaatcccgccagcgtgtcccacactgcaccgaccttgccaccacacgtcgctgtgcgcgtgcgcccgacggcccgaggcgtcgacgtcgacgggcagcttcctgaaggttcagaaatacaatggcgtgcgggcgaatcttccgccggacgacgacgacgaccacaaacgcgggcgcgggcgcactcgtagtcgtagggatggatggatggcgagattccactcactgtatgatccgggtgcgtgcgtttctttagcacccccagctagctacgaaag

SEQ ID NO: 22627 - DNA, 2021 bp, Zea mays
gccgctgcctgcctcctgctagcagttgcagcccccgccgccgcggaggcggaggaggtgaaatcaaccgcggttgtccccggtgggcgcaagcgaggccagcaggtcgcggaagtcccaattcccagctgcggccctccagtcggttccgtgccgcgccggcgccgatgcggatcccgcggcggaagggcggggccgggccgctcgctgtcggggtgcccagcaggcgggcacaggtggccgcggtcttcgcgctcgccacgctgctgggggtctccgtgctctacgacgccgcccacatcgccgcctcgctgcggaggcacggcggcccgacggcgtacgccaagctctcctcctccgacggcgccgcctccgtctccggcgtcgcgagggaggaggtggcgaccgtagagacgctcgcgccgccggcgcgggcgccggtggacggcgcggatcgggccgacccgcctccgcacgagcggcagcaggaggccgaggcgggcgcggcgaagcccggtgcctccctgcagcaggacgcgccgctgaccgaggaggtggtggaagggggaagcgggggccacggcggcggcggctcgcaggagcaggagcaggatcaggcccaggggacctgcgacctgtacaagggccgctgggtgtacgacgagtcccgcgcgccgctgtacaaggagtccgagtgcagcttcctcacggagcaggtcacctgcacgcgcaacggccgccgcgacgacgactaccagaagtggcgctggcagcccgacggctgcgacctccccagatttgaggctaagttgcttctggagaagctaaggaacaaaaggctgatgtttgtgggtgattctctgaatcggaaccagtgggagtccatggtgtgcctggtccagtcagaggcaccatgggacaaaaaatctctcgtcaagaatggttctcttaatgtcttccatcttcaggagtacaatgcaacagttgagttctactgggctccgttcctagtggagtcaaactcagacgacccagacattcacagcatcagcgaccgcatgatcaagccgacatcgatcgcgaagcatgcggcaaactgggaaggcgtggactacctgatcttcaacacttacatttggtggatgaacacaccgcagatgaaaaccgtgcacggtggatctttctcaaggaaacacgtaaagtacgatgaaatagagcgtgtggaggcataccggaaggtcctcaagacgtggtccagatgggtagaggcgcacattgatcccaagagaagcacggtcctattcatgagcgtgtcaccggtacatatgcagagtgaaggctggggcagccccaacgccgtaaaatgcttctccgagacgcagccggcgatcaactacacgaagaaactggaggtgggcacggactgggacctcttcgcggccgcccagcgcgtgacgaggtcgatggagaaggtgccggtgcgcttcgtcgacgtgaccgcgctgtcggagatccgcaaggacgcgcacacctccgtgcacacgctgcggcaggggaagctcctgacgcccgagcagaaggcgaacccgaggaagttcgcggattgcatccactggtgcctccccggcgtgccggacacgtggaaccagttcgtttatggtcacatcgtgtcgagcccgccgccgccgcaggatcaacctcacagataacaacagctagaaatacttctcgtgcatcagtgtgtttgtggtcgacgccataagttatttctttttcccctaatagtaggtttagaagcctatgctgctggactggttcacctgagcatctgttggaaggtcagatcgcactagtgtagccaaaaaaagcagcagtaaatgtggttgtttgagcctgaggggaaatgcgcgcttctgtgcctcgtgtttctacctggcacgtgtacataattttttaccagaatcattcgtgaaattgtttctattcgtgtcgaaatatttctctcaaaaaaaaaaaaaaaa

SEQ ID NO: 22628 - DNA, 6700 bp, Zea mays
  misc_feature (1553)..(1553): n is a, c, g, or t
  misc_feature (6613)..(6614): n is a, c, g, or t
cattttgcaggcataatgattgtaaacatgcattcatgtaatgttgcagcttcttcagagtaagataagaacttaggaaaaaaacaatagtgcaggcttctgtgcttcttagatgctgcttggttcacaaaatgtaatataaatggcatctttttttttttgctctcgttttttagtggtaacaagtttgaatatgctagtatcaattcctagtatggtatacaattacaatttgacatgttatcaattacccatcacattacaaaatatgtaaatcaaacaacatctcaatgtaacgcttgacttgaacaatactacaattatgaattgacagcatctaagagaagcttggagtttggaaacaaagatgccggagcatggttttcatcgtagtgttgatccacaagcttcctcggaactatatttccgcaatgttcgcacttttgaaggttcctagcgtagtgcgcgctgtgcaatgcaatgtttgaagatggaatctcccgcatgcctgcagaataagcagagaaatatggttaattatcaacgtacttaaccgcaactaaggactagtctgagtactctatttttagagggtttcttacttttacgaggaaaaataaactaatttatcttggaaaatagaaattctatagaaaaataaggttaaggttccaaactagctctaggtaaaaaaacatgggggagaaccacagttaataacgcaacagcgcgactaaaaacaataccccagacagtgtggtagctgatgcgatactggtaaaactgattatgtgtgtacacgtaacgtgactgatcgttggacaattttccgaaggtaatccacagagcaacggtaccactgagcatgcatgcggaaaaaaaaatcagtatcgtaaatatgcagcggttgacgacccaaagtctcatcccgtcgtgtgttggcgtggcggaggcgaacgaaggaatcgaccggcggcgggtaaacgcagacgccgggaaggcgagggaagagcgttaccagtgcgggcaggtggagatggagatggcggggtcggagtccgcggccgccatggatcggtgatcggaggtcctccgcggagatccacgtctcgcctgtgccgagtcgagcaatttcggggcggcgatggtgcggagcggagcagaggacggggggcaaggggagagaggttggagacttggagcctggaggcgctagaaacggaataggacgatttactaggaggccgaggagagagagagaaaggggccctctctcctgttcgtgtcggactgtcgggggaggctcggagacgaggcccacctgtcggcacctagtaaatgctgctcggtttggaagagcgcggtttgggctcttgttggagctgaacgggctactttgttgggcttcctgggctacagaatacagtactgtgtcagtggactgcagagattttggtttgcatctggtctacacgattcccccccccccccccctgagttcagggaaacaggacgcagagacagagagagcgcacttggataggcaccgtacnaatctcaaggccggtatcatcaccagacacccatcagtcttgatttttctcatccggccaacttgtccctgaagatggaatctcccgctgactcgggcttggagacgaacgaagccaccacacgtcgggatgcgcgtgcgcccgaatccatatccgatgccctctccccggcgtcgacgccgacgtcgacatcgaacgggcagcttctccttcccgagaaattcaaccgaacggcatggcgtgcgtgcgaatcttccgccggacgacgacggccggagacgggcagacggcgaacgcgcgggcgcacggccgcacgcacgcacgcgtcgggggaagctgacgcgccgcccaccgtcaccgatcctcctcggatagtcggatggaaatggatggcgagatctccactcactcctcgaccttttatggtcctctcctcgtccgcgtgcgcgcgtttcttttgagcgcttacgccctatctatctagtacgtgccacgaccgatgacgacgacgaccaccacgattttataataggccatatatcctatacatacgagattttcatgcacaaactttggtacatatgaaccgacaaagttttacaaaaatatatacatattctttccattctactctaattatatacaaacttttaagttcaaaatagttatgttttagctgtaataaaaaaaaaagagaacattttagccaattttcaatttaaacttgccaattttttatctttttattacgtttataatgaatttgagcttaaaattttatatagaactaaattaggattaaaagaatatgtatgagtttttttagaatttttctgaactatattagtttatatacatctatgttcctttataataatctctcgaggcctttctagtgggcaaatggtttcccaactttcccaggtcaccaaagcccaaacggaaatggatggaccatgacaaacactgttgcgtgagtgactgactgactgtcgttgttggcagcggcagcaagctgttccgttgcggcgataggtggtggtgcggttgatgcatcgccgtggtactgtgcgtgccgttagggggccgtccatgccagagccagccagccagcacacccccgatgggtggcggcgctttacggccactgctagcaggcttttgttgacgcttaaccaaagctgattagtctgttccaacaaacccatacagcctggcgggaaaaaaaaaacccaacctacacggaactacaaggctgtggcggcgactggccgcgtgaggaagccgttccgagccttcgtcgtcctgcaactggcaactgcaatgcaagcaccgacttgtcgtctggttcattcagagttcacgtctcatcatcatcagataatgaacacagcaaaaccgtgaccctctttgttggacgctgcattgcgtatgtttaatgtaactggatcttgtgttgagttatgtatgtatgcatgtacatgcacagcaaggtctgggtgttttctttttaccatggatggatcacaggtacaggacgacgacgacacagaaactaatgcaaagaattgtcagttcaagtcagtgtataatagccgaaggaaaaaaaatgagagaatgggttaggaatgaaacctatagcacagcacaggttcagagcagagagcagaggaggagatgagtccattgagatggtggcggttggttaatcgagactcgagaccgactaaacctagctgtccgacggcatcactcggccgctctcggccgccgccgccggccgccggccgcggccaggtaccggtgcgccgcgacgagctcctcccggaagcgggcaaggtccagccgcacgttctgccggtccaggtacaccttcttggtcacgtcccagccgcgctgcgcgacgccggcggggtccgtcagcacggggtcgcccgtggggtactcgcgggacagcgagctctcctcggggaggatcttgtagccgacgtagcgcagccccatccgcgccgcggggtcgccgtagtaggcgccggcggcccagtccgtgcccagcggcaccacctggatgaacaccttcccgggccgcatgaacaggaagtgcgtcatggcggcgccgtgcaccccgaccatcgcgtcgctggcgttcagctcccggtatatcttgcacagctccgtggtgcggtcggggcggatcacgcgcacgtcgaacccgacgtccgccgccagcgccgccacgtccgcctcgttctcgatcacgcgggaccccgtccgcgacacgatcaccagcctgggccgccgctcggcctcggcctcgcggggacctgcaggaggcgcgcgggggaccaaggcgccgccgcggtggtggcggtgcgggcgcctgcgcgccgcgcgccgctccaggcgctccaggaactcgatgcggccgcggtacgcgtcgtccaggaacctgcggaagtcgccgatgccccggcgctcgggcgtccgcgccgggtccacggtcagctcgccgtggatgcgcagcccggcgatcacctcggggaagcagtgcacgcggcggtcggcgctgaagtcgatcggcgggaactccgacagctgggacaccacgtcgccgtacttggtcatccaccagtcgtggtactcgaggatcaccagcgccacgcgccgccggaggtggcgcgccgtcacgaagagcggcaggatgccgtcgttgaactcgtggtacacgttccccgtgtacccgccggtggagaacaccacggccggtacgtcgtggcgcacgtcgcaccgcgcggcgtcgccgggggccacgcggcgcagccgcacctcgtcgatcgtcgccatcacgttcgcctcccacttgcgcgtgtacggccgtatccgctcccccggcgtcgagttgccggtggacacgagctggaacgacgcgctggccgagtgcatgcgcaagtcccccctcgcgaagcagatgtccgcgcgctccgacgtgcggtcgcagcagaggctgttgttccccacggccgagcacggcccggacaccccgccgcgcgcggccgtggccgccgccgccgcgccgccttcgtcgctatgcacgaaggagaggaaggacacgggcgccacgaacagcgtccccacgcagaggaaggagagcaggagcatggccaagaagcgccgcacgccgagcgccctgggttgcaccgtcttgccgctcttgccaccgccgccgctgccgtagtcctggtagtagtacatgacccgccgcccgacgcccttgggctgcgacactttgcatgccacctcctgctccgtctcgcccttcctgaactgcaagatgtagattctgtgttgctgttgctgcaccatggccgtcgccagagagagagagagagagagagagagaaggcctcccggtctcggattactatgagcagaagaggagaggggggtataaatggctcagctttagcagaagagtataggaaactattggcggttagaggttggcggatgactatgctatgtcacggaaaacgcagccaacagtgatggaacaaacatctctttgaggtgcatccagtgggtcctctgattgccacctaaattaaaattaaaacgcgcaatatatttcttatataacgacaatcattcactctagataaatgaatcaacccagttctcttatttcacatcataaaaattaagccaagactagcctcagctgtttgcagtcgtatctgattgaaatatatatcgctgcactcatttcttgagaagacatatctacggataatattatggcatgtaaaatttattgtcaagtgcttgtgtatatagtttttttttacgaattggacatgaaagttcctgattatattaggaaaacaaagaacgcaaattaggtagtttaataaccaacgagggtgtaacaaccaaaaacaacaactagagctaacaattaaaagtaaaaaccaacaaacgacggtcggttagattgagacatcaacacgcgccgtacgcccgtacaacaccgacgcactaccgacatatagcctcttttccgaatgaatacaattctgtttagcaacttttaacggtcatttacaagggaagcattgggacgtactacgggggttgttgccaacgtacaaaccggtaacgacatgccaggtcagggatggtcgtgcaactgtttttttggcgtgacgcctggtacgccgacaatgatcttgctacaagatacatgtatctgctcaaccacgtgaagaactttgaggttcgtgtgaggcatgtgaaggaagatggcatcgcctccatgttggtgtcgcgcctaactgatcttgaggaaataaacgccctagtgtactccatctctctagtggacgagcctaatgtccggcagtgctctttggcacaacaaagctccatagagggtacaatttttcgactggttggtaggaaaagaaaaaaatgcaatgcaaagttaatctgctaacaaaaagaattgatgtcaggtgaagcttgaaacaacgacacatgccctcttttgctttgagttcgcaaggcgcttctaggtgtggcttaggatcgacgtccccgagcacgataaagttctcctgagcaacctcttgcgtcctctggacactccagagttacacttcaacgtttttgtgttattgtgttgttgggaaacgtggaagagaaaaacaaagttgtctttgatggtgttaggctcagcctgagggaattcacaaccaggatcagggttgaagcaatgttgtggagccaacgcctaaaaacaacaaatcgctgggtgattgataaatggtattccaagcttaatatggctaggtgatacctatgcttcaccccctgtaacatctcttgtaaaacaatcctgggcccttttctaggaaggctgaaaaaccttcaatatatttaggtgggggactcccccccttgaccatctaaaaaatagatcttgagttacaaaaaggagaaaccatgatgtgtgggatttattgcacatagtattctcactttttaaataaaacacatacaannaagaaactattgcttgtatatcgtatgtatatacttagaaacattatgaatggtttttgcataatgtcttttgatacaatgctcag

SEQ ID NO: 22629 - DNA, 562 bp, Zea mays
ttcgagcggccgcccggcgcgtgacgaggtcgatggagaaggtgccggtgcgcttcgtcgacgtgaccgcgctgtcggagatccgcaaggacgcgcacacctccgtgcacacgctgcggcaggggaagctcctgacgcccgagcagaaggcgaacccgaggaagttcgcggattgcatccactggtgcctccccggcgtgccggacacgtggaaccagttcgtttatggtcacatcgtgtcgagcccgccgccgccgcaggatcaacctcacagataacaacagctagaaatacttctcgtgcatgagtgtgtttgtggtcgacgccataagttatttctttttcccctactagtagctttagaagcctatgctgctggttcacctgagcatctgttggaaggtcagatcgcactagtgtagccaaaaaaagcagcagtgaatgtggtggttgtttgagcctgaggggaaatgcgcgcttctgtgcctctcttgtttctacctggcacgtgtacataatttttttaccagaatcattcgtgaaatcgtttctattcgtgtcg

SEQ ID NO: 22630 - DNA, 2741 bp, Zea mays
tagccctgaaagtgaaatccgtagagccgtattatcgtccttggcatacattttcgtagtgtgaaaattgttaatgatttttcaaagaacaatggatcgtcattgtaggggtagcgtgatagttgtttggagttacttgttaagcatgggaaagatattcttttggttttcaatattactactgatgtgaattttaagctttatattgttactgcaattgctattgatgtgtaagatatccccttcactatgggcgcatcatccattccataactgctagaacgagaacgctgctactgaccccgttaacccaagttcgaaggcatataaaatagagaaggaaatggtttgtattgaaccaaatttctctctgtccttttttctcacgtttatttgacaacttgggccgctcggggcctgttcttttggtactcatcaaactccgcatggagcaccgatcaccctctgtatatgttctaggagtattaaaattacaatattcactgtcacaaaaatgaaaaaaaccaattgaaaatatcctccaccgtgaaaaaatgaaaaaaaaatcactatgtgacacccacgcttcagtggtatatcctctgttccacgcccaatcccgcacggtggcgctgcgcccagtggtcatacgcctggcgcaaccggcggcggaaccgtgccatgtccaggcgcacgttctggccgtccagataaacctgcttggttacctgccatcccttagcgttcacggtatccgggtcagtcagcaccgggtcgtcgttggcgtacttcctgtaaatcgagctctcggacggcaggattttgtacggcaagtagcgtaggcccagccgccgcgcgggctcgccgtagtacgtctcggcggcccagtcggtgccaagcggcaccacctgaatgaacaccgagcccgggcgcatgaacaggaagtgcgtcatggccgcgccgtgcacgcccaccatgacgtcagaggcgtttagggcgcggtacatcctggcgagctccgtgtcctggcgtggctggagcacggcgacgcggaacccggcgcccgcagcggcgcgcaccagctcggcttcgttctcgatcgcgcgcgacccgttccgagagatgatcgtgagcccggacgcgtgggcgaaggctggcgtgctgcgctgccggctcctcttgcttccgcgatgttcctgtctcctcgcagcagcagcttccttcttctcctcctcgatgatcgtctggatgcgaccacggtgagcgtcatcgagcatcagacggaaatcctggatcgtctggttggctggcatccgcgcggcgtcgatagcaagctcgtcgtggatgcgaagcccaaccacggcctcggggaagcagtgcgtgcggcggtcgttggtgaaatcgatgggcgggtagtcggagagctgctcaacgatgtggccgtacttggtcatccaccagtcgtggtactcgagcatgacgaagaccaccttcttgttatagtggcgcgcggtgatgtagagcgggatgatgccgtcgttgaactcgtggtacacgttgcccgtgtagccgccggtggagaagacgacggcggggacgtcgtggcggacgtcgcagcggctgggcgctccctctggcgcggagcggaggcggagctcgtcgatggtgctcatgatgctggactcccacttgcgcgtgtatgggcggatgcgctcgtcggtggccggtcgagacgagttgggaggcaggagcaggaagagcgagttggaggcggcctgggtgcggacgtccccgcgcatgacgcagacgtcggtgcggagcgcggtgcggtcgcagcagacggtgtcgttggccacgtcggcgcacggcggtgccggtgcgccgtcgtcgtgccgcgccctcctccctagctgcagcagctcgtccatggtggcggagacggggctgccaggaagcagcagcaggaggcaggatacgagcgcgaagccggcaagcatacggagcagcgcatcgtgcccgtgctttcggtgttgacaggcgtagtctgccaagcggccccggagctccttcatcctgccgccgcctgactcttcagccggcagcgcatcctctgccgccgcctcgccctttctgtgctggtgcaccagcaagctcgcccggtggtggtggatcatctctaagtctcaactcacagtcggattttgagtgggggccggcggggggcgtggtgttcgagccttaaaggatcagcagtactcagaaccgcccggaagaacccaggaagcagaagcacagggacgcgcatcccggcccgccgacggcgttagcacgcgaacgcagagtagaagagtcgtcgtagaccatgaccgcgtcggctggcgtggactcgcgtcattttaaacatggcgtgctgcgtggcggtctggcggaaggaaccaaaccgcgtctcatttctatggcttgcggcgtaagggaatgcaatgcaacaggccaaccgccaacacgaccgaaggctgcgccgctgatgctgaccaaacggaccctgctggcctgctggtgctggagatggactggcaatgcagcagcgcagcgggcagttggtggtagcacggaatcggcagcaggaggaggcggccgcaggtcgctttcattgggaccgcttgcgggactttgcgcgtttcatattctttcttagcgcgggttgcttatttgtatgggaaaggtgtttccgttcgcctgca

SEQ ID NO: 22631 - DNA, 2904 bp, Zea mays
  misc_feature (388)..(388): n is a, c, g, or t
  misc_feature (622)..(622): n is a, c, g, or t
  misc_feature (736)..(736): n is a, c, g, or t
tttgttggtgaacatttacatgcgatggcggaatcacctgatgaacagctagtggtggtatcacaggtctgaagttcttcacatattaactttgaatgaataactctgtaatattattcatttagttttgtttttcataactagctagtgtcttctttaaatttataacttgattgtacccgttgcattgaacctgtgcaggtgcttgtatcagatatcaatataggttatgaagaaatagtcaatactcaggtaataacagcttctagttctgtggtcactagcatgccttttaagccatttcttgcagtatattgttcctggaggctcgaatgacaatgtctgttctgcactactgtggtcactgaaacttttcatttttttattnttcgcaggtacttgctttcaatggccagcctgttaaaaatttaaagaacttggcgaccatggtggaaaattgcaaggatgaatttttgaagtttgatctggagtatgaccaggtatgttcttgaccctttctttatttgacttttgcagctaataaaagcatttctcatggacacaaatatctggagtttggtaggaagtttcccccctcaaattacatttgcacccctataanatgtctcatgatttctcaggtctagcaatagcaaatattatttttcttgccaaattggccatggacagctatagcctattgtcttacagtattatatatgagataggattattnaaatgaatcagctatcacttcacatgatgaaaaactgctccaaagtaactgtcaggattctttttgatttgttacttaactacttgaagctagtaactagtagcataatatatgatttgatagattgttgtcctcgagacgaaaactgcaaaggctgctacccaggacattctgacgacgcactgtataccttctgcaacgtcggatgaccttaaggcctagtgggaggaaaagggagcatgacgcagccctgggcctgggccagggccatcaggtgggccaatagtttgggccacaatttcggctgaattgattagcgcagcgtacgatccgtgatgaagaggaaccccaatgtttatctgtttaagttaaatatcttttgaggggttgtggatgtgagagtgctggctggtgtctaaagctccgccattatagaaggtttgagggactgtcactgtcagataacaataaactggagttgttacaggcagagtcatcgtgaaaacgatagtgtctagtaagaagctgagtttgttttttctttacatgatttcattacaactacaccaaattattgacggggaaaggaatcataattggtccgtgatttcattacatccttggtgtctcaagcttgttccgcatagtacctgctatttgtcaacgatacttttacttctgcttgtaaagtatttgcatcttgtttctggacaagtggtacttaaaagatatttaagcgttgtgaaccaaagttctgtttgccccggtccttcggctctgtctttgtcacgccgtagttgtccctctcgaatggtacgggtgagtagtagctggcttccagctcatgcgacgaggaaatttggaattctggccaggaccatggcaccttccactcctgcgtttgcgtttgcagcgtctgtatccgtgctgaggcacaccttgcgttcactcccctttgcttcccttcagcgctattcttgcaggttggtagtggtagctcgtccgcttccgtttgtctttatttcgttcagcagctatcgaggtgtacaacaagtgccattggccttgacgatttcgtttccgcatggtttgccgccctccctcgctggtgcggcgttagctgggtgccgattggtacgtgccttttggaaagcgaatcccaggatcgtgatggcctgcacggcaatcctgccggccgccgccgccgcgcttcgcaactgcctttccgatatcgaaacggctcacgcgtacggtcggggtgctgttcagttctgtactggcattcagcagcggcgtgcgccgtcgactgattttactgcgaacgtaacggtggcttgagtaagctggaaactccgattcggggtcatcaaaatcaaagaaactgaaagaattctagggattttgatccatctcagtctctcagtgatgccgcattgcacagtaccttgttttttttttcaaaattgtggtaagtaccatagtctagaagctggagctataaaaacgatataccaccgtgggcattttttaagccttgccgatgggattgactgctctttacacccgtatgaaaaaaaatcaaacacgaattcaatttctggtcggccacttcctcatcgaccttgtagaggagcacggcgtaggcggtaggccgtacatgccgtgccaaaccgtttcaaagcccaacggccatgagcccgtgaattatttattcatcacggcgcgtgacctgttgacacgtcctgggctcaaaccatgaaatcaaagttgtcctaggaacccgccgcgtcataactatacatgtcgcgccaaatcgtactccgtagtatagcgccatgtgcccgaggcagcgcgccgatcgccgagggggacaacgaggaggaaggaaaccaacgtcacatgggcacacaccgagacaggcaaatctgccacctccgcgcctgtgcgtctgtgcccgcccccacgccgggctgccgaagaagcgtctcgtccgcgaaggacgagcgacggaacagcgccaagcgaagcagcaggggggctgctagtgaatacagtattatatagtgatcaattactaattaacaattaatggagctttgttaagttgcacaaatcattactcccccgtcctagtatacaagacgcatgtttatagaattatagatagc

SEQ ID NO: 22632 - DNA, 845 bp, Zea mays
ttcgatccgagtatggccggccgggtgaatatgatgcacctgtcttgttgtctggtgaaacatttacatgcgatggcggaatcacctgatgaacagctagtggtggtatcacaggtgcttgtatcagatatcaatataggttatgaagaaatagtcaatacccaggtacttgctttcaatggccagcctgttaaaaatttaaagaacttggcgaccatggtggaaaattgcaaggatgaatttttgaagtttgatctggagtatgaccagattgttgtcctcgagacgaaaactgcaaaggctgctacccaggacattctgacgacgcactgtataccttctgcaacgtcggatgaccttaaggcctagtgggaggaaagggagcatgacgcagccctgggcctgggccagggccatcaggtgggccaatagtttgggccacaatttcggctgaattgattagcgcagcgtacgatccgtgatgaagaggaaccccaatgtttatctgtttaagttaaatatcttttgaggggttgtggatgtgagagtgctggctggtgtctaaagctccgccattatagaaggtttgagggactgtcactgtcagataacaataaactggagttgttacaggcagagtcatcgtgaaaacgatagtgtctagtaagaagctgagtttgttttttctttacatgatttcattacaactacaccaaattattgacggggaaaggaatcataattggtccgtgatttcattgaaaaataaacatcgcagtctccggccgaaaaaaaaaaaaaaaaaaaaaaaaaaaaaaaaaaaaaaaaaaaaaactcgaagaggg

SEQ ID NO: 22633 - DNA, 2272 bp, Zea mays
ctagttctagatcgcgagcgatctagaaccctagcccgccccccggggacgatccctcctccgcctccaacaagcacaagcgcaagcgggggcgcaagcccaaggcgtcgccgccctcccccgaccgctcctccccctctccctcggccgcgcccgctccggctgggcgccgtggccgcaagccgcgacgtcatgagtcccccgccgacgcggacgccacgcgtccgccgtccccgccccgccgcggggagccgaagccggtggcaaacggaggcgatgtggtggcagtggcggagtcaggccccgcgagctgggatgaggtggtgagggtagtgccgtgcatggacgctgtggtcaaggtgttctgcgtgcacacggagcccaacttctcgctgccgtggcagcggaagcgccagtacagctccagcagcagcggatttatcatcagcggtcgccgtgtcctcaccaatgctcactccgtggagcactatacccaggttaagcttaagaagcgcggctccgacaccaagtaccttgccaccgtcctggccatcggcacagagtgcgacattgcgctcttaactgtcaatgacgatgaattctgggaaggagtttcacctgttgagtttggaacattaccagcccttcaggatgcagttactgttgttggttatccaattggaggagataccatatccgtgacaagtggagtggtctctaggatagaaatactttcatacgttcatggttctacagaacttctaggattgcagatgttgctgtctattaattcaggaaattcaggtggcccagcttttaatgataggggaaaatgtgtcggtatagcttttcagtctcttaaacatgaagatgcggagaacataggttatgtgataccgactccagttattacacatttcattgaggactacaaaaaatctggagaatacacaggctttcctatacttggagttgaatggcagaaaatggagaacccggatctccgcaaagcaatgggaatgaaaccagatcaaaagggtgttcgtgttagaagggtggagcccactgctccagaatctggatgcctacgaccatctgatattattcttagtttcgatggtgttgacattgctaatgatggaacagttcctttcaggcatggtgagcgcattggcttcagttatctggtttctcagaaatatactggagagaaagctcttgttaaagttctgcgtgattcaaaagttcatgaatttaaaataaggttagcaactcacaagcggcttgttgcggctcatgtgaagggcaggccaccgtcgtattacatagttgctggctttgtttttgcagctatctctgttccatatcttcgatctgagtatggaaaagattatgaatatgatgcacctgtcaagttgttggtgaaacatttacatgcgatggcggaatcacctgatgaacagcctgtggtggtatcacaggtgcttgtatcagatatccatataggttatgaagaaatagtcaatactcaggtacttgctttcaatggccagcctgtaaaaaatttaaagaacttggcgaccatggtggaaaattgcaaggatgaatttttgaagtttgatctggagtatgaccagattgttgtcctcgagacgaaaactgcaaaggctgctacccaggacattctgacgacgcactgtataccttctgcaatgtcggatgaccttaaggcctagtggaaggaagggagcataacgcagccctgggccagggccatcaggtgggccaatagtttgggccgcattttcggctgaattgattagcgaagcgacgatccgtgatgaagaggaaccccaatgtttatctgtttgagttaaatatcttttgaggggttgtggatgtgagagtgctggctggtgtctaaagctccgccattatagaaggtttgagggactgtcactgtcagataacaataaactggagttgttacaggcggagtcatcgtgaaaacgatagtgtctagtaagaagctgagtttgttttttctttacatgatttcattacaactacaccaaattattgacggggaaaggaatcataattggtccgtgaaaaaaaaaaaaaagaaaaatctcaagcttgttccgcatagtacctgctatttgtcaacgatactttcacttctgcttgtaaagtatttgcatcttgtttctggacaagtggtacttaaaagatatttaagcgccgtgaaccaacaaaaaaaaaaaaaaaa

SEQ ID NO: 22634 - DNA, 1191 bp, Zea mays
gcgtgttttggtggtttttttttttttttttttcagcgaagtattaggcagcttgatcttctatctctccagcgtatatattaatgagaacccacagcccccttgataaaactagaaagcatccacaaatacaaccaaatgatgagaaacataaaaaaatagtgcgcgctagagctacagttgcaacatataacaacatttggcttcctaaggtaaagctgcgcccgaaaaggtactttgtttggcctagaaggttaagctgctgagttctctgattgttgagctagataatgctcaagcatgtcctcttcatcgtcttcaaaatcatcatcgaattcaatatcctcctcctcttcttcatcttcatcagcaactgtgcttgctcctttcactgcatgccttccactttcaaaatactgccgtcctgtgagtttcttttcctttgaggatgtaagagctgaatctggcataagtttagcacgctgtaaggccaactcagcttcaaatcggtctctccacgccagaaagctctctacagtaacagcttcaccatgtggtataataacctcctcttctgcttcagtttcttcaggttcctcgtcaccaccattctgaccatatatctcacttagccactctttggctgatgaaacaagagtgtagaccatagccatgccaagattctcttttgcctcttgctcaagcttttccttcagggatgcaagatcatgtggtttaatccctcgtacacttttcacatttagtagtggaggttcatcggggtacttctcagtgtgcgcaaaaatcagggccagttgaactgggacataagctgactcatcaaaatcatcatcctgaggagagagtaggatctggaagcaccgggcggtggtggcgatcccactctcactcgggtcgatctccttgatgtcgtccatgaggatggcctgcagtgcctccacctccatatcctgctcctgctcgtagtcggccatgatcggtgctgatggcgacgctgctggctgtacttcggcttcctacggggaaggtgaggacgaggcctctgcggcggcgcggtggatgattggagataggcgagcgcacgccgggggctgcgtgcgtcgccggaggaggtgaggtgttagtcacgagaggaaggaactaggatggctcgctcaatgtgctcgggcc

SEQ ID NO: 22635 - DNA, 1309 bp, Zea mays
ctagttctagatcgcgagcggccgcccttttttttttttttttagagataggagtattgaatatctttccataaattacttgtcccaaacacgcaacatgctccacaagccaaaatacacgtagtagccgatcaaaaatacagtaaattatacagcgaagtattaggcagcttgatcttctatctcctccagcgtatatattaatgagaacccacagcccccttgataaaactagaaagcatccacaaatacaaccaaatgatgagaaacataaaaaaaaaatagtgcgcactagagctacagttgcaacatataacaacatttggcttcctaaggtaaagctgcgcccgaaaaggtactttgtttggcctagaaggttaagctgctgagttctctgattgttgagctagataatgctcaagcatgtcctcttcatcgtcttcaaaatcatcatcgaattcaatatcctcctcctcttcttcatcttcatcagcaactgtgcttgctcctttcactgcatgccttccactttcaaaatactgccgtcctgtgagtttcttttcctttgaggatgtaagagctgaatctggcataagtttagcacgctgtaaggccaactcagcttcaaatcggtctctccacgccagaaagctctctacagtaacagcttcaccatgtggtataataacctcctcttctgcttcagtttcttcaggttcctcatcaccaccattctgaccatatatctcacttagccactctttggctgatgaaacaagagtgtagaccatagccatgccaagattctcttttgcctcttgctcaagcttttccttcagggatgcaagatcatgtggtttaatccctcgtacacttttcacatttagtagtggaggttcatcggggtacttctcagtgtgcgcaaaaatcagggccagttgaactgggacataagctgactcatcaaaatcatcatcctgaggagagagtaggatctggaagcaccgggcggtggtggcgatcccactctcactcgggtcgatctccttgatgtcgtccatgaggatggcctgcagtgcctccacctccatatcctgctcctgctcgtagtcttcccacgcggcccatcataaccatacacaagcaaagacgcggttggcagcaagagcaaagcggagaaaaaggggcttccggatttggttcgtaccggccatgatcggtgctgatggcgacgctgctggctgtacttcggcttcctacggggaaggtgaggacgaggcctctgcggcggcgcggtggatgattggag

SEQ ID NO: 22636 - DNA, 1106 bp, Zea mays
ggccgctttttttttttttttttgccccaaacacgcaacatgctccacaagccaaaatacacgtagtagccgatcaaaaatacagtaaattatacagcgaagtattaggcagcttgatcttctatctctccagcgtatatattaatgagaacccacagcccccttgataaaactagaaagcatccacaaatacaaccaaatgatgagaaacataaaaaaatagtgcgcgctagagctacagttgcaacatataacaacatttggcttcctaaggtaaagctgcgcccgaaaaggtactttgtttggcctagaaggttaagctgctgggttctctgatgttgagctagataatgctcaagcatgtcctcttcatcgtcttcaaaatcatcatcgaatcaaatatcctcctcctcttcttcatcttcatcagcaactgtgcttgctcctttcactgcatgccttccactttcaaaatactgccgtcctgtgagtttcttttcctttgaggatgtaagagctgaatctggcataagtttagcacgctgtaaggccaactcagcttcaaatcggtctctccacgccagaaagctctctacagtaacagcttcaccatgtggtataataacctcttgctcaagcttttccttcagggatgcaagatcatgtggtttaatccctcgtacacttttcacatttagtagtggaggttcatcggggtacttctcagtgtgcgcaaaaatcagggccagttgaactgggacataagctgactcatcaaaatcatcatcctgaggagagagtaggatctggaagcaccgggcggtggtggcgatcccactctcactcgggtcgatctccttgatgtcgtccatgaggatggcctgcagtgcctccacctccatatcctgctcctgctcgtagtcggccatgatcggtgctgatggcgacgctgctggctgtacttcggcttcctacggggaaggtgaggacgaggcctctgcggcggcgcggtggatgattggagataggcgagcgcacgccgggggctgcgtgcgtcgccggagcccggccggtgttagtcacgagaggaaggaagtaggatgctc

SEQ ID NO: 22637 - DNA, 1280 bp, Zea mays
  misc_feature (16)..(16): n is a, c, g, or t
  misc_feature (1260)..(1261): n is a, c, g, or t
tttttttttttttttncatgagatcaactctgagcttatcacgagatcgggaaaataattcgcttgtattttctttgttgtccatggtcttttgcagcaaagcatctctagcacactcgagagacattatgtaaccagaaatgtttaggtagggcttaacaaaacacttctgctcatcaacatctagatatctgttgtagtccactatatgaggctttgatgaatgatagtctgctgccagctcacagaaatgttagcaatgtcatatgcaactgggttgaagcttgaatactcgtaatcctgtgacataaaagaagacactgttctgaaaggttggtacgaagcaaacactctaaatagaaagcatatatcttcacatagtagtagtctccaaaacttagaaaaaactctaaatagtagtagtctccaaaaactctaaatagaaaacaccaacatagtagtagtctccagaactctaaatagaaagcttgagcgacggactgccatcaccaacagctaaaaccgcagtcctgatcatcgtcacccactcagctgtcagcactcagcagccagcgtccctgcttagctccgaccgatcctccagacgctgagaccgcatccatccacgatcaccgcctgccgcgcctccactgtcgatgccagcagcgaagcttcagtcataggcgaaggacgccttctgccgcctgcgggtcttgccgtcggagcactgggagctccggccaccgctcttcttgcgccgtctgtcagccgctgcaggcccgccgaacatggtgatgctgtcgatgcccctcgacagcgaagcgaggaaggcacggccgtgctcgccgccgccccacccgccgccgccgtccccgccgcgcatcctcccctgctgcttcatcagcccctgctcccgctccagctctgttagccgcacccgcgagatctcccgcttcagctcccggatctcaacatcaaggattcgcggccatggatggaagggcgcagagggagcgtatgggaagaatcgtggcgcgcagggatccgcggccatggatggaagggcgtagagggagcgcgactgccatggatggaaggaggcgacgtgatttgcgggcatgaaagggcatggtcgcgtgatttgcgggcgcgacggctatcctcggctggccgtgaggacggcggcgagggcgcggggaggggaatcgcgggcggaggaattgggatggaggaggggaatcgcgcgatggcagaaccgtnngtctgtggacgcctacact

SEQ ID NO: 22638 - DNA, 4847 bp, Zea mays
acgtatacgagagcaggaggagcagctctcggtctcggcggcaacagccaacagcagcacgcaagagcacgaggcgcgcggcgccggtggcccagccctgtcgatcggccgagccagcaggatcatcacctcgctttcagtccgctgtccgcggcggccgcgcgaacgatcaagcggcgcagattcgatccggccccacgacgccgccggattgagcggacctccgcgtacgccggcgactagtttccccagccccgtgtggacgccggcaggacacgtcggccgtcggaggatagcgccggggccccgcaggaatccggcctccgtatacgcggggccagtgccggctcgccacgtcggagatatggcgtcgcggggtgccgccccgtccccgccgagataagctggcgcaaaagattacaccatgctgacgagtgacgatgatgaccctgacctgcttgctttgcttcggtctttttttatataaaaaatgccacgatattttggttggcttgaaccttttctgaatctgcaagccctggtggtctcatttaagaaacatttatacaaaatgtacaaggacaaattaagatagcgaatgcttcaatcttttttcctctttggcacaaggtaagtcgtagcaacggtagcaggaggagcaacaaaagattcaaagagaggggattattcgtgatcggtctagtcatttttcccccttttttctgtcgaatttatctggcagcctgcttttcatgccaggaacgaaacggaaaggatcgtctagtttgccaaacagatcagatattttggtaacgtttctttctttcttaaacaacatgagattgttgtcagtcgaggttaatgccactaaaatatatatgtgtcgttcggcgcactaatcaatcggttcatacaacaagtatgattatgaaattgaagctagaatccacaccaagtttatgttttttttagaaaacgaaaaaaataaatatatttacacatattttggacacaccggacccgaccaacccaaccaatgcaacgaacaggtacgacccataatttttgacctgtaataatttacgggtcaggtacgtgccgtgatttttaaccctaaacctgatccgacacgtcaatcagagagcacgggccgacccgacccgactcaacactagacacgggtcaagtcagatacaagtcgtgataaatagctcatgacccgactttgatctaacctgacgtttgaataggtctaggtccgatggacaacatactagattgtgcttgggccgagataaaccgtgtcgagccacatgccgcctagtagactcgactcatttggacacgtataccgtacaccagtcatatgtccgcgtaggcagacgacaccataatcaagagcggacggggctatctcagcgcagcagagctactgggtcatcgattgagacaccggtttttgatttggtaaattatagttgtttaattgagaagaggatgtgcacgagcgtaggcaccagttatggcgctgtcgcccgtcgtacctgcaaggacacgagtaggacaccatctttctcgcaagccgctcaaagcttttttgctcaagacttttttgcatgtttatagtaaagatttgaaacatttttaaataactatcgaatttgaataagatatacatatgtggtatataaaaccatagcgatgtacgcaaatataattccacactttgaggaaacggtgaaatatgtcttttgccatgctctagaatttaccagaacggcacatctccgttctccagaacggtgtggtcgtaacgctagtttccgttttcgcgcgttaaagctgtgcgatactgcgatgcatggatgcattatgcaaatgcaatccagtgaaagcaggcattcagagttcaggctaaaacagtttgctacactactttactgatcctgcgtcgttcctgcatgctaaaaaatctctcgctagcctgtagcatttcctgcaataaactcctcctgatccgttccattcctccctgttgtttgttcgtctgagcgacggactgccatcaccaacagctaaaaccgcagtcttgaattcttgatcatcgtcacccactcagctgtcagcagccaccgtccctgctttagctccgaccgatcctccagacgctgagaccgcatccatccacgatcgccgcctgccgcgcctccattgtcgacgccagcagcgaagcttcagtcgtaggcgaaggacgccttctgccgcctgcgggccttgccgtcggagcactgggagctccggccgccgctcttcttgcgccgcctgtcggccgccgcgggcccgccgccgaacatggtgatgcggccgatgcccctcgacagcgacgcaaggaaggcgcggccgtgctcgccgccaccgccccgcccgccgccgccaccgccgtccccgccgcgcatcctcccctgctgcttcatcagcccctgctcccgctccagctccgtcagccgcacccgcatccgcgagatctccagcttcagctcccggttctcccgccgcagcgacgcgtagttgtcccgctgcggggacacgcacgagctcggcacgccgctgctgctgcacacgaaccgctgcgagaaggacccgtcggcgccgcccaagccgacgcacccggacccgccgcccgagaaggacgacttgaggcggagctgctcgaagtagagcacgcgcaccaccatctggatcggcagccggtcgttctgcgccgcgtggctcgacgcgtcctgcgacagcttctggcagtcgatcagcttgcacagccgcttgcactccgactccgtcagagatggatgcgcctgtttttgtttgtgtttttcccccccgcagcaaaacatttggtcagccaacgagttctttctctagacacaaaaccgatcaagaaatgacaaagcaaacagctagtgcaaaggatgcgcttggcctgattacaaagggcttcaggctaccgtcagacatagtaaagattgatcaggcaagatgttattaccttcaggcctgaagactgatcagacaattgtgttttcaaccacacagaaatccaagtccagtggtcggctagagtatagtattttattgcatacacatatttccatgctatctaattgcatgggaaatatgcctgctcaggaatggaattcattgacactaaataaaatatgttcttattctatttgatcagctaaacttgttctgattgatcctacaaatatcatgttttttttgtcaatttttatgcaacttaactccaggcatatacattgatctggaaaagtttaagcagacacagatcaaggtccagcgaccagctagaattcattcattccatttgattgcatatacacagttccatcaagactgaatataagatagatacttagaatatggaactctgatctctgctctgtattcactgaaacagctacagaagaaaaagaaaaaaaaagtgtgacacttgtaatctaatggctttaccttgaggtatatgtcgatggcgcgatagaggccatcatcaacaatgcgcgcataatccgggagcagctcaataagggccatgaacttctgcagcttgagatacggatccggcgccacctccgcgagatagccgtccatgagcctcccgaccttgagcaccgatccgtggctgggagacttgaggccgtcggagtcgtacccgcaggggggagacgacaggtcccccgagctatcctcatcaatcctctgcaagaagctgagcagtatgcggtggacggtgtcgacgtcgaacatggagtcgctggtctgcgcggcggggacgagcaggtcgtcgagcgccgccatctccaggcgcatcccgacccggcgctcgagctcgatccggcagtcgaggctggcgtcgacctcgacggcgacccgcagcatgccgaacaggaaggagagcgtgacggccgcgacgttctccgtggcaagcacgtcgacgagcgtctcgacgaccatccgctggccgtcgccgacgaacgggcccgatccgtcccagcaggcgcgctggcgccgccgctgctccacgtccacgcccttgagccacgtctgcgcgtagtgcgccacggacgcgccgatggtctccggccggaccccgctccgccgcatcgcggcgatgacgcggcggtagtggtcgatccggagcaaggagaggtcctccacccaccagtcctcccggcagcgcgcggcggcggcgcagtcgcacgtctccaggtgcgccgccaggccggagaccagctgctccttgcccgcgctggcggcgacggcgtcgacgcagcgggccaccagcccgacctgctccgccacgggcccgccgtcgtcgcacctgcgcagcacctccagcgccccgtccaggctccgcagcgccacctcggccaggtacgcctccgcccgcgccaccaggttgtccgcgtgctggtcctccgtcatctccaggtactccgccacgcaccgcagctgcgccacgttcgccgcggttatctcgaagtttgtgccgtagcagaacttggcggccagctcgaacgcgtaggctccccccggcacgttcgccagctccagcttctggtggccgtctgcgtccttgctgttggagctggaggagtccgccaacatcttgcgtatccgcccgcaccgggacaccagagggaactgcaaacaaacaaaaaaaacggcacatttcattcattcattcattaagctcttgttgcttcccaaaggcaaaacagttgcaccgaccttgtgcagcaggaacgactggccgtccaccgacaccgtca

SEQ ID NO: 22639 - DNA, 1932 bp, Zea mays
  misc_feature (9)..(12): n is a, c, g, or t
ttttttttnnnnttttttttttttttcttggatttgatctgacacatgtataacaagctgataataacaaatacaaacccaaatttaccttcttaacgaaatacagcctgttcgagagagaaataaaggtagagaaccaaattcccatagctgttttatgtttatacatctacccagtatacaatgtatgcgttgtcccaaagctaaggactccccaagcacaaaaccaaattatccagcacactaacaacatcaagcatacagaaactagaaacaccacaacaggaccacggctctcggcggtgctagccaaaactaaacatagcacacgcaacaccggaccggatctttatcttttaattgcattggtacagcataagcgggcagccaaatccccatagctccttccttccttcctgaagctgaagcctgaagctcatcgagttgcggagaaataacctcccgagcccaaaacgggattattcgtcgtcgtcgtcagtatttcttctttcacagcttatctatgtgtcagtggcactgcacaatttcgtgtgtgcagccacaggccctcagggagttcctgagaccacgtacgggtgtttatacacatgttcaagatgttaagatcgcagacttgtgccagtactgctcgaatctctgcctcgcatactccttgtagtcgaagtcaatgtcgttaacatggtccgaaattattccccagaggccccatactagatggctggcgagcgtgtgcttctcaatgctttggagcaggttctccacaacttccgcatcaggttcctcaccagaaatgttcaggtaggtcttaacaaaacgcttctgctcatcaacatctggatatctgctgtagtccagtatatgaggctttgatgaatgatagtctgctgccatctcacagaaatggttagcaatgtcatatgcaactgggttgaagcttgcatactcataatcaatgatggtcagcacgttggtctcttcatcaatcatgatattgccatactgaagatcattgtgacagaaaccaatccactggtaatcacctgaacactcgttctccaatgcagtaatctggttctccagactgtccaaccgaaattccttggcttcttcaggtggacacaagctcttggcagttctgagccagttcctaagtctgtcccaaatgagcacagatttgggaccaggcatgtcaaggttgtggaactccctcagcttggaagccaccagagctgaaatttcaggatcgcgaaggtcggcagctgacaatgtccttgcgtggatgaactcctcgacgcggccgttcgggaagcggccgaggaggcggggaccctggccatggcgtgacatgcactcgaaggtgcgcacctcgtcctcgcggtcgaagaagaggtcgacgccgtcgccgtaaatccgcacgagcaccttcctcacctccctctccgccctgggctcctccttctggccggcagggcctgcagtgagccagcgcgcctggtagacctcgttggtcatggcccccttgagcggcacgacctccagcgcgcggcagtcggccacgtccgcccacgccgccgccagctcgtgcagcaggcgccgcgcctccctggggatccgcgacgccggcgccggcaccgcctccgccgccaccgccaccgcggcctggctctggttctggttctcgatcgccaccatcctggctaaactgccgcacgttctgaaacccgggcggagaagatgaatggcgtatttggcgatttttcttatgggagttatccttctttctttgctagttcctcgttgtttctaattgatatttccccctactctccctgtctccctggtgagtctggcgactggcgcgatggaatggaagcgaagcgagatgagagggcagggcaggcgagtgttgtt

SEQ ID NO: 22640 - DNA, 1623 bp, Zea mays
tttttttttttttttttttacaggtacgaaaacacccccctcgcaggcttcccatttttttttttttttgttaaccaaatgaaatgttgataaggtagtttgtctcagaaaggatagcaatggcatcttacatggactaacagctagatgataatttacatacagtagatctgaaacaaaaaagtgaaaattattggtgcttcctgatgcttcattagtcctctcgtctcagaactaacagtctcggaccccatccatggcttaaattccctaaacaatggccatcgccaggcaggaagtaatatgattccatgcacaggtcgagagctattgatgtcatatcacaataaacatgatgttcataaaactgatatctttgctgattagagtacttgctcagttgctgctgtcttgcgggccttcggccttgctataatgtgcaaatgggggcacagaggccttggtgctctagtctccatgtcgaatcctcgcacacagacaaatcccctccagaagcattgttgtatttcttctgttcttaaacctttgaatatggtgggtactgaagtcccgaaaaagaccatgcgcctttgcaagttccatagcatctccctttccacatggattgggttgtggctagatctgtggtcagcaaatacctcattgacttgaaagtaagtgccattaagtgggaaactacccctcatagctgttcgacaaggaaccagaattgtgcctctgacatatctagattggttttctttctctgcagtacaattgtggcacatttcattattgcataaatcgcctcccatttgagggtcacagcatggttttggtgtcttagttatttcctttattccatctggtgtccatatggccaataagtatggggtaggatcatcatgttcccgttggtcaagtcctagctgttgtaaaagtggatgtgcatctggaagctcatacacatagtgttctgttcgaagcctaagcacattctttagtttcggtacaggaatcgaagctgcttcagtgctaatagcaaccaatgcttttgcaatatcatcagactggagttcgttattgctttctttaatgcaattctccaagttttgtgcaaaagcttccatgttaagctttattgttgggatttcaccatcttcataaaaatcttcaatatcattttccatggtttctggaggtctttcctctcttggacttgcaggctcctcgattattggctctgagttcttaggaagaaactcccttgaatggatactcccctcaaggcgaggtaggtgagtcgaattcatagcatgcatgctgctattctggaaagcaaatggattgctcaacttcactaagctttcctcctggggagcaggaagtgcaagccttgcacttgcaaatgcacttgcaaaatgcttgcactcactcctcattgggcatgcattgcaatttggctgtcttttggtacaaaagacctttccaaatgtaatcatctgataatgcagctcatacagtgtctgctgatcgagtttacaaaggcgaggccaaagatacttttgtatagtttccaagataggatatagctccaagagatgtagctgtactcgtccgaat

SEQ ID NO: 22641 - DNA, 1051 bp, Zea mays
tcgctgccgcgaatccccttgagcatgctctccatgtcgccagtcgccgaagcacaccaccaccaggttgtcgtggccgctggtccatcatcggcgacgccggtttggtggttgtcgagcagcgccttgtccgagtgggaggtgatgaatgcctcgtcggggtcagagtcaagcaggttcgaagagatatcggcgacagcatcacagccctcgaagagtctgccacagttgtcggcgaccacggatgacgcctcgtagtactgctcgccgtcatcgaagcacccgccccagttgtcggcgatgacgacgaccccaacggctgcagtcggggtgggcggtgtgctggcagatgcgtcggaggattggtggacgctgagcggtgtgggcggatggtcgaggtacgtagagggcgagaagcgccggtcccagcgaatttctagctcgtcgaattgccgattgagctcgtcgaggatgagcttgaaatcgagagacatggcattggcaaattgaagctgaggatcgaacgaatctgataccacttgttagcaattggctaggctagaacacaagaatttggtagaggcagggaagagcccgcgaatgtcttttttttttttttttggctagagaagttttcagtagaatgcggtggaatataattctgttacaagatgactccttccaactcctttctcatctacttaagcttcacgcaatgcttttaagaagttgatctacgccggcccggtaaccatcccattgctacagctgggccttgtcgaacgtcgcagcccatctggcgtgtagctggtccgacacactcttgtccactgtcgtgttcctcccgtgcaacccgcgcattactgacagctgggtactggattttttttaccccataaatatgacatgagcagataccagaggttggaggggaaggagagcggggactgcgacccaatcgccgccgattccatgggagcaccgcaggagagagggagggcgcggcagccttatcggctccagcgagccgaggtgtagtgagcccggccgg

SEQ ID NO: 22642 - DNA, 2729 bp, Zea mays
  misc_feature (367)..(367): n is a, c, g, or t
ttgggccgcctggtcccacttgtaagccactgtgtgggtagagtagatggtgtgttcgtacatgaaatacttaatcacgttgtaatgacccgtgataacccttgagatggggatattccagggataacataggtaaccaggggcataaccgtatttgacagggtgaaaccgtcccctggttacctatgaatacccccgcactgtaccctagtgcgagaggctgaaaaacacggttacgctaatactctgtgttgactagcatcaaatcatttccgcactctcactgtttgaattagctggaccccgtgtcggtaagttccaatagcaccggcaacagaggtgtaacagaaagcttcataaaactctntttgttatttgctaccgcttcttgatgcactttctctagaggaagactttgcacaactgagtgcttgcattttggtcttcaactctatctgattacatgtcttcttaggtgaagttacattatatgttataaacatatatgtgagctagccaaatgatgaagcttttctcgcaatttcacacgtgcctttcctgccaaactacttgagagtcaagttttaaaactttgagttcttctttaggtaagtaattcaggacatcatcttgacattaatgttagctttcccaagcgatgtggggtggattgctgtgcaacttttttggctttatgtttcttttggggtgccgttctagggtatgttcggttataccaatccatagggggattggagcggattaaatcccctcctagtcaaaaatgactaggcggggatttaaacccctctaatctccctctggattggtgtaaacgaacaagcccctagtgggtatggtccccatgtggcagttgtatgggaggtgatttaacgcatttttgtgctgttctgagttggattttagactgagggtcattgactgattgaaattactattgattgatgccgtgctgctactgcaggatgaaagggcagccaatacagcagaagcgcagctgctgctcatcatagacagggttcagggggcacttaatcttgaaacttgcagctaactacatgatgtccggtgtgagtgctggctgttgtttgttgaacgtggtaattaaagtcacctatctcatcttttgccagccggagcttgcctgtctatcaagattctgtgtttgaattttggaaagcagatctcagttagagaacatgtgtatgtaggcttgccgaaacttgatactatatggtaattggcttggtgcttcagttttggaatgcagatctcatatgcaggcttgcggactctacttgatccttcttgtcttttgacttggtgatggtataatcatatataactgcttgctttagagaatatatatgtgaacatgattatccctccaacaaaggtactatctggcaaaacgaatcaacaaacttttggactggaagaagagaaaaaaaaaacaacgacaaccatcacaacaacagatacgccactgaacgagagaccaccagcatgggttcttctaacttctaagccgagcagcactgcttcttgtgagcggcggcatcagcaccagtcgccacatcgatggtcttaccttccttgacgcctccctggccggcgccggcctcgtcggacgccacaggcttcttgctgacggcccggtaaatgtcacccaggatgagctggaacgcctcctccacgttggtggcctccagcgcggacgtctcgatgtaggacaggccttccgcctcggcgaagctccgagcgtcgtcggtggcgacagcccggaggtgcctcaggtcggtcttgttgccgacgagcatgatcctggtgttggagtcggcgtggtcgcgtagctccttgagccaccggctgatgttctcgaaggtggtgggcttgctcacgtcgtagaccaggaccgcgcccagcgccccgcgatagtaggcgctggtgatcgcccggtaccgctcctggcctgccgtgtcccagatctgcgccttgatgatcttgccctcaacctatataatattatcaagatgcaaaggtgagggaccggagggttagtgcctgtagctggattgattacacattcacacaaaaaaaagattacgaaaaacagggaagaagattaggttagttatatcagtcagcaggtccactaactgccaactgtctgaaaaatgcagaatgcgcccttgattcagaaagggtcttggtttggaggttctgcagctgaacagatacagctgagtgagaatgttgttgtacaagaggtgtatgtagtgtcgatctttagaaaaaagaaataaaaacaacaatgagcagcttgtggcacaaaatgtagtgtcctccctgtttgttgcattgcatattagcatgggatcaggatggctaagaacgaaaagggagggcatggaaactgactggcttgctgatgcttggttccttacagcaggaagtcttacagtctcaggccaaggcaggcaaaggcaacacagcaagcgagcaagagagagaatagctatgggcaggagcagaagggtggttattaggaatgaaagactaggcgcacaaacgcttgccacacttgcttacggagctggcagaagctaacgttttatccacgagtaaaatagtgtagcccactatgatattattgacatccatcatgtacataatccaacaatggggatatataatgagcgcgtcag

SEQ ID NO: 22643 - DNA, 1535 bp, Zea mays
ctgcaggatgaaagggcagccaatacaccagaagcgcagcagctgctcatcatagacagggttgcgcttctgctcatcatagacagggttcatggggacacttaatcttgaaacttgcagctaactacatgatgtacagtgtgagtgctggctgttgtttgttgaacgtggtaattaaggtcacctatctcatcttttgccagccggagcttgcctgtctagcaagattctgtgtttgaattttggaaagcagatctcagttagagaacatgtgtatgtaggcttgccgaaacttgatactatatggtaattggcttggtgcttcagttttggaatgcagatctcatatgcaggcttgctgacactgacactacttgatgctacaagtcttttgtcttggtgatggtataatcatatataactgcttgctttagagaatatatatgtgagcatgattatccctccaacaaaggtactatctggcaaaacgaatcaacaaacttttggactggaagaagagaaaaaaaacaacaacgacaaccatcacaacaacacatacgccactgaacgagagaccaccagcatgggttcttctaacttctaagccgagcagcactgcttcttgtgagcggcggcatcagcaccagtcgccacatcgatggtcttaccttccttgacgcctccctggccggcgccaacctcgtcggacgccacaggcttcttgctgacggcccggtaaatgtcgcccaggatgagctggaacgcctcctccacgttggtggcctccagcgcggacgtctcgatgtaggacaggccttctgcctcagcgaagctccgagcgtcgtcggtggcgacggcccggaggtgcctcaggtcggtcttgttgccgacgagcatgatcctggtgttggagtcggcgtggtcgcgtagctccttgagccaccggctgatgttctcgaaggtggtgggcttgctcacgtcgtagaccaggaccgcgcccagcgccccgcgatagtaggcgctggtgatcgcccggtaccgctcctggcctgccgtgtcccagatctgcgccttgatgatcttgccctcaacatggagtgtccgtgtggcgaactcgacgccgatggtggacttggactcgaggcagaactcgttgcgggtgaagcgggagaggaggttggacttgccgacgcccgagtccccgatcagcaccaccttgaacaggtagtcgtactcctcctccgcgcgccgccccgccattctcttctccttccaagccttccgcttcctctccctccgatacggcggaggcggagggacctgtgagctgaatgatgaatggagaaccaacctactacagtacagtacacctacctgagcgagcggaagaagcctcctagactgtgtttgtgtctgtagtgttgcggcaacccaatgcaaaggggggaaaaggaggaggtgtctctctctctctctcccggtttgccctcctccctcggcgctcgggctctatttcggcccggccgccctcgagg

SEQ ID NO: 22644 - DNA, 4887 bp, Zea mays
  misc_feature (455)..(455): n is a, c, g, or t
tgggaaagccgacgaaaatagatatttttcgtcgggaccgacgaaaatagttgcctaatttcgtcgaatttattttcggcggctattttcgtcggtttaggcttattttcgtgggtttttggcccacgaaaatttaggcgtttcctgtagtgggcagtcagatcgagacagctcccaggtcccagcttgcaacaaacacactagcaaagacatattctactcggaaaccaatgacacgcgggaaggaaccaaaccttgcagcttgcaacatagcaaaccacgaggtcccttcccttgccccccagtcactgagcatctcatggaaaaggtcagcacatatatttgtgtacctaccacaaatctaccaagctaagacttcttccatccaccccgactagagatggccaaatgggccgtccagcctggtccggtgaagcccggcccgttttgagccnggcccccagacacgattagaaaactgggttgggccatctaaacacgcgggctcaattttctgaccgagcccggcctgcagcaggcctgccggcccgtttagcacgaaaatagcgggacgaaaagcaagttatacggaccggtaagcacattttagtgtaaaaaagcggatttaacggacttaaaggtaaacagagcatgccggactagcccatcttacctaattttctgtttgagcctaatccgcttcgcttattcgtgccgggctcagaccgagcccaatcagcaggcttcgtgctaggctcgtgggcctcgtgtttattggccatctataaccccgaccaagatcacaagaacaggtgcttcaacaaagctcccaagtctcagcatgggtttgaaagatttgatgccatcacagtgaaaatgctcttggtggccaacttcgtcttggcgagctgagactgagatacacacaccatattgcattgcagttgcagcgaacatctcaaaactacctgacgatacacgagtttggtcaccgagacactcgaatcgccgccaataaacaaatcacctccccctctcctcaccttcagagtctctgcacggctgctgctgctgctgccgcctccctgtccctgtacatagcatagcatagcgtatgctacacatcccctcccggaaaaagcgtgggaccgaaacacatcggaggttccaacgccaaccgatcttgttcgagctccggccttactgctgcacagcctgatagctggagcggctggaagggaagactgggatggcgccgaaatcgccgggccttataccgccctggtgatgtccatggtccctcctcgctctcgacttctccacccgggttctccggaacacttcttggatttgccggtcgttctccttcagcatctcgtcgacgttgctgcctgaagggcaggtcaggggcccagagtgggtggatcttgctgcctttggatccgtagccctgtttcgtcaagagccagaaaatggtcagtttttttttcttccaaaagtactggtaatgaactaagaatagatggggttggtttcggttttgccccctttttcatgtttcattgacctaatacctgggtttgctaacctataatttttttttagcttggcgatgcatgttaaaatacagttctgaactaacattgcagtaaccatggctgaaacaggacaatcaagcttttcacccttttgcatttcaggtaggacgttacttacaatagctccatcagccctaatgttcctgtcatccttcttcgggaacacttgatcgtacttcccactgttactgaaatgctcattgatggactccgacagcctccgcccatgagcaaatgcttcagcttgagcgaccattgtccggccgctatcgtctgcccggggacctgatcttgtcgacaaaaccacagggtgattcgcaacaccagggacctgaggttcaccatttttgccgcctccagcctttgatggctggctctggttaactagaggcccagaatggaagatcctggttgggtaggcacgttgtgggtcttcagaagactcggtaacaggagttggccggggtggttcgattcggaatccggacgcggagtcttctttgcagggattgaacatttcgctcctgctcctggtattagcttgggcttgccttttctgaggtcaaagatattcatacagcaagcaacacaggttatgtatggtttgaaatgataaaaaaaacaagtagtacatgtgcatctccaaagctaaagataaaggaagtgtcaactgtcaacaagtggagaattacctgcaatgatgatactaattctgcatttgcctcaggggcagggactgctcttgattctctggttcttctttcagggtcatgtttatgttgctttcctccagtaacaccttgcctaaaaagtgcatgactatgatttgtaaaaaaaaaatcaaatgtatgacaacaatgctggttgccttttgcttgagtattgaaatttaaatagcacaaatggagcaggcaatgaactaaaggaaatagaaagaaaaatgaaacaagtagtgcaggtctaataaacaggacatgctaatacatgaaaaaggaaaataaatgttataattctgtgtaggtgtaggggaagcagcatccatgtatggcattgtatgcaatgttgtgtaatatataaagaaagaggggattgacagattcacctcatcactctgtttcacaacatctatcccttgggcacagagaacgacaatcaaggaagaaaagataacaattgctgtcctctgttacatgactcacaccagtaactcaatttttcaactatcacagtgtgagtacaaatggcaaaaggtgcacaaagatatcgtggacgatggatcttttgaaatggagatagtatatgttcatgtgattctgaaaaacataataatattcatctaagtttgatgggctcgacaaagatagatttggtgcaccatggcctagtgaagtgcttatatcattgcctcattaagaattgtttttgatcgatagataaaatgcgagcaccaagttggatgtgcttaccttcgagcttcctcctcccgacgttttgcatcaaactctttgcttggggggtacctaggcaagcttgaaggattgcaggcatatggttttgttgtaaaaaactacagacacaacagtaagttcaaagtcaattatttaaggcgagatgaatgaaatagaaaggaaacaatgccatttttgggcatattacttgataatagaaggagaaaagtggctattccaataagattaaaagcatgacatcgaaatgtacggtgctaccccttcttcctgattgccagactatcgtctatcgagtatagactggcaactggtaagcacaaaatagttcgttttgccatgttcaaactcaaattataaaatatttcaagtaatgcaaaaaatgagtattgaaacaacatgtctcataaaaaagaatgaccagttcgaaaacaaagacaaatgtcttgtgttgctggagataggtttaagagggaaattgtatacctcactttgcaatgcagaagacgcagttccacgatcagctgggtctactgaaagaagaacatctactaatgccagagcaggaacagggaactctttaaatgtttctggtacacgccttgcatacgggtgttgcggtttgaaaatggtggcatggggaagcttagatttcctccaataatcctctgacggtgaaccacagagtttaaatattttatgcaactgctcaacctagaaacagtggagaagctttacaacttagttttataaacaaatataactgctggagagattctcttgcagtatttacttagtgtgagggaagcttgttagcatacctctgttctaccaggcatgataggcttgccagcatatagctcggcaagaatgcagccagcactccagaggtctacagcaacaccataattggtggcaccaagcaagagctctggtggcctataccatagcgtgacaacacgactagtcaaagggtgtcgttgttcaggatcaaagaaacttgctaatccaaaatctgctatcttcaatatgcctcggttatcaatcaagagatttgaacccttaatgtcacggtgcagaatgtgacggctgtggcaatgctcaagaccacggaggagctgttgcatgtaacactttacctgagactcggtaaactttactccagggaaagatgctagtccagctagatcatgttccatgtactcaaaaaccagatataagctgcaggacatccttgatgttactagaccctctagcttgataacatttggatgatcaaggcgacgcaaaatgaggatttcccttgccataaatttcacgctctctggttccaaattatcaaaccgcactttcttcaaagcaacaatcttctccttttcgaggtcacgagctctgtaaacattactgtatgtaccctgaccaatcttgtcgagcttctcgaacgactcggcgcggcggggcacccatccgcgcacggcctccggggcgacggcgacgagccacggcggccaccccacggccacatgctccgcctcaaccgccctcggcaccgggctcctcacctggcacaccgccgccatcgccatcattgctcgcctcctctcgagcgcctcctcccttccgctccctgccctcacatgctgctgaagctggagctgctgctgtttccgtgcttcctccttgctcctcaccgccgccgagagcttcgcggccggcggaggcgtcgcgcggcactggccgtcgtcaaaggcggaggggagaccgcagacgcagcccatggcgccggctgtgacagcaacggcgtcgaagggagttacctgtcc

SEQ ID NO: 22645 - DNA, 1812 bp, Zea mays
  misc_feature (1407)..(1408): n is a, c, g, or t
agtactctcgagtttttttttttttttttttttaccagactttgtcttgttctttttgcaccccaacaaggttacaagaacagctgcttcaacaaagctcccaggtctgagatttggtgaaatcacagtgaagaagggtttcagtttcaggctcggcgagcaaacacttcaaccaaagcccacctgatgatacatgactcactctggtcaccgagacactccgccaataaacaaatcacctccccctcaccttcacaccctctgcttctccctccctgtacatagcatggcatagcatagcatagcgtcccaccacccgaaaccagcacaggaccgaacaaaaggttccaactccaaccgatcttgttggagagcgcctcactgttgcacggcctgataactggagcggctggaagggaagaccgggatggcgccaaaatcggcgggcctcatgccgccctggtgatgtccatggtccctcctcgctctcgacttctccacccgggttcgccggaagacttcttggatttgccggtcgttctcttttagcatctcgtcgacgacgctgcccgaagggcaggtcaggggcccagaatggtggatcttgttgcccttggatccgtagccaatagctccatcagccctaatagtgttcctgtcatccttcttcgggaacacttgatcgtacttcccactgttactgagatgctcattgatggattctgacagcctccgcccatgagaaaatgctccagcttgagcaaccattgtccagctgctatcatctgctcggggacctgttctagatgacacaaccacagggtggttcgcaacaccagggacctgaagttcatcatttttgccacctccagcctttgatggctggctctgattaactaaaggcccagaatgaaagatcctggtcgggtaggcatgttgcgggtcttcggaagactcggtaccaggagtcggacggggtggttcaattcggaatccggacgcggagtcttctttgcagggattgaacatctcactcctgctcctggtattagcttgggctcgccttttctgcaatgatgacactaattctgcatttgcatcaggggcagggactgctcttgattctctagttctcctttcaggatcatgtttatgctgctttcctccagtaacaccttgccttcgagcttcctcctcccgacgttttgcatcaaactctttgcttggagggtacctaggcaagcttgaaggattgcaagcatatggttttgttgtaaaaaactcactttgcaatgcataagatgcggttccacgatctgctgggtctactgaaagaagaacatctactaatgccagagtaggagcagggaactctttgaatgtttctgcccgcacgccccttgcatnnacgggtgttgcggggtgaaaatggtggcatggggaagcttagatttcctccaataatcctctgacggtgaaccacaaagtttaaatattttatgcaactgctcaacctctgttctgccgggcatgataggcttgccagcatatagctcggcaagaatgcagccagcactccagaggtctacggcaacaccataattggtggcaccgagcaagagctctggtggcctgtaccatagtgtgacaacacggctagtcaaaggctgtcgttgttcaggatcaaagaagcttgccaatccaaaatctgctatcttcaatatgcctcggttatcaatcaagagatttgaacccttaatgtcacggtgcagaatgtgacgactgtggcaatgctcaagaccaccctcgtgc

SEQ ID NO: 22646 - DNA, 2204 bp, Zea mays
ccgggctcgagtttttttttttttttttttcaacaaagctcccaagtctcagcaggggtttgaaagatttgatgccatcacagcgaaaatgcgctggggggccaacttcgtctgggcgagctgagactgagatacacacaccatattgcattgcagttgcagcgaacatctcaaaactacctgacgatacacgagtttggtcaccgagacactcgaatcgccgccaataaacaaatcacctccccctctcctcaccttcagagtctctacacggctgctgctgctgccctccctgtccctgtacatagcatagcatagcgtatgctacacatcccctcccggaaaaagcgtgggaccgaaacacatcggaggttccaacgccaaccgatcttgttcgagcgccggccttactgctgcacagcctgatagctggagcggctggaagggaagactgggatggcgccgaaatcgccaggtcttataccgccctggtgatgtccatggtccctcctcgctcgcgacttctccacccgggttcgccggaacacttcttggatttgccggtcgttctccttcagcatctcgtcgacgttgctgcctgaagggcaggtcaggggcccagagtggtgggatcttgctgcctttggatccgtagccaatagctccatcagccctaatgttcctgtcatccttcttcgggaacacttgatcgtacttcccactgttactgaaatgctcattgatggactccgacagcctccgcccatgagcaaatgcttcagcttgagcgaccattgtctggccactaccgtctgcccggggacctgatcttgtcaacaaaaccacagggtgattcgcaacaccagggacctgaggttcaccatttttgccgcctccagcctttgatggctggctctggttaactagaggcccggaatggaagatcctggttgggtaggcacgttgtgggtcttcagaagactcggtaacaggagttggccggggtggttcgattcggaatccggacgcggagtcttctttgcagggattgaacatctcgctcctgctcctggtattagcttgggcttgccttttctgcaatgatgatactaattctgcatttgcatcaggggcagggactgctcttgattctctggttcttctttcagggtcatgtttatgttgctttcctccagtaacaccttgccttcgagcttcctcctcccgacgttttgcatcaaactctttgcttggggggtacctaggcaagcttgaaggattgcaggcatatggttttgttgtaaaaaactcactttgcaatgcagaagacgcagttccacgatcagctgggtctactgaaagaagaacatctactaatgccagagcaggaacagggaactctttaaatgtttctggtacacgccttgcatacgggtgttgcggtttgaaaatggtggcatggggaagcttagatttcctccaataatcctctgacggtgaaccacagagtttaaatattttatgcaactgctcaacctctgttctgccgggcatgataggcttgccagcatatagctcggcaagaatgcagccagcactccagaggtctacggcaacaccataattggtggcaccgagcaagagctctggtggcctgtaccatagtgtgacaacacggctagtcaaaggctgtcgttgttcaggatcaaagaagcttgccaatccaaaatctgctatcttcaatatgcctcggttatcaatcaagagatttgaacccttaatgtcacggtgcagaatgtgacgactgtggcaatgctcaagaccacggaggagctgttgcatgtaacactttacctgagactcggtaaactttactccacggaaagatgctagtccagctagatcatgttccatgtactcaaaaaccagatataagctgcaggacatccttgatgttactagcccctctagcttgataacatttggatgatcaaggcgacgcaaaatgagaatttcccttgccataaatttcacgctctctggttccaaattatcaaaccgcactttcttcaaagcaacaatcttctccttttcaagatcacgggctctgtaaacattactatatgtaccctgaccaatcttgcccggccccgccggcctctcggcgcggcgtggcacccatccgcgcacggcctccgggcgac

SEQ ID NO: 22647 - DNA, 2677 bp, Zea mays
cctcgaggccggccgggccgggagtcaagtagcctaccgtttcaatttttgaactcccggtccggcaaccctccccagccagcgttccactcactccggcatcgcttcgaatctccgcgcggcggcgggaccgcgtgaccgacgcgcggcgctgccccttcagaaagccgcatggacgccgccgaccccctctgcgccatctcctcgactgcgcgactccttccgcggacccttggccccgccatcgggccttccccctcgaacccccgcgacgcgctcctcgaggccatcgcactcgcccggtctctgaaagggtctgaggagctggttaagcaggctacaatggtgccgaaggagcacggggacatccaggctctctaccatgatgatggagtgaaaggctggcctcctgcaaatggcagcaaagagcaacagggaagaaggccagcactggatcgtaaacgggctcggtttgctatgaaggacactggaagcaaaccggtgcctgttgtggaccaatctaagttatcaaatatttcagatccaatcacattcttcatgaccttggatcggcttgaagaagccgaggaggagatcaaacggctaaatggagaggcagaaaaacgcacattgaattttgatcctgtagatgaacccattagacagcctggtttacgtgggagaaaatcagtccgcagtttcaaggtaattgaggatgttggtactcaagatcccaatgaggcaccggcttcccaaacagcaactatgacaggatctcagttgtcacaggatgttatgcatgctgttgcgggcaaaaatggacgatctgtttcctcaagatctagtgaagctatttcagagaaagaagtttcattagctgagaaggatggccgtgacgatttgacttatatactgacctcaatccaagatttagatgaatctgaagaggaagagtttatccggaagaccttagggattaaagaaacaaggaaagaaagagttagtcttcgtaactccattcttggagttaggtccctaagaagcaatactgaacaaaaaggttcaatgaaggtccaccctccagaaagtcatttgcctcagactcgccaagatcgaatttcagagttagagaaacatttgtttcctggaggtgcagcaaatgctaaatgcacagatgatgaatctgaagggtcaccagatattgtgatgggtgaaccatcattggtgcattattcttctgatgttctgatgactgatgagaactttactgcaagtgacgttgacagggagaccccaaatctgggtgccagagcagcagaccctgttcttgatcctgaaccaaacttgcctgatcatgcatatgaaaggcaacctggaggttcctcacttggtttgtacagagacacagaagttggagttgccaaagaaaatgagacatgtaacaggagcaatatatctgtggaggaagatgatgtgccaatagactatataactattggcaggtctactaatgaaacagaagtttcttcttctcatcctttggagggcagctcgacagaagaattggtcactaaaccaggtagacatgcggctccagatggtatctgtaggacttcacatgcagctgaggatagcattcaacatctagaagcggtcaaagagggtggtgtcctacaagataagtcaagccagttgttggagatgcctcaggaagatattaatccactgaatcaggctcagatgcatggtggaagcactaagaaatcggcacctgatctatccccgaccaaacagaagaagcaacaggcagttcaagaaaggaaaaggaagcaacagtcaaagaggggcaagaaagtggctggtgaatccctggaaataccccaaacaaattttgaatcggagaatcaacctcataatgacgatgtcaacattgagaaacagacaattacgagtagcacactctcaccaaatggtgccaaggggcaaaagggagctcaaaggagaaaccagaccaaaaaaaggaatcaaagaaaaatccttggagatgctgaccttgcatgccagcctggagtgagaaaaagctcaagaacacgctcaaggcctttggagtattggcttggtgaaagattactatatgggcctatacatgacaatttgcatggagctattggcatcaaagcatactctcctggccaagatggcaagagatcattgaaagtgaaatctttcgtgcctgaacagtattcagatcttgttgctaaatctgcaaggtactgaagccaagattttccaaagaggatcacgccttgtgacctgttgctttgtcacctcactatgggatgttgacatgtattggtagaactgcagtactgcacaacgaaatgcatgttaacttaggcaggtatcaaatggatgagtatctatctagtttggatgcgctactacccattcggctactcgatacgtggagtctagggtgtcaattgacatttgcatgtatacatagtggtacttgatagtaagacagttttaggttcagactcttgaaaattgattttgtttgtcttctcgttttcagatttaagatgcgataccacagataaaaatcttgggtaattgaaggtaaaaaaaaggatagcccacctaaatatcataatgatgttatgattttttattc

SEQ ID NO: 22648 - DNA, 2468 bp, Zea mays
ggaacagtcactcactcgggagtcactctcccgtcctgatgccccgtttcaatttttgaactcccgatctggcaatccccacccacgctcccgagcaactttctactcactccggcgtcgcttcgaatcccagcgcggcggcgtgacgcgtgaatgcgtgatcgacgcgcggcgctgctcctccgggaaaccgcatggacgccgccgaccctctctgcgccatcacctcgcctgcgcggctccttccgcggacccttggccccaccccctcgaaggtccgcggtgcgctcctcgaggccatcgcactcgcccggtcgcggaaagggtctgaggagctggttaagcaggctgcaatggtgctgaaggagcacggggacatccagactctctaccatgatgatgcaatgaaagccatgccccccacaaatgtcagcaaagggcaacagggaagaagggcagcactggatcgcaaacgggctcggttcactatgaaggacactggaagcaaagcggtgcctgttgtggatcgatctaagttattgaatatttcggatccagtcgcattcttcatggccttggatcggcttgaagaagctgaggatgagatcaaacggctaaatggagaggcagaaaagcgcatattgatttttgatcctttagacgaacccattagacagcctggtttgcgtgggagaaaatcattccgcagtttcaaagtaactgaggatgctactactcaagatcccattgaggtactggcttcccaaacagcaactatgacaggatctcagttctcacaggatgttatgcatgctgttgctgacaaaaatgaacagtctgttccttcacgatctggtgaagctatttcagatgtttcaggaaaagaagattcattagctgagaaggatggccgtgatgatttggcttatttactgacctcgatccaagatttggatgaatctgaagaggaagcatttatccggaagaccttagggcttaaagaaataaggaagggaagagttagtctctgtaactccattcctggagtcaggtccttaagaagcgatactgaacaaaaaggttcaatgaaggttcgccctccagaaagtcatttgcctcagactcgccaagatcgaatttcagagttggagaaacatttatttcctggaggtgcagcaaatgctaaatgcacagatgatgaatctgaagggtcaccagatattgtgatgggtgaaccatcattagtgcatgattcttccgaggttctgatgaccaatgagaactctactggaagtgaaattgacaggaggaccccaaatctgtgtgccagagcagcagaccacgctcttgatcctgaaccaaacttgcctgatcatgcatacgaaaggcaaaccagaggctcctcacttggtttgtgcaaaaacacagaagttgccaatgaacacgaggaagatgatgtacacatagaatatccaactactggcgggtctacttatcaaacagaagtttcttctcatgatttggagggcagcttgacagaagaattggtcagtgaaccaggtaggcatgcggctccagatgatatctataggacttcacatgcagctgaggatagcattcaacatctagaagtggtcaaacagggtggtgttctacaagacaagtcaagccagtcgttggagatgcctctggaagatattgatccactatatcggcctcagatgcatggtggaagcactaagaaatcgacacctgttctgtgcaatgcactgtccccgatcgaacagaagcaacaagcagctcaagaagggaaaaggaagcaacaggcaaagagggtaaaaaaagtgtctgatgaatctagccatgcactggaaatatcccaagcaaatttcgaaccggagaatgaacctcataatgttgacgtgaacatggagcaaccgacagttatgagtagcgccaaggggcaaaagggagctcaaaggagaaacaagaccaaaaaattgaatcaaagaaaaatccttggagatgttgaccttgcgcggcagtctggagtgagaagaagctcaagaatacgctcgaggcctttggagtattggcttggtgaaagattactatatgggccgatacaggacactttgcctgcagttattggcatcaaagcatactctcctggccaggatggcaagaaaacattgaaagtgaaatctttcgtgtctgaacagtattcagatcttgtcgctcaatttgcgaagtactaaacaagacaccatttttctaagaggatcacgccttgtgacttgttgctttgtcacctgactttatgatgttacatgtgttggtggaaccatagtactgcacaatgaaaaggcacacgtcctaccgaatggttgccagtaaccttaggcaggtatcaaatggatgagtatctatctagttgggatgcgctcctacccattcgggctaactcc

SEQ ID NO: 22649 - DNA, 826 bp, Zea mays
ttgggtacctcgaggccggccagggcacggggctccgcgcggcccggcgtccctgacgacctcgttcccctccgctgtctcgcctctcccttggttcctcgcggcgacgactgggcgagcgcctcctcccctccctcactccctccgtgagctcctcgccggcggcgcgcgccgccgcccgtcgccacgtcttctccgctgacgtgggctcaccagatccaatgaaggctgccaacttgacgcaaggtgttcaagaaatttaaaccatgcactcttcatcgtaggttcaaggcaatatctgtgttaatcttggggaccttcagtagattgctgagagttctccttgatacaggggaataaagatccaaataagtttttgacattgatctgtagccagtactgcaatggctacgaagcttgtggttctcggtatcccctgggatgttgacactgaagggttacgagagtacatggccaagtttggacccctagacgattgtgtcgtcatgaaggagcggtcttctgggcgatctcgcgggtttggctatgtaacattcgcctcagctgacgatgcaaagaatgttcttgattgcgagcatgttcttgggagccgtacattagaagtgaaggtagctactccaaaggaagaaatgaaatcacaaggatcaaagaaagctacaaggatattcgttgctcgaattccgcaatcggtggatgagtcgatgtttcgtagacattttgaaagcttttggggaaattcttgatctttacatgccaaaggaacatggttccaaagggcatcgtggaatttggtttatcacgtttc

SEQ ID NO: 22650 - DNA, 1759 bp, Zea mays
acggcgcgcggcccccacatggcccggccctggagtctgacgacctcgtttccctgctgtctcgcctctctttcggttctcacggcgacgactgggcgagcgccgcctcccctccctcgctccgtgaggtcctcgccggcgacgagtgccgccgcccgtttccatgttttttccgccgattagtgtccaccagatctagtgaaggctggtaacttgacgcaaggtgttcaagaaatttaagccacacactcttcatcataggcccaggcaatatttgtgttaatctcagggacctccagtagattgctgagagttatccttgatacaggggaatatagacacagaattttttgaacattgatctgtagccagtgctgcaatggctacaaagcttgtggttctcggtatcccctgggatgttgacactgaagggttacgagagtacatggccaagtttggacccctagatgattgtgtcgtcatgaaggagcggtcttctgggcgatctcgtgggtttggctatgtaacattcgcatcagccgacgatgcaaagaatgttcttgattgcgagcatgttcttgggagccgtacattagaagtgaagatagctactccaaaggaagaaatgaaatcacaaggaacaaagaaagctacaaggatatttgttgctcgaattccacagtcagtggacgagtcgatgtttcgtaggcattttgaagcttttggagaaattcttgatctttacatgccaaaggaacatggttcaaaggggcatcgtggaattgggtttatcacgtttcagagtgcagagtctgtggacagcatcatgcaagagtcacatgagcttgatggcacaacagtagttgttgatcgcgcgactccgaaggaggaagatgtaagataccccccgagtagaccatctcagggtggctatggtgcatataacgcatacatttcagctgctaccaggtatgcaactttgggtgcaccaacactgtatgatcatcctggatcagcctatggaagagggtactatggatcctctcaagcagtgggcaagaagatatttgttggtagacttccacaagaagcaaacacggatgacctaagacattactttggcagatttggtcgaatcgtagatgcgtatattccaaaggaccccaaaagaagtggccaccgaggttttgggtttgtcaccttcgctgatgagggtgtggcagaacgggtatctcgtagaagccatgaaattctgggccatgaggttgcaatagacacagctgcaccacttgagaatgattcagctggtggtggttacattgatcccatggacctttacggagcttatggttcaatgagatcttttggcaggttctgcggtggtctagattataattacggctatggccccagcagcggaagcagcagatcaaggtcggattggcgataccgaccttactgaacgtgttttagtttacctctagggaaggaaactgaggagatggagaaaagaattacctgtctaagaatgctaagtgaggggggtaccttacgcgtggaatctatcattttgtttcatgttgtgattttggatttgtcgtgattcacattattgacacaagatgaaggcagtccttgtagttactgtatggaagtgctgtatgtgtaataaaaaagtatcatttgcgaaaaaagttataacgccatcagacgaggtgcctgcacgtttatatacactcgctctgttccagtaactcga

SEQ ID NO: 22651 - DNA, 1628 bp, Zea mays
ctcgaggccgcggtgctttgcacggctctgagtccctgacgacctcgttcccctccgctgtctcgcctctcccttggttcctcgcggcgacgactgggcgagcgcctcctcccctccctcactccctccgtgagctcctcgccggcggcgcgcgccgccgcccgtcgccacgtcttctccgctgacgtgggctcaccaggttcaaggcaatatctgtgttaatcttggggaccttcagtagattgctgagagttctccttgatacaggggaataaagatccaaataagtttttgacattgatctgtagccagtactgcaatggctacgaagcttgtggttctcggtatcccctgggatgttgacactgaagggttacgagagtacatggccaagtttggacccctagacgattgtgtcgtcatgaaggagcggtcttctgggcgatctcgcgggtttggctatgtaacattcgcctcagctgacgatgcaaagaatgttcttgattgcgagcatgttcttgggagccgtacattagaagtgaaggtagctactccaaaggaagaaatgaaatcacaaggatcaaagaaagctacaaggatattcgttgctcgaattccgcaatcggtggatgagtcgatgtttcgtagacattttgaagcttttggggaaattcttgatctttacatgccaaaggaacatggttcaaaagggcatcgtggaattgggtttatcacgtttcagagtgcagagtctgtggacaacatcatgcaagagtcacatgagcttgatggtacaacagtagttgttgatcgtgcgactcctaaggatgaagatgtcagataccccccgagtaggccatctcagggtggctatggtgcatataacgcatacatttcagctgctaccaggtatgcaactctgggtgcaccaacgctgtatgaccatcctggatcagcttatggaagagggtattatggaccctctcaagcagtgggcaagaagatatttgttggtagacttccacaagaagcaaacacagatgatctaaggcagtactttggcagatttggtcgaatcgtagatgcatatattccaaaggaccccaaaagaagcggccaccgaggttttgggtttgtcaccttcgctgatgatggtgtggcagaacgagtagctcgtagaagccatgaaattctaggccatgaggttgcaatagacacagcggcaccacttgagaatgattcagctgctggtgggtacattgatccaatggatctttacggagcttatggttcaatgagatctttcggcaggttctgtggcggtctagattacaattatggctatggccccagcagcggaagcagccgatcaagatcggattggcgataccgaccttactaacgtgtccattgtcagtgatgttctagtttacctccagggaaggaaactgaaatggcgaaaagaaacattttaagaatattaagtgttacgttaagtggcatgttaatcgtaagagggccgtgcggaatctgtcgatttgttcatgttgtaattttggacatggaaatgcttttatgcaatttctttgccgtgaaaaaaaaacaaaaaaaaaaaaaaaaaagcggcc

SEQ ID NO: 22652 - DNA, 1762 bp, Zea mays
cattgggtacctcgaggccggccgggggagcaacgtgtgctttgcacggctctgagtccctgacgacctcgttcccctccgctgtctcgcctctcccttggttcctcgcggcgacgactgggcgagcgcctcctcccctccctcactccctccgtgagctcctcgccggcggcgcgcgccgccgcccgtcgccacgtcttctccgctgacgtgggctcaccagatccaatgaaggctgccaacttgacgcaaggtgttcaagaaatttaaaccatgcactcttcatcgggaataaagatccaaataagtttttgacattgatctgtagccagtactgcaatggctacgaagcttgtggttctcggtatcccctgggatgttgacactgaagggttacgagagtacatggccaagtttggacccctagacgattgtgtcgtcatgaaggagcggtcttctgggcgatctcgcgggtttggctatgtaacattcgcctcagctgacgatgcaaagaatgttcttgattgcgagcatgttcttgggagccgtacattagaagtgaaggtagctactccaaaggaagaaatgaaatcacaaggatcaaagaaagctacaaggatattcgttgctcgaattccgcaatcggtggatgagtcgatgtttcgtagacattttgaagcttttggggaaattcttgatctttacatgccaaaggaacatggttcaaaagggcatcgtggaattgggtttatcacgtttcagagtgcagagtctgtggacaacatcatgcaagagtcacatgagcttgatggtacaacagtagttgttgatcgtgcgactcctaaggatgaagatgtcagataccccccgagtaggccatctcagggtggctatggtgcatataacgcatacatttcagctgctaccaggtatgcaactctgggtgcaccaacgctgtatgaccatcctggatcagcttatggaagagggtattatggaccctctcaagcagtgggcaagaagatatttgttggtagacttccacaagaagcaaacacagatgatctaaggcagtactttggcagatttggtcgaatcgtagatgcatatattccaaaggaccccaaaagaagcggccaccgaggttttgggtttgtcaccttcgctgatgatggtgtggcagaacgagtagctcgtagaagccatgaaattctaggccatgaggttgcaatagacacagcggcaccacttgagaatgattcagctgctggtgggtacattgatccaatggatctttacggagcttatggttcaatgagatctttcggcaggttctgtggcggtctagattacaattatggctatggccccagcagcggaagcagccgatcaagatcggattggcgataccgaccttactgaacgtgtccattgtcagtgatgttctagtttacctccagggaaggaaactgaaatggcgaaaagaaacattttaagaatgttaagtgttacgttaagtggcatgttaatcgtaagagggccgtgcggaatctgtcgatttgttcatgttgtaattttggacatggaaatgcttttatgcaatttctttgccgtgattcacattattgacacacgatgaaggcagcagcctttgtgtagttattgtgtgggagtgctggatgtgtgataaaaaaaaagatcatttccaaaagaagttataagcgagcggccggcgcccggaaccgtctgatcgttagtctct

SEQ ID NO: 22653 - DNA, 1974 bp, Zea mays
actaccagggtttcggacaaccgtctctctccctctctagtctctactgcttctccgccgtcggcggctctccgagtccggtatccccgtctccccatcggcgtcgtcgggtttaggttcatcacagcgtcccgttctcctatgcacgccgtcacgcgcaaaggcacgaagcgccggtcgtcgagcaacaaggctgttgggcccaggcacgcagccaacggaggggccactaccacacggcgtgcattccgccacccgtgaagccacatcgtggttacttcccccagccgccagccaatcaaacctaccagttccagccagagccagccttccccttcgccatggcggcctccgccgcagctcaacgtagatctgcaggaagtaggacgacgtacgagagggcagagctcgaggcgctcagggacgccccgtcgaaggaggctcacgcgcggctctgggccgacgtccgcgctacccttgtcgcctccgggttctccggtgagtatgacgggctgctcgttgccgaggaggacgtgaggagcaggaggggtaatagggggatgaaggctatgagcgtgaggaggtggcccgaagaggcggcggcggcccggtttttgggcgtggcagagattggtgcacacagaaatggggatctggcggtttgtcacgaacaccgatttgagtctgctcatgaccatgctgggacgtctggagtggttgaagagtcgtttcatcaaggtgaagatgttgaatgtgaagatgacagtgatgatgactataacggaattctgaagcctgcatttgctgtggatggagatccagattttgagtctggtgagccacttgatggctttgagtaccttcggcgtgtcaggtgggaagctaaccaaattcctagagtcaaggtggccaagatatattcaagtgcagctagaaatgagcaaactccttatatgccagaaattccggatataccaaagtgcttacctgatttgcgtgcgtcaaaacaatgggaggacagatttatcgtcgactttgaggaaaccaggatggtgctctctgagcttgacagttctgatgaaccatctgtatctagtgggacaaaaatctcaacaaaacctggcagcgggacggagccacagactgacccgacgctgacaatgattcgcagcatggatgcagtgtcaagagctgcgacacttcggaactacatcgatatgattcagagcttggatgcactatcaaggaacaactgcatgtggctcttcgcactctgtgttgccgttcacactcccctggacgcggagacatgtgcctcactgaggtccttgctgcgcaagtgcgccagcatccttgccaccaagactgagatggacgatgaagtcgtaatgctgaatatactgatgacaatttcgggaaggtattttggacaggacgaaagctgaaaacagcaattgaaattggagatcaggataacaccattgcaatgctgcattctcaccgatagtttgatgtcagaatatattatatttattattatatatgtgaaagttatgtttcattttcttgtaattgcttaccgataggttagtaggttactgcattttcaaagcatgcctagcacctacgcgttgcccgtatcgcgatgaatcttggagggcttaagggtaagctgtggtcataaactcgtcgaggtaggctcaaagcctggctcaaacacaacagagagttgatgtgtccgacctcgaggtaaagaagacccactactaattagccaatccttagaaatagaatccctcctccagggttcagccttctcgcgcgcatgccatggccgcggctgtcgcccaccccgccttgacctctttcttgctggcccatcggaccgatgtcgcggtggcggcagcgccagcgggcagtcgagattacgcagcccacctctgtcgagtccatgaaccggacggacgtggagca

SEQ ID NO: 22654 - DNA, 4270 bp, Zea mays
ccaatactcttgtttccaaacatgcccttagcgttttaaactcgcgcagctacttacggccactttaacaccgtaaggtgcagcgtcctgcaaataaataaaggtgtctgcagtatgcatgtttttaggaaaaaaataacaacaatatgacacacattctttgccaatgataagtgacacaatttttttcctcttcaatagagttaatcagtaataattattcgaatccacccgcctccaggctccagccctcctccctcgcttcgaaaacaatcgccatgcatgtcgcatggatgccagccagccagccagccagtatacatagcattaaccatctcctaggcatggacatcaaataatactttcactgtactctatcttaagatcacaaagttttttttcttctaaatcaacatttaaaactttaacaaacaatatctataaaaaaattatagaaacgatatattatggcagatgttttaataataaatttaatagtttttatttttatttagtcaacatttgtaaatattttgttattaacagtcacagtagaagatattttacttagaacacataacttctcgtgatagatcttaacacatgagacggagcgcgtaggatatatgtataatccgctcagacaacttaacgggataaataagggtctgtttatttctctactagataatataagttagattatgttggaagagtgtgagagtaaaatatgactttagaattccaaataaactgaaataagctagcatcgagtacattatttcagtttatttatgatcccaaagtaatattttaccgttctatcttttaattataatctaggttatataatttaggaggtaaaaaacaaacatggcctaaataaataaatactcttgttacccggtctgcagccaagtgcaaatgtgccatgcatgcgagttggggccctggaagacgacgacgaccacacccacaccacacacacactgcaaagcctctgtttctcatgtcagtaaaaattcctccctgtcctctgccggcatgtagttatcgacaagaaagccatggctggcagaggcaaggacagctcggtcgccaaagcgcaaggtgcaaatcgtgaaaagggagcaaaggcaaaggcaaacaactcgatcccactgcgcggccatattattcactttctccatttcttccctagctggctagctctctccgatcctcctgcgcccattctctttcgtctggttgggtggagataagctggagagactggagaggtgcgccgagctgtgggatcggagaccgagcgagcaataaatagaaagtaaggtcggggccggcctccatggcggcggttgcaggcgccctcgaatccctcccctgaagtccactgactccgcgcgtctctctctctctctctccttcttcttccttcctcgtcctcctgctgcgcctctttatatagcctccaattccggaaagcagcttgcttgcgttctctcccacccctccttccctcctccagatactacttattgtagacggcgcgggtgagggagaaagcgagaattagcctgcttagaccccaagacgcgaagagaggaaaaggattacgcaagaagagaggtggattagaggcgagctgcttcctattttcagcgaagagcaaggtgagtaacactgatgagtctgagagtcgactagtgtggttgagcactgcagctgcagcctgtaggcttatctttctcctctctcgctctctcgcatcgcacatgcatgccatatgcatactgatacggccactcatcagcggcaaggctatacccatcctcatctcatcccatctcctacgcggctacgcctagcttgcttgcgcaaatctctctctctctctctctctatgtctaggagctcctcgctgcagatctaccgccgatccgcctgctgctgagctatgccgatcaattatctatacatgcagctcatgcatctaacctacatgtcgtcacacaacgcagccccaccccaccccatgcctgctgcttctgtgcctgtgccgccgtcgtctctcgccttctgcttctgcacctgcttttttcttactcccaagatctgtaattgtttgttctgctgtataggagctagctgctagcaaggagccgaggcagagagaaagagggatcggaggaggagctgataaggctagcctcgctcttttggtggtggtggtggcggtggactggtggcgcacactctccctctcgctcgtcttgatggtggtgggtggcggcagcggctgcctcgcatggctgggttctctctgaggagcggcggagccggcggaggcggaggcgggaggggcggggaccggggcggcgatcactcgatcggcgccgacagcctgttcctgtacgcgcgaggggcggccgccgcggccgccgacacggcggccagcggcggcgggatagggttccagctctggcacccgcaccaggtccagcaggcggcggccgcgccgcacacgtcgcagttcttctcctccggcgccgtggccacgggcgtcgtgctcggcttctcgtctcatgacgggggcgccgccgggatcgccggcgccgggggcggcagggccggcaccagctgccaggactgcggcaacaacgccaagaaggactgcccccacatgcgctgccgcacctgctgccggagccgcggcttcagctgccccacgcacgtcaagagcacctgggtccccgccgccaagcgccgggagcgccagcagcagctcgccgcgctcttccgcggcgccgccaacagcaacagcgccgccgccgccgcgagcaagcgcccgcgcgagctcgtccggtcccttggccgtttgccgtccgccaactccgccatggtcaccacgaccacctcctcaggtactcctcgcggctcctcgccatcacgcgcacggcacacccactaggccactactaagtactgtagtgagtagtgactgcaccacagtcacaccatcgcggatggacggaatggcatggcgcgttgattatataacaatggtgatcttgatgatgctgctgctctataggcgacggcggcggcggtaggttcccgccggagctgagcgtggaggcggtgttccgctgcgtgcggatcgggccggtggacgagccagacgcggagctggcgtaccagacggcggtgaacatcggcgggcacactttcaaaggggatcctgcgtgaccacgggccggtggcggacgacgcgggccatctgccgccgccctcggcggagtaccaccaccaccagctgacggcggggcaaagcgagggaagcgccgtcgccggcggggagcagcgaggcggcggccacggcagcgacgtcggcggcggtgctgatggatccgtacccgacgccgatcggcgccttcgccgcaggcacccagttcttccctcataaccctagaacctagctcactactactagtatctacatattagctagctttgctgcttccattattatggctatcgatcgatcctagtagtagcttaattccttgatggttccatttacttcctccaagttccaaattaaagatgatgatgatgagcatgaactaagttgtcgtcattgtcgtcgtcctcgggattagcaaacaaattcgagacaaacgcgaagatatttttattgttactatttcttcttccactactactgcatacgcgcatgcgtttttcgagccgttgatcgatgaacactactaatgcatgatcaatggaacacatataatgtccttattattaattgagctagtgcactaccgctacctgtttgagcaatcttatttcgagttcattaataactaattggccaattcttaatgcaatgcaaagacaagagtttcaatcaagtgtagattccttgttcttgaatccattatattctccccattccacaaatgacgggagctgcatttgacacgcagtagtagcccagcacgtgattattagttagtgctagatagccactgtatcatcttgtctagctagtaagctacagtaatactacatgcatacggagtataatcctaccttgagtagcgtgtaatgtatgtatatataataagtagcttgtactgcctagctagatcgtcatcagttcatcacacagagtgtggttgctgcttgcacactaatctccttttgtttatttacattatatgcatggggaagcttcttatattactctcagggggatcct

SEQ ID NO: 22655 - DNA, 2115 bp, Zea mays
ctctatgcatacaatgccgtttattagttagtataaatttgtgctaaaagttggttattattaaaatttaactttatttaccatggcttaatacatctttggtggaatgagatccaataattattacctgcgcgggaataagaggggactaagtctcccatgcgagttttgtcatgtgtttgatttaaggttaaagtaggatgagaccagggtgacaccgttccctcgattttttgagaccacgttgccactaaaaattgattcggtgttcgcctcgataccgtgtgactctaaaaaatgtggctatttggctaccccttctatcccttttgtaggtccaaccaaacacatttaattccccggtgcggataaaaaaatatcacatgattactttcatgtttcgaatttcaaatatattataccacgtggcactagaaaatttatatttattgcctctgtagaaatatttcgtcgtctcgactgccgacgcccgagtatctcaagaaaaaggaaggtcttcgggaattctgttcagcagaatccgagtccactagccctcctcagtcctccccagggatttcgacttccccgagacaccatcgctacgacgagcaagcagagcaccatctcggctgccttaaactgtctctccgccggatactacacccgccgccgcagcgccgaccttgtctcaatcgagcggagcgggcgatcggattggttgcttccttcccccatctcatgttggtggactgagagatggagttttgatttcaaatagcatctagagaactgccactaagtttttaagttagtatataatgggtggctgttgttgctgttcgtcgagaacatctgaagccgatagagcaccaattgatatatatcgtcaacaaaatcttgaggagcatgagccgctgtcttcagcttttgatggatcatctccaccatcttcaattgttgcagtagacacaaatctggatacttccacacctgacacatatcgagcaccacctgcacccttgccttatgatgttgttttggcagtcccaactacccctggtttggagaagctagacaacaagagcaaaactgatgaccaacaagagtccataaatgatcaggagtctttaaacggggatgagtcatgtaagaaaaatgtcactgaagataaggctgaggaggaggatgtttgtcctatctgccttgaagaatacgatgaagaaaatccccgctctgtaactaagtgtgagcaccatttccatctttgctgcattcttgaatggatggagcgaaaagatacttgcccagtttgtgaccagacaattttggtggatgagatgtccgaatagacttggtaatcctggtggatcatcacttgaagctgtttgttactgaggaagtgcaggcaacaactactacactcttgatattcgtccattctgggtggctctcagagtaatgaattgatggggcaaaaattgaaaggatgaacgacatgaaatgtatttacgccccctcctttaccctgcattctgtgtcatgcttttgctgttcatagcaacaggtggactaggaaactgcttggttgaattatatatagagagagatatgtcggcttgcaggttgattcagttaaaagtgcaaaactatgccatttcgcttttctgaattcagagtttcagacatctgctggttcttccaggaatccagtcagctttttacatggtatattaggtggttgcaggtaaaaatggtctagatggaggtgggggtttctttgtataatccacatgctattcaagcttcctgtatataatatttcctgttttcttcgatttgtctagtcaggcaagtttcagggatatagttttctgttatgctgaatatttgcacacccccgctgttctgataaaaaacttactgatcaaaaaaaatcaaagggccagacaaaacgtctcagggatataatataatacatctgacagctcttgttaaaacatcttcggggcctgctaaaatgttcacattatgttccggctatgaaaactcgcagttctctgcgatgctacgagtcgcagacattttctttttttatcagtgttgtaaagtagc

SEQ ID NO: 22656 - DNA, 1411 bp, Zea mays
gggtacctcgaggccggccggggttccgcagaatccgagtccaatagctctcctccccagggctttcaacttctccaaaccccatctcgccgccgaggccgagcgagcagagcagaacaccacgtcggcggcttttccctgtctctccgctggatactacacccgccgccgcagcgccgatcctgtccgagtcaagcggagcgggggatcggattggttgcttccttccctccatctcatgttggtggactgagagatggagttttaatttcaaatagcatctagaggactgccactaagcttttaagttggtatataatgggtggctgttgttgctgttcgtcgagaacatctgaagcagttagagcacgagcaccagttgatatatatcatcaacaaaatcttgaggagcaggagccattgtcttcaatttttgatggatcatctccagcctctgcaattgttgcagtagacacaaatctggatacttccacacctgacacatatcgagcgccgcctgcacccttgccttatgatgttattttggcagtcccaaataaccctggtttggagaagccagacactaagagcaaaactgatgaccaacaagagtccataaatgatcaggagtctttaaaggtggatgagtcatgtaagaaaagtgtcactgaagataaggctgatgaggaggatgtttgccctatctgccttgaagaatatgatgaagaaaatccccgttctataactaaatgcgagcatcatttccatctttgctgcattctcgaatggatggagcgaaaagatacttgcccagtttgtgaccagattactttggtggatgagatgttcgaataggtttggtaaccttggtggatcatcactcgaagctgttcgttactgagaaagtgcagcaactaatttacttttgatattgatccattccgggtggctcgcatggtaatgaattgagggggcaaaaattgaaaggatgaatgtcatgaaatgtatttacaacgcctcctttgtcatgcgttgtgtcatgctatatatatgccggcttgcgggttcattcagttcaaagtccaggactatccttttgcttttctgaattcagagtttcagacatctgctggttcttccaggttccggtcagctgtgtatatcatatattaggtggttgcaggtaaaaatggtctagagggtgggggttgctttgtacaatccacatggtatttaagcttcatgtatataatcttttctgtttctcttcgttttgttctgctgaatacttgcagatccttactgttctgataaaacttactgactcccaaatctgtgccagacaaaacgtgtttcaggaacataatacatctgatagcacttgttaaaacaaaaaaaaaaaaaaaaaaaa

SEQ ID NO: 22657 - DNA, 942 bp, Zea mays
ttttttttttttttttactacaacaatatattatttcattttaagttccaatagccaataaatacagagtatttaacatcacaaagattcaaatgtacccaataaataataaagttatgttgaatcattatcgcttcgaaacatttttagcccatatccaacagggaatagcgggtcatagttagagtctccagcatctataggcaattgatcaacagacttacaccatgtcacaggcaatgtgcccacaaaatcatgatctccaaagaggcaatcggtaattcccatgccctcacttccaggcagccaggcagcgactagagcttctatcttttccaaaacttgtgactcaataattaatggccttccagatataacaatcactagggtagggattttacttgcaacacggatgataaggtcagagccattaaacggaatactaaggtcagttctatctcctgtccattcggcatatggaacctctccaacaaccaccaccgcataggaaaaccccccagtttcaatcatagcttcggttgggcatttctcatacacaacttcagtttgcactcccactaattcttgtatggcctccaatatgctcgtaccaagagttatttttccactgtctccatgccatgctatcgtccagccaccacattgatatccaatatcatcagcatgtgttcctgcaaccagtattctttttgcatctttggccaatggaaggaatggcttattctgatccttgccatttttcagaagtaccaaagacttgcgaacagcctcacgcgctagtaaccgatgttccttacaaccaactatgtccagtagagattggtctgaaaatggatgctcaaacactccagaaataaacttaaccctcagaattcgttcaacagcatcatcaatccgagacatggtaaaaaaaaaaaaaaa

SEQ ID NO: 22658 - DNA, 1198 bp, Zea mays
ctcacttgtggatcccatttataaagagaatagggttgtctggagtgctaatcccctatgtgctaatcccctatgctgttaggagcgttgataaagatgacaacacagtccatcggtccccggcccccctttttttttttttgtttaccaggtcaacaaaaactcttgcaccagcaggatgtaaagccatgccaggtatcttcgcgcaattatgatgctagtatttcatgatgagtacaggtctcgttctcacaatgcagataaaacttaaagcgcaaacaatcaatttccgccgatgaactccttcatgctcttcagccaaacaacatactccttctcatcctttctcatcatgtattcgtacagccaatcatgtagtgaatgtttgaaccccctgacctcaaggtacctgtgcaaggccttctgcaagctcttatccaggtccgaaaattgtggcccctcatacacattcttagcatcggggttatcacggttcagcgccctcatattttcaattgttagttcatcatcattaaagttgcagtcaaattctaggattggaccttctggttttttaatagtgacaaccatctgaagtagtggtttgaaagattcctcatctgtgccacttttgtcatcctcatcatccaaatgttcatctgtatcaaagttggtgtatataacagctttaattgtctcccctgcaatctccctttggagggttattgactgatcaccaggattgtctatgatctcaaaagggaagtcctctggtagatcaatgtgcttgtcggtgttgctctcctccgactggacaacgcactcgatctcagactcgacgatgcgcctcaggttatcgtccgccgaagacgtggaggaggacgccggggactgcgacgccaggaagcggcgggcggtggtccccgccgtcgatgaggtggccgcagggagacggcggaggaggggaacgggcgccgaggaacagagaccgcggcggacaagagcggagagaggagaggaagaggtggaagcggcgcggcgtaggagccgagctgcgagggacgccggcgacatggccttagagccgtggaatgtggttccgctctaggagggggtggacggcggccggttgtcccggccgcccccggggccccaatcgccctatggagtaacgatcccccgccgcctcgaggtccca

SEQ ID NO: 22659 - DNA, 1009 bp, Zea mays
  misc_feature (1)..(1): n is a, c, g, or t
  misc_feature (24)..(24): n is a, c, g, or t
naaaattttttttttttttttttntttttttttttttttttttttttttttttttttttttttttttttttttttttttttttttttttttttttttttttttttttaccaggtcaacaaaaactcttgcaccagcaggatgtaaagccatgccaggtatcttcgcgcaattatgatgctagtatttcatgatgagtacaggtctcgttctcacaatgcagataaaacttaaagcgcaaacaatcaatttccgccgatgaactccttcatgctcttcagccaaacaacatactccttctcatcctttctcatcatgtactcgtacagccaatcatgtagtgaatgtttgaaccccctgacctcaaggtacctgtgcaaggccttctgcaagctcttatccaggtcccttctggttttttaatagtgacaaccatctgaagtactggtttgaaagattcctcatctgtgccacttttgtcatcctcatcatccaaatgttcatctgtatcaaagttggtgtatataacagctttaattgtctcccctgcaatctccctttggagggttattgactgatcaccaggattgtctatgatctcaaaagggaagtcctctggtagatcaatgtgcttgtcggtgttgctctcctccgactggacaacgcactcgatctcagactcgacgatgcgcctcaggttatcgtccgccgaagacgtggaggaggacgccggggactgcgacgccaggaagcggcgggcggtggtccccgccgtcgatgaggtggccgcagggagacggcggaggaggggaacgggcgccgaggaacggaggccgcggcgggcaagagcggagagaggagaggaagaggtggaagcggcgcggcgtaggagccgagcggcgagggacgccggcgacatggccttagagccgtggaatgtggttccgctctaggagggggtggacggcggccggttgtcccccgcccggcccggcggtaccctacccaatg

SEQ ID NO: 22660 - DNA, 4562 bp, Zea mays
  misc_feature (13)..(13): n is a, c, g, or t
  misc_feature (25)..(25): n is a, c, g, or t
  misc_feature (84)..(84): n is a, c, g, or t
aaggtgatgactngattgcgccctnccgttgcaagggaacgcagaagtatgtccataggtcctgtcttgataactggagatcancaaaggaaggttttgcattttcaccattgcactgaatgtcgagctgcattctttcttcgtgcaaatgttcctccagatcgatcccacgcgtacgtgaagtttcaacttctggttgttagggatcacacactaatcttctttattgtgcaactggtagttgctttcatgggtatggtgatttacagattttatggagatgaactgcgcgaaatgtttggttatgaagagcacccatatgctttctatgccatggcgatactggctattgttttggttggtttgctgtatgggttcttcattgctataatatgtggacagaggataactgaacggcattaccatgttcttgcaaagcaagagttaaccaaggagtatattgtagaagatcttgaaggagctgaccatgtgccagaccttgatcctagccatgttatagagttgaagatattaggactatattaaacatagctgcatattacatcagataaacattgttgatgaatggggaacagcataccggaaacaaatcccaggttgatgttgcaagaaatacgtacgtcattccacttcacctggagacagtgcaaaatgggcctttgtgtgactgtcgcccataaattcttgtgaagcaaaacacacttgctcattcgaagaacaccatttgaagattctttggttccaatgtaggcctgatagctctcaaacaagataataacattcatcgccgcacatctcaacgaatgaagattatcgtgaaagaagcgctaggatgatggtctcaatggacatttttgtaaagtagtagcatattatattcttttctcccttgcttcagatacacaacaaacatgcaacagccaagatgctaatgccccgtttgttgtacataccctgtaaaacattactgccaaactcgcagtactttgtccttttgattattttcatcgaatcgatgaactaaataatgtaacctggagctggagccgctcaaaagtctacacgcgcttcagaaaacgggattgatgtgaggcttgtgctggatcgcttcactttgctgccatcataatttggtctgcacatggctgcatcctttttcaattgtttgctacattttaactgaattttctatggttgctacttgctagtaccttgggacctgggatgtgctgctgaaatcaggagcactcctgcctcgatgcttgcattattaatagagaacacggcaggcacctggaggtggtggccatcaacaacaatcccgtggaaccatgtcatcgcaaatgctatcgaggtcctagatttccaatgtatgtatggagccctgttttgaactaatactagaaaccgtacttttttttgcctttaggtttaattaatattttaaatgacgccatgacagtgaaagtgaagctgattcttgacggcttgttaagaagaatattccaggcagagctaacctccagtgcctgccaagcgtgtgaatcgccatcacgtggatctgcttccgcatgaactttctccagaaaacgccatgatgtcaccacggcacgaccactgtaagttatgtccttctaacttcatttatagcgctgtcaatcagccatgacccatgaatccatgaactgaaactccttccggaaagctcggttgggttgctgaagaagcaaacatcatgttttgactctttgcttcctaacaaaacaaacgaacaccgatccaatcttcctagtttcttgtgtaaggtctcttgggtcaactgcactgaagtttgccaaagactttgcctgacttcctagctcttgacaaacaaaactaccatgctctagcatcagcacgtgcaccacacacattttttttgttgaaaaggaaatcttcctcgtatttcacatcattaaggaagtttattacttcgagtccaagttaattgacctcgctaagagaagattcaagcctttgctgggggttaaagacccactaatggagttcctaaagctgagcctggcaagagccaggaagcaagcagccatgtgacaagaggagaaaaaaaagaggagagattctaccattactttccatgacacgcaagcttgtagtaactgaatgacacattgacactgatgatggtgcatgacagtgtgagattggtgtggtacagaactacagacagtgacatgtccagtcctacggcaaaaaaaaaaaaaaaaacagacccggctggagtgttggactcgaactcctttgattaggtggagactggagacattatgactagatttgggcgttggttatctcactactaatttcatgcatgagtgcaagtgtcagcttgtcccataattaagacctggaagcttgttcaatttattatgctaaacaagttggctttttgtgaggtccatgctttcttcatctgattatgggaccctctgggcgtacagttttgcagtactgcctcttcactggccatcttaatcaaataatcaaaaggccaatatcaactgctataaaatccaatgctcaatgatcttacgagcaatctgagacgcatacatacgcggttcgagttttcacacattctgaaatacgatcgagtactgctctagttggcaaacagacaaaaaccctgattgattcaacaagtctgcagcgaagccaagaagcgtgttgctagaggcatgactgcgatatggaacagcagatttgaaaccagtgaacactgacgctttggagagccagccatgtcaaaatctgttgcccccccttttttgatctgtacatctcttcaaccacccaaagatgagggataacgtgcagctttcgagcactgtagctcgacagtggggcttggttctctaggcattgcatgttgatgtgaaagagatacggacagacagacaggcagacatggagcatgtaatcaaacgaaccatctggagaggcggcgttcgtactctataagaaaatcagtatttgcaagcagtgaatcagttaaaatcatattggttttttccttgattcgagagaaagggatcgccacaggaggtctgaaacagaaccggcgacccaaggatggagcaacgcattgacagtctgacagtgccgcttcggtcctttcagggcaatggtggtcacagtcacgtccgatatatggatttgtacccagagaagcttcaagcactccaagaaaaaaaaagcttggattgttgagcaaacacagccaagtttacacgcacgcaacgtaacctccgtttccaggtcgcgaagagcgacccgatgtcgggaatgcgctagctttattgctgcaaatgccacgaacagcctctttattttattattgttctcaagaaggtttaaagcgttcttgtgagcaaggttattacgtaacttttgttgtgcatccagtcacaggccatgatcttcaccggctggctggttggtctccagacgtgtctgcgtctgcgatagccgataggctcttgcaggtaaatccctgccccatccttcggcccccactgttatgaatgcacattgccccccactgcactcataagactaagatggcattgcaaccgctgcctttgcacacacaccattgcacccccctccctttcttgacactagaaagcaaaaccctagcactgaccatggcaagctgcctcgttcaccacggaacggaacggaacgacgccttccatttgcgcccacagatgcttttgagcgcctactagaatcaaacggtccggccgggtctctgcgaatttttattttatttgaaaaaatcttcgtgctttataaagctttcgtgggggagaaggagtctgaatttcgtcaggatctggtgcagttccacgtggggattgatttgaacgaccgtgattataaagcgcggctcacctttcgatcaacctagtattccttgcttgcttcggtttaaaacccaccctaaccagatgcatctttcgatcagctgtggggggaatccagttaacaacgactgcatctgaaatctggggagctgtgcaaaaccactggcggagcaatgtgactgggaatccagttaacaatgactgaatctgatctggggagctgcgcaaaccactggcggagcaacgtgaccgaacatgagcgcggcagccttccagtgcatcaccggccggccacatgtggacagattagcgcatgcgtaagtgcgtaacccatgtccctaagcagtattcaagcggggcacacgggtacagcccgcctcggtttctgcgctaaggaatcgagagaggtcttattcatttcttctcaggccatatccccccaccccgatcaaggcatgtgtatctttttttttacgtaaaatatctagcaggacatattttcgcgtgatagcttatcgtgcgcacacgaatgaccatgccaccgtgctttgattgataggacctgagctatacactgttaacaaattcttataaacagtcttatactatatg

SEQ ID NO: 22661 - DNA, 1457 bp, Zea mays
ctgatatagtagtgaataaagatgtatttctgcagtcatgattctcgtcttctcgatgtaatgtcacaggaacgtttcttgataggaaatttacataataatattaaaatgagcgagccaagagttcaagacccgttcgctgtgaaccgcgacaggtttccttagtgcctctgtacattgggacaggacataaattattcgatcctgatcgtacatacacacatttgggaacacgtattttatcaaataaatttgtgtcggcctggtaccttcacagtatcaacacaaatttattcttcctaattcctggacaaagaaatttacggatgataacaacacaactgcttcatcctcaactgtgttcttaacagaacatcatccttgaatcctttaatcagtatagtacaagagcaaggatttttcacattccccacaaatgtgtacttttcttctacgagaacatactcatagacaagatcagatgagcctagacaattttcagtcaagtcatcaactgaattgatagctccaccaccacgtgatagctcgaagagcaataatctgagcataaatgatcatttcagagcagttttaatcagtcaatgccttcttcaacccttaacttcatgagattcacgttctcaaatgaaaatctaaatccattcatggttcaaaatgaacttaggtcatgtaaccaccaaatagaggagaaattaccccgctctagcaaagagatccagagatggagggtcaatgcccttctgattgatcaccacagttttttatcaactcggctccggctgggatgaaaagaccgccctctcaatattatattaagaagagactgaaacatggtcccgtccgaaaaaaaccccgaactctgcccccagccttaacgggccgatcaacaggccactctgcaacggcccagacggagggtggcgcgcaggatatcgacccccgagaccgggcgggacacaacgagaggattattttaaccaagcccaaaattcgcccccgagagagatcgaacctgggacctggagttgctacttggaagccttaaccattacgctagaggccctttcgcaccacaaagtttttatcacctccatcacaaacctttcttccacatatcccaccacataaatagatcaattggtgaggtcttgtatagggcagtgtacctttcttccacatatcccaccacacaatgccttggccatcaatagttccattctcacctacatagatcattgcaataacaaactatcattcttgcgaacaacctagctgatgatttcctttattatgaataatgttattttgtgagtttgcccagatcattttgtttatagcattttattaaatgcttgtgattggagattgagaattgtgatatttttgcatcttagtaatttctccatagcatatttcttgggaatatgactgaaaca

SEQ ID NO: 22662 - DNA, 950 bp, Zea mays
tttttttttttttttttttttttttttttttgtcacaggatggtttcttgataggaaatttacataataatattaaaatgagcgagccaagagttcaagacccgttcgctgtgaaccgcgacaggtttccttagtgcctctgtacattgggacaggacataaattattcgatcctgatcgtacatacacacatttgggaacacgtattttatcaaataaatttgtgtcggcctggtaccttcacagtatcaacacaaatttattcttcctaattcctggacaaagaaatttacggatgataacaacacaactgcttcatcctcaactgtgttcttaacagaacatcatccttgaatcctttaatcagtatagtacaagagcaaggatttttcacattccccacaaatgtgtacttttcttctacgagaacatactcatagacaagatcagatgagcctagacaattttcagtcaagtcatcaactgaattgatagctccaccaccacgtgatagctcgaagagcaataatcccgctctagcaaagagatccagagatggagggtcaatgcccttctgattgatcaccacagttttttatcaactcggctccggctgggatgaaaagaccgccctctcaatattatattaagaagagactgaaacatggtcccgtccgaaaaaaaccccgaactctgcccccggccttaacgggccgatcaacaggccactctgcaacggcccagacggagggtggcgcgcaggatatcgacccccgagaccgggcgggacacaacgaggggattattttaaccaagcccgaaattcgcccccgagagagatcgaacccgggacctggagttgctacttggaagccttaaccacagtttttatcacctccatcacaaacctttcttccacatatcccaccacataaatagatcaattggtg

SEQ ID NO: 22663 - DNA, 1519 bp, Zea mays
gcacgagaccattacctagaacatcctaatcaaaaaagcagcgtccgctccaaaacgcaacggtcgaatctcctcgaattcgaattgcagccggtgccacccacctcacatggcggcggcggaagagatgatggcggtgctggacaaggagacgctggcgctgatgggtctgggcaacgccgccgccgcggtggttgtcgagtgcgagaagttcaaggagaacgcgaggccgctcaagcgcgggcgcgacgtgtccaaactcaaccacgcgctcaaggcacacgccgatcccgcccagcgcgccactcttctcgaagcccgaaagaagatgattgaggcaatctacgagtaccaaggcgaggatccgctccaaccgtggctggactgcatcaagtgggtgcaggagtattttccgaccggcggcgagtgctcagggttggtggtgttgtacgagcagtgcgtgcggaccttattggatgacgagcgctacaaggacgacctccgcttcctcaaagtgtggctggaatacgcggggaactgtgctgatgctgaggtaatatacaggttcctggaggccaaccagattgggcagggccatgcgatctactacatgtcttacgcatcgttgatggagtcaaagaacaagttgaggaaagctaatgagatctttgtccttggtatagctagaaaagcgaagcctctggagaagttggaagctgtatacagggcatttcttcgaagatcaatcaaaaagagggaacaagagcaggatgatacagtagatgatgatctgccaaaacgcagtttcgggaataacttgaaacgagatgaaaacagaaatcagcaagcagggaactcccacctggggagaccaagggcactgcagaggccgctttcagtttacaaagatgaaagtccattaccaaatcagggccttgacagagtgaggagcaaagaaaataacacaagttggcgcaccctcggaacacgagcagaacggaacaaggaaaataacatgatgcctgctaaatggacgtctcacaagattccacagaagttaggagcaagaggagcggttcaatcaacccgagccagttgttccattgaagtcttcgtcgaggaagactgcacacatgaacctgctcggccggtgccaaagagcccaaatccttctgttctgaagctcaggcaaacaacaagcaaaagccttaagaaggagactgaattgctcaaggagaacccgctgcgcaacttccccctgagcaggcttaggtaatcagcatcttgctggttctgagaaacatctcgtacgttatgatttggtcgtatgtatggttgctgtgaggtgttgtgcccaaaaaaaaggctttattagcctctaaagcttagacgagcaatgtatgcctatggcattacccaagtgctgtaaggttctgcattatattgacacggcgtgcttattattgatagacctgcagatctcgtgcgtgcctatgtgaatcgaaaaaaaaaaaaaaaa

SEQ ID NO: 22664 - DNA, 1414 bp, Zea mays
gcacgagaccattacctagaacatcctaatcgaaaaaccgtcaccgtatccttggcggatttcgcccacgcccgcctctgccgaagaccagccgccgctgtcgacggcgaactcccgcggcgagtcgaccgccgtctcagaccctaaggcctaagccctagttccagcccacccagttccttaaccatggaggatgccctcgcgccgccgtctgtggccccgactccctcccccctcgccgccgctgccgtcctcacccgtcgtcggtcacacctcgacagtgcctccttccgcacgctctcccgcctcttctctcactgtctccacatcaacccgtcgccctgtggcatctcgccgcccgtgcccgagcccgtcgccgcggacttcgtcggtggggaccccgacgattccccagaaaggcctaatggcgctgagttcaatcggctaaaggatgtggaaatcgaggcggcggatgcgggaggcccttcgcttcacgggactgtccatcaaccggccgcggcgaactctaccctcgacctggttgaggctgaggctgaggctctgtagctcgagggtgcgggcgcggtaggggtcgtagaaagcacctcgtgtatgaccagagccgaggctggggaatcagcgggacttgtggtagaaagcacctcatgtaagaccactgctgaggtggaggagtcagcggttggagctggactggcgatggtgggtgacgtatctttgaagtcggtggagtctctcttggagacgaaggttgacgattcggtagaggtagcagtgggtgatgatgaaggctgtcttttgtttgaagcgatgctgacaaacttcacagggttgattgatgatgttgatgctggagcaataccaacacagaggtgtgcagtttctggaggtgacctgcagaataataaggcatctgaggatttgaaacaactgggtggtaggattgaaggagaacctcttagaaactgtgataatgggcagaatgatggtggtggtttcgaggaaggagagattgagggcgagtttcaggatttgggttcagaagaatctggaaattccgaacatggagacgaagatggtgaagatgagaaattggaagacaattccattagcagaggctcagggccaaataaatcttgtgattatggcacacaattcgggaatttgcactcaattcctgaaacaggaaatgatcatcttgtactgaacatggatgctattgtcagaggtgatgcacaaatatctgttaccagggctcaagccgtcacttatgatgaagttgtggattggaatgagactccgctgcctgacaatgagagtgtcgaccctgggaagaagagaaaacgcattctgacagaagagagaaaagctaaaaaaacaaaaaaaaaaaaaaaaa

SEQ ID NO: 22665 - DNA, 1980 bp, Zea mays
  misc_feature (1964)..(1964): n is a, c, g, or t
tcgagttttttttttttttttttaatataagttttaaccatcaataataccaatagcataagccacaatgactgaaagtaagaacgttctgtccgaactagtataaatcttacattctccaccgcgtacacgctccaaaactcagaatacgcacaataaatttaatttacttgtcgagcaagattcgaaacaccaagaagtagattctcacaaaaccatagtatcatctacgataaatttcttcatgtttgaacagtatcaggcgcacatttcaatttgtaatatggcgctcgaaaactacacttaacctgtccaaaaacattgggttaatcctcatctttcctgggagacttgaaattagcaacaagacgacgacgaccggcatcatgagctcacggtcgtatccatcttggaggcgtcttcgatgcccttgaaggccacacggagcttcctcaacgaggacacttttttcccgttgttctctgccatgcccgtggcatggacagtggtgtatgggacctctttgagaagctcaaacatggggatgctcaggtttggccgtgtcatctgctccagcacctccggtgactgcatgtacaggttgttaccttcgtgcgtcacgctggctttcgacatccgcaacttggggtgctcttcaagcatcttgatgaaatctgaaagagtagatgacgtatccagctcaacaagggtaccaggcccacatacaaggcaatctttgtctctgacaaactcagttactttaatgtgtgttccttccagaccgttgtacgtgagatagtttgacacacttttgctgcacccagaaataagctttaaggcttccaatgcacaagcagccgatataattgcattcgttgatgcaatggctgggattatatttttgacaacaccctgtgtcaaagaatatgtaacaccagaaataccgaaaagctctgctctctttaaagcctctgaataaatccactgcatatgctctgcatcatcgccatcaaaaggttttccaggatgaacctcatcccatttgatcaagtgagcatactcaatgcagtgagctgcagttcttggtgtctcggcgagagtacataaagggaacttaacctgtggaggaaaaagccatatgttgcattcaaagcaaggtgttgttccaggtataatgactctagcgtgtcccttgaagccctcagttccaccatctaccataggtttaaccgtctcttggagtggattgtcacttgagtcataatctaagaaaccacaagccacagaattgatgtagcttcgagcttcaattgaatccagacctaggacaattatgtggaactgactgtagaactctatctctttatcttcaatcctgcaaaaatgaggaactatgttcaccccattaactcgctccataaccctcttcgctgctacttcagccttggacttcccaacatcttgaactctgaagagaaactggcgattgaggttggagacgtctatggtgtccatatcaatgacgtgcagtttcttaaacccggagagagccaggtccttgaggagctcgcagccaagcccgcccgcgcccacaaccaaaacctccacgaggctccccagtaggtctcgcaggccggggctgggatcgaaagtggcctccacgaggtttccagggcgggacaagagcatgtcgaggtcacgccaccgctcgagttccgtcggcgccggctgttccgcgtcaggggaggccatcgcggcggcgctctggatttggctctccttcgagcagcggggaggatgagtaagggggcagcgggatgcgcggctttgatggagataatcggcgcacctgggcaccgaccaccgagcagccgaggtttggttgtggtttcttcgaaaaagtaaataagctcaactccggttccgctgccggcccggccggatccgagggacccaatcgcccncccccccccccccccc

SEQ ID NO: 22666 - DNA, 1516 bp, Zea mays
atagcaaacattcattaattaataggggtaaaatcccgacacatgtcttcagacagagttacaaattcaccgtgacgctgcccttccctgtaataatcacacaaacacacacacggatacacaggaaatgaagcccaggaaatcactccctattggtacagctcgcaagtcaacgtttcacaagacctggtactcacatacaacgaaaatcccgacacatgtcttcagacggagttacaaattcaccggagcaacatcaggtcatagttatacattcctaattttttctacaagtaccaaacatgagacgtacaaactcttcggcgtgttgcctgtaggcttcacttcccttcacccagattatggcaacaccgtggacccttgtgctacggatcgctgcaaaggatttcggtgaagacggagagtgcgtcctgcaggtacgacgacctgctctcgtccggaactggagcgttgagcatcattagaagacaccccatgggtaggttcagcgtctcgcttggggtgtccaccagaagcgcgcatagctcctctaccatcttcgagtagcatgcccttgactcaacaggtaatttgcttccccagactaacaacgactcgtttaatcggccaaagaaacttctgcatgattcactcatctcctcgagtgaacccgaatcatccatggcatttctttcttgcattgagttcttcagaacgtagaagtctatgtatattccggcaccaaggtcccagtcagcaatttcatacttgtggttctccaaggcacttgtgatcctccagacctcctgatggttagatgacagaaacatagaatgagcaacagaagtcacgaaaatagtatgagctttcttccagttgccacactgaatcaaattctccagtgcgccctgtttatctccatagtattcgtgataaagagccagagcttcatgcatccattcttctggtataccaagttctacaatgtactgcctttgagcatcatctctactccatgactcgcaatactgtgataaaacttctaagctcggagggatcccgagaccagcagagaacctcagaaatcgcctgctcgttcttcatcccttcgactctccgcaacacaaaagagggaggcagcgacttgccctcctcctgtgccagggtcaaccacgcctgcctttccaattcggcatcatcctcaacgatgaccccctcccactcgaagatgacgccgagccactctcagcacatgcgctcgaggcggagcagcgggttgtgcagtgggttaccttgctaactacaaaatataagtccagatggcaggtaataagctagctgatgtaaacaaaaggaaataagaaatggcagtcgtgcagacaatcaagccccagaatgagacactggagatgtcgtaaattgtccgtctttgatcgcgtgtttgttctgttggggcatgcccggctcggccttgctaactacaaaatataagtccagatggcaggtaataagctag

SEQ ID NO: 22667 - DNA, 849 bp, Zea mays
gaagcccaggaaatcactccctatctgtacagctcgcaagtcaacgtttcacaagacctggtactcacatacaacgatcacatacaacgaaaatcccgacacatgtcttcagacggcgttacaaattcaccggagcaacatcaggtcatagttatacattcctaatttttctataagtaccaaacatgagacgtacaaactcttcggcgtgttgcctgtaggcttcacttcccttcacccagattacggcaacaccgtggacccttgtgctacggatcgctgcaaaggatttcggtgaagacggagagtgcgtcctgcaggtacgacgacctgctctcgtccggaactggagcgttgagcatcgttagaagacaccccatgggtaggttcagcgtctcgcttggggtgtccaccagaagcgcgcatagctcctctgccatcttcgagtagcatgcccttgactcaacaggtaatttgcttccccagactaacaacgactcgtttaatcggccaaagaaacttctgcatgattcactcatctcctcgagtgaacccgaatcatccatggcatttctttcttgcattgagttcttcagaacgtagaagtctacgtatattccggcaccaaggtcccagtcagcaatttcatacttgtggttctccaaggcacttgtgatcctccagacctcctgatggttagctgagccaaaataacaacgaatgaagtgactgcatattcataccaggaatgccatgtttataaaaaaaagataataaaatgaatagattgtttgaacaaactcatcatataaatcgatgaggaggacgaaaagaatagattgtttgaac

SEQ ID NO: 22668 - DNA, 848 bp, Zea mays
ggatcccgagaccagcagagaacctcagaaatcgcctgctcgttcttcatcccttcgactctccgcaacacaaaagcgggaggcggcgacttgccctcctcctgtgccagggtcaaccacgcctgcctttccaattcggcatcatcctcaacgatgaccccctcccactcgaagatgacgccgagccacccgcagcccatgcgctcgaggcggagcagcgggttgtgcagcttggggtcatctgccctgttccgcggaggccatgacggcgtggggctggtgaccccaacgttcccccatgtcgccaccatccccggggatcccccgatactccctgcgagggctggccctgacctccttcgtgacccccatagccagcgccctgaccggccaatcggcgaggcgcgacgacggctgcctggtgacccgggccacgaggcggcggccggcgaaggcggtgggcaggggtcggcaggcgacgacatggaacgtccggcggaggtggtggtgggaagcgccggctcccctggacctgtggtcgaacaggtggggggctattatggaggtgctcgcgctgaccgtgtcgacaaccatgatggccgctggatccggcgccctcccaccaagctacgaagaatcgagagaccggagcccaagcggccaaacaaagaattgttggaccaaatttgctggaaccgtctactcctctgccggaatcgcgcggcggcggatagggcgatcggacggccgcggaggcgtcgctgggtcgcggaggaacgggaggttgcttcgggaaactgcctaccgtattttttccccgttcccggccggcctcgaggtacccaatg

SEQ ID NO: 22669 - DNA, 886 bp, Zea mays
  misc_feature (170)..(170): n is a, c, g, or t
  misc_feature (173)..(173): n is a, c, g, or t
aaacggagttacaaagtgaccggagcaacatcagggcatagttatacattcctaattttttctacaagtaccaaacatgagaggggcaaactcttcgggggggggcctgtatgcttcacttcccttcacccagatggggggggggcctttaactttttttctacggatcnctncaaaggatttcggagaaaacggagagtgcatcctgcaggtacgacgacctgctctcgtctggaactggagcgttgagcatcgtcagaagacaccccatgggtaggttcagcgtctcgcttggggtgtccaccagaagcgcgcatagctcctctgccatcttcgagtagcatgcccttgactcaacaggtaatttgcttccccagactaacaacgaatcgtttaatcggccaaagaaacttctgcatgattcactcatctcctcgagtgaatccgaatcatccatggcatttctttcttgcattgagttcttcagaacgtagaagtctatgtatattccggcaccaaggtcccagtcagcaatttcatacttgtggttctccaaggcacttgtgatcctccagacctcctgatggttagctgagccaaaataacaacgaatgaagtgactgcgtattcataccaagaatgccatgtttatcaaaaaaagaagataaatgaaaaatacaagtccagcaagcatataggaggaaaagaatatattgtttgaacagactcatcgtgaggtttctaggaaatacgtgcagctgtatatttatgcacagcaaaagcaatatgtttcaatcatggtgaaaaaaaaggcaatacatttaccaaataaagaaattcattgaaaaaatgtttagggcactgtaagcaaaacttacagacagaa

SEQ ID NO: 22670 - DNA, 6325 bp, Zea mays
  misc_feature (4054)..(4054): n is a, c, g, or t
gacagaaacatagaatgagcaacagaagtcacgaaaatagtgtgagctttcttccagttgccacactgaatcaaattctccagtgcaccctgtttatctccatagtattcgtgataaagagcctgtatatagagctcattagctacacatgcttcatgtgtaataattttcatgcactggcattataaaccatttgcaaagcatattactaaagaaatttctactcaccagggctccatgcatccattcttctggtataccaagttctacaatgtattgcctttgagcatcatctctactccatgactcacaatactgtgataaaacttccctgattaatttctcatgaatgtatggggcatcgtcaagatacggcatgtgcagaatgacatagatagcccaatggcacctcccaagacaaagcaattgataaacaaaacttaaatctagcaagtgaagatcttttgaactgaaagctccaacagcctccaaaatcgaacgctgatgccatatgaaatgataatccaaggggtcgaatgaagatgagaatgcactgaacatagtctttagcagcccaaacttctcatctttattggcatgaagaagcattaggtagaaggagatatcaaaatggtcacccggggaccactgaggtgcttcatcaagaggtccttcatctatatatacaggaacaggatagggaactttgccctcaccaaggagttgatcgtaagaacgaatgataatatcgagtggtgtatcaggtgataattgataccacataatcaaaccaaggtacctcttccagtcaattggtaaatctagaaaagcggcctgtacgttaccagcaagtaacatatatacctttaaccagtcttcctcaatataatcaaaatctagaccattcattttccactgatccagtgtttgcgcaaggtcagatcgatttgacattgacccacctgcctgacttagcaagattgccaaccgaacatcaccccttgaggcagcaatttcagtggccgtgtccaattgtcgaccagtcaaaaggaggaggatattttccaagtacctggcatcatttaaggaacccacctctccttgcacccgatggcaaacactgtcctgtaaccaattgctaaaatctgctctcctaaacaaagggagtgcttcagggtctatgtcgacagagccttcttttttgtctaaaaccatgccttcctgatcatcatcaccaacagagtccaactggctaccagttgctctctctgagaacaagaccctaattaactcccagactgtaacttgatgcatcaacagcacacgtgaagacatggataaatcattgacttcaagctgcctttcgatgatatcaatatatgacctgcagatgtcaggcaaaaccaaacgatttgtcatgactttttgaagcttcaatctgaacgagtcagactcagtttctagaaagtcatgatcaagactcttatggaggtccattggagcagaaaaacatagttctgttaggtcatccttaatcttatccttatcatcacgcacaactttgtcacttgcaactttctctatgtgaataacagaagataggacagttccaggactattgaccagactacctgaatgtacaagtaaaccatttggtccccaaccaacacgaaatgatctacccatgaataaagcagcatccactacacagacagtatatgtgtttccagcaacaggagtttcttgctcaggcggcagcttaaagccttccaccttggtcatactcactggaaatcctctgttttgcccagacataagaataccctgattcgatgaaccaagctctgaagaattcaaattgtattccaaaagtgcctgacgttctttccgaacaggcataccagatctcctgccagccttctgagaagacatgtgcaagggagagagagaccttaacctcgaacctttactgcttgaggtaggtgaatccacattcatcctttctctgctaaggtacctcttgtcagaagggaacccatcctccatgtattcatcttcttcctcattggaaaacatcaccatcctcatttcttgcacctttgcagggtcaagcccgagatgagcaggcaatgaatgtgagagctcaatctcataactatttgaaggtggatctctttctcttacttcagtaattggctgccgaacagctgcctcgtccatcacagcatcctcttcgtcctcatccacaagcccaaatctactaaaatgatcaacctcaaatttccattttccattcactggattgaatgaaagaaacctagaaccttgctttcttgcacgacaccttagcacttcaacaaggatactgggctccggatgatccttcagattcagcagcaaggatacttctgctgctttgttaagaccatgccctacaggtggcttacaagtctcatcctcataaaccaccacatagtgtttttcaaacctgacaatttcattcaggtcaatgcccctcacatcggtgttgcccaagaacctaacctgcccatatccagccctccctatgatgaagtttggaaccctgctgcagtagccaggatcagccacctccctctctaccagctcatcaattgacggacttgtgaagtactcggaggagcgcagcacagggaacacagtgctacctgccatgggtggtagcgaggcgatgttccagaatcaacagcactgagtgacgggtccctgccgtggtgccatgttcgtcattgttccatacacaactaaccctgctccaaagaacacggttcatggtgagatgagaacatatgccaagctaatgtgatattttctaaaaaaacacatacacctacattttagtttcttttcaatacacagataatacccgataagccacattagaaattcaaaaggcatagcagcatagcaggaacattacaaattgccctacattcttgcaactgagctgtcctgagatttccaataagccgaacactacaacgactaaggttactgtcacccgcgtctctgctggttcccctccacagccagaccaagtgactagacggattgaccacgagagagggaagaggacgagactacgagtgagggaacgagacagaaacctgggcaggtggtggagctcgtcgctcgtgtgcgggtgacagcaaaaagcgctccccgtccccgctccccgggacgccgcggagagggtagcgtacgtcaccggaagctatttccttccggagcacgtgccggtgctgaagctcgccggcgacgccggatctcgccgcaggcttgtgcaggcggtcggcggcgggcacgctgggtgggaacccgactttgggaggtagaacaagggttctcatcggtgttgtaatagaagtaatgggccagacgatgtttgggctgcatccttaaatgggccgttatttattggcagagaagtttgagccaggagcttaccgtttggcacacccgctttccatgactcccgttgaacggatcttgactaagaaccggtcgaaccttacgattagacatgtcaaacgtggagacgggtcaaaatcaaatcatgaattatttgacacagtctatattcgattcgtgtctagtatcagatcgggttagctcatgcaacaatgttggacgtgttggattaagtttttcggttagtgtcgggttttttgggctttggattcacttttagatcaaaaaatatgacccgtgtttgacctgtaaattattgtggattaaaaattagagttgtccgtgtttgaccctcgttggcactcaaaccaactaggtcgcgctccagctgcgatcctcaccttgtatgtcgacatcgactaggttgtctgcaccaacacccgcaaattcacattggactatgtgatgtttttcaatgataacctcatctcatgatccagcaagcgtctttctaacattaagatcaggtaacataacaaaaggatgttgccaaggctgtctggcaaacttaagcaactcttgcataaacttcaccaactcttanaaacatgatattctcgtttactacgataacgtcagtgtagattatctctcgagtaacccgatgtagctccaatacaccaactatatcaagattgacctccgcttcatccacgactgagttgtcttcggccttgtacaagtaatctgcatcctaactaccttactgatatcttcattaaaatgcaattatctatggtattctattcctggagtttcaatcgagtaggaacgtccgccactccgccccagcgtcgaagcgtgcgcgctagtggcgccaccgcgcccgcatcgctcgttctcttgccgaccggatcgttcctgaaacagggccgtcgtctcctgcggtatctcgcgctgccgaggacgaccgagcggcaagcactggctgacaggcaccggcaacacgaaaagctggtggaggacgtaggggggggcagccggccaggcccgcgcctttgatgacgaggctcatgcttggcttggtggacctccttctcctccggcttgcaattgacgcgcgcgcggggcctgaccgcctgagccgggtcgctgttatggtccagtgcacagcgcgggaatggacctgttgaggtgagaggagggccgccggccgaggttatgagcagccagcagcagtggcgtgcctgcgccgccttccggccggcctacaggaagctgggatccactttcgagcctgccggtagttgcagcccggatcgtagtggtgccctgatccagcggcagcgtcctgcggcacggacagcgacgggcctctctccctctcgtgggctcgtggcactgtcagaccaccgccggcgttcccccggccgggcccctactggctactgtgtccggcaacgactactactgatgagtcgatcggcgatctatcgagcctcttgctgctggtaaccaccgatgagccgagcgtctccgggtatagtggctggactggctgcttggactgggagtgtgtagttgtttgagctcgtcgtttgaccgacaagacaagtgaagcagatttctagggcgcgccaggacagagctcctcattatgtgggcacgtacaaggggtctgcctgcctagggctacgtacgtcgcagacaaaaaggttgctccctcctcaaattgctccgaaaatcatcgcccagtctcgtcgtcgagacgacaccttgcattgggttgggtggactcactcagagctcggctttccatcagtcagtcatatacaaacactttcaataaataacttccttccaagtccatcagtgctgctgctgtgcacgcactcctctcttgaaaccgcgagtgcgtgcatgtggttcagtaaagtacactttcaataagtgtagtagtatctggctatggcttgccaatgtcttggaatgaacgggaggtcgactagtaaacggccggctaaacgctagctacgataatccgtgtttctggatagaatgtaggtttcggacgcacctgcactgcacagtccctgatatttcagcaggtggtgttgcatcgcggtccaaatccccgcttcaattgaatttaatttgtgcacataccattaccaatttagatattaatatgtttgatgtaatccagaaataatatatcaaaaactgcaacaatatacctctacttttataaagcatcagttttctagttttcacgtagtcccttttgcaaacaaaacattaaacttctttctatgctaacttgtggtcctaacgtgacgtgaaacgttaactcctacgtggaccgtgagaaagcaccaaggggtcgaattatcgtacttctttttatgcaatgctcctagatagtactacctctctagctaaaggtgtatgagtgtgtgagctagctataaaaaatggacatgtctccttttcaactcatattcaaatgtttcttctccagtctcgctaataactatatttatagccttttcgcctttcttaaatttacggtctagatactcacttgcctagtgctcatcgctcccacaaacaacaaccaccttctttgttctttttcttcttaaacatggttgactgcttaggctttgtattattctcttgcttttccttactattattactattacgagatgcattagagtttttcatctacaccatatattatcattagaagactcaactccttttacacttgcactcgccctctttcaacatcaagagatccaccattaaacggttatcaactattctatattcataaaattggtccatgatgtacaactttggtaccaac

SEQ ID NO: 22671 - DNA, 2359 bp, Zea mays
  misc_feature (2322)..(2322): n is a, c, g, or t
  misc_feature (2324)..(2327): n is a, c, g, or t
gggtaccgggccccccctcgaggtttttttttttttttttttgcaacgaagatcccgacacatgtcttcaggagttcagacggcgttacaaattcaccggagcaacatcaggtcatagttatacattcctaattttctacaagtaccaaacatgagacgtacaaactcttcggcgtgttgcctctaggcttcacttcccatcacccagattacggcaacacggtggacccttgtgctacggatcgctgcaaaggatttcggtgaagacagagagtgcgtcctgcaggtacgacgacctgctctcgtccggaactggagcgttgagcatcgtcagaagacaccccatgggtaggttcagcgtctcgcttggggtgtccaccagaagcgcgcatagctcctctgccatcttcgagtagcatgcccttgactcaacaggtaatttgcttccccagactaacaacgaatcgtttaatcggccaaagaaacttctgcatgattcactcatctcctcgagtgaatccgaatcatccatggcatttctttcttgcattgagttcttcagaacgtagaagtctatgtatattccggcaccaaggtcccagtcagcaatttcatacttgtggttctccaaggcacttgtgatcctccagacctcctgatggttagatgacagaaacatagaatgagcaacagaagtcacgaaaatagtatgagctttcttccagttgccacactgaatcaaattctccagtgcaccctgtttatctccatagtattcgtgataaagagccagagcttcatgcatccattcttctggtataccaagttctacaatgtattgcctttgagcatcatctctactccatgactcacaatactgtgataaaacttccctgattaatttctcatgaatgtatggggcatcgtcaagatacggcatgtgcagaatgacatagatagcccaatggcacctcccaagacaaagcaattgataaacaaaacttaaatctagcaagtgaagatcttttgaactgaaagctccaacagcctccaaaatcgaacgctgatgccatatgaaatgataatccaaggggtcgaatgaagatgagaatgcactgaacatagtctttagcagcccaaacttctcatctttattggcatgaagaagcattaggtagaaggagatatcaaaatggtcacccggggaccactgaggtgcttcatcaagaggtccttcatctatatatacaggaacaggatagggaactttgccctcaccaaggagttgatcgtaagaacgaatgataatatcgagtggtgtatcaggtgataattgataccacataatcaaaccaaggtacctcttccagtcaattggtaaatctagaaaagcggcctgtacgttaccagcaagtaacatatatacctttaaccagtcttcctcaatataatcaaaatctagaccattcattttccactgatccagtgtttgcgcaaggtcagatcgatttgacattgacccacctgcctgacttagcaagattgccaaccgaacatcaccccttgaggcagcaatttcagtggccgtgtccaattgtcgaccagtcaaaaggaggaggatattttccaagtacctggcatcatttaaggaacccacctctccttgcacccgatggcaaacactgtcctgtaaccaattgctaaaatctgctctcctaaacaaagggagtgcttcagggtctatgtcgacagagccttcttttttgtctaaaaccatgccttcctgatcatcatcaccaacagagtccaactggctaccagttgctctctctgagaacaagaccctaattaactcccagactgtaacttgatgcatcaacagcacacgtgaagacatggataaatcattgacttcaagctgcctttcgatgatatcaatatatgacctgcagatgtcaggcaaaaccaaacgatttgtcatgactttttgaagcttcaatctgaacgagtcagactcagtttctagaaagtcatgatcaagactcttatggaggtccattggagcagaaaaacatagttctgttaggtcatccttaatcttatccttatcatcacgcacaactttgtcacttgcaactttctctatgtgaataacagaagataggacagttccaggactattgaccagactacctgaatgtacaagtaaaccatttggtccccaaccaacacgaaatgatctacccatgaataaagcagcatccactacacagacagtatatgtgtttccagcaacaggagtttcttggggggggggggggngnnnncccactagtgagttctctctctcctctctctc

SEQ ID NO: 22672 - DNA, 4436 bp, Zea mays
  misc_feature (3132)..(3132): n is a, c, g, or t
accgggccccccctcgccctggttttctctcccctttggtacagctcgcaagtcaacgtttcataagacctggtactcacatacaacgaagatcccgacacatgtcttcagatggcgttacaaattcaccggagcaacatcaggtcatagttatacattcctaattttctacaagtatcaaacatgagacgtacaaactcttcggcgtgttgcctgtaggcttcactccccttcacctacggatcgctgcaaaggatttcggtgaagacggagagtgcatcctgcaggtacgacgacctgctctcgtctggaactggagcgttgagcatcgtcagaagacaccccatgggtaggttcagcgtctcgcttggggtgtccaccagaagcgcgcatagctcctctgccatcttcgagtagcatgcccttgactcaacaggtaatttgcttccccagactaacaacgattcgtttaatcgaccaaagaaacttctgcatgattcactcatctcctcgagtgaatccgaatcatccatggcatttctttcttgcattgagttcttcagaacgtagaagtctatgtatattccggcaccaaggtcccagtcagcaatttcatacttgtggttctccaaggcacttgtaatcctccagacctcctgatggttagcagagcttcatgcatccattcttctggtataccaagttctacaatgtactgcctttgagcatcatctctactccatgactcgcaatactgtgataaaacttctaagctcggagggatcccgagaccagcagagaacctcagaaatcgcctgctcgttcttcatcccttcgactctccgcaacacaaaagagggaggcagcgacttgccctcctcctgtgccagggtcaaccacgcctgcctttccaattcggcatcatcctcaacgatgaccccctcccactcgaagatgacgccgagccactctcagcacatgcgctcgaggcggagcagcgggttgtgcagtgggttaccttgctaactacaaaatataagtccagatggcaggtaataagctagctgatgtaaacaaaaggaaataagaaatggcagtcgtgcagacaatcaagccccagaatgagacactggagatgtcgtaaattgtccgtctttgaacgcgtgaatgtactgttggggcaaggaatgctcggcctgcaaaagttttagcaaaaatgagagaatggtcaagaccagcgtatatatattttttatacagaaagaaactatggtctcctttcagttcaatttcgccatgttctcccagaatggtttgtgtaagtgctggatggtgaaatatgaagttgagagccttggaaaagcaaaagtggaaccaaagtttcagtttacttaattaaaatttcagatggcaggtaataagctagctgatgtaaacaaaaggaaacaagaaatggtgaaaattttgagccgttctaatatctagttaccttgctaactacaaaatataagtccagatggcaggtaataagctagctgatgtaaacaaaaggaaataagaaatggcagccgtgcagacaatcaagccccagaatgagacactggagatgtcgtaaattgtccgtctttgaacgcgtgaatgtactgctggggcaaggaatgctcggcctgcaaaggttttagcaaaatgagagaatggtcaagactagcgtatatatattttttttatacagaaagaaactatggtcttctttcagttcaatttcgccatgttctcccagaatggtttgtataagtgctggatggtgaaatatgaagttgagggccatggaaaagcaaatgtggaaccaaagtttcagttcacttaattaaaatcaacctttttgttccgtccattgtaatccatgtaggtgtaactttgaaagtaaaataagaggatcctcggtaactaatggtgtgtttagtttgcggaatcgtcccataacttatgaggcagtggtgcacatgattccattccataaatttggtagcatgcatcaacctatttctcgtgcatatactagttattgggttgtgaaaagagaagtgatgattggtcagcttgcttcattccacaaatcaaacaaaaaaagtggggaatggatagatgatagaacacctcattcttgaaactaaacacaccccggatgaacaagtcagttgagtgctcacccagtcaccgtcactgtttgcatctggaacaagagcattgatttcacttgatttagctgttgttatagatgcctctaaagattccttgcttaagtaaagttggcagccagatgtgttgtctattgatatagtcggaactgagccctgcagtatcattagaaagcataattcgttcaaaaaaatcataagaatatatttgtatcaactgatacaagtaaatattatatttatgtgtttgtaagaaaatctacctcacattggacctctgcactgctacagttcacaatttcacaagccgctacaaccccctgatatataacaacaatacatgacaagttaaagaagcgacaagaatgccctggaagtatgtgtttgtttgtccatagatgtaccttgaacaagactcccactttggtgcacttgtcgattgttatgttgttcactttccctgcacatgcttggacggttattattttctcttgcaaaaaaaaataaaaaagaatgcatcattcaaaggattgttagtagcactttggtgggaaaatacctttgacttgcagcacacaatccttgcatccgtatacatacaccgactgtttggtatcacaaccttcaatggtcaagctcttgttcccaacatgatgctcaactacccatctgacagagaatggcattatcgagtgagcttggttttcattacgagggttcattcgcatttctggacacaggaaggaacgtaaagattacttgcggcccatttggagctccagtttagcaggacctttagttgaactaaagggaggtgaattgcgagtctcttttccttcagcagccacaacacctgttctgtctgttctatttttgctcttcatgtcatcagttaccttcctgaggcctgcacgtataacaagaaggtgaaacngtaactgtagcatagtttcagtgcctggaatgatagtgcatgtgtacgaattgttcaaccgaaaatcgactggaagctcatggtgagctgaccttgtgtcactggtttcccagagctgatttcagcaaagacagctgacattccagattttggttgggacgacgaggctgaagagatggaaagacatggaggaggaacagacggagctgaaggtgccttgttggctgcgcttcctggcggttgccacgaaggacccaatgggtaatacctcttcacgtagtcacgtaaattgggaatgtacagctcttttagggcttttgcccactccacatgatcagggtccttatttttgtattccacaagtacctgtgataatgccattatccatcactagaagatttagcctttatatgcttaggaaaagaactctactacagttaatctcttaacaagcttggttagacatggtgttatgctaagtaagcatttggtggtcctttttcaactgttaactctgattttgtttttgttttataaaatgtgtactccctcagtcccaaattagtattcgttttagcacttgttttatgtctatattcgaataggtaatgatgaatctagacacatataaatacatacattaattattgtatggattcattaaacgtctaaaacaaattttaatttgggatgcagagagttaaaaattttaggtatgcacacaggtctttgagccttgagttttactgtattgctcacatttagcctagaaattggtgcctgataaggattcatttgatcatttgctccttcgaccactaactcctttacatattatcaaggtgcatataaaaaaatgacactcttttttggaacagaggcactccagcatgacattagacaagtcaactgtgagtaatataccttattgctgtagaactctgccatttgccagctctcttctacatgagcaatcggaagaggcatacctgaagcgatatacagtctctctcacgttagcgtgcatgataaatttaccaaaaggttgaagatgataatttatacatactaaccgcagcctttgccggtgtaaccaatccatgccaaagcggccaggctaccggctgctgcttttagatggttggcatagatcgagctcgtccgctccaccaatgcgttggcctccaagatcgcttcgttcagaggccccataaaagtcgtcactgactccattgttggtttctaccaagtaccaaatcataagcactgaacgatcgatcgtcaaccacaaatatattaaatgc

SEQ ID NO: 22673 - DNA, 3496 bp, Zea mays
ttgaatcaagatcgtaatgagtggtattgagggggactaaatcatttccaagtgggtgtgttcatttgttccggaatcatgacctaaaaccaatccaaccagaaatgtttatctaatttgtataagctttgatcaactggaaccattcctggcctcaatcctgaacaaacgaacgcactctttaatccctgtgatttacggctgaaacgaagtcctcaataatctccaatgtaccccgaagcacgggtcgccgtgacgctgcccttccctgtaataatcacacaaacacacacacggatacacaggaaatgaagcccaggaaatcactccctattggtacagctcgcaagtcaacgtttcacaagacctggtactcacatacaacgaaaatcccgacacatgtcttcagacggagttacaaattcaccggagcaacatcaggtcatagttatacattcctaattttttctacaagtaccaaacatgagacgtacaaactcttcggcgtgttgcctgtaggcttcacttcccttcacccagattacggcaacaccgtggacccttgtgctacggatcgctgcaaaggatttcggtgaagacggagagtgcgtcctgcaggtacgacgacctgctctcgtccggaactggagcgttgagcatcgttagaagacaccccatgggtaggttcagcgtctcgcttggggtgtccaccagaagcgcgcatagctcctctgccatcttcgagtagcatgccctgtcaaacacgacactgtcagcaagcccagtgagagaatactccaaatataaacctaaacaagaatgcttcagaattccaaatggtgctgatcagctgggatttgaacaatttaacataacagtgaagttcctcaggtagttcaggtttgctatttgcatcaactcattataatccagtggcccaactccatcaaaacatggtacagaaggaaatggtttcagatagtggatgtggatcagtcacatactgtagaatcgaacgttaccttgactcaacaggtaatttgcttccccagactaacaacgactcgtttaatcggccaaagaaacttctgcatgattcactcatctcctcgagtgaaccctgaaacaaaaaaaagtaatgctgatctcagccacagttctacaaggaaatgcttgtgagtttgtctctgaagtaagggcttgtaccgaatcatccatggcatttctttcttgcattgagttcttcagaacgtagaagtctatgtatattccggcaccaaggtcccagtcagcaatttcatacttgtggttctccaaggcacttgtgatcctccagacctcctgatggttagctgagccaaaataacagcgaatgaagtgaccgcatattcataccaggaatgccatgtttataaaaaaatgataataaaatgaatagattgtttgaacaaacttcatcatgagggttctaggaaatacgggcagctgtatatttatgcacaacaaaagtaatatgtttcaaccatggtgaaaaaaggtaatatatttaccaaataaagaaattcattgaaaaaatgtttagggcactgtaagcaaaacttacatgatagaaacatagaatgagcaacagaagtcacgaaaatagtatgagctttcttccagttgccacactgaatcaaattctccagtgcgccctgtttatctccatagtattcgtgataaagagcctgtatatagagctcattagctacacatgcttcatgtgtgatgttttttcatgcactggcattataaaccatttgcaaagcatattactgaagaaattttctactcaccagagcttcatgcatccattcttctggtataccaagttctacaatgtactgcctttgagcatcatctctactccatgactcgcaatactgtgataaaacttctaagctcggaggaatcccgagaccagcagagaacctcagaaatcgcctgctcgttcttcatcccttcgactctccgcaacacaaaagcgggaggcggcgacttgccctcctcctgtgccagggtcaaccacacctgcctttccaattcggcatcatcctcaacgatgaccccctcccactcgaagatgacgccgagccacccgcagcacatgcgctcgaggcggagcagcgggttgtgcagtgggttaccttgctaactacaaaatataagtccagatggcaggtaataagctagctgatgtaaacaaaaggaaataagaaatggcagtcgtgcagacaatcaagccccagaatgagacactggagatgtcgtaaattgtccgtctttgaacgcgtgaatgtactgttggggcaaggaatgctcggcctgcaaaagttttagcaaaaatgagagaattgtcaagaccagcgtatatatattttttatacagaaagaaactatggtctcctttcagttcaatttcgccatgttctcccagaatggtttgtgtaagtgctggatggtgaaatatgaagttgagagccttggaaaagcaaaagtggaaccaaaggtttagtttacttaattaaaatttcagatggcaggtaataagctagctgatgtaaacaaaaggaaataagaaatggtgaaaattttgacccgttctaatatctagttaccttgctaactacaaaatataagtccagatggcaggtaataagctagctgatgtaaacaaaaggaaataagaaatggcagtcgtgcagacaatcaagccccagaatgagacactggagatgtcgtaaattgtccgtctttgaacgcgtgaatgtactgctggggcaaggaatgctcggcctgcaaaagttttagcaaaaatgagagaatggtcaagaccaacgtatatatattttttatacagaaagaaactatggtcttctttcagttcaattcgtcatgttctcccagaatggtttgtgtaagtgctggatggtgaaatatgaaattgagagccttggaaaagcaaaagtggaaccaaagtttcagtttggggtcatctgccctgttccgcggaggccatgatgacgtggggctggtgaccccaacgtcccccatgtcgccaccatccccggggatcccccggtactccctgcgagggctggccctggcctccttcgtgacccccatagccagcgccctgaccggccaatcggcgaggcgcgacgacggctgcctggtgacccgggccacgaggcggcggccggcgaaggcggtgggcaggggtcggcaggcgacgacatggaacgtccggcggaggtggtggtggtgggaagcgccggcgcccctggacctgtggtcgaaccaggtggggggctattatggaggtgctcgcgctgaccgtgtcgacaaccatgatggccgctggatccggcgcggacgcgtgggcggacgcgtgggcggacgcgtgggcggacgcgtgggcggacgcgtgggcggacgcgtgggtccggacgcgggg

SEQ ID NO: 22674 - DNA, 801 bp, Zea mays
  misc_feature (18)..(18): n is a, c, g, or t
aatctccaatgtaccccngaacacgggtcgccgtgacgctgcccttccctgtaatcatcacacacactcacatacaacgaaaatcccgacacatgtcttcagacggcattacaaattcacctgagcaacatcaggtcatagttatacattcctaattttctacaagtaccaaacatgagacgtacaaactcttcggcgtgttgcctgtaggcttcactccccttcgcctacggatcgctgcaaaggatttcggtgaagacggagagtgcgtcctgcaggtacgacgacctgctctcgtccggaactggagcgttgagcatcgttagaagacaccccatgggtaggttcagcgtctcgcttggggtgtccaccagaagcgcacatagctcctctgccatcttcgagtagcatgcccttgactcaacaggtaatttgcttccccagactaacaacgactcgtttaatcggccaaagaaacttctgcatgattcactcatctcctcgagtgaacccgaatcatccatggcatttctttcttgcattgagttcttcaaaacgtagaagtctacgtatattccggcaccaaggtcccagtcagcaatttcatacttgtggttctccaaggcacttgtgatcctccagacctcctgatggttagctgagccaaaataacaacgaatgaagtgactgcatattcataccaggaatgccatgtttataaaaaaaagataataaaatgaatagattgtttgaacaaactcatcatgaggtttctaggaaatacgtgcagctgtatattta

SEQ ID NO: 22675 - DNA, 779 bp, Zea mays
atcgttcttctccgtgctcgccagtgggttgctgacagagatggtagtggccgccgcgtcggaggggcgcggagccggaggtggcggcggaggtgccgccgttcgcggacctgaccaactccaggaagaagccgctcgtgtcggcgaggttcagcaggaaggcgaccaaaccaagccccgaaggtagcagggctctgcgggtggcgcggccgcggaaggaggagacgctggagagcacgtgccaggccatcgcggagggccgggggccgacgctagctcgacgcctcaagaagtccgacacctgggacacccgtcccgggcgccgcccgtccggcggtggcagcagcggggaggtcgatccagcggccgtggcaccggcgggggcgatgcggaaggccgagactttcaacgacggtggcgccggaaggagcaggcctgctcccgctgcgctggtgcggcgggagccgtcgctggggcaggacgagctgaaccgccgcgtggaggcgttcatccacaagttcaacatggagatgcggctgcagcggcaggagtcgctcaagcgctacaacgacatgattggcaggggcaggggcagccgttagtgggaataactgcggctcgcaagaaggattctgctttttttgttccgtgatatttctcgattttggttcttggtctctgtaagatatggttttgtgtaaatggttttatcaagtaacgaggacaagttcgatcgtactaaaaaaataaaaaaaaaaaaaaggcggccgctcctaaag

SEQ ID NO: 22676 - DNA, 3781 bp, Zea mays
  misc_feature (3194)..(3194): n is a, c, g, or t
  misc_feature (3643)..(3644): n is a, c, g, or t
  misc_feature (3655)..(3656): n is a, c, g, or t
tttgagggtaaaatcgttgaaaacaaaggaagctgcaattcaaatacctattaaggacaaataataaacaacttagagaagagcatctaataatgtagttacatgtatatttataggaggaagcaggaatacggttttcataggaacgaactatcacaaaaagtggtttatactttacagctcatcgtctggtttctgtttcttctcttacgacctattttcttgtttttgttgttgcttctgttgggccttcctttgtttcttttctagcttctctgccagcccactcagttgcctaccctctgtacacaggaagatgtatatgctcatgaaagaaggaaaaataagcattaaaattatatgtaaagaacacgatacactttaacaacaaaaccaaatagcagaaaagcaccttgtactccaatgcatttattcccttccacacaaaatcaaacaaagttattaaattctctggacttggagcgacgacaaatatatttgaatatctaagaagtcaaaaaattgcactaagaagaattgcacactctaactaaatattaacttcccttaggttgagctctacccagctgctacaactctagcaatggcaagaccaaggcctgctgatttaccacatccatgagcaggaagcagagcaatcttacttcgcagggacttctcaggaactaagggaaacaatagttatgcaattatccattattaacttcgagcgccctatccagtgcaaggtaaaaggagtgaagaattgttcatgtcatattaaaatttagcagaggatttgattaaatcatttagcacaattactacttcaaggaatgaatcttccagaaaacagaagagcattaaagcaatgatcaggtgaaacacggggggcctaacataatttacatttaagttgtaactgttctttgtttcatcaagtatttacattagagttgtaactgttctttgtttcatcaggtatttttatttttcaccaaccgtgtatgcctgaaagcaggttttacgtccctccgcaagaagatactatagatgatgttggtctaggcgctaggtcctcagaaaggagtcctattgtggaggggaacatgtccgttggatctgtgcttgcttcagatggatgtgatgtacctttgcagggaagcattactgagccctttttccagcaggataaacatgaccatactggtatagttggaccaaaatcttgtaagcgaaaatctccaattctatcttactgtgctgatggagatggggcagatggtggtggctccagcaatcagtcatctaaggtttccattcgtgaaggacctagcactcatgccacagtaactccaggttttgacagaatcagcgatgtcttaccaacagatgcacctgaatctgagcatttgcctgagtgcatagctgcacaggatacaaccatttcacagcctgacagcaggaaagctcatttgagtgctctgcaacaggaaaggggtgagaaagtaacccaagatctggaagatatctctgcaaatattgggtcagtggaaaaggaccatattcatggggatctgactttgccatctgccagtgttttactttctataagctgcaatggtgctaatcaaggaagtaaatatgaaaccaaccttcacccagggactgctacagaggatatgatggctttcgaagagcagaatgcagacaagtctcacttagaagtcagtggtatcaacaaggctaatcaagctctgcatgatgatggcggcgtcatgaaaaataatacagtacatggtgggttgattgtgcagactgctccagtgtctcaaaattgcaatgtagccttacatgataaaacttcagagcaggaaaatgaaaagaacattcaaaaagataattgccatacttatgttccaggctcttctcaggataggggtggagaaagtgcaaagaaaacaacaaatgaactaaagtctggggacatttcttcaaaaatatgtgttcatttcaatgttcaagacatcaatgatactctggaggacttgtctcaacaaggtttgtgcataaaatgtggtgaaggtggtcagttgttggaatgcaatggctgttttttagccgcccatagcagctgttttggttcatcggcgacatttgaaggaaccaattttttctactgcccggtatgcttgtataagaaagccactgaagcatataaaaaggcaaagaaaacatattgtgaaactaggaagaaccttgttgctttccttggcacagcacaagccaccaatcaacctgacaaacaactaaatggagctcagccaggagctgccaacagagatgaagagcctcatgatgagcaacattctaaagggtgtggcgcatcaaaaggggcccatgaaaatgaagtatacaatcttgctcatcaggatgaagagcatcatcagcagaggaagaagcagaaaataaatgctataggtaagagttatcctaaggaggtactcactgagaaggttcttttccagaactctgatcctgcatccattaataaacattcagtgctccagaataacaataaaacaccagttaaggatccagagaaaaagcagcaagcggtcaacgaagaagctcgcaaagaaggtggtaatgacaactcatctcatgaaacaggagcttcatctccgagaagatgtgatcctccttcgaatcaggacgttgaggctgaccaggacgatagccttacaacttctaatcaatctggtggttctgatgaaatagaagctacatcttctaatgactctgccaagcaatcatcacccccttggcgtggtatgggacacagcaaaaaaggattgcacgaaaaggagccagctgtatcaagtaaatctggaaaaggtattgggaaacaggatcaacatatgcatacttcacgaaggaaaaaaaatatgcacacctgcaaaagcgctattccaatcctgttgcgccacctggaagacgcaaacaactctgttggacagaaaaagaagtagctattttgagggatgggatggcaaaattctctccacataataatggtaaaataccatggacccagatactgcaatatggccgtcgtgtgtttcacaagacgcgcctgccatgtgatttgagggtcaagtggaggaacatggagaggaagaagtgggcaggcntactgatgctggcaatcttacacagacacacacacacacacacacacaactgttgtgtgtcatactgaattactaaccacaccttcatttgtttgtgtccatctgcagatctgatgccgtcgacatggaacactgatgtggtactagaacatagcggaacactgatatggtactaatagcgaatggaggagggtttcttctaaaatagtattttgatgcacagggtgggcatccttttgtgactggttgtgtcaacctagacctactatgcccgtgagagagattgctaaagagtcaactttcttttggaactgaaccctgcactctagatgatgataacatccggtagctgtgtttcttaaggcaactgtgtgtgtttcatccggcagctgccagtgcctcgcccaatgttctcgaatgaggtaggcgtcgtatgctctaaacacatnncacgaataatnnttcttccagcgtgttttcttcttcttcatctttttagtgaacgcaaccttgtaagtcacgttgcagaagctataaaaacagttagtgaaacctttaaccgtagaaaaaaaaaaaaaaaaaaaaaa

SEQ ID NO: 22677 - DNA, 3885 bp, Zea mays
ggtacgaaacccggccgccgaaggagatgaccgaacccctctccaatggcgccgtctaccagtcggtgcctgagtcctacgtgctcccggagcaccagaggcctaggagctcgccgccgtcttccgcggcggcgatacctgtagttgacctcggcggcgatgatcccgacaggacggcggaacagatcgtcgccgcggggaaagagttcggtttctttcaggtgagaaaatttcggttgctcgtcctcactcgtcagtcctgttcgttcctgcatgctgctcagaagcttgtgaaccaagaagaaacgaaaccttgggtgacaggtgatcaaccacggcgtggcggaggacgtgatggcctccatgatgagcgccgcggaggagttcttcaggctcccgacggacgagaagatggcgcactactccaccgacagcacgaagctgccgcggttccacacgagcgtcgggaaggagcaggagaaggtgctgtactggagagattgcctgaagatcggctgctacccgttcgaagagttcaggcaccggtggcccgagaagccggccgggctcggcgccgcgctggaggcgtacacggcagcggtgaggagcgtggcgctgcgcgtgctgcggctggccgcgtcggggctggggctcgaggacgaggcgcacttcgagggcggggagctgaccgcggggcccggtggtgatgaacgtgaaccactacgtggcgtgcccggatccgagcctgacgctgggcatcgcgccgcactgcgaccccaacgtggtcaccgtcctcatggacaacggcgtccgcggcctgcaggcgcggcggcggcgcggcgaaggcgaaggcgaaggcgaaggcggagggtgggtcgacgtggaccccccgcccggcgcgctcgtcgtcaacttcgggcaccagatggaagcggtcaccaacgggcgcgtgcgcgccggcgagcaccgcgcggtgaccagcgcccgcgccgcgcgcacgtcgctcgccgcgttcgtcatgcccgccatgggctacgtcgtgtcgccggcgcccggggtggtggcggagggagaggcgctcctgttccggtcctacacgtaccaggagttcgtcagcgtgtacaccgcggcaaccggcgacagggacgccgtcctggcgcggtttcggaacaacaatggctgactgacgctcgtcgccggccgccttctctttacctcaagaaggaactccttgctgattgtttttgtcaaaaaagaaaaacagcaagaattgcatattccgtgtcaactgtaatttgtcgttatcttgggtgcggtgcaacgtttttccaacgacgacgtattcctctcggttttactttttagccatgttttcaaacaatttgatcatgcccttaactacatggactatgattgttgattaagagcatgttagatagacaagatttttatagtccttaaggacccgttcggagacatggaacggaggaccggaattgttcttatccagattgcttctctaatttgtataattttggctcaataggaataattctgggtgcattccggtagaaacgaacagaccctaaagggaacagttgtactttgggggccggcccaaaacacgaaaaaaaacttagtccaactacgataaggttgaaatatttcagtgtcgagctgatatattaggtcgtgtctgaaccgtgtttatggacggatataggcatgacctatttaatacagacacaactcatgtacatgcacgtaaaggtgcatactcgataattttaaaacacgagtttcgtatatcgcgtgccacgcgcgaaacgagtataatatatttgttttctccccgcgtctcacctaataaaataggtcattacctatcagatgggcaataagaaaacacctaaatccaatatgacacgaaaccgcatcacgatgctcctggatagtaccagctcgctagttgaagaagaacgagtgatcacgagctataaaaaaaggaataaattttctttttaactcatatatttcttgatcttttgactaagatagagtgtactaactatagtttaatatctggtatatgagatatatgcccactttaattttagggtttattttgtagaaggggtctattttagttttaactttttttagaggatccatcacactgacttggcattggactcttgggtgtcatacaaatgttgcactatatcatgattggtgtgtctgtcacaacacacgggtattatactagtattcattaaaatcacactttgtttatacttccatgtacttgataaagaacaaaattgcagttaatgctagttaaatgtttttttgcaactttggattaaaagatgtgatataattttacttttgttataaacattagacaacaaactaaacttatgaactctatgtagatctggttatactcttttctcttatgtaaaaatgtttttaacaagaagtcatcgcacatctctagtaacttaatagaaatattaatttttttgtcaaatttgtttatctcatcttttgttaatttttttattaaacctctatttaaagttggactatgatataaattttgggctagaaattgaaatttgatatatttataattttggatcgctcaaaataagctacatagttaatcaattacgtgtcaggcctttggccggtccgacacatcttataataacaacagatcatgtcgatcgatcgaaattcaaatttgctggactttttcgaacttggaccgtattgggtcgaatggcccaaatgcacacttagaacttctaggcaatagccgcaacgttaatcgccatggagacaaaacacgccagacgtctcaggaagaaatgaaggaagaagaagaagaagcagcaaacaactgatgttgtctgtctctgtctcctccgtctcggatttgtctatatgagaggtgacccagacctagcaagcacgccaacgccattgcagtcatggtctgccgtatatatctgcaattgcagtgcaggcaacgcaacaggaaaaagggaaacgtccgacgaccttattatttccgatgatcacctaggaaatagtcagacgttctcttatctccgacgacctccagcagtcgtccgatgtctaggttatctccgacagctagactaacaaccatcggaagtctatgttatcactaacggctcctagagctgatgtcggggattacagatttcaaggtaacggcgccaacgtcgttttgattttcgatttctctcactctcgcagcgctctctctctccctgtcgttgcctcgccgccgtgcctactacctcgccgacgtgcccgctgcctcgccaccacgccaccacgctcgccgaggccgccgctggccaccatcgctctgcgccatttgcaaagccccgacgtctgcctcagcctcgtccggctccccacgtctgctgtcgtccgcctactccaattgtcctcgtccgcgccaacctcgcccgtgtccggtgtctcctgcgctactcgtgcctccaccgaccgttcctggcactcctcgccaacgatatagccacaaccaccactaagtcagtatctttttcttagaattttatgtattcatgtgttgactgattagtttgttatatctgatggccaaaatttgattatccaattaaattagcgtgttttagtttatttaggtgtgtgtagataatttaaatttttaattttcgagggtaattattgtgccctcggaaataaggtcatttatatgatttgtcactcataacaatgttatttcatatataatattgtattggtggtttattagttgaattatgtaataatgtacgatgattttagtattattcgtaa

SEQ ID NO: 22678 - DNA, 1216 bp, Zea mays
aaatcttttttttttttgttgttttgttcttcccggaagataaatgttaaggggacacaaaccatatttcagagataaaatctgcagaactattctacagtttataacttattgctctccagtaattccataatatcaacagtataatctcccccaacaagatccacaacattgagagataaaaaccggtacaaaaagatcggatgaattctattgaatgctcaaagatacaaaaattggatatcaacaatagaactccaactgcaataagactacttatgggcatatagataagatcataactcttcaagtgaccttacaaagttaagctctcaggatcctcaataatctttgcaaaagtttgtagaaatgctgccaaatcagcaccgtatacaatcctgtgatcagcagtgacattgaccagcattttgctcttgacgctaaagaaaccatctttatcagccacaactgtaggtttcgaggctccaacagccataatagctccctggccaggtggaaggattgcatcaaaccgatctacaccaaacatacccaagttggacagtgtaaaagtcccagagttgtaatcatttggttggagctgttttgcacgtgctttcttgactaggtccttccaattttgcgagagcaaataaatatccagcttgtctgcatcctgaaggacaggtgtaataaggccaccatcaattgccacagccactgcaatgttgatattactgttgtatgtgaagctctttccatccctgcaggtactattgacaacagggtgctgtgcaagagccatggctgcagccttcgccaacagcactgtcattgtcactccctttggcttaaccttttcgtacagctcatcgagcttatcggttacaatggggtacccaacgcggaatgctggcactgccaggctctccaccatgttcttgctcactgcagccctggtgctgaatggaacaacagtcgcgccaggaaccggcggcagcactgctgcctgaggcacagcaccaactgaaggcgcggccacaggtggtggcgcagcagcagcagcaggagtgggctctgacctcgcgcttgattccggcagccgcctcaagggcgtgccggcgtaattagaccgtcgcgccccccgccagtaatcttggcaaggtcctacctataaaacttagccagcttcttagcgtgcgggctggtaatgccg

SEQ ID NO: 22679 - DNA, 1429 bp, Zea mays
  misc_feature (63)..(63): n is a, c, g, or t
ttcgaaacagcctctccatattacagggagaaggcttgtctcagtttatcccttttcacaaanccctacttatctagtagcctttggcactgggtctaccctttttatcgttttttttttttttttctcctcaacaatgagagatacaaaccagtacaaaaagatcagataaatcatgccgaatgttcaaagatacaaaaactggagatcaacaacagaactccaactgcaaccagactatttatgggcatatagataagatcataactcttcaagagatctcacaaagttaagctctcaggatcctcaataacctttgcaaaagtttgtaggaatgctgccaaatcagccccatatacaatcctgtgatcagcagtgacattgaccagcattttgttcttgacgctaaagaaaccatctttatcagccacaactgtaggtttcgaggctccaacagccataatagctccctggccaggtggaaggattgcatcaaaccgatctacaccaaacatacccaggttggacagtgtaaaagtcccagagctgtactcatttggttggagctgttttgctcgtgctttcttcactagatccttccaattttgcgagagcaaatatatatccagcttgtcagcatcctgaaggacaggtgtaataaggccaccatcaattgccacagccactgcaatgttgatgttactgttgtatgtgaagctctttccatccctgcagctagcattgacaacagggtgctgtgcaagagccatggctgcagccttcgccagcagcactgtcattgtcactccctttggcttaaccttttcatacagctcgtcgagtttatcagtaataatggggtacccaacgcggaatgctggcactgccagactctccaccatgttcttgctcactgcagcctgcatggtagtgaatggaacaacagtcgcgccaggaaccggtggtagaactgccgactgaggcaccgcacccactgaaggtgcagccacaggtggtggcgcagcagcagcaggagcgggctttgacttcggctggattccggcagccgcctcgacatctgccgacgtaattcgaccatacggcccggtgccagtcaccttggcaaggtccaccctgtgctgcttagccagcttcttagcgtgcgggctggcaatgcccttcgtacccacggccaccggcgtgggagcagtggccggagcagaaggagggggcggcgtcgctgcggcatcctccgtcggagcaggaggcgcctgctgcggctgcccgttggagagctcctgagccttggcgagagcgagcggcacctcctcctctgactccgcgagcagcgcgatgggcgcgcccaccggcgccgactcgccagcctggacgaggaccgccgccacgatgccgtcgggaaggtctcagg

SEQ ID NO: 22680 - DNA, 2061 bp, Zea mays
ctgcaggggcaccgacgcacgcaccgtgcccatcacggactcacggtgggggaggctgctagtgccactggctgtcctgagtcgagtcctgtgacgccacgaagcgaaccaaacagcaacagttgacccgagccaccggcagataactatcggcgaacaaacaaggcagaagaaaggaggatatcagaagacggttgtaattgcaagaagctgcacgaatcaaaagagagttgctggagtaaaatcggcgcccatgccagcagaagcggcgaaacttccacccccaccttcccctcctgctgcgtgtgtatacatatttactcgccccggctggctcccaccacctcactccattcctgacggcggtttgaccttctgaccggagggagagagagagagagagagagaggagaatcatagctgctgcgttcgatttgcggagggctggaggggacgcgagacgggacaggacggatcttcgacggagcgttgcccgattcgtcgcagttcccggacaagggaggaaaggcgtgggaagagggaggacgcgcgttggtctccgatccaagagctttgttaacaccagagattaaaagatagcgccgtagcgcaatgaaggcaccatcgctactggttcggtgtttccctggcttgcttcccagcaaggacactagttgtgtgccaattgtgtccgagaaggatctgcagctaccatcactagccgttgaaataattccctcaaagagtgctcacccgtacaaatatgctggagagaaggttgatgtgcaaggttttgatattttcaagggtaaagttagtgtagcagatatgatatccttctcaccttctgaagtagcatcatcaaaatatgatggaactctgaaaagctgggagaattctattactcttgtcaacattattcgaaatgagatccgtgatggccagctgagcttcaggggcaagcgggttctagagcttggatgtggatctggcgtctccgggattttttcatgcttgaagggtgcatccacggttcactttcaggacatgaacgcagaaaccatacggtgcagaacaatacccaatgttcttgcaaacctcgagcaggctcgggacaggcagagcagaccatcagaagagagccccgtgacgccatcccggcagctcttggatccaaacgtgcatttctatgccggagagtgggatgaactcccgacagttctctcggctgtgccgccacccgcggcgccagcagacctcagcttctccgaagacgatttcatggatggcggcagcagtagtcatgatggaagcagtgtagtcgtcggccaggactactgccccagaagatctaggaagctctccggtagccgccgcgcgtgggagagggctaataacgagaccgaccaggcagatggcggctacgatgtgattttggtctccgatgtcccctacgcagctaactctctgaagaagctccatgcgcttatttcaaagtgcctacgccctccgtacggagtcatgtactacgtggcatcgaagaagagctcggttgggtccaacggtggcgccaggcagctccgagctctgatggaagagggaggcgtccttggcggccacttgttgaccgaggtgtgtgacagggagatatggaagttcttcttcaagtgagcagatccagggactgggagtgggaacggcaggggaaatggatccttcctgacgttgaaatgaaacccagttttttttttggtttctatctgcagcgatgtacatacataccgcgaggcgtatagtacgtagttccattaattctttggcagcagcagcagcaacgttgaagcttcaagaatcaaatacctgtagctgagcttgcacgaatccttcgccgcctttgtagagatctgtctgctatgtgctgtgctagtgtcgttctgttaaagtacagagagcaaattgtagtgacctttttgtgtatatcgaatacacggtgatggcaattcggccggtgcatggtatgtgtgagaaactcgcgcacaatttctacatgcatctttctac

SEQ ID NO: 22681 - DNA, 3544 bp, Zea mays
ggatcccccacgacaatctggatgcatgcataatgatagtgcctagtgttagacttttcaagtttgacatttatctattaaatggcatttctaaattggcactgacgaactaacctacagtagtcatatacccccccccccctctggtcataaaacaacatgtcgtttaggacaagatttagtcaaacttaaaaactacaaatattgttacttttaatttatttagtctgaaaacatgcaaacatatatctataagtgtattgaaaaaattgcttgcaaaatcttattaatgtgaaaaacttttaataatatattctaaagaaaatagtggtcaaagatatgcatcgaagaccatgcaaagtcaaatgggacaagtgtatttttgatcggagagaatagtttcttatattttgtcaatatttagccttggattttcactatgggtattttttaacttttatatgatcacttcatggtttaattattgttgttgttgttgttattgttgttattgatgcagcttggatgtggatatggcctctctgggatttttgcctgcttgaaggtgtgttcatctttccactactcacgaatcatgataatgttgaattagtaaagggaatatgcttacttcatggtaggagctgaaagtaggggggggtttcttgcatgacgagcagtgatctgacttgcttaaatgctacttgcagggtgcatccacagttcactttcaggacataaatgcagaaacgatacggtgcagaacaatacccaatgttcttgcaaatcttgagcaggctcaggaccgacagaacagaccatcagagagccctgttacaccatctaggcagctcttggctcctaatgtacatttctatgctggagagtgggatgaactcccaacaattctctcagttgtgcagccacctgcagcaccaacaaacctcagcttctctgaggatgattttatggatggctgcagtagccatgatggaagcagtgtagttggtcatgactactgccccaggagatctaggaagctttctggtagccgtgcatgggagagagctagtgagaccgaccaggcagatagtggctatgatgtgatcttgatttctgatgtcccctacgcagctaactctctgaagaagctctatgcgcttatttcaaaggtcagtttgacaataattcaacttacagttttgccatatcagcatcttttgaatttaattgggtacttccattgatcagaaccattgctagagtgtctttgtccttgattgctgatattattttaacagttgcagtgtttctctggttcctctgagatgtcgacttcggttcttttgtctaaccgtatataactcttgcagtgcctacgtcctccttatggagtcctgtacgtggcttccaagaagaacttggttggttccaatggtggcgccaggcagcttcgagctctcatggaagaggaaggtgtccttggtggccacttcttgactgaggtgtgtgacagggagatatggaagttctttttcaagtgagcaaatataggaagtgggaagagaaggaaatgagttctgacgttgaaacccagtttttatggtttctatctgcagcgatgtacataccgcgaggcatagttccattaattctttggtagtaggttgaaacttcaagaaatatctgcagttgagcttgcacaagtgttggagtcctttaccgctttgtagatctgctatgtgctaatgtcgctctattaagtacagaaagcaaattgtggtaacgttttatatatcgaatatatggtgatggcacttaagccggtgcatggtatgagataattcaactcttttacacgcctatatgcagccttgtagatgtacgctgtgttggagtggctatatgtggctctataaaaaaacgcagatttgacttagtcggtggcaagacatggaattttttttaaaaaaaaacatttgggcactatttttactatcatgaattccaaacgatctccgatccaaatcctcaaggcccttttggatcttttgaattaaatttcattctaataattataaattagtcatatctctactatataagaagctaacgatgtcgtccacagttacaccactcccctgttcggacatcgtgcaagccctcgctgctcgcccctcctcgcccacgtcgtgcccccgtcgatccatcgtttgtgtccccccttcctccctgcgcctccctctcaccctctatcgcctaaaaaccctagtccgtgcccagccactaccgtcgactgcgcgtggtcgctggccgcgtgcgtcgacccaactgatggcacgacctccctcaccttcgccgctaacctgatccatggaaggcgaaagatcccctgattacccctctccctcccaccttcctcggctccaccctccctcgactggccgctctactgcaccgccgccaccgccacaaccaccatgcggaggcggatccacgtcgtctaggtcgacgtcccgttgctggagacttggcgcaggcccatcaactaacacgccaccgtcctcgcaccgcatgaggtgctcacgatgcgggagctcgacgttgccaaaatcgtagctacgggggatgactggacacgatgccccccacacccaacaccatgccaacgtcgccctcggcccggtcggcgcagcgtggcgggccgccttcgcacttgaggaccccgcggaggcggaggaatagcgtggacgtgccgcggtggctgttgtcgtgtgcgttggtgaggcgcgacgaggacggtatcttcgactggcacccaggaacgacgacaacatgtggagccaaatggaaggaggaggatatggtgaagacgttgtggccgtcggtgtggctcactgaggacttccccctgagcgtcgatgaattccttccgttgcctggcgaaccgcgtgcgcgtcgtgcgtcggctccgcgtgctgctcaccaccaagttcccaccggggactttcccagtaaaggtaacatagctctcctgctcaataagaaaccacaaaattgcatatatttctccatttccaaattcagtggctgatcaattctgcgatgattcatccttcttgataaacgaattgtttcgatacattcgtgtaacggtcaactaccagttcaaatgatgttctagtgctaaacagaccatctctgagcagggagttcttgtctgttgatcaagttgttttatggcaactgattcttttatcgacaacaaataacccacagtttacttgccacaactacaacaacataggaagctgagtcagaaactcagaatcatggcatatactggcctgcaacttgtggagagtcctatccgaatattcggggaaagaaaagagaactgtttagactgatagtttaacagttcttcactatttagtttattccagaatagtaccggcacttaggacacatatttaagggaatttacttagctggcactcacctcacgtgcattgatattgtcttgtttgataaatcatagtga

SEQ ID NO: 22682 - DNA, 1735 bp, Zea mays
aagaaaaaaaatccgacgcttgtcacaggataggagtgagtaaaaatcaatgaccatagcagcagaagcggcgaaacttccaccccaccttcacctccttgcttatatatactcgccccgccgccccggggccggctcccacctcgctccagtctagacggcggtttgactttccgaccggggaatcggcgctgcgtttgatttgaggaggcgacacgagacgggacgggagggatctcttcgctggagcgttgcccgattcgtcgcggttctcggacaagggagggagggcacacctcgggctccgatcgaagagctttgttaacattagagattaaaaggtagcgccgtagcaaaatgaaggcaccatcactactggttcagtgtttccctggcttgcttcccagcaaggccactagttgcgtgccaattgtatctgagaaggatctgcagctaccatcaccagctgttgaaataatcccctcaaagagtgttcatccatacaaatatgctggagagaaggttgatgtgcaaggtcttaatattttcaagggtaaagtcagtgtagcagatatgatagttatctcgccttctgaagtagcatcatcaaaatatgatggaactctgaaatactgggagagttccattacccttgtcgacattcttaaaaatgagatccgtgatgggcagttgagcttcaggggcaagcgggttctagagcttggatgtggatatggcctctctgggatttttgcctgcttgaagggtgcatccacagttcactttcaggacataaatgcagaaacgatacggtgcagaacaatacccaatgttcttgcaaatcttgagcaggctcaggaccgacagaacagaccatcagagagccctgttacaccatctaggcagctcttggctcctaatgtacatttctatgctggagagtgggatgaactcccaacaattctctcagttgtgcagccacctgcagcaccaacaaacctcagcttctctgaggatgattttatggatggctgcagtagccatgatggaagcagtgtagttggtcatgactactgccccaggagatctaggaagctttctggtagccgtgcatgggagagagctagtgagaccgaccaggcagatagtggctatgatgtgatcttgatttctgatgtcccctacgcagctaactctctgaagaagctctatgcgcttatttcaaagtgcctacgtcctccttatggagtcctgtacgtggcttccaagaagaacttggttggttccaatggtggcgccaggcagcttcgagctctcatggaagaggaaggtgtccttggtggccacttcttgactgaggtgtgtgacagggagatatggaagttctttttcaagtgagcaaatataggaagtgggaagagaaggaaatgagttctgacgttgaaacccagtttttatggtttctatctgcagcgatgtacataccgcgaggcatagttccattaattctttggtagtaggttgaaacttcaagaaatatctgcagttgagcttgcacaagtgttggagtcctttaccgctttgtagatctgctatgtgctaatgtcgctctattaagtacagaaagcaaattgtggtaacgttttatatatcgaatatatggtgatggcacttaagccggtgcatggtatgagataaaaaaaaaaaaaaaaaaaaaaaaaaaaaaaaaaaaaaa

SEQ ID NO: 22683 - DNA, 696 bp, Zea mays
  misc_feature (30)..(31): n is a, c, g, or t
  misc_feature (72)..(73): n is a, c, g, or t
  misc_feature (94)..(94): n is a, c, g, or t
  misc_feature (97)..(98): n is a, c, g, or t
gtgtgaaattgtaaacggttaaaaattttnnataggaaaaagttattgacttgattttgccaagtttggttnngagcttggatccattagtaanggnntgacagtgttttggaatttgcccttaagcagtggtaacaacgcagagtacgcgggccattaattctttggtagtaggttgaaacttcaagaaatatctgcagttgagcttgcacaagtgttggaatcctttaccgctttgtagatctgctatgtgctaatgtcgctctattaagtacagaaagcaaattgtggtaacgttttatatatcgaatatatggtgatggcacttaagccggtgcatggtaaaaaaaaaaaaaaaaaaaaaaaaaaaaaaaaaaaaaaaaaaaaccaaaaaaaaaaaaaaaaaaaaaaagtactttgcgttgttaccactgtttatgaaacctagtaaaaaatacctaaacatgtacagaaacacgcaatcgactacaccatcaaccacggcaacctgcctcagggcgatcgtgaggtccaactgctaccacaggcagggccacagcgctccctgcggcgccggcggggaccacctctacatgcatgaaattcggcgccgcccaggcggtgctgtccctcatacccaacttaaacaaaattgactggctgtgcgttatcaacaaacgaatgtccttcacctac

SEQ ID NO: 22684 - DNA, 3151 bp, Zea mays
aatccctccctccctcatcgcgttttattattcccgtccttcttcattcggcccttcgccgctgctatatttcgcggccgccttgcctcctaataatagccgccgcggcagtggataccgccaccgccatgggagcgctcgaggaggcccacctcgcggccgccgcgtgcgcgtgcgaggaggaggaggaaagcgactacatcggcctcctcgcaggggaagcggcggcgggcgacgccgtggagccggccgtgcgcgccctgctgctggggctcggtgaggacgaccgccgcgagggcctgctccggacgcccaagcgcgtcgccaaggccttccgcgacggcacccgaggctacaggcaaaaagtaaaagacatagtgcaaggtgctctgtttccagaggttggtgtggataaaaggactggatctgctggtggaactggcgggcaagtagttgttcgagacattgaacttttctcctattgtgagtcatgcttgcttccattcagcatacagtgccatgtcgggtatgttccctcaggtggaagagtggttgggttaagcaagctttctagagtatctgatgtctttgccaagagattgcaaaaccctcaaagactagctaatgaaatctgtggtgcactgcatgctagcattcaacctgctggtgtggctgttgctctgcagtgctggcacattcctttaccagaaaacttggaatgcaagactttggaaggttggattagaacttcacattcatctcgctctggagtctttgaaggtgaaagcagcactttctggagtgacttcttggctcttgttaagcttaggggcatagacgtggaggctaaggaccatactgtttctattccttggtgccctttaaggtctcatgaggttccactctctaacgggctctgcaagaaaaactcaactaatggcatggtttctgctgttacctcgatgctcttatcactcggagaggaccccctcaggaaagagcttttaggcactcctcagcgttatgtgcagtggctgatgaagttcaaagcatgtaatctactagacgtgaagctgaatggttttacacttagtaatgttagcttatatgagaggacaggtggaggcacaactgatcatggagcaatccgatcggagctgcacttgccattttgtgctcaatgtgaacaccatcttctgcccttctacggagtagttcacattgggtactttggcaatggaagcggagaaggcattgatcggtcgcattttcaggcgttggttcatttctacgggtgcaagcttcaggttcaagaaaggatgacaaggcagatagctgaagcggtttattcagtttcgcacaatggggccatggtcgttgttgaggccaaccacatttgcatgatctcaagggggatagagaaaataaggagcaacacggcaacaattgcagttttgggccagtttttggccgacccttctgccaaggcgtgcttcttacagaatgttttggattctgttggttctgcggtatgaatcgtatcgcaagcagcaaagaaaaaaatgtctagttggagtactatccagcaattgaaatttttagcaatctactggtctagcatgattcttctcgggtgcaaatttgtcacctgtgggactgtaccgaggatgtcacaagaaagcaccaaaagggttttggttctctcgtgttgtaccatgtcacttgtaaggcacttcaaataaaaaagaaatagtaatagttacaactgtgccaagaaggatatagtcattcgtacttttagatgttgtcaaaattgccatttgttcttgaaattttagtggagattactctggcttttgttgttgtaccgttgaatttgatgttacgccgatcgagatcagtaaaaaaaaaaaactcagatatctgttcgcttgaccaggcgccaacgaaatgtaattcgttcttgcaagtctggcgatatcatttcagcttctgctgtgggttgatttgattccgcttactgtgtggacatcgtcacttgacatctttcaatggttcactgagttgtcatacgcatgctcttgtcatcccaattttatgtcacgatgttcgaattgaatcctgattcttgcatacagcttcagtagcggtgacgttccagagttgcatttacaaatactttttatttgcgtcaatatggacggtaactacacaattttcggtaccatgctttgtgaactcacggctcacgtatttcggacgttccggattacctagttgaacagtggcagcataaagcaccttatagaatccgtgttcattgatgcagtaggtggtggtccatcggccatctaactttcaaggatatggcttatcaaggagttttgggttttcgagtatagaccatcctaggactcgtgcggtcatctttactaacggttcgcatcgtacaagtatggcttcgataccacttgaaacgccctagtttaaactaccgaagctaaacatgtagggggtgtttatttgaaaagtcataccatttaagatgagacggtgcatcatgagtccattccacaaatttggtggaatgaacttgtttctcacattattactaattattagcttatgagaaataaaatggtgatggatcaattcattctattccacaaaccaaacaagaaagcgacaagacgatggactaccttattcctcaaaccaaacacactagtatttaagcaccagaaagcagttacaagtgaaaatacattacataagtggtgtcacagtcatacacaacttcattttagtatgttcaattataataataatacaaactagaaaaactatagtcgatctgataagcgcgagggtaatctcctcgtgacacatggcggcttctaatacaacgatatcactccaaacttggatagagggcgtgaactactcaaactcatcggacacaaaatcagtatcctctacaacaaatcatcatatattgagtaatgacaactcaacaagtaatgacgtattgaacattgtccatacctaacaggaaccccgacccctgaagggccgagaaaaagaacgacatgtcttgagtccccgtttcgcttgaccccgacccctaaccgtaggaggtcggaatctcgcc

SEQ ID NO: 22685 - DNA, 5601 bp, Zea mays
  misc_feature (882)..(882): n is a, c, g, or t
  misc_feature (1064)..(1064): n is a, c, g, or t
  misc_feature (4990)..(4990): n is a, c, g, or t
tcctcattaaatagagttgttttactatagtacccctaacaaataggtttagatagctttcaaaacaaaagatgatatttgcttagttggattccaatgtaggctgcaagcattcaaatgctaactcgtgtgatcgaatctcatggttccctttttctacgttttttttcttgatcaatggtatacgtcgtgtgtgggaccatctagatcaatggtatactagctcaaaatgagctctaaatgcttagagctcatttaacataaccaaaatattcggttaaccgactagtcggtttcctcttttctaaatacaatttaggttttcattttctaaaaatgaacttttaaaaaaccgaaccataactattcgattaaccgattgctctggattaggagtcgtaggatggtaacggggactcgatctccgattctccacggggtatttctccactagaggatgaagatgtggaagtttttttactattgagatgtagacgaggaaaatttctttccggacgagtaaacagagatgggacacagaagcattctccatccccgtttcctatggggacccgttaaacctacacgtgatgatgtttttttgtaatacttaatgataaaaacaataattatccagacaagagatcacttattatacaaatgtgattattttgatgtgtatataatgatttttgacatttgacaatatgtataagtgataacattttacattaataatgaaagacatacgtcataaaactaattataatttaagtgagacgacgacgatttatcccgtgggaaggaatggaaagctatttatcgacgtaaaattcctcccattgcccgtgggcgtgtggcggcggcgacgacgaatcaaangatcctgatctacctcacacatctcgaggaggccgtccagcgtccaccaactcccgcatctcaccccatcgcttcgtcgctagtacgcagttcggtccacctatctatcgcctccttgtcggccgtcgttatatttcgcggccgatccttgttcagttgttcctttttccccatttgcgccncttcgtcgctgctatattccgcgaccgcctcgcctaataatagtcgccgcgggcagtggataccgcgaccgccaccgtcatgggagcgctcgagggggcccacctcgcggccgtcgcttgcgcgtgtgacgatgacgaggagcaaagcgactgcatccccctgctcgcaggggacgccgcgacggcggccgacgccatggagccggcggtgcgcgcgctcctgctggggctcggcgaggacgaccgccgcgagggactgcgccggacgcccaagcgcgtctccaaggccttccgcgacggcacccgaggtacggcggacccaccgcttccaactctccgttttcccgctcccctcaggccctgacttcgtggatccgccgggtaaccaccgtccccgtgctctgtctttgtgtggaaaatggcgtcttccctgattgacctgccgccgtggagcggtgctcttcagcatacaacagctccgttggtagagaagggaataacaacgccgtgtgtggcatttggacacgtttggttttgttcggatctcacgacgaggggtgcttggtgcttgcgatgaaccatgggataattcccatcatgggagatagaaaactgagtgcagtaacactgcagtttagtgcgggtggtcgttggcatctgtcgtaatcggccgtgccgactactactagattgctcacgtcacgacgcgttcggttccggtatttgacaaatgacaagccacggtttgaaaatagctgtcgaccacctaacgcgatttgaggcaagtacatagaggacctgggctgcttgctagctgcttcactgttattactacgacgagcttgcgtgtactgtccagtccagtgtgagagtgccattcttactgcgaatcttattctggtttctagtccagcttactgcaagctatatcactagcgaatttcatagataaccgttatggctctgatgtatttgcgctttttgtcagatgctacagcacagtcgagggcttttctaatgaagacttaggatactgatgtgtgggaattatttgtggggacttcacttgtatagtcgttgactatttattgtgtacttcacttatgagtaacgacttcatacatgctaacatacactagctcgtccacctgatggccatttagcctcgactgctcagaacacagcgcttctgagttctgacacaaattactaatgtgtttttttaaatttcaagttttaccatccctagctactgtccctttctcgctcttcagtttcactaccttaaccagctactgatcattagagatttttgttagttgattctccccttccccttgttaaggtagtaggcgactataactccttcaggcatttctttatcaatcttcattacactaacttttttttattgtataagagcattcttgatttaaaatgaacctagacatcttgttgtttctggtactacatatttctttgttcatgaactttgaagggttttgctgttttggaattaatgactacctgagaatgggatagaacatcgataaattcactggtgtgtttaaaattgatcttctattttgatcagtcttttaagtatttgaaaatcattttttgctacaagtgaatatttgagagttatctgtagtctgtggaagtatttgaaagaaattcattttacttttttttttcttcgatgtcttctactagacagcggtttttttatccattaccatatgtgctcatctgaaacatgagactttttacttgtgttcttttctagtcctatataatggccattggcagctatattacacttggctttggtattttgattgctgtttgtttctttcaaaataagtaccgcttttgtattcaactataaaaatgttgacctgctaagagcttaactcctctcagtagaaattgtaactttgagcaaacaagccaaggctaggattagtgagccgctgcttctttttcaaagttgtacatgactggaaattaacatatccaggcttttcaattacatttctgttgcaagttttagctgctaagaaggtgtgtctatccgatactatgaaacttatagattgagtggaattgaacaatttgatcaaccagaaaatattctccaatgtttaaactcactttggagctgatagatcctgcatttgttggggcaataaatctttcttctgttctttagcattattcacatggtactatgggagtaatatgcatgtcagtcctctattcaacaacttgtgctaatttcgtctgaaatgttcaagtttattctgtggtgaattgctgacatgggaccacatcattcttgttctactaaaaaaagtcacgtgaaatctggataatctcttcccatgcaagtcatgtgcggtagagtttgtcatggtgttcttattgaaggagacataactatttatacaacaaatagtgacatgtgaagatgtgtttcctgtattatattcttttttgcataaccttttgttttaatgaagatatttcctttaattgcttcatggtatgtatttaacatatatctaaatctacaggttacaggcaaaaagtgaaggacatagtgcggggtgctctgtttccagaggttggtgtggacaaaaggactgggtctgctggtggaactggcgggcaagtagttgtccgagacattgaacttttctcatactgcgagtcatgcttgcttccattcagcatacagtgccatgttgggtatgttccctcgggtggaagggtggttgggttaagcaagctttctagagtgtctgatgtctttgccaagagattgcaaaaccctcaaagactagccaatgaagtctgtggtgcactgcatgctagcattcagccagccggtgtggctgttgctctgcagtgctggcacattcctttgccagaaaacctggaatgcaagaccttgcaaggttggataagaacttcacgttcatgtcggtctggactatttgagggtgaaagcagcactttctggagtgacttcttggctcttcttaagcttaggggcatagacatggaggctgggactggggaccgttctgtctctgttccttggtgccccttaaggtctcatgaggttccactctctagtgggctctgcaagaaaagctcaaccaatggcatggtttccgcagttgcctcaatgctcttatcactcggagaggaccccctcaggaaagagcttctaggcacacctcagcgttacgtgcagtggctgatgaagttcagagcacgcaatctactagacgtgaagctgaatggcttcacacttggtaacgctagcctacatgagaggccaggcggaggcacagctgaccatggacatggatcaatccgaaccgagctgcacttgccattttgtgcgcagtgtgagcaccatcttctgcccttctacggagtagttcacattgggtacttggacaaaggaagtggagaaggcatcatcgaccggtcgcattttcaggcactggttcgtttctatggctgcaagcttcaggtgcaagaaaggatgacgaggcagatagccgaagcagttcattcggtttcacgcaacggggccatggtcgttgtcgaggccagccacatgtgcatgatctcaaggggggtagagaaaataaggagcaacacggcgacagttgcggtcttgggccactttttgaccgacccttctgccaaggcacgcttcctgcagaatgttctgcgtacagctggttctgcggtttgaatcgtatgacttagcaaaggaagggaaaaaaaaatgtgtacgattactctccagcaatggcatttttttttgcggatcttctggtctaatacgattaccactgaaaatgtccgtagctcatcgcctcttcttcttgactgcaaatctntcacctgggtgactgtaccgaggatgtcacaagaaaacaccgaaagttttttttggttctcttgtgttgtaccatgtcacttgtacaccgtttcaaataaaaaaaaagaaaaaaaaagaatagtacgtaatagttacagccgtgccaagaaggaaatagttattcgtacgttagatttcttgtcagattgtcagttgttctcgagatttgtagtggaggttactctggattttgttgtaagtttgagttttgatgatgcaccgatagagatcagtgaaggaaactacgcagatatatgtgttccattgacaattgaaactgcaatgtgatggacgggactaggctacgcagtacgcactggcatcggcatagcacacacgccaaactcgccttcactacctgtgtggcaaatggaaaacgttggagctcccatcccacttgacttgaggcggtcgtcacaggaaccacgtgcagctgcaggcacacaccactctgcgactgcgagcctcgctcagcaaggcacgggaggaaacgggaaaggtaaagagcccagcccccgtgcacaccacacgcagctatagcgaaaccgggcggccgcggcccacaggttt

SEQ ID NO: 22686 - DNA, 1564 bp, Zea mays
gaccctcttttttttttttttttttccagcggaagatttctacgctcgccatgaaacttattttcagactatcaataagaaagctcagttctttctatctgaggctaaatgcagcagatgctaaccacggtttacaagaaactcaatcataaataaattagctaacaaatcaaatgaggtgcaactggcaacaacaaccgatcaagcggacgaagggagctgcgcaggatttacaccgatggagggttcgactccttggatttctcatcagaagacgcgcggctctccgaggtggactggcggagcccctcaatcatcctgatcacctcctccatcgtcgggcgccggcctggcgacttggccgtgcacaccatggctatctgcagcatttgtaccagctcctcctcgatgttctggtgcttcatcagctccacgtcaaacacctcggccgtccactcctcccggaccaccgagtgcacccatctcggcaggtcgacgacgtcgtcgttcccctgcgtctggagcggggccttccctgtgagcatctccatgaggaggacgccgaagctgtagacgtcggatttctgggtgatcttgcggttctcgactatctctggagcacggtaaccgaccacgacgcgagatgcgttgaccggcacactcgtcagagcgctgaggccatagtccgagacggaaggattgtgatcttggtctacgagtacgttggttgacttgacattgccatgggtgagcttcgcgcccccttctgaatgtatatgtgcaattccatatgctgttccaaggatgatcttcattctggagttccaatctaacggggtctccgcggtaacgccccggatacctgttgatcaagcaatccagcaagaaacactcattaacaaaacaaatggatatctcagttatctagcacaagttgcactctgtagaatgagcgtgtcaagctatgttaaagcaatgcaagtgcagcttcagccttccgcagcaagtagaagatatacatatgaaggtgagttttcttcccaaccatattgaagaaaagaagcaactaatatctagtcagtgacatacgcagctctcctgtgtttttggaaaaaaaaattgatgttaaactgagagaaacataataaaatggcagagatacagcaagctacgtgattcaagctggcactttaggaatgctggcctgttgttagtaaaaatgggtatcgatcaatcacatcagtaatgattttgaaaaatatcacatcagcaatatgtctgtagcagtgaaaaatcataccatgcaacatggccgaaacacttccagtgtcaatataatcatagacgatgagcttctcgtctttggaatagtagtaggcgcgtagtgggagtaggtttgcatgtttgcccaacctctcgatgagctccatctgctgctcaaactctcttttccctgccacaacatcttttaatctcttcactaccacgacagtaccatcttcgagtacagctttgtaagcagttccataactacccttgccaaggacttctgcaggcatgcaag

SEQ ID NO: 22687 - DNA, 3796 bp, Zea mays
caaagatcccaccagcagtggaacgacggagcgagcgagctggactccaagtctccaagccgcgttagacgtctgtcgtttgggccccatggtgtcagttgctcagagagagagaaaaaaaagggcgagctgatgtgttggagtggactgggacgaccgagagggaaaatcggccaagcgccatttgtttcacttttcttttcctattttgttttctatttcagatttttcctttttctgttattttctgttttcttttcttttatatttttttgaatttcaaattcgaatctaaatcctgttgtgaattttgtacttagactaaatggacaaatcacaaatgccagtataaaaaggtgtatttatttatatattcttcttcatattttatataggacatttccttttctaaaatggttcttggttttttttccaaagctaagttctcaatttgcaactctcaagtataatttgagatatcagaatttactagttcattccttcatgtatttatttaaaaaaaattatacagattttgggtattacactttgagtagcaggaacgtcgtatgcataatacattactaggtatatgcctgtgcgttgcaacggagacatataatacataagttaccgtgatattatatgtccccgttgcaacgcatgtgcactcacctagttagtcaataaactttagtgactaaattttagttcctaaaaacatatttagaagatctattttagttattttatttagtattttagagactataagtgactaaactttaatctatcaaacgtcatagctgcaaattcgtcgcgaagaggcgtagatttttctgtcatgacggatattcggtaggaaaatttcgttcattttgccaagcatattccaattttctaccagtccttttcctgggtgacattaaaaagtttataactcctaacgtactactaaaaaaaagctaagttgtcatcagaaacgtaggaaattgtaaactcttggtaaattgccgaacatcattctacgtcgataggatcataggaacgggaattttcgcttggacgaaatttccggagagccaactgtatcagtagactgccgagtcaacctcgtcaacgctactgccgaatcttcctgccctactaggcccccaagcccccatcagatttcgttttgtgcatttatgcacggcgtgacccttgtgcactggatacgatccccccaaccaaaccgcatccgcgaaccgacgatccacatctacaggccacagcacagacggagagcggagcagagctggcatggcggccgcgccgtcgcacccgttcgtctacatcgacgcggcggctctccactcgctgctccccttcgcgtcgctgatcccacacctccgcgcgggcctcgcccatccggagctctccgccggcatccagtgcccgcagcgcgtctccatcccgctccccacggcgccgtccgccgcgctcctcctcatgccctcctggtgcgcgcacccgtcgctgccctacctcgcgcttaaggccgtcacctcgttcccgtccaactcgccgcgcctcccgtccgtccacgccgccgtctccctcttcagcgccgccacgggcgcgccgctcgcgtccatcgacggctccgcgctcacgctgctccgcacggccgccgtctcggcactcgccgcctcgctcctcgcctccccgtcccgcccgccctcggtcctcgcgctcgcgggggccggcgcgctcgcgccctacctcgcggaggcgcacctcgcggcgctcccctccgtctcccgggtcctcgtctggaaccgcaccagggccaagtccgcggcgctcgtcgccaagctccgcgaatcgcacccgggcctcaccgtcgaggaggtgggcagcatggacgaggccgtcgccgcggcggacgtcgttagctgcgccacggggtcgcgggagcccatcgtgcgcggggagctgctgcgccccggcgcgcacctggacctggtggggtcgttcacgccggcgatgcgggagtgcgacgacgacgcgctgcgccgcgggcgggtgttcatcgactttgaggcggcgatggaggaggccggggaattggtgggtgcggtccagcgaggcgtgcttcggagggaggacgtggccgggacgctgtcggagctggccgccgggactgtggtgggcccacggagagacgacgagatcaccgtgtttaagtccgttggcaccgccgtggtggatctcttggcggcgcagctggcctacgagactcaccttgccgcaaccaaggatgcttgagctccaccctccaccagcttctagatgatgcggtgtttctttttcttgtccaatcctccgacgagttacaacagaaataaatggatcagctcaatccttatgcattaataatagattccagtgatagtgtacgtactccacatttgttacttgttagtatatatttgtttatgcaaaaaaaaaaaaaaaagctagcaaggtgaaccgtaagtgttcacggttaaatggagctccattgctggaatatttgtgttcttttcatgccggagaagaactctcttgatttttagagcttgtttgggacgtagtttttccaaaggagcttcaaaggattgaaaatcctgatgtcatataccggatttcaaggaaggattgaagcttgccgtcctgttggaaaggtttcattcactcaaaaaacacaggatttttacatccactcgtatccaaagtttttgagtgtttgacaggaaagtttttttgaaactatatggtattataataccatggtatacaactggttacactattcatatatggttttccatcagctcactaaaactaaagtattctataaatctagcacatgtttggttctaaagtatttgttgactaccaatattaataagttgcagcaaccgtagccctaaaaaataccacatgagtaaatatcaccaatatatatacagtaacaatcagaacccaacacacaaaaaaaataccacaggagcaacaaacacacacacatatataggaattgtgccctgttcagcactagaattataccaaatcatcaatacgagaattgcagtacaattaacacaagaatatagtgacagataaaaatggtcattacatggattgaatgaaagaagataccaacaccttcttaaagtacatgagtctatgtatgcggtctgcagctatagctcaaaggcgtgcagaccatagttcaaaataggataagcttgttaaaggagcctagtcataatagcagcctagccacgagttcctatgatctggcaacaaaggaaatatagcagtcaatactttggtaactacaactatggtaattaggtgttagatgagatcttaatatgtctaaagtttaatactgaaacaggtagtatctagcactaatgtggctgtagtttagtggtgagaattccacgttgtggccgtggagacctgggctcgaatcccagcagccacactttttcttaatttttatgtactcgcttagaaaattttcccttgccccatgcgaatcccagcagccacactttttttgttttctatgtactggttagaaaaaattcctagctgattttgcaactttgttttaccgtctcatgctgcctatacaccaaataaacttgtggaataacctagtttagacttgctataataagaacgtaggtagtcagcaagcaaatgaacctcgggagtaaatattgtgttgcatcttgccccatgtggtttgtactct

SEQ ID NO: 22688 - DNA, 2502 bp, Zea mays
tgcagcggcggtgacggcaacgatccagtttcttcctattattggcttgttcaatatatgttgccaactgtatgcttgtgccaatcaaggagtttgttggggtgatcgttgtcaaatggtctgatggccccagcggccttttttggttttgcaatcgagcaggctaacaatttcaattttccagcggaagaattctacgctcgccatgaaacagagtttcagactatcaataagaaagctcagttctttctatctgaggctaaatgcagcagatgctaaccacggtttacaagaaactcaatcataaataaattagctaacaaatcaaatgaggtgcaactggcaacaacaaccgatcaagcggacgaagggagctgcgcaggatttacaccgatggagggttcgactccttggatttctcatcagacgacgcgcggctctccgaggtggactggcggagcccctcaatcatcctgatcacctcctccatcgtcgggcgccggtctggcgacttggccgtgcacaccatggctatctgcagcatctgtaccagctcctcctcgatgttctggtgcttcatcagctccacgtcaaacacctcggccgtccactcctcccggaccaccgagtgcacccatctcggcaggtcgacgacgtcgtcgttcccctgggtctggagcggggccttccctgtgagcatctccatgaggaggacgccgaagctgtagacgtcggacttctgggtgatcttgcggttctcgactatctctggagcacggtagccgaccacgacgcgagatgcgttgaccggcacactcgtcagagcgctgaggccatagtccgagacggaaggattgtgatcttggtctacgagtacgttggttgacttgacattgccatgggtgagcttcgcgcccccttctgaatgtatatgtgcaattccatatgctgttccaaggatgaccttcattctggagttccagtctaacggtgtcttcgcggtaacaccccggataccatgcaacatggccgagacacttccagtgtcaatataatcatagacgatgagcttctcgtctttggaatagtagtaggcgcgtagtgggagtaggtttgcatgtttgcccaacctctcgatgagctccatctgctgctcaaactctcttttccctgccacaacatcttttaatctcttcactaccacgacagtaccatcttcgagtacagctttgtaagcagttccataactacccttgccaaggacttctgcagaagccctcagtagatcctccaggtcaaagctataggtgcaaccctccaagaacactaacttattcttctcagcaatttggccgccgctactgaattcttgcttcggcttctcgctcctggtggcagtacccttacctttggattccacatcaatctcgtccttgcctttcctctttgaaaagcacacaaccacgactagcatcagcaatgcaaacccaccaacagcaactgcaactatgaaacccgtgcctagtttcttatcatgatgtgtcaaaggtggagattgaggcgatggagatgattcaggtgagcgtgctggtgaaggatgtgagcattcagctagaggtagcccacacagtccagcattccctgaaaatgaaccctttggaaatttctggagagatcgaggaattgagcctttcagttcattgttgctcagatttaatagtttcagattgtgaagcttgaggtcagggatggatccagagaaagagttatcttgcaaattaagaacggttaactgagtgaggttttgtaaacttgcaggtacttctcctgtgaaggaattgtaggagaaatctattacactgaggttaggactgaaggaagaaggcaaccctcctgaaagttcattgtgctgtaggtatatggaacgtaaagacggaagggaggccacatcagctggaagacttccggtcaatcgattagaccgcaggctcagtacttgaagagaataaagcttgccaagagtgtttggagaaattactccgataagaccagcagccggtaccctcaattcaaaaacttgtgactgatcttctgagcattttacgccatgccatgaacaaactgaggtatgtttgtcccagttgagcttgtttccatgatagactgcagagacaaagtcaagaagggcttgcttctccgaagataagtccgctacaatcaagggactgaacgatgatagcagcaactgtatcgagagcagaacacggaaagatgtcctaaggttgagacaatccatctgatgaattcccccgcccgctcgagggtagcagcatactcaattgcctatatcagtcaaggtaagcaaccctccgccggcgattggcgccggtacagagcggagggcggggcgcagcgggagcccggcgaatgcgcgtgcgggcttagggctcgggcgtcgcgcgcccgtgtcggcaggggcgaggatttgcgctggtgctgttt

SEQ ID NO: 22689 - DNA, 1652 bp, Zea mays
  misc_feature (1144)..(1144): n is a, c, g, or t
  misc_feature (1178)..(1178): n is a, c, g, or t
gtaaatattgtacgaggctaacgcaactgaaatgatcaaaatcggaattaaaatggacaagttatgattttcgaagggtttaagtggctaatataaaacaaatgcggtacaagattttaatcataggtttcatggcaatacaaggttactatatgataaacaatattattatgagtccaatgcacttagaatggataaaaaatgagttagaatcatagagttatggatttcctaagattgggagtttatttgtgcactaaaaattatttctatatttattttaatgaatttcacagccctctggagccgggccacaaatacaggagaacccaaggtcaaaactataaatttcagggctgttttgcattgattcctaaacgtgcaaggacggtgggttaattcctcactactacaggggttctttataaaaaaaccacggcgaaggggtatcgcggtttctggggcgatggagcccacctgacccccccccccccgatctggcgcccgccaaccctgctagtaaccctggccgcccgatctgatcaacgctccagatttaatatggttacgatcacatctcgaccgctaatagctaatcctacggccacggatcaatccacgcgaatagttatatcttggtttaatcctaaccgcccagaacccaatccacggtcgcgagtgcttcttctctcactaaccaggccgacggcggcgctgcacagggacaacacggcggagcatcccggtgagcagtgctccgacacctaggtgccccagctaggctacggatctatgctaaacagagcggagggtaagaagaacttaatggagtgcttcataccggttatggtagcgtctgcagtgttgtccacgccgcgggacggatccacgacatggtcgccaccacggcgagaaattgagcggcttgcggtccaattcccagggtgggaaggttacgagcatcatctgagcaccactgcggtatacctggccaaccgacgaggttgaagcgccacccaaatcatgagtcgaccatggcggatccaatcacccgcggagaatgggtacggcggcgctcactccatcatctctctctctctctgctgggcatggaggtttgccgggctggataaaggaggggganggctctacggatcataaccttaagtagccccgangatggtgttaaggctggaccaaccgcggcagcggcccgagcagcgcatagaacaacgacgcaagctcgcgatagaggaggagaagagagagagggctcgatttgtttatggcctcagccaaggacgggctcggtcagacttaccccaaggttctagcgtggatcacggagaatcagttgcttcggcgcgtccggttgttagctccgtccatggcgcgatatttgcgcgaggaagacgaccgacgcgcacgtaggaggatggccagtggggacccggtgtcagtgcgagcgaacgaatacacgagccgcgagaggaggcagacacgtgggcccaccagcaggtgtcacaaggagggagcaggtgtggcgcgcagatgaagcctggcgtctagggttgggcaggcgcgctagtgagccgagtggcccccgcaggggcgcccgctattgggccgacctgagtgaaatcggcccgcgc

SEQ ID NO: 22690 - DNA, 696 bp, Zea mays
ggggacatagcttggtaaagcttgttgggatccgacgggttgaaccttgtcagtccgtctgcttggtaaaactcaaattgctggtcaattattgtatggttgaacttgttcagctttttattttgtgctacttcctcccaaacacaatgccgatcatagtgattggaaatagcatattcatagccatgccgccagaggaaatactccaggataaggataggatcagtttgtagtctcagtttgctgtctaaccagattgagaacctcgatgatgggaatagcctgtgtgccaaaaactttggtattttccccactctacgcatgtcattataaggcatgttcttaatcaatatgatcttccatatgccaatgaaacccatgctgtccattttctggccttcagattctaaagtgtgcaatgtcacttcatccaaaaacatagcaaagcaaactgtcttctttgagaggcttgtaatcgttttgccaaatggagtcctcagtcgatcagaatttccaaagatgcaggatgatacagcaatgtggcatttactcatgtactttcggtcatcatcagatatatcaaaaccagtacttgtaccatttggacccttaacaaaagcgcatatcaactgttggtcatgggctttgtatgactcctctcttttttgcaggctcggacgctgggcggacgctggg

SEQ ID NO: 22691 - DNA, 3083 bp, Zea mays
tttttttttttccttttatataacaacagagtgatagagataaatgtcacaatataatcagagtacttattacatagcggaagtcttacaaaataaaagatgaatatagcaggatctaaaatctatccttggcgcgagaaagtcaactgggagacaccacctagatcgaatcgaactcctcgatggggctccacttgaaccacatgttcttctcctggcacttgagattccagttaccacttgctcttcaagtgactcgtaacctcgctcgatgatgggaatagcctgtgtgccaaaaactttggtattttccccactctacgcatgtcattataaggcatgttcttaatcaatatgatcttccatatgccaatgaaacccatgctgtccattttctggccttcagattctaaagtgtgcaatgtcacttcatccaaaaacatagcaaagcaaactgtcttctttgagaggcttgtaatcgttttgccaaatggagtcctcagtcgatcagaatttccaaagatgcaggatgatacagcaatgtggcatttactcatgtactttcggtcatcatcagatatatcaaaaccagtgcttgtaccatttggacccttaacaaaagcgcatgtcaactgttggtcatgggctttgtatgactcctctctttcttgcaggctttggtggccggcaaatctcggttcccaatattctgatccaataggtctttcttcaacttctacatactccaacttaaaactagcaaatttctcattcctcccaggctccacaagctgagcagttgagttaagaaacttcatttgacaaattgaaccagacttcttgcgtttcggtttcttcttgggcccatgcttcttgtctccagtacctgaaaccttctttttgtctgggctgctaatatcatgactacccgcaatccctccacctgcttctgtgtgcctctcagtagcgacctcgtccttcttctcagcaccctcatggctgccaccaccaagcttcctcccaccatcagatgaatgcaggtgagcatcctccatttcatcctgtgtatcgatgccatcgtcatactcatcatctggatcaacctccttcacccctgttcctgtggctcccatggctgcagcctcgtactgctccagctccttcctgccaccctcattgtacaaggtcccacctttcccaccttcagacacctctggaacatccttagcatcgctgccggtagtcaaacctttatcctccccacctccctcagaggtggtacctttatcgctgctgccgccagcatcgccggaggtcccacttccacccgagatcttctccttttcgtcctctgtgtagtcctcgtcgcggcgcctatcgtcccggtcccagtacctggagtcccgcgcgctgcggccacctccgccgtgcccgaacttgagctccttccagctcttgctctggttccagtccggcaacgtctccctagcgctcgaatcttggctgatctctacgaaatcacagagacgacaaggcaaccaagcggagaaattttcaaatcaagggcgcaatgggagcttcaaccaaacatgaaactggatcgagaactctcgggcggtaccgaatcgcgcaccagaagagcccagacgcgccaaagatgcgattttttcagtaggatagaaaagcgagaggggaaggccaacgggcccgaggaacccaacctgccgggcggcgcgagatgcggcgcgaaaggaggaagacggcggcgaggagtagagcggcggcgacggcggcagcagcagccggcgagcggcggcgcggcgcaggcttcccggggcggcggatccgtgaggaggacttggcggaggcgtggtggggccggtgccagtccgggagcacctggtgatggtggccgcgggagtcggaaaagccgacgccgtactgctgcctgtactgcgccattagaggcccccgcgccggagttgccggtcgacggccaccagcaccatgaacggagacgaggggggaagggaagcaagggactttcttgtaattccaacgcggattggttggagagggttgattaattgcacgtgatgatggtggggattaggagcggtttggtgagatgggcagacatgcgagccgacatgctcatactgtaaaggcaatgactaatatgcagttactaggtgcaagcgtttatgaatagtttttagtctgttagatttatatccaatgataaatacaattatattttgttagagggttttcttataaaactacattagatggtgatggaaatgtttaattactaaatataacatatcgttagatctaaatctaatggattaaaatatctgcttacaccgagtatctgctatgacaatgctcaattacagatagcattagtttttggcacggagaattttaatttttgctaaataggataccccaatctaattagaatgatatgctttttatttgctaaattaaaattatatataaataaaatcgtattattaatggataattctctacagacaataatgttatctaaccacatgtcttttctcttctatcatttatctattggaattattataggctagacccatttaaatttgataaatcaataaactcatagtaccgaattggaattccaatggacgctgactgacgtatatggtgagaattattctatttaatttgagatattaagaaacaaacaaagacgtgccacacgcgcgagtgtgccgttgtcggccgggcacaagcgtgacgtggcgaggcgaggcaaggttgtgttaatttttagcactcataaaccgcggagtttcaacacaggttaaactttttcagatgcccatcttcttctttctggtagagagacgtctccatcttctacggaatgacgagaaaagttggacaagtatctggatcctcggagcacataggagggtacgatcgattcatctccttatcgttttatattttccagattatatatgtttcatttgttcatctctactgtttcgtatgtagccatgagtatatttcatctgttttgtcatatcatacca

SEQ ID NO: 22692 - DNA, 2430 bp, Zea mays
  misc_feature (1460)..(1460): n is a, c, g, or t
cacgagagcgttcttcgaggtactagcgagttccttgtctaaggtgtccccaaatgccttgagaaggtcgtcgaggctggctagggatacatcttcttcgtcagaaccagtcatctattctggggggaggcagggctagaggggccttcttcttcttcttctctgtctggcatccttggttagtggtcttcttctggatcttctttttgggggcgagtgcctttagcttcttgtcaaagtctatcttcaaggtccgataggcctcacgggtgttggcttcctcgccttccactatgctgagactctcctggagagatgccttctcttgcgtaagctctttgacttgctgctctaggctttccactcgggagtttaggtgggtacaatgggaggagagctcatcgtagtggttgtcgagggtgtggaggtatccgaccatgtagacgatagtgggatcatcttctatgggatctcctcctgacagagcctggagtcttttcttccaggttggggtgtttttgttgctgggtgggaaatatcggaggggagtctcaaagatctctcggctatagttttggcacagttgtttgagggcttttcgagcaacgctctggcatgtgtctgggaagcggtgcccgatgaaggtaatttggaagggagggtggtttgggtagttccggctttctcccaagtagaccgccatagagcacttttccattccattttcacggtactccttccagacatattcgggcttcttgcggatccccaagcgcagcgcgcagcttcgaagaaggtgaggaaagccttcctcctctgagcaataggaagtcctaatcacccaggggttttccatctggtagacgaaaagaaaggtctattaatatcggggaaaaggggaaagagtgtttcttggaggtaagaggtgttttcttgttaaggcaacttttaaggtcagggctgtggtctacggccagtcctataggctttgataccacctgaagcgtcccgatcctttgggactcaaatgtgatacaattactagtcccaggaggctagtaaccacattcattacttcaaatagttacagagtctgaataatgttattacaataccggggatacaagctcgaaagtgagccgaaaaacataaagcgcagtggaaggtaaaatagcccaggccacaggcagaactgggtgaagacacagccccatcaatcaagcatagcagaaaagaagtcttcagctgcctccgtctacgctgaaaagaatcatgtgtcaagatccaagcgaggcataagtctcttcgctcaacctcgacttctcagctcgcttcagccgccttttacgatacctccatgcaacctgaatatcgagttgcagcaatggttcgccagtagggggattcatacctgatcgctccctgcactcgtggattacgcaggaatcgagcaaactgcngaggtgacttcttccagatcacttgctctgagtacaaaagcttcaacatttgttaaacatcttactgtacgtatagcaaccaaccgcataccttggaatttaattttcccaccatctctgttcgctgaagagtgttccaagtaccacgtgaggagctcctctccacatacatctccatcatgtaatggagccttgctgccatctgcactgatgctttccagcttccctctcactatgaagaccatcttttcaacagtaccaccttggtaaagaatgtcacttccactaatatacaagttttgtcttaatttgtcacatattgcatccaatataggccaatccatcaaggtgaataatcggaccttattaaggaatctaaagaagtggcgacgtatgtccctttggatatcttcaggtaaattactcaaaagctcctcttcattcactccttgagtagctgcccaggtgaacctttcggctcgtctaaccctccttctcaaatcttcaggcaatcgcctatggctcatccacttttcaacatcacggcgcctaagttgcatttccaacctccttcttccaagagcttgcagaaaattttgcatgtttccaataagcaatgcaaaaagcaacagtcccagaccaataatagccatcgtgaacagaacttcccatataaagtaactcgggacaaggtttcctgctaaggtacttatttgctgaaacccccaaaataatgaatatatatatcgttttacagcactgtgttctgtagtgagcaaaacagcctgctcataaattccatattggaaagtagcatcatttccagtgttaaaacaagcttctgcacccgagtcattgaaccactgctgtctgtacagtccactcccaatgccacgtccacagtctataaaagaatcacaatatggaatggtcgatatagaacaagcatctcgtagacattggttaaccc

SEQ ID NO: 22693 - DNA, 1970 bp, Zea mays
  misc_feature (27)..(27): n is a, c, g, or t
ggggggggtgtgtttgattgaaaattntgtattcttttataatgaatatttatttacacctggtgacatcccgggtggcgggcaaataacatagctcctagtaatctgaatgcaacgtatatgtgcgtgtagtagctcatgcttttttttttttttcgaaaaaaaaaactttcctcttattatgtacacggaacaccaaagccaaaaatatttgccccgttaggttccaccaagtagacatgttcggagaaatttcacagctctagaagctttagatgctgaactgaaactgaaaagttagtgcctagtcaggtagcgatcaatcatcccctccgtctacgctgaaaagaatcatgtgtcaagatccaagtgaggcataagtctcttcgctcaacctcgacttctcagctcgcttcagccgccttttacgatacctccatgcaacctgaatacgagttgcagcaatggttcgccagtagggggattcatacctgatcgctccctgcactcgtggattacgcaggaatcgagcaaactgcgaggtgacttcttccagatcacttgctctgagtacaaaagcttcaacatttgttaaacatcttactgtacgtatagcaaccaaccgcataccttggaatttaattttcccaccatctctgttcgctgaagagtgttccaagtaccacgtgaggagctcctctccacatacatctccatcatgtaatggagccttgctgccatctgcactgatgctttccagcttccctctcactatgaagaccatcttttcaacagtgccaccttggtaaagaatgtcacttccactaatatacaagttttgtcttaatttgtcacatattgcatccaatataggccaatccatcaaggtgaataatcggaccttattaaggaatctaaagaagtggcgacgtatgtccctttggatgtcttcaggtaaattactcaaaagctcctcttcattcactccttgagtagctgcccaggtgaacctttcggctcgtctaaccctccttctcaaatcttcaggcaatcgcctatggctcatccacttttcaacatcacggcgcctgagttgcatttccaacctccttcttccaagagcttgcagaaaattttgcatgtttccaataagcaatgcaaaaagcaacagtcccagaccaataatagccatcgtgaacagaacttcccatataaagtaactcgggacaaggtttcctgctaaggtacttatttgctgaaacccccaaaataatgaatatatatatcgttttacagcactgtcttctgtagtgagcaaaacagcctgctcataaattccatattggaaagtagcatcatttccagtgttaaaacaagcttctgcacccgagtcattgaaccactgctgtctgtacagtccactcccaatgccacgtccacagtctataaaagaatcacaatatggaatggtcgatatagaacaagcatctcgtagacattggttaaccctctgtaagccaaagagataccaacatgaaccaaccacatgtcccgccaaaataaacattagaaggttgatcacaaaattagcccatgctgactcaaatatgaatccattggtggactgaccatcaagaagtggtacgaatctgatgatacgggggacatattgaagaagaacagtgacacgcaataaattcttagcatagtttgcagcagataacccaactttaggaactactagcagtatcatcacctgagggagtggaagcacatcaaagaaatcaagtaaaaagtaaccacgaaaataatggatagccccccccccccgcctcgtcaaccaagtctccagctcccaccactagtgactctggtgcaacataagccaatctgaactgaagcaacatgtggaggaaataaatagcatcagtcacacttctcacaacagcaagtgttgtatataagtcccc

SEQ ID NO: 22694 - DNA, 1089 bp, Zea mays
ggccgctttttttttttttttttctggtgaaacgatgcaaaacatctggcaaattcatcagactggcaacagttcaaacattcccgttaaaacaagtctaccaactccgaaatgaattctggaagaaaaaaaaataagtatggaccaccataatgatgtacacaaaccgaaggcctctagcctctaggagtgctgctgttgttacacgttagaacagggcgctccggttaggagcgaaaacacatggggagagaggcataccacccaccacctgtggggtgggggtatcctttcatgggagtagtagagatctgctggagacaccgttccactatgttctcttgaggatgtagccgacgacgatgcccaggaggcccacgacaaacaagaaggtgatggagaaaccgccgccggttttgctgctctctttccgtagaagctccagctcttggcgtaatttctggttctgctgaacagcagacattttctcctcagttagcttggagatcacagaagttgcctcagagggcttctcctttgctgtttcagcagacgatctagatacagatagtggcgtcatggaatgatcgatcccgttttcttgtgaaaatgagggagtggaactccctagttcagattcttcagggattgggttgggcctcgtgcctcgcgcttcgtactgctttgggttggttgttttgaccttgaatgctacataatggtcagtcttattggtcagttgcatggaacacgagctctgcctcattatctcaaaggggaatgcgagctccgacggctggatctcgaggaaactcacgcttccgccgccgctcatggctgcttccttgctcgatccctgatccagcaagccctcctcctctggcagggacggagcaaatcaagagctccgccacaaatccgacccgaaaggaatcgaatgcgaaaggcaacagcgccgggccctctgatcgatgggaaccaggaggggaaatcccgaaaggaatgatgagaaggagagatgggaaattccggtcgccctcctgcctcgctgcagtaacgggcataccggccggcctcgaggtacccaat

SEQ ID NO: 22695 - DNA, 2087 bp, Zea mays
  misc_feature (284)..(284): n is a, c, g, or t
  misc_feature (326)..(326): n is a, c, g, or t
  misc_feature (397)..(397): n is a, c, g, or t
atcagtcattttcttttacaagaggagaagaaaatgcatatactgggtcctacactacacaagctgagaaggttcatcagacgagaaggagttatgcaagaacgtggaaagataccaaaataagaggaactgacgctcagccttcccgtgagtttcacagaaacggcacgatctcatatggtaatttcgtgaacgcactaccataatcccggcggcgggctgttgatctgatggtccacatcacatcccacacgaagcggactcgatccgacggcgcagagccnccgccgccgccgccgccgaaccggcgcgtccgttaagggccnagcccttatatgcgcatcagcgcgcggttggtcttgtactgtcaaaaaatttacgtacgaggtcaatggangacgcagcgatcgacgacagcgtccagagcgcctccgccgtgacggaggtgggcagcagcgtcactgcggcggtggaggaagagtcgcggcggcccggccggggcgccgtccgcggcgaggacgggcggccgacgatggcggacaaagaggcggtggacgactacaacggcccagtggaagcggagacgacgacggtcgtcggccgagacgtggacggcccatcctcaacgataaggctcgccgcggcgaggtccgggtacctgctgctagggtttctcgccggcgcggccgccgcagcgctcttcctggtgcgccacgacacgccgatggcaacgtgcacggtgccgaccttgaatgactgactgcatgctgttattccttaacttctttgattgcagagcagttgatcgaacctgatgctattttactagttgctctgaatgctcggtgattacatagcgcgcacgtcatgcatctctcggttcgagtacttcaggtgaaacgatgcaaaatatctggcaaattcatcagactggcaacagttcaaacattcccgttaaaacaagtctaccaactccgaaatgaattctggaattttttttttttttttgggtctttttttttggcaaattcatcagactggcaacagttcaaacattcccgttaaaacaagtctaccaactccgaaatgaattctggaagaaaaaaaataagtatggaccaccataatgatgtacacaaaccgaaggcctctagcctctaggagtgctgctgttgttacacgttagaacagggcgctccgattaggagcgaaaacacatggggagagagaggcataccaccccacctgtggggtgggtgggtgtcctttaatgggagtagtagagatctgctggagacaccgttccactatgttctcttgaggatgtagccaacgacgatgcccaggaggcccacgacaaacaagaaggtgatggagaaaccgccgccggttttgctgctctctttcccccccggcgcctgattcagagagacatgggtttttgagtctggaaagaactcgctcatatatttgagtttgcacacgggttttgatcaattatgccttttgaatttatgctagggcattagccaggctagagctttttgagttattggtgtgctaccttttctaaatatgcagctactaggtattattcaatcagataacattagatgcagtcgcttgaatattggagcaggaaagggttcacaccacaacatggccatccaaaagttcagttccacgctgccctttataattaattaactggatcttcctagtattaccactcacaaaattataatagagtcaccccttccccgcccccccccccccctcaaatgcaaaatacaggtcttagtttcttcacttgaaatcgattattatatgtctaacaggatccatcagtttatcttgcataaaaaaaaactggtgcttgtaggaacaagaaaactttcacttcagtagctttcaatgttcttttcccttcttatgacgatggtgctcagagaagcaaatggaaatcatacagcaatagcatcaatggacaatgtcaccacccaccaaagtaatatttttatgagaatggaaacgattcaaaggacacctagaaaacaaatgatcacaaaatacagtactgattcagg

SEQ ID NO: 22696 - DNA, 1327 bp, Zea mays
tttttttttttttttttgattcgttgctttttatctggcaaattcatcagactggcaacagttcaaacattcccgttaaaacaagtctaccaactccgaaatgaattctggaagaaaaaaaataagtatggaccaccataatgatgtacacaaaccgaaggcctctagcctctaggagtgctgctgttgttacacgttagaacagggcgctccgattaggagcgaaaacacatggggagagagaggcataccaccccacctgtggggtgggtgggtgtcctttaatgggagtagtagagatctgctggagacaccgttccactatgttctcttgaggatgtagccaacgacgatgcccaggaggcccacgacaaacaagaaggtgatggagaaaccgccgccggttttgctgctctctttccgtagaagctccagctcttggcgtaatttctggttctgctgaacagcagacattttctcctcagttagcttggagatcacagaagttgcctcagagggcttctcctttgctgtttcagcagacgatctagatacagatagtggcgtcatggaatgatcgatcccgttttcttgtgaaaatgagggagtggaactccctagttcagattcttcagggattgggttgggcatagttgttggcacataaaccacacgcagcttgaattcatcgacaactttccctggctccttattgaacattgctgcattaatatcttgagctgtcacaccattctcggccacaacgctttgaactaggaacttgtccttgcactgcatgtcaggtggtgaagccttctgtgcttgcattgtcactgtaacatcgcaagttgagccaggtaatacaacaccaatattaggacgcacacagtactgctttgggttggttgttttgaccttgaatgctacataatggtcagtcttattggtcagttgcatggaacacgagctctgcctcattatctcaaaggggaatgcgagctccgacggctggatctcgaggaaactcacgcttccgccgccgctcatggctgcttccttgctcgatccctgatccagcaagccctcctcctctggcagggacggagcaaatcaagagctccgccacaaatccgacccgaaaggaatcgaatgcgaaaggcaacagcgccgggccctctgatcgatgggaaccaggaggggaaatcccgaaaggaatgatgagaaggagagatgggaaattccggtcgccctcctgcctcgctgcagtgccgggcataaagaaaaagcaggaggctgacaaggcggcccgccaccgaaccccggcaca

SEQ ID NO: 22697 - DNA, 2948 bp, Zea mays
  misc_feature (647)..(647): n is a, c, g, or t
tattattgtttataattattttgataggttagggattagataagataataactttaatggtaccgaaaaaaatataaaataatgataaaaaaaatcttaacaattttttttctaacataagttatgatgtcctcaatgacctcagaaaatatgaatttgaatttcaacttgtacatggagaaatgaaaaggacaaattttgttaaagggtaaactgaaccaactcaaagaagtgaagggataaaataaaccaaaaaaatactttagggggctatatgaacttttatccacaggtgggaagtaatttggactttttccaataaaaactcaaaagtgtccaaattggtttagacaagagaatacaaatcaaggttttgttcgattagctctgtgttgtggtgatgcaggctaagatacgaacaaaagatattgtctgattggcatgaattatggtgtatgctgtagatagatggtgatatcatggaaatctggcctgcaatacacatccacaactgaatcctcacgctgctggacatagccatatgaagccttaattcatgtttatgattcatatttatccaacctgatcattagcgtaggccctccacccccaattgcttagggctgcaaggagacccattctcgcanacacagctaattctccaccatgtagggcaggtagaatgacaaagcagcacctaaaacacacttacagacattctttcattcaaaaatagatctagcatatgaaacctgtgctagaaggaacccaccaactaagtgttcaattatgaattatgcacatacaataagttgaaaacatattgaatacagattgtctgtattttgggattcttcactctttcagatagcacaaacgcccatgcaacgctcaaagtctctgcccaagagagcagatcagcagttaagtaatatcttccagtaagggaaaaactgactctggaacagtatttcttcatttacagagttgatattacattaatacatttatttgtagtccttacctgatttgtgaatacaaccaacagtaaaccactgtacagttacatggtcaggactcaggaactagatcaagtgaataaaaacagaggatgattttttaccctgcatttccaagtaaatttacacattcactaaaaccaaatggttaaatttcacatggttagccaaaagagttcaagaggcatgtgctggcatgggtgtaacttagggtccgtttggttgggagccacgggagcgaagccgtccattccagatttcgagagtggagcggctccattccacattctaagagtggattggaatcgttccattttctggttgggcccactgtaaagagagagggagaagtagaacggtgagattccaccaatcttttcgagcgagctcgtcccgaatctgatgaaaatattcccgatttagaatcgctccgctccatcccgctccgttcactaaaatagagcggctccattccaccttgctccccaaccaaacggacctttaaagtgtcccgctggagtcaaatctcctctaaaatctctagaaactctgacagcatagcattaatctaacaagagaaaaatctaaaaggtgaactgtagataaatgtaagcaatcctaagcagaattgtaaactaaagagcaccacagcacaaatatctatctgtctacccgcagggtgaacaatgtccataataaacaacactgccaactccattcgggggcctagagtcggggaaacgtaaccaaatccacaccaaaatcctcattcttctaggtacgtacatgaggcctcgaaatggcgccacgaccacaaactacctcgcgatccctgatctataaaccctagcgcgagattccattcaaacggggcaagcaaagagtgcagacgacatgcccgggcctttaccgtatccgacaacggcgccgacgagggatcccgcggcggactcccaggcgaagcggaggaggcacaccccgggggccgcggtggccgcggccagcgggctcgggttccgcgacaccgcgaggcgagtcaggatcgggttagtggtggcgccggggcggcgagcactaatcccctgcggaggagactcgtcggtgtccgactccgtggcgtctccgtcggagaagggctcgtcctccggccttgggtcgccgccgccgcccaccatggccgccgcgttatggtgttctggtgttcgtgttcgtgttcgtgctcgcgctcgtgcgcctagcgcgcggctcgtcacgatggcctggtgccctggtgggtggctgggtgcacggccaccgcgcactgtccgtgtgccgcacagcctgcgtgcgagtgaggtgggccactagcgacacgtgcactagtaggatcctctgtgactaaccgtctaattggttgcccgtatcatcacatcttggactaccacgtgtatctgatattaggctgtcttcaacagttatcatatctcatctcttattttaaaattcactctataaatagtgtaatttacagtaaaaatatattattttacacgatcttttgtggacagccttattttagactgtgtatttagtttctagaagtagaatcccaaaatccaaagtgggatagatattaagagacatatagatacgagcatttgttgaaactaaacccaggttcaacaatgttacactcagcttttttggtgtagttgtggctacggctgaatttttttaacctaacgttgctataggttgaactgcaatacagacagttgcagtcgtttttagctaaaacgaccaacttcactatttccaacagtgtcctcctaaattttatcctttacccaaatattctccattatttatagtatcctctaaaaaattccatcctctatatattcaatatctccaactatgcactctaaatttcgtcataccatacaatga

SEQ ID NO: 22698 - DNA, 1150 bp, Zea mays
cccggccccgggttttttttttttttttttttttttttttttttttttttttgccgaagtaaaaaggttaggtaagtgattttcggcatagaaggccccaacaaatactacaacacctgaacaaaggatgaggtgctcctcttattcgcaaaactgtcacagaaaggtgtagaatcattaacattaacaagacactaccttagaaacatacatttgcagagaaataaacccaaaaaagggctcagattgacgcatttacaaggcaactaaacgtcactccataaggtgactcattttccctgaaatttcgacgacaaaaagttctggaacttagaaaatccatccatcgcatcctgcggaagagggagcgtgaagggaggaagaacactttgtccagcattttgatccttagccagtggtagcgccagtgcgggctgctgcttgtttagcgtctctatgatgtacgagaaagtcccaaaggtcaggcagctctgaatcagagtttgcggtgcacctggaaagctcagcgcaaggccagtgcaacagcctgccactcctgcattgataccatcatcttttccacgtaattttcgcaaagagcaggctaccaaactttgtacgccagcaaggacagcaaatatcttagcagacgaagcagcatcaggaaatgatcctttaaaacccttcctcatgaccagacctttaccgtatccgacaacggcgccgacgagggatcccgcggcggactcccaggcgaagcggaggaggcacaccccgggggccgcggtggccgcggccagcgggctcgggttccgcgacaccgcgaggcgagtcaggatcgggttggtggtggcgccggggcggcgagcactaatcccctgcggaggagactcgtcggtgtccgactccgtggcgtctccgtcggagaagggctcgtcctccggccttgggtcgccgccgccgccgccgcccaccatggccgccgcgttatggtgttcgtgttcgtgttcgtgttcgcgctcgtgcgtctagcgcgcggctcgtcacgatggcctggtgccctggttcgattaggatgttctaggtaatggtctcgtgcacggccaccgcgcactgtccgtgtgccgcacagcctacgtgcgagtggggt

SEQ ID NO: 22699 - DNA, 992 bp, Zea mays
ccgccttggagggccccaactttttcttcttctcctgaacaaaggatgaggtgctcctcttattcgcaaaactgtcacagaaaggtgtagaatcattaacattaacaacacactaccttagaaacatacatttgcagagaaataaacccaaaaaagggctcagattgaggcatttacaaggcaactaaacgtcactccataaggtgactcattttccctgaaatttcgacgacaaaaagttctggaacttagaaaatccatccatcgcatcctgcggaagagggagcgtgaagggaggaagaacactttgtccagccttttgatccttaatctctgtagccagtggtagcgccagtgcgggctgctgcttgtttagcgtctctatgatgtacgagaaagtcccaaaggtcaggcagctctgaatcagagtttgcggtgcacctggaaagctcagcgcaaggccagtgcaacagcctgccactcctgcattgataccatcatcttttccacgtagttttcgcaaagagcaggctaccaaactttgtacgccagcaaggacagcaaatatcttagcagacgaagcagcatcaggaaatgatcctttaaaacccttcctcatgaccagacctttaccgtatccgacaacggcgccgacgagggatcccgcggcggactcccaggcgaagcggaggaggcacaccccgggggccgcggtggccgcggccagcgggctcgggttccgcgacaccgcgaggcgagtcaggatcgggttagtggtggcgccggggcggcgagcactaatcccctgcggaggagactcgtcggtgtccgactccgtggcgtctccgtcggagaagggctcgtcctccggccttgggtcgccgccgccgcccaccatggccgccgcgttatggtgttcgtgttcgtgttcgcgctcgtgcgcctagcgcgcggctcgtcacgatggcctggtgccctggtccgcaggcagg

SEQ ID NO: 22700 - DNA, 1519 bp, Zea mays
tctgaagatgtagtcgtttctttattttcaccagagccacaattcccataacagcatcttgttttgttgttttatgagaaagagtaagcgtgtagttctcggagagcattggcattttgcacctgaaactgagtcaattgacccgccctgatacatttgcttgccaaaatgtggcaacctatacacaaaacactgaaaactgggtacagttctcgcattctctgttttagttgagtttgcaggtagtagagacgacatgactcagtcaaccgcttgttctttgacaacgacggctgctgcagcaagtgggccattgttagcgtcaagcttcagggagacatccttgaacatcttgcggctgagggtgttgtaaaccgctctcgagtactgccgcgacgtgttcctccagtccattccagctttcatcatcagctcgaactcctcgtagcttatcttcccgtccttgtccttgtcgacgtctaggattatgtcgtcgattgccttctggtcacctctcggagagagcgcctccttcaactcctcgatctcgatgtacccgctcccgttcttgtcgaagtagctgaacaccttgggcaggtggtcctcgctacggatcttcttcagatgaatggagactgtcacgaactccttgcagtccagggtcccattgccgtccatgtcagcttccatgagcatatccacatctgtgtcatggacgttgtgtcctatcagtcgcagtcccttcctgagctcctcgattgtcagatgcccatccttgttggtgtccagcatgtgaaacaactccctgattgcttccagctcttcggctggtaggtactctgcaaccacaagcagggccttcttcttgaccttgttcatgccagtgaattgcttcagcctggacctcactgcttctccgagtgggatgttgggagctgcactggcgttctgtatccaaggatgttctagaacctgctgggcagtcagccgagagtaggggctcgggtcaagcatcttcctcacaagatccttcgcattttccgacacctttggccatggctctctctggaagtcgatgttggaccggattatagcctgcgctatgccctcatcagtctctgcccagaatggtgggacgccacatagcaagatgtagagtatgactcctgcactccatatatctatttctttaccatagttcctcttgaggacttcaggagccatgtagtagggggatccaacgatctcactgaacctgtcacctggtttgaagcacacagagaggccaaagtcgatgaccttgagaggggaggtctcagatgtgttggcatacaggaagttctcaggcttgaggtcccggtgcatgacgccatgcttgtggcaatgcaggacaacttccatgatggtgcgcatgacgccggcggccgcgcgctcggtgtagtggccgcgcgagacgatgcggtcaaagagctcgccgccctcgcagacctccatgacgaggtgcacggtgtcctcgtgc

SEQ ID NO: 22701 - DNA, 4471 bp, Zea mays
  misc_feature (1740)..(1740): n is a, c, g, or t
  misc_feature (1976)..(1976): n is a, c, g, or t
  misc_feature (1993)..(1993): n is a, c, g, or t
tgggtctgtttatatatgtccggatgtggttcggctcgaccggattgtatcatccgacctgggcttcctttagttattggaagcacagggctcctaatatataaactatatatatatattaggtatggcacagtaagaataggatacgaaagttttgatattgttttcgtttttttatgaaaggtatggcattggtagtctgtttattcagaggatgtgatcaatggaaatgaaaggatgcactgcagagtgcagatggcagggaatcagctttttatatgcaattttcttttgtgaggtgagaggttctgttaatctgttggagatggcccggaccagcaccaccagttgggtggggtggggctttcggaatcagcgaaaacacaagcagtacgggcctcctcagccctcgcaaagtaggccttgtacggcctacgcacggccccgttaaggatctgtaacatcacggcgtgtaggctcgctgctatgtggtcccaataggcccatgaggcgagcagatggaggtaaaggaggtccagttgggctgggccgcagagggtggtaaagaaaagtcacaggtgatttttgattccagacatttcgatttcgcgtttcagaaaagaggaatgtctttgctaatttgttcgcaaaactagacgtattccatcacataaacacgatgtctatcttttagtggtttatccatattcctctatgttttgtaccatgtaatgtgtggtatttttcgttgcgttcttcggtacgtgatgctagctccgattgaactagctctagctgatttgtgatcaatctcttttttgcatcattgatggatctcgcagcagctgtgccctgttgaatcgagtggaaatccttgctggccgatgtgcttaacattaatcagtgctgctcttgagataatggtggtggctaatttgttgttgtggagaggaggtgcccgggaatcccacacagatgggccgatcatgcaacccacgttctagatgggccggatatatcctatattttcttttttacggtcaactggttacaacagagtaaaaacaaagctgtcatggatttcgtttaaattcggccgaaccccagaacaaatagttttgctccttataaaaaagacaggtttactttgcttcacaattacaacatcaggtaagtaaaaaataaacattactatcatcagcaaatagaaaacaaaaatcagcgtgaagaactctactccttgctagtccgagagaaccagccgatttctagtcggtttgctggtaattaacgaggtaatccgagctcaggtttaggaaagcttgtattcgcattgccacgatctctgacacgaacaaaaccgacgggcgcggattggaggtggtacatctaatgtatgtcgcgtcgatcacgccgacgcctagtcccggcgtcgatcgaaggcgctgagggagagcctgctgcagcgcccgtcatccaccgggacgctgctcccggcaacgacgacacgccacaagcagtccatcccatccggcggctgtggtcgacgggacggaggcggcggccgagtggcgcgagcgtgaggcggcggccgtgctccaggccacggcgcgcgagaagcagtgcgccagctgcgggagctggaagaggagctcaggtacaaggacgggcgcatcaaaatgcccgtggccatcgtaaacaccatcaggaccaaacgaagctgaccattttcagctccancacgcctacagtcgccgactagctaggcaccgacgacaagcagggtgaacgccccgtgccgccgggtgctttgggcccattcaaccccgagttggcccggctaagagagtggcaccgctacactacaaccacgccgacggcccatgcaggacactgcaacgacgacgtctcctctcctacagcgtatagtgacgctcgctctcaaattaacctgtccagcgtgtcaacctttcggncacgcacggcacttganggcatctcccgttccatgtgaactattgtagtagttccatgtgaactattgtagtagccaccaagtctagccgagtgcactgcccctactgttagtctgataccaagagcatgcatggcttgctacgacctggatgacgatgatcatcccagactcagagacgacgaagcgtacgttcccgtccatgtctctttgaatgccggccggggtccatggcacgagacgagacgtcctgctccactgctccagctaccacaaccgtccggtgctagctagctcttcaactcgagccagagacggaaaggacccatcatccgtgcaagtgcaagtggccgtgtaggcccaacggcaacggccaacacgtggtctatagtgtatatctatggctagcactactgtaacacatgtctgtctagctaccattcaggtcgcccctggcagcgaggcgcaggccgagagacgaggaagaggcaagaacacgtgccgctgcgtgcgaccgccggtcggtcgtcactgcctcactgacgctgggcacgcagccatgcacctcggtcaggcaggcgtactagcggtgtgcagagagcagccgagccggccatgcatgtgcctgcaaattcagagtgctctcccaactgcaggcagaaaggaggcccggccttgtccggtttgcagggttgcagttgcagttgcaccaccggccaccctcacttcacttcctgtccagacgacgtgtgcgccgctgtgcagcttctgctttccgtcacatggcgtgcaggcaggcgtccaaaaccgttgcctgcggggcctgcttcgccttcccaaaggacgatccatatctttgggaacgggagcgaaaagctatcgatccggtttactattttaaactttactctatgaactacactgtaaaagtgttttgattactaattaataggggttttatttcactcgatccatagacgacactactaactttgcaaacaggcacaaatgcgatgcgtcatctacgcgcagatcgagcacctggaatcctgtgaatacacagcagcacagctgcatgcagagtctacaactacctgaggatctgtcgccaccgaacgcagcgggttcagtcgtaggcggcgctgaagaaggccttgacgacgttggcggagaggatctggaggacgccggagttgttggcccggccgacgcagcgcggcgacttgaactggctgacgggggcgccgagggagaggtagtggcggagcaccttctggaaggtgccgcgctgcagcacccgcagctcgagcgggccgatgccgcgcgccctccgcgacccgacgtagcccgggtccgcgaaggcgcggtccagctcgtcgcagcagctctgcagcacgtcgtcgccggcgtcggcgttcagctcccagaacaccacgtagtggcccgggtcgcgcgacacctccgcgtggctgctgtagtccaccacctccagcttctccgccgccaggaccttggccgcgctgtccacggccagctgcaggtcctgctcgctgctcttgtcgatgttgatgctcagcaacaggttccgccggcacacgaacttgagcttcggcgtcgagcggacgcgtgggcggacgcgtgggacgtcccctagacggtaccggtacagccctgcgccaccccaaaaaaaaacaaaaaaccctcgttcagcttggaagcaaatcttatccgttcatctgacaagcagatcataggacagacacatcatgttctcagtttcttctctctaggccttttctctcatgcatgacgtgcgtgcccacacccatgactccatgatccatccatggagtcacagtcgtttacgcagtggaagcaaagtctccaggctgcaaagtctgcgaactcaggccatgggggaaaaaatcatacaaaatcctcacagccacagaggagaaccaagaaagcgaaaggttctcgctcgtctagtagctgctttactacattggaagactagtaaagaggtgaagagaacgactgaaaattcagctgctgctgctgctgcttcgttcgttcaacgaagcaggcagccagtgtttgacggacacggcgcgcggcaagtagccgttgcactcagttgtgtgaatgcacgccacctgctgctggccaggttcagttagactacggcatagctaggttcccaggctgcagaagggccaagagcaatggacggccggcaagccgacaaaaccaccatggaagcagatctttcgtcccggcatattattcgcggtcgatccaccagttccacacctaatccatatcagagatggcaatgatcccgatctccggttcctcctcgtgggaaattcttttattaggtcccgttcgttttaatcaaatccatagaaattgagagggattgaatcccccttaattcccatggattaggatgaaacgaataaattctctctcaacgagtaaacagggacgtag

SEQ ID NO: 22702 - DNA, 2944 bp, Zea mays
tgcagcggcccgcactgccgcggatccccgcggaatccggaccaggctgcaatcagtatcacgtttgaaacggtcagagatatcaacatcaggtgcatcaccatattagggtagcacactatctagaaaaacaagtacattacctccatcccaaccatttgcacccagttgacagcagttccagtcgccttggacatgaactctgccaatgtctcctcagcaatagcgagtagactggacaaaaggaaaattagcattacagcaaggataaggtttgaaatgtaaccaggtttcaggcttaccctgctgggttgttcgcatccctttgtggaggatgcagaactgctgggttttgctgttggttgtgctgaccacttgtcaccacagactcacagcttgtgtcggtggtggctacagaaggctgcaaatttacaagcaaatgttatagcaagcagaaaaagataatgcataagcagggaaaaaaagaattacagtaggcatgtaaacaatactgtaacagactttgttaaaatgcagcaagccatgcatcatgaaaccaatccattttctagttcaagcccatgtacatttgaaaagagaaaagtagctcacactgtggagtcgattcttcatatacccgttgtcaaagacgagacgggaaacctgcttctgcagccggtcattctcctccatcaacagcttgttcatcgcactcagcttccggttcacggtttgtagacgagaggactccttgcgctgcttctcccggcatctaccaacgacgatggaaacacgatttagtggcaggcacgcctaaaaaagcaaacagctagcaaacagtggattccaatacacgggattcccttgtagttcttgattggcataaaccaagaatgaacaggaagaaggcatttcagtaaatttcttatggcatgagcgggtcattatacaggaatgtgtggaaaagctgaagcaaaagagaccaaatggatgctaactaagaaccaatatgtgtgaatcattgcttgattggaagtgatgcgtgtgtgtgtgtgtctgcatgtaccaagtctggtcaaaattagaccttcctaagcccccagggtgcatgaaagattcttgactccttttacccttctccaagctttttactcaaaaggtgccgttatcctcattcttgattcttccacagtggcagtgaggcaccaccaagaacaaaactgttacccaacttttaatccgctggaaaagaaggcaaagtgacatagcctacgaggtgatgttcagaggggcctgaaggacagcgaatgccaccactgaagtggaaaagactgacctcaactcagaatgctgttggatcggtcaacaaggaaactggaaacacacacacacacacacacacacacacacacacacacacacacacacacacacacacacacacacacacacttgaagctacaatcaagaactcgaggattttgtggtgccgaacaactgtcacttgtttctattttccgatctcatgtttcaagatagatgtagtgctaaccgaccagctgagttcatattgacacctcgatacatgattgactagcaacttcttgactaacacaagcaaccatacgtccttgactcgttggggcatacatgtgaaaggttgacacctcccatccacgcttgtgctgctaagcaacaggacgaatcctaccaaatgcaagcagaaactgcctggtggcaagtcattgtcatcacgaacggcatgacgtttatgaacacataggccaagtaatttccatacaataaatctgacaaagacggttgctttagttccctgcctaacccacagatggcaaaaagtatgtgatacggagactggaggagatacaggagcccatatcatatcattgtgcgaggttcgacaaaatcttttcaaaaaaaatccaaggaatgagcgcagattcaagcaattcgtgtttcgtctgcacaaaatctctgaagaatacacagtttctccccaacaaaaatagcatcattgccacagcgcagaactcccaagatcctataagtcaatcaaccctatgaaactgcgaaaatgatccacttttcccacatcccaacatggaaaaaccaaatgcaggaaatagaacagcaacgacagcaccagaggaggtaaaaaaaaggtcacgcaatgccttgacccccatccccaagaagaaagaggagagccaaagccaggagatggagctcacagtcacagatcgagcgtgcgagaaggggtggggggacggacacggacggaccgagtgactgacctgcggttctggaaccagaccttgatctgcttgggctcgatgttgcggaggatggggcagtccctgatgaggtgctgccggcgcagcgagctgggcttggggcactcgctgtagacgcgctccagtgcctccacctgctccggcgtgtaccgcacgtacttgcccgcgtccacctgcggcgcggcgcccggggagagcctctccctgctcgccaccgccgccatcgtcgccagcgggcccgctagtagtgcaggagaggagaggaagcggaggcggagtagtagcaggcccccgtgcgcgctgccgccatggccatggcgctgggcgtgcttgcggggggagtagtgtagggtctagggagtaggtggtggttgtgctcgcgtgggatgggagtgggcagtggtggagtgaggaggaggagaggacagtagcagcagagctctgggcttgtttaatagcagtacagtactgctgctctgcagcagcaatagatgttttctggtcactctctctctctctttcatccggtttttttataacttttatgaaaccttcgggtttttttctattggcttgttcgctgcggcttgctgcggctgcaatccggctgcggctgcggcttctacagt

SEQ ID NO: 22703 - DNA, 1653 bp, Zea mays
cactcccccagttttttttttttttttttttcgagcaagcagaactagcaaatagtaatactgcaacctgcaacagtgatcaatgtcgccggcgacaagccggggagacgagaccacgaccaggcacgcatacagctgttgtagttgtttgtcacgcgcacacacacaaacaaacagagtcagttctcgatcatccacacagtacacaaattcttaacacaggcggcacaacggaaaagcaactaatgatacgtagtaaggcaaaaggcggcatccggtctggcgctgccgagcgatgttgcgagcctcagatgaaggtccagttggcgagcatgagcgccaggcactgcggggcgccgtcgtcgcccaccaccttccacgccactgcctgctcgtacgacgcctgccgccccatgctcgacctgcacacgccaccggggaggtacgccaggccctgctgcatgatcgcggggagctgcgcggacagggccttctggccctcctcgtcgaggaccgcctccagcggcaggtcctggatgttcaccatcgtcgtctccaggatgtcgaagccggcgctgttggcgaacttgagcgtgaaagccggcgacttcagagagcagcagagtatcgcgtcgctgtgcttccagaacagcatcagcggagagtccgcgccttcggtgtccgaccagcggatctccgttccggtgtgcgccctgtagctcctgccaatccacgtagctagtgcaagtgcctcgggagagcccggcggatgcttcagttcgatacgcgaaccgaggcgagaaggagcgatcgccatggccaccctctgcacggaggccatcacgcccctgacgtactgcttggccattgccgccacgctctcgcgaaggtggttctcgaacgagaactggaaggcgatggtcaggaccgatctcgtggcgcacgtgccggaaccatcgcatgaagcgcgcatgccgcttccacctgatccaacctcgagcgcagaggcaaggtcaagcgtgcgtgtggtggcggcagttggcacatccgtcttagcatcaagcggtatcacacggaagcctgagggcagcaacggtgcatcgtcggcaaaagattcatcaataggagcaaagacaagctgtgcacacgcaccaggtgcatcctcgtcgacgccactgcacagctgtagaagaaacatatcccgggacataagcacctcctcatggctaaagccatgtccttcaagcctaataacctccaaggactcttcatgctccaaggtgcgtgcaaggggcagtataacctggttgcccataaacccaccagcccttaaacctggaacagtgtatgggttggccctcaaagaggcgacagaataagcatcgatgccaggatcagcccattcagaccgatgctccctcaaaaatcgcacaagtagagcaggtggcacattctgcagcagcatcgatgcttttgcgcacatgattccaccccccatagcagaaaataatggggaagcgctgacatgagacccaacaagtttatttggagatgagttgattgtaactgtaatatcctcagcaccatcggtgttcaacaaacaagaccagccatcatctggaaagccactcacagcatcattgaagcctctgc

SEQ ID NO: 22704 - DNA, 2984 bp, Zea mays
ttttttttttttttttggttttttttttttttttttttttgataacagcagtagtaatagggttaagtctcacacataaacagacagcaggggcattgttctccaactcccgatccaccacagtagacttaggccataaacagacagcaggggcattgtctcgagcagttgtagcacacaggtgcaacggaaagcaactagtaatacgtagtcggataggataggataaaggcggcaaccgatctagcgctgccgagcgaggcacgaggctgtgaacgtcaagagcggaggagcatcagatgaaggtccagttgacgaacatgagcgccaggcactgcggcgcgccgtcgtcgcccaccaccttccacgccaccgcctgctcgtacgacgcctgccgccccatgctcgacctgcacacgccgccggggaggtacgccaggccctgcagcatgatcttggggagctgtgcgaccagggccttctgtcccccgtcatcaaggaccgcctccagctgcaggtcctggacgttcgcgaccgtcgtctccagtatgtcgaagccggcgctgttggcgaacttgagtgtgaaagccggctttagagagcagcagattatggcgtcgctgtgcttccagaacagcgtcaggggagagcccgccgcgtcttcagtgtccgaccagcggatctccgttccagtgtgcgccctgtagctcctgccaatccacgaagctagtgcgagtgcctcgggagagcctggcggatgcttcagttcgacatgcgggccaaggcgagagggagaaatcgccatggccaccctctgcacgatcgccatcactgccctgacatactgcctggccatcgctgccacgctctcgcggaggtggttctcgaacgagaactggaaggcgatggtcaggaccgacctcgtgctgcgcgtgcctgacccgctatcgcttaaagcacacagacctccgcctgatccgacctcgagcgcagaggtcaagggtacgtgtggcagatggcacatccgtcttagcatcaagcggtatcacacggaagccagagggtagcaacggtgcatcgtcagcaaaagattcatcgataggagcgaagacaagctgtgcacaagcacccggcgcatcctcatcgatgccgctgcacaactgcagaagaaacatatccggggacataagaacctcgtcatggctaaagccatgtccttgaagtcgaataacctccaagcactcttcatgctccacggtgcgtgcaaggggtagtataacctggttgcccataaacccaccagcccttaaacccggaacattatatgggttggccctcagagaggcagcggaataagcatcaacaccagggtcagcccattcagagcgatgctccctcaaaaatcgcacaagtagagcaggtggcacattctgcagtagcattgacgcttttgcgcacatgatgccgccccccatggcagaaaagaatggggaagggctgacatcagacccaataagtttgtttggagatgagttgattgtaattgaaatatcctcagcaccatcactgctcaacaaagaagaccagccatcgtctggaaagccactcacagcatcattgaagcctctgctgagcctttgactgaaagttctgagaacagctggctgtcgcccagcaccatagggcgtttcaccacttgattcgtgtgcaatttgcctaatgtgacgcaacgccgcagcagtcatcttttgtgccagtatcttaggagattcatagagcggtcgaagaacctcagggacactacaagcattcagatcaacatgatccacaatgtaaatcatggaacctcccccatcacaaggtcgaatcagataaccactaggaagcacctcagctcttataaaatctggagttttaggtccagaaggacctccagtggagtgggtcaatgacctttcgcagatcacaagactgccatcgtcaagaccactagtgtatcgtagtgtccaaaagtcgcgcggttccgccagagttgtcagtgcataagtctgcatatagatcagctcaatcgttccaccgttacccgtagggataacatggaggatatcaacacgccgacaatcgcgataccacgatgcgcgatccttaaggatctcggcaacctttgtgggctcgaggctcacaaggccgcaagctcgtgctgctacgccgctgcagttgtgcgaaacagcgatgattccaacggaatccggaccaggcttcatcccaaccatctgcacccagttgacagcagttccggtcgccttggacatgaactccgccaatgtctcctcagcaatagcgagtagacctgctgggttgttcgcatccctttgtggaggatgcagaactgctgggttttgctgctgcttgtgctgaccacttgtcaccacagactcgcagcttgtgtcggtggtggctacagaaggactgtggagccgattcttcatatacccgttgtcgaagacgagacgggacacctgcttctgcagccggtcgttctcctccatcaacagcttgttcatggcacccagcttccggttgacggtctgcagacgagaggactccctccgctgcttctcccggcatctgcggttctggaaccagaccttgatctgcctgggctcgacgttggtgaggacggcgcagtcccggatgagctgctgccggcgcagcgagctgggcttggggcactcgccgtaggcaagctccagcgcatccacctgctccgccgtgtaccgcacgtacttgcccgcgtccagctgcggcgccgccgcgcgcggggagagcctcagcctccccctgctgctcgccatcgggctcccgcgctagtggtgcgggagcggagaggaggcggaggcggagcagccggctcccgtgcgcgctggcatcgtggtgggcggcgtgctcgcttggggctcctagcgaggagaggagaggaagag

SEQ ID NO: 22705 - DNA, 2035 bp, Zea mays
tttggtgagaaaaccatgatcccagaagcaagaaacaaactggaaagcctcatacctgcagaagaaacatatccggggacataagaacctcgtcatggctaaagccatgtccttgaagtcgaataacctccaagcactggaatttgaaaatagcaagttagatggagcttatattggacattaacaagatgacagatgaaaggaactgtgatcgatagattacctcttcatgctccacggtgcgtgcaaggggtagtataacctggttgcccataaacccaccagcccttaaacccggaacattatatgggttggccctcagagaggcagcggaataagcatcaacaccagggtcagcccattcagagcgatgctccctcaaaaatcgcacaagtagagcaggtggcacattctacaatatcagaagaagtacattggggcaaggttaactataccataaaaacgattttatgcaaggaaaactaccatgaagattgttcatttagtactgtaacaacacaagcagctaaatggactacaaggtaaagtagcttggaacaaaattgagtgcatgtacaaacctgcagtagcattgacgcttttgcgcacatgatgccgccccccatggcagaaaagaatggggaagggctgacatcagacccaataagtttgtttggagatgagttgattgtaattgaaatatcctcagcaccatcactgctcaacaaagaagaccagccatcgtctggaaagccactcacagcatcattgaagcctctgcagattagagttcagatttcagaccagcgggtagccaagaacggaatgctattagaagacactcttgcggatgcttataaggtcagaagtcttctacacgcctgctgagcctttgactgaaagttctgagaacagctggctgtcgcccagcaccatagggcgtttcaccacttgattcgtgtgcaatttgcctaatgtgacgcaacgcctatacagagaccagtaggtgtcactggtgcatcggtaaaattacagatccaggagtacaccaaagcccaacaacagctgcttagcaacaatgaaattgagcagtgatacataccgcagcagtcatcttttgtgccagtatcttaggagattcatagagcggtcgaagaacctcagggacactacaagcctgtataaaaacaagataatttaggcacatctgctaaaaaagtcaaaaaaaaaactacatgcatatcttaatgaattagtcaagtgcccactcagtatgaaagatctgctgctactcacattcagatcaacatgatccacaatgtaaatcatggaacctcccccatcacaaggtcgaatcagataaccactaggaagcacctcagctcttataaaatctggagttttaggtccagaaggacctccagtggagtgggtcaatgacctttcgcagatctacagaagacagagagccacatggttaccaatactgttttatgcagcaaatataatgatcatgcaaaagaaatggcagcatcagtggggttactaagtccaaaaggcacaatgtggcaacaatgttcacactgtagtggtaaaaattgacagcagggaagttcgacaacaagactaaacttggctggaacatgacagtcgaaacaacaatatgcattaggtcaatcatgtaattaaggcataccacaagactgccatcgtcaagaccactagtgtatcgtagtgtccaaaagtcgcgcggttccgccagagttgtcagtgcataagtctacagattaaagcaggaatttttatttcaacaaaagcacagttactagtactagtacataatcaagcacgtaaaaaagactgaaccttatgtgcagacacatacctgcatatagatcagctcaatcgttccaccgttacccgtagggataacatggaggatatcaacacgccgacaatcgcgataccacgatgcgcgatccttaaggatctcggcaacctaaatggaaattaattaggtgtcgcacagctgcag

SEQ ID NO: 22706 - DNA, 1059 bp, Zea mays
tttttttttttttttttttttttttttttttttttttttttttttttttttgttttttttttttttttttttaacacagtgacaaaatccatcttttaatagccaaatagcacatcaagcaaacatgcaggatccaagcgccaagcactatgaccaagtcatatgcctggcaagcaggaaacgataataaaccggtcagtaatacggtctataacaaagcagctgatttctcacggtacatgtcgactccaactacaggataacaaagttccagacacaataacaagccttataatagtagatagactttcatacctggatggcacatacttctcaatcaagaactaaggccatcagtaaggacctgatcggtcacggctgtagcgatcgccacccccatagctgccgccatctcggctacggccagagtatcggtcaccaccacggtcagaaccataacgaccgccaccgccaccgccaccataccggtcatctctcccaccatatctggtcccctctcccaccatccccagatgggcactctctagcaaaatgaccaggtttcccacacttgaagcagtcaccaccaccaccaccaccaccaccaccacctcgcggtgcacgcccaccaccatagtcacgaccacgttcataacgagatccacgctcgcggtcataatcacggtcaccattacggtctctaccaggtccttgtggctgagctttatcaacagtgatgttcctcccgtccaagtccagtccattcattccctcaatagcatcctccatggcttgcttctcatcaaaagttacaaagccgaaaccacgagaacgtcctgaaaatttgtcaagaaccacctttgcctcagtgaggttgccgaatttgctgaacgcatccttgaggctttcatcagtcgttgaccaggacaggttcccaatgaagcaacggtactcgtcgacatcagccatcagctggtcaaacccagaaatctcgaccaaatctgaatagagccacagcgcagacgtgaatgaatcttacaaaacgaaaacagatcgagc

SEQ ID NO: 22707 - DNA, 2007 bp, Zea mays
  misc_feature (6)..(6): n is a, c, g, or t
  misc_feature (12)..(12): n is a, c, g, or t
  misc_feature (19)..(19): n is a, c, g, or t
ggaganaacggnaacctgnagcagcttaatgtaacatacttttttagtacaaaagctcaattggttagtacgaacagtaaaagtaacctaacgtttgcatcctgagattcggtgaactaagaaaaaaaggctacactaaatcaagggcaattagaatgctgctgatgaataataacatcatcataactcctctcaaaggggcaccagtaattaatctggaaccagaggatataagctgcgataggacattggtgcattgtcaaaggaacagcaaccaggtagcatcacatccactcaggcaagcataacctctggtgttctcacaagtcacaaggaacacgggacagctcaaggaacaccccaccaacatggcgaagcaaacataaccagttcatcaagcaaccataaatagaggccctccaatgctaaaggcacatagaatggaaccaaaggataatctctttgcattcccggactcaactgagccagacttaaatgatcttgggacgcaagtaaccaaatccagaaccacagtatcaaccaatccacagcaagaacagataaccaaaaagaagcctgccaaaacaaaagtcatttgagaatgacgttgtaacacagtattgaagatgtaagattgaaaacattaccagttaattttctctaatggacgattcatcactcgctttcagaagaggtaacaagaacatagttttttcttgtagctgtaggtgtgttcaagcagattatagtagtcaaccccttgcttccccgaaaagaacacaaatgcggacactaacttgccatccaatcccccgtatcacaggcataagcttaattaggaccagggtcatcaaacacagtgacaaaatccatcttttaatagccaaatagcacatcaagcaaacatgcaggatccaagcgccaagcactatgaccaagtcatatgcctggcaagcaggaaacgataataaaccggtcagtaatacggtctataacaaagcagctgatttctcacggtacatgtcgactccaactacaggataacaaagttccagacacaataacaagccttataatagtagatagactttcatacctggatggcacatacttctcaatcaagaactaaggccatcagtaaggacctgatcggtcacggctgtagcgatcgccacccccatagctgccgccatctcggctacggccagagtatcggtcaccaccacggtcagaaccataacgaccgccaccgccaccgccgccatacctgtcatctctcccaccatatctgtcccctctcccaccatccccagatgggcactctctagcaaaatgaccaggtttcccacacttgaagcagtcaccaccaccaccaccacctcgcggtgcacgcccaccaccatagtcacgaccacgttcataacgagatccacgctcgcggtcataatcacggtcaccattacggtctctaccaggtccttgtggctgagctttatcaacagtgatgttcctcccgtccaagtccagtccattcattccctcaatagcatcctccatggcttgcttctcatcaaaagttacaaagccgaaaccacgagaacgtcctgaaaatttgtcaagaaccacctttgcctcagtgaggttgccgaatttgctgaacgcatccttgaggctttcatcagtcgttgaccaggacaggttcccaatgaagcaacggtactcatcgacatcagccatcactgcgaccgagagcgagcgaggaagaggaagcgcacgtcaaatcgaagatgcctctgcctcgttatttttagcaaagggaggacaagatggggaatagatcgagggaaggagggagtcgcccgccccaggattggattggagtggagtcggcccgggctagaagtagaaccctaatcccgcccggcctcgaggcacccgagatgtagatatttccctggttcgcgcgacaggcgggacccgcccgggggccggcctcgaggtacccaa

SEQ ID NO: 22708 - DNA, 2362 bp, Zea mays
taagcttaattaggaccagggtcatcaaacacagtgacaaaatccatcttttaatagccaaatagcacatcaagcaaacatgcaggatccaagcgccattgctctatgacccgttttttttttttgtttttaaaccggtcagtaatacggtctataacaaagcagctgatttctcacggtacatgtcgactccaactacaggataacaaagttccagacacaataacaagccttataatagtagatagactttcatacctggatggcacatacttctcaatcaagaactaaggccatcagtaaggacctgatcggtcacggctgtagcgatcgccacccccatagctgccgccatctcggctacggccagagtatcggtcaccaccacggtcagaaccataacgaccgccaccgccaccgccaccgccaccatacctgtcatctctcccaccatatctgtcccctctcccaccatccccagatgggcactctctagcaaaatgaccaggtttcccacacttgaagcagtcaccaccaccaccaccaccaccaccacctcgcggtgcacgcccaccaccatagtcacgaccacgttcataacgagatccacgctcgcggtcataatcacggtcaccattacggtctctaccaggtccttgtggctgagctttatcaacagtgatgttcctcccgtccaagtccagtccattcattccctcaatagcatcctccatggcttgcttctcatcaaaagttacaaagccgaaaccacgagaacgtcctgaaaatttgtcaagaaccacctgtgcctatcaccagaaaaacaaaattaaagcaaccatacataagagaccatgctatatagcaatattacaatagaacacaaagaaaattgtagcgagaatggatgtatgctaagagacatcgagctatttttttgaccattcagagtaaaaaatattgcctagagaatccatgcagacaggaatagaacatcataaatatctttatggcgcttttttggatatagagtaggaagaaaagatgtgcctgggcaaatcagttagatttaagattctttggagacaaaaaatgcagtataccaatattcaacgtaacacaagaatttttttgacatgtcataaaaagaataaaacactatcctaagcaacaggtgtcaacacaatctatggtgttatcatgctcatggcaaaactaaagatgagaagttattcacgtcacctttgcctcagtgaggttgccgaatttgctgaacgcatccttgaggctttcatcagtcgttgaccaggacaggttcccaatgaagcaacggtactcgtcgacatcagccatcactagaacagataaacaaatatatacaccttataagtaagtagggttgcaggaagccagagctagagctaccaagagagatcactgcagattctgtggtggttacaggtaacctagtcaataatcactgatcactaaagctgtgatatttattttagaaaagcagcacctccgagaaacaaaggcacaaagagtatttataagcaaaagaacttcctcttaaggaaatacacgttctcgggcatgttattagcgtaccctaaccgaagttgactctacagtttatagtcctttactaatttgcagaattcagtacataatgtgctcagaagtgcacataaccacaacacggcaaggttaaacttcaaatataatcatgcgtgcgtgtaacttaatgattgttagacgcaaaatctatgttagatagtacaaaataaaaaaaaaataaaaggagatatagtcaagctccagaatccagatcggggccgatgcttacgctggtcaaacccagaaatcacgaccaaatctgaatagagccacagcgcagacgtgaatgaatcttacaaaacgaaaacagatcgagcaaagagagatctactacctactacgcgtaaagaaatccataagcgatgaagaacaggacgtaggtacctgcgaccgagagcgagcgaggaagaggaagcgcacgtcaaatcgaagatgcctctgcctcgttatttttagcaaagggaggacaagatggagaatagatcgagggaaggaggcagtcgcccgccccaggattggattggagtggagtcggcccgggctagaagtagaaccctaataaatcccagcggcggcgcagacgagatgtagatatttccctggttcgcgcgacaggcgggacccgcccgggggacaagcgggctggccgcaacgcgcacggcatattcccgtggcgcggcttggacgcgtcaggcgtcacccagccagaatgggccgcgggcaggctgagttggcccacggc

SEQ ID NO: 22709 - DNA, 5615 bp, Zea mays
  misc_feature (331)..(331): n is a, c, g, or t
tcctccttttcgacttcgttccttcttatgggccaaagggtttgaaatattcactgcgagcattgcactgggccttccccatgcagggcctttctctttgatggcattatgggtttgcgcatggtctattatggcgtgcgctaatgttgggaaaaggatcccaacgagcgaagacaaggtcccttgagccttcactagtggaggtgcacaattaatgaggcaaagatgactaggatttcaagccaaaatcactgggtgctttaatgatcatcaccacattttatggagtatatttacaaaatgttcatgttcctttttgttcttagcctantatagcatactcctgaatatccaaattttttacaaggtttagtacctcgggggtatcgaaggccttttacatgtcaaccgcctttggtcgtggtccttagtcgagccacgatgagggtccattgaacttacttcagtcttccgagtgcctttcctcctgaggcgtagcacatctaaaggttatcgcaatcgacgaaggtctctgacacgatgtttgccatcaggttcgacaaaggcccttggggtcccatatttaggtcttcgctaggggtttgattcgaccttggcctctgctatcgtcgaagcctatgccctcaacactgcattcgcacgaacctagagctggttaaagtaaggtggggagtgaatggtttcgtactttgcctttgaagagctagcttgagaacccttggacctaggccttcactctcaaacaagattcttcttacaaaaatataaactttcagcaacatattaatcctgtataagagtttgccgtcttagaaaaaaaattggaaaatcgtatttttcttgtatgacatcgtgtaaagatactttatatatgaaaattgtagttatcgatgagatctacaactatttagttttgaagtttgaggccattaagatgcacaaaaatataatataaattttcaatagcttgacttcttagaaaaccatatctttctaatatgatatctaatgaagatactttttttattacaaaagttgtatctcttgacgagattattaactatttagttaaaattaagttttccggcccagggtaacagcttagtgcccaataatgctcacaatttcgtttcaagaagtgacaaaaacgacaattaacgccaggtccttatcaaggcctgtctcagcgtctgcgctgtacagttggtcggtcgcacaagacaaaagctttaggtaactgcaaatggcgctgctctagctatatacctcttatcagcttgcccagcaacctgcaattttttaagagtcatcagcagtaatgacctagtctgtctttgatccaaagcacgatgtagttttcaacgatgcactaaacaggacaacaaagaacctccaaatggccccccctccccctcgcatgctacaataccaagagaagatgacaacaaagatagagatgttcccgaggaatcgatcagagatttcgatgcatcatcgacatatatatatgagcacctgaaaactgacacctatgtatgagcagctgtatgaagacggagctaccaatcacctgatctgatcatacatggccgtctttggtggaggtcccgtgcttgtcgccgtcgcgctggcatgcgcgggcctcgtcgtctggctgcggtcacggagctcctcttccaaggagatgggggacatcccgggcacgatggggtggccggtggtcggcgagacgttctccttcatctccgacttctcgagccccgcggggatcctgagcttcatgcgcgaccggcagaggcggttcggcaaggtgtccaagacgtacgtgctgggggcgggtgacggtgttcatgacggggagggacgccgccaagaatcctgctgtcgtcgggcaaggacggcgtggtgagcctcaacctcttctacacggggaagcaggtgctgggccccaccagccctgctcaccaccaacggcgacgagcacaggaagctgcggcggctcatcggcgagccgctctccgtcgacgctctcaagaagtacctgggcttcatcaacgaccttgccgtgcagacgctggacacgtggcacggccgcagcagggtcctcgtgctggaggaggcatcgtcggtaagcagtagctagcagttcttctctctctcgagactcgagagagattttgactggggatggatggcatggcaatggcatgcagttcacgctcaaggtgatcgccaacatgctggtgagcctggagccggagggcgaggagcaggagaagttccgggccaacttcaaggtgatatcgtcgtcgttcgcgtcgctgccgctcaaggtccccggcacggccttccaccggggcctcaaggccaggaaccggatgtacgcgatgctggactcggtgatcgcgaggcggcggagtgggagtgagggcgaggcggccgccccgagcgacttcctgcagacgctgctgcggaagcacgccggcgacgaggccgacaagctgacggacgcgcagctcaaggacaacatcctcaccctgctggtcgccggccacgacaccaccacggcgggcctcacctggctcgtcaagttcctcggggagaaccccgacgttctggacaagctacgggtgagcctctctgtccctgtccgtcaggctcaggcggcttccatctcaagctatacgtgtggttgcaggaggagcacctggagatcaaggagagcctcaacggctcgtcgcgtctcaggtggtctgatgtcaacaacatgccttacacaaacaaggtgatgaacgagaccctgaggagagcaaccatcctgccatggtactcgaggaaagccgcacaggacttcagcatcgacggtcagtggcagcgacgccctcaccgcactggcggacagacagcaacatggactgatgccgtggaatctctgacacgcagggtacgcgatcaagaaggggacgtcggtgaacccgcgcgccgtgtccctccaccacgacccggccgtcttcgccgaccccaaccgcttcgaccccaacagattcgacgtaggttcatttctggcggcgagctctgggcacgccggcgacaggccgggagcgaggtgactgacagtgtgtgttgatgcgcaggaaacactcaagccgtacagcttcctggggttcgggagcgggccgcggatgtgccccggaatgagcctggcaaagctggagatctgcgtcttcgtccaccacctcgtctgccgatacacgtaagcagcagccatggctggcctggccactaccctccttcccatccatccgtcagcagcagctgagctcgcctggttccggtttggctgcagatggaagccactggaggacgacgacacggtgcagccgacgctggtgcggatgcccaagaacaagtaccccataatgccaaccgcgctctaagatagaaagatgcacgttgctaccacagcatcaacgctacatctgtctgtctacgctgctgcaaatgactgaatgcttggccagatccggcacaaaatacgatttgaacaatacagcagttgagaaacaagcaagctggaccatctagatcactgtaaaatgatcacactgtacttttaaccgttggttgttgtgttgtaaatgactgaatatttcgcagtctcaggcgccaatggactgaatgaaagaatagcctcaaaggaaatgccccaaatcgccacaaatgataaacatacagcacaaacagagaggagcactttcagtacaaatcaacatgttcaaagccgggagaaaacggaacctggagcagcttaatgtaacatactttttttagtacaaaagctcaattggttagtacgaacagtaaaagtaacctaacgtttgcatcctgagattcggtgaactaagaaaaaaaggctacactaaatcaagggcaattagaatgctgctgatgaataataacatcatcataactcctctcaaaggggcaccagtaattaatctggaaccagagtatataagctgcgataggacattggtgcattgtcaaaggaacagcaaccaggtagcatcacatccactcaggcaagcataacctctggtgttctcacaagtcacaaggaacacgggacagctcaaggaacaccccaccaacatggcgaagcaaacataaccagttcatcaagcaaccataaatagaggccctccaatgctaaaggcacatagaatggaaccaaaggataatctctttgcattcgtggatcaactggccagactaaaatgatcttaggacgcaagtaaccaaatccagaaccacagtatcaaccaatccacaacaagaacaaataaccaaaaagaagccagttaattttctctaatggacgattcatcacttgctttcagaagaggtaacaagaacatagttttttcttgtagctgtaggtgtgttcaagtagattatagtagtcaaccccttgcttccccgaaaagaacacaaatgcggacactaacttgccatccaatcccccgtatcacaggcataagcttaattaggaccagggtcatcaaacacagtgacaaaatccatcttttaatagccaaatagcacatcaagcaaacatgcaggatccaagcgccaagcactatgaccaagtcatatgcctggatggcacatacttctcaatcaagaactaaggccatcagtaaggacctgatcggtcacggctgtagcgatcgccacccccatagctgccgccatctcggctacggccagagtatcggtcaccaccacggtcagaaccataacgaccgccaccgccaccgccaccgccaccatacctgtcatctctcccaccatatctgtcccctctcccaccatccccagatgggcactctctagcaaaatgaccaggtttcccacacttgaagcagtcaccaccaccaccaccaccaccaccaccacctcgcggtgcacgcccaccaccatagtcacgaccacgttcataacgagatccacgctcgcggtcataatcacggtcaccattacggtctctaccaggtccttgtggctgagctttatcaacagtgatgttcctcccgtccaagtccagtccattcattccctcaatagcatcctccatggcttgcttctcatcaaaagttacaaagccgaaaccacgagaacgtcctgaaaatttgtcaagaaccacctttgcctcagtgaggttgccgaatttgctgaacgcatccttgaggctttcatcagtcgttgaccaggacaggttcccaatgaagcaacggtactcgtcgacatcagccatcactgcgaccgagagcgagcgaggaagaggaagcgcacgtcaaatcgaagatgcctctgcctcgttatttttagcaaagggaggacaagatggggaatagatcgagggaaggaggcagtcgctcgccccaggattggattggagtggagtcggcccgggctagaagtagaaccctaataaatcccagcggcggcgcagacgagatgtagatatttccctggttcgcgcgacaggcgggacccgcccgggggacccgcccgcccgccgcaacgcgcac

SEQ ID NO: 22710 - DNA, 1372 bp, Zea mays
aagaagccagttaattttctctaatggacgattcatcacttgctttcagaagaggtaacaagaacatagttttttcttgtagctgtaggtgtgttcaagtagattatagtagtcaaccccttgcttccccgaaaagaacacaaatgcggacactaacttgccatccaatcccccgtatcacaggcataagcttaactttgttttttttttttttttttattgacaaaatccatcttttaatagccaaatagcacatcaagcaaacatgcaggatccaagcgccaagcactatgaccaagtcatatgcctggcaagcaggaaacgataataaaccggtcagtaatacggtctataacaaagcagctgatttctcacggtacatgtcgactccaactacaggataacaaagttccagacacaataacaagccttataatagtagatagactttcatacctggatggcacatacttctcaatcaagaactaaggccatcagtaaggacctgatcggtcacggctgtagcgatcgccacccccatagctgccgccatctcggctacggccagagtatcggtcaccaccacggtcagaaccataacgaccgccaccgccaccgccaccgccatacctgtcatctctcccaccatatctgtcccctctcccaccatccccagatgggcactctctagcaaaatgaccaggtttcccacacttgaagcagtcaccaccaccaccaccaccaccaccacctcgcggtgcacgcccaccaccatagtcacgaccacgttcataacgagatccacgctcgcggtcataatcacggtcaccattacggtctctaccaggtccttgtggctgagctttatcaacagtgatgttcctcccgtccaagtccagtccattcattccctcaatagcatcctccatggcttgcttctcatcaaaagttacaaagccgaaaccacgagaacgtcctgaaaatttgtcaagaaccacctttgcctcagtgaggttgccgaatttgctgaacgcatccttgaggctttcatcagtcgttgaccaggacaggttcccaatgaagcaacggtactcagtcgacatcagccatcactgcgaccgagagcgagcgaggaagaggaagcgcacgtcaaatcgaagatgcctctgcctcgttatttttagcaaagggaggacaagagggggaatagatcgagggaaggaggcagtcgcccgccccaggattggattggagtggagtcggcccggcccgggagtagtaccctaataaatcccagcggcggcgcagacgagatgtagatatttccctggttcgcgcgacaggcgggacccgcccgggggacaagcgggct

SEQ ID NO: 22711 - DNA, 2745 bp, Zea mays
tttttttttttttgacacatacagctacaaagtaatataatttttctttttagacttttcttacaaagtgggtattatacataccactggtttccatccagcagattgtgttaccattgttcaccattcaacagtaaagcttggatttataggcaacacagtaatatgctacataatgtacagactgagctctctttattctataaaacgggtaatatggtatacatatcaaatgtacatacaacttctacatcagggttagtatttacagtaggaaaaggcaatcctctccagctataaggagcttccattgaaatgtttactgaaagcttcttcgtccttgcagtgcacccacaagaccttgtacacctcaattagcaactttggaaatcggctagcaaaatagtgatcaaatccctctggcaatgacccaagtatgcccttgagatcatttgaaagttctctgtaatgacccgatttatttctgatatacctcagaagatcacgagtagactcaaagttatattttctataacgacccatgtctgtaactaaagcagcatccagtttctctccccatttcccaccaaacgccactggtcctatgctttccagtgcgtttatgaggtccgtttcactggttttctcaattctgtcactggtatcccttagaaacgaaaggcgcaattcagggctccagaagagaggatgatgcatgacgtatactgccgttggtcttgtctctgggtttggttgtaacagttgagatataagatgtactgcttctggtatgtagtccaccacaaagagatcaaagcgattgtttacaatgtttgtatcccgttcatagtattcaccaaacggatgcttgcctttagtgatacaatagaaaataaggcagcccaaactaaaaagatccattgcacgagtttgacgaccatgacgaagctgttcgggtgcttgccagccagagcttccaattcctgtaccatgatggctaacagaagtcatgtcatcttgcaggtgcttactgatacccatatcagaaagctttgctctaataggtccttctgcgcttattaagacattctgaggcttcaaatcacgatgaataattcccaagttatgcaaatgcacaaggccagcaaccacatctctcatcagcttcaggagttgtgctgaaggaagcccatcctgcgtccacaactccacgtctattcccttaacatttgaaatctttgagttgatgctcatactgacctcattgttagaaatagactctccagaagacaaatatgactgtttttggattaggtcagccaagctgcagtggcacctctcaagcgagatataaacaaaatcactgtcatggtcacaaccgtagagtctaacaatattaggatcatgatccgatataataagatttcgagtctccttttcggctatgtcattgtgggaacgcagcagacgtttcacggcaacttgacgaccatcataagatccttcaaaaacaattgtgccattgctccctctgccaatttctttattggagacatataccttaccaatctgacgaccaccaagggcatctgttagcgcagaatttttcattggtgcctcagttgacccaccagtatcactgcactccttgtcagatgctgtcaaggtctcagagctattgacaagtccatccttcttccgtgtttttctttttttgggagttccctccgacctgcctctaatgtccaccgatttcttgttgtgcgtgaatggctcaataagttgaatcataaactgcctgcatgacttgcttgcagatatcaagctcaacagataaccagtgaccaaaaatatgggaaacaaagggaatagccatccagaagtgttcctagtggggtttagggtagcttcaggatcggcagagatggcatgagatcgagcaacatcatgagtttgattttgagaatcatccaataggatatttgacttcccagcagtgtttggtagcttccttggggtttgaactggttccaaagcatcagaaccatgcatagaaacaaaaggggtaccatctttcaagacaattacattagctgaatttaaatcaggtaaagcaagtggcaaaccctcagttctaatgcatggaatgtctccttgcaggcaagatgactgatcaagcatgtcagggtgcttgtatttcacatagtagtttgcagtgaaagaagttcttgtccagttaaataaatgattgccaaggtctgatgcactgagagaatagtcagttctcacaagcactatgatattatcactgtcatcactagtacggacatttagcttggatggtgctccttcaacccctggtccttccaattcctttaacgcagatgggatactatgcctgtaaataatctcaccactatcagcatcaactacaaaaacagttgaaacttttgatccgatagtaacaacagaatcccgaatatatgggctcctggcaacgaattcctccaatttccatgggagcctctcccggtcgccccttataaacctccaaaaaatcagtactattcccattcatgttctcgttcccattgaaaggataaatgaggtaattcggaccagactcagtggtagtaatatggtctgagagtggaaggccctgtggcaatctcccacagaggagattgagacagcttgtccacaagctgaatcgtgccattgtcgtaaaactggagcacagatctg

SEQ ID NO: 22712 - DNA, 993 bp, Zea mays
ccaagccatcagagcattaggctgtgcaaatgacacggtcctaccataccggtgcataatgtacagattgagctcttttttatcctataatacgagtcatatggtacacatgtacttgttctacatcagggttagtatgtacagtaggaaaggacaatcctctccagctataactaacttcctttgaaatatttactgaaagcttcctcgtccttgcagtgcacccacaagaccttgtacacctcaattagcaactttggaaatcggctagcaaaatagcgatcaaacccctctggtagtgacccaagtatgcccttgagatcatctgaaagttctctgtaatgacccgatttatttctgatatacctcagaagatcacgaatagactcaaagttatattttctataacgacccatgtctgtaaccaaagcagcatccaatttctctccccattttccaccaaacgccaaagatcctatgctttccagtgtgtttatgaggtcagtttcactggttttctcaattctgtcactggtatcccttagaaacgaaagacgcaattcagggctccaaaagagtggatggtgcatgacatatactgctgtcggtcttgcctctgggtttggttgtaacaaatgagatataagatggactgcttctggtatgtagtccaccataaagagatcaaagcgattgtttgcaatgttcacatccctttcatagtactcaccaaacggatgcttgcctttagtgatacaatagaaaataaggcagcccaaactaaaaagatccattgcacgagtttgacgaccatgacgaagctgttcaggtgcccgccagccagagcttccaaatcctgtaccatgatggctaacagaagtcatgtcatcttgcaggtgcttactgatacccatatcagaaagctttgctctaataggtcctcctgcgcttattaagttttcgattaggatgttctaggtaatggtctcgtgc

SEQ ID NO: 22713 - DNA, 2426 bp, Zea mays
catgagaatgatcacatcatatgaattcataccatggaatattacacatcacaaccaatttttcttttgaatatgttgaacacaaatatttcatccatgagagaattatataacttcaaaacatatatctgcaaattctttaacttaaaatccaaatcaaatcctataacttcaactcaaagtattatacattaagcataattgaaataatcatataacttcaaatctagagctactgtaacaagctactataacagctataaggttgtaggccctatagtggttagttagacttaagatggaggcacttggcctcgattgaagcttaatagttgatgaaggaggttattttcttcgatcgatctcttcatactattaatggtctcctgagatgcttttgctgctacatttgaggatctccagctcgacgaggccgagcaacatgagccccgttgtgagcctagacatgatccctctccaaaggcaagaacaaatgtcgctgacaataatacaaaaagaacatgatgaaacattctatcaaaaatataggaagtgcctccatggcagcaacattacacaacaatagggtgacatgaagctggtgttgcttttgaacaactggaaggccgacagctgcaacaaacaaagtaaataataaacaacacttgagggacaacaacaatacactattgaaactaaaaaggggatgctaaaataccgcaccagggtcgagtcttagacctatgctttggcgtagcagcgacatcgtagcccatttgagaatgaccaagacattaccggggtcgaggcttagaacaatggtttgtcatgggacaaatcaggagattttttaacccagcctaaatttttttatacggggagtcaaactaaaaacctaaggagtgctacttagaccagctaatcaactagctagagatcctttcacgctgtaaagattactaggtaagacaaaactgaaagtgcattctaccctagtaaataaaaatggtagatacaggatactccagagtgatcactttttatgattatccattgcattatacttcctcttcccacttatctgatgtaccatttcatatatcaccagaacgaggtgaaccatagaaaagaatgaatcccatccacaatgcttttccttattcctgactatacccatttttgtttgttctctttccttttcaaacacttctgcatgtaaaaaatatgtcaatgttagtgttaccatcacattttatcctcactatcattattgccacttacaaaatctagcagacttccgatacgagcgagaaaaaaattcaccaccatacaccaaagacgctctaatgttcaaaattacagaggtacttgagaatacgatagagtatatgacgttctcatctccattccttcatgtaaccagccacaccaatgtgatccctactaccaatataacaaacccgcacataggacagtaaccagatcgagcacaacgaggtaacaacagggaatggatagggattcagatcgtactagcctgagccttggtgtcggtgccgctgtgttggaggatctctagctcaacaaggccgagcaacgagcccagtgtgagtctggacatgatccctgtgaagagcacgaggacatgctgaacgaatcatccgcaaccaaagttatcccccaaaataacttatggccacaatgatacaacagtttcataaacaaacaaacaaacaaatattcagtaaagataacttgaaatgaataagtaggtatataatgtaggaaatgtaccaactctgcacaaggagcacatgcataacacaggagaatttgaatcagaaattaacatccagtttgagagaacaaaaatagaagaacattctcaaaaactctcaccgcaatataacaaaacttatggaacatgaacaatcagagtatcctcatcagcccaagatactactccctccatccaaaattcccgacagataaggactctgggaattttaggaaaaaaagtgtaccaggggacttcgaatagggagcacatgctgaacggatcatttgcttgctgtcgtcgttgtttgctgtcctgtagtggcacgctcacttggctagcagctgcagtcacacgctcgcggcttgcctactaccctgcagtctcgcgctaaactggcgcagctgcttgtacatgcgcttctcctctggcctcacgtgctcacccagggcgcacggtggctggcgcatgtggttcgcccacacggccacacacagacgcttggccgctcgaggagctcgggagggaattagaggcgggagccctcacctgctcgccggccaccgccatgctcgcgaaaccttagcacgcccgcggagccccgctcaaccctagcacgctcgtgtagccgctcaaccctagcacgccc

SEQ ID NO: 22714 - DNA, 1906 bp, Zea mays
  misc_feature (1879)..(1879): n is a, c, g, or t
  misc_feature (1893)..(1893): n is a, c, g, or t
atattatttataatatatatgaccccttttttttttttttatgcaacgctgatacactttcacgtataatctgctctcaggtacactttcacgtataagcatgcacgaatgtcacagttcaggcttggactattactccaaaatggaagaaaaatggccgtccgtctgtctatgctgccatcgcaaatgaacccccaactagtaggccggcggtgcagcaaaccatggcaaccctgtcacaaaccatggcagccaactcttgcagttaccttcaatgatcaatcttcatcaaaatcgacctctaagaagtgccattcttcttccttcaaattgaacttttcagtatggagatcattgaacttcagagtatgcattttagtttcttgatcgaagtcaattatccaacaaccaacatacatttttttatgtggatgccacagccgaagaaactgctgtatgcaattctcacaacttgttttccgctttttcttcttggcatgatgattctgtgagcttcctgaatacttcgtcgtgcctagcatttttctgcagttcgaagacccacaatgacaaacttgagctgctccaaactggacaaatttatagtcataggtcagctcctcccctatctttatgtcacgaagtgcaaaaattccaaccctggtctctccatcaacagtccatttctgcatcgctgtgtttggttcacagctatggtttatgaatcgggaccggtttcccttgtttgttgcatcaatgaccatattactactgacctcacaaaggtagaagtcagtgtcaagcagccttttcattgtccatagcctattctcacatgttctgtcatcaataacttctccaacatactcaataacaaattctcctttctttatttcatcctcagcaaccaatccatgaccacatttctctgtcttaatcaatttggttttcttaagaggtctgtgctggaatgatttattggtgcatgtgtcatcacattcacattgtgatgaacagcaagagaaaagcatgccacaatggcagtctctgccacacacaactgatgaaccaggagaaggcttacagtgacaagaaatgccataatcttcaatgcgtctcttagtgcaatatacattccgcttgattggttcatagcggcctaacacattcaattgtttcaagaaaggccgcgtatcaaaatccgcatgttctatcttgttgatcagttggtcaaaaacattatcgatttgctctgtcagattgaccccgggcgcggaagacaagcccacgcggaccatggacagatggattggggcagggataaactcacaataatctgagaggagggacagatttgggttttgaataagagcgcaaaacaacacctactgactcaaagccaccgccgagttgattcaagagaggccaagttagggcttcctctcaccaatccaccaggaagaggtagaggagcggcggtgccgggcggggcggcgcaccagcagctggtgctggtggtttaagcggagggtgacgctgcctacgctgccgagaccgagagagacagaatgggcggcgctgtgctgctctgggtcggcttcctggagctgtggaggcgaggagagcccgcctagggtattgctgaatgctgatgccgccgccctagttttggcaagcttttaattggttcctacacttaatttgtagctccatgggcgacgaaaatcgaatcaatgtgacaggagggaaagggggcaagcgggagaaggagctctgggattcggcagaagcagcagcggagatgctcggagcggggctcgccggcggcaagtcagcgagcaagctgcagtcgcgccgtttttttttttttttttttttncccggcacggcccncgaggggtaccca

SEQ ID NO: 22715 - DNA, 1755 bp, Zea mays
cggtcatcctccaaaggttactggccagattacattttccaaagatgcacaacataattggaagttgagacttaaccacacctcatgccaatatcatctggcacgactattccttgtacaaggatgcaataaaactgaacaataaagcaaagcaaaaaaggatggtaaaacatcttttgaaaactatatttgacgcagaattgggatttgcataaatgaatcatctgattacaaaaacaagaattgtggtagtgaactcttacagttaccttcaatgatcaatcttcatcagagtcgacctccaagaagtgccattcttcttctttcaaatcaaacttttcagtatggtgatcaatgaactggagagtatgcattttagttccttgatcgaagtcaactatccaacatccaacatacattttttgtcgtggatgccacagacgaagaaactgctgtatgcaattctcacaacttgttttcctctttttcttcttggtacgatgattctgtgagcttcctgaatactttgttgtgcctagcatttttctgcactttgaagatccacaatgacaaacctgagctgctccaaactggacaaatttatagtcatatgtcagctcctcccctatctttatgtcacgaagtgcaaaaattccaaccctggtctctccatcaacagtccatttctgcatcgctgtgtttggttcacaactatggtttataaatcgggacaggtttcccttgtttgttgcatcaatgaccatattactgctgacctcacaaaggtagaagtcagtgtcatccagccttttcattgtccatagcctattctcacatgttctgtcatcaataacttctccaacatactcaataacaaattctcctttctttatttcatcctcagcaaccaatccatgaccacatttctctgtcttaatcaatttggttttcgtaagaggtctgtgctggaatgatttattggtgcacgcaatatcacattcacattgtgatgaacagcaagagaaaagcatgctacaatagcagtctctgccacacacaactgatgaaccaggagaaggcttacagtgacaagaaatgccataatcttcaatgtatctcttagtgaaatatacattccgcttgattggttcatagcggcctaacacattcaattgtttcaaaaagggccgcgggtcaaaatctggatccgcttgttcaattttgctgatcagttggtcaaaaacattctcgatttgctctgtcagattgaccccagacgccgaggaagatgagctcatacggaccatggacagatggattggagtggggatgaactcacaatgatcaatagcagaactccactccgttagtccgttccggtccaatctaccaggaaatggtagaggagcggcgacgcggcgctccagagctggtggtggtgatttaggcgaagggtgacgctgcctccactgccgagagagataaagagggccgcgctgcgctgctcgagctgggagggaaggaaaggccaactagagcattgccgatgccgccgctagttttggcaagccttaactggctccttcacttgaatttgaagctccaggggcgaggaaaatcgaatcaacgatgcgaggagagggggagaggggagaagcgggagaggggctctgcgattcggcagaagcaggcgcggagatgcttggagcggggcttgccaacggcaagtcccggccggcctcgaggtacccaatg

SEQ ID NO: 22716 - DNA, 3497 bp, Zea mays
  misc_feature (959)..(959): n is a, c, g, or t
aggatgagactttacccatgttgatatagcaaaagaaaatataggactgtgtctcgggaggccataaccaggcaatcgaaaaaggaaactacagaaaaacaaaacaaacaaataacctgcgcgcggcgcaaaactcagcttgcaacctaattggcaaagcagaagaccaagcgctcaagatgtcgtcgttgtttgtttaaataacatgaccgccaccaggccaccaccaagaggccacacatgctcctcgcaaaaccaacccccacacaaacacaccgccaagaacatagagtcctggacaacatcagctctttaagagagagagaagaacaatccatgcatgcatcgtcccccacatgaacccactagctgccaccgaaaacgtctaggtagctagggctaacgacaatcctacttgtgacaaaagaaaaagaagtactacctccattcacaaatatataacatcgttgatttttttaaaaaaaatttgatcactcgtcttattcaaaatatttatttaaaaatataaaattttaaataaaatataaacttccttaagtgataaaataaataaaaaataataatttattattatttgaataagatgagtggtcaaagtttttttaaaaaatcaatggtgtcatacattacatttatgaacggagggagcataaggctactgatgggatagatctcttgttcgaaagtactcgcgagtattgttccatgaaagagaacgtacggtagaatgtggaagatgataatggagcggggttgtggttgtgggccatcacatgcgtggctttggaaggatccatctccatcctcgcggaaattaaagggaggccctccggcgccacgcctgtgggcccacaaaaggcggccgcgttgtttgccttttccccacgcggccacacacacccggccctactacctcttcgctcggagccctactggantgggccaccctacctcttcccccttcttctctctctcattcattcatgccgtaccgtacgcatgttctctctctcatttgttcgtatcctggagggatggagagagagagagagcaaatggatgggtgccgtgaccgtgagttgcaggcgcttgaaacaaatgaggcctcagatgttgctgtggcccaggagaccacggtgggctcagcaccagacggccgggcggaagcgccatgcttgtctgtcgaggcagtgagcaccgccgcagcacaaaagccgcgggacacggccgggtgcagtgcagcccgtcccactccctcccaaccgtgcatcggcaagcatcgctcccaatgccagtgccagcagctaccatggctcacctccagcagcctgcttacttgctgtccctagtctctactctctactccccctgccatggcccatggcacggcacagattgctagcgcaactgcattggagtgatggttttttttttttttttgtctctatttctaaagcaaactgtgcttcagttccacactttctctagcaccagtacagcatttctttggagaacagacaacacacacccatggaggtactgctgtatatctcattaccaaacaacaccttcggtgaaactagtactacaatacacagggttgcacagggtttcttccaaacaagtcctctagtttacaagttacacagggttgtattgtacagttgcctgcttcgagtacacagcggcagtttttggcctatatcatgcatgcatgcatgcgtccatcaacctgccgctacccaggggacaaatgacaaatcacttcgatcatgccgcctcaagtttcagtctggcagctggaagcagcagttacagtttatgatgcccaagggcatgcacgaatgccacaattcaggcttgcagtagactccaaatgggagagaactggccatccgtctgtctatgctgcgaccgcaaatgaaccgcgaactagctggcggagcagcaaaccatgacaacccttcaatgatcaatcttcatcagagtcgacctccaagaagtgccattcttcttctttcaaatcaaacttttcagtatggtgatcaatgaactggagagtatgcattttagttccttgatcgaagtcaactatccaacatccaacatacattttttgtcgtggatgccacagacgaagaaactgctgtatgcaattctcacaacttgttttcctctttttcttcttggtacgatgattctgtgagcttcctgaatactttgttgtgcctagcatttttctgcactttgaagatccacaatgacaaacctgagctgctccaaactggacaaatttatagtcatatgtcagctcctcccctatctttatgtcacgaagtgcaaaaattccaaccctggtctctccatcaacagtccatttctgcatcgctgtgtttggttcacaactatggtttataaatcgggacaggtttcccttgtttgttgcatcaatgaccatattactgctgacctcacaaaggtagaagtcagtgtcatccagccttttcattgtccatagcctattctcacatgttctgtcatcaataacttctccaacatactcaataacaaattctcctttctttatttcatcctcagcaaccaatccatgaccacatttctctgtcttaatcaatttggttttcgtaagaggtctgtgctggaatgatttattggtgcacgcaatatcacattcacattgtgatgaacagcaagagaaaagcatgctacaatagcagtctctgccacacacaactgatgaaccaggagaaggcttacagtgacaagaaatgccataatcttcaatgtatctcttagtgaaatatacattccgcttgattggttcatagcggcctaacacattcaattgtttcaaaaagggccgcgggtcaaaatctggatccgcttgttcaattttgctgatcagttggtcaaaaacattctcgatttgctctgtcagattgaccccagacgccgaggaagatgagctcatacggaccatggacagatggattggagtggggatgaactcacaatgatcaatagcagaactccactccgttagtccgttccggtccaatataccaggaaatggtagaggagcggcgacgcggcgctccagagctggtggtggtgatttaggcgaagggtgacgctgcctccactgccgagagagataaagagggccgcgctgcgctgctcgagctgggagggaaggaaaggccaactagagcattgccgatgccgccgctagttttggcaagccttaactggctccttcacttgaatttgaagctccaggggcgaggaaaatcgaatcaatttttcgattaggatgttctaggtaatggtctcgtgcgaggggctctgcgattcggcagaagcaggcgcggagatgcttggagcggggcttgccaacggcaagtgagcgagggaagctgcagttccagagattagacaagccccggccggcctcg

SEQ ID NO: 22717 - DNA, 2095 bp, Zea mays
gcccaatacagtaaagatataaggataggctatatcaatataacattaattgcattgtactgctcatatcatttctccctgattaaccatccttttgaattaaataattatgaaaacttgaatcaatatcacagcaacgatcttaccttaatcaatttggttttcgtaagaggtctgtgctggaatgatttattggtgcacgcaatatcacattcacattgtgatgaacagcaagagaaaagcatgctgcatcagcaaagcttcaacatgtaagaatatctcaataatgataaaactcacaggtgtaataatccaatagctaacaaattcgtatgagtttcgtattctagattttctaaataatatagaaaaaaaggaactggttacagaattgagcagaatcaattctctagtgtgtgtataaaagtttgaaagcttacctacaatagcagtctctgccacacacaactgatgaaccaggagaaggcttacagtgacaagaaatgccataatcttcaatgtatctcttagtgaaatatacatcttagtagaattaagggcaataaaaatgtggacatgtccataaaaaggcacaaattcaaattcatcttggtagagtaatatttccattctctttcttaactcagaagctagaaaaaataatttgatttcactctcaataacaaagaagaaccatatgacattaagacacatccctgttgtaatcacaaatattgtattactagttcgcttcctgcacttatttctactccaggcaaggactatgtaatgtagtcaagttacagtatttgttggatgaaacatgaacttgactgataaaaaagaggcatagaaaagaaagtttgaatatgttgaacaagaacatgttagaatatggtactttgatgacagtaggaattaaatgacccaaatgtgcaaatagattatcttgagaaaaacaatactcgtatattacagtgaaggttcaaaagtctagttgataaggatactccgcttgattggttcatagcggcctaacacattcaattgtttcaaaaagggccgcgggtcaaaatctggatccgcttgttcaattttgctgatcagttggtcaaaaacattctcgatttgctgcagcacataagtaaaagataggcaagtgagagatatttccacgcaggagaataagtaactcagtagaactgagcctgagaggctgagacaaagatagtaacatccactcttgtatggccattctccataggaagcaaagaacattcaagcagtgggtgcattacaagcgtccgcagcatgcacagattatatttgtgtgactgagacaccactagccaaaattccgtgcgcggagtaaattttaccttgatggatctacatttgccaaaaaaaaagaagtacaagcgaaaaatacagcattgaaatcggcagaaaattctttggacaaggaactgcaagcgcactcacctctgtcagattgaccccagacgccgaggaagatgagctcatacggaccatggacagatggattggagtggggatgaactcacaatgatctgaggcggaggtagaaatttgggttttgaatgagagcgaaaaaccaatagctactgaatcaaaaccaccgccgaattgaggcaagagagaccaagctagggtttcctctcaccaatagcagaactccactccgttagtccgttccggtccaatctaccaggaaatggtagaggagcggcgacgcggcgctccagagctggtggtggtgatttaggcgaagggtgacgctgcctccactgccgagagagataaagagggccgcgctgcgctgctcgagctgggagggaaggaaaggccaactagagcattgccgatgccgccgctagttttggcaagccttaactggctccttcacttgaatttgaagctccaggggcgaggaaaatcgaatcaatgatgagagaagaggggagaggggggaagcgggagaggggctctgcgattcggcagaagcaggcgcggagatgcttggagcggggcttgccaacggcaagtcagcgagggcacctgcaggcatgcaagc

SEQ ID NO: 22718 - DNA, 2688 bp, Zea mays
  misc_feature (1956)..(1956): n is a, c, g, or t
aataggaagaaagtagagcctatacttctattctatggataaagctgaaattgatagagaaaacaccgtaaagatcaattagtgagcgactgggtcgatacaactaaaaaactgcttcattataccacgatatgggacaaaatttaggaatccacttatgtaataaaaccgatccactaaaggattaagcagcggtgcagtatcagatcccaaagatagtgaaccaggcaaccagactagctaaacaaaccgggccgtgtactcctccagtccagttcacacgcaacggagactaaactaaaccgctacagtataatatatataatttttagagaagattttagtaaagctccatatagtcatatagacacgcatagacacggtagcagtagcgggcgctcgaatctcaccggccccatctctaggctctagctccatcactcggagaagataagacccagagtgtcgcctggtccatctccaatccagcaaggcgggcagacgagccgagagtgagacaaccatggcgtctctggccctccgccccgtcatcccggccaccaccgcttcatccaggaccctcacgatcgtcgttggctcccgctcctgccacgctgccacactccaccgtggctttcgctcgcggcgcctcatcacctgcaaggcggagccgagcggcggcaacagcaccctcgagctgggcgcaggggccgcagggctggcatcgagcgcggtcgtggcgtggtccctctacacgctgaacacgacggggtgcggcctgcctccaggccccggcggcgccctcggcgccgcggagggggtcagctacctcgtcgtggcgggtctagtcgggtggtcggtcaccaccaaggtgcgcactggctcgggcctcccggctggcccctacgggctcctcggcgccgctgagggcgttgcctacctcaccatcgcggccattgccgtcgtcttcggcctgcagttcttccagcaggggtccatcccgggtccgctgccatcggagcagtgttttggctgactgtgtattactcattcggttggatgtctgttgccgagtgtgccctgctatatacacataacttttattattaagtaaatttctagcattttagttagagatttaagtttctgtaattccttctccaagattggcaaaggctctcttttggatacaaagcagcctgactcgaggaatcgaaggatttcctgtttttgttttccaaataaatataaatataagagaaccgttaattataaaaaaaaaaaaaaatttatggtagttgacaggtgcaagccggtacttacgactacttttgcttttgatttattgtgaccctcagatgtaaataaaatctaggttataagtgtgtttttagtgaattaaatgataacacgaataaaggattaactataatcatgagatatatgcaggtgtttaatcctaggtttatcattacatgttggactaatattatgtgttgtgatcatgtacgacttagagattgagtcaaagtttgattattgtgaagtatgaatttgcaagaaagtctattatcaaaataatgagacatgagggcttgcagggcctggcttcacgcacgttcaccaagtgcgaccgcacagggcccaaaattctgaggggcctaaaaaactttttagctcagtagtaagtctaaacaatatgcatcaattagcagactaatattacaccatttaagctgaacttagttagcagctagcttgctgatcttcaaacacatctagtaaatattttgtaattcagaatatataaattctattacaatgtagttctgattatatttttttctataaaataggacctcttttaaattttagtacagggcctctaaatttaccggcccggccctgagggcttgcatatggattgatctcaactataaagcttgcaaatatagntattaaagatggttgtcaaagcttttgatgatgatgattattattgataacaatctagtttaagcacaagacaataatacaaatgaaatgatatttattataagctcaaaccattgtctgaagcattgatatggcttaatttgatggcttgagaaggtgaagatagcaagaaaatatctttgaggtactaaataaaggtgaagagcaagtgatggcttgatgacctagaaatctagctaaggtgtagaagaaatttacttgcatttaatcaatgtactaaaagctttggaaagttgcattaacgtggaaaatcaaatcaaatgataaaagtgacttgaaacctttctgccgtttctccctacttctcccgtagttaaaaccggtaccgacgtttgattcagtaccatgatgtcctgggaagtaagctgctttgagttgattcgattgctcatctgcttcggtagcgattgtgcatatcaggatggatgatttggttccttggtttgtactaggtaactaaccatggatagagtgtgatagtgagaaagtctgaattttcatcgacaaattaagccataaagtggcgaatgctacgtctctctcgtttttaatattacacagttacagctttgaagtctggatatctgagatgtagttctcttcttattattcatagggactagggttataaaaacccgtgtcttttctgatcaatccttggcatagaagata

SEQ ID NO: 22719 - DNA, 3048 bp, Zea mays
ataagaaactgaagctacctcaatcaataaaagacagcagctacttcaatcattgaaaatcgatagcatgaatgaacttgattctggaagtaacatcaaaagtccaagtacattctgttccttgttcaaaccaggctttcatcaatgcccaaaaggtggcagtgcaagaacatatcaaagacaaaataaaatctctaagaacaaacaaattcaggggagaagaaaaacatgacatgttccaaattcaataaaagatagatgaaatctaccaacatgctactgcacttctgcaattatagaattccataattttaaaaggatatccttttcatcacttcatggttccataattttaaaaggatatccttttcatcacttcatggtatgccatcacctattataaacaaaattctacttacaaaaaacaataacagcatagcttagaccaaggactgtaggaattactgttgataagcttcccatcaaagcaacaagttgagctcagtttgcaattcaagattgtaaattttactttgcatacaagcataacttctccaatgtcagcatttaacagtataatgttcaaaaaatgtgaggctatctcaaatcacacagttctcctcctgaatatatttttagcgaattcattaaacattgaagcagcagcaatgtaagtatctaagttaacaatcttatccaaatgaagcatttacttaagtgaatccataaaactaaaattatgtagttcactctcacctgatcaagcacagcctcagtgatcatatccccagcaacctccttcgactcagccaccacagcaagctcatctgacacccacttcctcccagcaggcgccgaagtgataacgttggcaaacctctgcagatccctttcctctttctgcagcgtcttggctgccttcttccgggccacggccagaaccacatggtccatggcctcttcgttcattaccacctcgaacgtaatgtgtccttcccagggaagaccagctcgacgaaccttgacagcaggtcgtgccgcgcccgcatctccatggtggcgagcatgccctggcagaagcgtctcccactggcgtagaatttgaacacgtcctgcccttccttgagcaggagtggcgtgtccttgccgtcgcctgtgccaagaaggctgaagttcttgtcgaagatggagtccctcgtggcgaacttggtggcccaggccagcgcgatgttctcgttttgccgcttccccgtaaagtagttgagcacgaagcagatcaggaagctgacacacgcgatctcgacggagaacgcgcggaggagctcagctgggctcctcttcgcggccggaatcgtctcggcaggagcctcggcggagggatctgactggtcggcctcggccggggcggcggagtcgtcggaggggatcgcttccggcacggggatgccctcgaactcgtcctcgtcccagaggtcgagcgccggggtggggtcccgaggcgtacgcgtagcggggttagggttcggcgcggatgtcgtcgtgacgggaggtgatggcgcagaggtggagagggagatgggcggagggggcgggaggtcgacgccgtcgagaccttcctcgtcatcgtcagcatcgaggccaccggccgcggagggaaggtcgtcggagtcgaagccctcgaagttggcggcggaggaaagggagatgttgagggcaatgagcagcaggatgaggagggttgcacgcgactgccggagccggatccagctcggcgctgccatagctgaggcagcggaggaagggtgtgtgtgtgctgggggacgacgaaggggatgactagcgcggtggtgctgtgctggggcctggggggatgatgcggaggggacaaagcatgtgtgccgtgcgacttgctagtactctgcaagtagtgatcgatgggatgtgagatttagtttttcttttcatctatttatcgactaaattttcaaataattttattcgtagtattattaaaattcaaatgactgaattagtttcttttcactatgggtgtttaaattgactagagctaatagttaactactaaaattagttaaatacattcaaacagtctagctaattgtttaatcattaactattttagcaaattagctcagataaatccactagtaattttttagccaactaattattagttatattgcattcaaacatcctcaaagttaccttaatatcttactttgtcaacttttttgacttttagatccaagaataaaatactcattaaacgaaactatagacctaatgaaccctaatatacgtagtcacataaacaactagcaatttacaatttactatagttagataaggataaaaatattataacataaatatatttaacaatcacaagataagtaatacaattgttgtggaaaacaggtagtgcgtatcgtgtgaagtaagtctaatatttatgaaaagtatagaaataagcataaattgttaaatgtatttatatcaacataaattagttttttttgttaagtttgaagttttgtttaacatgttttaaatttccatcatcactcgttatatataccgagtgcaaaaactaaaaccacaattttaatctttattgaaaggcttctttgtatatgctttgttagtgtatcaatgatgccacacacataacaaatgaggaaggaactcatattatacggacaccgctgatcacccacgccttctcccctattggcagtgattccacgtctcaaaggtttacaaatatctagcttcaccttgactagataaaccttctcgctgctagatcatcacttcaaagtccacctccataactctccaatttcatcccctatcacatgttttgccgctctgttcatgagacccatcacaagccacgccacatggtctagatcgaaatgaaggagaaatcaatttcatccaaggttttggacccatcaaaatctgctaccactagtacttccttagaaatcatccatggcccatcttttagagtctttctcttcc

SEQ ID NO: 22720 - DNA, 2408 bp, Zea mays
ctataacaaaaaaaactacctatatagaacaatagcagcacaacttatgccacatggtccataggttactgttgataagctttctatcaaagcaacaagctgagcccaatatattcaaaattgcaaattttaatttgaatacaagcataacttctccaacgtcatcatttaacagcatatgttacaaaaatgtgaggctatctcaaaccacacaagtttcagtagttctctttcgaatacattttgacaattcagcagtcaataagattcacctttatcgagttcattaaatattgaagcagcaagacagtgcaagcattaacaatattatccaaaagcatttactttaccaaatccacaaaaccaaaattctaaattaaagttcaccctcacctgatcaagcacagcttcagtgatcatatccccagcaacctcctttgactcagccaccacagcaagctcatctgacacccacttcctccccgcaggtgcagaagtgagaacactggcaaacctttgcagatccctctcttctttgtgcattgtcttggccgccttcttcctggctacagccagaaccacatggtccatggcctcttcgttcattatcacttcgaatgtgatggtgtccttcctagggaagaccaactcgacgaactttgacagcagatcgtaccgcgctcgcatctccatggtggcgagcaacccctggcagaaccgtctcccacttgcatagaacttgaacacgtcctgcccctccttcagcaggagtggcgtgtccttgccgtcgcctgtgccaagaaggctgaagttcttgtcgaagatagagtccctggtggcgaacttggtggcccaggccagcgcgatgttctcgttttgccgcttcccagtgaagtagttgagcacgtaacagaccaggaagctggcgcacgcgatctcgaaggagaacgcgcggaggagctcagccgggctcctcttcgcagccggcgccacctccaccggtgcctccgcggagggatctgatgggtcgacctcggccggcgcggcggagtcgtcagaggggatcgcttcgggcacggggatgccctcgaactcgtcttcgtcccagaggtcgagcgccggggtgggatcccgaggcgtaggcgtagccgggttagggttcggcgccggtgtcgtcgtgacgggaggtgaaggagcggaggtggagagggagatgggcggagggggcgggaggtagacgccgtcgaggccctcgtcatcgtcagcatctaggccgccggccgcgacaggaaggtcgtcggagtcgaagccctcgaagttagcggcaaaggagggggagatattgagggcgaggagcagcaaaatgagaatggcagcacggggcggccggagccggatccagctcagcgccgccatagcttaggatgcgggagtgaaggtgtgcagtgtgctggggaagacgaaggggattatggtccgcggcggtgctgggaaggacggaaggtggggccgtgggggaaccgtgcgactactgcggaagtggttgatcgttgggatctgagattcagttttttttttctctctctctctcatttggtgtgatctggcaatgggcgtgggaatatgatgcacatttcatcaaaaagaaaaaaggaaaaagaagtcccattcaacattaattagtcactgaatttcgaagagttctcaaactttaataccagagaatttatatacttaaaactcgtaatatttctttggtggttttactgaggcatcttcaagtgtttagtttagtttacttattaaattaatagatctactgagttaatagaagaaataacaattttaaattttgtccttctttaacaatcttctataataactttgtaaacaattctgcagtgaaaactctcaactattgtaaccaatcaaatgtttttaatagtttctttgcctcttacaggttcctcatctgaaacttttattttcttgatctactcgtacgtctaatttactccgatctctttataataacaccacacggaaaggaaatcgggtacggagtttttcctcatcacggaaacttacgtgctagagcaaatattttgtgattcttttattttaaaggagatcttttaccaaatcattggaagatatttttctaattttgctaataagatagatagttgtttttataaagctcttggagatgctctagcagtctagcgtagcagtatactccaactatcattcggtctctctcttatataaaaaatacagctttttctatgtaaagtcgtatgtatacggacttttacatcataattgtagagctcaacattataatttttataattaataattgtcacattcgatcatgactgggttatttttgtcaacatcatgag

SEQ ID NO: 22721 - DNA, 1903 bp, Zea mays
catatcatagttctatcaccattcttcacagttaatcatgcaagttctatttctcatacagcaaagcttatgcataacaattttttcgaagttacgtgggcgaatgtgactacagatatttcgggcacacatccaataaaagccaaaacgccagtgaggattcttttctcctcgatcctttttgctcattctcaagggaaacatcgtggcccaaattggaatgtaaatgagtctagcagacactcaacaggtgaatagcaaaagccaacccgtggtagattcaagagcggagcatcttcactttgggcccagatttcttcatttgcctagccctttccttttcatctttcctccggagtgcctcagcgcttagtttggcatctgtctcctccatgagtttcttcttttcagcctttttcctttgcagggcctcctgcctggcactctgtagttccctaaaagcttcctgagcagccttcgttctagctccatcagttttagagcgagcatgagagctgagcttataacgcccaaccaaatcaatgtagtatggcacaagagaaaccaatcttgtcatctctgacatgttgcttgcatctggcaatacaaacttgaatgtaaggaccttcttgtaggatcctgccaactggtccgaaaaatgaagcgagatgaaccactttccaaatttctcgcacgccttctcaccaagaacctgatcaagcacagcttcagtgatcatatccccagcaacctcctttgactcagccaccacagcaagctcatctgacacccacttcctccccgcaggtgcagaagtgagaacactggcaaacctttgcagatccctctcctctttgtgcattgtcttggccgccttcttcctggctacagccagaaccacatggtccatggcctcttcgttcattaccacttcgaatgtgatggtgtccttcctagggaagaccaactcgacgaactttgacagcagatcgtaccgcgcccgcatctccatggtggcgagcaacccctggcagaaccgtctcccacttgcatagaacttgaacacgtcctgcccctccttcagcaggagtggcgtgtccttgccgtcgcctgtgccaagaaggctgaagttcttgtcgaagatagagtccctggtggcgaacttggtggcccaggccagcgcgatgttctcgttttgccgcttcccagtgaagtagttgagcacgtaacagaccaggaagctggcgcacgcgatctcgaaggagaacgcgcggaggagctcagccgggctcctcttcgcagccggcgccacctccaccggtgcctccgtggagggatctgatgggtcgacctcggccggcgcggcggagtcgtcagaggggatcgcttcgggcacggggatgccctcgaactcgtcttcgtcccagaggtcgagcgccggggtgggatcccgaggcgtaggcgtagccgggttagggttcggcgcgggtgtcgtcgtgacgggaggtgaaggagcggaggtggagagggagatgggcggagggggcgggaggtagacgccgtcgaggccctcgtcatcgtcagcatctaggccgccggccgcgacaggaaggtcgtcggagtcgaagccctcgaagttagcggcaaaggagggggagatatggagggcgaggagcagcaagatgagaatggcagcacggggcggccggagccggatccagctcagcgccgccatagccttaggatgcgggagtgaaggtgtgctggggaagacgaaggggattatggtccgcggcggtgctgggaaggatgcgactactgcggaagtggttgatcgttgggatctgagattcagttttttctctctctctcatttcccgggccggccggggggtccccatgg

SEQ ID NO: 22722 - DNA, 1530 bp, Zea mays
gatgctgagcagcgatgttgctagaatctgaaagcatgtaatccgagcatagaatttcatatcatagttctatcaccattctacacattgaatcatgtaagttctatttctcatacagcacaggtcttgcataaccaaattttcttagaagttgcgtggggccacggataattctggcacacatccaataaaagccgaaacgccagtgaggattcttttctcctggatcctttttgctcattctcacaggattagaatataaatgagtctagcagacactgaactatatgctaatcaacaggtgaatagcaaaagccaagatatgatagattcttgaatcatgacgttgttaagagcggagcatcttcactttgggtccagacttcttcatttgccgagccctttccttttcttctttcttccggagtgactcagcgcttagtttggcatctgcctcctcgatgagtttcttcttttcagcctttttcctttgcagggcctcctgccgggcactctgtagttccctgaaagcctcctgagcagcctttgttctagctccatcagttttagagcgagcatgagagctgagcttataacggccaaccaaatcaatgtagtatggcacaagagcaactaatcttgtcatctctgacatgttgcttgcatctggcaatacaaacttgaatgcaaggaccttcttgtaagatcctgccaactggtctgaaaaacgaagcgagatgaaccacttcccaaatttctcaaatgccttctcaccaagaacctgatcaagcacagcctcagtgatcatatccccagcaacctccttcgactcagccaccacagcaagctcatccgacacccacttcctcccagcaggcgccgaagtgagaacgttggcaaacctctgcagatccctttcctctttctgcagcgtcttggctgccttcttccgggccacggccagaaccacatggtccatggcctcttcgttcattaccacctcgaacgtaatggtgtccttcccagggaagaccagctcgacgaaccttgacagcaggtcgtgccgcgcccgcatctccatggtggcgagcatgccctggcagaagcgtctcccactggcgtagaatttgaacacgtcctgcccttccttgagcaggagtggcgtgtccttgccgtcgcctgtgccaagaaggctgaagttcttgtcgaagatggagtccctcgtggcgaacttggtggcccaggccagcgcgatgttctcgttttgccgcttccccgtaaagtagttgagcacgaagcagatcaggaagctgacacacgcgatctcgacggagaacgcgcggaggagctcagctgggctcctcttcgcggccggaattgcctcggcaggagcctcggcggagggatctgactggccggcctcggccggggcggcggagtcgtcggaggggatcgcttccggcacggggatgccctcccactcgtcctcgtcccagaggtcgagcgccggggtggggtcccgaggcgtac

SEQ ID NO: 22723 - DNA, 2535 bp, Zea mays
tgcctgtcacaatgtcaccacgggtggtacgcaaaaccaagtccccggtatgattagcaaaaaagaccctttcattccgagccgacgcttttggacggctacattttgagtgactagaaatagaagatgctttgttgttgtggccgcttttttttttttttttttcttttttttatcagaagagtcgtctaaccattgaaatatgcgtgttttctgtttatttttatttcatactacagaactgaagttgctgatctatcgtataatttcctgtgcaggcaaaaacttggtctagctgagaaagtttctgtaattaccctgtgtcatattgttcacttgattggttcggacgatgcaaaattcctcataacagacatgggcactcattctgaagttctggatcaatgcctaagatccacaaaaatacaaaatccgcaaggtggatcagcattttgttaatctacttagccttcttcttttttgctttcttctttttcttttgaccagcttctgattcccgtttgaagatagccagaatttcaatgctatctgtgccagggaagaagttaaaagcatgagcattttccaactgccaggccttgctggatatcaagcttttgcagtccctcttaaaactttcccatccacagctaatgtatatgagagtttcaggccacgtttcattgccctcttcagttgttgtattatcaacatgaactgcagcctcccttgcccgtaagatccatggtctcttctcatccttgacctttgcaagcgaacttttagccttgtatgccttgcgctcagacaaagcaactttctgtaaaccgctgataacagatgggtgcaaccctttccttggtggatccacaataacaacacttgacccttcaagccagtgcgaaggttcaactgaagcatcggtattgtgccaagtaatggtgcaacccaggttcgctggaagtcggcttgctgatgtctcaaaagacatctttgactgtttgttaatctcgatacatttcacagacctacatttccttgaagcagcaactgataggccaataacaccagccccagagtacaaatcaacaactgttgaactacgtggtacatacttgttcagcttatgcaacaaagagttaaatgacagagtattagcctggccaaagctacaaggatccagagaaatatcaactcccccataacgctcccacatgtccctctcccccttaagatgtctccatttatgcccaaaaattatgttgctggttgatgtctgaaaattggcccatatagaatgaatgagatggacactactttttggcccaccatttgtccacaagtattctattattgaagtcagcttctctgcgttctgagagcgctcgtctcttgaattccaaaccaatgaaacttgaactttcccttgctcgtatcttttatcaaccggaatagatgtgttatatgttgtcacggccatctgaacatatctgagttcaccagctccagcatcttcatcaaatggctgaatacttagctcagttataccttgccttaacaacttaacagcagcattaatgcttgggtgatgagctctgcactctggaatatctataacagcatgcgtcccttcctggtataaaccaatcaacgggttctctggtgttccacgaacagctagctttgctcggcaccgccattgggacagcctgcccctgctgaaggtgaaatctccgaccccgtgtcccttgaagaaattcgccacctcctgcagcaccggcggcttgtcgaggtccacctcgtgcgtgcaccctgagcacttgccaaaatggacgcagtcgaggcaggtggacgaagaagacgctgcagaggcagtggagggaggcaggagtgtggcgacggccgctggttttggcgcagcgggctccaggcggggcggcagtggcgtcgtagcaggcggaggcggaggaaggcggacgcgagtgtaaggtggaggcggcggccgaacgtgggtggtgcgaggaggaggccgcgtcggggtcggggtcgcgaggcgcgtggtggacggcgtcggccaggggggcagccccgccgggggaggcatggctcaccggcggtgggtgtaccactgtaccgtatgcaggcgggaagtgaagagggaaacgtggggaggggataaggattaaggagggaacgacagaccccggccagcctcgagggtccagatatttactacaaaccatatttttaagattgacgaagttattttatatgcatattcttgcttggtattggaggcttggagcacagttattttcaatgggctgagggcccaaaccggtcttcttcggcgagatacagcccagcaatcctgagtcttcgagtcgccggctcccaacatgagccatgacatgaggtgacactgacagaatgcactacagctgtcgatatatccagctgttgatattgtttgagtctttatcaaggttttaaatagccagctattaggggttgatatatccatatatatatttt

SEQ ID NO: 22724 - DNA, 4209 bp, Zea mays
ccagtcgcccgccgcggattggagaggctgcgcggggccatcgtctggaagcttcgcgggacggaggagtgaaaggtttcatggaccatcggtgtccgatcggacggctgaaaaatatagaatgaggtggatagactagttggactcgtttccgttgactttaaagataaagaaatttcagcaatccagcttaatcccctagtagagtcagaagccccaatccatcagcagattgaataatctggcatcattggagcgtacgtccactacgaagtacgaccaatctggccgccttgtgagttgcgagttgcgacttctagcatatcatcggcatcgcctgctctgctggtgaagagcgaaggccgaaggggccaagaccacacgccttccaaggtccacacctaccccaagagccgcccgccccatcagccgccacgatgtgcaccctggagcagcgcggccgcgtcttcgtcctcacccttaccggcgacggcgagcaccgcctgggccacgccctcatctcctcgctccgatccgccgtcgcctccgcggcggctggtgcggccaaggcggggcccggggccgcgctcgtcaccgtcggcgagggccgcttcttctccaacggcctcgacatcgggtgggcgggaacctcccgcgcgcgcctaggcgagctcgtcgacgcgctccgcccgctcgttgccgacctcctcgcgctccccatgcccaccgtcgccgccgtcaccggccacgcctccgcgggcgggtgcctcctcgcgctctgccacgactaccgcatcatgcgcggggaccgcggagtgctctacatgagcgaggtcgacatcggcctccccctcccgccctacttcatggccgtgctccgcgccaagatcaccgccgccaacgcgctccgcgacgtcgtgctcaggggcaagaaggtcagggccgcggagggcaaggatatgggcatagtggatgccgtctacccctctgcgctcgagacggcggaccaggccttcaagtttgccgagcagctcgcggcgaggaagtgggacggaggcgtctacgcgtccataaggatgtccatgtaccctgaggcctgcaggtcagttggaatcgtcgaggagagcgatgaggagaagcggaagcacttcgcttctaagctctaacttcgtgattggctgatgagaggtcagtatccacgcagattcagtatccttggagtccctctgttggtgatgagaaaacatacggtttcatctgtgctgtgtttactgatagtttggctgtgctgtagccagaatcccatatcaaatcagcatcaaataatttgactgatgttgttggcttgtagtaagaattgcttagtttgcgatccaattcagtcgaggttcatctatatccaaggttagtggattttggaaactttttccgaattaatcaactttagacataaacagtggcagggctagaagtgaaatagatgggcaattacgtacttcactggaggacattaataaccgaaggcaaccttagagaagaataaatccaacaataaaatcaatctaagggttcagtgttattgttttagtaataacaacagtatctgaaatatggggaattggtctttccatctccatctccctgtcatcgtactactaggtactagctacaatttcaaattgtttgtgcttttctatttgattccatgagatttttgtttttatatgcaactgattttgtgaggatttaatccaagctgggaggatgagtctaacaaggctttgacccactgccatctatcatattttttgttattctagtctcgtgattgttttgttagtggaacaattcctcaagaaagacccacaagtttggacagctactactgactactttgatataaaataacctaaagagcaagtagtataggtatatagctaacttattagtattttgaatatcatgcttgacaatcatgatacaatcacattttttatcatgattgtgaatttaatttgaaggtgacctgcaaaactgatatttgcatcactgtcacttttgactatgcatttatgatggacctaacctattagtttcccccatatcccggataaaaaatctacctagtttcagtatagctctggcctttgagagaagcaattttattgggattcatctggagctagatgttgctacttgctaatccatctggtgtgaatcagcttcctttgttgcaatttcctattgcatagagcatctccaacaaggtacctcaaaatagtgcccccaaattaaaatactagatcagttaaagtgattaggacaccaaaaacaaattgaggtccaataattaaaccataaatcatgtatcttaggaagtaaattacattattagaaaagaaaatattttgaatgatgtagaaaacaaagatagggcactaatctgagttgtagtatatttgggtcacttcatagtgtgcctatatttttttaataaaaatttataaaatgaggtattattggagctgtttttttttatgaattgagccctatatttcatttaaggcactgttggagatgctccaagactgggttttaggccaaaggccaggtctcatgctttttgtgacaataagactggtgccgtagtgtatatggtattatggtgtcactttaagcagttacagtcttactggaccttgaggtctccattttcagcagtgtggtgcccaagtaccatcacccagaatcgttctatcgtaccaccaaaatcatcttcatgggtttactgctcagatcacatatggttaacttgtatatttggtaccaaaaatcccctcctgatcattgtctcatgtaacctagtttgcagtttgcatcaatacatagatgatcttacatagcgtcactgtacgattgagaatccacttcatggtatgcatttatgaccttttaatcatcatttatttagattcacaagtcatgttggaacaaaaagtgctgtcggaacttgaattacctcctggcatccgatatgtgtatgctgtgcttttctaagatggttttttgttcgtatttctgctctgtggtcatgtggcagctgtaaacctctctgcctggactgtctggaattgctacaaatcaactctgttcgagtttctgaaccagcccctcttttcttttctgcagggtttctgtggaagcatggaggaacctacacattctgtatctgtacatcgtccaaccattggcgctgtcgctacgtgtgaagtacacacgtgtacttgtgcagaccttgtaatttttacttgcctggtagcgggaaataaatcgaagctcctctcaccctttcttaaaaaaaaaaaaaaagtaacattatcgatatgtgttcatgtgttgtgcttgattccaaaaaaaaaaaaaaaaaaaactcgtggggggcttagaacttgcgaatggtcccgtggtggggtatcttgcaagttgcaagcgggtacactccttggctgcagctcgccatggattagctcttttccggctttgattgaccggaaaatttccataacgaaattgtcgcatcatgtctaacatgagatgacgagagtgcctcgatcatgtcagtgtcatgctggctgtactatttaggcttgtttcaaaggaaagaaaaattgacatgaattttgaggaatggcatttacgtacaaagttgcttacgaatttggactagaagatacaactctgagtcgtacagaattttggtgtagcttttgttttgtagggcatataaaatctagaaactctagaatgattttctaaatacaagagtcagttaaaaaaagttaaaaatacaagagacagttaaaagaccttaaaaattgtatgataaaactctgagttcctagattacgaatactattaagaattgtcgatgtttggaccgtgggtacttaactaaccaataatatgtcgcgtggctagctctagatggtgtgcgagataacacaagcgattatcctggttcgagcttttcgagatcctactttcagcagagaggataaggcttatattactcgcaccgtagtgcctgtagtaggggtttacaagcacagcgggagaggtgaagtccccaagttcctagagatgattgaagcaagtgccaatatctaagacagagtgagaaggcaagaactcgtcaacgtgtgtctccct

SEQ ID NO: 22725 - DNA, 1359 bp, Zea mays
  misc_feature (1314)..(1314): n is a, c, g, or t
  misc_feature (1341)..(1341): n is a, c, g, or t
atcatcggcatcgcctgctctgctggtgaagagcgaaggccgaaggggccaagaccacacgccttccaaggtccacacctaccccaagagccgcccgccccatcagccgccacgatgtgcaccctggagcagcgcggccgcgtcttcgtcctcacccttaccggcgacggcgagcaccgcctgggccacgccctcatctcctcgctccgatccgccgtcgcctccgcggcggctggtgcggccaaggcggggcccggggccgcgctcgtcaccgtcggcgagggccgcttcttctccaacggcctcgacatcgggtgggcgggaacctctcgcgcgcgcctaggcgagctcgtcgacgcgctccgcccgctcgttgccgacctcctcgcgctccccatgcccaccgtcgccgccgtcaccggccacgcctccgcgggcgggtgcctcctcgcgctctgccacgactaccgcatcatgcgcggggaccgcggagtgctctacatgagcgaggtcgacatcggcctccccctcccgccctacttcatggccgtgctccgcgccaagatcaccgccgccaacgcgctccgcgacgtcgtgctcaggggcaagaaggtcagggccgcggagggcaaggatatgggcatagtggatgccgtctacccctctgcgctcgagacggcggaccaggccttcaagtttgccgagcagctcgcggcgaggaagtgggacggaggcgtctacgcgtccataaggatgtccatgtaccctgaggcctgcaggtcagttggaatcgtcgaggagagcgatgaggagaagcggaagcacttcgcttctaagctctaacttcgtgattggctgatgagagggtttctgtggaagcatggaggaacctacacattctgtatctgtacatcgtccaaccattggcgctgtcgctacgtgtgaagtacacaccgtgtacttgtgcagaccttgtaatttttacttgcctggtagcgggaaataaatcgaagctcctctcaccctttcttgaataatttgccccagtaacattatcgatatgtgttcatgtgttgtgcttgattccacataatttcttggtcctgggagtttggaagcttagaacttgcgaatggtcccgtggtggggtatcttgcaagttgcaagcgggtacactccttggctgcagctcgccatggattagctcttttccggctttgattgaccggaaaatttccataacgaaattgtcgcatcatgtctaacatgagatgacgagagtgcctcgatcatgtcagtgtcatgctggctgtnactattaggcttggttcaaggaaaganaaatgaccatgatttttg

SEQ ID NO: 22726 - DNA, 974 bp, Zea mays
taattgttcacgaagatgtgatatttttttttttttttttttaataataacactaaaactttattctatgcaaagagatgtctttacaatatgtgccatatggatttcattttaataacactacaggtttattccgtgcacagagatgtctttacaatatgtgcaatatggatttcatttttgagaagagcatacacagacgggatattgatcgatgaagcattcttcgcttatgagtacatcaatgagccctgatttcttccaaattcaaggtactgggagggggatatgggtttaggacccccaaaccaatcaatcaagaatatgttttcgatttccattttgaagattttgaaatgatgattctttggccaatccttcatttcaggatgtttggtaaaaagtgctgacttggccaaatctgcttcagatgactgaaggtcaaccatcttcaactttccattaagagtaagttttgcacaagtggggttttcaggatctatttccccacaagttcccagagggaactcactaagggtaaaagaggtcctttcatcttccagtgcatctcttgcactgggatccagagttgtcagataaaagtagggtattccacggccctcgcctggtactccatcactatatgaaactacattgccaaatggagctccacttaagtcacttgatattgtgctgaggacaccccacgtgttctgggcggcgagccacctcgcagtggcggtggcctcggagggggatggcttgccatcgaagatcgggcgggcggcagcagcgccaggcgccgacgaccggacgacgaggaggaaggcggcggcgaaggcgaggtgagcaggggaaatcatagctgtcagctggtggaagagtccatcgatgcctcggtgttttgtaccgtagccaattttcctctgtgccagctgtcgagagggttgaaggaggcggacgcttccggccgg

SEQ ID NO: 22727 - DNA, 2441 bp, Zea mays
tagatttaaaatgccaaatacaatgcaaataattgtctgaaaacattgaactatattacctcgcctacaacaatacaaataattgtgaaactatactatcatgtcataataacaattaacaaatagatttgaactatgaattatcaactattttcaaaaaatcaactaacaaatgtacaccaatcgtcatcttctaccactgaacatataatactactaataaatgtgcacaaacctaaaaacgagtggaaaacagtgattaccgagcagttatcaacgaatcttgtcgttagtgtgccgaatctcgtccgtgtctaaagctggcgcgccctcgcttgatatgtcagaatccggtgttttcttgtcaagaaacgatgaaatctgaccgaatctcgatgtattttgggcgagatctctcattagtgtcacttgcgacagccgaaagctgagggagtggaagaaagagagagaatgaaatgagtggagttgtcgggtgaaggctgtgaagtacataggagattttttattaataggttcgagtttcggttaacggttcagaacaattgaatttgaattttagtttgtatgaaaatatagattttttttaacaataaatatacttctgaacttctaagaacctctaatttttataaactcttttcaaaacttttatatttttttaaatttcaaacgaaaaatttcaaaaaatcagtgaatttcgtttccgtcgtttgtcgggaacgggaaaaaacgcccaaacccgtcgaatcccgagcgggatttatatcccaacgacacaaaactctggaagtcccgcatctcccgaaaaaacgccgcgacctacacaagaagtgacctctgacctccacagtctataacggcacgaccctcgctcatgttctcatcttcccactccttccatttgtcctcttcctctccctcccacgccaccgtcaacgagctccagagccccgcaccgcgccgcccgccagcaaccaccccctcctcacccagatgccgcggctgccgggatcgcagcctgcgccggagcggcgactcgccgtgctcctgtcccacttccacccgtgttgcgaacctccacgcaccatcgcctgcgtcgccagcgcggagtgcctccggaccgcagccgaggaggaggccgagatgcagttgagcctctccacgtcgccctgcgcaggaggtgagaaggggggatcctcgggtggcgggcactcgcgtgttctgcaacatcgtcgcgggcaccgcgcaggccttcaaggttagtatgcacgctggcgcctcccgctcccagcctgttcaaccattcttgtaattgcgtcgctattcgaggcgttctatatttattctggtttttccagaactttcgtggactgtggggattttaaatttgctctcgtgatgtcctcgtgtgtcagttgttgatgaactggttgactgtttattgattaattcggattgttgtgtgcttcattttgcagctctacgaggatgatatgtgcttgtgcatcctggatgctaaacctctaacaagcgggtaagggtttaatgctcttctcacttgtcagctctatcattacttcagttcttggtgtgcttaatttcgttaagttactcgagtttgtcacccacgattaaaaccaaatacagatagtgacttgttgtgtaacgtgagttttcactgggtgtttgattttgtttgagtaacatgcagtttttgttatttgtctgcatcaagtttgtattgctttgtttgctatgttctattgacgtgaattgacaaagaatgtctgaaataatatgtactaatagtctgtatgttgggtactgaaggagttgagatcgcttgctcgataaaggggtaatctagactcttttttgtgcaattgactaaatagtttttgaataggccatcggatagtcaagttttcgcactagaatgaatggatgacaatgacataattaatgcctaaagcgaaagaaaacattactgctagaatctggacttgaatgttttggtcttcactcttcagtgtttggataaatcatagatgctatatgcaaaccaatcttttctgcccttgagctgtaaatttgtagaatactgaaaaactgggaatgataccctattggacttacatctctgctgtagtttgattgccatcattcgagtgttttttcaagaaaatctaatggcacttcttgccccttcattggacattgtgatttatgcaccagatgacatgagtacttttaaaatctgtgcaattgttagtcctgtagattacctctttcatgaagctagaatttgcattgctgagttcattcgagtgccattatatagacttgtggtattgtttgatcaggacagatatatcctcaacggtggcactcatacaaaaagtagtagttaagatgcagct

SEQ ID NO: 22728 - DNA, 6948 bp, Zea mays
  misc_feature (18)..(18): n is a, c, g, or t
  misc_feature (46)..(47): n is a, c, g, or t
ttttttttttttttttgntttttttttttgctgtgaacttttgttnnttttttaaattatttatttataattgctataagacagccgctgaaaatagtcatacaggccaattttgggggcccagtctcaccaaatttgtaaagcacggctcagcccatacaacggttcggcccctgcaagacagtaacactgcgcacctcgctgccggcacggttcgctcgctagaacggggttacagccgcacagggtaacgagatggcggcggtgcttacccgagccggcggccgctccaagcgatccgtctccggcttccacctccgctctgttctcgcggggcacgggaccttctcatctgaagccgcgtcgaccgccgtgggcgaatcgcgtggtcgcggctacgggcgagcacgatggggacgacctgcgcagccgcatcttccgactgggcctggcgaagcggagcgcgacggcggcactcgagaagtggtccagtgagggacgcgacgcacccacggcggagctccgccgcatcgcgcgcgacctcacccgcgtccgtcgctacaagcacgcccttgaggttcggcaccggcagaatccttgtcccttgttattattgctcctcctgccataggcctcgtgaatgcggggtttaattcattgtctgtgctgcgcaatgaactttgatctaatgtgttctttttttgttgtggaaatggataattttttgtacaaaactaggcaactagcaatagctaccaagaccaacggcaaggccaaaacaatagaaaaacataaatggaaaagttccaaataatgctcctcccatgacaggcaaaaactttgcatcactgctgtgtccaaaacctagccggctatgatatgagaccctctgaataaaatctgtacaaaagaatttgtgatgtgcacgcgttgtaggtttatctacctgaataattaagatggttcggttggctctttacagtgccgctgctgatgcttctggtttcatcaacaggccgagcttttctaactagattttgctgtgggttagtaagctgtattcatgtgctgtaactttgttccttattgatgagggtgcctatgaagatgctcatgaagactggcatgatggcgaaggttgcagctatgatcttataattagtaaccaacatctcatcaattgaatttgtctcaagtattccttttgttgccattttaatgctaactgatactagctattgcgtttctatatttttacaacatgatgagccatcttacctttacattcctttgcgaaatggtcttgtgtcattgagatcggataatcctgtatgagaactatcgctaaccctgaaggatgtcatcggccagacttttacgttggcaaagcttatagcatatattcctttcctcttattttgtttggttgcttatgctgatacccaccataccctagcaatattacattttgtcgatggtggtttacacctttccccttctagggagaaaaaaaatacagatcgctgtatcaactaactattaactgcatattttacaggtagcagactggatgaagacacatcacgagtctgatctatcagagaacgactacggaatgcgcatcgacttgattaccaaggtcttcggtgccagtgccgcggaagatttctttgagaagctcccaccgggagccaaatcgctagaagcctacacagcacttctgcactcctatggccggtcgaagatgacggacagagccgaaaggctgttcgagaggatgaaagacgcgagcctgcctatggacgccctggtctacaacgagatgatgaccctgtacatctccgtgggggagctcggtaaagtggaggccgtcgcagaggagctgaaacggcagaacgtctctccggacctgttcacgtacaacctccgtgccagcgcggccgcggcgtccatggatctcgagggcttcagagcagtcctcgacgagatgtccagagacccgaagtcgtccacagaaggagggtgggcgctgtaccgggacctcgcgtccgtgtacgtcgacgcgggccagcttctgggctctgtgaattcgccgccggtggaggccggggaggcgaggatcagccagagggaatggatcacctacgacttcctcgtcatcttgcacgccggcctcggcaggccagagaggataagggacatctggaggtccatggtggcgacctcgcagtcgcagtcgcagcagcagcagcgcatgacgagccggaactacgtctgcgtggtctcgtcctacctggcgtgcgggcggctggaggatgccggggaggtcgtcgaccagtggcagcgctctaaggcccccgagttcgacgtctccgcctgcaaccggctgctggacgccctcctgcgcgccggtctcgccgacgccgcgggtaggtttcgggagctgatgctgcagaagcgttgtatactgactagcagcagcagcagcagggcggcagtggtcgagtgattacgggttggtttcgagtctgttctttttgttgttgttgtcttgtgtgaaggaataaacaatggacagcccaagcactctgcacgttacgttattctctgacatgattgatgtgatcatgtctggttagtgggttacgtacgtacatagtgccaggctcgtggcatgacgaagcacactgagaaactgtgtacggccatcggtgcgcgcgttcttgtgaccttcgtcttcttcctggccctaactaccctgcaggctgcagctattgtaaagacgacaggtacagcggctacgagctggcggaaacgatgctgttgcatactgtttgtcctatgctccacattctcgccacgaagatggtgacgttgcgagttgttgtttcatgattgtgcgtggaataaagataccggtcgcaagccacaggagttttttcaagtatttcgagtcctttcatgcgttgcctaccaccaccttccattccatccacggctgctttgatagcccccgaaacctcagaatactcccggtcccggcccggtgtcaaacactcggcacacgcctgcctgccatccgccgctccttcggcacagtcgcgctcgcgcagatgtaaaacgtgccaaccctgcgtcaaagatccacccagatgcaggaactgaactaggcgggtctgggatcggcaagaaagagagaggggcaagcaagtatttcgcccaactcacgagtcacgacgtgggatgtaggcatccgcagcaccaccagcgcgcgtctagctagcaacaccaatcggtttctcactttctcgtgccgtcaaagcaggattcgctccacagcagacagaccggcggcagaagtggtgccgtttccccaaatctgtgcctctgcgtgcgtgcttcgcgaggagcgatggagacgcgccccctgctcctcgtgttctgcctcctcggcgccggcatggccgtcgtcgtggacgcgcaggcgcagtcggcgccggcgccgccgcctcggcagacgccttctgcgccgccgcaacagacgcagttcggccgcaccatgtcgaccttcatcacggtggccatcagcgtcttcttcttcttgctcttcgtctgcgcgtacatcaaccagtgccgcctagcggaccccggggcggcggcggcggcagcggcagcggcagcggcagccggcggcgggggcgggggcccgtccaggagggggaagcgcgggctggaccccgcggtcgtcgccacgttcccgattgtgtcgtacagggaggtcgtggagcacaagatcggcaagggcgtgctggagtgcgcggtgtgcctgacggcgttcgaggacgacgacgacctccgcctgctgccgcactgctcccacgcgttccacccggagtgcatcgacccctggctgcagtcgcgggtcacgtgcccgctctgccgcgcgaacctcgagaagccggcgccggcgccggcggtggcgcccccgtcgccttcgccgcggctagcgccgcgccagccttcgccgccgccggaggccgtggcgataccggtgtcggacgacggatcggaggggggcagcagcagctgcgaggacgacaggaaggaggaggccgtcgagctggagacgctgcgcagcgcgcggcgcgccgccaggatgccgcggtcgcactcgacggggcactcgctgttcgcggcggcggcgccccccgccgccgcggaggaaggcgaccacgagaggttcacgctgcggctgccggagcacgtgcgggagcaggtgctccggtctcgccgcctgcgccacgccaccagcctgctcaacctctcggacatgagttccgaggggagctcccgaggcggaaggggcgtagcaggagcaggaagctttggcaacggcggggggagcagccacggcgggcgccggtggcaatcgttcctggccaggacggtctcctgggcgcgaggcggcggcgacggctcggtgcggagaggctgggacgggtccacgaggagggggagggacggcggtgagtcaagctggaagggcgtggcgtcgccgccgccgacgggccggccgtgatcgaggccgcggctggaactggcatgctgcggccccgtaaagtttgacgagctgtgccttttcttttcttttttcttttgctgtatttgtttattgttaggagcatttcgtgatatatagctgccagattttcgcgacactttatttatctatctagcttttattctagtacctttctgcaaagattgattcgtctggtccgtagattttgattttgtgggattgatgattactgacgataagagaagaactcactttggtctccctgccgttctttagttaaaccctcatcagtatccttcttttgatttcgagacggtagcctctccttttgctgtcacgattcgacgtcagtgggagaagcattgtcctgccactgccagcatcagctttgtaagatcatctgcgatcgctaatcatcatttctcttcatgaaaggactgttcatcaccattctttacgaggtcttctctcagtactggactcttttggccgtggctgtgtgggtgtcaatctgacttggagagatcgatgtgcgagaaaaaacaatggggaaggttcgcgcactgggtagtgaccggcgtaaagaaactgtaaagaaaccatattggataaggaggccgtcgcccccatttcaaaggcctttgtttgggtcgcctagtgggcagtggctcctggcgacgggtttttgaattttgatgaagtctcttggctacggttcacaatcacgtcgccggacaaggacgacggtgtaccctcttgcggcagctagctagcgcccaggcgtgccttcacctgcacgctgcactgccgtggagagattttttttatttgttataaacagagtgctccagatatccaaaggattttcttctgcgaagcgatcgagaaaacgaaccatcatcatccgtgggcgcatcgcggaaagagctcaagtggcgccggacagaaacggcgccgatgacgtggcaactttagacgatggtacctatggtttggcaactttaggcgatgcattgcggtacctgtggtttggccgggttcttgctatctctagtccatgtccgagcaagtactctacgactccagggacaactgcagctaagccattggcaacgaagctatggatcttgtgaattcttcgtgccacagaccatggctattggctctcacccacctccagatggttaccctaaaaccgattagttttttatcataatatgtgtttagactagtttatctatttatatgagtttgctaacgtgttaaaaaaaaccaacaggcatgtaggcatccgtttgctactgcactactcactactggaatcgacggttttgccgagtgcctgaaacactctgcaaagactgaaaaacattcggcaaaaactttgtcgagtgtcgcactcgacacacagtacatcggcaaagtcgtctttgccgagtactttttctcgggcactcggtaaagaaaagccgccgtcacggcaccgaggtgacggagacggcgtctttgccgagtgtcctaggtgacactcggcaaagaagttacctttgccgagtgtctgccggccagcactcgacaaagaatccgtcagcgggtccccgtgtcaggttctttgccgagtgctttatatggcactcggcaaagcgtgcctctttgccgagtgccagggccactacactcggcaaagaacctataccggtgcccaggtctcgattctttgccgagtgttatggtcctgatcaccaacggtgaggtcgcgaccaaatcaagcgacgatatgatattgatttgatgtagtgggtaggttttcttgggggagattcaaaagatctatcaacttgtatctctatgtgcactagttgatgcaatgcattattcgatgtcactgaccacaatcaatgcaagtaagtgtttatagtccaatctctcgtacgtccagaaggaagaatacaaagcagagatggcgtaggttcaaaaacaccatgaaaagatgatgtatattggtagtgagtagttatattagacgttccccaagaatctagacgtccaaacaggtgtcgtaaacgtacgcatggttttgagggtttgctcgttcaatcctatatgcatagggcactggaacggggaaaacttgggagaaactcaataggataagagggtgtggtttgttcaatcctctctagagcgaggctaaaggcaaacacatcttatagacttaagagatgaaaggtgaaagatagataatgaagctggacattataaaacattcatcaattatatacatgagagttactagtaagttagccataaccataggggttactattaattggtgctataatcatagatgtcactagtaactgcag

SEQ ID NO: 22729 - DNA, 2010 bp, Zea mays
ccaattcgacatcccttcgaggccaaaggataaaattcttgatagcttgtccaagtgtctcgataccttcgggcccagggatgtctagcatgtcgtcctcgtatccttggacgactgtcgtcacttctacccggcaatattcttctggaatgtcgtttccatggaacttgcgtcctgggattgcaaggcctgtggctactttccttgtacgctgattgttaataccatatcttataactagtgtgcatgccacaggccttgtgatgtcatcaactggatagcggaccttatttcccattgacgcgacagagcttgggatggtcgtaccctcggtggaagccggcgtttgagctgctggaattatttgcatctgtggagtggtcatctgttgaacagacatcgcactcgccatcgccaattgctgcatcaattctagaggaggattcgatagcatttcagacatcaggcctttgaactctttcttggcctcctccttaaaataattcgccatctcttccttgtatcgatcacgtttcttgtacagaccttcccattgtggtccgaatccttccttccatccttccttagatgagattcctcgtacacgaccaggatgctcagggttaccgagaccagccgttagaatgtctctctccctttgcggcttaaatgttccttggctctgcttagctgcaattgcatatatgttttttgccgcttcttcgacagtgggatcatcaaaagatacaccagactcagtttcccttggttttctagcacggatccaattagctgtcctttcaccgagttgctcggacagcgtcggcaaccctgcagccttcttctcggcgtcttcttgtctccatttaggaacctgacgcttgtaaccacctgtgccaaggtggtggcggtatttgttcttcttagacagttccgaatttgcctcacttagcgatatgaaatcagggctgctcctctgctctagaaatactgcccactgacctgctgagattttatattttttcgtcgggtctaggcctttctttgcaaactttgtattcatctcagacctccagtttcggaaattgattgcaaactgcttcatcgtgtattttttcacgagttcttctgaacccccaggcaaaacgaacctcgttattagcttattccacatttgattcttgacatcatctgatacatctctccactgtcggattgtgatgtcaagattatctctaactaagaacccaagtgcattccggaacttaggcagtgcctcttctggagctaggggctgaccattcgggctcacgtctgtgattttatatgtcttgtcaggaaacttgtttagccccctgtcacctctgttccgatcgctctgcttccttttccttgacctctcggtggttgtctcggtcgattccggtgcgccttgggtcggttccggtgcgccttgggtcggttccggtgcgtcttgggtcggttccggtgcgtcttggttccgtgccgcagctttttcgagcatcgcacgaaattgagacaagacctcctattcatgtaataaaatgcacaagaaatcatgcatgtgtaatagacattgtgaaatcagctaattaattaggtacacacacgaaattaaggatgtgtaatttacctcatggttcttgtggatcactgctggggtcacgttgaaactcacgcgcagcggccctatctatcctagtggtaggaaaagggtcgctaggcgtttcatatccttcactgctggattcttcttgagcaacactcttgtccatgtggtcgggccctaatccttggtccttggttggagaactcattgagctacatattaacataagcaataattaaattcatattaacaaataccctaacccttaaccactaacactaaccctaagccctaaccctaacccctaatattgtgatacgaatattatcgagttacgtatagagagggagagtcgtacaggacgtagagagagatggaag

SEQ ID NO: 22730 - DNA, 2126 bp, Zea mays
cttagtttctcaagaggtagcagaggtctgcccggcacatattttttaggcacgtttttgtaatctgccttagttggcttctttatctttgcggccattgcctcagccttttttgcagactcctcgtgcttggccaaatcaacagtttgtgacgtgaggctccgtccaatccctttcaaaaaccgagttgtgccagcagtagtagctttactcttctttttctgatacggggacaccaattttggtataggaagtttagatttctttgatggccttggatcctttgatggttgtggagaaggtggatcccttgatggtggcgtagacagtgggtcaccaagaggatggggaggagaaggtggtggagccctgaatggtgatgcttgtggcggagacggtgggtctgaaaaaggatgaggagcagcatgtgaagtttgaggaggtgaggatggatgtacaataggaacagcaatttgagaaggcggagacggttgggcctgcgacgcctgcggcgaattcgaccaatcaagcaattcgacatcccttcgaggccaaaggataaaattcttgatagcttgtccaagtttctcgataccttcgggcccagggatgtctagcatgtcgtcctcggatccttggacgaccgtcgtcacttctactttgcaataatcatctggaatatcgtttccatggaacttgcgtcctgggatcgcaaggcctgtggctactatctttgtacgtttattgttaataccatatcttataaccagtgtgcacgccacaggccttgtgatgtcatcaactggataacggtccttatttcccgttgaagcaacagagcttggtaatgtcgtacaatctgtggaagccggcggttgagctgctggaattatttgtatctgtggagtggtcatctgttgaacagacatcgcactcgccaactgttgcatcaattctggaggaggattcgatagcatttgagacatcatggctttgaactctttcttggcctcctccttaaaataatccgccatctcttccttgtatcgatcacgtttcttgtacagaccttcccactgtggtccgaatccttccttccatccttccttagacgagattcctcgtacacgaccaggatgctcagggttaccgagaccagccgttaggatgtctctttccctttgtggcttaaaagttccttcgctctgcttagctgccattgtatatatgttttttgccgcttcttcgacaatgggatcatcaaaagatacaccggtctcggtttcccttggttttctagcacggagccaatttgccgccctttcaccaagttgctcggacagcgtcggcaaccctgcggccttcttctcggcgtcttcttgtgtccatttaggaacctgacgcttgtaaccacctgtgcctaggtggtggcggtacttgttcttctttgatagttctgaatttgcctcacttagagatatgaaatcagggctgctcctctgctctagaaatactgcccactgacctgctgagattttatattttttggtcgggtccagacctttctttgcaaactttgtgttcatctcagacctccagtttcggaaatttattgcaagctgcttcatcgtgtattccttcacgagttcttctgaaccccgaggcagaacgaacctcattaatagcttattccatatttgattcttgacatcatctgacacatctctccactgtcgtattgttatgtcaagattatctctaactaaaaacccaagtgcattccggaacttaggtagtgcctcttctggagctaggggctgacctttcgggctcacgtctgagattttgtatgttttgtcgggaaatttgttcagccccctgtcacctctttttcgatcgctctgcttccttttccttgatgtctcggttgttgtcttggtctgttccggtgcgtcttgggtcggctctggtacgtcttcgtatcgtgccacggcttcttcgagtatcgcacgaaattcagacacgacctcctattcatgtaataaaatgcacaagagatcatgcatgtgaaatcagtagggtacacatacgaagctaaagatgcgtacttttacctcagcttctcg

SEQ ID NO: 22731 - DNA, 1457 bp, Zea mays
gcacggttcgctagctcgaacggggttacagccgcacagggcaacgagatggcggcggtgcttacccgagccggcggccgctccaagcgatccgtctccggcttccacctccgctccgttctcgcggggcacgggcccttctcatctgaagccgcgtcgaccgccgtgggcgatcgcgtggtcgcggctacgggcgagcacgatggggacgacctgcgcagccgcatcttccgactgggcctggcgaagcggagcgcgacggcggcactcgagaagtggtccagtgagggacgcgacgcacccgcggcggagctccgccgcatcgcgcgcgacctcacccgcgtccgtcgctacaagcacgcccttgaggtagcagactggatgaagacacatcacgagtctgatctatcagagaacgactacggaatgcgcatcgacttgattaccaaagtcttcggtgccagcgccgccgaagatttctttgagaagctcccagcgggagccaaatcgctagaagcctacacagcacttctgcactcctatggccggtcgaagatgacggacagagccgaaaggctgttcgagaggatgaaaggcgcgagcctgcctatggacgccctggtctacaacgagatgatgaccctgtacatctccgtgggggagctcggtaaagtggaggccgtcgcagaggagctgaaacggcagaacgtctctccggacctgttcacgtacaacctccgtgccagcgcggccgcggcgtccatggatctcgagggcttcagagcagtcctcgacgagatgtccagagacctgaagtcgtccacagaaggagggtgggcgctgtaccgggacctcgcgtccgtgtacgtcgacgcgggccagcttctgggctctgtgaattcgccgccggtggaggccggggaggcgaggatcagccagagggaatggatcacctacgacttcctcgtcatcttgcacgccggcctcggcaggccagagaggataagggacatctggaggtccatggtggcgacctcgcagtcgcagtcgcagtcgcagcagcgcatgacgagccggaactacgtctgcgtggtctcgtcctacctggcgtgcgggcggctggaggatgccggggaggtcgtcgaccagtggcagcggtccaaggcccccgagttcgacgtctccgcctgcaaccggctgctggacgccctcctgcgcgccggtctcgccgacgccgcgggtaggtttcgggagctgatgctgcagaagcgttgtatactgactagcagcagcagcagggcggctgtggtcgagtgattacggattggtttcgagtctgttcttttgttgttgtcttgtgtgaaggaataaacgatggaccgcccaggcactctgcacgttacgttattctctggcatgattcatgtctggttagtgggtcaaaaaaaaaaaaaaaa

SEQ ID NO: 22732 - DNA, 1663 bp, Zea mays
tttctctttgctttgctcttgttaggatactccttgcgttccgcttagcgtggtcttgaattcgcttgatgatgagagccatctcatcttcgtttagcccgaccacctctatttgtaccaccttgcttggtggcgcctccttgctacttgttgctttgagagcgacgagttgaggctcgtagacgggcatggggtcgtttaatgcatcatcaacatatcttgcctccttgaccatcatgcgcccgctcacaaattttctgagtatctactcgggcgtcatctttgtgtacctaggattttcacgaatgaggttcacaagatgagggtcaataacagtaaaagacctgagcaatatcggacgacatcgtggtccgtccatctcgtgcttccatagctcccgatcttgttaaccatggtcttgagcctgttgtacgtttgcgttggctcctctcccctgatcatagcaaaccttcctagctcgccttccaccaactccattttggtgatcatggtggcgtcgttcccctcatgtgaaatcttgagggtgtcccatatttgcttggcgttgtccaagccgctcaccttgttgtattcatccctgcacaatgatgctaacaaaacagtggtagcttgtgcattcttatgaatttgttcgttaatgaatacagggttattcgtactatcaaattgcattccattctcaactacctcccaaatactaggatggagagagaaaaggtgactacgcattttgtgactccaaaaagcgtagtcctctccatcaaagtgtggaggtttaccaagaggaatagaaagcaaatgggcattggaattatacggaatacgagaataatcaaatgaaaaatttgagttaaccggtttctttttctcgtcgtagtcgtcgtctcttggggaaaaagaagactcatcactgtcgtagtagacgatcttcttaatgcgcctcttcttcttcccgtccttcttgttatgactcgagccagagtcagtgggcttgtcgtccctcgtctcgttgaagatggactccttctccttatcattgaccaccatcccctttcccttaggatccatctcttcgagcgattagtccctttcgtgaagagaacggctccgataccaattgagagcacctagaggggtggtgaataggtgatcctgtaaaattcaacaactaatagccacaaaacttggttaagtgttagaatgataaaaccaagtggctatagagcgagctcttgcgaatcacaataatcacacagaaaagcaatcacaagagacgcgagttatcgtgtggttcgacaagtgttacttggccgaaccacgcgataaaacaccgtgtctcttgtgttgcttttctctgattgatttcttctcaagagctcactctatggcaactttgtttagtctaactaacactttataaatcaagtatgtgcaattagtgttgaattttacaggattatctattcaccccctctaggtgctctcagttacatatctcggcggcaatatagatgacgcccagatctcgcaccctgcgatgatctggcgcttgcgtgttagggatcagcgccataagctttggcgcctactctttttcctgtgccgagcaaaagccaccggccttatcagatgtctgtcgtgt

SEQ ID NO: 22733 - DNA, 2078 bp, Zea mays
tcgggacccctgactgcatgcgctcgcggctgctcgcgagccctagctgtcatagactgcatgcggagtgcaaatacggagtctgctggaaacggggacggatacggagagagaaactgttggcagtgctaaatacggatacggagagggagtcttagtggccgtggccggtgtctcaagttgtactggtctggtagatttgctgttgccaggtgtgtggttttatgcaaaaactctgttaatatgattcagatgtcttgagatggacatgatctgtttcaattccaaacagaaattagattatctttatctttattacagacaaatgacagtcatggtccgttgttttttcttctgttgcctgagactcccccatagatgatgacagtagctcctgcttgtacggttgcacgcctgatggctgcttgtacggaataagatcagaatttccccgtttcatctttcaaagatcacaagtaaattttacaaacagacccgacctatctaattacggctgcaggtgccgtatgaatttccagcttgaagatttctgtcaagtgcatctgacagacagacacatttctctgatagatgaattaagcagtagcaaggcacgaccacaactcactccattgcttaatgcgatgcagcgttcccacattccagagggaaaaaaaagtggaatcaattcctttcttttggaagggcaaatcatcacatagtagatcaaaagcaaaatcaggagttcaggacagggcagcatcctcagctgatgagcagcagaacaatattgctatcgtgatgtttgcagactattccagtccataaaacaaaatgctttttccaatgttcgtcatcaaggttaaacatgggatcaccatgaccagaggcaacctccatcgatccacaaagcaacatcaagaaccacaccaaggcttaacggcgactgaccgtcactgcgaggccgatgtggatgacggtgatgcgccggcgctgctgctgctttcagtggacggggagtagaggaacttcttcgcgttgcccacgtgcacgcaggtcagcttcacgacatttctccccgtcatccatttcagcaggatcttcatgtgcgtcttgctgttcagaccagcgatgccagcatcctgtggtacaaatacgccagggtcagtgtacagctctggacaaggcagcaagcagggtaaatttcattttcgggttcagatactatacattcttctgtagctaaagctaacctgaatcaggccttagtgggtaacaatgacagtttcagaaccatctgcaggcgcttatatataactggaggtaaaacgatcatgtatacatgctacagactgcaacccaagcctgtcaaatctcatggaagagttatttgccactctgcctgtctgattgactgattaggtacctaaattcatacactgtgaagaaagtaatcccgatttcggttccttagcaacgtgatcgtatagcagaatgtgcgtatgattacagagacgagatgatccaatttaatctcaagttcacagagtttaaaaaaaaatagacacccttgtgggggtccaagcatattgagcaaaggtaccgtggattgaaaatttggaacagaagggaaacgttgcaattgcaaaggtaccagataccacaacaaatagctgttgggatggggctacgattgaatccatctttcgtggtattccataagacagtgcctagtttatcttactaccactactggtacgcaaaaaggcattaggctgcttttctgatgttgtagcagagtgatttggatattttatacaggtttgtaggggcagtagcgtgtttatcgttgtaccttggcgtggttccaggtgttgccgacggtgaggggcccatggtcggagaggatctggaggagtcggccggaaatggcgacggcctcctccttgggcaccttggggttgatccgcctcacgtccacggaccgcttcttagagaagtgccgccgcaacacctcccacgccacccccgggaacccaccgcccccgcccccgccgccgctgcctcggaggaactgc

SEQ ID NO: 22734 - DNA, 710 bp, Zea mays
  misc_feature (46)..(46): n is a, c, g, or t
ggccgcgggttttttttttttttttttctttttttttttttttttntttgatgagcagcagaacaatattgctatcgtgatgtttgcattttttttttttttttataacaaaatgctttttccaatgttcgtcatcaaggttaaacatgggatcaccatgaccggaggcagcctccatcgatctacaaagcaacatcaagaaccacaccaaggcttaacggcgactgaccgtcactgcgaggccgatgtggatgacggtgatgcgccggcgctgctgctgctttcagtggaccgggagtagaggacttcttcgcgttgcccacgtgcacgcaggtcagcttcacgacatttctccccgtcatccatttcagtaggatcttcatgtgcgtcttgctgttcaggccagcgatgccagcatccttgtccccgacggccgccaccggcttcaacatcaacgtcgccgcctcctcggcgcccaccgtcgccaccgactacaccacggacaaggaggcgctgccgctgtgcgccatgcctagaaatccaagcttcgcccctgtgcaccgtgcctagaaatccaagcttcgacagaggaggagggaggaaggaaatggcgctgcgtgcgagaggaagacagagaaggaggagaaatgggaaacagacggcatgcgttgagcctgataccgtaaggtagaatcggcacaaggattcac

SEQ ID NO: 22735 - DNA, 1356 bp, Zea mays
  misc_feature (558)..(588): n is a, c, g, or t
  misc_feature (591)..(607): n is a, c, g, or t
gcttgcaaaatcatctaatccagcggccatgtgcgagtatgcgccgccgcccgacgtctttttttcgtcgcagtcgccgtcaccggtgctcttttggtgctgcccctctcctctcttttagtggccgtggccggtgtctcaagtcgtactggtctggtagatttgctgttgccaggtgtgtggttttatgcaaaaactctgttaatatgattcagatgtctagagaatggactatgatctgtttccattcccaaccggaattagattatctttatctttattacagaccaaatgacagtcatagatgatggcagtagctcctgcttgtacggttgcacgcctgatggctgcttgtacggaaaaagatcagaatttcccgtttcatctttcaaagttctcaagtaaattttacaaacagaaccgacatatctagttacggcggcggctggtgccgtatgaatttccagcttgaagatttctgtcaagtgcatctgacagacagagacatttctctgatagatgaattaagcagtagcaaggcacgaccacaactcactnnnnnnnnnnnnnnnnnnnnnnnnnnnnnnnttnnnnnnnnnnnnnnnnntggttttagtgtgtctttttttctttttttttgaagagcaaatcatcacatagtagatcaaaagcaaaatcaggagttcaggacagggcagcatcctcagctgaggagcagcagaacaatattgctatcgtgatgtttgcagactattccagtccataaaacaaaatgctttttccaatgttcgtcatcaaggttaaacatgggatcccaatgaccagaggcaacctccatcgatccacaaagcaacatcaagaaccacaccaaggcttaacggcgactgaccgtcactgcgaggccgatgtggatgacggtgatgcgccggcgctgctgctgctgctttcagtggacggggagtagaggaacttcttcgcgttgcccacgtgcacgcaggtcagcttcacgacatttctccccgtcatccatttcagcaggatcttcatgtgcgtcttgctgttcaggccagcgatgccagcatccttggcgtggttccaggtgttgccgacggtgaggggcccatggtcggagaggatctggaggagtcggccggaaatggcgacggcctcctccttgggcaccttggggttgatccgcctcacgtccacggaccgcttcttagagaagtgccgccgcaacacctcccacgccacccccgggaacccaccgcccccgccgccgctgcctcggaggaactgcatcacgccgctgacgcctgggtcgctggggttcagtgtaaagccctcttcctcctc

SEQ ID NO: 22736 - DNA, 3465 bp, Zea mays
ggatcctatagagtccacctgcagctgaactgtaacaacctctatatctaaggcttatctttgtgccataggcatacagtttatgcactatttgttgtggcatatctattcgcttacatgttaatcaagtttatttatgtcattctgttttctaatagcaagctttgattgttcttgaagcggtgtgatttgcaacttggggttcctcgcccccggccgcggatgtatccaagctttgagcaacagctaaggatggcctcggctggagctccgccttatgggaccatcggcaggcatgaccctatacctgtaccagagccaacattgatgctaggttatgcaccgcagctaggtaactgcccccctccgttccagttgggctggggtccgtcttattcgaagatggttggcatgctccaatctgtgtgcgtgtggtgcaatagcccattccagcatttcggcaccgtcgctgagcagcaggcagattcacttggttacatttgcccgtcgtgcaagggaaagttttctggtcatcttggcatcaacggtccatctatttgaaatcagtttcttgtaacctgaactggtgctgctgccccaccatcaatttatagtctagttgatatgaatcgttttgtacttgtagtatgtatcctttaactcgtggctagtggtggaaacaggtttattcgaatcttacatttttggttattaaaactcaaccatcaagcagttgttgcgaacaaggaagctaagttgttggatacatacaagactgtgctctcaagagacactggtgggtactctgctgaagaaaagaccaattggcctgaagactaaattgtccatcttcaattgcagcaagagaaaggatctccattgcactggtggctggtgcatgtttgaggcttggatgatggcagaagtgtcatgtttttttatgttgaaccttgtttctaaatagtaagtctagacaattgttctgtttgaaatctgaatgaattgtggctggttgttggtggactggattaaaaaaaaaaaaaaaatgttttttctatctttaaccttgtgtataatatagtaaaggacggatgattgctctatttgaaatatggagtaatggttgctagttgcctgacatgtttttttaaatgttgaacctgacatgctaaccgtgtgcaagtgtgtctataaacaagaaagatataggttacaaagatcatttttacattagatcctttgtatcaataaataaaagactatcaggaattaaaaactgtgcagacagtgtaagcagacaactcattgtataattcgtctgtttgtgttgtctgcattcagaattttgtaccgtcggaactgcaggcatgcccagcacatggtaagcgagaaaacacagaaagtgggattctgaattcaactaccatcgccatagaattgccgtcaaatatgggtgagctaaccaaactctgcaaaccatctgccttccagagtacttgaaaaacgcctcttccggcttacaaaccgtcctctcaagacaacaaagaagaacaatcgaagacaaggttaacatgcctacaatgcctagagcaaattagagaacacctaaacgaacttgtacagacgctcgacggggatgacacggcaggtcaaaattcttcatatcgccattcaactcacaccgtccatgcagcagccagctaattggtgctgagccattgccccgttggctgtataaatgcaaaataaataatcaacaaactgctggactatatttaccgaggaggtatctacacaaggcatgggttatggttattgctgccgatcatcatttcttgttgcgtgtggagtcaccgaagttaaactgatcgctgacgacaaggtcttctgcaaacgaaaggatgggtttttttatggcctctgcgtttgggagaccgactctggaagactaggtaggcaggtcggtagatgctcgtgctcatctgagtggaaatagaaaagcactgctcggcagaaaatgaacctgcatttgggggtgaaaaataagcaggcataacttcaaatggttcacactgcaagaaatatagaactaaatattcaaacaattgtatcgacggattctcaagacgtgaaggcagagaatgtcatatgttcaatcatatgttacccaaaggcacagtgtccataacgaagcgaagaaaatacataacagtcatggacaaatcagatcagattttttggcatcatactttcccagaacataaacaatttgctggcagcacaagtttacttagaactttgcaaaaaaaaaaaaaatcgactgtaaagttgttgatgaactaggaaacatagatttataacaccctttcctctaacatgcatagtaatggttactaattcctacacaaccctgaacatgtcagcatcaaacatctaatggaccttattacttgctcggtagctactctagatgtgcattgtcttctgaaagactgaatttttagaggcaagtatgtaaaataaatattattatagaaacaagagactggcgttaagttgctggaaatactacataccagttgacagccattttcaacatgttgatgcccatttctttttcccttttttttcttattttttctggacttgagacccataaatggtaggaatgagatggattgagagttaaactataaatttgtccctagccaaaagaattgcaagcaatgtaccaatattttttcttcatacctattatttaagaaaatgaagccaatacacctttttccaagttacattgctaaattgatgttccagcttagacagatgttcatacagatttgaatgtggcaaatatatgtacaaggtacctgagaatcagccgtctgagaaatggatctggtaaaatttgcccccagacattgtttaatccaacagaagtacagagtattccttcgtattcttccaaagcagagaaaagtatgttctctgcatttgcatatgtatcctgaaaaccaagcaacacaaatccaactctggaaatgattttttttaggaaataacgaatagtcaattcctcaaacagagaacttacggtatctatgtcagaagttattcctgctagttggcagaaggcttgcattggagcagtgaggaagtatgtaaactggcttccgtgacccatggattctactccaggcatggctgacgatgtcctgggagaaagtaataaagcagctggttctcccttctctgcattatgtattgcctggcaaattacacgaccaaatgataatttggtaaaacaatttcggtaggcagtactgctgcaggtcgattgctcccccaccccccaaaacaaaaagttggaatggaaaccctaaccctaatcagggttgggtgtagtattaatagacttaggtaattgggcctggcccattacaaagggttgagatagtaattaca

SEQ ID NO: 22737 - DNA, 3373 bp, Zea mays
ggcaaagccaactgcctcctgatatccaagaagggacaagaggtaggaagatacttctttgcaagtagcaaactgatgtcctttcttggatatcaggaggcaaagccaactgcctctcagattaacaatgcaggagtgcatgacctacatgttaattctgtaggtcttcaccagcaaaccatctcaattgaggaaaagcaaattgcagtgccagttaattcagttgcattgtttaattcctctggtgattctcatcaacaaaaacttcagaaggatgaagctccaatagaagtgaatgcaaaggagtgccggaaatgcaatttgacgtttcatgaccagagcgcctatatgcaacatcagttgtcctttcaccaaaggaaagctaaaaggcgcagggttagtaaatctggagaattgggtaccaacatagatggaaactacgagaagactcagcagaagacctctggagaggtatctggcaattttggccacagcgctgcaaatgtaaggtatgaaggtctgagtccagcagaactgttagatggtcgaccatccttgatggcagtgccatgtggatctcaggagatcactatcttgcctcaacagggaaaagaaccttgtgtgttgcctcaacagggaaaagaaccgtctgtgttgcctcaaccgggaaaagaaccgtctgtgttgcctcataccgggaaaagaaccgtctgtgttgcctcaacaggggaaagaaccttctgtgttgcctcaacagggaaaagaaccttctgtgttgcctcaactgggaaaagaaccttctgagttgcctcagcagggaaaagaatcttcaggagatatctctgtgaatcagaaggaccctcttaaggagatgaatggctttcctgaacaggaaaaaggacttgttgctggagaacttgtctctgcacatcataaggaccctctaatggatattacagatgcatttgaaatgataaaaaaacatcctgccagagagccttcctctgggcatcatctggatactgtcggcaattctgatgatcataaaacccacgatgaagcatgtgacaatgttgtaacttctctttctattgatgctgaaaggaaattgggtgtttgcaactccatgaatgttcatgagaatatcagcttaaaagatccagaactttccaatgcagattattcccaaaagttcaataggtctgatgaaacttgtgatgtacataaagaggtttcttcaactgtgaatgatcctgatgaaagaaaatgcacagatgattcaacgaggtgtactaatatgtcctgtgatctactgcatggcaaaattgtcagttctcctgaagaacatgattttagtaaccagctagaaagtaacccactttcagtatctaggaatgagcctgatcttaattcaattggtacggaagtggatggtggcaatataacttgcaatgcggaaaaccccagaagcttcaaaagtgagaaatctgctgagctcaagattatggattgcgaaatgacttcttttaaagacagtgaaataaaaaatgatgtcagagtaagggatgtaaatctcaattcatgtttggattcaatatcttctcctatttctggtggaaacaatgaaacatctgatactcctgatgatgctattcgatcatccattatcgcccaatgcttcggtactacctctaatgatgacacggcttgtaaggatggaaactttgccaaccagaacgacacctgtaagggtgaaaattttgtcaaccagaaaaatgtcacaatgtaccaatctaatttgaccatggaacctatacctctagctcaaataaatgtggattgtttcacttcttcctgttcaatgactcctgaaatcaaggactatggcaacagaggtgaagatcgtgcgaaagaagcactagtgaactcacaaaacatgacaagtaatgaaactggttttgatgctgaagcttataacagtgatatcttcaatggtactatcacagaaagtagtcttgcccagttgagtaatgtcattagtatgaaaaatgcttttgcaaactgttactcattatctgacctaaacacacttactggtggtactgcaactgatgatattgatatgcacaatattaggagttcttttgtcagctctaccagtcgcactgaaccaaatgagcactgcacgttggattttgatatcaagggttccatgcttgaggcattggaaaaatctgatagtgacttagataatcaatacaatgatgcaggcccttcttgtgactcactacctgctactgggacaagtgggactattgatgattttatgtccatgcaaaccaattttggtagctttacttctttggttcgtgctgttgaagatgttccactgagcaggattattcaagatcagcggtgtgatttgcaacttggatttggtggccccaagcagcagatgtatccaagctttgagcaacagctaaggatggcctcggctggagctccgccttatgggaccatcggcaggcatgaccctatacctgtaccagagccaacattgatgctaggttatgcaccacagctaggtaactgcccccctccgttccagttgggctggggtccgtcctattcgaagatggttggcatgctccaatctgtgtgcgtctggtgcaatagcccattccagcatttcggcaccgtcgctgagcagcaggcagattcacttggttacatttgcccgtcgtgcaagggaaagttttctggtcatcttggcatcaacggtccatctatttgaaatcagtttcttgtaacctgaactggtgctgctgctccaccatcaatttatagtctagttgatatgagtcgttttgtacttgtagtatgtatcctttaactcgttgctagtggtggaaacaggtttattcaaatcttacatttttggttattaaaactcaaccatcaagcagttgttgcgaacaaggaagctaagttgttggatacatacaagactgtgctctcaagagacattagtgggtactctgctgaagaaaagaccaattggcctgaagactaaattgaccatcttcaattgcagcaagagaaaggatctccattgcactggtggctggtgcatgtttgaggcttggacgatggcagaagtgtcatgttttttttttatgttgaaccttgtttctaaatagtaagtctagacaattgttctgttcgaaatctgaatgaattgtggctggttgttggtggactggattacaggcaaaagtgtcatgttttttctatctttaaccttgtgtataatatagtaaaggacggatgattgctctatttgaaatatggagtaatggttgctagttgcctg

SEQ ID NO: 22738 - DNA, 4274 bp, Zea mays
cgtccggtttaaaagattatgggacatctctgaaaacagaaatatctgtgtggataaggtgatttgctccaattttgaggccttaaaaatccagagaagactctttggtgacacggtgaataatcttgatgaaatgaaacacatgtgcagggatattcacctgactggcgctgacgattcagtgtcttggactttagataagaagggattttcagccaagtctctttacaaaaaaattaggagtgatctgtctgaagtccctttcaaattcttatggaaagttaaaattccccaaaaaaataaaatctttttgtggcttatagctaggagtaaaattttgtctaaaggaaatctaatcaaaagaatgtggaaagggggaggagaatgttgcttttgtggtttattcgaatcaactgatcatttgttttttttaattgctcggtggctagatatatttggaggattgttcagattgttcttaatctaaggacagtcccaaagaaacatgaagatacttttggtaattggcttttaggctctgataagagaattaggaaccttttgattgtaggattaggatctgtgctctggtggatctggaagactagaaatgatgtatgtttcaacaataaacggattattgaccctcctgatgtggttttcctctctggtcactggttggattcctgggcaattttgcagaaaaggaaggaaagaagaatgatggaggaaggaagccagctaatcaaagggatggcaaaggaggtttttgatcgctcgaaaggatgggcgccaatatctagaagaatccttcgatgaagaattgaagacctagtggctaatgatgcaagaggaaacggtggatttagtagttcttttgctggtcataattggcttgttatcaatagctttttgaaaaaggagttacttcaaatagcagaaaattgagctgtaatagactgcctagtgctacgtgggatgtttccccagtgctccatatgtaggttgttgggtgttttttttgtctttggtatgtttggctataggtttacatgaaaatcttaatctttctgagttctgtaagaactctgaattctccatttcataatgaaggggggggggggggggttctgcccttatggtaaaaaatcaataagaaaagctataataaccctaacggtgtattatcaaatgtgacgtcgttcatcaggtaaacagatacagacagtgtaaaattactcaactcaaatgctcaataacaattgaaaaaagataggcatcaaagaacgaaatataattcaagaggaaactgtatatacctggctgcaaataagcacaattgaattctggcggcagaaccaactgaaagctgaccttattcagtcaagcctgcagtatcaatcatggtctctctggaatctatcttgctcatacacgcatagtgctgaagcttctcattgaacagcacgaggggatccttctccttgagcacgccattttcgtcatacgcgtccctgaggaataaggcccagttcatctctgtgccggcgaggtagaaagcgcggttctgcttctgtaacgactcgtacatgtgccgcgtgagcccgaactcctccttgaactcgacgatgtggtggatcatcgctcgcttctccagcgtcaggttcaggaactcgtgcaccacaccgacgcggtacttttccgcctcgggcgtccatggcttgagcagcgcgccgttggtgtacggcgagaccaacgggaacgtggtcgccatgtcgaggcggtcggcgtcctcggcgtcaagcggcatcaaccggcggtgtgggaccgcgaagcggaacgtgcgccggacgcggcgctcgtccacgacgaagtcgcgctccaacgcactgacggcgagcgcagggtcccagcgcgcgagctcgaggaagtggcggccgtccctgggatcgactacgacgcggaagtcgtcggggaagtcctggacgcggtcgcggaagtcgtcggggaggccgagcacagcgcggcagtggtggagcttcgcgagcggcacgcgacggtgggctgtgagcatgaggagcttcctgactgcgagcacccgcgaagggaggaaggtcgtcgtggatgcggcgctcttcctcgaggagcgagcacatgaacggcgtgagcgcgaggtgcggaacggagtccacgactgggaggtggaacagcagcgggtggcgcgtagcggagcgcgacactttgcggccgcgggggaagccgagctcgcggtacagctttccagcctcggcaagggggatccggtgcggaggcgggagggaagccaggaacgagcgcgcccggtggaggaagcggaaggccgtatcgcggtcgagcacggcgtcgagggccggaacgcgacgcgcggcctccggctcgataggcgcgacccgtgggctgttgagcttcctcaggagcttctttctccgcttgcaggggagcagtggcaggagcgaggccgacgcttccgcggccgctgcagaagacgcagaggtgggcgccggcgcgggagctggggcaggaaggaggagcgttctcgtggcacagaagaggcggcgcgccattgctgcggtggcggcggcggcggcggcggcggcgcggtgagtgatgaccacgtgagactagttgggttcagtattcacagtccagggtttgatcaaatcaacacgcaaattggaaggcaccgtaaccgttcgattacggggcccgccgcgccactcgacatctcaacccacactggcccactcctgtcttgaacatctcccgtccccatcgtcctcgtcgcatccagcactctgcactcatgcgtttcctcccctcctaagccaaaccccgaatcctccgtcgcccagcagccgccggtgacggcgacgctgggcaatggggactgaggtagcagccgtagtggatctccgggcgctgacacagtcggatctcgtggccctagctgccgcatcgccctacgccgtcgactcccgccggggccggcgccggcgccgcgatagcgagttcctctctcccccgaagatcgaccgcgccgttttcaacgagagcgcaggttcccgcaaacaaaccttctcccgtcgccgcgtcgccaccaacatatcccacaaactaacgcccaccaccaccggggcctcctccttatctacgccagctgcccccaccgaggaggaccccgacaaccgcctcattgtgttctacctccaacgcctcttcgcgcgtgacgacccctcgtaccctgctccgcctacgattccaccccgaccgcaaaccctagccgcgcccgcgataacagcacctgcgccgcccgcgccgtctctgccgccgccgtctgctgcggcggcagaccccgatagggtagtgctgaatccaaagggtttggtggttgacctggtgagactcgccgatcttgtggatccgtatggggaagagctacgtcagcgtacggcaggattggggtcagagtccgagctgctgggattcatgaacgcgctggaagggcaatggggaagccggaggcgtcggaggaagtttgtgaatgctggcatgttcggtgaccacctgccctgtgggtggaaactgctgcttgggctcaagcgaaaggagcgtgtcgcatggattaattgccgccgttatgtgaggtctgttcctgtacccaggcatacttgtttattgtagtataggcttcagttggtacggtttcagtctttcagagtatgtataatgattcagattctgtttcaaactgtcacgaagtgattatatgcatgttttttcacaagttccatagtagcctcacagtgcttctgtcatagaaagattgtctacttactctttagcactgagttgtctttccccaataggtcagtaacctaactgaaacatgaaattgagattaggaggataggacttctatatgaaatatgctgctcagatccgtgccctcaagcgctgaaacatatatacaataggcttacaacatcgagctgcatatatctgaacaactatcatcttcatctgagtttgagaaaattaggctaatacccaaacaagcaaaattagtgaaataccatcgcatcaagattcaagactgatgttagtgccatcacaaatgcatgcagttataaaaacatatctttttctgtgaaaatgtctttttgtttccttttaacgatatgaatcacgtaattttgtagttgtttgatgaaaagcatagctgtttggcgtgttgt

SEQ ID NO: 22739 - DNA, 1386 bp, Zea mays
tttttttttttttttttcgaaaattggaaaaccgtaacctgccgtcaaatatggtgagttaaccaaactctacaaaacaatctgccttctagagtactttaaaaacgcctcttccagcttacaaaccgtcctctccaagacaacaaaatagaaaaaaaatcgacgacaaggctacatgcctacagtgcctagagcaaattagagaacacctaaacaaacttgtacagacgctcaacggagacaggtcaaaattcttcatatcgccattcaattcacaccatccaggcgcggctgccgctgctaattggtgctgactaattgctccgttggctgtataaatgcaaaacaatcaacaaatcgctggactatatttaccacagaggtatctacagaaggcatgagttatggttattgctgctggtcatcatttcttgttgcgtgtggagtctcggaagtcaaaccggtcgctgacgacaaggttttctgcaagcgaaaggataggagttcttatggcctctgcatgcggggagactgactctggaagactaggtaagcaggtcggtagatattcgtgctcatctgagtggaaatagaaaagcactgcccggcagaaaataaacctgagaatcagccgtctgagaaatgggtctggtaaaatttgcccccagacattgtttaatccaacagaagtgcagagtattccttcatattcttccaaagcagagaaaagtatgttctctgcatttgcgtatgtatcagtgtctatgtcagaagttattcccgctagttggcagaaggcttgcattggagcagtgaggaagtatgtaaactggcttccgtgagccgtggattctactccaggcatggctgatgatgtcctgggagaaagtaataaagcagctggttctcccttctctgaattatgtatgaccttgaatgcatggctattttcactatcaattacaaggaacagtggatatcttgtaaatggaattagatcatctggataaagattgtttggacctccacttccacgggggccaagccatagatgattatcagaactgttatgcgagtttggcttatcagtggggaaggcagaggcagccctcgcacgagatgagctagagccaaacttttgactagcaaaactctgctcagcagaccctgacgctgatatatagatgagtaaaatgctatcttgagagagctcttcacaaattgttgctagaactgctaaaagatgagcggctgtaggatgatatatgattgccttttgaggatttgaaggaagacttccatcagatatttctgttgacagttgaatatcaatcagaccagagggtccactctgatcacttacagtgccattttctcggacgcggg

SEQ ID NO: 22740 - DNA, 1784 bp, Zea mays
cctccccacctattttatcgctcgtgtgtccccgtctctctcctccgctcctcctccatcatagctcctggctcgcggctcagcttgccactaccagcaagcgctcgtcacccgtcggttctccccgagtagctcgtcgcgtcggcaatggagaatctgagatctcaaaactgccaccaaggtgttgccatggagggagtcaagtttgcgccggagaaggccaacaccaaccggagagccctcagcgacatcaagaacataataggaggcccacaccagcacttggcggtcagcaagagggctctgtcagaaaaaccagctgctgctgctgctgcaaatgctaaagatcaagctggctttgttggacaccgtccagtcaccaggaaattcgctgcaacattggcaacccaacctacagttgcccttctggacccaattggaagtgaaagactgaaaagaaacgctgatacggcatttcacacacctgcagatatggaaagcacaaaaatgacagatgacagtcccttgcctatggtgtcggagatggatgaaatgatgagtcctgaactgaaagagatcgagatggaagatattgaggaggcagcacctgatattgacagtggtgatgcaggaaattctctggctgtggctgactatgtagatgaaatttacagattttacaggaaaactgagggtgcaagctgcgtccctacaaattatatgtcaagccaaactgatataaatgagaagatgcgtggcattctaattgactggctcatagaggtacactacaaactagagctgttggaggagacccttttcctaaccgtgaacatcatagacagattcttggcacgtgaaaatgtggtgcggaagaagcttcagttagctggtgtaactgctatgttgctcgcgtgcaagtatgaagaagtgagcgtacctgtggtcgaggatctgatcttgatctgtgatcgtgcatacacaagggctgacattcttgagatggagaggaggatagtgaacacacttaatttcaatatgtcggtgccgactccatactgtttcatgagaaggtttctaaaggcagcacaatcagagaagaagctcgaactcctgtctttcttcatgatcgagttgagtcttgtcgaatatgagatgctccagttctgcccgtctatgctagcagccgctgccatctacaccgctcaatgcaccataaatgggttcaagtcctggaacaaatgctgtgaactgcacacaagatattcagaagaacatctaatggtttgctctaggatgatggttgaactgcaccaaagagcagctcatgggaaacttacaggggtccatagaaagtacaacacttctagatatagctatgctgcgaaatcggaacccgcaactttcttgctggatgcctgaacctaagcttgaactatacacactcttaactacttccatggaaagagtggaagggaggctgcttcgactaaactacagaagtgggatctatctgaatatatgcaacggctgttgcagcaaatatttggtggggctgggttggtgtgttgtttgttagttcaataacttaacattaatgaaacagtgtttgtgttgtttaggttttttttccaattatatcgattggaatttcatttgttgtatcctggccatcattctttactcatgtcatgtgacacctctgcgttttgaaaaataaacattgattatgtggatctgctgaaaaaaaaaaaaaaaaaaaaaaaaaaaaaaagggcggccgc

SEQ ID NO: 22741 - DNA, 1537 bp, Zea mays
gagtctatttttgtggctcgtaaaaagagcgagccagctcggcttggctcggtgcagctcgcgagctggctcgtggctcgacccaacaacaatttattacataaaatcttagttagcatataatattagtaccgagtagacaatagtttatgttatttgatattactatacaaaaataatctatatttttaagattttatattataatttagagaacaaatttacatttatggctaggcggcgagtccggagtgagtcgagccgagccggttttccgagctcgccagatgaacgagccgagttgagctcggctcgtttccacccctagcgtaaaatgcatcagtggtcagtgcagacctggagatggcacatcacattgattcgtgaaatgaaattgttgtcacaaagcgatagttccatcaaagtgtatctcttgtagtacacaggactgaaaccacagaagacaaatgccgcatcgtgcacctgtgcagacaagagatgaatgctacactgcaaatctgcgcagattggagacgaattgatacaatgacagcgccgacataactcaaactaatctattcacatacgttgtactgtcacctacaaacggcagctgtggacgacaacaaattcaattttcgcagaaatttcactggagaacccgtgttacaaacgacgcctgaaaaaccgctgtgctccagcattagtgttttcacccttcagaaaccgctggtgccgttgcttcagaaaactctccatggatttaactgccgttggggattcttcagtatgtgccaggggggcatccagttcattcccttttctgctactggaactggactatggtactatttagcctatatttatgctaacttactttgctcaatgttctggtaacttgtgatcaaagcattttctcagggctgcccttatctccttcagcatctcgtcgatcccgatgcgccgcctgcagaaccaaggcaacagggttaaacaaactggatcgacattataacaggacaagagataagcagacgtcaagctagaaagatatttttgcttccagggctacgaaggtcctagttctagaagatttggcagcccagaggaaaagaacagcacatttatgaacttcaatatgaaccgcttaaaaattgaaaaattataaacatttgtctagtgtggtaaggtgatgggacatacaatacgctagcagccacgacagcttcaggtcttggatagtccccgagctccttttcaacaccttcagctttagcctctgataagacctgatgatcacttactcgtccatttaggttatctttgctgccactttgctcatgcccttcttcacatccaattgaagatatctctaagaccagtgcagatagtctatctgggccctacgagggaaatcaacgctacaatagttaaaatacctgacatatcaaatatgaaatcaaattttcatgatattgttttgaatagagaataacgtcactgaaactaggaagaaaacaacttgacgtcttgaccc

SEQ ID NO: 22742 - DNA, 1122 bp, Zea mays
tgcagagcgaatggacgttggacttgcgaactgcggagcggcgcaccccacgagtttcaactttcaaaacggagcctgaaaactaacgcgatctgtatgactgtatcagacttcaacgttggtggcttcatcgtctttcagaaatggcaacgtcggtgcaaccgtgcaagtacggtgatcgcgtgcatataaaatatgggacgttcgcagaagagatgcccgcttttgtcaaagaaggaagcacagaacgcgaggtgtgttgagttccctggcccgatgggcgtaaaatgcatcagtggtcagtggcagtgcagacctggagatggcacatcacatcgattcgtgaaatgaaggccgcgtctctttgcgatagttccatcaaagtgtatctcttgtagtacacaggactgaaaccacagaagacaaatgccgcatcgtgcacctgtgcagacaagagatgaatgctacactgcaaatctgcgcagattggagacgaattgatacaatgacagcgccgacataactcaaactaatctattcacatacgttgtactgtcacctacaaacggcagctgtggacgacaacaaattcaattttcgcaggaatttcactggagaacccgtgttacaaacgacgcctgaaaaaccgctgtgctccagcattagtgttttcacccttcagaaaccgctggtgccgttgcttcagaaaactctccatggatttaactgccgttggggattcttcagtatgtgccaggggggcatccagttcattcccttttctgctactggaactggactatggtactatttagcctatatttatgctaacttactttgctcaatgttctggtaacttgtgatcaaagcattttctcagggctgcccttatctccttcagcatctcgtcgatcccgatatgcctcaatacgctagcagccacgacagcttcaggtcttggatagtccccgagctccttttcaacaccttcagctttagcctctgataagacctgatgatcacttactcgtccatttaggttatctttgctgccactttgctcatgcccccccgcccacccaattgaagatatctctaagaccagtgcagatagtctatcat

SEQ ID NO: 22743 - DNA, 1360 bp, Zea mays
ggcatgcctaattggggatggcaagttcttgtcttgtttcttaagctgcccacagcttttttttttttttttgcacaaacggtcgaccaaaacgacatcattaattacccagttttagttgcacacactaacataacagctaaaacaagattaagcacacagaccattgtttgacagcctgtgttgcgactggtgactagtcatcccaatcccaagcacgaaacagatcacgtaagacaccagatgaatatgctatggagtagcagtgtgcatgtgataagtgcattagacaatattcaatactgtgaggaaaacggtctaacatgaggccgagtcattatgagcccatctatctcttcatgatatatcccagtagcattcccaggagagcaatggccaccacgaccacaaaggagaatccaccattctgcttgttggcttccctcctcgtaaggtccagttcctctcgaagcttattgttctgctgaatggcagagtttctctcttctgtcaactttgaaatcaaagcagatgtctcggaggtgtagtccttttgatctatatgagtttttacagccgagaacaacagtgactcatcagattccctcgttgtctcttgataattcaagttaattccatcggacaatgaaggtcggggtgatgagccttcttcagattcctcatgcactggggatggcggtttgggtggtgggatgtagacgaccttcagcttaacctcatccaccacattagctgattctttggtaaacatatcgccagtgatgtccttgactaaggtcccttccgccacaacgacactttgcacaagaaacttgtccttgcactgcatgtccggtggcgcctccttttgtgcttgcattgtcacaatgacatcgctggtggaccgaggtggcacgatgccgctgttgggccggacacagtacttcttcgggctcgtcgtcttaaccttaaagccgatgtagtcatctgttcggtttgtcaactgcatagagcacgagatctgcttctttgtctcgaatgggaatcggagctcgaggggctcgatctcgagcaagtccttggagtgagaccacatcccgccgccgctggagtccgggaggcggaggcacgctgtacggagttgatccgggggtggttgcctggcaggccacgcgggcgggagagcgaggagctagggtttgggaagcgaggctggtttgcgctcgccacagcccacaggagcagggaaaagagcctggagtggagtggagtggagcagcaggagggcagatgggaatttggaatcgccgtaggcaacaacgggagttggtaggaactaggaggagcggaggagggaacc

SEQ ID NO: 22744 - DNA, 753 bp, Zea mays
ggcggcaatggcaagttctagtcatgaaacaaaagatgtcccacagcaagttggcttcgctgttacacaaacggtcgaccaaaacgatatcattaattacccagttttagttgcacacactaacataacagctaaaacaagattaaggacacagactattgtttgacagcctgtgttgcgaatggtgactagtcatcccaagcacgaaacagatcacgtaagacaccagatgaatatgctatggagtagcagtgtgcatgtgataagtgcattagacaatattcaatactgtgaggaaaacggtctaacatgaggccgagtcattatgagcccatctatctcttcatgatatatcccagtagcattcccaggagagcaatggccaccacgaccacaaaggagaatccaccattctgcttgctggcttccctcctcgtaaggtccagttcctctcgaagcttattgttctgctgaatggcagagtttctctcttctgtcaactttgaaatcaaagcagatgtctcggaggtgtagtccttttgatctatatgagtttttacagccgagaacaaccctgcgtcgccggcggcccgcccgctcggcgtctcttgataacaagttaattccatcggacaatgaaggtcggggtgatgagccttcttcagattcctcatgcactggggatggcggtttgggtggtgggatgtagacgaccttcagcttaacctcatccacacattagctgattctttg

SEQ ID NO: 22745 - DNA, 3254 bp, Zea mays
ctgcaggccgcggcggcgcggcgcggcctccctggctagtcctcgtccccggtccccgtcccgcccgtgtataaagtgcgtctgcgccgccgccacctacacgcgcggtacttgcgccgacggcggggaccccgtagctagacttccgccgcccgccgctccaacagctctcactagtagcctttccatcgcacgcaacgatgcaagagaatacggacggggaccgatcggccgacggctttccacgaccacatttgcaatcaagccacaggctcactccgttttagattataaaccattttgttttttctaaggaatcaaagcatctcaaatttgtcggttaaaatcatagaatgatattataatatttataacattgaatagatatactatatataattaatgacaaattaatgatatttatttaatattatatatattattgttttattattcgaatttgattaaacttaagatgctttgatttaaaaaaggttaaaataacttataatttgaggtatattaactttataaaaactaatataactcatgttttgggaaggagcaacaattttttttctagccgctatcaccggccttgtggaatatggagcgtaccatctacaagttgttttaacaaaatggtctctaaagctattttggaaaacatttagggcatgttcggttacatcgaaacgagaccaggaactgttctagataatcaattactatataaattaaactatcattctaaatggaattgttccgaaggttgaattggggataaccaaacagacctttaggggtgtttgtctagaattataatctattcagattatataatccaataaattttgaattagattatataatttggacacatcataatcctaaacaaacacctctgtttgtttattctctagattatataatccaatttagataagttaagcgataaacaaacatcacaaattattagatggattatataatctcgatgtctagattataataatccgtaagcaggttcttaggtgcttccataagctggattatataatcttggaagagagcacgggaaatttgctgtaaacctaaacgagtctggaattctgcatccagtaaaacgagacagaaaaaaaaaacacgaaatgaaaggtattcatgccattttcggatatcaactcagaatctagaatttgatgagcacaaccacaaccaaaatctgcaacaataagcaaggctaactgtatcaattgaagtgtcaagaattcaagctgttactacaactcgtaactgctctatcttttcggtgaactaaacgccacaaatatctagtacgccttactactacgcagtgaagtcttatacttcacaaacagaaagacgtgaacaacagtggttcgtttctggtgaagccaactgaagtcgtatgcagtaagcataccatggcaagttgtaccaacagatagccatgctctcaagcagagaagctagaaatccctcttttactcctaccacagtgtcctcaagcagagaaccaggaatccccatccctagacataccttgactagcggccaagaacgcagcagacaagagaaatcgttgctgagctcatcgcatggacatcagtatgcgcctttggacaactaccttggaaggctgagcagcctttggatgagtttccttcatatggcgcctcaccatcttttcaatctgctctatcgaacctgacagtttcttcaccagatcagcgggagatggatcatttggcttggatggagccacctgcaaggagcagtccgttgcctcttgcttgccctcagccacagaagtcacacggtttgcaacagctgaagttgagcttggaccagaagcaacagcacccggtgtttcttgagtttgcgtgctttgagaatcaggattactatgttctgcagttgttggatccacaggctgtgaagaatcttcattcgattggatgtgttgccgagccgcatcctcctctaggcgatttcttttctcaagagcctgtaaattgcagttagtacagtagcatggtggacaagcaatttttgagtgtgcatcgacaaacaaaagcatggactacctatagtgaaatactgaaatgttagtgaacgtctaacatgatatgttattcagtgcatgatgatactgcatttacaagattgcaaagcagcaatatatattaaatggtgcaaaatatatcgataagattgaccttattgcatactgctagctacatcggtcccaaaaatgtaagtcttttatcgttctaagtcaaaccgttttaaaattgattatgcctatagaaaaacacaccaacatcacaacatcaacttaatttcattaaatccacaatgaaataagtcttaaataacgcattcattatgtaccgtaaattgtatatgttaaatattttttctataaacttgagcaaagttagaagagtttggcttaggtcaaaactaaagcaacttaattttgaaagaggggagcatcagacctttctctagttttaagcacattcatattgctgactgcataaactgagaacagcaaaatccaatcaaataaaacaaaagggtgctgattggcctaacaaaatcatcgctaatccatttgaactacaacaacttttatgttaatcactggattaagcataaaagatttgcttagcctgcaatttcatgctactgtcatcctcaatcaaatcatggttacacaatattagttctagcatggtgaagtttatggcataatattagcacagaacatacacaatattaaagaaatttatggaacatccaaatacagtctagggaaatagttcaccacctttacgattgatgtgatgtcacggagtgggacccttgggtaccagtcaggtagggggcttctcctctttggtttagccctcgctgcaggtgttcggacccgtcgagccagcggcttggcggcgccctttgcctgggaagttcctggtgatgccacccttctcctgataaaaaaaccaccagcagagttgctggcgagcgccggcctgctggcagttctcaattgaggcatcttgtagtcctgcgagaagtttgtgtagctcatatcggtgagacagtgattcaagaaccaaccagacaatgaatcagcacatcagtaaatggaccaagaaaccataaattttcttacagttctgctctcgttctgcccagatttctattgttcttctcctgga

SEQ ID NO: 22746 - DNA, 1717 bp, Zea mays
ggaacaataagcaaggctaactgtatcaattgaagtgtcaagaattcaagctgttactacaactcgtaactgctctatcttttcggtgaactaaacgccacaaatatctagtacgccttactactacgcagtgaagtcttatacttcacaagcagaaagacgtgaacaacagtggttcgtttctggtgaagccaactgaagtcgtattgcagtaagcataccatggcaagttgtaccaacagatagccatgctctcaagcagagaagctagaaatccctcttactcctaccacagtgtcctcaagcagagaaccaggaatccccatccctagacataccttgactagcggccaagaacgcagcagacaagagaaatcgttgctgagctcatcgcatggacatcagtatgcgcctttggacaactaccttggaaggctgagcagcctttggatgagtttccttcatatggcgcctcaccatcttttcaatctgctctatcgaacctgacagtttcttctccagatcagcgggagatggatcatttggcttggatggagccacctgcaaggagcagtccgttgcctcttgcttgccctcagccacagaagtcacacggtttgcaacagctgaagttgagcttggaccagaagcaacagcacccggtgtttcttgagtttgcgtgctttgagaatcaggatcactatgttctgcagttgttggatccacaggctgtgaagaatcttcattcgattggatgtgttgccgagccgcatcctcctctaggcgatttcttttctcaagagcctttacgattgatgtgatgtcacggagtgggacccttgggtaccagtcaggtagggggcttctcctctttggtttagccctcgctgcaggtgttcggacccgtcgagccagcggcttggcggcgccctttgcctgggaagttcctggtgatgccacccttctcctgataaaaaaaccaccagcagagttgctggcgagcgccggcctgctggcagttctcaattgaggcatcttgtagtcagttctgctctcgttctgcccagatttctattgttcttctcctggatctatgcaacgaattcttggtgccccgggcactgttgctcttcccttcccctattggctattgctcggtttccgcctctccgtgatttctcccaatgtcaacgcgatccctacgagtctaggccacctcgaacaggttccctcagctcctgatcccgcctccgaatccttacctgtccgcagatgattttcgctccgctcctctccgagccgcggcgatccggcccccgcgacggcttcttgatacgataggaccctgcttggggtgtgatttctgggtagattccctagggtttgagcctggatggagatggctactgggtactactggctactgggtaccaccatgccgcgcttgggagaggtcagcgccagcgagcggtccacggcgacgacgaaagcgcgagggggagctgaatggagattcgcagcggatgacgggatctaggaggagggcattgatggaggcggatgacgggatctgggagtggcaattgcggcttgcgggctggatggcggggtgcgggctggatggcgggcgggaatgcaggtcgcggcgttcgcggcggccgcggcgggcgggggtgcaggtcgtggcgtttgcggcggccgccctcgtgccgaatta

SEQ ID NO: 22747 - DNA, 1031 bp, Zea mays
cctcgaggccggccggggtcagtcgttttccgccttctaggctagtttgcgtaaagtacgatgcgcctcccgcttcttccacggtctcctctcctcgccgccgccgccgccatgcctcctcgccgacgtcgcgttgtcaaagcgacgccgctcaagccgtcttctccacaactctcctctaccccgccaccgaccccgtccgtagaggtccccaaacccgaaccccccgatcaccacgatcccactccctccgcccgtcgccgcctccccctcgctgccggggccgttgaggcgcaggaagagtggcatccgctcccgctctccacggccgacctttccctcccgctcaccctccccaccggccagaccttcctttggcgccgcacctccctctccccgctccgcttcaccggtgccgtggggtcccacctcgtctccctctcccacctgcccgactccgacgatggccgcctcgcattcctcctccacaacgacggcggttgccccgcctcctcgttgcccgccgcccgcgccgcgctcctcgactatctcaacgcggccgtctcgctcgctgacctctggcggcagttcgccgccgcaaatgagcgcttcgctgatgtctccgcgcggctcgggggcggcggcgcgcgggtgcttaggcaggaccccgtcgagtgcgtcttccagtttctatgctcctccaacaacaacattgcccggatcgagaagatggtgtggacgctggcaggctacggggagcggctcggcgcgcggtggaggcgggagggtcatcgtacgaggccgtgggcgcgctgctggaggatgtgctgcggcctcagcgtcagcgccaagtcaaggatgccgtccgggagacgaggcgggatgctgagatttttaattaaactagtaacgggcttgtgcgttgtaacggggagataacaaaatttcaaaacaatatatgtacattacgatataacaatatccaaaatagcaattctctgtagtatttgtttccaaaaaaaaaaaaaaaa

SEQ ID NO: 22748 - DNA, 854 bp, Zea mays
ctgtgcgccggtcccgccgggccggccgggaccgctctctcccgttcacccatcacaccatccccactctctcctctccacccggcgagcggacactcccctgtcctcttgacccgatcccgtccccgcccgcccgccccgccgccgcgcgcgctggtccggacgctcgggcgctggtgatccggttgatgcagcagcggggcctcgcccacaactgccgctcccgcggcttctcccgctcccgccgcgcagtcgagggcgcctgaaacgcacccgccccacgcacgcagcgcagccgaaaacccctcgatccggctctcctcgcgctgcagcttttataacgccgtagacgacaacgaaagagaacggaaagaaataaaacccaccacacctaccgtcgtccgtaaaggaaggaaggactcgagatggacaccgtcggcgtccccgtggtggccgttgcgaatgggatcggggaggtggagcgcaaggtgcagaagagctactgggaggagcactccaagtgcctcactgtcgagtccatgatgctcgactcccgcgccgccgacctcgacaaggaagagcgacccgagatcctgtctttgcttccctcttacaaagggaaatcagttctagaacttggtgctggaataggacgctttactggagatctggcaaaagaagctgggcacgttctggctctagacttcattgaaagtgtgattaagaagaaccaaagcataaatgggcatcacaagaacataaccttcaggtgtgccgatgtgacatctaacgacttgaagattgaagataactctgttgatctgatattttcaaactggctattaatgaatctt

SEQ ID NO: 22749 - DNA, 2865 bp, Zea mays
gggtacctcgaggccggccgggattacttcccgggccggcccggatcgctctttcccgttcatccatcacagtatcacaccatccccactctcttctctccacccggcgagcggacactcccctgtcctcttgacccgatcccgtccccgcccgcccgccccgccgccgcgcgcgctggtccggacgctcgggcgctggtgatccggttgatgcagcagcggggcctcgcccacaactgccgctcccgcggcttctcccgctcccgccgcgcagtcgagggcgcctgaaacgcacccgccccacgcacgcagggcaaccgaaaacccctcgatccggctctcctcgcgctgtagcttttataacgccgtagacgacaacgaaagagaacggaaagaaataaaacccaccacacctaccgtcgtccgtaaaggaaggaaggactcgagatggacaccgtcggcgtccccgtggtggccgttgcgaatgggatcggggaggtggagcgcaaggtgcagaagagctactgggaggagcactccaagtgcctcactgtcgagtccatgatgctcgactcccgcgccgccgacctcgacaaggaagagcgacccgagatcctgtctttgcttccctcttacaaagggaaatcagttctagaacttggtgctggaataggacgctttactggagatctggcaaaagaagctgggcacgttctggctctagacttcattgaaagtgtgattaagaagaaccaaagcataaatgggcatcacaagaacataaccttcaggtgtgccgatgtgacatctaacgacttgaagattgaagataactctgttgatctgatattttcaaactggctattaatgtatctttcagatgaggaggtccaaaagcttgtggggaaaatggtaaaatggttaaaggtcggaggccatattttctttagagaatcatgttttcaccaatctggagattccaaaaggaaggtgaacccaacacactatcgagaaccaaggttttataccaaggtatttaaagagggccattcatttgatcaagatggaggttcgtttgaactttctctagtgacctgtaaatgcattggggcttatgtcaaaaacaagaagaatcaaaaccagatatgctggttatgggaaaaggtaaaatcaacagaagacagagattttcaaagattcctggacaacgtgcaatacaaaacaagtgggatattacgttacgagcgtgtctttggtgaaggttttgtgagcactggtggaatcgagacaacaaaggaatttgtgggcatgctcgatcttaaaccgggccagaaagtacttgatgtcggatgtggaattggaggcggcgacttttacatggctgcaaactatgatgtccatgttcttggtattgatctttcggtgaacatggtttcatttgcaattgaacgtgccattggacgcaagtgctctgttgaatttgaagttgctgattgcaccacaaaggattacccagaaaatagttttgacgtcatctacagccgtgacaccatccttcacatacaagacaagcctgctctgttcagaagcttcttcaaatggctaaagcccggtggcaaagtcctaatcagcgactactgtaagaatcctggaaaaccatcagaagaatttgctgcgtacattaagcagagaggctatgaccttcacgacgtgaaggcttatggacagatgctgaaggatgctggttttcataatgtcatcgcggaagatcgcactgagcagttcttgaatgttctacagagggagctaggtgaagttgaaaagaacaaagacgctttcctggcagacttcacccaggaggactatgacgacattgtgaatggctggaacgcgaagctgaaacggagctctgccggcgagcagaggtgggggttgttcattgccaccaagtgatttggcctggcagcaggagggctcttcggaataagaatggatgtggctctaactctgcttctagaccggtgatggttcagcttagaagcaggggatcttcatcatcagaataaaaacgtgtgttgttgtgttgctgtgtctacgccactagtatttctgttgttacttatgttctaggtaaactgcgcagccagagcagagctgaagaatatgtactgcttgctcgctcttgtgtggttgtgtctaccctactagcatttcagctttgttgtaggtaaactgcgaacccagagttgcagaacccgtactgctcgtttaagctcatggtgaactacgagctaaaaggctgttgccagagtcgatgtcagtatgtcacttgtcactggaggtccccggttcagttcagatgttgctttggcacgagctattcttttggaaaaaaaaaaaaaaaacggccaaaaaaaaaaaaaaaaaaaaaaaaaaaaaaaaaaaaaaaaaaaaaaaaaaaaaaaaaaaaaaaaaaaaaaaaaaaaaaggggccaagctccaaccccacgccttcactacagccaacctttttttatagtgccacccaaattaaaaacacaggccaaaatataaaaaaccccgggattaaaaaaaccttggggttacacaacactttccctttgcaaaatatccccttttcccaaacgcccccattaacaaaaagtcccaaaaagagagccctccccaaaactcccccccacccaaattgtaaatgggaatcaccctcggccggggcattaaacacacccagagtgggggttacacttatcggaaccccaacacgagccaattccctatcgcccccccctttttctttcaccttttttttttttcctcccttatcgggttacccccggcgccctt

SEQ ID NO: 22750 - DNA, 2542 bp, Zea mays
ccacgcgtccgcgttcatccatcacaccatccccactctcttctctccacccggcgagcggacacccccctgtcctcttgacccgatcccgtccccgcccgcccgccccgccgccgcgcgcgctggtccggacgctcgggcgctggtgatccggttgatgcagcagcggggcctcgcccacaactgccgctcccgcggcttctcccgctcccgccgcgcagtcgagggcgcctgaaacgcacccgccccacgcacgcagggcaaccgaaaacccctcgatccggctctcctcgcgctgcagcttttataacgccgtagacgacaacgaaagagaacggggtgcctcgaggcccgccgcgcctaccgtcgtccgtaaaggaaggaaggaaggactcgagagatggacaccgtcggcgtccccgtggtggccgttgcgaatgggatcggggaggtggagcgcaaggtgcagaagagctactgggaggagcactccaagtgcctcactgtcgagtccatgatgctcgactcccgcgccgccgacctcgacaaggaagagcgacccgagatcctgtctttgcttccctcttacaaagggaaatcagttctagaactcggtgctggaattggacgctttactggagatctggcaaaagaagctgggcacgttctggcactagactttattgaaagtgtgattaagaagaaccaaagcataaatgggcatcacaagaacataaccttcaggtgtgccgatgtgacatctaacgacttgaagattgaagataactctgttgatctgatattttcaaactggctattaatgtatctttcagatgaggaggtccaaaagcttgtggggaaaatggtaaaatggttaaaggtcggaggccatattttctttagagaatcatgttttcaccaatctggagattccaaaaggaaggtgaacccaacacactatcgagaaccaaggttttataccaaggtatttaaagagggccattcatttgatcaagatggaggttcgtttgaactttctctagtgacctgtaaatgcattggggcttatgtcaaaaacaagaagaatcaaaaccagatatgctggttatgggaaaaggtaaaatcaacagaagacagagattttcaaagattcctggacaacgtgcaatacaaaacataagggttttgggatattacgttatgagcgtgtctttggtgaaggttttgtgagcactggtggaatcgagactacaaaggaatttgtgggcatgctcgatcttaaaccgggccagaaagtacttgatgtcggatgtggaattggaggcggcgacttttacatggctgcaaactatgatgtccatgttcttggtattgatctttcggtgaacatggtttcatttgcaattgaacgtgccattggacgcaagtgctctgttgaattcgaagttgctgattgcaccacaaaggattacccagaaaatagttttgacgtcatctacagccgtgacaccatccttcacatacaagacaagcctgctctgttcagaagcttcttcaaatggctaaagcccggcggcaaagtcctaatcagcgactactgtaagaatcctggaaaaccatcagaagaatttgctgcgtacattaagcagagaggctatgaccttcacgacgtgaaggcttatggacagatgctgaaggatgctggttttcataatgtcatcgcggaagatcgcactgaccagttttcttgatgttcttgaatgttctacagagggagataggtgaagttgagagaggacaaagacgctttcctggcagacttcacccagcaggactatgacgacattgtgaatggctggaacgcgaagctgaaacggagctctgccggcgagcagaggtgggggttgttcattgccaccaagtgatttggcctggcagcaggagggctggtcggaataagaatggttgtggctctaactctgcttctagaccggtgatggttcagcttagaagcaggggatcttcatcatcagaataaaaacgtgtgctgttgtgttgctgtgtctacgccactagtatttctgttgttacttatgttctaggtaaactgcccagccagagcagagctgaagaatatgtactgcttgctcgctcttgtgtggttgtgtctacccctactagcatttcagctttgttgtaggtaaactgcgaacccagagttgcagaacccgtactgctcgtttaagttcatggtgaactacgagctaaaaggctgttgccagagtcgatgtcacttgtcactggaggtccccggttcaattcagatgttgctttggcaaaaaaaaaaaaaaaaaaaagaaaacaaaaaaaaaaaaagaaaaagaaaaaaaaaaaaaaaaataaaaaaaaaaaaaaaaaaataaagaaaaaaaaaaaaaaaaaaaaaaaaacattaatatatgggggggccccccccttttgggtctcttcccccgggatattatttcgagccggtgccctgggggctccccatttttccttt

SEQ ID NO: 22751 - DNA, 1840 bp, Zea mays
gggaccctcgaggccggccgggaccatcttatccccacgatctccgttcatctcatctcagatcgcctcgcgcccggccggcccggattcacatccccttccgattctccgtcgcctgagcggctgagccaacctgccaagccaagcaagccaagtcgtcgcctccccgacccaacgccgcgacccccttgcccgtccgcgagcgctgcagcacctcggatcccgccccaatggcaacagcgtgtccgccgctctcgctgccgtccacctccctcttccgcggcaggtccgcccgcgccgggcccagacgcaggcagctcacggccgtccgctgcagcgccgtcggagaggcggtagtggaggaggcctcgcccgggacggcggaagagccgctgctggtgagcgcaatcagagggaggaaggtcgagaggccacccgtctggctcatgaggcaggccgggaggtacatgaagagctaccaattgctctgcgagcggtatccttcgttccgtgaaagatcagaaaatgtcgacctagttgttgagatctctttgcaaccatggaaggttttcaagcctgatggagtcatcttgttctcggacatccttactccacttcctgggatgaacataccttttgacattgtgaagggaaaaggtccagtgatctatgatccattgagaacggcagctgctgtgaatgaagtcagagaatttgttcctgaggagtgggtcccttatgtggggcaggctctgaatattttgcgacaagaggttaagaatgaagctgctgtactaggttttgttggagctccgtttaccttggcatcttattgtgtggaaggaggttcatcaaagaactttacattgattaagaaaatggccttctcagaaccagcgattctacacaatttgctacagaagttcacaacatcaatggctaactatattaaataccaagcggacaatggggcgcaggctgtccaaattttcgattcatgggctactgaactcagcccggctgattttgaggagtttagcctgccttatctaaagcagatagtggatagtgttagggaaacacatcctaacttgcctctgatactctacgcaagtggatctgggggcttgctggagaggcttcctttgacaggtgttgatgttgtcagcttggactggacggtcgatatggcagagggcaggaaaagattgggatctaacacagcagtccaagggaacgtggaccctggtgttctttttggatccaaagagtttataagcaggcggatttacgacactgtgcagaaggctggcaatgttggacatgtattgaaccttggccatggcatcaaggttggaactccggaggaaaatgttgctcacttcttcgaggtcgcaaaagggatcagatactaaagaaccttgcatggttctttcctttctccaaatcggcagaagttgtagagtcggcggcggtcgaggatagatgcagaaagccatgtgcagtatagagtgcctgaaaacatttttgtgactgattctgtctgtcgcatttcaagttccggtttcagtgtaatattgtaagcagatttgagtcgaggcgtaatgaagtgcctacttgtttatagcactactatagttctgtacaaccagtagccttgtctatgagactacgaagcagaaatactgatcatgtgttgacatgatagaaatgtttcagtcttaccccatcgagggtgtttgttcttgtatctcctcagaatactggttacaaacttttctttgcaaaaaaaaaaaaaaaaaaaaaaaaaaaaaaaaaaaaaaaaaaaaaaaaaaaaaaa

SEQ ID NO: 22752 - DNA, 1740 bp, Zea mays
gggtacctcgaggccggccggggtcgcctctccgaccaacgccgcgacccccttgcccgtccgcgagcgctgcagcacctcggttcccgccccaatggcaacagcgtgtccgccgctctcgctgccgtccacctccctcttccgcggcaggtccgcccgcgccgggcccagacgcaggcagctcacggccgtccgctgcagcgccgtcggagaggcggtagtggagcaggcctcgcccgggacggcggaagagccgctgctggtgagcgcaatcagagggaggaaggtcgagaggccacccgtctggctcatgaggcaggccgggaggtacatgaagagctaccaattgctctgcgagcggtatccttcgttccgtgaaagatcagaaaatgtcgacctagttgttgagatctctttgcaaccatggaaggttttcaagcctgatggagtcatcttgttctcggacatccttactccacttcctgggatgaacataccctttgacattgtgaagggaaaaggtccagtgatctatgatccattgagaacggcagctgctgtgaatgaagtcagagaatttgttcctgaggagtgggtcccttatgtggggcaggctctgaatattttgcgacaagaggttaagaatgaagctgctgtactaggttttgttggagctccgtttaccttggcatcttattgtgtggaaggaggttcatcaaagaacttttacattgattaagaaaatggccttctcagaaccagcgattctacaccatttgctacagaaggtcacaacctcaatggctaactatattaaataccaagcggacaacggggcgcaagctgtccaaattttcgattcatgggctactgaactcagcccggctgattttgaggagtttagcctgccttatctaaagcagatagtggatagtgttagggaaacacatcctaacttgcctctgatactctacgcaagtggatctgggggcttgctggagaggcttcctttgacaggtgttgatgttgtcagcttggactggacggtcgatatggcagagggcaggaaaagattgggatctaacccagcagtccaagggaacgtggaccctggtgttctttttggatccaaagagtttataagcaggcggatttacgacactgtgcagaaggctggcaatgttggacatgtattgaaccttggccatggcatcaaggttggaactccggaggaaaatgttgctcacttcttcgaggtcgcaaaagggatcagatactaaagaaccttgcatggttctttcctttctccaaatcggcagaagttgtagagtcggcggtcgaggatagatgcagaaagccatgtgcagtatagagtccctgaaaacatttttgtgactgattctgtctgtcgcatttcaagttccggtttcagtgtgatattgtaagcagatttgagacgaggcgtaatgaagtgcctacttgtttatagcactatagttctgtacaaccagtagtcttgtctacgatactacgaagcagaaacattgatcatgtgttgacatgatagaaatgtttcagtcttaccccatcgagggtgtttgttcttgtattctctcagaatactaattacaaacattttctttgcatgatatcagttttttttgttcttcaggttgacttggcttcccagataacttgctcgtgatctatctcgttaagttaaattttctgcaggtcgac

SEQ ID NO: 22753 - DNA, 6860 bp, Zea mays
  misc_feature (1859)..(1859): n is a, c, g, or t
  misc_feature (2165)..(2165): n is a, c, g, or t
  misc_feature (4343)..(4343): n is a, c, g, or t
  misc_feature (5991)..(5991): n is a, c, g, or t
gttgtgagttgtgaaaaaatattataatatgtgaatcgaaaaaaatgcttctataaactatatgtcataaaaaaagtatagcttatttagccaaaacaattataaaacacacaatcctctctatatctttcttaaaacaactaaaatatctctacatttcaattaattcaaagaggttaaatgttgaaagcagaatgctaaagtgatataaaaaaatactatgtaaaatgagctgcgcctaaaaagtgccatcagattttatttattttaaacagtagaaataggtagaagtggaatgcccattggccggcgtgccacgagcccacgacggcccacgttcttgcatgttttgaagggaagagacatttcttagcggagaattgaagccaccgcccaccggacctggcgcaccgcgcacgacaccaaagtaccaaacgcttgggagctttggactctacaccgcgcatagatcgtgggcatcgcgacacctcacctgcccccctgcggccgccgtctctcctcgccggttaccccttgctgcccgctcccctgcgcctcgcctttctcgccctctttccgcctttctcacacgtgcccgccttctccgcccctctcctcaccagcggtggcgtcgaccggcagcggcgttcaactgcgccccacgagcaggtgagcccgtccaacgctctgcctcaccaacccgcacgctgaattcctcgttccagcgattaatttgtagcctcggatctcattttgcgtcgtcgcgccgcggagagttatctgtctctttaattttcgtgctgtgttgtttttcgcggtggatctcgcccgcgacgcactccccacgtagatgctgaatacatttcgattgggcgcctttgtctggatgttggatcattaggtgtggaacgactattagccttgcctgttgcggcggggatttgatagcgaaattctgcagcgatgcgagtgctgactcctgcaatcggggggtgtttgtcgattcgaggttctgactggtcccggaagaggccagtgtcaccatcgttggcagacttcgtgaatcggtcagcagaggaacggcctgtctgcttgcttagtgctccaggttttggtgtcactatcgctcggaatggaaggatatttcccttttcagctcaatgcttgctagtggcctctgtgttccccatgtttccatgtatattgcgtattgctagacgttactgtttgctggtttcgtagatgaatgtcgcatctgatgtgctcttgttagaattgagatgagcaatgcactgcttaagttcttaagttgggcatcttgagttttgatgccagtttaacctgtgacataacctcaatagtgactgggcattttctggatttggacctgaactgtgcaggtttcttggccccgtcgacttccagtgagttcagtttagctcagtaagcatctgatcaacttcgaggtgccagacagatcctatgctgccttactgggatgaaaggtggctgtctgcataggctccttgtccacaagctatgctttggcctgagtattctcactgtgccgattattgttctgttactggaaggagccccagtactcactatcttcagcccaacaccagggcaattaaaagttctctctcaaggtagtctgacatctgtatatttttggcttgtcgccttatctaccaattcataatttacactctgattgttggggacttgttgttttcagaatttacactctgattcttcttggcatcaggttttctacatcagcaggagcaggaacatcttggagatgatggagcaaccctagctggatctccaggtccagcttccaggagccgctngcaaaaaagtaggggcaaagtgatgaaaagtaatttcttttgtgcagtgtgactaaatacttattggttttgttgtgtgcccctcttctggttcgtgcttgctgacttacctgaagccttggaaagcatacttctcgtagtgcttattttcaaatcaaacgatctgtgattctgtggttgagtcatgtttacacattaaagccccatttatctgcttttgcataattgaaggttgttgttacatcctagaatgtaactatgcagagcgatgccattttattattgtttattcatctcaaccattgnaaatcacaattttatgctgatgataaggtgtttttgcaaacatgtaatttgctgatatcaaatttctttgcctcatataatgattctattacttcgtagattgcaactacgcaaaggggaagtggatagaagatgataagcggccgctgtactctggtaatgagtgcaaacaatggctgtcaaaaatgtgggcttgtcgaatgatgcggcgcacacatttctcttatgagaattaccggtggcaaccacatgactgtgagatgcctgagtttacagggcctaagttcttaaaaaggtatcttacttcatttttctgcataccttaatgagatctggattatgctaacatatttttgggatttcaggatgagaaaccgaactcttgcttttgttggtgattcacttggcagacaacaatttcagtcaatgatgtgtatagcaactggtggcaaatacagtccagaggttgaagatgttggttggaaatatggccttgtcaaagccccaggtgctctaagacctgacgggtgggcttatagattttcgtccaccaacacaactatccttgcaggctggtctgctactctgtctgaattggaacctctgaatacagaacacgcggttaccagatatgcgttgcatcttgatcgaccagttacatttttgaaggagtatcttaatgactttgatgtcctagtacttaacacaggccatcactggaacagagggaaattcaatggaaatcactgggaattgcatgctgatgggaagcctgtaggcaatggtagtagacttgcagacctaaaccgtgcaaaaaatcttacattgcatagcattgctagatggatggattcagaactcgcacggcatcctaagatgaaagttttcctcaggacaatttcaccaaggcactttgtaaatggtgactggaacacaggtggaacatgtggaaataccgtcccctttactaatggaagtgaagtcttgcaggatcattcaattgatatacccgcagaaaatgctgtgaagggaactcgggttaagcttttggatatcactgctatctcaaaactacgggatgaggggcatatctcaaactctagtttcaaaaaggcttccaccggaattaatgattgcttgcactggtgcttacctggtataccagacatgtggaatgagcttctctttgtacagatttagtatcaccctcttgttaggcagatctttttcagagccccaaggatctccgctgttcatagcatagaagtaaagtttaaggaattttgggtcacccatatggaggtgttcacatgatgatactattgatttctatgaagtacgtaatttacagtgtggaacagattattccaacttcctttcggagcagagtaggagatggaggtgttgcacagcccaatctgactatcgagtattcttcaggcacgttgaactttgtttctacgtttaccttactgtaaaatcctaccacggtttaccatgtgcagcatatatccttcagaaaaatgttcatacctgttggtcgtaattatatttgttcattcagatgaaattaaaacttcaacatccgattgatttgtcatttgtgtgagctcaaaggcttcactcttgtctgtgtaacattttcagtgatagatgacctgatataccatgcatcttatacctatatgacacacctagggcccggacggacgacctcgtctggatgtagcccgtgcgaaatgggggaccgcatgggcgcatggcatgtgaaaggaggccagtgctgccagcttaccgcgacgactgattcgttattcgagttatttacaagtacctaatatatctagatgatacatttgcaacgtgcatcaaaatttgctgaaacatttcgaatgtgtttgtaacataagtatagttattacaatagactccctcggttcgttttttatttgttgtctgttagcacagagctgaatagggtggcgtttggtttgcgaaatataacgtaaatgataatggtaactatttacactcgaatatcgatggtaacaaatttgaataaaacgatacctatttgtagtgtggtatcgattatagttagacttaaataaatataatttaacgttatcgattacccatttggttattaatatgtgaactaaacggcacctaggtganaccaaataagtaaaaacggagatagtatataatatctagatttattgcaatatactaaacagtatctagatctaattttgtgttgtctaaatgaaacacttgcaatgtgacgttatcatggcaactggaacacacttgtttttaaagaatgttgtctttcatttggtgctcacaatttttcatctatttttctaagatttataagtacaacagcatgagcatatcacaatattttaaatatgcataattttgtcaccgatcaattccatgtcatcaaaggctcaatatgcaaagtttgacttatcaattttatggacattataaaatcaaccgaaggggtttaatatgtatgccctgttctagaagaaatgaacactagtatgtgccagaagaataagcttttaaaagatctgtatatttgttttctcagcgatcagttggttaaactgatataaggatatctccagcagcttattcatcctcgtacctatattcaaattctattctgtgaacagtgtagtctacagcaaaaaactgtattttgggttactttttttagtcaacagcaaaaaaactatatgggtgaaaacagtcatataaacattatgaagaaaacaaacaatcatgaacctgataaggattaggcaagggttgggcgaaattgcataaatcatgttcctctagtgcactttgatgttgatgtatactaagcaattattattgtcacaacaaacgctccccttctgaaaggcaacgccatctattccgaaaagaaagggttaactatcttgatagtgtcagtttatgagtcaattcgactgaatatacagtttttctctttttctggaacagctaccgacaaatagctttggatgttgaagagtttgtttctttactttaaaccgtatttgcatgtggagcccaagtaaatgatgtaaaccttaaaaaaacaatagttattcacttaggactgttaaaggccataatactaccactaattgcatacaagtatagatagagagcaaaatattatatgctttcagtttggatattaaaaccggaaactggggtaattcacaaataggctgatctcacaatgaatcgaatggataatgtgtagaggagcctagtgccggaaatatgagccgcgcgttttgggcagcacgagcacagtctaaaaatagaagcctaaaatacgacgtgacagaaaataatttgggccggactggcacggcccgaaggtgggcctcaaattctggcccatcgagcccccgacacagcccgcacagatgggcctacacgacccaatgaaggcacgacgtggttttagggccaagctggaccactattttacactttaggctggcacgacacgacccaaaaaatttttaggcttttttggcctaaatctgtttggcacgaagcacgatgagctcgggccgggtcgacttaacccgaaccaattcccagtactagaggagcctctagccagatacgagtggtttaaatgatcagtttcaacggttgtctactcatgagcaatatgaataggtttcagctaaacaacaaacccttgaaaataattttaactccttcaccaacatgttcaatagttttactgagcatttgcatgcatactattgtactntttgtccctccaacaactttttatcctcatcctccattttatcctcctccaccttatggtgattgagtggttttctctttttggtacttggtgccaaaagaggagtgaacaaatggagaagttgactatgaagagattaagacaagaaagctttgaattagggggaaggttgtaggtgaactatgcatgttggcatattcatttgaatatgtggtaagcattattgtttatgattgtttatgatgaacatagtacttttatggtcttgtgttgaactaagttgaaaggtaaatgggctatataacatttctatattggttttgatgattaatgaccaagacaacgatgttatctaactagtttgctaaatctatgaacgtaggttcataagtgtaaaattgacgtactcaatgcaacaatagcttaaatgcccttagaaacataattgaccactttagaaggattgaaagtttagattttgaaaaatatgcaattgaagccaatcaaccaagtttgagctagattcggattttaagttggatgaatcaaaaagacctataacttagactaattggacagattctatatatgtttatctaagtcataaaaatactctcaaagataaccaaataaagacaaaagagaaaaagcccaatttggacttaagtatactagcatgcggcgcattggaccagtctagtgtgtgccggactgagtatgtagagagggttaagtctggtcttgcatgggtcggtgcactagaccaatccagcggtacgttgagcccacttcacatagacgtctatttctaggtagatggggtttgggggtaccaaaccagtttgtagtgtgacagaccacttaatgca

SEQ ID NO: 22754 - DNA, 814 bp, Zea mays
gccggccgttttcgagacccgacaccaaagtaccaaacgtttgggagctttggactctacaccgcgcatagatcgtgggcatcgcgacacctcacctgcccccctgcggccgccgtctctcctcgccggttaccccttgctgcccgctcccctgcgcctcgcctttctcgccctctttccacctttctcacacgtgcccgccttctccgcccctctcctcgccagcggttgcgtcgaccggcagcggcgttcaactgcgccccacgagcaggtttcttggccccgtcgacttccagtgagttcagtttagctcagtaagcatctgatcaacttcgaggtgccagacagatcctatgctgccttactgggatgaaaggtggctgtctgcataggctccttgtccacaagctatgctttggcctgagtgttctcactgtgccgattattgttctgttactggaaggagccccagtactcactatcttcagcccaacaccagggcaattaaaagttctctctcaaggttttctacatcagcaggagcaggaacatcttggagatgatggagcaaccctagttggatctccaggtccagcttccaggagccgctcccaaaaaagtgccgccgcccggatgaaaaattgcaactacgcaaaggggaagtggatagaagatgataagcggcctctgtactctggtaatgagtgcaaacaatggctgtcaaaaatgtgggcttgtcgaatgatgcggcgcacacatttctcttatgagaattaccggtggcaaccacatgactgtgagatgcctgagttta

SEQ ID NO: 22755 - DNA, 2103 bp, Zea mays
  misc_feature (340)..(340): n is a, c, g, or t
cctttcgatgagttaggagtggtgcacactagttatctttagctctaggtagcttagatgaggcctaaaagctatttggaactaaccatattcacaaagtttttgaattggaggtgaattgagagttattagaggcattggatcctaagagcatctctaagagctccctagaaaatgacttctcaaaatcagttttgaggggtatctaaaaacttagtaggggtagatttaaatcctttctccaacggattctttaaagcgacagatttttctggggagcccaaaacccccctcatttatagctacaaataaaggagttttaagggctatgaaaaattangaacgttttaggaaaactgttggagatacgtttttgtgtttttcccaaaaaaaacttgatttaggtgagactactgaaaaactcttggagatgctttaagaaacagggtcattaaaccaatacgaatggtcaaacacctccacgtggaatgctagtgaaggcatggtcgttggaccctatgaacggggtcattagaccagtgcacatgagttcaatggtctataaaaatagactagagagctcgagattgtgtcgagctggtccaacagtcgttgttaggatggacgatgtaactttagcatctagagttcttcctacaagattattggaccctatgaacagactcaatagagtgactataggaccattgggtctaggtctatcctacccccaataaatataaaaattaattttatcaactaacctgtcttttttttgttgttttaatatttattaaaattaataaaacaacttacatagagcgtgagagctgctcgcaacttattgccttgtgctggccagccacttagcattgagcacaccacacagccagagccagtattttttttttttttttttgacaattggagattgcatttaccgaggatataactcatcacgtacacttttacagttacagacaagtagacgtgaaagcctcaagcgcaccgccacaatcggcaagcgtttgtttacatacatggacgtctcccggcaccaaccgcgccatgcatggatggttcagctcacctgcttgcgagcgggaaccatttctcccggaagttggactggtaggaaaccatgacgaggagcagcaggagcaggaccccgacgccccacggcgacccgccggcgcggtggatggagtcccgctcaggcatcggcaccgccagcaggtgacccacgctccggcccgcgccctcgccagagacgctggacagcagccgcacggccagcagcagcgcgaacggcgacgccatgagcacgatgcgcgcctggtaggcgaacgactccgcggccgactcgtagctcgtgtaccacgagcaggccaggaagaggagcagcaccagcaggaagaagcacaggtgcagcggcacttccagtgccgccggcgccggcgccgagccacccccgctgtatgagttccccatggatctcgctccttagctgtggcttcaggccttcggctggcggttcgtgaacgtttggtatctcaggtgaggtgattagcaggtggctttcttggatcgaagtaaatcaagcttgatgcgatgtgaatttgtgatgccggctgggctcgatctgggtcagctcatttatacggcctgcggctgcgctgcacgccgcaacacgccaccagccaatgcgcgctctccacgactgaccgactaaacatggtggcgactggcgagcttgagcgctggccagtgggcactcgccgcacgacacgtacgcaccgcacgcgacatggacggcgagcagcagcatcagcatgcacgcccccacgcgcgctgcgcgcacgtggggccggctccgcgggaagaggaggtggtggaagcgggaggctctgccgctttgcttagcccgagaggtaagcccttggcgtgcgcgtcgacgcgaagcaaagcccgcgctgggccgggccttcattgggtgggcggcgaccgtgggtctgctgccgttgccgcgctgggcggtgccgtgcgtgaaccgcgcagtgcagcagctgccttggtcaggcagccggatctgtattttcttag

SEQ ID NO: 22756 - DNA, 1737 bp, Zea mays
ggccgctttttttttttttttttttaccacgatacacgtacacacagaggacccaggaagtacatatagcacaagtatgccaccaatatatatccatgcatgggctcattcacccattcatatattcatattaatatttgcgcattggacgtcttccgcccggagtttggttctttcccgggtgaatggtgatgttgcgcttcatcccgtgaaaaaggggcctccaactgatcttcttcaatcttcccctgcatctgcagctgcagcaggcagagggtggccgagctcgtgccgctgctccctgcggacgaagcgcaccatgagcccgttcttcatatagagcgtggtgttgagcttgggcttcacctcctgccccggcagcacctccacccggaaccgcgccagcaccgccgccgccgccgtcttcatctgcatgtacgcgaagcgcttgccgacgcacagcctcggccccgcattgaacaccacgtacttgtaggggctctcggcgccgcccgcgaacgcgccgctcttgctcagccagcgctccgggcggaactccaggcagtcggggccccaggtggccttgtcccgtcccatggcgtacgtgtagtagatcacccgctgccgcgcgcgcaccagcgtgccgtccgggagcacgtcgtcctccagggcctccttgaagtcgacgggcaccggcgggtacaggcgcatggactcggtcagggccgcgtggaggtagtccatggcgctgacgtcgccgccgccgcgggcgacgtcgtcgaggacgcgggcctccacgtgcgggtgggaggcgaggagccagaagacccggccggccgcgacggacccggtgtcgcggcccgcgaggatgaagctgatgcagaaatcacgcaggaactcgtcggagtagccggcggcagggggcgacgacatgagccgcgagaggaggtcgcagcggccggccaggtcccccaccttgcgcagctcggcgcggcggtcggcgacggtccgctcggcgaacttccgcacggcgcgggcggcctccacgagcgcgcgctcgctgccgacgccgaggagccgcttggacttccagacgaagggcggcgtgtagaagcgggtgagcgagagctccgtggcccgctcgaacgcgcgcgcgaacggcacgtcgcggagcccgtcggccaggcacccggcctccaccccgaaggcggcggcgcagatgttgtcgaacgcaaagcgaagcagcacgtccctacaggtccaccaccgccgtgccctgtggccctcgcttgctcaactcctccatcagtggtagcagctcactgtgcaccgggcgcttgacggtagccgccgagaactagacgaatcgcgtcgagtgcatctcgacgtcgacggccttccattgcgcgtgccatgagccgccgtcgtgcggtctccgtcgctcgcgcctcgggcagtcgtcgccgccactgtcgatcgtaccacaggaggtcgaccaccgccgctcgtgcattaggcgtaggcgatcatgaccgttgtggcgctcgcgtctcgagcgatgctcaccgacgtcacctgccgctcgccgatgtcgcacctctggccgcccctcgcgtctcacgtcgatgctcgcgccttgggacaccgtcgtcaacgtccgctcgctgcagctcgcgcctcatgcaatcgcaactgccgccagaaatcaaaaccctaatccctagggtctggcctgct

SEQ ID NO: 22757 - DNA, 3218 bp, Zea mays
  misc_feature (107)..(107): n is a, c, g, or t
gttatagaattttgtagttggcaaaattttcatttcaagtcatcttgtcaacgaaaactacgtctgaatttaaaaataattaaaatttgaattttgaaaatgacctngaaagaaaaaaaaccaccttcttgtgggttgggggtattgaagagttatgaaactttgtaatcactagaaatctacaatataatgatcaccagcaagcaacatttgaatagtttccttgttggagtccatcctagtagctaatgagatagacaagactacacaataactccatctgtatcagttaacttacagaataataatccatgcatggaattaatggaatgggcaattaataatatttatgatgcatgatgagttgatcacatgggcagcaggtattggaagtcgtagtccaagggaatgacatccacgaccacctcctccagcttgttgttgttgttggtaatggcggcgaggcaatccaccatggatttcctgatggaccaggacgtgggcagctgctcgcagatccatcgaagcagcgactccgtgtcctttgcaaagtcatgcatgttggagtggaggaggcttgggatcatgagcctcctggtggatgtcaccaccagcgatgcctgcaggtactcaagctttgccttgtccagatccacaagaacacgatctgctttgtagatgcgaagctgcattgtgttgtatgcattaattgagtgccaatataatacatacatgcatactacttactgctggcgatgatctgatgccgcagcagagtgcaaagagaatgttgggttctgaagtcttgagcccataaacctccctcaccgcctgttcttcttccacatccacgtcgcattgccacaactcctgctggattattcgttcatgcatatgctgtagcaacgtcgtactgcaatcgcatgtgcatgcatatcaaatattctcacctgtttcacacttgacggctgcctcaagataaaattctcaatcaccaacgcattgaaagtttgccctgacgcgttgattgttgccttgttcttgagtgcgagtaacttgtccgagtttgagggcaaaccatgctgcagaatgccctgcatgaatatgcatatatggcatggatcagtagattagattagttcatccatccatccatccatcgtctgcactgcacagagagagagagagagagagagagagagagagagagagagagagacgtacgtgcatgatgcatgtgttgtagatgttgagccagaacgccagcctctggtggtgattcaaggagcgcacatccacctgctgcagcgcctccagcatctccctcagtttgcttaccaggggcgacgccgagaaccctctgctgaggaggtggaggtccagggagccggagccggagccggagccggagccagccgaggtggtgaacctgacgaggttcttgtagggcccgatgtccctcaccatggagtcctggatgccgaagatgccgtagtgatcctgctggcccctctccttctccttggccgccgcagctgcagccacgttgacgagccccatgtccatcctgaagccgccgaggttgcccgcggcggactcggacgcccgggacgaccggagcagccgcatgaagatgcacaccaggcacttgaggatcctctccgacagcttgttgggcggctgctgctggtctctcgccctcctctttgctatcaccgtggggctcttcttggtgatgggcagctcgtgctgggcgatcttcttctccaacaccgcatgcccatctgacgacgacgccagggaatgcctcttgttgttcaccaccgtgctgaggtacgcctcgccgtccatggcctggctgatgaagaacatggacttgcagtgctccgtctgctgctgctgctgctgctgcgtggcggcggacttcttcatcctttttatctggtcctccagcctggcgatctcttcctccaccagcagcagctccgcgagcagctccttggccttggtggggatgaaggcggggatgttggcgagggccatggagctgctgggctgcaggccgccctccaggatctggtgcaccgtctgctcgttggatagctgctgcttcagctctgccacctcctgttcgagtgcctcacgccgctgtcgttgcatcgtcgcgctgccccgcgtcctctgcgactggaaaaaaaaacaaggaacgtctcagcatgcatgcatatgcatggcaacacaggctagagtaggatgacggtggtggtcgatccatcgtactgactgaccacaggcggaggacggtggtcggcgatggagtgaacaggcggcggcactgctgcttgttgcaattgcatccgggcgaccacgtagtccatcgccgatgagctaataacaagctagctgctagctagaagatgatcggcgatcgatgaagcttgggccgccgccgggtagcatgcatgcagtggaggatgaatggtacatacatatggatggctggctgctgtgggggagctgtcggcgatgttggtggtgctgtcggatgcgggcggttggtagtggtggtggtggtgatggtggcgcctggtgtatatgtggttgccttggttggtcagtcatccatccatcattcgtcaccatgcatcattgtcactgcaatacgcctgcctaccaagaaaaaaacatgtggtttgctcagagtaaagtagccgttacgcacgttggttaccaatttattagctacgaattaattgaaggcaccttatagtttgcttcacacccaatataatgaatgaatgaacggataattctatttaatttgtctgtctctatctctgtattcgatcgcatgcctgcctaccgccaccactaccagcagcagatcagtgccttttcttgctgtctaacttatatattccgaaaaacattttcgtaatataaccgatagagtaagttagaacgaaatgacacttttagctacaaaagaaatgtctagattcataactaaaatgttattgacgctgaattaatcatggttggtattattgacgttgaattggatcacacatcagcgatcatcctggttatcacggaccgaagctagaaaaacatatacgtggtttatcagcgagcatcatggatatcacacctacgtggtgacaagcagatagttttacgagcatagcaaatcacgcttacgtcactaccggacacag

SEQ ID NO: 22758 - DNA, 975 bp, Zea mays
gctggcccctttcctttttccctggtcgccgcagctgcagccacgttgacgagcccccatgtccatcctgaagccgccgaggttgcccgcggcggactcggacgcccgggacgaccggagcagccgcatgaagatgcacaccaggcacttgaggatcctctccgacagcttgttgggcggctgctgctggtctctcgccctcctctttgctatcaccgtggggctcttcttggtgatgggcagctcgtgctgggcgatcttcttctccaacaccgcatgcccatctgacgacgacgccagggaatgcctcttgttgttcaccaccgtgctgaggtacgcctcgccgtccatggcctggctgatgaagaacatggacttgcagtgctccgtctgctgctgctgctgcgtggcggcggacttcttcatcctttttatctggtcctccagcctggcgatctcttcctccaccagcagcagctccgcgagcagctccttggccttggtggggatgaaggcggggatgttggcgagggccatggagctgctgggctgcagggcgcgctccaggatctggtgcaccgtctgctcgttggatagctgctgcttcagctctgccacctcctgttcgagtgcctcacgccgctgtcgttgcatcgtcgcgctgccccgcgtcctctgcgacacaggcggaggacggtggtcggcgatggagtgaacaggcggcggcactgctgcttgttgcaattgcatccgggcgaccacgtagtccatcgccgatgaactaataacaagctagctgctagctagaagatgatcggcgatcgatgaagcttgggccgccgccggtagcatccggccggccgcgggggaatggtacatacatatggatggctggctgctgtgggggagctgtcggcgatgttggtggtgctgtcggctgcgggcggttgtcccggccggctcgaggtcccaatg

SEQ ID NO: 22759 - DNA, 2084 bp, Zea mays
aggtcgaagttgtcgataaaagaccagacggtcacgatataggagatgttctgacgacgcccagacacaaaaggttgtctggcggtaacatcgtcaagacgtctagcgctagagatggatttgtgctcaacgaagtggtgcgacgatacgaaacaatggttggcgtatgcttttcagttttcatgatataattaacaccaataatgatttagtgaatcccaacaaagttggtaaaagtagggataaaattgagttttgtagtgattttttttaatttagggatctaatttacataattgttggagaacttttttcttgaaaaccttttaaatttatatttaaagagttatttatataactattggacatactctaaaacactgttttgtactattttgtaccacatgctgctatacttataaagtgaggtttgatataagagatgagaccaccggagataccttaactcctgcgaaaaaaaaactgtgcggaaacgaaataaaagcaggagagagcatcttgtgtcgtctgcgcaagagagaaagaacactcggggttaggagatctgacccaatggccgcgaccaaggtgtgcaacgttaggttcgagggcaacgtgatcaccaccaccgtgacggcctccggcgcggccgtggagagctggctcgacgagatcctctccgtccaccgccgccgcctgcacaagctcgtcgtcgggctggacgtcgagtggcgccccagcttcagccgcgcctacagcaaaacagccatcctccagctctgcgtcgggcgccgctgcctcatcttccagcttctccacgccgactacgtccccaacacgctggatgagttcctcagcgaccccgactacacattcgtcggcgtgggcgtggctgcggacgtcgagcggctcgagaacgactacgacctggaggtggcgaacgcggaggacctggccgaactcgcggcgaaggagatggggcacccggacctccgcaacgcgggcctgcagggcatcgcgagagtcgtcatggacgcccacgtcgagaagccgcagtgggtgaggacgggcccctgggacgcgtcatccctctccgacgagcagatcgagtacgccaccatcgacgcttttgtctctttcgaggttggccggatgctgctcagcggctactattgatcgatcgagccgttaatgcaggcggccgccgagagttccgcgttcttgaagtgcttttgattcgtcatgcatgtcctagtagattgctccctagcgcattagatgctctctcttaatcggtaaaagcaggttttaggggtttcggccctcctgggatggaagaaaataatcaaccagagtaccagacaatacaatcgtggtggattcgtggattaatcgaactattatgatgcttgatgcgtttgttcatggcttttgtctgctttatttaactcatgcaaatttttgtggtgattaacaagtttctactgttatcgatctagcgtgtgttgtgatgtcgatgtttgaggcgatcgtgagttcgtgactcgacctgtactcgactgtatatatgcttgcccggagtggaaggcgagacaccaccgcggcggcggcggcggcggcgaggaagtggccccgcaggccggagggaggggctgcgaatcgtcgagacccgttgcctgtgaccggggaggagtagatgggtcagcttttgactgccgctggcattgccatgacttgcgccgcggagtggatgaaccgaccggacctccgccagacggtaactaggccctcgtgcacgtacttaggccggaaactagccgaccttcgctcggtgactaaggctcgttgggttattcctactccacgtggattagaagggattggacaattttaagaaagattttgacttgtttaagattaaaactcactcaatctacatgaattgagaacaaaacgaacaaactctaaacagtctcggtttggcttaacattggatcgcgagtcatttcctgatacttattattatattatttagtgaattaaaatcatataaattcaaaatataaaatcatcattcaacattg

SEQ ID NO: 22760 - DNA, 1752 bp, Zea mays
  misc_feature (1737)..(1737): n is a, c, g, or t
  misc_feature (1744)..(1744): n is a, c, g, or t
  misc_feature (1751)..(1751): n is a, c, g, or t
cttgcatgcctgcaggagaatgcatggagtgcgctattttgcagtggcagtggaggagcggtatatcaagcgttgtacggatgcagtgcgctatccactgtgccgtgaggttggcagcaaaacgcggtcacgtgtacataggagagaattaaaaaatgatataatacgtagtagttggtatagagttgagatatgaagtaaatatgactgcaaaggtttatggtatagagtaaagaaccttgctgataaggacagaatattttttagagtagaaatttagagttgtatgagtgcagatagcctaaaagtgtataatagggttctggcttttttccagacaaaagccagagccaaagtctgcaaacaggctcttaatttcacgacacaacacgttttttttttttttttggtgatgaaaatttgcttggatttcaaaagatgtaatattcaatcaaatttaaattatacagcataaaagcaggcatacagctggaaaacgaaacaaagaatgtatacagcataaaggcagatattaggggagatcaggggaatgtatgtaaaggcaaaacttaggaaattggaagcccgccggtacgccatctgatcaggacctgctgttgaccttgcggcatgtcttcctgatctctccgttggcggcggttttgatctcgacgccggccatcttcaccatggctttggcgaacttctgctgccacagatagggcacgaagtccgcgtaggcgcgcaccaggttgttggacgtgaagttggtggtgagcgcggcgtccgacgtgaagagaaccttgtgggccagcacgttcttgtagtactggttgtccaggacgtcgggggtcttgaagtcctgcatgaccgtgttgtcggtgccgttgggcgacgcgcagctagcctgcagcgtggcggcgaacgctggatctatgtcggtggtgttgctgggcggcaggcggtccctggtgaaggaggagcagtgggagcggccgatgctgtgcgcgccggagagcgtgatcatgtcgaaggcgtcgagccctttgtcggcgaacaccttgacgagctggtcgaagccggtgaacggcgagggcaggttggggagggtctcgctggcgagggagacgttcccgtcgtagcgccccgcgggcatggcgaagctgatgccgccgccgctgaggaagtaggacgcgtcgcgggcggcgaacgcgacgatgtccgcgcacgagaccgtgccggggcacgccgcctcgatctcggccttggccgcgtcgatcacctcgaagccccgcaggctggggaagttgggcacgccgaacttctctggggtcaggctggtgtcgttgctgaacgtgtcgaggaggacggagccgtcgcatccacggacgaagcagtcgtggaataagagacggacaagcccggcctgcatgccagcatcggtggccttgacgtgcttcttgacaatagcttcaacatccacgtaagcggcacacttgtccttgtagtatccgaccatgagttgcggactagaaggagggctgggtgttggagatggttgctgcggggttgggtagaagtagtagccaccggactggcatgacacggagccgagcagggcaaacagagtgaggacagcgagcttagaggttgtcatcgcttaatccctcgtggtcttgtgctactagaggagacaggcgagacgcgagagctagcgatgggctgaatgcccggccnacgtagntgactcna

SEQ ID NO: 22761 - DNA, 742 bp, Zea mays
  misc_feature (14)..(14): n is a, c, g, or t
cgggaaagtccaancatggtcattctagctagctagcttcgttctcactccaggctccaccacgcacagacaacgagctctgcccccacaggccagcaggcagatagatcctcaccattttctctttcactcgcatcggatctctcccataatacactctcggggtctcggttgccaggaatcactggagccgagcgagcgtgtataaaagggcgcttggtcctccgaagcctgaaccttgaagcgccccgtagtgcagtgcagcagtgtgctacctcctcagtcctctcactccatcgcaaacgctagtcttcctctaaagagatctttggcaacgaccgacagctcggagcgagtctcagaagcgatggcggcgtccaagaggctgctgctggcggcgctgtgcgtggtggcggcggcgctgctcgccgtgcggtcggagtcccacggcctggaggacttcgcaagcagcgacgcgacgccggagatgcagaccttcttcaagcccgaggccgcggcgctcccggaggccctggacgcgtcctccatgcccgccgccaccatggccgcgaagccggaggccacgtcgatcccgaccaccaccggcaccacgacggcggcggcggcggcgggcacctccgccgcggcaggcactactactgcgtcgtcgccgccgcgcaggtccgtgtccgtggccgccggcgtggcctgcggcgtggctgccgtggccgtggtcggcatc

SEQ ID NO: 22762 - DNA, 969 bp, Zea mays
aatttttctctttcactcgcatcggatctgctctcccataatacactctcggggtctcggttgccaggaatcactggagccgagcgagcgtgtataaaaggccggcgcttggtcctccgaagcctgaaccttgaagcgccccgtagtgcagtgcagtgcagcagtgtgctacctcctcagtcctctcactccatcacaaacgctagtcttcctctaaagctcggagcgagtctcagaagcgatggcgtccaagaggctgctgctggcggcgctgtgcgtggtggcggcggcgctgctcgccgtgcggtcggaggcccacggcctggaggacttcgcaagcagcgacgcgacgccggagatgcagaccttcttcaagcccgaggccgcggcgctcccggaggccctggacgcgtcctccatgcccgccgccaccatggccgcgaagccggaggccacgtcgatcccgaccaccaccaccggcaccacggcggcggcggcgggcacctccgccgcggcaggcactactgctgcgtcgccgccgcgcaggtccgtgtccgtggccgccggcgtggcctgcggcgtggctgccgtggccgtggtcggcatcgcggccgccgtggcgtacgtggtgcgcggcaggcgcagcagggaggtgcagctcggcggctcctccccgtgagcacgcgcccagcgccccggcccgctttacaggcaggccgtcatcgccattaggatctggttaagcgcgtcgtctagctctgcgatttgtgtgtggcttttgggttagtggttgaattctttttttcgcgtggggttgtcggtgaagatctcgctaccgggtacggaccagccgtggtgcatgtaacataaataacgctggtggtattagcgtcattgttgttgtggcctgtgtgcatggtgtctagacctttgctagatattttgattaaggggggggcccggtaccca

SEQ ID NO: 22763 - DNA, 940 bp, Zea mays
ataatacactctcggggtctcggttgccaggaatcactggagccgagcgagcgtgtataaaagggcttggtccttggtcctccgaagcctgaaccttgaagcgccccgtagtgcagtgcagcagtgtgctacctcctcagtcctctcactccatcgcaaacgctagtcttcctctaaagctcggagcgagtctcagaagcgatggcggcgtccaagaggctgctgctggcggcgctgtgcgtggtggcggcggcgctgctcgccgtgcggtcggagtcccacggcctggaggacttcgcaagcagcgacgcgacgccggagatgcagaccttcttcaagcccgaggccgcggcgctcccggaggccctggacgcgtcctccatgcccgccgccaccatggccgcgaagccggaggccacgtcgatcccgaccaccaccggcaccacgacggcggcggcggcggcgggcacctccgccgcggcaggcactactactgcgtcgtcgccgccgcgcaggtccgtgtccgtggccgccggcgtggcctgcggcgtggctgccgtggccgtggtcggcatcgcggccgccgtggcgtacgtggtgcgcggcaggcgcagcagggaggtgcagctcggcggctcctccccgtgagcacgacccagcgccccggcccgcttgacaggccgtcgtcgccattaggatctggttaagcgcgtcgtctagctctgcgatttgtgtggcttttgggttagtggttgaattcttttttcgcgtggggttgtcggtgaagatctcgctaccgggtacggaccagcagtggtgcatgtaacataaataacgctggtggtattagcgtcattgttgttgtggggtgcatggtgtctagacctttgctatatattttgatttcaggattttgctgttgtaaaaaaaaaaaaaaaaa

SEQ ID NO: 22764 - DNA, 6929 bp, Zea mays
  misc_feature (442)..(442): n is a, c, g, or t
  misc_feature (918)..(918): n is a, c, g, or t
aaggacctcgcagaccaacacagccgacagatcggtgaagcacctgacgcaacaggttgaggcagatgcctcatcgctggcttgagcttcttgttcagggttagagtctctcgaaacagatccataactggatttatgtttctccaatttgttgaggctcttcaaacctttaggtgatgtttggtttgtggaatcattccatccaaaatgaggtggtgcatcatggatccatttctcaaatttagtgcgatgaactcaattctcatattagtactaactaattaactatgaggaatgaggtggtgatggaccaactcattccattacacaaaccaaacaaaaaagtaagaagtgagaagatgatggactagctcacccctcaaaccaaacaccctattagtcttctagtagtgagataagggatttgtctggattagagtancctcagtgcaaacgctggagcaattatcaggcaaagaaactcctctttccttgttgcagtcaaaggccataaaattatgaggctcaacctcgagattaatctccccagaccaaatccccctggaatcacgagaatcagaacacagctatacctgaaaaaaaaaatcaagaaatcaatgatcaagtctcaatcacaaatcatatgcaatatcattaagtacaccaagactgaatctagagagcgtcagggcttgttcggttagctctcaatccatgtggattgagtgggattggatgggtttgaatcccaaacaagtcaaacttcttcacaattttttccaatcccatccaatccatgtgtattaggaataaccgaacaagccctcagcaaagcagtcaagctgctcaatatacaaacatccgagctatggtttgattcaggcattaatcagatcgaagcaaatttcaatccctgcntaaccagcaagcttcgcacccgcaaccaaacccgacagtaattcgacctgtaatggctatagatgatttaggttttctacaccaacagctcgaggtgttctacctaaatcgaagccaaaaaatccacggcaatcccgccgcggaagcactcctactacaactgaaaaatcaggcgaaagtatgcccctctgcatgcccgaagggtgatgctcaaagggtacgatactcatgtgcatgatgattttacctgagtaatcgaactccttctgaaccgacccaagttcgttgaacaaatcgggcttatttcgttttgggcttctgaacttggcaaagcacgcctgacttgtcactctgaaacgaagccgagcagattggcttctcagcagatcacagtctcaactgtcaactgcttccgaagaactcgatgtaaaaaaccaacgatccgatggcatccattaaaaaacaagaagcgatctaaaaatccccatgattaacattttaattaattatcatggccggttggactcaagccccacgcgtgcgctgactatgatttggtctatgattggttaactgcatgacatgaactcaatctgcacgcaaggggcggagcctcgccagtgttcctcctgtctgcgtgtatgcgccgagacgcgaggcagctccgtatctaccgaaacaagctggtgaaggtgaggtggaggcgggaccagcaaccgatcaagtcataatgtcataatacatagcatgcttaacattttaggtgaccatatgctgtcattttcagtaagttaaattgatgtgtgtattaagttgtttgcgtgatttgtaattcttgtttgcaaggtaactaaattcaccttcttgtggcctgaaaccgttgtttgtgatatgaaaaaacaaccattgggagagagaaaaaaaggtccgcagtgtttaggttgaaaattatagagacgaacatatttacactgcttatggtctgaaattacaaaagtagacttcacttgctctgacaaaaaggactgtttgggctgattatatgtttacactacttatggtctgaaatcacaaaagtaggcttcacttgcttcaacaaaaggactgtctggattccaccatcttgaacctaggctatttgattctttgatagttatgtatgactgctattgatttgtttgacttcattctagcctcccttactgaagagcactgctatttgatatgttgtcatattctcttcgtttattggcatcttacagaccattgtgctgagaaaggcgtggacacaaaatgtatattgtttaatattttttttggaaagcatatgaaactttattggttcggtttcttcaaaaataatctcagattaagtgatctggtaaaagtattgtattctttttatagtatatatacgtgcacgactctataccttacaaagtctgctcttttttaaaagttcttatttataaatataataggacatcataactggttgtaaacacatgagttgtcggacgagcacgtcttctagtttttagaaagccacaacaaagcaaataaaaacaagcgagaaagaatcacaagactcccggggacagtccatcttccccaaaaaaggaagagtgactagctaagcactgattcttttttttaaagatatattgcgctcgttttgcaagatgttgctgaaaaccagtctaataaattgctctgaaaaataaccgatagaaaaagagcacaatattatacccgtggttagtttttggccactaatcagccgccattactgagcgacaagtgaaaagggacacgaatgctgcagccagaagagcacgtgtccttccgctcgcgttaagcaactgataaaactctgcagcgggaccgacgaaccatacccacgctgccacgcaccgtcatcgtcaaaggcttaaaaagcactgtcactcactcactagtcactagtgcacatacacgccgggacaaaagagccccagcgggcagcggccagctaccactaccacaccgcaccaactttaacgccatgcacgctgcattgcgccagattcccgtacatgcgctaggtgcacggccgaagcgccgacggcgaaactctgccggcctcgcttccacttccaccaccagcagcagtgctatccagtctctctcggcatgtggaccgtcgctcactcatggacatggtcacgcggccagtgtttgggtcagaaggcgatgctccgaagctaccccgcccagccgggacagttgcgcgcggtgaatccttggagtgaaatggtttttttttttttttttgacgatgttagtgagagagaactccgaaagagactcacgcatgcatgcatgcatgcatggcagcagcatggggcctgaccgttcagtcgtcagagtatccatccagtcgcaccgtgattacattaccagcagacagcagtagctcaacgacaacgacactgccgtctgtcctgattgtgacccatatgatgctgcgagcggtgacctttatggatttattggggttaggtagcggaaacagtgtagataaaggagccagatcggctggccccaatcaccaggttttgttcttccgggtcatctatgattatttattactccgtacttagtagttattgttagtagtagtactgggacagcagagacctactcttcgtgtagatccgagacgttcacactctcgttgttaccactctcgctcgatcaccggaaggcagcaaaagttgttagcgctactagcattttataactacgactcctagagagcctatttagattcttgatctaacagccgaattaacaggcagtatgctaaacttgacagggataaaattttagcctacagtgcgtctgtctttcctttgtgggtcatgcttaatagatctgtgaatgcttaggatattacctaagggcccgttcgcttccaccggaataaacatggattcgttccagctcgtcaaaatctatataaattagagaagtaatccggctaggaatcaatccagacctccaatccctaacaaccgaacgaggcctaagtcactagaataccagtccggtctagtgacaacctcgatgacggataaattctaatctactgagaggttcagctgcaacataccttcttgattcgtgttcacggcagcagtagcatttgcggtggcgtccaagtttgtgtgttcacacctcctcctccatgtgttcctcctcttggagtttcatgtgcgtggttagtgtccaataaggacgtttacgacggcagccaatcgtgatggttccagtcatttatgggtgaattaaggtgatcgaaaccttgggaaatgtgacggctccgatttcggagtcgtagaaagtgctgtcgtaccagtctaggaccgcgtatatataatgctcaccttaatcgacggcacaaccaaaagtacagttgcgcacttgcgctccgatcaaggcacattgagtccatacacgattagggtgttccctcatttggttcgaaccgggcgagaggacacacactaacaaggctagcatagtaccttgtgggacctacatgatggcttataattacaccctttttgtgggacaaaataacactgtagcaagcatttttttattaggtggagggagtactagcaaaacaagattattagtttggtgcggaatgttatgttgctaaaattatcaaaaccttgactgcctcatcatatagtcgtagaaagtagatcgtttttccatcgctgtgcccccaagctagctctcagggtcttggttgggtacggaagtagctagatgtttttccatcacgccgtgtagtattttcgatcacataataatatatagacactggtcacgctgtttgtgccgtcgtcaagctccgctacgactggggtaccgtgcagatctagctgccgtggtatgggcatggagtgatgagttccgtacgtgattggacgaacaaaacgccaccaagaaagcgtgggcgcgcatggcgtgactgcctgccaagagcaagcaggcgacgcatgagctaatcgatcgagttaacgctgctcgtggtctcattaatcgagaacctagctaggcactgtcagctagacactagacaagagatttagcggtacggtggcgtggcttcgcttcccatgcacggcgtcggcggcgtcggcgtcgtcctcgtctccgccggtcagagcggtggcttgtcccgtgaatctcggcatctcgccctgtgcagagcgatgaacggcttcaatgagagcgaggcgagcacggcccgcagatcagtctcgatcgacacgggcagcgtacagtacgtggtaaatagtggatcgaagcaagccgacaggggttggtaaaggctcacatgctcacctaacgtgggtgcctgtgcctctctctctctctctctcactctctctctctctctctctctcttcatgctgtgctcttccaaagtcccaaccatggtcattctagctagcttcgttctcactccaggctccaccacgcacagacaacgagctctgcccccacaggccagcaggcagatagatcctcaccattttctctttcactcgcatcggatctgctctcccataatacactctcggggtctcggttgccaggaatcactggagccgagcgagcgtgtataaaaggccggcgcttggtcctccgaagcctgaaccttgaagcgccccgtagtgcagtgcagtgcagcagtgtgctacctcctcagtcctctcactccatcacaaacgctagtcttcctctaaaggtatgtgctagtgttatattactcaaagaaagcaacatttccgttggagctctagtcctaaaaccctttgtggaattgtgaactgggaactgaagctgggcaaagtttgctttttgcctaagcttctttcttaatcagatctagcatcgttgttgcatcggtaaaacctcggtctcgtttgacctgagagtccagttcttgccttacgattgggtgaagtgaaccatctggatcactctgtccgcagttctcgagctggtaatctttagtcaaatgcaagaaacttggagctctggatcttgacgaaagtggggaggaaatgtagcattgtcaccacagtcatccacgaacactgcatctaaagttttggttagcattattgcttgctcagccgggccccgtttctaacagagatctttggcaacgaccgacagctcggagcgagtctcagaagcgatggcgtccaagaggctgctgctggcggcgctgtgcgtggtgccggcggcgctgctcgccgtgcggtcggaggcccacggcctggaggacttcgcaagcagcgacgcgacgccggagatgcagaccttcttcaagcccgaggccgcggcgctcccggaggccctggacgcgtcctccatgcccgccgccaccatggccgcgaagccggaggccacgtcgatcccgaccaccaccaccggcaccacggcggcggcggcgggcacctccgccgcggcaggcactactgctgcgtcgccgccgcgcaggtccgtgtccgtggccgccggcgtggcctgcggcgtggctgccgtggccgtggtcggcatcgcggccgccgtggcgtacgtggtgcgcggcaggcgcagcagggaggtgcagctcggctcctccccgtgagcacgcgcccagcgccccggcccgctttacagacaggccgtcatcgccattaggatctggttaagcgcgtcgtctagctctgcgatttgtgtggcttttgggttagtggttgaattctttttttcgcgtggggttgtcggtgaagatcacgctaccgggtacggaccagcagtggtgcatgtaacataaataacgctggtggtattagcgtcattgttgttgtggcctgtgtgtatggtgtctagacctttgctatatattttgatttcaggatttaaaaaaaaaaaaaaaaaaaaaaaaaagcccccta

SEQ ID NO: 22765 - DNA, 1198 bp, Zea mays
gctccaccacgcacagacaacgagctctgcccccacaggccagcaggcagatagatcctcaccattttctctttcactcgcatcggatctgctctcccataatacactctcggggtctcggttgccaggaatcactggagccgagcgagcgtgtataaagggccggcccccgcccgcccggcctgaaccttgaagcgccccgtagtgcagtgcagtgcagcagtgtgctacctcctcagtcctctcactccatcacaaacgctagtcttcctctaaagagatctttggcaacgaccgacagctcggagcgagtctcagaagcgatggcgtccaagaggctgctgctggcggcgctgtgcgtggtggcggcggcgctgctcgccgtgcggtcggaggcccacggcctggaggacttcgcaagcagcgacgcgacgccggagatgcagaccttcttcaagcccgaggccgcggcgctcccggaggccctggacgcgtcctccatgcccgccgccaccatggccgcgaagccggaggccacgtcgatcccgaccaccaccaccggcaccacggcggcggcggcgggcacctccgccgcggcaggcactactgctgcgtcgccgccgcgcaggtccgtgtccgtggccgccggcgtggcctgcggcgtggctgccgtggccgtggtcggcatcgcggccgccgtggcgtacgtggtgcgcggcaggcgcagcagggaggtgcagctcggctcctccccgtgagcacgcgcccagcgccccggcccgctttacagacaggccgtcatcgccattaggatctggttaagcgcgtcgtctagctctgcgatttgtgtggcttttgggttagtggttgaattctttttttcgcgtggggttgtcggtgaagatcacgctaccgggtacggaccagcagtggtgcatgtaacataaataacgctggtggtattagcgtcattgttgttgtggcctgtgtgtatggtgtctagacctttgctatatattttgatttcaggattttgttgttgtattgtatgttggcatgttgccgtgtgagctactagctagctccggacgcctgaactttgtaccttgcttggtggagcctacctaccatgaacaaaaaaaaaaaaaaaaaaaaaaaaaaaaaaaaaaaaaaaaaaaagggcggcccggacgcgtgg

SEQ ID NO: 22766 - DNA, 663 bp, Zea mays
cctcgaggccggccccgcccgctcatcacatctgaaacagaaacagctagaagacatattcaacagattcagagaaagcacatatagatagagagagagagaggcaaaaaaagagcgagagagagctgcggattaattatcaaaacccggccgcttccatggagagagttgcatcaagctgctgcgtcagcctcctagcacaaagcaggagggcctacactatggccgcggccatggctaagaagggagccgccgcacggagggtcgacgagaagaaggcggcggccgcgctgaccaagcgcgtgatgggcaagaaggaagtgaacacggctgccgctgcggcagctgaggagaaggcgtgggtgccggaccctgtcactggctactatcgcccagcaggtagcgccaaggaggttgacgcggcggagctacgctccaagctgctgacggaggctgcggccaactgattcatcaagcagtcactttgtcgacctacagcatgagttggctctgtccacctagcttctcctgctttaagatccgcgctcgttgatccccgagctccttggcctaaagccttttatatactcaatgatacatatataatatataacggggaacatatcggtgcacaaaaaaaaaaaaaaaaaggcccctagggcc

SEQ ID NO: 22767 - DNA, 1087 bp, Zea mays
  misc_feature (23)..(23): n is a, c, g, or t
  misc_feature (84)..(84): n is a, c, g, or t
aagtgtaatatgaactaattttntctttcaatccctaaaatacacttcaatccacttcaatccctctttatccaaacaaggccnttagcgacattggcaaacacctcgccggctgactccagcagctcatcacgggtagcagtgtaatgcatgaggctaggacgagtgaggaacaaggacttggaagccaggtcgctcgttgggattgggtcaggtttgcctgacgactgcccaaacgacaccaggaagccgcgggacgccaagcactccagggaagccttgtatgtatcctttccaacagaatcatagacgacattgacaccttttcctgatgtaatatccttgactcttgcgacgacatcctcgctagtgtaaattatgggatggtggcatccatcctgagctgcctgagcggctttttcttgattggaaacagtcccgatgacagtggcaccaagggcgtttgcccattgacaaaggagtgagccgacaccaccagcagcagcatggaccaggatagtatggccactctctaaccttggaatacccggcgaagcagaacatgggcggtcatgcccttgagcatcacagaagctgcttgcttatgatcaacggaaggtggaacaggaacagcgacagccgctggaaggatctgctcctgagcataggagcccatggggttgccggcatatgcaacaacatcgcccaccttcctgccagtgaggccaggcccaacagcggtgacgacgccaacggcttccattcctggggtgaagggcatggtgggcgcggcgtagacccccttccgaaagtagatgtcgatgaagttgacgccgacggcggtggtcctgatgcggatctccccttcaccgggctccccgacctccacctcctcccaccgcagcacctcggggccgcccagctcgtggaccctgatggccttggacttgaccagagtcgcggcggtggcagcggagccggctaaaccgggtgggaggatttgggaggagttgcagtggctgtccaggaaaaaggaaaaacgatggcagcaggagcgaggagaatgccgacatctgttatcaatagt

SEQ ID NO: 22768 - DNA, 1484 bp, Zea mays
  misc_feature (1483)..(1484): n is a, c, g, or t
atgaaagttgaggaatttatttcaaggaacacaagaagaacaaagttgttcaagtaaaatttatgtaaccaagagtttagtaggtatgcttttcataaattccatttctatactgttattttttagtgatggccgctttttggggcctctgtccaataattccggcacggccctgacccaacaacacaagggcgccacttattcattcagatttaggaactcagaaacagactcgaacataccgcataaacagcatagatataattattattacgccgttcccataaccagatcaccccatttattcattcacatgcccttgagtctatcccgggatgagcactatggaccctgatgtcttcctgccctccagatctgcatgggcctgggcagcttccgacaatggatacgtgtggttcacccggacgtgcagcaccccgttagcgacattggcaaacacctcgccggctgactccagcagctcatcacgggtagcagtgtaatgcatgaggctaggacgagtgaggaacaaggacttggaagccaggtcgctcgttgggattgggtcaggtttgcctgacgactgcccaaacgacaccaggaagccgcgggacgccaagcactccagggaagccttgtatgtatcctttccaacagaatcatagacgacattgacaccttttcctgatgtaatatccttgactcttgcgacgacatcctcgctagtgtaaattatgggatggtggcatccatcctgagctgcctgagcggctttttcttgattggaaacagtcccgatgacagtggcaccaagggcgtttgcccattgacaaaggagtgagccgacaccaccagcagcagcatggaccaggatagtatggccactctcaaccttgaatacccggcgaagcagaacatgggcggtcatgcccttgagcatcacagaagctgcttgcttatgatcaacggaaggtggaacaggaacagcgacagccgctggaaggatctgctcctgagcataggagcccatggggttgccggcatatgcaacaacatcgcccaccttcctgccagtgaggccaggcccaacagcggtgacgacgccaacggcttccattcctggggtgaagggcatggtgggcgcggcgtagacccccttccgaaagtagatgtcgatgaagttgacgccgacggcggtggtcctgatgcggatctccccttcaccgggctccccgacctccacctcctcccaccgcagcacctcggggccgcccagctcgtggaccctgatggccttggacttgaccatggtggcgacagaggtggagtcgcggcggtggcagcggagccggctaaaccgggtgggaggatttgggaggagttgcagtggctgtccaggaaaaaggaaaaacgatggcagcaggagcgaggagaatgccgacatctgttatcaatcccggccggcctcgaggtccccgccggnn

SEQ ID NO: 22769 - DNA, 1013 bp, Zea mays
atacgataactcttattttttgtttttttgtaaatccacattttatatactgctagtatatatacgagttattcttctgagtgtacttttacatatctagtacgtacacgcacatgcattttggtttggaacataaaacaacggccactgcaggctttaacgcttctcccagacccatcggctcggcctgaaaatctgccgaaggagcgccatctttggaacgttccaattttcgacgtgcctgcacaccttccccgattcagcatcgaagtagtattccgtgtacccggttgctgacagaataggcctccaggggaacgacatgacacagctgaaacgccagtgcccgattgacttgtcctccaggtcctcccatttggtgagcttcatgttcgatttctcgagcagcgacccaaaattggtgcagttccgtttgaaccgccgcaggcctctgaacgagcccgccgggtcggcgaactcgcagtcctcctcgtaagctctcagcgtgagattccctgtgacgaagtacgaccgcgcgaagtccgccttaatggcctcggccactcccgcgtggtccaggtccagggcccccgccaccgccgccgcttcgccctctgcgtcaccgccaccgccagcatccccctcctgaggcgacgacggcgcgggccggagaagcgacgcggcgatgccgaggagctcggagccgtaccaggcggccttgaggacggcgttctccgagcgggaggatgaggacgacgtcgcggtctcggctcccgcgccacgggatccggcgtcgggtttctgcgcgtgcgccctcaaacggctcctagaacccgccggtggccgacggaggacggctgcggcgctcctgccatgacggccggtggtcagcgtagagctagctggacctgcgtgctgcaaggccatgcgattttttccgtgctcgcctcgccggtgaggaactcaggattcaggaaatcccccggccggcctcgaggggtcccctgatcttg

SEQ ID NO: 22770 - DNA, 1089 bp, Zea mays
agatcacaaattgattatgaaactttttcacataacaatataacacacatttgtacataggttatcgtatattatatgttcccgttgcaacgcacaggcatttagctagtatgtatatatgagttatccttctgagggtacttttacgtatctagtatgtacacgtacatgcattttggtttggagcataaaacaacgctcccctgcaggctttagcgcttctcccagacccaacgactcggcctgaaaatctgccgaaggagcgccatctttggaacgttccagttttcgacgtgcctgcacaccttccccgattcagcatcgaaatagtattccgtgtacccggttgctgacagaataggcctccaggggaacgacatgacacagctgaaacgccagtgcccgatcgacttgtcctccaggtcctcccatttagtgagcttcatgttcgatttctcgagcagagacccaaaattagtgcagttccgtttgaaccgccgcaggcctctgaacgagcccgccgggtcggcgaactcgcagtcctcctcgtaagctctcagcgtgagattccctgtgacgaagtacgaccgcgcgaagtccgccttaatggcctcggccactcccgcgtggtccaggtccagggcccccgccaccgccgccgcttcgccctctgcgtcaccgccaccgccagcatccccctcctgaggcgacgacggcgcgggccggagaagcgacgcggcgatgccgaggagctcggagccgtaccaggcggccttgaggacggcgttctccgagcgggaggatgagggggacgtcgcggtctcggctcccgcgccacgggaacgggatccggcgacgggtttctgcgcatgcgccctcaaacggctgctagaacccgtcggtggcctacggaggacggctgcggcgctcctgccatgacggccggtggtcagcgtagagctagctggacctgcgtgctgcaaggccatgcgattttttccgtgctcgcctcgccggtgaggaactcaggattcaggaaatccgctagtttcccgttgccagtttgtcttgattcttgaacaggactct

SEQ ID NO: 22771 - DNA, 982 bp, Zea mays
ttttttttttttttttaaagggtaagcctcacaggtgttcatttttttttgtacaattgggatgcagctgttcttttttttccccgaaagagaacaaggctaatctactagacataccactgatgtttcacctcgatgttctgaagagctgcctacctagagtcacagtcgggtgcgagtgagatcaatgagtgtaagaatattcagaaacatgtgtgtaacatatgggctctagtaggcaaggcctgtaaataacagtatatttatgatgatggtggtgtcatggtgtagtagcaatgtggacacgcgacttacatactacgtattacaacaacatcctttagtcatcatgcatatccttattatataacacgttggattggttcggtggctagttaaataaataaatgcggggttaataattaagatgactacagatatatatataatgatgggctagctatagcaagctagctagacgttcccggtgacggggcagccggtggcgcagaccatggcgtcgttggtgcacttgaggaggcagacgggcagctccacggggtccaggtcgaccagcggctggtagcagtccagcatgcaggaggtgaccccagacccgcagcttgtcacgcactgcgtcagccccgccagaggggtcgaccggcggccatctcggccgccgccgctgtggcggtgccagctctggccgcggtggcgctggtggtggtggccgtcgtcatcacggtggtctgcgctcgccaccgtcgccgcggccaccagcaccagcagaagcatcgtcgccgcgacgactgccttcatggtgtacgagtacgatcgacgttcttcggagacgaaggtgcagtgcagatcggagatgcgcgctagctgcgtcgttgggttgggttgggctgagccgggactatttgcgggtctatatatatacacgcagcgcgcgccgacgcgacgcaaggagcaggacgga

SEQ ID NO: 22772 - DNA, 773 bp, Zea mays
ttttttttttttttttgtttggcctgtaaataacagtatatttatgatggtggtggtgtcatggtgtagtagcaatgtggacacgcgacttacatactacgtattacaacaacatcctttagtcatcatgcatatccttattatataggagtaacacgttggattggttcggtggctagttaaataaataaatggcggggttaataactaagatgactatagatatatatatataatgatgggctagctatagcaagctagacgttcccggtgacggggcagccggtggcgcagaccatggcgtcgttggtgcacttgaggaggcagacgggcagctccacggggtccaggtcgaccagcggctggtagcagtccagcatgcaggaggtgaccccagacccgcagcttgtcacgcactgcgtcagccccgccagaggggtcgaccggcggccatctcggccgccgccgctgtggcggtgccagctctggccgcggtggcgctggtggtggtggccgtcgtcacggtggtctgcgctcgccaccgtcgccgcggccaccagcaccagcagaagcatcgtcgccgcgacgactgccttcatggtgtacgagtacgatcgacgttcgacgaaggtgcagtgcagctgatcgggagatgcgcgctagctgcgtcgttgggttggggactatttgcgggtctgtatatatacacgcagcgcgcgccgacgcgacgcaaggagcaggacggagccgagctgatagagtgttggtgcttt

SEQ ID NO: 22773 - DNA, 1119 bp, Zea mays
ttttttttttttttttttttttttttttttttttttttttttaaataaaaatttagatcacaatccattatcacccctattcaggccacatgttgggaccgtctgacttggcagctgccattttagtgttcatgcactcatccggaagtccaggaagggacgaaaaatagggatacagggaaatttaaaattatgtcagaaatttactgcaaggcgcaaggaagcacacggttttatacagattataatgtaaaagcatgcgttcaagtttggaaatttcaattcacagacaagagcttcctatagattacacagatttttccccaggaaggtaggagggagaactgctgccaggttggtttttcttcttatggaacatgctcgtgatgtttggcagcatgaagctcctcctcagtagcgttctgctgttcctatgcccgtcgttcttctcagaagctttcccagctgaagtctgaggtacaggaggcgatccacttccaagttcttctgcccctgccgacggctgagcctctgcggttttcttctccttctcgcgccatctcttgagctcaccttctacagcctttttggctgcctcagccatctctgccctctttagggcctcttctgttgccaattccatgtcctccatttccttgcgggcagtttctagtttcttgattgcctcattctcactggctctgatggcttccacttgagccatagcagcagcaactttcatatcactcaacttctctgactcctcaacctttcggctgagagatacaaactcctctttagaaattgtgataattgctccagactcggatgttgaggatctagcagcacttgctctatccgagagttgcttgatctgatcaagggctcttgcttcagctgctttagcctcttctgcttcctttaaagccaattgcatcttttgttcggcttctgctagttcaaccccacccttttccccttcctctcttagctctgctgcactcttctccatcatttcagcttcttgcaaagcattctttgactccgaccgcagttgctgaagggccagcattaggtcatcagaagctgacatagcttttgattcagcagccacagcag

SEQ ID NO: 22774 - DNA, 1473 bp, Zea mays
atcccccgcgggcccggccgcccttttttttttttttttgacacacttgtaacagtatttccaatctttcgccgcaaaatacacatcgaggtcagtatgattctggtattgctttgtgaaacatagcacgaataacataaaaacaagatgggacgctgtatctaaatccagaaaatgtgagcatccattcatgtggtgagacgggtaatacaactctgggaaaggtttatttctcgactgacaagtgacaactggaactggtaggttgatcaatcattttaaccattcagtttcgaaaggggtagaggcatccagcagttccagatccttgttcggtgcttcaactacccattccccttcttcagataaacaaatgccaatagtagcagtagatcatgcatccatcgtcagaatgctgcccatccagctcctgtgctctttgtttgtccgggttcagcagatgaaggtagattttgctttatagcagaaagatctgaaaaaggatcgttatttctcttggtgggttcttttggagccctgattcctgcagtatgtccagaattcatccttgcagctgcagggtcgttaggtggtggtggaagtggagatcgaagcttcccagctgcgcctggaggtggcgcaagaagcatgcttgtcttgggttttgcagtggtccctccagataaaccagcagctgaaagcataccacttccagttgatggcttgttttttacagttatcctaatggtttcaccttccttgagtcggcgattgacagccggatgtatatcaatctcaccgccgccagtctcctcgccgccagcgcccgtggtctccttctcctgctccctcttgacgtacttctcgtggtcagagagggcgacgttgaagtcgaatgcttcgttgcgctcgttgaagccgagcccgacgaaggcatgcttccccctgccgtcctcgatgcggagcacgaagtagcgggaggagtcgagcacggtctcgacggcgctctcccgctgccccggcagcacgaagcaggcggcgaagagctcccccgtggccgggtcctcgagccggatctcgcagcggtcaccgcaggacaccacgcggaggcgcccggaccagatcttgtccgactgcagccactcgccgcacttgtagccgccgctggtggtgcgcggcgggatcttgtacactgacacctcgcgcaccaccagaagcgtgtgctcgaaggcctcctcctcctcggccagcgacgacgccatgatcctgcgtcccctcaaaactcactgcctcctcactcgggcacgatctgagccaagacgatatttctgtgatatatctcgtaggaattttggcggttgggggtttggattggggttctcgaggagagaagaagaaaggttgagaagacgtgggatcgaagggtggaaggtgggggaggaggaatgcacaaatcagattgtccccggccgg

SEQ ID NO: 22775 - DNA, 1562 bp, Zea mays
ggttaaggttgaatcaaacgtcggtcccataatccacacaggcctgaagaccattgcaaacagggttttgacaccacttggtacagtatttccaaatctttcgccgcaaaatacacatcgaggtcagtatgattctggtattgctttgtgaaacatagcacgaataacataaaaacaagatgggacgctgtatctaaatccagaaaatgtgagcatccattcatgtggtgagacgggtaatacaactctgggaaaggtttatttctcgactgacaagtgacaactggaactggtaggttgatcaatcattttaaccattcagtttcgaaaggggtagaggcatccagcagttccagatccttgttcggtgcttcaacttcccattccccttcttcagataaacaaatgccaatagtagcagtagatcatgcatccatcgtcagaatgctgcccatccagctcctgtgctctttgtttgtccgggttcagcagatgaaggtagattttgctttatagcagaaagatctgaaaaaggatcgttatttctcttggtgggttcttttggagccctgattcctgcagtatgtccagaattcatccttgcagctgcagggtcgttaggtggtggtggaagtggagatctaagcttcccagctgcgcctggaggtggcgcaagaagcatgcttgtcttgggttttgcagtggtccctccagataaaccagcagctgaaagcataccacttccagttgatggcttgttttttacagttatcctaatggtttcaccttccttgagtcggcgattgacagccggatgtatatcaatctcaccgccgccagtctcctcgccgccagcgcccgtggtctccttctcctgctccctcttgacgtacttctcgtggtcagagagggcgacgttgaagtcgaatgcttcgttgcgctcgttgaagccgagcccgacgaaggcatgcttccccctgccgtcctcgatgcggagcacgaagtagcgggaggagtcgagcacggtctcgacggcgctctcccgctgccccggcagcacgaagcaggcggcgaagagctcccccgtggccgggtcctcgagccggatctcgcagcggtcaccgcaggacaccacgcggaggcgcccggaccagatcttgtccgactgcagccactcgccgcacttgtagccgccgctggtggtgcgcggcgggatcttgtacactgacacctcgcgcaccaccagaagcgtgtgctcgaaggcctcctcctcctcggccagcgacgacgccatgatcctgcgtcccctcaaaactcactgcctcctcactgatgcaatccaaaaacaggtaatggtaacgggaccaggttacgacgagaggaaaatgaaccagtagagatctggatcacctcgggcacgatctgagccaagacgatatttctgtgatatatctcgtaggaattttggcggttgggggtttggattggggttctcgaggagagaagaagaaaggttgagaagacgtgggatcgaaggccggcccgtggggggggagcaatgc

SEQ ID NO: 22776 - DNA, 2407 bp, Zea mays
ttttttttttttttttttgggacaacaccttgcgacttgcgagcacatgaatcactgtatagaaactatttacaagcagtacaaggtacatccatgactggacaatgagtgtcgattctcaatttttctcactgctaaaccatcgtatggttaccgagccagcggcgagggtcttgctttagagtttaggctgtctgaacccttgacaattcatgaataaaagccccataggagtataggacatacgatctcagctctaagcttggagaaaagaaaatttcgaaaatacaccaacagtgggatcgtcttcaaacacccggccttattgctgaagctcgttgttctcacttcacatggaccacttcctgtcacacctaactcaaccttgatctgtattgagccgagtctcttctcctcccttgctgggaaccagctatgctccttacagatgaatcattcggctctgctaagggattggtgacaaaaccaccatggactccaaatttctgctgtctgtcccacttgtaaggacttctgctctcctcggagtagtttgctgcgtccgatatagggtacctggaagtgtacctacctccgtcatgccttctccagaactttgggctcagaatgcagcaagcgtttgtgtcaggctcgctgttcggaatccttcccgaggaagcagccaaatcacgggatatctcgtccaacaccatctccagcccgttcacccttgtctccaaggaacgtatcccattctgggagctccccatgaatttctggagaagattaagcaaactggcttgctgattctcaatctgaacgagctgcatcctgatcttcgacaagtcctcatctttgtgagctgactgaaattcttcgggcgcgtcctcagtctcagccgtctcttccgagtcaccatccccttccccgctgtatggaacaactctggatcctgacttgggaccagccaccttcttgtaacctttgtcaccagtcttctgaaacagcacccgccgcgcttcaagcctctccctaacattgccttctttcagcagcttctcctcagccaccattttgattggcgttgcgtctggagccgtagtaacaacaaccctgtcctcagatttcttgaactggtctgtgctgcggcgtgaaggaggcagatttttcttagccacgatggaaggagggctgccttttctgttgatggcattgttcgatccatccggttggggctgcctgttagtcggccatgagttcctccttgtaattgaagggctagaggtggagcccgaggaatcagccgggtatcggccatcacttgcagtatctgtgagagaagatctagactgggacgatggtaaggagcagacctcctcatccaaatccgggatctccttccatgcttcgatcaaccggttcatggactcgcgcactattttcaccttatcaaatctcttggcttcgaagacggtaatgcaggaagatttgtgtgagacgaggtcgtctccgtgctcgagggccaacaaagcgagcgcctcggcggcagccttcctggcggcccaatcgtcggcagtgagcgcgtcgcggaggcaaggcacggcggcggaggcggctccaccgccggaggctgccgaggcagcgccgatgagggagatgagcgcgggcttggccttgaacgccgcgctgcggaggagcttgtagaggcgcgggaggagcccccggaggtacgcggcgaggtcgtcggtgggctccgaggcctcgacggcggcggcggcggcgagcgcggcggccagctgcgcgcactggtcctgctcgtggagcacggcgtcggcgagcggggccggcgccgcgggcggcgacgccgcggcgcccgccgcggcgcgggccgcgtcgacgagcgcggcgcgcacggaggagtccgggtcgcggacgcggcgcagcgcggcggccaggagcctgggcacgagcggcgcgacggcgtcccgcgggtgctccccggcgacgagcgccagcagccggagcgagtgccgccgcagcggcgtcctgtcggtgggccgcgcgtcggagaccgcggccacgaacaccggcagctcgtcggcgtccagctcgcgcgcgatcgcgtccagctccgccgcggccatcgcctccgtgtcccggtccgagaggcgcagcaggcagcggttcacgcgctgcttcatgggctccctcggcgcagggcccatggtttcctactacttggtaatgtagcctcgatgctccggcaggagcggtgtcgacacgccggagtccgagccgtcgtgggctctgcgcaggtaggtactcctagttgggtgtaggaaggtaggtggcttgaagagtgggagtccggagaggcaggcggcgaagcggggacgatggcgtggca

SEQ ID NO: 22777 - DNA, 2072 bp, Zea mays
cgtaaccagttcaaattatgctcttattttaactcatctcaatcaacttttcaacatgcctagcatcaaagatgagaaataccagcaaacgaaacaattatttagcaagggtcctatcatattgtagtttgacataggtagacgatactagaatgagaacaaaaattgtatgtttctttcccaaaaaaacacaaatatgttcgggacatgagagcgcaacagcatatgacatcttcagcttggccttcagatggtcgcctgtccactaaatgaaagggaagacatgatggtcaacatctccgtcacagaagccatggcgcttaccgctgctttaaggacatcctgcgagcacccgggcttcacaatgcttttcaccttctccaaatactcctgcaacttcttgattcttcccatgtaatcctgatcttcaacgcacaatgaaataggctttgtatcagcacctgacccttcgaactgaagtggcccagggtttcggtagatgtcttccatcatgaagctagaagaattttgtctcaacaactcatatgcttttccttttaagtcaacactcgccatgtggacagcaggcttaccgatttgactggtggcagcaccacgtgaccatctcttcacagtcatcatagatgtaatgggagcagcaccacatttccatttgtttactggactcttaaggttggtcacagtggccatgtagccgttcaaaccagccgctacgatgtgataacatacatgtccaagaactaggcgtttgtccatttcggtctcaaccaattgtgctagaagcttctcaatttcaatctgggacagttgagctgaatcgtcagatccaggatggagaagcagctgctttctaataaatggaggcaaaaattcaaatagtgcagatgcccaaggtgaaagatgagaagagatgttctcaacagaaacacctttattatgcagtccatgaatttcctggagcaaagcatacagttcaggaatactctcaacaaggccctcaggaataagtacaactccatgatatttgtctttttcagctcttgcctgcacagcatcacatatctgctttgtaatatcaaatattgtaagttttgacacagaaacctcctcgcctaggataaccatatttggatgtgactgaagagcacattccaatgctacatgagatgctttccgtcccatcatccgaataaagtagtaatacttttcagcagaaagggcatctatgcatgcattgcttattaactgcgagttcaccttgcatatggtatcaaaaccaactgttgtttcaacaaattggttcttgagatctccatttagagttacaggaacaccaactacctttgttggacatttcaactgagcaaatgtctcagcaagctgagcagcatccgtgttggatgtgacacctccaattataacaagagcgtccaacttcaatgcttgacatgtacctattgttgcctttacctgctcagttgttctgatctgatcccttgtacgaccaagcatgtcataaccaccttgatttttataggatggaagagcttcatcagtgatttcaatagttttctgtgcaaataatccatcggttcctccaagaaaaccaataattttgctgttggagttgtgagcctttacaacatcatagaggccccatataacattgtgccctccgggggattgcctcccactgaagacaacgccaatcctgacaacagggtgctctgttacgatggtagcgtcatgcacgttggccgtcttcgtgagaaagtgtaccagcggctggccgtaggtgtgggggaaggcgtggctgataacgtgagcacccgcgacgtcggccgcgatcgcagcatcaccatattccacactgactgtggggccctggaggcacggcggggtctccggtcggtagagcgcgcgcgccttctgcagcggcgacagctcgcgcggcgcgccgtagtcggcgtccatggccacgctgcccatcgccggctcgatcgattactcccagcctaagcctcggtccccccgcggggcgagggtcccaa

SEQ ID NO: 22778 - DNA, 1728 bp, Zea mays
gggatccgccgcatttcccaagagccgggctgcctgatctcacaagtcacaccaacgattcggatcctgaaccggcctccggtttcggattccaattccagcggccaccccgagcccgatatcgtcttctaatctcatccgctccgtgccgcaccgcaaaacgcagatccctgcctgcacacggcatccggagttccggactcccctcctcttctcgggcagccgggcgccgcttcgcctcctcctcgcaggcaagaagagcagccagccgcttcgcgatcggggacgcggagaggggaaaggcgagtcgtcgtccgtccacggcagcttccctccctctcctctccgcccccgcttacctagcccggcccctcctacgccccccccctcccgccgccgcacgatgagcacctctccggccgcgtccgccgccgcgtcgcctccgccgcctattgcctccgccgccgaggcctcgcgggcgacggagacgttggtggtcgacgagagggtcgcctcacacgtggacccgttcctcgtagaggcgctcgacaaccctcgccaccgcctcatggttctacggatggaactggatatacgaaactttatgcagaaccctcagctgcaggagttcgaattccagaactttccgacttcttacctacgctgtgctgctcatcgtgttgcacaacattatggcttagagactatagtggcagatagtttagtagaaggctcagttagcaggatcgttgcaagaaaaacaccagagagcaggtgtcctgcaatttcattagcagaagttcctagcaaacaagcaagaaatgatcatgaggcagcagagaagcttaagtttgtcatttatcaaaggcccaaagcattccaaaatggaagcactgatttgggaaacaagaatggtgcaccaaaaactgttgaagagagaatagaggaatataataaagcacgagcacgcatcttcaatggttctgtttctgcagattctgatgctgcaagtgttttgggaactctttgcactggcagagatgagtcagtaaatgttgaaccttctgttgatgaaatcaaagtcagcacgatgaacaaccgttccagagttgctgttttcaaggatactcaaaaggatcgcagtgacccagattatgatcgaaactacaaaaggtatgttaggagcccagttcctgacttcaacttgagcccaggtgccttcaactttgtgcctcagtttatgcagtatggcgttggttatgtgcaatctcctggcatgtctacaaaccagcctgctgtctactttggccagcctgatctaacaatggggtcttctggagctgctgtttacccacattggccaaccccagcaatgatgtatccccattgctatgacaatgttggttcaatgatttctcaggttcctctgtaccaatctttcaaccatggttagtagattctgcttactggaaagttgggaaccgttctctgttgaacttgctatattgtgccgtcctatgttaagtggagttactttagattcgagccatttcgattacagaaaattccaaaaaattcatgtaatgtcgaacgtattagtttgtataatggggagtcctaattcgttgaaactaatatcgtgaactagtctggaactgtaattcgtgtctaatatctagttctcgtctgcaaaaaaaaaaaaaaaaaacacccgaccaaacctcgtgc

SEQ ID NO: 22779 - DNA, 1581 bp, Zea mays
accgcttatcctccgcgcaggcaagagcagccagccgcttcgggatcgggacgcggagaggggaaaggcgagtcgtcgactcgtcgtccgggcagcttccctccctctcctctccgcccccgcttacctaggccggccccgcctacgcccccctcccgccgccgcacgatgagcacttctcccgccgccgccgacgtttcgcctttgccgcctactgctgccgccgacgaggccgcgcgggcgacagagacggtggtggtcgatgagagggtcgcctcacacgtggacccgttcctcgtcgaggcgctcgacaaccctcgccaccgtctcatggttctacggatggaactggatatacaaaactttatgcagaaccctcagctgcaggagtttgaattccagaactttccgacttcttacctccgctgtgctgctcatcgtgttgcacaacattatggcttagagactatagtagcagatagtttagtagaaggctcagttagcaggattgttgcaagaaaaacagcagaaagcaggtatcctgcaatttttttatcagaagttcctagcaatcaagcaagaaatgatcatgaaacagctgagaagcttaagtttgtcatttatcaaaggcccaaagcattccaaaatggaagcgctgattctagaaacaagagtggtgtaccaaaaactgttgatgagagaatagaggaatataataaagcacgagcacgcatcttcaatggttccatttctgcagattctgatgctgcaagtattatgggaactctttctactggcaaagatgaaccagtaaatgttgacccttctgttgatgaaaccaaagtcagcacaatgaacagtcgttccagagttgctgtttttaaggatactgaaaaggatcgtagtgacccagactacgatcgaaactacaaaaggtatgttaggagctcagtgcctggcttcaacttgagcccaggtgtttttaactttgttgtgcctcagtttatgcagtatgacattggttatgtgcaatctcctggcatgtccacaaaccagcatactatgtactttggccagcctgatctaacaatagggtcttctggagctgctgtttatcgacattggccaaccccaacaatgatgtatccccattgctatgataatgttagtccaatgatgtctcaggttcctctgtaccagtctttcaaccatgattaggagattctgcttgctggaaagttgggaacaattctctgttgaacttgctatgttgtgttgtcctatgttaagtggagttcctttagattcgagccgtttttattacaaaaaattgtataaggagtcctaattcgttgaaactatttcgtgaactagtctggaactgtgatgcttgtctaatgtctagttctcgtttgcaatttgctcccggtttatagttagtagtgtgctgcgactggtcttgaaccgtgtcgcgtggtcgtactggtagaaccaggttgctacttgccagcagtcattgctttgattccgattttttatttaacttctttttaatcaagtaaaaaaaaaaaacaaagtacc

SEQ ID NO: 22780 - DNA, 690 bp, Zea mays
tttttttttttttttttaccacgtactcatacgttgattataaatctctcgtagcaaacgctcaaaatgccattacatgtccaccggtgcgcgctcagctctcaacagagagtgccttggcaccaatcagcttgccgtcggcgtgcgaaaccacccaatactcggtcctcgtagcatctctcgtcacttgatatacacgaacatcattaccctgcgaggcttctcgaacagcctcgatgacgtcggtgtatctgccgtgagagtcccagttgagaggatcaaggatcttgatgtccgctgagtcgggggaggagtggttgatgagtttggcgaactcggactcgctggggaggccatttttgccctcccacttgagagaaacctcttggaagggctcgtctgcatcggatgtgtatacggcgttcttgcacacgtcactgataggtttggggacttgagcgccctggtccttggtcttgaaggtagccttttcctgagtcgcggcatcagcgccggtgtcttggttggccttgttcaggaaagccatgtaatcgttgtcgtttgacatgttgagggatctggtattgctgagtagtcttgtgttgtgtcgagaggtagctgtagctgttcgtaggaggccggtttgattccgggtaaccacagagccaagaagattcaggtttggaagtc

SEQ ID NO: 22781 - DNA, 4538 bp, Zea mays
  misc_feature (167)..(167): n is a, c, g, or t
tttaggaccgatgtagtccttatatatatagtgccccccttttcctttggtcttatcgtatgacccttgtcctgtaagcagggccagagctgagatttgggtggcctagagcgaacataaaaaaacgagcctcttataagtataatattttcctggttttatatatntatatatatatatatatatatatatatatatatatatatatatatatattattgataagaattaatgtgatctcaaaacaaaataaattttacaatacctctaaagtttattctaacatttctttagacaaagtcattaatgatcgtgttaatattaatcttatctaataatttttttctcactacataggtggccaaactattcaattgtttatgagacattatagaccttaaatatttttttaataacttcaacttaaaaatatgaatagaagatatggatagttctagaaagcttaacttcaaaactctcaagttagagattagattatataacctaataatagctactatgttacaattaactagagagagtagggcctctcggacttgggggcggctgccctgatgaccctatgcccaaagcccctgtaagcagcctgccgggaatgccttctccggttggtggaaaagaaagaaagagaacacctgaccggcgcgacggggtgccggagctccgccgccggtctcagggcgacgcgtacggtacacctgcagcacgccggcgcagagcgaatcccgctgcctgcaagcaaacaccttcacagcggcgcagggtctctctcctctttctctcttttgtagcctggaccagaaccgtccaaggcacactgcaatgcatcaactcggagcttttcacaatttcacctgcacttccgaagcagcaacgagcgcgcacgtcccggcggcggcggcggcggcggtagatccagccgcacatgcgcgcgcacggccttcaagacgggggcagtgattggttgtggcctgacacgggtcacagaggaagctgccaacccgaatttccgatttgaaggcagtaaaagatggtgcgactaccgtccgaaacaaaaaaaaaacgtgagatgttagcaaattttactactactttaaaccaaatggtagaaaaaaatctgttcagtagaatttcgcggtgtgtcgtgtattgtgagtgtgacggaatggaagcaggatatgcttgtgagcgacagacagtgagtgagggagagagaggcgcgcgtgcgcactgcgcacacaggaatggagtgaaccgtattgaatgcgtgcatctcgtctcgtctcatcgcacgcgcgcgctctgcgtctacgtacgtacggtacgcacgcttactggtctcatgattggaactcagagccgagccgtccctagcaagtggccgttctgacggccgctgccgtcgcagtggcgccggaagggggagtcatgcggccgtacagaattgcagatgcagtgttggatctgcatcttgctgcagggccaagcgaggccggcgccggcggggtggtcgtgtcctgtgagaaagggaacagttctctcggctgcagcgaaccacaaccacgcgactgttttggccgggcagagccagccaccacggcaaacagaaagagccatccaatgtatacaggacagggagaagggacagatctgacagaagctacatcgttccctttttattttcttctttggcggctgggggagcacgcagtcctgccgtccggcgtcacggcgccacgccatggagcccggcagactgcaggaggacggacttgatctcttcttctggcaggaggaggagcgctgggccgtccttgcacagctgccagcattgagcaaaaaccagcaggccctctctcctcgtcagtagatttttttttcacgtggcaacgaaataacatgacattacgtttacctcagccttgaagatgtccaaggaaaacccgttgaagcaactggcaacagcttgctggacgtcgagcccgagcccttcgattgccctcatggtagcgagcagaagcccaggcctgcgagcgcagagcatgtggatgttcacctcccgcccttccctcgtcgtcctcacctcaacctgtcgcacacaacaagtcagctaaatcgtccatgtcactcacagtcacagctgaagaagctacattcgaatcaatacgacatgttttttttttgtcgaaccatttcatctgaaagaacgctgccgatgaagcgtggtttcagagagaagtatgtatatatactgacccttggttgcttggaagtagggctaggcaacgcgctcgggcacagctcttccttcacgcgagatggtagggcgggcagcgtgggagtcagagggcggaagctcgtgggcgtcggaggcagcgaggccgtggaagctggggatgctgatgactccacctcgttctggagctcctcgatcttccgcagcagctccttcaggtactcgatcgcgtcgccgagaatggaggccctgtccatctttacagaaacagccagagaaagttacactagtgatatctatgaatgcagtgaaggatgcagtcagagacaacaagggcatctacaattctatgggaacagctgcagcttatgtgcgcaacatctctacaacaatttatagtgcgccatggagggagtacactagcttcacataattaattccatgaaacatataccaatataagcacacatagtaatgcactaatgccagatgctaattgctaccaaaattcggagaattcatctaaattacgagctacaattcatagtagccgattaacaaatggatgaaagggtacaattctcaccttgctgatcttgggcacgacggatcggagcatgtagagccggtcattaagcttcttccggcgacggcgctccgccatgaggttcttggccggcaacctcttcctcttacctttcccgtcgcccgcgctgttggcgttggaacccttgccgtccttctttccactatcctcgacgcccctgcaggcgtcctccgagtcgtagttgagcccggacgcgtcgatgctcccgccgtcatcgtcctcagcgtcgtcaccgccacaggccgacgaagctcccgcagccgcggcggtggcctccgccttgcgcttcttgtcgtagtcctccccgccgccgttgcggcgcagcgcgcgcttctggaacagcgtcggctgcgcgcccacgggcgggaaggtctccagcgggcggagcacggcgggcttcccgcgcccggagaacggcaccgtaagggacgccgaggcaggagggggcgccgcggaggaggagccggcgccgttgttgaacatgtcgaacccgcccaggccgccgaagtccggcatttgcgccggcgctgtgccaaagccgccgaacgaggaggcgaggaggccggcgttcagggacatggaaaaggacgcggaattcgatgtgttccctgcacccgccaacgggaccaggtcgccaccggacccgccgccgagcgtgccgaggccaatgtcgaacccatggacgtcgaacgtcgcggcgccgccaacgttgaagagggagaacatctgcgagccggcgccggggccgggcaccggccccggcggcgccaggagcaggtgcccctgcgcgccggtggcggcggccgcagccacggggtcgaagtaccagtcgtcatcgagcatcgccggtgagctgaaaacacatccggccccggcaacggcggcggccgaggccagggctaggaggttctgctcctcgtgcccctgcgccggcaccgtcagcaactccatgggcgtcggcggaggcgcgtgctgctgctggtcgtccatgtcctccggtacccagagcgggttgccgaacggcgggagcatgatgaaggcgccgcgcgagggcgagccgtcgtcctcgctttcttgggggtggcagagctgcagaggacaccgggcgcgtctgagttctctctggcagagcaggatgccagtgctcaagtgctgtatggaggcgaagtgctgtgtactggcaccgtggagactggagagtggacccgcgtgccgaatcgagactgcccttcagctgatccggaccttgcgctcttggcccccttgggccttggccccttcgcttctactcgcgttcgcttccatggtaagcaatccggaccttgcgctcaaaatcggacgcttgagacgatacttacactatacaagcttgcctcacggacgagcaaacatggccctactctagacaaagttgttcggcactaggataaaaatgaataatgccagcttgtatatgcgtcacattaacaaaccaatattaagttgtgacgaatagtatagcgacagaaaatataaactacttttagtgaaaatacataacattccaaaagattgcttagctacgtatctttatatctttagatgtaaagcatcagttgcttgttcaatgaaaacatggagacaaaataagcaatattgctaaaatacaccgcaatatcttgttgatagaggaaa

SEQ ID NO: 22782 - DNA, 1491 bp, Zea mays
ggcccatattattgtgcttatatatattataacaagtcctaagaactaatcattattcctctaatccaaagtttgtaacaacatgttttttttggtttttttttttttttttttttcaaccaaacgtaggtagtcttattgcaatcttgagtttagtctacatagccataaaacacaacaatatgagaaaagaggcacaggaaaataccatgaaggcatgaagcagctcagccagtgatcatggtgcctgtgccctcgtctgtgagaatctcaagcagaagagagtgtggaacacgcccatcaatgatacttgcggtgtgtacaccttgtgccagggcgtgaacacagcactccaccttgggtatcatcccaccagctaccttcccgtcagccaccatcttccgcaccccagcaatgtcgatcaccttcaccaggctcccagggtcattacggtccgccaaaatgccagacacatccgtgagcaacagcagcttctcggcgcccacggcagcggcaatctcgccagccgctgtatcagcattgatgttataggcttgcccagtctcgtcggcggcaacggtggcgataaccgggatatggcccgcggcgatgatgggatggaggacggtggcgtccacgcgcgaaacctcgccgacgaatcccagcgccgctgcatttggagacgggcgagcggtgataaggcgcgcgtccttgccgcacagaccaatggcggtgcctcccgcgatgttgatgagggaaacaaggtttttgttgaccttcccgactagcaccatctcgacgacctccatggtgagcgcgtccgtgacacggaggccgtcgcggaactgcggctcgacgccgacgcgcagcagccaggaattaatctccggaccgccgccgtgaacgagcacggggcggaggccgacgcaggagagcagcacgagatcgcggatcacggacgcctgcagctccggggacttcatcgccgcaccgccgtacttgaccaccaccgtcttgcctttgaatcgctgaataaaagggagcgcctccgagagcacgtccactcgactcagcgacgcggtggcagcggcagccgacgaaggagccggcgcagccgtggatgtggcggagatgcggaggcggctgcgacggcaagtaggggcggcaacggggcttgcatggttggagctgagagtagggctcgacggcggcggggatgggactggaaggagcgagttggagaggtagggtttcgtgaggaccatggctgcggtggctggggctcgagctcgactcgccgctggcgttcgacgaaatgtttagaccgaaaggtttagaccgaaagtttcttctgacgcggcgttactttccgttatcctggctgctggacacgattaagtttctaaatttaaatttctaaattcccaaataagaaatttttagttttcgtatttgttaatttaaaataaataaaatagagagactaaaaaa

SEQ ID NO: 22783 - DNA, 1490 bp, Zea mays
aaaggccctcactcggtttttcaatatatttgagatggtgaatcaaacattttccatgaccatgaaatatccctgatgttgttggcacttggcagttaggtactactgaaataacgccattcaagttcatatgtcacttgctttttttatcgtgagcagtaaccaaagtaggatggcacataacttggacaattctcattaatgtgcaaaaaccttgcctgaaggacaactgatgttcacgatcaagcatttcaaaaaatattattcaatccaacatcgggcctgtttggatcggcttctggccgtcagaatcggtttctggccaccaaacgcttcgcttctcagcccgtttcatgaaggcatgaagcagctcagccagtgatcatggtgcctgtgccctcgtctgtgagaatctcaagcagaagagagtgtggaacacgcccatcaatgatacttgcggtgtgtacaccttgtgcaagggcgtgaacacaacactccaccttgggtatcatcccaccagctaccttcccgtcagccaccatcttccgcaccccagcaatgtcgaccaccttcaccaggctcccagggtcattacggtccgccaaaatgccagacacatctgtgagcaacagcagcttctcggcgcccacggcagcggcaatctcgccagccgccgtatcagcattgatgttataggcttgcccagtctcgtcggcggcaacggtggcgataaccgggatatggcccgcggcgatgatgggatggaggacggtggcgtccacgcgcgaaacctcgccgacgaatcccagcgccgctgcatttggagacgggcgagcggtgataaggcgcgcgtccttgccgcacagaccaatggcggtgcctcccgcgatgttgatgagggaaacaaggtttttgttgaccttcccgactagcaccatctcgacgacctccatggtgagcgcgtccgtgacgcggaggccgtcgcggaactgcggctcgacgccgacgcgcagcagccaggaattaatctccggaccgccgccgtgaacaagcacggggcggaggccgacgcaggagagcagcacgagatcgcggatcacggacgcctgcagctccggggacttcatcgccgcacccgccgtacttgaccaccaccgtcttgcctttgaatcgctgaataaaagggagcgcctccgagagcacgtccactcgactcagcgacgcggtggcagcggcagccgacgaaggagacggcgcagccgtggatgtggcggagatgcggaggcggctgcgacggcaagtaggggcggcaagggggcttgcatggttggagctgagagtagggcccgacggcggcggggatgggactggaaggagcgagttggagaggtagggtttcgtgaggagcatggctgcggtgactggggctcgagctcgagctcgactcgcgctggcgttcgacgagatgtttagttaccacaatgtttagt

SEQ ID NO: 22784 - DNA, 1808 bp, Zea mays
ggcaacatgacttcaatgtaaaaaaaaagggtttgggatttaacaaaaaaaattgtaatttgtgtgtccacaaatttaaattgtttctgagcaagaagtttttttgttttccatgtggtatctactaagaaatgtaatgcctttctactgtacattgaacactttttaaaggtactctttgtagtttgttttggacttgaattgtagttctggtgaactaatatctgtgatgtaacatatgttccagaagttgtgattcaaaacatttatattcttgttggaaattagtctgaaacccaccattttaacagggaacatgcctcagtagaattgatgaaagaaataaaagaagggtatgtgtgaaatattaccagtatcatttcataaattttacagcagtttgtattaactattgtgcacgtcaccttggaaaccattaattttttttaaaaaaaaatcatgaatgcttcttgagatgtttggtgtagttgtcagagctgtcttactgagtcatcaggtcatgggttcgaagcaacttctccacatttatgtgggaaggctcgcctcggcttatcccttcacagacgctactcatgtgggagcctccagcagtaagtctgcccaatgctccttgagatgtgccatcagaagagtttttttccacataaacacaaagttacagaaaaaattatgcatgatttttattgactattttttgagcaaagagataagctattgccaggattaaaaaaactagaccaacataggaggaaccaggtggcattttattatcaagaagaaaatagccatgcaaattttccttgacgaggactagaacctaggtggcctgggctagccacagaaccacatgctctaccaattgcgatagatcagcttccttaacagtgagcatacggtcaggattgtctgagcatacaaccaggattatgtcatatatgttgattggaattatatattgtgattgcaactgtttgtttgttttttccatgtaggctatctattttgacacagatgttgtcctcagttgtgtttcaggactaaaagttttttagtaattgttcattattgagttagcactcatgtttttcgcttgatttgttgtgtgttggacttctctgtaatatcactatcatatgaactaggcagtagtatgatagatggaggatttctgagttagtttgacctctgcgctgtaatgttatctttagaaggtaaggaaaccgaaaaggctgaatttcaattatcaattatgtaccatgttgtcattgaaattcacttttttgtgctctaaatatgtaatgtagttattttagttcgtttctgatcgcagttttcctgcatacttgagaaaaaagaagcttgtttctgatcctttttttagtcatgccatgtggtatgagataacctgtcaggataaattatccaaaaatcattcctggttatgcagttccactaattagcagtaggtagtttattctataattgtattgaggcttgaattatgattttggttgggcatgtagtaagtagcatccaagaaatatggtttagttggaatatcttaatgcctcatgattagctctaaacctgccacaaattacttgacattcttctctacaggctttaccgaagggagctactgctatagttccacttgttatatttgatgatgcaattggtgatcatttatctactcttgatcagttttgataattcgtttttggatctggaacgaactagaggcgcccctgggatgctgtaccgtgtcgtctagagaaggagacggc

SEQ ID NO: 22785 - DNA, 1188 bp, Zea mays
tatgtcaatttcaagaatattacattagcatagccataaaatactcgtcgtaactgaattcatgtacagacacaagaatagccacaaataaacaccaatccaaacaccgaattctcatagacctacaaggtcatagccaaacccacaagaagcactttttatgttaagttcacatctttaattgagttctcacaatcacttcataatatgtagctttcctctacacaagaaacaattgcaatggctgctgccccccggaccccggtgacaggcacaaacatgcacagcaaaaaacactatgtgcacatcatgccttaccttatgcaagttggtagggtgaaaccatggcacacgaagactagaacgacatatattattaccaggaggagaagtatcaatgcggccgtgagtttgacatttctccaccaaacagtgtttctgaaccgccgagcttgtctcttgaatcgaactgtatttccttgcatatttgcagtcttgtcaaccagcagttctaaacgatcacctctttcaagaaccttatcaatgttatcaatcataacactacggacctgattgatttcacctctcatgcggtttattctatctgcactagggtcatttgaatagtagtccatttgctggctcaagacccttgagaattcatcattcattgcatatgcaagagcggttagcgcagcccggccatatgtcttgacaaaccttccatgaatatcctccaaaaatgcgaagggaatccgtcttccggcggcgtcgtcggccatgcagagcgcggtgatgccgtcggtgcgcttggcgtggaagacgtagcggtcctgcgtgtaggagacgtggctgtcggcgccgccgtcggggaggcgctcgaggacctggcgcgcgatagcgcccgcgttggtggctgccgcgctgtgctccgccagcaccaccgtgccgcgcgccaccagcgcgtacaggattgccatctcacctgttcccttggagccgatcccctcccctcctctcctctcccccggcggcggcgtctgccgtgtggactaggagaggacggagaaaaggggagaggtttgggctcggttgggccaagatggagacggaggaggaaggacacgcccgagctggttgcctgcctctctgccagcctattgtgttgggggcccggccggcctcgag

SEQ ID NO: 22786 - DNA, 1955 bp, Zea mays
cggacgcgtggggtttggttggaaccaaacgcaccctgtattgccttttccgccgcacggcgtcgccgtgggctcggtctcgctcgccgcatacggccgcagccagacagccaacgtactcggggcggctaccgggccggggtccgcgatcgatggcggcgcggcggagcaggggctgggcgcgcggcgcggcggcgttcgcggccgtggcgctggcggtgggcgcggggcggaggtacgggtgggacggtgcctccgcggtggcggcgttccgcgaggcccagggcgctctggggcactgggcggcgccggcctacgtggccgcgcacgcgctcacgcttgcgctctgtccgccttacgccatcttcttcgagggcggcgccgcgctcatcttcggcttcctgccaggcgtcgcatgcgtcttctccgccaaggtcctcggggcctcgctctccttctggatcggcagggcaattttcagatacttcacttcagcaatggaatggctacagaggaacaagtacttccatgttgtggttaagggggttgagcgtgacggctggaaatttgtattgcttgctagattctctcctttgccttcctacatcatcaactacgcgctatcagccacggacgttgggtttttcagagattttctctttcccacagttatcggctgcttaccaatgatactacagaatgtttccatcgtaagccttgctggtgcagcagtggcgtcaaccacaggatcaaataagtcccatatatactcttacctgtttccagcaataggcattgtgtccagtgttctcatttcatggaggattaagcagtattcctcagcccttgctgttcctgaagagctgcaaagttcacctactaatggagatcacaatggtgacgctaagctggcttccgcgccatctaaaaataccggatctgggaaaactaggaagagaaggtaactgacagtatccccctgtattcactatttactacattgtgataccaagtaccaagcagctacagccaatgctagtcaaacatttggatttccacattggtttaccactacagtaagctgtcttgtctgttccatgccatgatcttttgggggggtatttaacagatgcgcaggcagctaccttcttgtttgtcaattgtcaatgagcttctgttcttgtggcagataatatcataaaatgttgtaacagatgcgcaggctcacatagtcacatgttgtacacccgaataacctggtggtttagatttggatcgtcctgagttcaattgtatcctggggatcaatattggttttccctccctaattattgaacttgacatgtgcacggtgtagtccaaccagtttatgttctttggtgtaacaatttaattcagaactgtgtttgttttaaaaaaaagcaaaaaaaaaaaaaaaatgggtgaaaatccgctgggtattacttgcccaaactcatacccgcgaaagaaaaatacgcccgctaaaaaactcatacccatgacgggtataaagttttgtccaaacccatacccatgcgggtttcggatatccaacgggtttcccatacccactaacatcaacataaaaaataatttatcatgtaaatgacaatcaatacattaataagctagcataaaaggaacaagtgataactaattttagcctaaaatttattacatgaagtaatttcaattagaacatattcaattaataatattatgagacatatttataaggaatgttgattttaaggcgggttttaaaatccatgggtttgcgggtatggggtagtggaagaacaactgatgccacgtacccgttgggtttcatttgaaccattacaaacccatgggtagagaattgaccaaactcatatcctatagagcaaaaccaccgggttttcgggtagcgggtaccatttgcatctctagtt

SEQ ID NO: 22787 - DNA, 1352 bp, Zea mays
taaacagcgaccaccaagcctctgtacaggcagctgtgcctctctctcatacagcaggcttgtttggttggggacacttgctccgccccaggaaaaataccatgacctgaccacaaagaattcccatgaaacaaagacaagggtgactacgatttgagtgcctgctacagcctcatcattcaagtgatccttatcagcagaaccaccattacaaacatgcaggtcatcacaaacattagcagccactggaagcacgtagtcttggaagccagcgagtagacctccgcagctcgcgaggttgcgtggcctgtgcttgccaggctgtgctccacggccctctcggtagaatcaaggatcttctctgtctcctgcacggattggttcatcattaggctactttccttcagttgacgtgctaactcgaccatttcatcagtcaaatcttcttggagcttcctatgcttctcaatgtgagcctgagcttctgcatccaattttatcggtgctccgatatcttctttattttcctgatggcttgttccaaccacagcatgggctgttgatctccttcgcagtcctgatgataaagatattggactttctggctttgcttcttcataagagatttcatctttgctttcaataatcggcttttcattttcaggcactgaagcagcaagcctggaagcaagtgcttcaatcttttctgaatactcagaaagcttagcttttgaaatgcttgatatcccttctggtgttgtctcagctcctagctgctccaacagctcccgcgctgtggttacataatagacaagtttagcctgattttgctgccgtggagcagcctccagcagccttataaggttcacttccaccttattgagcctcatgttgatgtagcgagcgtagtaattatatcagatctggaattctggatacgaatagccaaacagtagggttcgcgcaagagcggacccagtacaggtactggcagatccagggttccaaaaggctgcactaagcgcacgcttcagcgctaagcgggtaacgcttcagtttggggcataagcgttcccaaagcggcgcgaccgccttggtggagcagcggccgctggcgcagggcgcagtcgacggtccagcggaggcggaagggaagcgggaggcgcgcacgcagagtcgccggcagccagcaggtgtgcggaggaccggaggcgaaggcgcgaggcgactggcaggagggggagccgctgacgacgacgccgaacctgggactgcccgtctggcgtctgcccctccgtcgctgagagccgcctgcgtgtgccgagcacgattttttttgggtacgagagggg

SEQ ID NO: 22788 - DNA, 1315 bp, Zea mays
cgaacgcctgggagcgctcgccttttttttttttttttcgccataacctcttgctgatcaaaattaaatagcaagcgattatatgtccctcaattacctctaatccccatgcaaccaaaaacagcaatcaccaagcctctgtacaggcatccgtctcccagtttcacatactacagccttgtttggttggagagacactcggtcgagaaaataccatcaacacaaagaattccctatgaaacaaagtcaagggtgacaaaagatttgagtgccctctacagccctcatccttcatcaagtgatccttatgagcagaaccaccattacaaacatgcaggccatcacaaacattagcagccactggaagcacgtagtcttggaagccagtgagtagacctccgcggctcgcgaggttgcgtggcccgcgcttgccaggctgtgctcgacagccctctcggtagaatcaaggatcttctctgtctcctgcacggattggttcatcattaggctactttccttcagttgccgtgctaactcgaccatttcatcagtcaaatcttcttgaagcttcctatgcttctcaatgtgagcctgagcttctgcatccaattttataggtgctccaatatcttcttttctctcatgatgacttggtccaacctcagcatgggctgttgatctccttcgtagtcctgatgataaagatattggactttctgccttggcttcgtcgtaagagatttcatctctgctttcagtaattggcttttcattttcaggcagtgaagcagcaagcctggaagctagtgcttcaatcttttctgaatactcagaaagcttagcttttgaaatgcttgatatcccttctggtgtagtctcagctcctagctgctccaaaagctcccgggctgtggttacataatagagtagtttagcctgattttgctgccggggagcagcctccagcagccttataaggttcacttccaccttgttgagcctcatgttggtgtagcgaccaggctccctgcctggtaagcggacgatgcgggggctggggacgcgccggcgtgaccggagacggcggtgaggggaatggggatgcggcgccggcgtggctggagatggggcggggcagtcagcgcggagactggggatgcggaggcggagagctggcccagccgcctagggagtctgccggccaggatgggggctcgccggcgctgattcacgactggcgctgtcgcccgtcgcgcggaggcggagaggtgtcgaggagcggcacgctgaatggcctcggccggacctcggaggg

SEQ ID NO: 22789 - DNA, 1763 bp, Zea mays
agattgcagaagtttttttttcgcttatcagtatttcggtcgagaaattcgcgaagggattaggggaattcgaggcagggatttgcaagaatcagggcagtttgatgttgcttcctgtgcgcgtcgctaatttctctgttttattcgcgtgatttttagggttttattttgagtttttcgttttctccaccgtatttcgttggcttcgttccgtgctactgtaaattcagaatcttgtcagagaaaagagaaggaaaaggaaaaacaaacaaaatagtaaggggaatttggtacctgggtgtttgctgttccttgagttggtgaatctttggagtgcctggctccgacgagatcgaaaggagggacctttccttggttcctctgctggagctgtgattgcagaggtgaaccatgtcagcgatggcggcggcgggtgaagcggagtatggtgaatgcgtgcagaaggggtccctgcagcagcaccaggcgcctcaacccagccccggcgctctattctacacccatgatggcgtcgccgtctacaggaatccggtcatgccggcgttctaccaacagcccgcgggcagcaatgtcgtcgtgccggcggctccagggccagctcattcccctgccagctctgagcccttcaagcgcaagcgcgggcgcccccgcaagtacgcccccgcagacggcgccgtgccgctggctatcgtgcccccatcgcagccacccactgctcgtgccccagctacctctgaggcctcacccacggttcctcctggcttctctccaagtccgcagagtggtggcgtggtgagtcggcaggcctcgccggcgccggcgccggcgtcaggtgctcccgatgtcaagaagcggggccggccgtcgggcccctccagcaagaagcagcagccgcaggcggcagcgcctggaccaggctggactggattgaagcctcatattttcacagttcaagctggagaggatgtagcatcaagagccatgtcattttctgggaatggatgggctgtttgtatcctgacagccaatggcactgtatctaatgtgaccctgcgtcaaggagagtcttctggtggaacagtaacttatgagggccgttttgagattctctctttggctgggtcatatcttctgtctgaaagtactggcatgagcagtcgaacgggtggacttagtgtttctcttgctagtcctgatgggcatgttttaggtggtgctgtcgcaggacctctaaccgcagcttcgccagttcaggtggtcattgggagctttctggctgatacaaaaatggagcttgaccctggatcagcacctgagaaacatgttttcagcaggtttcaaactaccagcagtccatctaggggtaccgaatcctcgggtgggcatgcaagcccaccaaacaccacaggctccttcagcaccagcacacagccaggcttcccaagctttcccacatggaaatgagtttacctgctatggtggagtgggaccgtggcctctggggatgaggagggaggaatttggaactgacagtcctcgagcgtcgtcgctgtagtttcatgagatgttatgagagtcaatcctatttaggtacttctaactggttacaatgaagttccggtttgctgcttgtcttgacattttgcatcattgaggcacttcaaactccaaagtggtggtaacatacagtatattagatgattccccctatcaaatgccttttgtcaaaaaaaaaaaaaaaa

SEQ ID NO: 22790 - DNA, 1465 bp, Zea mays
  misc_feature (735)..(735): n is a, c, g, or t
ccaaatatatattgcttagaatatatattgcttattaactagttgggtaacaagtccgcaacctttgcctgactcttttttgttattatagctcaaaggtagatttgcattggctttggaacaacatttggttcaagctcaagcaaaccctaatagcaataccatactatccctaataatggtatggcatctcaagaagaaagccatgcatgagagaatgggagatgaagagatatctagctagcatcatgaagacatctaactaaacatggagatgatggaggtagtaccatttttatatattcgacatgagcatgcatgcaattaggtatttgagctacgacgaccaatcgagcgagatgatctgcccgcctcctgcggcggcgtgctagctatgctgccgcttgcatgttcatgtccgagacccgtcgcctcttgggccggtctccggcagcgcctggcctctctaccagagcccgcagggcttccttgaggaagtcaccgccgccgccgtctgtggcaccgcccgccgagtcagcagcgcgtccaccgtatccgtcatcacctcccgcgacggcaccgccgccgccgtcgacgacgtcgcgcgccaggacgagcacgttgcggacgcggccgccgagggtggccatctcggagcggagcgtgcggaggcggagcgcgcgcagcgtctcgatgaggtccgggaggaggtcggagcggtcggttcgcagcagnacggaggcctcgaagacggcgccgcatgcccgacgcgagcaccacgatctcgtcgtgctccgtcgggaacaggtgcgccggcgccgcctccccgacgcccgccgcccgctgcttcaggtcccgcaccctctccaccgccttcgccagcagcgaagccttgtctatcttggggtcgcaggcgaggacgttgcggaggcggtcgaggtgcgacttaatgcgctcgcgccggcgcttctcggcctcgcggtggttgcgcgacgcggcgagcgcgcggtcgtgggcggcggcggcggcggccgcctcgtcctcctcggagccagcggcgccagcggccgcgggccagatggagcccatgaaaaagggcggtagcatcgtcccggcggcgtcgccggcagcctgacgccccgctcccgcaccgcccgccgcgagcgccgacacttcgaccgggaacatgtgcgagctagctactagcagctggtcgatcctcttgtcgcccttgcagctgagacggttgctcctcgagtgagtggcagggagaggcgcagcgcagcacgccctgctggtgtcccagccgcccccgcccggcgaagctagcactgaggcgtgcagctggtatggtagctagctacagcgcggcggtagtggcggtggtggtgcgagtttttgcgccgtggtgttattcctaggacttggttttttgattaggatgttctaggtaatggtctcgtgc

SEQ ID NO: 22791 - DNA, 709 bp, Zea mays
tgcaaacataaccggccgttgtttctcttcttatctgggtggattgggctccggcccggcgttgatctcttcttccactgcctccccaccacttcgtcctcgccggctcgcaactccttgatggcggccacggcgagtctcactaccactgctccctcccctccagctctcctcaaagcatcagctcctttgcttatctcctttcgccccgtctcccgccactgcaagaacctgtgcatcaagaccaaggccacagaaaatgatcagtctgctaaaaagcatcagaaggtgaagagcattctttgccaggactgcgaaggaaatggggcaatcgtatgcaccaaatgtgaaggaaatggggtaaattctgttgactattttgaaggccgatttaaagctggatctttatgctggttgtgcagaggcaagcgtgaaatcctatgtgggaactgtaatggtgctggcttcttgggtggatttctaagcactttcgatgaaactgcgcaatagtcatcggtttagcactttcgatgaaactgcgcaatagtcatcggtttaatttatgtttaagttacattgagggacccataatatatgtatcgtgttccatggacacataatcatattatataaaataatatttttaatgaaaaaaaaaaaaaaaaacttgatttggacgttctgggttttaaaaaaaaaaaaaaaaaaa

SEQ ID NO: 22792 - DNA, 872 bp, Zea mays
  misc_feature (857)..(857): n is a, c, g, or t
  misc_feature (862)..(862): n is a, c, g, or t
ggaaactaagaaagaggtggttgtcgtacccacccgccagtttggcaggcccgttcatttagtaaacttggttgggatccgcgcggagggtggcaggaaatttcagcccagaagacccaattgcgcttgggacctgcgttagtgggaaaagttttgtctgtttggtgccgctggcctacggcggccaattttgtgctggggcggcttggaaagttcgttgaggccggccgcgggggagtctcgataacactgctccctcccctccagctatcctcaaagcatcagctcctttgcttatctcctttcgccccgtctcccgccactgcaagaacctgtgcatcaagaccaaggccacagaaaatgatcagtctgctaaaaagcatcagaaggtgaagagcattctttgccaggactgcgaaggaaatggggcaatcgtatgcaccaaatgtgaaggaaatggggtaaattctgttgactattttgaaggccgatttaaagctggatctttatgctggttgtgcagaggcaagcgtgaaatcctatgtgggaactgtaatggtgctggcttcttgggtggatttctaagcactttcgatgaaactgcgcaatagtcatcggtttagcactttcgatgaaactgcgcaatagtcatcggtttaatttatgtttaagttacattgagggacccataatatatgtatcgtgttccatggacacataatcatattatataaaataatatttttaatgaatactccttcgtccacttgatttggacgttctgggttttgaaaaaaaaaaaaaaaatatgattggtgggtggggggtggatgataaaaggttgaaggtggaaaaanaaaanaaaaaaaaag

SEQ ID NO: 22793 - DNA, 810 bp, Zea mays
aagtccccggcaagcgggcaaaaaaaaaaggcaaaatttgccgccgagttttttttttttttttctttcaataagccccaggatgttgtattatcagaaccccatggagggaaaacgggagacatcaaaggtttgttttgtttacaaggtgaccgagtctctctcccgacttaaacatgtatgccaattagtggtcgatctctttcttgcacattgatcatcaggcatcagccaattgacatgcagtcaattagcttagcgatggcttctccttctccatctatatctcctcctcggtgtctttcttcaattctgtcgtgggctcggctgccaccttgttggtggcaatattttcctctgcatggactgctgatggcttctccttctcgatgacggtcttctccacaacttcctcctcctctttgttctcaggctcgacaacgacgaccgccacttccgaagtggtcacctcactagcaatctgctgaggctcaatggtggctgctggctcttgtttcgccgccactgttagtgcctcctccttgtcctcctccaccttctcaactactgcatgttttgccgcaacctcaatgtggatggtagtggtctcaggtgcaaccttgggtgtggagatggtggcctcagctggggctttcccctcaagcgtcttaggcttcgttgcacaggcacccatggctgcacctaatagatgtggcggtcggggaggcttaattgttggtcaatggaggaggcgaggaggttcttgaatgtgtggagaccccggccggtggccccatctcccccggccgg

SEQ ID NO: 22794 - DNA, 1696 bp, Zea mays
  misc_feature (106)..(106): n is a, c, g, or t
gtcacaagaaacgagtacccagaaacacaccatataaaaatctcccataggtagcgtattgtgttcctcagccctattgattcgagaactttatgactatggtttnatgttagttagaagtattaaatctagtatcaaataaagatctctgattcaaattagaatatgtaattctaacaagaaccttgactagaatcaaactgctccatccgtcctaaagtaatttttgaggagtcaaccattttaactttaagtaaatatatacaagaaaatattaataataataataatataaatttaatatcgctagataaatctttgaatctattatataataaatttatttagacgtataaatattgcacatatttttgcaaatctagttatacttgataagacatgatacgataacgacaacaggagtacctatgagtcgctccttccaacatgtgttcaaattaggaatcgtactaaaaagcagggtagttctagaatggaccgaactaaaccgttatagcgatataatcttactaaaccgctcataatagacaagtacaataatttaaagtagtctaatatcgaatcgatgaacaatgaaaatcataaaacatattgaaaatatataatccacttttagggggtaggaggctctatgagatcggatatcagaagtggtagaggggctccaccgctcgagccccaccccctaccgctccatccgtctatgtcaatagcatacataaaaataggaatgttgggttgacgaatattcccggccgcttctttagtaacctagttttctttcattcaataagccccaggatgttgtattatcagaaccccatggagggaaaacgggagacatcaaaggtttgttttgtttacaaggtgaccgagtctctctcccgacttaaacatgtatgccaattagtggtcgatctctttcttgcacattgatcatcaggcatcagccaattgacatgcagtcaattagcttagcgatggcttctccttctccatctatatctcctcctcggtgtctttcttcaattctgtcgtgggctcggctgccaccttgttggtggcaatattttcctctgcatggactgctgatggcttctccttctcgatgacggtcttctccacaacttcctcctcctctttgttctcaggctcgacaacgacgaccgccacttccgaagtggtcacctcactagcaatctgctgaggctcaatggtggctgctggctcttgtttcgccgccactgttagtgcctcctccttgtcctcctccaccttctcaactactgcatgttttgccgcaacctcaatgtgtgccgtagtattcagctcacgtcaaggaataaatacagatgtgatcgaatgccacgagcatgcgttgtcatgacatcacctcaatgtggatggtagtggtctcaggtgcaaccttgggtgtggagatggtggcctcagctggggctttcccctcaagcgtcttaggcttcgttgcacaggcacccatggctgcacctaatagatgtggcggtcggggaggcttaattgttggtcaatggaggaggcgaggaggttcttgaatgtgtggagacagctttgcaatgggggatgctctatatttataagaaggcatgcatgatagttaaatttagacgaagattatagcaatggtttagaggag

SEQ ID NO: 22795 - DNA, 779 bp, Zea mays
ggccgcttttttttttttttctttcaataagccccagggatgttgtattatcagaaccccatggagggaaaacgggagacatcaaaggtttgttttgtttacaaggtgaccgagtctctctcccgacttaaacatgtatgccaattagtggtcgatctctttcttgcacattgatcatcaggcatcagccaattgacatgcagtcaattagcttagcgatggcttctccttctccatctatatctcctcctcggtgtctttcttcaattctgttgtgggctcggctgccaccttgtcggtggcgatattttcctcttcatggactgctgatggcttctccttctcgatgacggtcttctccacaacttcctcctcctctttgttctcaggctcgacaacgacgaccgccacttccgaagtggtcacctcaccagcaatctgttgaggctcgatggtggctgctggctcttgtttcgccgccactgttagtgcctcctccttgtcctcctccaccttctcaactactgcctgtttcgccgcaacctcaatgtggatggcagtggtctcaggtgcaaccttgggtgtggagatggtggcctcagctggggctttcccctcaagcgtcttaggcttcgttgcacaggcacccatggctgcacctaatagatgtggcggtcacggaggcttagttgttggtcaatgtaggaggcgagtaggttcttgaatgtgtggaggcagcccccggccggcctcgaggaacccaatcgccctataggagt

SEQ ID NO: 22796 - DNA, 3004 bp, Zea mays
gagaatgggtaaataccgcaaaaaccagataagcccggtgcgccgtctccttccttctcggcgctctctcgcccgcgcctccatcactcgctagtcgctccctccgcctccgtccaccatgcccgcctcactccttcctccgaccttcctcccccaccacctgcgccgcctcgctcccgccggttgcactacctcttccgtcacctcctcctcggtctccatcccagcgagccgctacgacttcgagcccctcttggcctacctctcgtccccctccgtatcggcctccctcacctcgccatccccaccggcatccgttccggcgcccgagcaccgcctcgccgcgtcttactcggctgtcccgtcgcacgagtggcatgcgttgctgcgtgacctcgccgctagtgacgtgtccctgccgctggccttcgcgttgctacctttcctccaccgccaccgtctctgcttcccgctcgacctcctcctctcgtctcttctgcactcgctctccgtgtccggccgccttctcccgcactccctccttctctccttcccgccgtcgctctccgacccgccgtccccactgctgctcaactccctcctcgctgcgtccgccgcggcctcgcgccccgccgtggccctccggttgctctcgctgctccgcgagcacgatttcctcccggacctcgcgtcctactcgcatctcctcgcttcgctgctcaacacgcgggacccgcccgacgccgcactgctcgagcgcctcctcggtgacctcagggagtcgcggctcgagcccgatgctccgctcttctcggacctcatctctgctttcgcgcgggcggcgctcccggacgctgcgctggagctcctcgcctccgcgcaggccattgggctcacgccgcggtctaacgcggtcaccgctctcatctccgccctaggcactgcagggcgcgtcgccgaggcggaggcgctgttcctcgagttcttcctcgctggggagatcaagccgcggacgcgtgcttacaacgcgctgctcaaaggttatgtcaggattggttcgctcaagaacgcagagcaagttcttgacgaaatgtcacaatgcggagttgcgccagatgaggccacttacagcctgcttgtggacgcgtacacaagagctgggaggtgggaaagtgcgaggatactgctgaaggagatggaggccgatggggttaaaccaagctcgtacgtgttcagtcggatccttgcaggattccgtgacaggggggattggcaaaaagcttttgcagtgctccgagagatgcaagctagtggagtaaggccagatcggcatttctacaacgtcatgatcgatacatttgggaagtacaactgccttgggcatgctatggatgcctttaacaaaatgcgagaagaagggattgagccggatgttgtcacatggaatactctcattgatgcacattgtaaaggagggcggcatgaccgtgctgcggagctgtttgaggagatgcgtgaaagcaattgcccaccaggcacaaccacatacaacatcatgataaatttactcggagagcaagaacactgggagggtgtggaagcaatgctatcagagatgaaggagcagggactggtacccaacattatcacatatactactctcgtggatgtgtatggaaggtccggtaggtacaaggaggcaattgattgcattgaagcaatgaaagctgatggtctcaagccatcgcctactatgtaccatgccttagtcaatgcatatgctcaaaggggtttagcagatcatgcgttaaatgtggtcaaggctatgaaagcagatggcctggaggttagcatcttagtgttgaattcgttgattaatgcttttggtgaagatagaagggttgttgaagccttctctgtgctgcagttcatgagggagaatggtttgaggcctgacgttataacatacacgacattgatgaaagctttaatacgtgttgagcagtttgataaggttcctgttatctatgaagaaatgatcacatcaggatgtgcccctgatagaaaagctagagcaatgctgcggtcaggtttgaaatacataaaacacatgagggttgcataggaaactaaacacaattactgatagcatctgatggaatcatataccttctcctgatcttatagaacatttcaacagaaggtgaagcaccacatgctgacagacacgatctgcttttgcacaagatgatagaatcatcaatatagtcacttcgtcttcctaatcacctaggggaaggcgaatatataatacatcttgatcatttgcaatggaaggagattaaatacatgacaccaagaagtcaggatcttggtataggaaacaaatacatagtctgtccagacctcaaaatttgagttggaatcttggaattgacatttccttataactcaattccagtattttgctgagaaaatcaattgtaacatggaatccaattccagccttttcaaattgtatctaggcgtagacatttctagaatttgtctagggcgatacaaaaggaaatgtattgcatttttattgcctaaaacaaactttggcattaggtcctgtttggatccttgaattgaattgtattctaacaatcataatttagacatagatcaattaagttaatatagttttacatggaacatatttgtatactactgttggtcatatgaggaaggtatttatatgctatatttctactatagagagtgaaccgaagagtttgttattagttgcagagtagaaacataagtaaggtgatatataaaatcaatttctatttatcacactatgaatttaagataaggttacatctaaactttaaagtggtggaatatcaaatttcaagccaaatatattactctattaaggcttgtttgggagaaaaaaaaatactggagtggattataggggctaaaatgtctttgctatttaattttcaatagaaga

SEQ ID NO: 22797 - DNA, 2254 bp, Zea mays
tttttttttttttttttttttttttttttttttttttttcggttgctttgggagggccacaactgttggttgtttcgtgtctaccgatgtaactttaacattgtttcaagcacactatgatcacctgcgacaacagagttaatacatcagcacgcctagcgagtaccgacagtaacgcgaagggattcgaatttctcacagcaccacacgatttcgttacacctctgctcgaacaagtcagcagatcacacataattaccgaaagtgtcagcagcgaaagctcttactccgactagtgaccctccgactttgctggcatgctgcggacgttcttgagcagatcctgaatcttggatagcatcatcgtcggcgtggagtcccctcccgcaccgctgctgctgcccacgccgaccgttggcctctggttctcctgcagcttgatcttctcgaagaggaactgcttctctgcctccgcctcctccaggcgccgctttaggtacatgctggcatagtcctgctcggctgtcttggacttggtgagcgcaatgctctgcagacgctccgcctcctgccgggcctcgttcgccttcagctggaacatctccgcttccgcctgcttcaaccgcacgatgctctccagctcctccacctgctgcttcttgcgctgacgctctgccttcagctcctgggcttccctaaccttctcctccagctctcggtcgcaggcctccacggcgaggcgagccttcttgtaaagtcgcatcttttcttctgccacgagctccatctttctcacggcctcttggactacctctgctatgcggttgcaggcttcctggggtgtgatcagatgcccaacatcttcattttcagagatcttgggggagtccatctcaagctcttggagtgcttgtagtatcatcctaggattgatggaatcagctggagtgttcctcagcctttcaatcagatctagacatttcctgaacaacactctcccttttgcatcctcacttaaacggaatatcttacaaacgaactcaagctcgcgtaacaaagcatccctatcccaaccaggagcgcattgttggaagacatccttaacccaacccagcagctctgaggtcctctggcaagctcggcacctaaaaagcatttcagcatgaccaatgctgcttttcactgattgtcccattccgatctggccattgtgaattgcacaatctgtatgtgtccagtgagagcaaaaatcacagccaatccaacggcatgtattgacctcaaaatcaaacttgttgcagatgacacacatgcacaggttgcaaaaaccattcctgctagcgcacacgttgcatctgcactcctcagcagggagagcactctggcaagcaatgttccggcacctcttgtacaagaagacctccaccaagcgattgtgtggaatggtaacactggggtgcagaaaggcctgtattccagtcttgattgcaacaaggatctcaagctgcacatggtgtgccactgaaagcatggatggtgtcaaatcatgcctgtcctggacaagcttctgcaagtacaagaactcctcgatgtggtgagaacctccagtgccctccagaatcgacctgagctcattcttgacctcctctaggtgctcatccgacatcatcttcatcttctcagcgaccagatcaaccctctcccgtgcaacctcccgcagaagcatcccactcacacgggaggagggtccatggataacctgcggcttggatacaccatttgccacctccttctccgccgccttactcacaacatcactggcagccaccccaccattgctctggttcggctcagctggccatgtgtctttggaactggcgctctcagtggcggaatcatgccctggctccgagtttgaaccaggctcctgcatgtcaggcgagccaacctgctccgaagaggccagcgagagcgaggtctgcaaccctgaggggcgtggaccatgccttggaggcaacatcccctgggtcggaggaggttgctgatggaaattcgcgccagaagaggtccccatctttcagaatcccaagctaaaagcctgcaaccttaacctcggcgctagcgagacccgtatgggcggcgcggcgtgaacccggtacaggagcgcctccgcctttgaccgatgaggacagcgagatcgcgtcccgtcccagcaaatccccccccccaccacgcggtgcccacgcggccgcgg

SEQ ID NO: 22798 - DNA, 4207 bp, Zea mays
gcgggtatctctcgtgtggccttccgtagtatacatacatgtaatgtaaacaaacagacgctaaaattcagtcgacgtggatatagataaaaggatatttgcatgagattataatctgtttggattatataatctaacagatttctcacagatcaatacatactcaccaaccataccgtgtttggtcaagggctccgttaaaaatgcatgcgggtgtatacgtagatttaagatgcaaagggagggccacaactgttggttgtttcgtgtctaccgatgtaacttttaacattgtttcaagacactatgatcacctgcgccaacagagttaatacatcagcacgcctagcgagtaccgacagtaacgcgaagggattcgaatttctcacagcaccacacgatttcgttacacctctgctcgaacaagtcagcagatcacacataattaccgaaagtgtcagcagcgaaagctcttactccgactagtgaccctccgactttgctggcatgctgcggacgttcttgagcagatcctgaatcttggatagcatcatcgtcggcgtggagtcccctcccgcaccgctgctgctgcccacgccgaccgttggcctctggttctcctgcagcttgatcttctcgaagaggaactgcttctctgcctccgcctcctccaggcgccgctttaggtacatgctggcatagtcctgctcggctgtcttggacttggtgagcgcaatgctctgcagacgctccgcctcctgccgggcctcgttcgccttcagctggaacatctccgcttccgcctgcttcaaccgcacgatgctctccagctcctccacctgctgcttcttgcgctgacgctctgccttcagctcctgggcttccctaaccttctcctccagctctcggtcgcaggcctccacggcgaggcgagccttcttgtaaagtcgcatcttttcttcagccacgagctccatctttctcacggcctcttggactacctctgctatgcggttgcaggcttcctggggtgtgatcagatgcccaacatcttcattttcagagatcttgggggagtccatctcaagctctgtgtgaagatatgtccatagtacatcaacccatcaatatactcagaagtcagaaagctaccacagaaaaggaaacataagtagtatttacgactgcttaaaacaagggtcagataacatgtcatgttaacacatacgaaatcctaaagaacttatccaaagcacccatagaactcagccaaacaaattcaacatgtgtactaaggtctaagggagtgcccagaccaaacatttatatactgattatgtttatgttggggatatctagttgattgcggtcgcgcgggattttgacatcatgaccaaagctatgaagagttgaggaacagacagcagcaaaattttgatccaatagaaaatacttctagtaacaattaacaacaagaatgttcaatgtaaaattgatcttagccatttattaaattataaaaacaaaacatttaaatatatgagttaggtagatgcctacctctaaaacgaaggttgaatgcagtagaattttaggtgtggcaacaaaaaaaattcttgctggcattcaataacaagataaatggcacaagttcattcttatcatacacgagcatagccataccgctaagaaatagtagctttacaacacaacataaagggcgaatcctgatagaaacaaataagaagtgattgatttgtttgcctgtttttagaccagttcaataccttttaatgttaacacaaagtgaaaataaattggcactgttcaaccgcctgggttaaagggaaggctggatgggccaggatgaactgctgaatgctacgacataaggctcaacaacgactggatgaggcagcagagaccatatcacaggggacaggggtactgataaatgcagggagacatcaatgacaggcactaaggattacgagcaggagcaatgctggagagcaaatgaatggatgggactggaaagagcagcgtcaggaaaacacaaaaccaatccagaagttcttttttttaaaaaaagtttgcaaacctgacaaatttcaggtccatttgcactatagaaaaaatgtctaatgcaaaggagagtgaaatttgtcacttccatatcaggaaaaggttgtaaagagtcaattcaggtgggtggaaaatatgctttcatgaaaaggtggctggaaaatgcagtagaaaagtgatttaataaagtaaaagaaattgaaggcatttattcatacccaataccagaagtgccaaatcatcaagttgtcttactaaagcaaataaataaacaactggaatctggcagtacttgctggataataaaataatctccaaataagtccactaggacatcaatttggtctccatttttacactatgactaatagtgtcaataagaatatgttgctttaaataaaaagtgttatatattctggaagtatatttcatgacaaatgcagacatgcagtaacagcaaccccatgttatcgatctaaatttggtcaatgatggctgatgctaaaaaagtttgaccttggacaaagctaaatggacttgtatttgggatcggagggagtagacaattttcatagtcaacagggtgccacgaaacagtaactaagcagacttagaaattagtattatcaaatgcaagtaacagaaagaaaataaaaagctaacaagtaacaggtcaaatgcaaactcatgtttcagccagggaaaatagacggggtgagtccagctcagtgactcttggagtgcttgtagtatcatcctaggattgatggaatcagctggagtgttcctcagcctttcaatcagatctagacatttcctgaacaacactctcccttttgcatcctcacttaaacggaatatcttacaaacgaactcaagctcgcgtaacaaagcatccctatcccaaccaggagcgcattgttggaagacatccttaacccaacccagcagctctgaggtcctctggcaagctcggcacctaaaaagcatttcagcatgaccaatgctgcttttcactgattgtcccattccgatctggccattgtgaattgcacaatctgtatgtgtccagtgagagcaaaaatcacagccaatccaacggcatgtattgacctcaaaatcaaacttgttgcagatgacacacatgcacaggttgcaaaaaccattcctgctagcgcacacgttgcatctgcactcctcagcagggagagcactctggcaagcaatgttccggcacctcttgtacaagaagacctccaccaagcgattgtgtggaatggtaacactggggtgcagaaaggcctgtattccagtcttgattgcaacaaggatctcaagctgcacatggtgtgccactgaaagcatggatggtgtcaaatcatgcctgtcctggacaagcttctgcaagtacaagaactcctcgatgtggtgagaacctccagtgccctccagaatcgacctgagctcattcttgacctcctctaggtgctcatccgacatcatcttcatcttctcagcgaccagatcaaccctctcccgtgcaacctcccgcagaagcatcccactcatacgggaggagggtccatggataacctgcggcttggatacaccatttgccacctccttctccgccgccttactcacaacatcactggcagccaccccaccattgctctggttcggctcagctggccatgtgtctttggaactggcgctctcagtggcggaatcatgccctggctccgagtttgaaccaggctcctgcatgtcaggcgagccaacctgctccgaagaggccagcgagagcgaggtctgcaaccctgaggggcgtggaccatgccttggaggcaacatcccctgggtcggaggaggttgctgatggaaattcgcgccagaagaggtccccatctttcagaatcccaagctaaaagcctgcaaccttaacctgggaggaaaataaaacggcgaagagatgggagccgaccaacgccggtgaagctcgccgtcggttttggcccgccaaggggagatctcgccgtggtgctgctggtaacctttctgttcgtccagagaggatctgcgagtccagagaggagatacgatcccggccgtgccggcaagc

SEQ ID NO: 22799 - DNA, 1622 bp, Zea mays
  misc_feature (17)..(17): n is a, c, g, or t
tttttttttttttttcnttttttttttttttttttttttttttttttttttttttttttttttttttagaagagtacatccactgctccacatattcgacttcgtaccgaacttacatttgccatgttgtacagtacagatggagcctgccttcacgacaagcggataagaagtcgatgactgtcaccttattagtcattgtttttaaactgaacatacttacagtgccagttgcttatctcctagtaattgctatatgcaacacagtgcaggggggaagacagctgatgtatgctgctgttactggagtttcagttacaatcctctgcaccgacgtttctttcagcgtagagaagtgagttgaaggtttgcaacatatacacaacggcatctgaagctgaacatcacgttcttgttgtgccgatctggaaaccgaggacccggagcagctgctgcatggctttcccggcccaggccaagtcgttctcaaatatacttgtcggcctgttcggtagcacatcacctccctgatacaagggagtgtcgtcgtcgtcgtcgatgctgccattaccagcataatcggcggcagaaagggtgccgttttcttctccggggacctcttcaagaatcgtcttgtgttcgtccaccaccagctgcggttggcccgttccgtttgctgctaccatttcctgctgcggaggagcatctgcaaccaccgcagccgacctgtcactgtcagtctccacattctgatgcttctcgggattatctgccggcattgcgtttgcgccatctgttcccgcaagatcctctggaaacatcacatcttccccgatggagagctcttcctcctctgacactttctgtttgttgccgtgatcccagtcttcgtgaacaactacggtgtttggggtttcagtagtaattcgcagagttctgttagcgccatgctgccaatgcgcatgccccgaggcatcttgcagcaagaacttgaactcgatcgacctgttcgccggcaaatccgtgttcgccgtccagacgtggccttctgaccaaaccaaggagatcgccttagctggatcccaaagcccgagcgccgcgtcgtcgccggcgacgaggaactgctggccgaaggcgcactgcttcctcagcacgaacctgacgcgcactgtcctccttgcctcaggaacgtgagcagcagcgggaggcaggttttcgacggaaacaattgagttcagatcatcctcatcctcacccacctccagcgccacggcctcctcgcccagggattgcgccgggagtggctccccgaccccgagcgacgcgacgagcaaccttcttctagcggcggacggggcggggccgacggcaacggcccacgtacgcgccctgctgcttggacgggcccgcgcgagcagcccggcgcggcacgccacggccgcgacttccatggtttcgacctggtggcggcggccagcctacacggaaagaggcggtgtgccggactgccgggtcgtcgtcagctgcggagtgccagtgcgcctcgcaagcgggctgcggccacagcgctttggccacttctgcagtttttgattaggatgttctaggtaatggtctcgtgc

SEQ ID NO: 22800 - DNA, 2456 bp, Zea mays
ggctggcaaacaaattatcgccaaacataccaaaaaaaataagacatggcagtgatgtaaatacagtcgacattttgtattctttgaagcatccatcactcagtttaccataatatgggtggggggggaggggggactcaggaattagatagctaatccaagaaatatgtcaaaagatagaacaaagaatatcatcagatggttttatgctaattttcgcttttcttcttcagcaaaccaccgaatctcttcagcaaaggcttcttcttatgctgttgcggctgtttagttgataccatgccactgctctccttagttgagtgcaacccattgctgtcaagacctgcatcccccttgtttgattccaaatcaacctgtgagtcaccatcattatccttctccttagatgaatcatagtcagcaaacttgccgttctcccacattttggcaactaccacaacaggttcatcaacctcttcagtaccctccttctcattatctccttccttgctgttaccatttatcatgctatcttttacattagcaagctggaaagagagagccctaaccttctcagaagctgctaattcctttgcctgcaggtcgtcgttctcctgttttatgttctgtaattcattctcttggtctaatatgttctccttccatcggatagtttcagcgctggcttcctttctgattctgtttgcttcaattagctgagactcaagctgctgcagcttctcctgcaactcagtgttttcattttctttctctttaacaacctccaaggtcctgtccatctgaactctgatagcaactatctcttcctctgaattcttaatagaattgacaaaacttagctctttggaatgccattcatcatgtgcactctttgcttctgctttcagtctttcaactgttttcgtaaggcaaacgttctcatagtttgcctcatcaagcaatagttcatagttctccttagtattcttcagactcaagctcagctcctctacctgtgcctgagcacgctcaatctcatcttgtttgagaaggtacttctcttgcgcctctctggattcagctgacatttcctgtaaggctgaggccagaccctccattgccttcttagttttctcaagctcatctttgtttgcctcgagcttgtcagccagctggttcttctgttcattcaaggtctcaatttctaagctagtactcttatcactgttcagggcctccattttctcttcttccactgtatggagcttcagcctaagcccttcaacctctgtccatagatccgccgcctctttctctgctgcatctgcccgttggccggacacaacaatatcattcttgagctttgtcagctcatcctccaagaacctgactttgtcacgaagagcagcaacttcagattctctgtcacgaagcaaactacttgttgaatccaattcttccattgctgaattcaaagactcgcccttcaaaatattagactgatcagcctcttccaatctgacctcgagaagctgtgccttcttctgccattcatcggctaactgctttgacttggaaccaaaattcctagcatcatcaacatcactctgaagttcatcaatcatgcgctccaatcgaattgccttttcttcagcagccttttttttctgaagctcaagctttaatgcaaagttctcttcttcaagattctgtatcctctctgcagtcttcttcctgttgccatccaccttggaatcaaccagccctttgaggtgtgtaacctctgcaatgagatgctcaacttcctgggtcttcgcctcagaagccctaacggcatcatctacctggctgagggcttcattcttggcatcgattgcgttggccagctcgtacctagccttctcaagctgctccactgtcgaccgcagcacagtgtcatcagcctcctgctggtcgtggatgcttgcctgctccgactctccagcagggagtttgtctgcctcctgcgcttcaatagccctcctttgcacatcaagagcatcctgcagcttggcattggcctcatcagccaccttcttggcacgctccagctcagcaagaactctgcacttctccttctcgttgtccagcaactgctctttggccttcacgagctcttctcggatctcggcaagctgcgcctgccgcccccgccgccgctttgcgggcttccccttctgaaaccatcaatacaactctgaattccgcaaaaaaagcacgcggattttcgcgcccgcaggcaggcatggtagtctcgattgctatacctcgggaggcgtggcgaggcgagaggcggcggccttgggcgtgggcgccttgcggtcggccgaccccgagccgggggacttgtcagccgcccgcggcgtgccatggccggcggcgcttgccttgggcacggccggcttgcgcggcttgct

SEQ ID NO: 22801 - DNA, 1402 bp, Zea mays
aacactgggaggagggacaagcggccacaccggctcgccgtgagcagcagctaagctctcgcatcggtgaggcgtaggttgggcggccgcggtgaggaggtaaatgtgtgggcgaggcagcgcgtcgaggggagtctgacggagtcaaatgaactaggcttctcaatctagggttattggatgtcgtgctcaattcctatagcgtccaaatcaattgcccatggacgccttacccacgcctcatggaagtcatggacgattcgaggacgccatatgcctaagatctgaagtgtctagtatggcgtccgacctgcagcgccttaccgcttaggcggcggttagaggacgccataacaaccatgagtggcacacatgtaagattttcatgctttgtggtgtgtggagtgtgttgtatattttggtcccttcttaatgcaatgatacacagccctcaagagtattcaaattttaattaccagtagcatatgagaaacaattaaatacgttaacgcataccgacaactgagatagttcaaaggaactgtgttctcaaaagtttagtggaaccaaacgtgtgaagttgtgaactatggtaaagaccgaatgatccaaagaaacttggaagtacaggttgtgacacaaataaaactcaccagtggctgcatccgctttttcccaattgggtatctgtatggatttggtgtttgcattgaaaaggcagtaaaccacaagataaaatcctgacaacaagtctagaagagaatccaaagttgatgcgatgatagcaagtgagccactccttactgaagcatacacttttgcagcaaagagaaccatatttgcaaagttagacaaccgtatggctaatgtttcactcctggcaaccttctctcgttcttccttggacattccaggaaggaaaccacgatctgtaagtgtgtccatctcactaaaaccctcaagcatctccacttgctgttggtagtattcagcaacaacatcctcaggaccttgagctagcacgccgaggcagtggtgaagcggaccgttcggcggcctctcctggtgcgcctccggcgggcggaacccctcgaagttgagccgccacgaatcctccacctcggtgggtacgccgccgccgcggccagcctccacggccgagagcaggaggagctcctccccgtctccgccgttcgccgccgccgccattctggaaccctagcagactgtgagcttggggcaaccgcgctttgacccgtacgtacgtggtgctctcccgcggcgcggcggcggcgcgcgaggactaggagcagactgacggccgagttggtttggtagttgccaagcgggcaaacgcactagccgtctagccccagccccggcccccgcgtgcgtcacccaa

SEQ ID NO: 22802 - DNA, 954 bp, Zea mays
agagtccaggtcgggacgcgtcggggtagcgcgcagcagtgcgcgatgccccactgcgtgaaaggtgtcacgcgtctggaccacgcgggggtacgtctccacgtacgcgcggccgtccacgaccaccagccggaacgccgcccggtggcgcccccgctccaccgcctcgcgcgtgatccccgtctcgcgccacggcgacaggtcggagtggatgaagcggaagtaatccgggcactgaggagggggttgtttattcttggacgatgatgacttggtgcctgctggtggcgatgacgatgatggcgacggagaggggggtgatgttgcggtttgacgacggggacatgccgagccgttgccgccgcagctgaagggtatgggcacgaggtcggctgcgggtgaagggacgtggtgaggaggccattgatgctgcctcaagccgccgccgcgcagaaacgacgatgcatagtcgaggtggatccagcgacgacgactggtgttggcgccgccgccgccgccgacgacgaggagcaagaccagcacgaggagaccggcgatgaccaggccaacacctctggtgggcaccagcagcttctgcgcccgccgcagcctccaccacgccggcacccgccgctccgctgatgacgatgcttccgccgtcttggtcgacgtcctaattgttcttgtgtgctgctcatcctgcagatcctcctcatcgtcaccgtcatcctcatccatcagctgctccggatcatgctcgccgccgtcctttctctgttgctggggccacggcgacggcaccaacgccgccctctcctcctgcaagctcttcatggatagacgatgatggatggatggagtggagtacgtggtggagaggagcgaggcccctggctattctaatagagagtcatcccggccggccccggggtcccctatccctatgagtagtcg

SEQ ID NO: 22803 - DNA, 2118 bp, Zea mays
ggccgcaaatttttggccgcttttttgctttttctgttgctttagagtgtgagttgatttgaaatagacgtattttttttttttttttataagaccattaaaactgatattttaatattatagagacagagaccaggacgtagtataacgaagtggatattcaagatagatagatagatagagaacaagagaatcccttaattggtgacgtcatggagtgacggtggtcatcatcttgtgcacgttggcgcgcacctcctggtctcttcgcgtcatctccctgatgtgacggtcggtaaagggcggcggcagcgtgcagggctggtagtcggcgatgtacctctccctggactgcatcatgaagtcgaactccctcctgttgctgtggtgcgcagcggggcaggcgacggtctcggcgcacagctctacggcgttctccggcacggtgggcttgtagcggagcaggccggcgtactgggtgagcaggtgcagcatgtagtcgtagacgtagtccatgctgagctggtggcgcgcgaagccgctgccttcctccgccatccggcgcgcctgctccgggtgcgcgttgccccagtcgtggacggcgaagttgatgtcggcgcacttgcgggctccggggtcgatgggccagtagtgcctgccggcgacgaggccccgggagaagaagtccttgaagggcgtggcgatgagcagcaccggcgagtcgcaggcgaggatgtacttgaggctgaccgaccaggaccggccacgcacgtagatcttgtagcggtagcggcactgcttggccaggttggagtcccggaagccgtcccggatggcggcgccccagtcctgccagaacacgcgcgtgccgccggacgacgaggagtcgttgcagcggcggaggtcggcgcgctcggcggacacggtggggttgcccttccagtacgcgtacggctcccggtccgcccacggcaggcgacccatctcggcggccatctcctccagcagcggcgcccagggacggatgttgacctcgggccagccccagaaggaccagtccgggaacacgatgtccaccgtggagtcgtccttgcagtagcggaacagcggcggcgcggacgactcctccgacggcttgaccttgacctcgggcatgtcctcgcagttgaacatgaggtccaggtccgggacgcgtccggggtagcgcgccagcagctgcgcgatgccccactgcgtgaaggtgtcacgcgtctggaacacgcggtggtacgtctccacgtacgcgcggccgtccacgaccaccagccggaacgccgcccggtggcgcccccgctccaccgcctcgcgcgtgatccccgtctcgcgccacggcgacaggtcggagtggatgaagcggaagtaatccgggcactgaggagggggttgtttattcttggacgatgatgacttggtggctgctggtggcgatgacgatgacggcgacggagaggggggtgatgttgcggtttgacgacggggacatgccgagccgttgccgccgcagctgaagggtatgggcacgaggtccgctgcgggtgaagggacgtggtgaggaggccattgatgctgcttcaagccgccgccgccgccgctgcctagcagaaacgacgatgcatagtcgaggtggatccagcgacgacgactggtgttgccgccgccgccgacgacgacgagcaagaccagcacgaggagaccggcgatgaccaggccaacacctctggtgggcaccagcttctgcgcccgccgccgcctccaccacgccggcacccgccgctccgctgatgacgatgcttccgccgtcttggtcgacgtcctaattgttcttgtgtgctgctcatcctgcagatcctcctcatcgtcaccgtcatcctcatccatcagctgctccggatcatgctcgccgccgtcctttctctgttgctggggccacggcgacggcaccaacgccgccctctcctcctgcaagctcttcatggatagacgatgatggatggatggagtggagtacgtggtggagaggagcgaggcccctggctattctaatagagagtcatccggccggcccgggggacccaaatg

SEQ ID NO: 22804 - DNA, 1685 bp, Zea mays
  misc_feature (459)..(459): n is a, c, g, or t
atatatatatatatatatatatatatatatatatatatatatatatatatatacacacaatttatatttaataataaaaacatctgagcatgatgttctaatgcttagatagcttcactcagtgtcttccgcccttcttccatcaatgtgtgggttcgaaccccacctcctcactacttttttaacattttacactgatttaaccaaatgacctgatacagtcagcaggccggcacgccatgcctaggccagagttgtggcccgtgggcgtcaggaccgtgccgaaccgctgtttagccatctatatatggagttgtgttttgtaacgtggaggttggttgcgcagagcagacagacgtgcagcgtattaatttgaaatagatgtgagggattatctgtaaaaatatgacgcagaacgaccgttgaaactgatgctttaatatagtatagatatatagnttaaaatgggtacgtaagaaattaagaatgttattgattaaattaaaatattttttaaaataccacaacagagccggctgatacgtgtggtgccatacccgcccacgcccgctcgggacgaagcgcttcacaaagccacaacggcctccccctctccgtttcttaagtgcccgtgcgttgctatgatttctatatagcaaagaatttaattacaactgtttatatggtcttaacctacatcatttaacaaccaatcatcacagccctgctttgaaacgtagagcacaactgaaccaaataagtatgacgaaaaattgtgttacatatatagatttctcattgttttgtttgcattcaacaataattctgaaaaacgaaatatatttctaaaatttgatagtatatcaatacgatattcatcaatatctaattctttagcaatagttgttgtcataaaacagatattattattgcagggttaccattaattcactaaatcacaattgctgctcagatctttggggccacctgctgcaacgtgacagaagtaaaaggttgccactacagtactacactgcagcacagttgagaatttgcctcaaacaaaacaaaaaaaatctttttttctcaaaccaaacaaaaatggccgcatttactgtacaagacataaaaaccttgagcattgaaaggtaaggaatttgaactttagtgttctggttaagctacaatatgttatgaacaaatactacagttgtactcaaatgagagatgtaaaaaaggtacaatatgtttaagtagatgaactataatatatgaccaactatggttatcaagagcatttctctaaaacattaaacaacctatcatatgtatcaatttcataaaagtatatcacacaagttttatgtggacaaggtatatacaagtacaaaacatcaactgaatatctagcaggaaagtttgtgggatacaatacagaaataaaaaggtatctacaagtcaagaatcaagtaaaaatagtttcttaaacatattatcagatgtaaaaagtaaaagtgggcaacaattctaataagtgcaccatgacaagaaatagacaaacaaaacattgctggatgaactgatcatttttaggtgatagtatggttttggaaggatcacaaatcaacaatataactaagaggcgatctatagaaaatcccagtaaagttaaaaaaaaaaaaaaa

SEQ ID NO: 22805 - DNA, 2495 bp, Zea mays
aattagtatttatagacaggtaatttccaattccagtaagtaagaattactgagtagtgagcacacagtgttgagtaagtttattgatttcctgtcaattcagatctttattgtttgcctcagaaagaaacatggaaagcaatgctcattctattcaaaatgcagagacaataattcagattacgtaaaagataagtaaatcattttcgcagaaaagagtacaaaacattctggacaacagatctagatgtcaacatcaaccatcatttttggaagtacaggttatggcaaaaaagaactcaccagcggctgcatacgctttttccaattgggtttctatagggatttggcgtttgcattgaaaaggcagtaaaccacaagatatatcgtgacaacaagtctagaagagaatccaaagttgatgcgataatagcaagtgaaccactccttactgaagcatacacttttgcagcaaagagaaccatatttgcaatattagacagccatatggctaatggttcactcctgacaactttttcgtgttcttcctgcaggtcaataaagtggccagatatctattgatgtcgtcactattaaaaagaagaaaaaatatagtgaagaaaatttgattattaacatccacataagttaccttccctaatgttcaaacagaaagtccatatatagcataccttggacattacaggtaggaaagcacgatctgtaaatgcgtccatctcactaaaaccctctaacatctccacctgttgtttgtagtactcagcggcaacattctcatgaccttgagctatcaatagaaccatgaatggtacattaagaaggaagatatgtgaaaaaagactcatccaaataagaaagtaaaaggactttaaatagtatgactactaacattatcttgaacatataactcatttgtttttataaagtcacacttccaaattcactaattaggtgcacgtgcgttgctacggtatcttatatcacataggtagacattgatatagagataattaaagagacatgacatataattcatagatagaaggttgtcgtctatccatatatatagagataattaaagagacatgcagatggagagcgtcgagccgcatctgtgggttgttggggcgtacacacttgacatcttataggtccgccccggatgatctgtgcgctgccaatggaaggttagcctccgtatgcgctgtaccataatttggggccgacagcctccaccgaaacagacaaagacagttcacagagaacaggcattagaacagacaacaggcatcagaacagacaacaggcaaggcattagacagagcaccaccagctgccattaccagcataattggcggcagaaaggggtgccattttcttctctggggacctcttcaagaatcgtcttgtgttcgtccaccaccagctgattcagtaaatagaagaactgtcaggtagatagagtacatgcttctacgtgaaataaaagatgtgatgccgtggttgtggttacctgcggttggcccgttccgtttgctgctaccatttcctgctgcggaggagcatctgcaaccaccgcagccgacctgtcactgtcagtcttcagattctgatgcttctcggcaagcaaaagggtgagggcaaggccgtgtagtaccttggatccgctcggttagggggggctcaatggccggatctggctaccatctctggggaggcccgctcgaagtcgagctcctgtcgccatcatggacggtctaggcctcgcctgcttagctctatctttgaagctagcgcgaacgagtcaagagacgacttttcggccggggtgataaaagctgcagttcttcttatcagcatcagcaagtagcagcaaaggataccagcccgacccggacaatgtatgcacggtggttgttgcctcgaaggcaggcatgcacagcacgacactgcgagtagcaagcagtatgaaagcattccatggacagactacagacaccgagggcagtggtgagcagcagctatagactcggcgtcgaaaagctgagctgagcaattccaaagctgccgagaactgaagaggaataagatgtgaagttggacccaaatctcctgacgcagccgcgtcgccgccagctccttgggggagggagcaatcttcaggtgggcgagcgcggtcctccggcctgcgcgagctcagggggccagggacgcacacgggggagggtggtgcggggacgcggtggtgtcgatgttggaaggcgacacatcggcgaggatgccctcctaggaaagggggaggaggtgacgacgacgatgtttgaaggcggcacatcggcgagcatcgcgcgaaggatgaggtgcgagggagttctgggtggcggggaggttgaggagggcggatttcacggagcgcggtgggggaggcgcgatttggggcgcatctgtgcacggagggatcgacggacgcgaag

SEQ ID NO: 22806 - DNA, 2036 bp, Zea mays
aggtgtgttctctctaatcatatgtacatcgatatagtagtataaaaagaattaaatatatttcttaatttttaaaccagaagtggttatgtcttatatattgggagagagggagtaagttatttgtcggatcctcgatagttcaaagagttgtatatacttttcaaaaacatataggtcctgtcatggcatatcatgtcatcaaaaatcgcccgacaataagggctactttgggaacctcaaatccctttcaagattgaagaggattgagatagaaatgaactaatttcctctccaatccccttcaattcagaagaagatttgagtttccaaactagccctaagggatactggagtagggtattcaatatccagtttataattaatagggttctctgtcgaacttcgatagtccaaacttcaaccacgttttcatatcgatttaggatctgccaccactcttgaccttcgtatcgattcaggatctaccagcactctagacctaaatgccaccgtactgagagcatctccaacaataaactctaaaatagagttctaaaattgaaatatggccatgtttaaagtggttaggaccttaaaaagaatttttactccaacagttagacgttaaataatgttattttaaaaataaattatgttataaaaaaatagttggagatgaggatagagctccagtatataagatatcgaagagaccaagctctaagtatttaatgaattcttataaaatagaactgttgtgggaagagtgttttatgattctgagttttatatttaaaataggttcacgtttgaagccctcttggaaggagatgctctgccatgccatataacaaatcttgctaaaaaaagaaagtaaaagcgccgaaactagataagcaactaccgaactacatggaacatgaacagttttttttttttggttccttgaactaccgtttttctagcaaggtgcagaacaaggttacaaacatatgattacaacatgaaggaaaaaatgtctaattcccctctccccaactatagcaaaaatctggatgacctaaattgtagtgccattcacggaacctctaattcacaaatatcacttcccagtgttgcctttgttggcaccacgtcagcggtcagcccatacccatccaccaaggcatcaagacaaaaaccgtagtaccttacaacgtggtggtgacctctaatttaccaacggggaagtggttccagcggctctggccgtgcttgtcagcgtcgagaggctgcaattgcatgcatggcctggcactggctggttttggagtatgggaattgcagatgtggtgtgggaagtccgtttgaggtggacggcagattgaacagagaccatgtcaaaggtagcagtagtcgtggtggttgcggtcttgatctgtctggttgctggtgggaacttcatgcagggacagtgcccgcctcgcatcaaggggagggggcacaggcatgaatgcatgatggcaccaacagcaacactgaagccacctccagcaccagggcctcatccttgatgcacgcgcactcttttgttaacgaggctgcagacaccgtcagtgatctggacacactttttgtcattgtgcgaccccttgttgagcccagctgctgtctcactcgtcacctccggctctcatcaccagagaccctgctccagttcctccaccactatcttgccacagattgagctcaagatggtatgatgtgtttcatttttgagaaatcaattttgtccttggtcacaactgacaagtgtgttcatgacagcaccccaatcatgaatggtcacctcttgtaaggcttcatgtggtagagtttgaactcatcgccaaattttgctgccccgcccggcctcccggctcccaagccttctccaggtccgcagcatatctgcttgtattagaccacgatacagtgtctcaaaggtgatcttttggggaagaaaactttctcgatctctaccatgaagaactgacagcttcccgccactactg

SEQ ID NO: 22807 - DNA, 7024 bp, Zea mays
cgatataaattgattattgattcgattgatgatgcttaatcggccgttttcctctgtatttatagagaaggggggctggacctgttacaaacagatttcccgagctaattccgcgaatttagctaacaaccataggtagaagctcggaaccctgattggttctacgcgcgcgcagaccgtctgcaccatcagcgcgaaccgtccggcggtctcattttagtgctcaacaagtatattgagacctcttggtgtaatcggtctcctacttctctctcctgaaatccaagggtctgtccatacctaaacattttgcacatcccctattctctgtatgagccccttcttcaatagatttatgtctcttaaaatactcctccatgtataatacataccttcgcttagttttacattaatacaagaagtctataacacccttggtgttataaaaactaaaactagacatgtcatcatatgaattataactattttgaatgtttaaccttagtatgcatcaactagggccatgttcatgcaaattgaatgtgcttttagtctagagtgtgtttaaagatcaatatcttgtttaagattcaactttgaatatcatcttccaaaatattgaaaatttggctatagaccttgaataagaaataaagatattttcaaatagaacaactttgttcttgggtgttacccaagtactgttatccaaatttgaaatttaacccacatttgaattgcttatctttgccccaagttcaaatttcaaaatctaaaaaaaattgggtatggtccaagaaacaaagttgaagatcttagagaaatgaacaaactttattttttgagattttcaagttgttatataaatttgaaagtaattttaaaaattctgaaagggggaggatttagctacagtaatttaatcgacttcagtttcagagttcagtgttattgctcgatctttggtgctatttatctctcgatccgttaagttttgatcaacaatccttatatcaaagttgtagagctatgattgataaacaacttatgttctcgggattgatgtgttgctacatggattcgggagaaaactcaagctcaagttgcggttttaggtgatgaacagtgctctctctatctatcagcttactctctgtctgctcaccggtcgccgccaacgccaccgtcatccaccgcgcgcgctcgcgcgcgaagcacgcaattgctttgtcttatacacgtccttggtggaggtggcaagctctggagtagctcgcgccacgtgaagatcaccagcgacgccatgacctccttatcggcgtttccatcactgtcgtcgtttcctcccttctccagccaaattggacgatcttggcatgtctctctttaaattgagcacaccactcgcttcacctctattttatgcaccacatagaccttttcttgcttctcctcctcaaccgtatccaccacacgccgatgtcttctccgcgggcggccaccggcgccgccgtaggtaggttcatcgtggacatgccaccatggtgctttgcttagtaattagtcactcgttctttgttacttatcttctctggttgctcaccaacctaccggtttgaactctattcttcagggctagccggaacaacgccctcgtcactggagaacgtcgctgcggcacggtttcccaatgaccaccgctctctggtcttcacccgttccaataatcacgtgcaccagctttggggtgagtcattgatcattttcctactctcaattccacctctactaccttgtctagctcggtacattagtcaccggaccaccgtgccgtcgtggtgagccgcatgctctctgtagaacatttccactgtttttcctggctccaatagatgcgcaatcgattagaacacggtttagagcaggtttagactattcccgttcccgagccttcaccaccgtatccgtaacctccgactcgccagagctcggacgagggcgaggaccagggtttgtaaattcaaaggaagataggggttatttgcaaattcgctgactcatgtgaatagctctttggaccggtttgctgttatttcaaaggctgagggattttatacaagatggccagcgcgccagcgctttcctggtcgggctgggtcggcctgtcagtttgagcccaagtataattaaaacaatgtccaattagtttctaatatgtgttatcttgtgaattatgctttggttagtagaagtatgcaaaaatgatgaaataaatttaactggttcaaagaaaatgagtaatccatgttaaaaatatttattctattttaacagatgcttttctatatagcttttatttaaagttaagctaataaagcataattgaatttttgtgatacaactgtagctctaaaaattctgattttttgtacactactgttggtcaaattgagaatcagaagaaacaatgagaattttgttttagagggtctagtgtgaattaaatgttggcgatcaacagtgaggttttggtggcagcaacagtgatgacttcgttgtgacacgagtgacggtcatgatcttgagttgaacatgttttatttgagcaaagtattgtaaacgatgagattgttttttttcctttctaatcgttggaccctgaccctagagtagttggaccctgaccctagagtagggacaagggcacacactggcccgaagacttgggtctcgcttgccggggtcctaatatccgacgaggcggttcgggaccctttgtgaggacctaaacggtacacgtggggtcctgacccgtgagggtctagatccatgaatgtaggtcctaaacatatcatttttcaaggcacgtgtcagtatcggaccaaggcattcctcctgaaagaaatgaaaacaaattccacgtcaattccatccgccccctgacaatggcactagactcgtcacgtcacattaaccctttccgttccacgaccaaggcacagtaatcccaaccggacagcgacaacgagatggaacccgccgcggcaaccggagagtcccgtgatccacggctgtcgccgtccccggaggatctctctactgtagggccttcaccctccttttgggattactatagtaatcgagattacatgattattgattcttaaagtaaaagatgttgaatgaaaaatgtgtatgcctttgtcagaacaatgttctttttatatattttgcaacagttagcccattttgtgtgtcttgattcttgctagcattctctagtaatataggggcaatttcttgttttctgttgcaaaattttgaaatccattacataactgtttgaaatcccttacataattcttgctagcccaatttttttagtttgttttcactttgaaactaatgtgggagatgatattcgaagtctcagcttcgtaactgtaagtatatatctggctgccaaatttttttttttttttttttgacaaacttgactaattgaagaaattattgttgaagcaggcaccttacatacatttcatgccatacagaagtttcaatgtcttcttaatttctgaaagcaggaaacgaaagtataaggctattatacaacgatatatgagtgacagaaacaggtacaacaaagaggtacattagacattgttaacagctgtcttccaaggaactttacagcaaagaatccgtctttgcaggtagcctcctgaagaagtttgctggtgctgatggcaccttgtggcgaaaccgaggatgcctcatcgagaagaacccaaggcagagtgcgatcgcttggaatggtgtcacatatagtataatggcagtaatcaagcaaaatattaggaacatagctgttgcccttgggtccctccagctgagcaatgactgtagcctctctccctgagtggcaatgtccccaacaactgtctgtatcctcccagcaacatgccgtaacctgtcgtacctcatccgaatgagatctgggctcttggaggttgggaatgtgtcgaattcctcatcaagctcatctgggtttgcaacatcagcgtaagagatccttgtgttcatgtgtggtgggaagcgtggccggaaccggtagttccacagccctatcaagaacatgtagaggaagactgttggcaggataaggtctggatagaacacaagcatgacaaagagcacatggaccagcactgtggtgacagggttcttccactggcaaacatccccaaaccacttgcccgcagcgatgacccctgagaagacttgcatgagacggaagaagttagccttgctccgccgcatgctccacaggtgggagcgagcatctgacatgaactcgacgacctccttgcgaactggtggctccatgcgccccaggcgctgcgcgacaagctgcacagcctggtgtcgcagcatctcctgctgaactatcgacagaggctgcgcgtaatgcatcttgggcaagaggggcctagagtatgtgaagagcacattgataagggacgcggctgagaacctgatggcgagatggagctcgcccatcttcttgactcctgacgggccgaggacgagcaacggatacgagtgcgtgtacacacgccccgtctcaagcgtcgaaagccggatcctgactttcccgatgggtttatccatgtggcctgcagaggagccgttgtctccacttatgtgacagttgtcaaacagaccaatggtgagcacggttccgtgatcgaagacttcccacgtgtactgctcattgaaccgagggctcaggctgtcaactatcgtgcgcgtccggacccattttgaaccatacttggcaacacagtacgcatcacaggacccacggtcgtttctgggtttcgttgggttaaggccgttggcgcttaaaatgccaacctcaagcatgccgatgggtggcttccacagctgcttcatcgtcggacggagatcactgcagtactgtgtggactcgtcgagcacatggtagccgccttcgaggcagacacggaggcttaccttcgcatagaacttgtcttccttcttcttgagcagctggtccacatcgtcgatcagtcctggcctcctgagatcaacccactgcggcggcaccggcttgtggtcagcccgcctcggaagcctggcgagtggtatgacagcttcaccgatcacctcgtctttgttctgtgccacacagtcttgtaccgacacgaccaggtcgtcctcgaaaggctctgccgcgacgaacatgagctcctcgttccacatgaagtttcttgtcggcgagcgaacctgcctcgtcctgagcagctgatggcccagcctcaccttgaccagcacatcaggcacgcggttctccgccatcgggtatacgtcgtgcgcctctagcacgttgaccctcacgtaccacatcctcggcgcagggtagaccttcccgcggatgtggctgtggagatgggactccaccggcgttgaccccgcatggatggcgctcgggaagcactcgtctgcctgggtgccgtaccagaccgcgagcatcagctcccctctgtccctcatgccgtccttgcccacgagacggtaccactccggtgccagcggactgtccgggggcaccctcagggggacctcgctcaggtcaacgctcactcggccgacgtagtcgtcccggatgacgtccttgtccttgacgacgacctcgagcgtcgccgactgcatgacctccttggggaacgcgaagacctcgtcccactcgggcctctggttcttctcgaagtacttggttttcatcttgtagttcccatggcgcacctccacgtaaggatccaggcttccggtgatgtccatgttgggcaggtcgcgggccttgaccacgcgcacgaagaggtactgcatcttctccacaaggtcgtacgccccggccttctcgccggggtacacccggccgccgataacacggccaccacccagcgtcgggcttgtctccttcagcgggatccctctgggccgccccgctggacctggagcgtacatccttgatacctgaacctgaggcgctggggctgcggctttgttcgcgaccgcggagaagcttctctgctgctggtctccgtagtacgaacctccatcggcggcgtggtatgggtatggctgtgcaggacgctgctgttcccttggcaagtgctgcacctgtctcactgggtttgctctggtctcttggaaagggtttggaacggagctggctgctgctgctgcctgctgctcctgtgcagcagtggtaggcgtgcttagcatgtcgaactcctggtggtggtgacctcctggggtagcagcagacacgctcactgatggatcgtccgtgaggaagactcttagcccaagctcgccgcgcgcgcgcgacaagatcgtgcgcttctccagggggtagtgcagggcctcggcatcaggctggctgacgaaggacgtgcccgatatgcgaaccttgcccaggcaggacttggagttgtcggcacggttcgcgtggtacacgtaggcctcgaggtgcagctccgggaggcgggacgggtcagacacgttgaagtagagctgctcgttccagacagggttgaggtccctgtccctgatggccgtgcgggacttctggccgtcgaactcgacctccacgaaagggttcgccgtgccctgctctttcgggaggagatcgtgagcgctggtaacctcgacgcccacgcgtccgattgctcatcgtgtggcccgcagccggatctttcttggagcacggaaggcacgcaccggagtattattcttgaggaacgcagagggcagccgtcgtcgtcgtcgtcgatcttcttctcttgctccttggtgggttgtcgagcgaggaggacgaagacggagatggatcggagacgatgacgactgtctgtctggctctggtgataagataggagctgatgagagctccaatccaatcccaaggccgcttgctcgccagcaaactgac

SEQ ID NO: 22808 - DNA, 2828 bp, Zea mays
gagaccccctggccctattgggctgagatcagccactacttagcactatttccatactgctgtcatgctgttactgttacagtagatagaaaagacagcaaggttgaccttttgccaacttcctgctgtagcaaaacaagagaagaatgcagcagatgccccttccttttcgcccccttttttttttttttttttttttttttttttttgactaattggagaaattattattgaagcaggcatcttacatacatttcatgccatacagaagtttgaatgtcttattaacttctaaaagcaggaaataatgtaatgagattaacttattttgttcgctcacatgaagcacaatatgatctgacttaaggctattatacaacaatatatggggaacaaaaacaggtacaatagacattgttgatagctggtcttccaaggagctttacagcaaagaatctgtctttgcaggtagcctcctgaagaagtttgctggtgctgatggcaccttgtggcgaaaccgaggatgcctcatcccgaagaacccaaggcagagtgcaaccacttggaatggtgtcacatacagtataatcgcagtaatcaggcaaaatatcaggaacatagctgttgcccttgggtccctccagctgagcagtgactgtaatctttctccctgagtggcaatgtccccaacaacagtctgtatcctcccagcaacgtgtcgtaacctatcgtacctcatccggatgagatctgggctctttgaggttgggaatgtgtcaaattcctcatcaagctcatctggaagtgcaacatcagcgtaagatattcttgtgttcatgtgtggtgggaagcgtggccggaaccggtaattccacagccctatcaagaacatgtagaggaaaattgttggcaggataaggtctggatagagcacaagcatgataaagagcacatggaccagcactgtggtgaccgggtttttccactgacaaacatcagcaaaccatttccctgcagcaatgaaccctgagaagacttgcataaggcggaagaagttagctttgctccgtcgcatgctccacaggtgagagcgagcatctgacataaactcaacaacttccctgcggactggtggctccatgcgtcccaggcgctgcgcaacaagcagcacagcttggtggcggagcatttcctgctgaactattgacagaggctgtgcgtagtgcatcttgggcaagagaggcctagagtatgtgaagagcacattgataagggatgtgactgtgaaccggatggcaaggtggagctcacccatctttttaactcctgatgggctgaggaagagcaatggatatgagtgcgtgtacacacgcgccgtgtcaagtgtcgaaagccgaatcctcactttcccgatgggtttatccatgtggcctgaggaaccgtccttgttatcatctccacttatgtgacagttgtcaaatagaccaattgtgagcacagttccatgatcaaagacctcccatgtgtactgctcgttgaaccgagggctcaagctgtcgactatcgtgcgcgtccggacccatttggaaccatacttggcaacacagtacgcatcacacgacccacggctgtttctggtcttcgttggattgagaccgttcgcacttaagatgccgacttcaagcatgccgattggtggcttccacagctgcttcatcgtcggacggagatcgctgcagtactgtgtggactcatcaagcacatggtaaccaccttcaaggcagacacgaaggcttaccttcgcatagaatttgtcttccttcagctggttcacgtcgatgatccctggccttcttagatcgaaccatgctgggagtaccggtttgtgatcagcccgccttggaagcctcgcgagcggtatgatagcctcaccaatcacctcgtctttgtcttgtgccacacggtctactactgatatgagcaagtcgtcctcaaacggctctgctgccacgaacatcagctcctcgttccacatgaagtttctggtcggcgagcgaacctgccttgtcctcagcagttgatggcccagcctcacttttaccagcacatcaggtatgcggttctccattgggtatatgtcctgtccctcaatcacattgactctcacataccacattcttggcgcggggtacaccttcccgcggatgtagctgtgaagatgggaatcaaccggtgtcgatcctgcatggatggcgcttgggaagcattcatctgcctgagtaccgtaccagactgcaagcatcagctcccctctgtccctcacgccgtccttgcccatcagacggtaccactccggtgccagtgggctgtccggagggaccctgagagggacctcattcagatcaatgctcactcggccgacatacccggcccgaaggacatccttgtccttcacaacgacttgaagcatcgtcgactgcatgacttccttggggaacgcgaaaacctcgtcccactcaggcctctggttcttctcaaagtgctttgtcttcatcttgtagtttccaaggtgcacctccacgtaagggtcaaggcttccagtgatgtccatgttgggcagatcgcgtgccttgaccacgcgcacgaagaggtactgcatcttctcgacaaggtcgtacgccccagccttctggccagggtacacccggccgccaatgacacggccgccgccaagcgttgggcttgtttccttgagctggaagtctacaggctgctgtggacctggagcatacatccttgacacctgaacctgaggctgaggggctgca

SEQ ID NO: 22809 - DNA, 1594 bp, Zea mays
ccacgtacgcggccggagcgccctatacaagcgccacgtcgatcgccgactcgccgtcgccgcgtcccccacggctcttccttcatcctccggcgagctataaatccctcccgccgacgccacccccatggcatcccgcggttccccttcctcctactcctccccgaggaccccgacgtcgtcgaaggctaacccttggcccgcgccctccgccccgccgctgtacccgacgctctccatggccgacctcgcgcccgtcgagatagggcccgcctcgtcgccgacggcctcggatgactacaacgcgcctccgccgtctgaggacgtcctcctccgggtccccggcgcgcggctccacctcgtcgaccgcagccgcagccacccgctggccgccggcgacctctccctcctccgcatccgctccggcgacacctccctggccgccatcgcgctgctgggcccggtccagtggccgctcgcgcgcgacgtggccgccgtcaagctggatccctgccactacgccttctccctcaccgtgccggcctccgccgacgaccccagccccgacccgctccactacggcctcacgctctcccgccccgatgtgcgcctcgacggcgtcctcgctgcctacaccagcttctccgtgcacgccgtggtcggcgccgggcagctggaggccagggtgcgcgacgaggccgaggccgccgcgtactggacggccgtcgcgcccaacgtggaggcgtacggaggcgcggtggccaggaccatcgccacgggcgccgagcacctcgccaaggggatactgtggtgcggggaggtcacggtggagaggctccgttggggcaatgaggtcctcaagaggaggatgcagcctggcgacgccaacgccgaggtcagccccgagatgctcaggcgaatcaaaagggctaagagggtgagccaaatatctgagaaagtggcgactgggattttgtccggagtggtgaaggtcactggttacttcacaagctctctggccaactcgaaagctggcaagaagttcttcaacatgttgcctggagagatcgttcttgcttcgcttgacggatttgggaagatctgcgacgccgtggaggtggccggaaagaacgttttgtccacgtcgtcaactgtgacgaccgggctagtatctcacaggtacggagacaaagccgccgccgcaacgaacgaagggctggacgccgccgggcacgccatcgggacggcatgggccgtgttcaagatccggcaggccttgaaccccaagagcgtcctcaaacccacggcgctggccacgtccaccatcagggccaacgttgccgagcttcgcgcgatgcacggcagcagcaagtagctcgcgcctgccgtccctgtttcgtaaaaactctattatctcgctctgtcacgaccaacgatgcactcgctgcttccagcagcagcgttggctgttgcctgttggcctgtaaaaaaaaaaaaaaaactgggaaagccaggaactgaaaggcttaccgcttccgctttgttactttgttagtgatgctggtgatgttctaagagcttttaccactgctgt

SEQ ID NO: 22810 - DNA, 804 bp, Zea mays
ggccctaggggccttttttttttttttttttgcagatggggcaactacatttcgatttaagaacctgtagaccacattttgccataaaaaagttctcaggcactacaatgttcttacagttttctcatctcatgtattaaccgtacagaatcacccacaaatgtcagaagggggtgctcgagacatgcatctctgctaccatcaccttgacgtcgatgagcgagcggtgatggaaatgtgatacgttgagctcctttgcttacgataagaagaatacacatcgtcatactggctcacctcgttcggatcggcggatgctccgagacccaaccggccgctggaccctggcttactgtcgacgctgccatcggcgtgcatccctgtctcagggttcagaagcagattcggcgggggagggatgcaggcgcctcccttccgcgcaggaagctccctctcgtagtcgtcgtagtcatcgggctcgccttgcctcatcggaccttctgacgggttcacctccccaatgtcgctgaagaacttggacacgcgctcgaggatctcggactccgggactgacgatggcgggatggtcgtggggatgtcgagcgggctcagggaagagtacggtaccccgctgcctatttgcatcttccgaaccattccagggatgaggccaggcgggaagagcggataaggaggtggagttgaatcgtttgcggcggcagtgctttgaggagccacagcgggaactgttgacgacggttgcacctccaaagatcctgcaaatgcattttgcccacgcgtccg

SEQ ID NO: 22811 - DNA, 1162 bp, Zea mays
tttttttaacactagaaatagataccgacttatttaaacttttaccaccggtattcgaacgtgaatcattactattatcatttacgtcacatttcgtgaacgaaacggcacattagctcttctacagagtaagtgatactaccaacgggaacttttctgtagccacgcttttatttatcttgttttaacgtgtttaaataataaaacgaaggcaagaaaacaatagaacatgctgcagtgttgggctaaggcagctgcaaagcaaatgtgggatatcaagtgcctatgactgaaagtgctataatgctatatcgctttgcctgaaagagccatgacattgaagttgtttgactgcgaatacatggcgattcttgcttttataacttctgcagcatcctgcaacaaggtatcaggagtggaaggcccatggggtattggctgtgatgtccccccatcaagctcataaagctctccatcgacacaagagaaacaaatgtaatgttcaattacaccgtccttggcctctgtgtcaccagcagtagcggcaatggaatgagcattctccatttcctcgtcctcctcaagaaatgcagcacgctggataggatccatgtcagcagttcgtttataaaatctatcaaaatatgacccctcacctaacttgattctggaagtagcattccccagtgcatgaataataccaactgtgccacaggcattcccaacagtttgctttgtgaaatatacgttcttgctgggctccttggtctccaccgacgaggtagctgaagcttgggactccttgctccggtcctgggggtagagaagtaggaccgcgagcaccggctggggcaccatggcgagcaactcgtcatcgaggccgtacacgtcgcagaaccccacgtcctcggggacccccagtccccacatgaactggttcatgacgtcggggttggcctcgaggggaagccaccgcttcaccatggcgacaggcgcgcagcaggaaaggaaggcggaactatcggcgtctggtggagtaggcgatggcggcggcgattttgcgaggcgaatcgggcgttttttgttggtacgcttcagttgctagtttgttcccattttcaggctctcggttatagtgtatttaaaaaaactcgaaattttt

SEQ ID NO: 22812 - DNA, 995 bp, Zea mays
agctctcctcaagagaagtgatgctaccaacgggaacttttctgtagccacgcttttatttatcttgttttaacgtgtttaaataataaaacgaaggcaagaaaacaatagaacatactgcagtgttggactaaggctgctgcaaagcaaatgtgggatatcgagtgcctatgactgaaagtgctataatgctatatcgctttgcctgaaagagccatgacattgaagttgtttgactgtgaatacatggcgattcttgcttttataacttctgcagcatcctgcaacaaggtatcaggagtggaaggcccatggggtattggctgtgatgtccccccatcaagctcataaagctctccatcgacacaagagaaacaaatgtaatgttcaattacaccgtccttggcctctgtgtcaccagcagtagcggcaatggaatgagcattctccatttcctcgtcctcctcaagaaatgcagcacgctggataggatccatgtcagcagttcgtttataaaatctatcaaaatatgacccctcacctaacttgattctggaagtagcattccccagtgcatgaataataccaactgtgccacaggcattcccaacagtttgctttgtgaaatatacgttcttgctgggctccttggtctccaccgacgaggtagctgaagcttgggactccttgctccggtcctgggggtagagaagtaggaccgcgagcaccggctggggcaccatggcgagcaactcgtcatcgaggccgtacacgtcgcagaaccccacgtcctcggggacccccagtccccacatgaactggttcatgacgtcggggttggcctcgaggggaagccatcgcttcaccatggcgacaggcgcggcgcgcgccggaggaaaggaaggcggaacttctgtgagtaggtaggtgatggcggcggcgattttgcgaggcgaatcgggcgctttttgttagtacgcttcagttgctagttt

SEQ ID NO: 22813 - DNA, 901 bp, Zea mays
tttttggttccgggccccccctttttttttagcgcccggaactcggagatgatatttcgaaatgtcttagaaactcgtacacgaagcaacgattacactggaagcgcacagtgctagaccggcagggccctaggaatacatatttcattgctggcctgaaatcaacctttcatgctaaaacccctcggatgaagggctcaaccgggcagcgaacccgtgtcaggcgggtgcagccctgggggccaatcagaatatgccggagagcaagctcccggcgctggagagcgcggcgccggtgatggcgaagttgacgagcttgtcggagtggccgccggcgtcacccgtgagcgccaccgccgccccagcgatggcgcctgcgatggcgctgttcttccagtcgtggcatcccctggcctcccgcagcgcgtacgtgagccctgagtagactccggctgccaacccccactggaaggcctccttgccggccgtttttaccactgcgtcgagcgacctctggccgtcgtcacctctgatgctggagaaatggctccgcttgccgccgtcggcgtctagcccggacgagtctcctgaaagcccttcgacggtgacgacgtaggcctccctggagacggccctggccgccccgaccccagcggcgcggatgaagctgtcggcgacgcggttgagcagcgggtggccgaggtccacgaggcacttcctgtccatgctcgtcagctcgtccttgagcgtccgcgtgtccagcgtgctcatcttcttcgtcgcctgttcttgcccagcgcacccgctgtctcgccactcaccaacggctcaccgaccgtcgatgggaggtaagctatccggaaaccggaatgaagtgcccccgccgagcctcgaggtaccc

SEQ ID NO: 22814 - DNA, 898 bp, Zea mays
cccctcctcgagttttttttttttttttttttttttttcctcctttttttggtttttttatttcgaaatgtcttagaaactcgtacacgaagcaacgattacactggaagcgcacagtgctagaccggcagggccctaggaatacatatttcattgctggcctgaaatcaacctttcatgctaaaacccctcggatgaagggcctaaccgggcagcgaacccgtgtcaggcgggtgcagccctgggggccaatcagaatatgccggagagcaagctcccggcgctggagagcgcggcgccggtgatggcaaagttgacgagcttgtcggagtggccgccggcgtcacccgtgagcgctaccgccgccccagcgatggcgcctgcgatggcgctgttcttccagtcgtggcatcccctggcctcccgcagcgcgtacgtgagcccagagtagactccggctgccaacccccactggaaggcctccttgccggccgtttttaccactgcgtcgagcgacctctggccgtcgtcacctctgatgctggagaaatggctccgcttgccgccgtcggcgtccagcccggacgagtctcctgaaagcccttcgacggtgacgacgtaggcctccctggagacggccctggccgccccgaccccggcggcgcggatgaagctgtcggcgacgcggttgagcagcgggtggccaaggtccacgaggcacttcctgtccatgctcgtcagctcgtccttgagcgtccgcgtgtccagcgtgctcatcttcttcgtcgcctgttcttgccctgcaggctgcagcgcacgcactgcctcgccactcacgaacggctcaccgaccgtcgatgtgaggtaagctatccggaaaccgaatgaagtgcccggg

SEQ ID NO: 22815 - DNA, 2152 bp, Zea mays
ttattagaaatttcccgatccaattttttgaagagatcagaaacatggtgtgcttggatacaatttactccactctcactgatcgctcagatgaatgggctgccatgtccagatccccgctcgactatcccctccgagaaactctcacagcagtcaaaccatcttacgaagatactgccctgctcccagcccagggttgtgcttttcaatatttccatgcctcagccagaagactgtagcaactggggtttgtagagttcactgtgggatttgttctgcaagggagagcttctgtctcttggaggggaagtcagtggagaagttggttgcttgcttggataataataatgagaaagtagttgaagctgccctatcagcgttatccactttactggaggatggagtggacattgaccaaggtgtcatggtgctgtgtgatgccgaaggaatcaacccaatacttgacgtattgtgtgagaacagaaatgaggcactgcgccagagagcggtgtgggcagtggagagaatcctgaggatggatgaaatagcatatgaaatatcaggaaaccaaaatgttggtacagccttggttgaggccttcaggcatggtgactataggacaagacaagttgcagagcgagcattgaagcatgtagataagctgcccaatttctctgggatattttctaagatgggagcacaatgacgacgttacatggaagtagtctaattctattttgacacatggattgcagatccacatgaggcacagatgaacacatgtagattggttttgctgacccgcagatggtggtagcgatccgattgatcgaagaagaatcgaaacattgcacgtgttgtatagtgtatatttctacctgtaaacttgtatgtattttttagattggtcagattcatagaataggttgctatccctgttgtgtttagataaatataaataatgcataatccccagctctgggtggggaaaaagaaagaaatgtgaagtatttgcacgtatttaattgccatggtttcctgatcttcggacatccgacgataaaagggcatgctatggtattcatatttgtggccatgataccatctcactcacgtaagcctggtaattggttatgcgttttcgcaaatgtttttttataagaatcaggtgattccattaagaccgtgctccagctaaatcgctggcaaccagaaacagagtataatgattgataggtgaaaaaattcttcatgcaatgcttgtttcacctatacgacatcagtttcaagcatcaggcgcccaatggctagctctatcgctgcattgactcctttgaagcttgccgtatttctcttggcaatgatgagataacatgattaattttcccagctccagatttgattgcatcgcctttgtcatcccagatcacatgtccccagctcccagtcattttttcttttatcaaaggagtcacaacattcagcttcaggaatccttcctcaggtcttatcctggaacacctcagcctgcctttctgtcataatggccactgtttctgcacttctactctcaataaaaccatcaatttacttaaaaatagcacgacattcagttgtgttggctgtgttggagaaacaacattagactatattctttactagttaggtgcccgtgcgttgcaacggcatacaaaatattcaataaaatattagtgtccaacaattacataaaaacgagcaccacatatattattgacctcaatgtctcttaatttcattggcaacaaccaatatagaactaaactgatacaaatcagtttatactacaatacgaatattagaaaaaaaaacaaatttacgaagtaagtacaatgcctatgcatcacgataacataaatcatatagtaaggcgcttgtgctaagtatacgacaaatctaaaagatcaatatatcacaaatccattggcaacctacaataataacaaacacaaaggcagttaaaatgcacagttagaattcttcacatctattttggcaagtctccattacattcgtaacaacaaacaagttagaaatgattgtttgcccatttttcttaaaatagtcctaggtggaccattgaacgagcagttttccatctaagcccttgttt

SEQ ID NO: 22816 - DNA, 1550 bp, Zea mays
  misc_feature (1473)..(1474): n is a, c, g, or t
cattgggtacctcgaggccggccgggtttacttaagactgacatgcatatattgtcagtttaattcagtttgttgaagcaccgcaaagggaagtacgcatgaattccatcaagctcctgaataacatatctccctcgcggccgcaagaacttgctgatgcttttcgtggaaactttagtcaactccgcagcttggtcaaggtcattgttgataacaatggtatttctgaagagcaagcagctgctgctggccttgtagctgatcttcccatgcgggactctgtcctcaccagacgtcttcttcaagatggggcatttgcaacaatcattccaaaagttttaagaatccgacaaggcgagattcgtggggggcgttttgtgaacccattcctcgaaggtctagttagaatagtctcccggatcacatttgtcttggatgatgatccagatatcattgttgttgcttgtgattacaatcttacttcactcttcactgatctgcttcagatgaatgggcttgacattgtccagatcgtctctgctaatgcgctagagaaactctcacagcagtcaaaacatcttacgaagatactgcctgctcccagcccagggttgtgcttttcaatatttccatgcctcagccagaagactgtagcaactggggtttgtagagttcactgtgggatttgttctgcaagggagagcttctgtctcttggaggggaagtcagtggagaagttggttgcttgcttggataataataatgagaaagtagttgaagctgccctatcagcgttatccactttactggaggatggagtggacattgaccaaggtgtcatggtgctgtgtgatgccgaaggaatcaacccaatacttgacgtattgtgtgagaacagaaatgaggcactgcgccagagagcggtgtgggcagtggagagaatcctgaggatggatgaaatagcatatgaaatatcaggaaaccaaaatgttggtacagccttggttgaggccttcaggcatggtgactataggacaagacaagttgcagagcgagcattgaagcatgtagataagctgcccaatttctctgggatattttctaagatgggagcacaatgacgacgttacatggaagtagtctaattctattttgacacatggattgcagatccacatgaggcacagatgaacacatgtagattggttttgctgacccgcagatggtggtagcgatccgattgatcgaagaagaatcgaaacattgcacgtgttgtatagtgtatatttctacctgtaaacttgtatgtattttttagattggtcagattcatagaataggttgctatccctgttgtgtttagataaatataaataatgcataatccccagctctgggtggggaaaaagaaagaaatgtgaagtatttgcacgtatttaaatgccacggtttcctgatcttcggacctccgannaaaaagctatcgatcccgtcgactcaaggggggcccggtacccatcgcctttagggaagcgataacccggctccct

SEQ ID NO: 22817 - DNA, 2789 bp, Zea mays
tagaggatttccctggcatgcaattacctatggctgcataccttggagagcttgttctaagcaatgatgttaaggtacttgtggcacaaaaggctggctccacactagtcaatatcatgaaaaaagggaatagagaggccagagaagcagctttgaaggcattgaaccaaatttcatcttatgatgttagtgcaaagatattaattgaagccggtattcttccgcctctcatcacagacctctttactgttggcagttcgcagcttccaatgagattgaaggaggtctcagcgaccattcttgcaaatgttgtggcagcgggtgcacgttttgagtccattccacttgatcataataggcagaccttggtgtctgaagacattgtacacaatctgcttcatctcataagcaacactggacctgcaattgagtgtaagttgctccaggttttcgttggtctaactgactcttcgacatctgtacaaaatatagttgatgctatcaaaagttcaggtgctattgtcagtttaattcagtttgttgaagcacctcaaagggaagtacgcatgaattccatcaagctcttgaataacatatcaccttatatgggtcaagaacttgctgatgcttttcgtggaaacttcagtcaactaagcagcttggtcaaggtaattgttgataacaatggtatttctgaagagcaagcagctgctgctggccttgtagctgatcttcccatgcgggactcagtcctcaccagacgtcttcttcaagatggggcattcgcagcagtcatttcaaaagttttaagaatccgacaaggggagattcgtggggggcgttttgttaacccattcctcgaaggtctggttagaatagtctcccggatcacatttgtcttggatgatgatccggatatcattgctgttgctcgtgattacaatcttgcttcactcttcactgatctgcttcagatgaatgggcttgacgtagtccagattgtctctgctgtttcactagagaaactctcgcagcagtcaaaacatcttacgaagatactgcctgctcccagcccagggctgtgcttttcaatatttccatgcctcagccagaagactgtagcaactggggtctgtagagttcactgtgggatttgttccgcaagggagagcttctgtctcttggaggggaaggcagtggagaagttagttgcctgcttggataataataacgagaaagtagtcgaagctgctctagcagcgctgtccactttactggaggatggagtggacattgaacaaggtgtcatggtgctgtgtgatgcagaaggaatcaacccgatactcgcggtattgtgcgagaacagaaacgaggcactgcgccagagagcggtgtgggcagtggagagaatcctgaggacggacgaaatagcgtatgagatatctggaaaccagaatgttggtacagccttggtggaggcattcaggcatggcgactctaggacaagacaggttgcagagcgagcattgaagcatgtagataagttgcccaatttctctgggatattttctaagatgggagcacaatgaccacgttccatggaagtactcgtgttctatttgacatgaggcaggcgcagatgaacacttgtgttcccagcaggccttcactggttttgctgactcgcactccagctagatgttgtagcgatctgattggtggaagaagaattaagtattgcacgtgttgtatagtgtgtatttgtacctgtagacttgtctgtactttcgagattggtcagattcatagaataggttgctatccctgttgtgtggagacaatacataatgcataaccgccagcactgggtggaaaaaaagggaagaaatgtgaagtcgttgcgtcagatatgacatggttttctggtgtatgtcttaatgtctacagaggcaaagtgcaaaggactgtttggttcgctgtctaacttgccacattttagctaacttttctgtctaaagttagttcttttattcaaacgactaatctatgaactaaacataccctaaatatttttgttgtcaatttaaatgaggtaaaatattttaatagcaattaatttatttgagaaaaccaaaaaaatattttgcccaaataattacgacatgcttgatagatcaaataacaaagtccattgtccaaattcaaataaatgtccaagataaacatacaataacattgaatgcaaaattggtcatctcgaatagcttcattggatccatcctctccatccatcggaccatcacctcgtcggcctgctggtggaggccatagcagtggcagcactagagttcgtggggagtacgagtagcgagagagagagcgtcgtgagaaacaagaaacattggggcagaggcatgcgtacttcaccttttcttagagtggagttttaagagatagaggtgtttggcaagataaagctataacgaatctgttggcaccaaattctaaccggattggtgcgacattttctggccgatacttaatagtagaggtattcggtctaggcagaagataggtcttatcagagttattaaaacctgacaccttttgagcgctcctccgcgtttggcgtatgttccgcccacggcgtgccaacgcgtggcagcgcaactgtgtcggacacgggtttttttcttcaattcaacagaagagcgtcgcgtctgtgaggcagctgcagtccagccacgccacccgtgacgccgctaccggctccgagcgccgtagatccc

SEQ ID NO: 22818 - DNA, 1500 bp, Zea mays
agctctcttctcctagtagtataataatagatgaagaagtgattatctcatgaccctcacctgaatcagttgatattttaagcatttggccggctaaaagggattaccttcggagaaattgaagctggaggtctcccggaggccccctcaacacgccatgcatgcctagtaacactttttttttttttttttgctatcagatcaggaaaaaaaactatacattctgccatgcatagtttacatacggccaaaatatgcatcttgccctatcaagttagaccctactccgagcgcaaacgaatcataagacgacttgagcttcaaacacgaatcacaaagggtagtgaccagcaacccatcgtgccacccattgcttgaaagtttcctcctgccgtcccttcaacatgctggcaatgtgacgattctgagcaagataggtcagcagatcaaggcgtgccggcaaaggatactcatccatgtcttcaatggctttgtaaataccctcgtatgggtccgtgccaccgtgggtaaagctcacagcttccgacagggcctgcatgaagatggggacgccttgcctagcccatttccattccttctccttctccttctccttctcctcgtgcctgcgcttcgagcctactgggttcggactatcagactctgcgagggtgtcgaaatcgtgttgagaagagtcaccattcagatctgctggctcttgatctaggttgacattcccaacggcatcatcctcttgccttcctgagcgatcaaacggtgcttcaataacactgaactctccagtagcgtgtttccccgtgaagacaaactccatctcatcatacaaggggatcggaacattgtagtacttagccttcttgtcgcctttagctttcatcttgacaacctcgatctcgtcgtaggttatcttcttctgaacatcatcaaaaccagcacccctagcagacttcgcctccatgatcaccttccattctcctttcagcttgtggtacttgttgtaggtttgtttccacgtgaagttagcaccatacttctcattaagcctccgagcacactcttcgtgatggacctcccttagaacaaaggccctccccgactcatggattttctccttgtagtaaagaaggattttctccttgtggtagagaaggagatcctccacttccaggtgttgccacatcacactgttcccaaccatatctctcgcgcagaaggcagtaacagggtgcgatgcagggaggcggcgacgggccccaaagcttcgatgaggaggagggaaggcaccagtggcaccggatctgattctgcggccgggtcgggcgcgaccggaagaagcaggaagcagtcctcgcacggcgccgtgtgctcggattaccactcaggagaacagatgtggcaagcgaaggggaaggggtaacaatagcaatgcaagaggagggaggaagaagaagacaaacaagagttcaatcttcatattat

SEQ ID NO: 22819 - DNA, 1474 bp, Zea mays
ttttttttttttttttgaagaaagcccctaaactttctatctataatagagaagcatgtaggtactttcagttttcaggcaactactccaaaaccagagaaacattaaaaactctaggcaataaaaaccattgatttaggtgatcattgtaactaaagtgaaactgatagtagtaccagcaaacgtacacatgagccaaaaaccagaaataataccaagctgtgtgacggcctgatgggatgatgacaagtatgatgcttccgctgcgctgcacgacatgcgtgagcgccgagaagatgggcatcttgtggctgccctcaccgtgaccatcaccttctctgccaccacagtcacggcggtggggcccttgtcaaccacagacttccccttcctctgcagctagtggtgggaagagctcactactttcttcaagacaaccagcaatgcctacaaatccagaagcccagttgttgaagcaaataactgaacaaccaaagatccaagaccgatgaagcaacaagcaaaagcaactacaacaaactggaagtgatgctcgcctagtacaaacaacaatacaatacaacacaacaaccacgtcgggggctttaatgccaacggggagtggagtgctttcatgttacttgtaggaccagcataagatcccggatccagaaacaaaataagaggttggtaagtaagacctagaccttgatcaactcctcattaaacagatggatcatttgctacttatggatagttatagtaatggtttggacgttgtagagcattgtagtcgtgttgaaccgataccagatcaagagtgttccccgtcctagaccaagctcaattagattcagctttgttggctttcccatttgctcctagaggcacattgcccatacacctatcatttgtgccaaagaaatgcaatagcagcaccatcagttcatgaatctcattaatgtcttgttggtttggaaaaagagagagcacatcttatggatccaatgctatacttgaaacataaagttcattattggatcgtgattaaagcacagtgcaatgttcttcaaaatagtgttgacaacataattgatcagtgagaaccagttttacctctccaaacatttggctcacctctagcgaggtgatgaaatcccctgattcctaaacatgtgttacctgtccaccagctacggtcatgaggacatggtattgccaattattattttaaacaacagaaagcactgcataaataagaactgcaaaagaagttggtcttgcacaccgttgaaccaaagaataagcaatacataaccatagttcgttctgttactaatgccactagccaataatatttctctctgagtttaaagactacacaaataggctatgataaagaagaatttcatgaacttaggacttgtttctcttaagaaactcgaaacaataacataaagcataccaaaacaaa

SEQ ID NO: 22820 - DNA, 1509 bp, Zea mays
  misc_feature (1508)..(1508): n is a, c, g, or t
acgccgccacgcaacgccgccggccacacgcacactgccacacggagctagctagctgatcgatcctcctctcggccgcccgcccgttaattaggtagccgacagtatctatccagctaggtagccagccagcgaggagccgccgttgcttcctagctgcacctccgcccggccggccgaagaagacgccgacgatgaaggtgtcggtgctggcgctgtggtcggcggcggcggcgctgttgctggtggcgcaggcgccgtcggcggcggaggcctcccaccacggcggcgcgggcctcaagctggggtactacaagaagacctgcccgggcgtcgagaacgtggtcaagtaccacgtcgccaaggccatcaaggccaaccgcggcgccggcgccgcgctcgtccgcctcatcttccacgactgcttcgtcagggggtgcgacgcgtcggtgctgctggacccgacgccggcgaacccggagacggagaagacggcgccgatcaacatcgggctggcggcgttcgaggtgatcgacgagatcaaggcggcgctggaggagcggtgcccggggacggtgtcgtgcgcggacatcgtggtgtacgcggcccgggacgcgtcgagcctgctgagcaacgggcacgtccacttcgcggcgcccgcggggcggctggacggcgtggtgtcccgcgccgccgacgcgcagcgcgacctgccggactccaccttcaccgtgtccgagctgatccgcaacttccggcgcaagaacttcacggtggaggagctggtgatcctgtcgggcgcgcacgccgtcggcgtcggccactgctcctcgttccgcgcgcgcctgtcggcgccgccggcgcagatcgtgccggcgtaccggaacctgctgtcgggcaagtgcgcggcggcggcgggcggcgccgacgaccccgtggtggccaacaacgtgcgcgacgaggacccgcgcgccgtcgcggcggccttcccgtccttcctcgggaagctgcgcaaggccagggactttctggacaacagctactaccacaacaacctggcaaggatcgtcaccttcaactccgactggcaactgctcacggagaaggaggcgctggggcacgtcaaggagtacgccgagaacggcaccctctgggacgaggacttctccgacgcgctcctcaagctcagccggctgcccatgccgccgcacagcaagggcgagatcaggaagacgtgccgctgggtcaaccaccactgatcctgctcaagctctgcacccggccggacggaaatataccagatgggtcttcacgccgatttgtttcgatcttctttcattttgttgctgtatgtttgtttgattattatctgatgatatgcatgtgtttttttatgcggttgatctcttgttgtatcttgttctttcatgtatgtatggactatgggcaacagtaataaaacaaattaaacgttggagcagtgtagactgcccccgcctgtgccccana

SEQ ID NO: 22821 - DNA, 1349 bp, Zea mays
  misc_feature (80)..(87): n is a, c, g, or t
  misc_feature (278)..(300): n is a, c, g, or t
  misc_feature (357)..(383): n is a, c, g, or t
  misc_feature (394)..(398): n is a, c, g, or t
attgcagcgcttcgtagtttcaattacagccaacagtactcgaaattgctgcaggggccttctctacagtatttcatttnnnnnnnngcagaactcgaaattatcagtctgtacagcaggccacacagcaggccagcctgaactttgcatctgcaaaattccattagattgtgaccccactaaacattacagatggaagaacatctggcactagtaggtgtgaaacagcttgaatcgtgctcagagcttagcagtgcaagggaaacaatcctgaaaannnnnnnnnnnnnnnnnnnnnnncatttgaaactccactcctcaatagttacgggttcttcagtcctgaacagttactannnnnnnnnnnnnnnnnnnnnnnnnnntctgggtcttnnnnncaaaccagcccttcccttagcatcggagtttgttgctttccctgattcagccataatttcatcatcagggatcctttggccagtatgctcatgatcatctagctcaacttcaaaatcatccaaaagttcagcttcaacagtattgccaccgttattgactagctcaatttcaaaatcatccaaaagttcatcttcaacagtattgtcactgttattgactggatcagacccatgatttacagaagcatccatgatattagaaacaacagtttcatcttggaggttaatatttctcaaagactcttgggcttctacattcgctgagaaatttgatgtcactaatctcttctttttcacgcttctaatgattgatccaatggtctcatcatcaggataaatgtcttgcaatgctttctcatgttgggatataatcggtgaacagtccttggctttggtgttgtctgaagattcttgatggtttcgtacattcccttcaaaatctgacgtggataacctcttcttttttctacttctaatcatggatcctatggtcgcatcatcagagtctgggtcatgctgagcttcttgatgctgtgatccactcagtgaactatccaccaatggaactttcttactttttgatctgcttttaagtacttgtaatgtgtcttcatcagatgattttctctgacttgtgtcatcatggtcatcacttgccgtgtgtaattttttccttctgggcctggagcttttagccttggagccatggttctgttcgcctagcatggggttcagatcatcaagcgagttgtcttgttgttctatagtccgatctccagttgaaagagattcacctgcaaccttttttctccttgtgacattcctgagacctaactgtgtaagcttacgagaaacttgagcagaagatcggacgcgtgggcggacgcgtgg

SEQ ID NO: 22822 - DNA, 1579 bp, Zea mays
aaatattttttaagattttcatagagcttcttatatggatatatttatatgaaattttgcccagctgagttttgtatattacaacatttacgtttactaaattatacccgtgcgttcaatcaggatttccatttttgctcatgtataagatgacgcatgtcatttgtgatttagacagatgataatggatcatgatccaaatcttaaataattttagttcaaaaatgaatataaattaatttgatctagtgtaatatttagagttcatatattataagatatataaaattatttacagagtgtaaaacatattgtatcccacctacgtggtgtaggtctagcttatcgaaatctagaaaaaaaaaccaatttttactttgttaaatatttaggaccctttggaatgcaacaatttgagaaataatgcaagaattttacagaaatcaatgtatttttgtagaaagtatttttgtaatcccaagataatattatagcatattttagccaacatatctttacgggcatatttaatcatggtttccgaaccacagtatttggggtctaaaaaactcggatcattgcaatctcgctctttatccttccctcgtgcgctgcaactaaagtacttgtccccaaatagatgagaatctgtaaagacatgtacaactgggtacgcccgtgtctaaagagcactttaggtgaaagtgaaaacagtataactgagcgcattcgctagagttgcagtgttcgtagtttcaattacagccaacagtactcgaaattgctgcaggggccttctctacagtatttcatttaaaaaaaagcagtactcgaaattatcagtctgtacagcaggccacacagcagggcagcctgaactttgcatctgcaaaattccattagattgtgaccccactaaacattacagatggaagaacatctggcactagtaggtgtgaaacagcttgaatcgtgctcagagcttagcagtgcaagggaaacaatcctgaaaagttctttttttaatcccatttcccatttgaaactccactcctcaatagttacgggttcttcagtcctgaacagttactaatcatcatcctcatcgtcaataaccattctgtgtcttcttttcaaaccagcccttcccttagcatcggagtttgttgctttccctgattcagtcataatttcatcatcagtgatcctttggtcagtatgctcatgatcatctagctcaacttcaaaatcatccaaaagttcagcttcaacagtattgccaccgttattgactagctcaatttcaaaatcatccaaaagttcatcttcaacagtattgccactgttattgactggatcagacccatgatttacagaaccatccctgcaaagtgagaaattttctttcgtaactgattaatgcatattgtagtacgcttctcttattaagatgggatgacctagctacttattttcaataagcataaatgcattacatgatatgacaagtcaaacacaatcctagaatgctaagccatattgaaaaggtggaactaaaaaaataaaaggtttcctgcag

SEQ ID NO: 22823 - DNA, 4314 bp, Zea mays
tgcacgtcctgccgaccctgaccacgtaagtgtgctgcggcttgacgaggaaggggggcagccgcagcagcgcctcgcagacgcagtccttctgcacctccttgagccatcggcagcagtcacggtacgcgcggagctcttcatcgtggtggtcatggtcgtcgtcgtcgtcattatcatcgtcgttattgtcgtcgtcgtcgtcgtcgtggtcatcgtcgtggtccgggtcgtcagtgtcatggtggtcgttgtcgtcgtcgtcatggtcatcgttgttgtcgtcatgatcgtcgtcgtgatcaggatcgtcggcgttgtggttgtcgccgtcgtcccgcagacgcccatggcggccacgcccacggcctcgaccgcgcccgcccgcgggtgcggttgctttggtgctggtggtgaccaacggtgcggttcccagagacgaccccgtggctgccgttattcctcgccatcagtgccgagaagctcatggccgccgcgtggtggctgcgacggtcgcggtcatgatgctcgtcgtcgccgtcgtcgtcatcgtcatcatcctcgtcgtcgtggtggtgctcgtcgggtggactcggcggcaggatggagcaggcctggctggcgatggcgaactggctaatgcagaacgccttggcgccctttggcgtctgcgcgacgacggcgaggagggacgggaggaggagcaggacggcggcgaccaccgcgacgtgaggcgccggggccgccatcgtctcgtggcctagctgctagcgtgctccgccgttgtgaagcctcccttcctagatcgctggcggcgtgcgacttgtttatataaagacgtggattgtttattttcaagtagttgggtcagccgctgcacggtctggattaggtgcttcctccgtaaccagacgagtaggagtgagcggagcatcggtgaattaggtgcttcataccagcggcatgcatggccaccctgtttacgtactggttgctgctggtgagaggtcagtggctctttggtcgtgcatgcaactcacttgtttttttttcttagtgctgttcgaccaacacaagtcataaactaaatggaactatacttgtgattgcagatacattatcagataagatttgtatttttttattctagagaaacagaaatgatcaaccacaagtcatcattagaagatgtttagtttctagagactaatttctaggttaactaaaatttccatattaaataaaataaaattgagcgaacctagaaaccaaacaccccttagttcgaccatgctcttatatataagcaggtgcaacgggcaaaatgatttatatttctcttttttaggcatatatgtacgctgtgctcaaacagtttcggcaagacatcagagcagctggctgtcgtctgatgaggccaggaggaattcagcaatggaatcgagggctgttgcactaacaaacagtacaatctaagactacgatccggttgatagaagacaccctacacccctacaactcagctctgcgtgtggtcgcgcagtctaaacccctactagggtacaaacagcagttcaggcagcccgaccgccgtagaatccatgagatacatctgtacaaggaggcaggtaccagctcccactttcctggagtgctccacctccgtgggtgccttcaacctgaagcagagacaccagacagactctcccacaggttaagcccccacagaccaaggaaagcatcagagcacctgaaacaaacggggtggtcagatgaaacagaaaaagacaacacctttgtaataaacctcaacaaaaaaaacactgccaatgtaacaaacggcctaccgcttcgataccgaaaaaggttatctaggtctccatccaccatgacctgcagtgtgaaaggtagatttgagtatccacaatttttactcgccaagcaagagagtctgagaaacttcctttcataaaatacccagtggccgttatattaacatctaacgccaagcaaatggaataaatacatctttgtaattaacaagtagtaacagggattacagtgaatggactgctgacaaaaggctacttttccaaagtaaacataaaatggagaacaggattccaatcctagtcaacaaaactacggcactctttttccacgtcgttcccgcctgactataagctgaagctcatgaattaagcctcagaatcctctagatttgtaacaaaactatacttcatcccaaaacataaggattttttttatttgtaatcaatcaaactatcttaagttcgaccgagcttatagagaagagtattaacatctacaagatcaaagtaagctgtgaaatatataacataatggttaatggatctagtaatgctgaattgatatcataaatattactgtttttttatagacttgtatagtttgacttgggacaaaccaaaagtcctcaatattttggaaaatagcaattccttacaagaccttcccaaaaactaacaagtcctcaaaaaaatgaaagcaacttccattaaaaagcatatatatcgacataacatgttacatacccccagctgtatgtgaaactggaggctccacagaatgtctcgagggagaatagttatcagatatcctaggcggcctagaccagcctgcacaaggccttggcggaggatctgatggtcgcccatagtgcattggggctggtggagcttcaaaatggtcaggaatccgaggaggacctgcacatggctcaacaacaaaaacaaagaaactcagtgctggatgttgatgattatataacaagcaatagctcaggcactagcatatcctattgttgttaaggtatcttacagcatgataaccatggtaagtaagaaaaggttcatgaccatggcaagaaatgtacctggaggaaaagaatatcttccctggtcagcggcatcattgtgcattggccccctaatagctctctcatcaaagtgatgtcctctatcgtcaaaatgatgtcttctatcatcaaagtaatggcctctatcatcatagtgatatcctctatcatcgtagtggtatcctctatcatcataatggtgttgtctgtcatgtccatgatgccttctatcatgtctgtgattacctcgatcatgtccattgtaccgatatctctcgggatacggtggacagttattaccccagtgatgtggcctatgttggtgttctggtggcacagaagggaattgatttggaggcggtggagggggtggtggttgctgatgatatccctcgttaggcatggatgtggttggaggccgatgatagttgttcccatggtaaggtgctgggggagcagggaaactgccatggggaccaggaggattgagtggtgccattggtgggggaggtggtatctgattttgttgccctccatatcctgaactgttaaacggtgggggtggcaatggtgcaacagaagaattcatgttacctgggtgctctgcaatagaatgctgttgttgactttgaacactatatgtagctctttgaggatgtggcgccatgggatcagatgccatttgtaatttaggctgcatctgtgcactctgaggaacggggacaggtggaggagatgatggcaatggcggaggagatggaggccggtccacaggaagtggagggccagcatctgaagggcgttggtcagatggtgcacgattggtgtcactttgctctggttggcacttggtggttgccccaatatcagatggtggagctacatcctccatctcaagctcaccatcaacctcttccagaatatggtgatgcttctcaacaggcatttgagattcttcattgtcatcattatatggggcatcctgttcaggtgtaacagcttcaaagctcaagctcctgccttcagaagagttttcttcctctttcttcaaggacttttgtgccaatttagttgggtagccggacgccagcattactcccatactcatcaacaagcattccttcattgtcacgcaaagggtcatttagagctctctctgttcttgaaggacggcgagaacttccaaatgatgcctcgttgatagtctcaatttctctaatatggtgacggatgatatattctgaaagtgttttcctttcaagccaaagtttcaaaaccttgagacattgctttcgattctcccaagctgagtttccaggaggtgcagcagcatagagtattcgaggtagaactgcctgaatgagagagggatatacatctccagctccgcctttctgattgcgggagcattggtt

SEQ ID NO: 22824 - DNA, 1236 bp, Zea mays
ttttttttttttttttttttttttttttttttgccaaaatgtcaactttgtattggggccaacgggcatatgtatagtttatgaacagtacatatttcctgctgccaagcaatatgctgaaacattaaggtaaatggtatgatcattcaggagaatgctgacacctaaagtcacgtgtgcaagttcatgcgacatggagtatttgttctaacttcactctaagtcagaagcttccattctaaaaactcacgaaccctcaactacaaggccaaataaccagcactaaaacaaaaggaaataataaggctcctgaggcagcaactgtgctcgaatccggcagtgtccgttgaaaagttgcgcaagaacttcaattagcccatcttcctttttctattgtccatagcatttctcatgtcattcttcggcatattagtgcctggagttcctacaaactgcataggagacattgcagatgcaccacctgctaccacaggtggcatagacgatgttggtgcaggaacaggtggagctacaggtgtcggcacggacgcttgtaggggcaatgtagcaggtgcctgtgaaggtgcaggttcaggaggagggcgcggtatgatgtgcttcagtctgttattcctgtagtttttccagaagaaatattgctgcctatgagcaagctccttgtttgttggatgtgccattgcatttcggaaattggcattttggagaagctcaagaaagaaaaggcagtgtggatacattatgtatttgatatactctggtcgctgccagtattttagatacttgaggtacccgataaatgcctcatcctcgaaatatctattctgcgctagatagtggatgtaggtagggttggcgaggcactgcacgaactccaactcgagtaggaatcgctgactcccattgtcagggtccttgtacggcggcggcttcccacccacgccagggttctcgacgtcggacatcggggttcaatcggttgaaaccaggggcagatttggcgggcgctcttcgccggcaaacagatcggagaaggtctcggcagtcggcacctggcgtacggcggcggcggtagccgaccccgagagagaatgaccggatcttggaaagagggagtatcgacctggactgacgcactgtcagcggtgcgagccaggcggcgaacggacgagaggaggtgccgtgtgcggtttccctgcgtgggctcttattaatcct

SEQ ID NO: 22825 - DNA, 625 bp, Zea mays
cttttttttttttttttttttttttttttaatcgaatgccacaaaatttttgattttcagaaaagttggattatttctcttaagaacggagacatgaatcaacgtacagaactggactcagagccccgcaaaagaattttggctggtgtcagcgaaagacaaccaaccacttgacaacacaactgagattcttattcgtcggcatcctcgtcgtggaagcgcaggggcctcccctccggcaccagcaggcccctgagcatcaatgcgcgaagctccgccgtcgcctcagctgcatccgcctcctccacccgctcgatctcgtcgtcactgttgtagatgaacctggtgggcttcccctcgaactgcggcagcacgggcttcttcttctcctcctcctccaacacgggcatcctgctcatctcctcgcacagatcatcgtagcagtcgtcatcgctgtcttcggcccagtcctcctcctcctcctcttcgtcagggtactctgctgccagctcctccacgcccaggtgttcttcgtcgcccttctcagaggtggcatggacctgaatggaccaggcagaggagctgctcctcaggtgatgatgactgtccagtagctgccggtgct

SEQ ID NO: 22826 - DNA, 1344 bp, Zea mays
cggattggttactttatggcaagtggagactagaggaccttctctctcatttcgtggcaaaacggatttcttttccccaaagcatagatggcctgaagatatagcttggcatccagatggtgagacaatttttgctgtatacactgctgataatggtgattctcaggtttcaatgacaaaccttatatcaggacaaaggaaagttactttcctacccgagaagcctcacacaaaaggcatcataaacgacataagtttcatgccctggtctgatgtatgctttgtaactggaggaagcgaccatggcgttatactttgggaagacaaagatgatttatggaaacccaagagagtgcataaggatttccattcatccgctgtcatgggtgttgctggaatgcaacagaaaaaaacaatattatcagtaggctgtgacaagaggataataggatttgatctctctgctggaaggacagagttcaagaacctaattgatagcaaatgcatgagtgtgttagcaaacccatgcgattgcaacttatacatggtgcagacaggggctccaggtagacagctgcgcttgtttgatgtcaggcttaggcaatctgaggttcatgcatttggttggaaacaagagagcagtgagtctcagtcggctctaattaaccagtcatggtctccagatggatggtacatgtcgtctggttcagcagatcctgtgatccacatcttcgacatcaggcatcatggccagaatccttgccagtctgttcaggcacaccagaagcgggtgttcaaagctgtttggcaccgaacgttgccatatctgacctccatatcatcggacctcaacattgggatccacaaatattcatgaaacgttttgggctgattttggcgcttggcaattttttttgttgtggattaggaaccatgaagacctgtgaaattttcaggactttgcatcaatcgaagatacagcaaattcagcatgctttcgctggacctgcttcgccattgactttctctgtgggagaaccatgcagctcagcagctgaagagccccacggttggatgtttgcgcgagctgacccaaacttttccaccttttgagctgctgctggacagctggagtggtatggtaggtcattcatccgaacactgtttggctcgatgtgttgccctggttatttctgggaaggaaacagtcaactatacacattatatccaacatattcagcaatgtattccccctgtctttttgcagtgaatttgcccttgttggttggttggttgacaaggcattcagaattttttatcagcatgattttagagcagctagta

SEQ ID NO: 22827 - DNA, 1912 bp, Zea mays
cattgggtacctcgaggccggcccggcaatcccttgtcctgtcctcgaaccgtccgccgccgcgttcaacatgggcgacccgccgacgctcaagaggcccaagctcgagaaggccgacgacgactccacctactgcccccgcccggcctccaatggcgccgcgcccgtacgcacaccaggcgccaccgccgccacaggtgcggcgccgggtgacgacgtggaggaggatgacatcgcggaggaggcggtcatcgccctgatcgcgcaccgcgagcgcgacgtcgagcgctgcaagctcaagttgctccactaccagtctctcctggacaccgcggagatgaagctggaggaggcgcactcgaggctcgccaggttccgagatcgcaagccgccgccaactcggtcggaacccaagccaccgacgccgccaatccagagggaacacaagccatccccgccgccgatccagagggatctcaagccatcgccgcagccgctaatccagaaggctccttcgcccgcgccgcagccgtcggcgaggccgcagcttgtcatccctgggaccagcaaccgaccgaccccgcgccctgagcccatgcctgggttgaagagggccgccgccccgtcatcatcttcatcaccggcgccaccagagcggtcaaggaaagaggagaagaagcccaagataaagatggaacagaaggggcatcagaacttgattccgagtgttgggaaatcatctgcgactgtgcttagatttcaaggcggaaatttggtctcgagccaacacaggaggaagcttaggtgtcttgagctatgccctgctaatgatcagcttgttgttaccagtgcgctggacggattggttactttatggcaagtggagactagaggaccttctctctcatttcgtggcaaaacggatttcttttccccaaagcatagatggcctgaagatatagcttggcatccagatggtgagacaatttttgctgtatacactgctgataatggtgattctcaggtttcaatgacaaaccttatatcaggacaaggctccaggtagacagctgcgcttgtttgatgtcaggcttaggcaatctgaggttcatgcatttggttggaaacaagagagcagtgagtctcagtcggctctaattaaccagtcatggtctccagatggatggtacatgtcgtctggttcagcagatcctgtgatccacatcttcgacatcaggcatcatggccagaatccttgccagtctgttcaggcacaccagaagcgggtgttcaaagctgtttggcaccgaacgttgccatatctgacctccatatcatcggacctcaacattgggatccacaaatattcatgaaacgttttgggctgattttggcgcttggcaaattttttgttgtggattaggaaccatgaagacctgtgaaattttcaggactttgcatcaatcgaagatacagcaaattcagcatgctttcgctggacctgcttcaccattgactttctctgtgggagaaccatgcagctcagcagctgaagagccccacggttggatgtttgcgcgagctgacccaaacttttccaccttttgagctgctgctggagtggtatggtaggccattcatccgaacactgtttggctcgatgtgttgccctggttatttctgggaaggaaacagtcaactatacacattatatccaacatattcagcaatgtattccccctgtctttttgcagtgaatttgcccttgttggttggttggttgacagggcattcagaattttttatcagcatgattttagagcagctagtataacagtataccaactatatattttctctgtcctacaaaaattaatatgaattttagccgtaatcaaaaaaaaaaaaaaaa

SEQ ID NO: 22828 - DNA, 1137 bp, Zea mays
  misc_feature (30)..(30): n is a, c, g, or t
aggccggccgggccgggttcgtagccagcngcaacaggggtacactttccggcagggaggacgggcacacactcaaagactcgcgggagatcggatacccaggaccaggagaagacgcgcggcccgctccgcatcgctgccccacacccccacctgcccctgctcctcgaactgtccgccgttgcgttcgacatgggcgacccgccggcgctcaagaggcccaaactcgagaagggcgacaatgattccacctactgcccccgctccgcttccaatggcgcgggcgccaacgtcccaccgccgcgtgacgacgtggaggaggatgacatctcggaggaggcggtcatcgccctcatcgcgcaccgcgagcgcgacgtcgagcgctgcaagctcaagctgctccactaccagtccctgctggacgccgcggagatgaagctggaagaggcacactcgcggctcgccaggttccgagatcgcaagccgccgccaacccggtcggagcccaagctaccgacgccgccgatccagagggaacccaagccatccccgccgccaatccggagggatctcaagccatcgccgcagccaccagagaagaaggctccatcgcccgcgccgcagccgtcggcgagcccgcagcttgtcatcccagggaccaacaaccgaccggccccgcgccctcagcccatgcctggcttgaagaaagccgctgccccgtcatcgtcttcatcacgggcgccgctggaacggtcaaggaaagaggagaagccgcccaagagaaagattgaacagaaggaacatcggaacttgattccgagtgtcaggaaatcatctgcgactgtgcttaaatttcaaggtggcaatttggtctcgagccaacacaggaggaagcttaggtgtctcgagctatgccctgctaatgatcagctcgttggtaccagtgcgctggatggattagttactttatggcaagtggagactagagggtacgcataatttactttgaattgttaacatgttttccttgtcatttcctgccttccttttttacttatctttcaaccatatttaagagatatgtcgctagtttctgtaaagttgtagtgaaatatgaactaggtaaactgaatgtcc

SEQ ID NO: 22829 - DNA, 1842 bp, Zea mays
ggcgtggtgagtgaggcagcggcgagcgagcgctttcaggcggtccgccccccccacataccttctctctcatttcgtggcaaaacagatttcttttccccaaagcatggatggcctgaagatatagcttggcatccagctggtgagacaatttttgctgtatacactgctgataatggcgattctcaggtttcaatgacaaaccttatatcaggacaaccggaaagttactttcctgccagagaagcctcacacaaagggaatcataaataacataagtttcatgccttggtctgatgcatgctttgtaactggaggaagtgaccatgctgttatactttgggaagacaaagatgattcatggaaaccgaagagagtgcataaggatttccattctgctgctgtcatgggtgttgctggattgcaacagaaaagaacaattttgtcagttggctgtgacaagaggataataggatttgatctctctgctggaaggacagagttcaagaacctacttgatagcaaatgcatgagcgtattagcaaatccatgcgatttcaacctatacatggtgcagacaggggatccaggcagacagctgcgcttgtttggtgtgaggctcaggcaaaccgaggttcacgcgtttggttggaagcaagagagcagcgagtctcagtcagctctgatcaaccaatcatggtctccagatggctggtacgtgtcatctggggctgccgcgccgccggcccgcatcttcgatatcaggcaccatggccagaatccttgccagtctgttgaggcacaccagaagcgagtgttcaaagctgtctggcaccgaacgctgccatatctgacctccatatcatcggacctcaacattgggatccacaaatattcatgaaagcgacatcacgtttttggtgctcagcaatcccatgaaaacctgtggacatttgtttgctcaaagcagaacttggcatcaattgaagaaaacagcaaaatcggtgtgctttgagcttgtttcactggccctgcttcgacattgaccttcggtgcagaagaaccatgctgcgagagagctccacagttggatgtcttgctccagttgatggaaacattcccacctgcttttttgagctgctgctgcagttcattcaccagaacactctttggctcaatgagctgcttcggttacttttgggaagagaagagtcagctatacacattatgtccaatattttcggcaacgtattccctcgtctgttactgcttttttttttttttgcccttgttgggtggtttacagggcatttatctaaggccaaaatgtatgtgcgccctgcgtagttttatttttctcacacatgtctcgccaacaataatatatgtattgcttgtttttatgtaatgataatattttatcaagtattacgtgaaaaatgtaaagttgagtcactgaaaaaaaaaaaaaaaaaactcgagactagctcgtgccggagtcactcaaacgctttgatgcgccctgcgctatgttagccaaatctctcatctccacagcagcagccagccagccagagccgcccaccttatctatgtctatccttcgtctccatgccataatcagtgtaattggtgagggactagtgcatctataccatgccatgagctctcgcaatgtaaatctgtaaagccaatttacatttggtaaaatgcagaaaaaatcaacacaagatgaactttgcattcattctctgaatatcggcaattccaagatacagcataacatgaaccaggagccaacactctggctttttttttgcattcattctctgattagggcga

SEQ ID NO: 22830 - DNA, 1099 bp, Zea mays
gtagaatgaattcatgtcttatatcatcactaactattagcctataagaaatgaaatggtaatgaaacatctcattctattctacaacttaaacaataaagtgagaagtgagaagataatgaactatatcatttctcaaacaaaaggttgtttgggaactcaaaacgcctctgaattactggtgtttgagtaggaaaatgagctaattttctactcaatcttcgggagtcttataggaaatttaagtttctaaactagtcataagtttcaaggtaaccctaaaaaagaataataaagctttattggtgacaagcaccaccccatgtctatgaagcgcgttggctaaataagaaatggtgttgatggtgcgtgaggaagaacaaaggatcgttttagcctggcaaatctttgctttcttcttctgagcatcgaaggggctgacgaatcgattcggcagctgccacattgtattcaagcacacaggacatcttattcagaatgtattacaatttatgctctgttagggtgaaggcggcaggcagatcgaaatgtaacaattcttggggtgtaaacaacagaaattgttttcgatttgggtacaaaactgatccaatcaccagctaaatgtgcctcctactacaatgcataaagttttcgtttctgcttcgcactcgaggcacgtgaacagtagcttccacacaatcagtatgttctgttgctgcagcagtttagcatactaccgaggaccctcgttgaacgttaattgctggaacagctttgcttgtttggtgaaatatacacaatgcaaaccagtgggggtgctctaatgtgctaagatcccataccagccacccccttagctttggctgccgcctgctgtgctgccgcggcggcggctgctgctgctgcagcagctgatgcagctggtgatgcgggggaagctggtgcgactgaggccttctgtggtgcttcgatagtatgctcatgttgctgtttgttatgaacctgggctaatatgttctttatctgggctcctgtgagggtctcatgctcaagaagtgcgttagctagagcatggagctctttgttgtgttttgta

SEQ ID NO: 22831 - DNA, 1026 bp, Zea mays
gggaccctcgaggccggccggccctttagcacattgggttcctcgaggccggcccgggctcccaaatatctctccccacctcccctgagcttctcccgacctttggtcaggcaaaggaggcggccaacaaggacgagcgatggtgaccaaggtcatctgcttcctggtgctcgcatccgtgctcctcgccgtcgcttttcccgtgtctgctctgcggcagcaggtgaagaagggcggcggcggtgaaggcggaggcggaggcagtgttagcggaagcggaggcggcaacctgaatccctgggagtgctcgcccaagtgcgggtcgcggtgctccaagacgcagtacaggaaggcctgcctcaccttatgcaacaagtgctgcgccaagtgcctctgcgtgccaccggggttctacggcaacaagggcgcctgcccctgctacaacaactggaaaaccaaggaaggagggcccaagtgcccctagaagatccaccgcagctcccgtccgccattgtccccccttctccgaatctggaacgtgttgttcatcttcgaccaccccctaggcttggcattttattactagtataatgctagtgtccgcccgttgcttaatctggaatgctaccagccagatctccatgctctcctgtgagccactcggcagagtgaggattactaggtagggtggcatgtcatgtgctccaccctccactggtacgagtcaatcaactaaagctacccccggattgatgaggaacatcccgcgcgattagtggggcatgtcattacattcatcagcttctatatataaactagataaactttttatcaaaaaaaaaaaaaaaaaaagcgcccccgcccccgcttttttttttttgggttttgtttggcggccggaacagattgttgttgccttgttgggaggaggaggggaattggaggaatatatcccaacaagaatttgattagtaaaattattccatggatcgaggtcgattgtttttttttttttttttcccggcc

SEQ ID NO: 22832 - DNA, 853 bp, Zea mays
  misc_feature (850)..(850): n is a, c, g, or t
atataagcacggcggggcgcgcccgccggtccctcgctctcaaatatctctcaccacctctcccctcagcttctccccacctttggtcaggcaggctcaggcaaagggggcggccaacaaggacgagcgatggcgaccaaggtcatctgcttccttgtgctcgcatccctgctcctcgccgtcgcctttcccgtgtctgctctgcggcagcaggtgaagaagggcggcggcggcggtggtggcggaggcagtgttagcggaagcggaggcggcaacctgaatccctgggagtgctcgcccaagtgcgggtcgcggtgctccaagacgcagtacaggaaggcctgcctcaccttatgcaacaagtgctgcgccaagtgcctctgcgtgccaccggggttctacggcaacaagggcgcctgcccctgctacaacaactggaaaaccaaggaaggagggcccaagtgcccctagaataagatccaccgcagctcccgtccgccattgtccccccttctccgaatctggaacgtgttgttcatcttcgaccaccccctaggcttggcattttattactagtataatgctagtgtccgcccgttgcttaatctggaatgctaccagccagatctccatgctctcctgtgagccactcggcagagtgaggattactaggtagggtggcatgtcatgtgctccaccctccactggtacgagtcaatcaactaaagctacccccggattgatgaggaacatcccgcgcgattagtggggcatgtcattacattcatcagcttctatatataaactagataaactttttatcaaaaaaaaaaaaaaaagggcccctacngcg

SEQ ID NO: 22833 - DNA, 526 bp, Zea mays
  misc_feature (231)..(231): n is a, c, g, or t
ctcgctctcaaatatctctcaccacctctcccctcagcttctccccacctttggtcaggcaggctcaggcaaagggggcggccaacaaggacgagcgatggcgaccaaggtcatctgcttccttgtgctcgcatccctgctcctcgccgtcgcctttcccgtgtctgctctgcggcagcgttgaagaagggcggcggcggcggtggtggcggaggcagtgttagcggaaanggaggcgcaacctgaatccctgggagtgctcgcccaagtgcgggtcgcggtgctccaagacgcatacaggaaggcctgcctcaccttatgcaacaagtgctgcgccaagtgcctctgcgtgccaccggggttctacggcaacaagggcgcctgccctgctacaacaactggaaaaccaaggaaggagggcccaagtgcccctagaataagatccaccgcagctcccgtccgccattgtccccccttctccgaatctgggaacgtgttgttcatctttcgaccaccccctaggctt

SEQ ID NO: 22834 - DNA, 925 bp, Zea mays
tttcgggatacggtgcccccacccaacctccgtctccagtcatccactgcctgccgcttccagtcccaaatatctcctcctcgtctgcctcgtttgccacataagcacggcggggcggaaccggccgcccctcgctctcaaatatctctcaccagtcaccacctcccctcagcttctccccacctttggtcaggcaggctcaggcaaaggaggcggccaacagggacgagcgatggcgaccaaggtcatctgcttcctggtgctcgcatccctgctcctcgccgtcgcctttcccgtgtctgctctgcggcagcaggtgaagaagggcggcggcggcggaggaggaggcggaggcagtgttagcggaagcggaggcggcaacctgaatccctgggagtgctcgcccaagtgcgggtcgcggtgctccaagacgcagtacaggaaggcctgcctcaccttatgcaacaagtgctgtgccaagtgcctctgcgtgccaccggggttctacggcaacaagggcgcctgcccctgctacaacaactggaaaaccaaggaaggagggcccaagtgcccctagaagatccaccgcagctcccgtccgccattgtccccccttctccgaatctggaacgtgttgttcatcttcgaccaccccctaggcttggcattttattactactagtataatgctagtgtccgcccgttgcttaatctggaatgctaccagccagatctccatgctctcctgtgagccactcggcgctccactctccactggtacgagtcaatcaactaaagctacccccgggttgatgaggaacatcccgcgcgattagtggggcatgtcattacattcatcagcttctatatataaactagataaactttttatcaaaaaaaaaaaaaaaaaccagtctaccactac

SEQ ID NO: 22835 - DNA, 3721 bp, Zea mays
  misc_feature (2136)..(2136): n is a, c, g, or t
  misc_feature (2228)..(2228): n is a, c, g, or t
  misc_feature (2462)..(2462): n is a, c, g, or t
gtctcaatccattctcttccccggcgacctagccctcgccgtagccgttgtgcgctcgctcccgttcccgtcttcctccatcccgcacgctcccgctcgttcccagctccggccccctccacacttctgcgcgaacggatcctccgctcccgtcagagaccgcgaacgtcccgcgccggagtagtttgcgcccgcgaccgccgtgtaagcgcatccgatctctctcccatttctctgtccccattttttggatttgttttgttattttcggtaatagacaggtaaaccccattttttccccaagtgttgcaactagtattattcgttgattggaattattaattgttgtattctaggttataatctaggttaatgcggatacatttcatttttgaacaagcagtttgtgttctaggttataatctcagatgtttccacttttattgtaactgcagtgtaccttttgttgcaactggtccatgacataagttgcaactgtataatttttactttcagaccacatacatcattactgtcttttataactgtgctcgtatacaactagttatttgtttaaattcactgttgcaactgtcccagtagtaatttttttagcagtcttgttgcaactggcttatgtcgcatgttgcaattatgtccctggactaatgtaatgtgtgcagcattagtgtgtattagtttgttgattagcaatttttggtttatgagatctgtaccatgtgtttgtgccctcatgttttttgcattcccattttttcagtgttttttataatggatcaagatcagaatgtatcaggccagcaaggcgctcatgctgtccgtcgctctccccggtgttgaaaacaagagaaagcaattagataaaaatgaattaaaggaaaggaagaagagattaaggttgaaagtccctcctatacaagatgccgaaagtgatgatgaaaaagacacagagtttgttcctggtggcgatgggtctggtgatgacaatgttggtattgttggtggagatgaaaataagggtataactaagacacgagctattcgatgctcacctggaaagtttataaagcttgtgaattctctatctgatgaattgaaaagtgaagtggttgctaaggggtttggcggcctgcttaggttcaagccacatttattgtcgagaaagttgcttagctggctgatgcggaagctcaacccagaaacaatgaaattagagattggtggtgggaaagagattcaaatcaccgagcacagtgtttggtgtgttttggagttaccaaacgttggcagtgatccgccccccatgtctgacgcagatgctcgtgccttgcgggacgagctgggggagcaaatttgtgggaaatcttatagacgcatatctggcatcaatatatctgttatcactgatagattgcagaagaggactctcaatggggagctgggcctgagagcctttttcatggcagcatttcagtgtcttctattctccaatactgacactcggatcaggattgatgatgtgaagtacactcaggacatccagaatattggcaacaagaactggtgcaaagctgtagtagacaggctgagcatagctgctcggctttatagaaaggattttgctgagaaaggcattaacgcaccaatcagtggatgcggaatctttgtagctgtaagctcaacacacacattcaatttttgcccttgcaacttactcttccaatttcacaagtagtaattttttatgtttactgtcacaactgtcatatgttacaagttgcaatttgagggcatttttttatgataacttagttcacacattcacatgtattttgtaatttatgttgttcataaagtagcaataattttagtatgaggctatttcaactggcttattgcacctgtgccaatttggtttactttttttcattatatgaattcaacctaaaatacccatgtgtcttttacctaatgttaaaaacatgcagatgctttatgtcgacaacctgcaacatggattagacacaagtcctttttcaatccctcgatgtgctttcttggactccaagatgattgatgctatagcaaatatggatctcaggggagatgttcctnctgggaccactgagtttggacacctcagggtaagttgcaaatgatactccacaatagttgcaatttgttattcatttatcattttatcattntttttttactttcagttgagaagtatcactgacacgtgctacggcgtccccattggtgctctagcaatattacatgctccagtaccagcacctgccccagtagcagtccctaatccaacagcagcacctaacccagtagcagcagcatctgtcccagtagcaacagcagcacctactgggacatttgctgatgtgcttggcacatcccatgatcccgtcggtcatgcttccttnaatatccaacccccagtcttttaccagtaccctagctttagatcttcttttggtcagagtattactgatttagttggaaggagtaggaagtcagatgcgctgaacatcttgaaggcgtttgatgaaagcactagtgaagcccagtcgtacgcacagaaggctgtgaagtattcaacaatatcccgcgaccttatggcaaaagctcaccacgagtgctacactggcattcagaagcttatcgctgacgctatcgttgagaagcgagctgccaaagagcgcaggaggaaggtgaagaacgaccctagagcaggagcaggtattttttgttgcatataggataatattattgtttgcaagcacccaccatacaagttgcaatttgcccagacacatcaatatgtgtttacaatcattttttaaatttgtttgcaggagcaggaactagttcaattgcaccggaggaccaatctagaggaggtgatggtgaagaaattatacggagtcccgttgcaattgaccctagagctggagcaggtattttttattgcatacagtataatattattgttgcaaccacccaccatacaagttgcaattttacccatatacatcactttgtgctttcaatcatttttttaaatttgtatggaggatcaggaactacttcaaatgtaccggaagaccaacctggaggaggtgatagtgaagaaatacagttggattgcagtggtggagatcttgatgacagcttagattttacgagaaccccatcgtgtggtgatgacattgatctggaagagggaaatttgaatagaagtaagcctacctatgtcttccatgcttaaaaaatgttttctctcatcttgattattcctttttttcatttatattttttattctttcccctggcagcacctcctgatttacgtgggtcaacccgaagtattgatgatatattgcaaatgatctattccccagagcactttgcaagcattgatggcgaggttagtttatcgtgtttttttattaccatcaactccttttttctgattaatattatgatttttcccttttttctacaattacagtccccttccaatagccagccgactcgtgcaccacgaattgctgttcgcaagaggaaggcttcctcaaacccccctggcaatgatcaacggcttgtggtaagatcatctgatacccatgtgaaagcagtccatagttgcaatcgggccccacctattgtagtaatcatagcc

SEQ ID NO: 22836 - DNA, 2531 bp, Zea mays
  misc_feature (4)..(11): n is a, c, g, or t
  misc_feature (31)..(31): n is a, c, g, or t
tacnnnnnnnnacgcaggttctccagtccgncgtgtaacgacggcagtgaatgtatacgactcactatagggcgattgggtaccgggccccccctcgagtttttttttttttttttttgcatgaaaagattaattgcataacagttttttttcttacattcaccagtaaaagtggtattaagaatgcatttcaccgaatgaatatgacaggcccccacaaataagagctgacagaacagagaaaataaaaggttacactccgtgtgggcggacaccatttacagctgaaggtcatcaagtgtcaattcttctactgacatcaactttaattttgtgatgaactggggaggatcatcaaggctagatgaaccaaggatgatgtctcgcttcagcttggatgaaagcttgtgtgcagcacgtaactctgatcgagtagcaccgcctattacaaaaacaaatatacgctgaccaagtttcctgaagtcactggaggcatgcttcaacacagaatcacttgaatatccatcatcagagccacgaggtcttgcccatgtgccacctgttcgtctggatcgcattgagtgagcggggcttgttcgggcagagttactggttggcagtccatgaacagtaggactagggtcattcatacagttatattcatcttttggcagctcacctttgctaagattttcaatcaattgctccaaaatagggtaaaatcgagagagtgcccatgttgattcttcccctgttcgctcttttcgatttgtgtgtttcttcttgtgaacatcaaatttcagtgtaaaaccccctactgaagactttttggtatcaggcccacataagcaacgcatattatttacagcaatcatgtcatcagcagataatcctgccaactgcattaattttgcacccttgtcgctttcaaacttctctgggttaagtgctgcataaatcatcagcaagcgtaatttattttcacgacttacaaccaattgtgttctcaaaaagttgattagttctttggttccagcatcgccaaacacaagatcttgctctagctgtccaacatcccgaagacattgttcccttattatgttattgagttttcctgcaatctcaacatgcagggaaagcttatcaatttgatcactgtactgtggaagagcctgaaccattttttgtaaatctcttgtcgataattctccatcggttcgtgcttgatgcaattgtgcagctttgttctttgaaatgaagttggtcatcttatcatgtagcctctcacttgcatctgctatatgtgcatgcctaagctcaagccagacagggtcatgatcctccaacaggacctcctttttttcagttgccgacccatttttagttggaacctcatgaacatacttgttgccatccatacaaagcagatcatgacacatagcatcataagtccattcatgaataattggtgcaatctgatctattgaacggtctactataagtagctcacaagtttctgtttgaggaaattcaggtattgtcgttttatatttcgcaagacaattccatacactggcagcaagctttgtggggactaagtctcgtagtgttgtcattgtagaagcatcaatcgtcttggcaatacggtagtgtacacgagggaattccctcattgatgcaaatactgtggatatacgagtagccattgtgttcagacaagcattatacttgtgagatccttctgcattttcactaaaaagttcttccaatgccctctcatggtcagttatgaaaccctgggaatcaatagcaaagtactccaaattcatctcactaagtgcggcaatacgaggtagtacacttgaatccttttttatttgagcaactaattctttatgtacgggagaactgaaaaacacatatgccttcttgtacaaagggcttcttcctgacatgtcggataggaacatgacaatgttctctttagttggttggatgaaatatatggcatccagtgaaggcaatggttgcctccgtttatataaatcttcgaccaatgaaacaccttcttctgtaatatctgccatcttacatgcatatgacataatcttgactgtaaacttatccatgataagaaccttccatgttgatttcgaattcttcctagttgatctgagcatttcaaataataaacgatctcgcgtgatctggcggaagctacggtagtccccaccctgcgaggaagcctccgagtccaacgacatcgcgccggagtctcttgcctctgccggcgacgccgactcaacctggatcttcggccagagagatgacttggctcccacttggagcagcggcggggaccggagcgagatggcgacgaaagcaacagcggaagcgggacgcggagcgagattgacgaggcagagtgcgggcaggggaagcaaaccccagcccggcccgctcgttctctcgaagaggtcgtcggccgcaaccggccagggaaattacgctaccgccctgatgctgttttt

SEQ ID NO: 22837 - DNA, 1231 bp, Zea mays
  misc_feature (1040)..(1041): n is a, c, g, or t
ttcccgccgtcatcatcatgtatcctaaatccaaagccagcgaagaagagattccgccggtgccgtagccgctgagctaaccaccagccggttcttgtcgcgttgtctgcaactttgcaagtaagcaactcgtcaccggtcagccaccaacaaggcaccttggttatcgtcttgcacgtccaagaaatcgagaactcaggcaggcgtcgcccacttgccctcctcctcctcctcccgtcgtgaattccacgctggttcagggatgtcgatcgagctcctgacgaaattcctcacattgctgttcgggtatgccatgccagcgctggagtgcttcaaggcgatcgagcagcggcccggccgggcagatcagctccgcttctggtgcgagtattggatcatcctagtcctcctcgtcatgttcgacgaaattgctggggttctcatttctaagatcccaatgtactacgagctgaagctagccttcctcgtctacttgtggtacccaaagacaaggggaacggacatcgtgtacgagaccttcctccagccgctggtgatgcagtaccagcccaacatcgaggccaggctccagtacctgcgcgccaatgccggtgacatcctcgtcttctacctcaagaacttcaccgagagaggctacgagctcttcctccgagtgcttgactacgtccggtcgcaggcgtccagagggtcaagaacacggagtttcttctcgttccgaggtgaacgttcggagaggccaagcttcaccgatgactatgtcactggcggcgaccggagggacgggggaaggcaccgtcgaccacgcagtggctactagtagaccaagtagtcactggatgtataggatgtgcacagaaacatatacgattactggtatagtgttaggtaggagtaggatcaaatcaagcaaaccttacggacagaacttgtaggatccactggaaaaacagatagcttcttataaattttctattcatattgtcactttgtcagccaaaaaaaaaaaaaaaatgcggccnnttgtgcttttgtgtatggctcattaagttttgttgacaaagtttcatgtggaatagctctctatgttctcgagtcctatcaaggaagtacaaagatcagatcaaatttaggaacaacatctggctattcagttacaagacttggcttgggcttagttccagctgtttgttcgctgctttcagctatagca

SEQ ID NO: 22838 - DNA, 913 bp, Zea mays
tgtgcggcgctcgtcccgcccgccgcgcccaccaggcaccttcgttaggctgtttgcccatccatccacccatcgtcttgcacgtccaagaaatcgagaactcacgcaggcgtcgcccacttgccctcttcgtcctcctcccgtcgtgaattccacgctggttcagggatgtcgatcgagctcctgacgaaattcctcacattgctgttcgggtatgccatgccagcgctggagtgcttcaaggcgatcgagcagcggcccggccgggcagatcagctccgcttctggtgcgagtattggatcatcctagtcctcctcgtcatgttcgacgaaattgctggggttctcatttctaagatcccaatgtactacgagctgaagctagccttcctcgtctacttgtggtacccaaagacaaggggaacggacatcgtgtacgagaccttcctccagccgctggtgatgcagtaccagcccaacatcgaggccaggctccagtacctgcgcgccaacgccggtgacatcctcgtcttctacctcaagaacttcaccgagagaggctacgagctcttcctccgagtgctcgactacgtccggtcgcaggcgtccagagggtcaagaacacggagtttcttctcgttccgaggtgaacgttcggagaggccaagcttcaccgatgactatgccactggcggcgaccggagggacgggggaaggcaccgtcgaccacgcagtggctactagcagaccaagtagtcactggatgtataggacgtgcacagaaacataaacgattactggtatagtgttaggtatgagtaggatcaaatcaagctaaccttacggacagaacttgtaggatccactggaaaaacgggatagtttcttataaattttctattcatatggcagc

SEQ ID NO: 22839 - DNA, 2114 bp, Zea mays
ctcgaggccggccggggtatccccgtcgccttccttgggcagttgggctgagtcctcccgtctctcgccccagatatagttgcggcggggtttccttcttcgagaaagttctgaaccagggggagccgcgccgaaagccggagacgacccttgctgctggcaggtggtaattttgtagtcttgctaacttcagctgatggttaatatgagggacaatgactcatcaagcgacgcacaattggacgagcccttaggacgggtatcgatactctcttacggatctgggcatatgctcaacgacatcacatcgtcttgttggtttacctatttgcttgtgttcttgacagatctgggacttagtccaggtgatgccgctattgtgatgctttctggacaattggcggatggcttcacaacaatctttgttggggaattgatggatcgctttggacatttcaaactgtggcatgcaggaggatctattttagtggcaatttccttctcttctgtttttggtagctgtgttccttgcaaacttatgggaattaatacatctactttggagactgttgggtacagcacatttgctgctatttttaatgttggttgggcagttactcaagtcgctcacatgtctatggtaaactgcattacatcaaatccaactagccgggtttcacttgtaagctgtcgtaatgccttcacgatggttgcgaatcttagcctgtatggcgttgctttggtgatatttactctatcgcagtcagtgaacgtactagttcagtatcggtggattgcttatgtgtccatttccctcggatcttgctttgttgtcatcttcttgattggaaccaaagagccaggatcgattcgacactgtttggataagagtccttccagaatttcatgggactactggttcaagagagtattgtactaccaagttgctctagtctatactctgactagattggtgaccaatgtttcacaggcatttcttgctttctatgtaataaatgatttagaaatgaatcaatcctccaaagcattggtacctgctattatctacatctgcagtttgatagtatctgtaatattacaggagactagatggtcaagttggcgtcttaagctttactttccagctggcgcagtgctttggatattgtcaggtcttggaattgttcttctaccgagcagaatgcacaacctcatgtatgccatttcaatcgtaataggagctgcgaatgcacttatgacagtgacaagtattagcatggaaggtgttctagtccgtcaagatctaaatggttgtgcttttgtgtatggctcattaagttttgttgacaaagtttcatgtggaatagctctctatgttctcgagtcctatcaaggaagtacaaagatcagatcaaatttaggaacggcatctggctattcagttacaagacttggcttgggcttagttccagctgcttgttcgctgctttcagctatagcagcttataccatggagctccctgatactcagaaaggacctttggtggaaccccttctagcataacttcactggtggcagtgttacagtttcaccgtgagccttcacagtaattgctcgatggaatgacactgctgctcgagcctgaagatgttagcgacctggtcaattcgttttgacttcgtatatatagtctgaataaattatgacggaggggatatactgagacacgtttgaatagggattagaagtgacataggggggctaggggcaagaagatctgtgttgatcatactgagctttacaagtcattctgcaatccaatgtaaatataacttagcttcatttcgaaagcatcaaaactgccaactaggcacatgtagcgacgatgggcaaggaaaagaatatctctggtccttgttctacgctataatttcattgtatatgtagcatcatgattgaaaagaaatatcttatatttatattgatgggtgaaatagtgtcgcctatgctcatgtaaattgtttctgacatttagaaattaaatatgcttgagaagagagcactaatctgtctaaaaaaaaaaaaaaaaaaaaaaaaaaaaaaaaaactcgag

SEQ ID NO: 22840 - DNA, 689 bp, Zea mays
  misc_feature (676)..(676): n is a, c, g, or t
ggtttgatcagcttattttattggccgctccgaacgtgtcgttttggtcttttttttttttttttttgtacagacagcggacacaaattgctccataggttacaaaagtgtagcggcagccggcaggtatcctgatccatcgccatctgcttacacacagacaaaacaaatagtaacgacactaggcatgaagtcgctggcagcataactattgctagcaaaaaaaaaaaagagacagtacaggcatccgggcgcagttgaaacccagcacagattattcaacaatcaccagccacaaacatgtaatccccccttcattcatttcctcctgagcttcgccttcaacctctcgaccgcggcccgcagcgtgccttcgtccttgctgaaggtgaacctcaccaatttctttccctcttcggggtcgaggtagaacacgctgggcggtatagcgcagacgccgacttcgcggatcaagtactcgcagaactctacgtcgctgtcgaaaccgaacggggtgtggtcgaccatgatgtagtatgtcccactcgatgggtagacgatgaaccctgcggcttcgagtccttccagcaggatagccttcttcgcgctgtagtccctcttcagctcgtcgtagtagctgtccggtgccctcagagccgccgcggccgccgcctgnatcggtgtgcagc

SEQ ID NO: 22841 - DNA, 991 bp, Zea mays
tgaatcagagaaacaaaaaaatcaagagtttgggggatgttgaacaaaatttgacctaacatgacctactcaaaaaatcatcccctcactaccccctcccgctgacttcgtttccacaaaatccgcctcttgtttattgctaataaggtacacaagatcacccaggtgctgcacttgcaggcccgtcttctcacacctgtcgaagaagagtgattgatgacccttgccgattcttctgcgccagctcattagaaacaccggtggttttgcagatatttgtgtccctgatttgtcagtgatggttatgcagccagatttgtgatccttctgcttgtactcattcaaaagaaaggacactgtcttgaccaagttgtcatactgtttgacatagagtaggatatcacttgcaatgacaatgtcccaatttggtgtgcaaactggaaatggatctccccacgtgtgtctaatatgaggtaacacatctaaggcattcgctctgcaattgtaagatatattcttttcaatttcgccgtcatcataatcagaggttgtaatgttcacctcaaatgccttcctaagaaagatcgcaagcgctcctgtcccacttcctaattccaggactcgtcgtccatccaaaattgaccggttcttaaccagccaagtagcaaatgaaaatgtccccggccacaacaggttggcgttaagctcatgacatgagaactcccttacactcagtttcatgtcagggaagtcgtggactctctcctgatactccaacgccaccggcttctccccatcggagcagatttgcatctcatctcggtcgtcgtcgctgtcgtcgactccgtggaagagatcggcgggggagaagacggcggtatccatgtgtgctcttcgctgttgagggtgggaaggggaggccgaatgcgagagaggcgccgcgcctcggcccgaggggaagtttctccccggccggcctcgaggtacccaa

SEQ ID NO: 22842 - DNA, 837 bp, Zea mays
ccttccgggaaggcacgggcgcctctggtttcgtcgtctccgcccgtttgttcccccctcttccatggcgtggcaggcagggtcatctcggcacctggctggctataagtagctcacctggctgcatccatcactggcacgcatccgcgaaatccaagagcagcagcagcagcagaccaagatcgagggagggaggaagacagacagacagacagagagatggagcggatgagctcgtcggtgcagtcctgggtggaggaacacaagctctcgtccatcggagccgtgtgggcgacggcggtgggcgcgtccgtggcgtacagccggcggagggcgccggcgcgggccacgagcctgcgcctcatccacgccaggatgcacgcccaggcgctcacgctcgccgtgctcgggggagccgcgctcgcgcaccgctattacggcagcagcgagaggaggcagaggcaggaggacctggactacggcttcaaatcccagctgccgccggccaccgacgccgagggcaacgagaacgagcgctggagctggtagtggcagggcagactagcagtgagtgaccagtgagccttcagatgcatacatcagatcagagagaaggaaggaagagggacaataaatagattaattagtactagtagcaataataataattgcatgcctgtttgccaatcaatgatacatgacgtggcgcctgatcctgttcgtcacggcccataaacccaggaagcagctagcccatgtatgtgtggcctgttatgcgttaccgtacttcgttttcactcgttaatagtactctagatttcaaaaaaaaaaaaaaaa

SEQ ID NO: 22843 - DNA, 909 bp, Zea mays
agaaaggggagtggcctacggcggccgtgcgtgcccacaagaagctagggaaaccgggggagaaacggaaggccggggcgcctctggtttcgtcgtctccgcccgtttgtttccccctcttccatggcgtggcaggcagggtcatctcggcacctggctggctataagtagctcacctggctgcgcccgtcagctgcaatcaagcacgcatccacgaaatccaagagcagcagcagcagaccaagatcgagggagggaggaagacagacagacagacagacagacagagagatggagcggatgagctcgtcggtgcagtcctgggtggaggaacacaagctctcgtccatcggagccgtgtgggcgacggcggtgggcgcgtcggtggcgtacagccggcggagggcgccggcgcgggccacgagcctgcgcctcatccacgccaggatgcacgcccaggcgctcacgctcgccgtgctcgggggagccgcgctcgcgcaccgctattacggcagcagcgagaggaggcagaggcaggaggacctggactacggcttctactcccagctgccgccggccaccgacgccgagggcaacgagaacgagcgctggagctggtagtggcagggcagactagcagtgagtgaccagtgagccagtgacttccgccttcagatgcatacatcagatcagagagaaggaaggaagagggacaataaatagattaattagtactagtagcaataataataattgcttgcctgtttgccaatcaatgatacatgacgtggcgcctgatcctgttcgtcacggcccataaacccaggaagcagctagcccatgtatgtgtggcctgttatgcgttaccgtacttcgttttcactcgttaatagtactctagatttcaaa

SEQ ID NO: 22844 - DNA, 2526 bp, Zea mays
ttttttttttttttttgagcagatcaaacgagagactgatccagccaaaaagaaattccaaacactacatggggctatcagtaattacacatgggtagctgaatgacagcagcagcagcagcagcactaatcaaggctagaatgagcacagcaatttagcaatcactttagaactggtccctaagcacaccgccaccagtcaccttccgcggcaccggatgccgtgcacccgtgctacttttgacaatcaggttacccgttaaatcatgtaagctaaaagacgaaaaagagtcgattcagtccaagatcgattggatgcaggctagagttatagctgattctcttttaggtcaactgagatcaagaagtgaacggattggtcggcacctccgattcagccttggaagattgatcatcaacttcttcctccatgtttgtggtcacgcttgacttcctgatctcctctatccgcgtaacaacatgccccattgagggccgggcctctgggacttgcgctacgcagtccagagcaagcagcacaagctgagccatcagctcctcgtcagcctcgtgtctcatgagctcaatatcgaacacctccgaaccccattcggagcgactaactgactgcacccatctgggcaggttgacgccctcgtcgttgagagcggcctggctgggggccttgcctgtgaccagctcaagcaacagaacaccgaagctgtacacgtctgccttctgggaaaccctccggggatcaataacctcgggtgcacggtatccagtggcgcgagacggtgaagacgatggaccaacaagagcggtaaggccattgtctgatacgtgtgcttgatacgattcgcccaggaggacattggatgacttgatgttaccgtgggaagccgttgagctcgttgagtggatgtactcaacaccacgggctgcagctagagcaatgcttgaccttaaatcccagttaaggggtgtcttgccagaagttatgttgccgtgcaggactgcagacaggctccccttgggcatgaagtcgtaaacaagtagcttttcatctttgctgtagtagtaagcacggagtggcacaatgaactcgtgctgaagctcgccaatctcagaaatgcgttcacggaactcaggttcagacagagtcacgtccttgaggcgcttcacggccaaagttgcaccagactcgagcactgccttgtacgtcgtcccgaacgttccttttccgagcacctcagccgacgcgcgcagcaggtcctccagcttgaaagacgccacggcggccgatgacccaaagaagaccagcttcttaccggacgtcgactggacaataggagcgttggggtggcctatcgtggtcaacggcgctacagcagcagcgctagtcatctcgggaggtttcctgccgccggcaggcgctggggaagaaggtggcatctccagagaccgcgttctgatgccccccgacctgcgacagaggcagacgaggaggaagaggagaagtgcggcgcccaaggcagagcctatgacgattccggcaatggcgccaccggagagcttcttgcccttatggccattttctacgccacttccaccgttggtgccgccgccgccgccgccgccgccgcccctgccactgggaacaggcgtcggcgacggtgtctgccccgctggagcaggggacgggggaacctcaccagggcaaggccccaagggtccgccgcacaagcccgtccccagaaacgcggagcgcggctgcgaccgaagtgaggccgggatggatccgttcagctggttgaacgagacattgaactgctgcaacggcggtagcttcacatcggaaatctcgccggaaaagcgattattctcaaggagcaggaccctgaggtgtgtgaggttgtcgagctccaccggaatgggcccggacaggtcgttcccgccgagcgagagcctgacgagccccgggagagcgagaatcgcctgcgggaacccgcccgacagcctgttcccgttgaggaagacgttacgaagcgcggcggcggaagacaggtcggctgggagcgcgccggagagaccgttgaggcggaggctgagcgtgtgcagcgccgtgaggttcccgagcgtccccgcggggactgtccccgagagcgtcgccccgggaagccgcagcaccgccacgcggccgtgctcgcaggtgacccccgtccacgagcacgcgcccgcgacgtccgaggcgttccacgccaggcgccgccccacggcgtcacggaacgccacgagcgcccgcgcgtcgctcgcgaggtcgtcggcccccgccagcgacgcgacgaggaggagcatggggaacgagaaacggatgcgccggagccgccacggcggtggcgaaggcgaccgcatcgcggcggcggctgaggtggcgagagcgggcccggtccggaacgagccgaggttgagagtggtctcgtccgtttcttcgtttcttggcgtctggcgagcggggagagaaaa

SEQ ID NO: 22845 - DNA, 4377 bp, Zea mays
gattgagacggttttttctttcttcatagatagataattgagtggagcggtgttagaaactaactagagtggaatacatacgtacagggggagtataatgtaatgtgcttattactacctgtctgcgaatcagtttacttgtaggagactaggagtgaggacgaagagatgccatcttcttgttatgaagtcaagggtccaaaaccaaagctggttattaggtaatcagacaggagaaaggatagtaccatccggccggcggaagttggcttgcgcgcgtacgcgctgcttaatattcctacttacgtaacactggtagcagaacactcttggtgtggtactagtagtcgatagaggcgtgaatgcttgtttgtttcttaactaaaacctgatgcgcttcgttcggtcaacttctcacccacctacgtgtccatattagctgcatcgggtctggaagctcgattcttccagcaaaaacaaaagaagaatctgctcagcactgcgtgcacgactcggccggcatactgttccaagtaaaaaaaatcaaaaagaaaaaaaaaagaaagcgaagttgatgcatccatagccaatagccataggataggcgcaccgttcaaatttgttccatggcggcaaacacgcacgccacgcccgatactaggctactagtactagctagcctgtgtaggggaggaggaggcaggggcccgtgatccgcgacgacgaagcgctcacgtatcagtctacgatgcgcggtccccgcaaacaaaaacaaaaaaaaaaaaccggtggaccggagacgagcgctcccgctccgctccgctccgctgcttgcctgcttctgctccacacgaccgcacggccggccggtcccccagctctcgtgagccggtccggtaccgcgtgctctgtggagtggtaccgtggtggcgccgagccgatacggatcaccgcatgtggcggacgggatgggaatgggaccagagtaccaccataccatgggagcacggcacgggacttcctttcagatttggcgggggtcgcctcgccccatgcccccgtggtccgcctagcagtagccactaggcatttagccgagacgccggagccggacggaacaagaatccccctgacctaccacggaacggaagaacgggtgagagctccgtctcctgctgccgtccacatcgcatacgctcttggtgagaaaaaatcgggcagttagctgagctacttgttctaccaggaccagcaactcgggcgagggaaatcaggaaagcatcatgcccttgcctcagcaatttcgacgagcgccgctggaatttcgtgggtactgatgaattctgggggggggggcgtcgtaggcccacccgccttcaattatcagcgagtaccatgtcagctactatcaatgaacaaacgccaagcagtgctcgtccacagccacatcactatactgcacatcgagatatcaaaccggggcctgcagcgcagaccgaccaatcactccagtttcgaaatagcctcgctgaagacaagatccgtggcaccaggtctcacaactcacagcttcatgacaatgacaatgccgccatcaatcagctgccaccgtagcacaagtggttaacagtacaccaccaaaacttttcccaaaaacatatttggtcccactgaaatcacattgccaagcaactaaggcaaatcaaacgagagattaatcaggcagtgaaaaaaaatccaaacgctagatgaggggcttgagtaattacacatggatagccgaaagacaagcagcagcaacagctacaagctaaaaccaacctgatcaaggctagaatgagcacagcaattaagcaatctcacactttagaactggtccctaaacacaccaccaatcaccttccgcagcacagggtgcgactgccgaacacccgtgctgcttagtgacgatcaggttaaccgttaaatccaacaggctaaaagatgcacacacaaaaaaaacagttgactcagtcgaagataggattcatcgaatgcgtgaatcgattgaatgcaggctagagttatagcagattctctctctctcaggtcaactcatatcaagtagcaaacggattggtcggcgccgcctccgattcagcctttgaagattgatcatcaacttgttcaatgttcggggtcacgcttgacttcttgatctcctctatccgcatgacaacatgcgccattgacggccgggcctctgggacttgtgctgtgcagtccatagcaagcagcacgagctgagccatgggctcctcaccagtctgatgtctcatgagctccatatcaaacactagtgaaccccactccgagcggttaactgactgcacccatctgggcaggtcgacaccctcgtcgttgagagcagcctggctgggggccttccctgtgaccagctcaagcaacagaacaccaaagctgtacacgtctgccttctgggaaaccctccgggaatcaataacctcaggtgcgcggtatccggtggtgcgagacgatgaagatgatggaccaacaagagtggtaaggccattctctgatacacgtgcttgatatgattttcccaggaggacattggatgacttgatgttaccatgggaagccgttgaggtcgttgagtggatgtactcaacaccacgggctgcagctagagcaatgcttgaccttaaatcccagttaagtggtgtcctgccagaacttacgttgcctgttcaataaaaatgagatgcagacagtttaagtgaggccaagtcacgaccaattgctgtattcatggtcagcaaagacgattgagaacaatacattaggggatcaaagaacaacttgatcgtatagtaccatttcacaagctacaatgaccccaactgattttcttctttaatcaaaccagaatattctaccagtaaagcagagggcaaagataactaaaatgaaaaatccaagaacatacaaccaatgatgaccaagtaatcaatgattcggaaagtttctcagaactagtaagcgaccaattagtgaaaagggaggcatgataacaaatattttattagaggttccatgttggcatcgacaaagttaacacataaatctgagtcagaactgaataaaactttcctagtaatagtgtaatacccagtaaataataacatataattcaagtgctttggataccaagcaagataaataacacctcgatcccactgattttgacttggtctccttagaccatgacaaagaaatcaagtcctattcacaggagagtagagagtacgggtattattaaaacggaaaaacaatttggagtaccttttaaccaacacgagccttaaacattagaaaatgaagcaatactctacccctaccacccaagaacatgcaatgcacatggtactcacaagcacacgtacagcaaaatggtgatgctactagcataaacagataatatgcaacagaaacctggggggtggggggttaagatctcaccgtgcaggactgcaggcaggctccccatgggcatgaagtcgtcaacaagtagcttctcatcttcgctgtagtagtaagcacggagtggcacaatgaactcgtgctgaagctcaccaatctcggaaatgcgttcacggaactcagcttcagatagagtcacgtccttgaggcgcttcacggccacagttgccccagactcgagcactgccttgtatgtcgtcccgaacgctcctttcccgagcacctcagccgacgcgcgcagcaggtcctccagatcgaaaggtgccacggcagccgctgacccaaagaagaccagcttcttaccggacgtcgactggccgataggagcgttggggtggcctattgtggtcaagggcgcaacagcagcgccgctggtcatctcgggaggtttcctgccgccagcagcagcagcagcagcaggcgcttcaggtggcggcatctccagagaccgcgtcctggtgccccccgacctgcgacagaggcagacgaggaggaagaggagaagtccggcgcccaaggcggagcctatagcgattccggcaatggcaccaccggagagcttcttgttcttgtggccactttctcccccatttccaccgatggtcccgccgctaccactaccgctaccgttaccgccaccgctactgggaacaggcgtcagcgacggtgtctgccccgctggagccggggaaggggaaacctcgccagggcaaggccccaagggtccgccgcacaagcccgtccccaggaacgcggagcgcggctgcgaccgaagtgaagccgggatggatccgttcagctggttaaacgagacagtgaactgctgcagcggcg

SEQ ID NO: 22846 - DNA, 1741 bp, Zea mays
tatcctagatccaccaccgtgcactgactagacatgctgcgcgtgtgtacgacaggagccgtgtgggcgacggcggtgggcgcgtccgtggcgtacagccggcggagggcgccggcgcgggccacgagcctgcgcctcatccacgccaggatgcacgcccgaccaatcactccagtttcgaaatagccacgctgaagacaagatccgtggcaccaggtctcacaactcacagcttcatgacaatgacaatgccgccatcaatcagctgccaccgtagcaccagtggttaacagtagaccaccaaaacttttcccaaaaagcatatttggccccactgaaatcacattgccaagcaactaaggcaaaccaaacgagagattaatccggcaaaaagtgaaaaaaaaaatccaaacgctagatgaggggcttgagtaattacacatggatagccgaaagacaagcagcagcagcagcagctacaaactaaaagcctaaaaccaacctgatcaaggctagaatgagcacagcaattgagcaatctcacactttagaactggtccctaaacacaccaccaatcaccttccgcagcacagggtgcgactgccgaacacccgtgctgcttagtgacgatcaggttaaccgttaaatccaacaggctaaaagatggggaaaaaacagtcgactcagtcgaagataggattcatcgaatgcgtgaatcgattgaatgcaggctagagttatagcagattctctctctctcaggtcaactcagatcaagtagcaaacggattggtcggcgccgcctccgattcagcctttgaagattgatcatcgacttgttcaatgttcggggtcacgcttgacttcttgatctcctctatccgcatgacaacatgcgccattgacggccgggcctctgggacttgtgctgtgcagtccatagcaagcagcacgagctgagccatgggctcctcaccagtctgatgtctcatgagctccatatcaaacactagtgaaccccactccgagcggttaactgactgcacccatctgggcaggtcgacaccctcgtcgttgagagcagcctggctgggggccttccctgtgaccagctcaagcaacagaacaccaaagctgtacacgtctgccttctgggaaaccctccgggaatcaataacctcaggtgcgcggtatccggtggtgcgagacgatgaagatgatggaccaacaagagtggtaaggccattctctgatacacgtgcttgatatgattttcccaggaggacattggatgacttgatgttaccatgggaagccgttgaggtcgttgagtggatgtactcaacaccacgggctgcagctagagcaatgcttgaccttaaatcccagttaagtggtgtcctgccagaacttacgttgccgtgcaggactgcagacaggctccccatgggcatgaagtcgtaaacaagtagcttctcatctttgctgtagtagtaagcacggagtggcacaatgaactcgtgctgaagctcaccaatctcggaaatgcgttcacggaactcagcttcagatagagtcacgtccttgaggcgcttcacggccactgttgccccagactcgagccctgccttgtatgtcgtcccgaacgctcctttcccgagcacctcagccgacgcgcgcagcaggtcctccagatcgaaaggtgccacggcagccgctgacccaaagaagaccagttct

SEQ ID NO: 22847 - DNA, 2351 bp, Zea mays
  misc_feature (1871)..(1872): n is a, c, g, or t
  misc_feature (1966)..(1966): n is a, c, g, or t
gcgcgcgagacggtgaagacgatggaccaacaagagcggtaaggccattgtctgatacgtgtgcttgatacgattcgcccaggaggacattggatgacttgatgttaccgtgggaagccgttgaactcgttgagtggatgtactctacacctcggcctgcagctagagcaatgcttgaccttaaatcccagttaagaggtgtcttgccagaagttatgttgcctgctcaatgaaatgaaatccagacagtttaggtgataccgagtcacagccaattgctgtattcatggtcaaggaagacgattgagagcaatacattagggcatcaaagaacatattgaccaaatagtaccatttcacaaactacaatgacctcaagtgatcgtcttctttaatcaatccagaatgttatagcagtaaagcagagagcaaaagtaaactataatgaaaatccaagaaaatacaaccaatagtgaccaggtaataaatgatttggaaacttactcaacttgtgggaactagtaagtgaccaattagtgaaaggggaggcatgatggcaaatattttattagagcatccgtgttgacatcaccgaagttaacacataaatctgagtcaaaactgaatgcaacttccctagtaatacccagtaaataatcacacataattcaagcgctttggatatcaagcaagataaataacaactcaatcccaactgatttcgacttggtctacgtagatcatgacaaaaaccaagtcctattcacaggagagtacgaatattcaaacgaaagaacaatctagagtacctcctaaccaacgtgtattaaacatattggggatgaaatgaagcaatactctacccctaggctaccacccaataacatgcaatgcacatggtacacgtacagcaaaatggtgatgctaatatcataagcagataatatgcaaccgatacttgggggacgggggattaagatctcaccgtgcaggactgcaggccggctccccttgggcatgaagtcgtaaacaagtagcttctcatctttgctgtagtagtaagcacggagtggcacaatgaactcgtgctgaagctcgccaatctcagaaatgcgttcacggaactcaggttcagacagagtcacgtccttgaggcgcttcacggccaaagttgcaccagactcgagcactgccttgtacgtcgtcccgaacgttccttttccgagcacctcagccgacgcgcgcagcaggtcctccagcttgaaagacgccacggcggccgctgaaccaaagaagaccagcttcttaccggacgtcgactggacaataggagcgttggggtggcctatcgtggtcaacggcgctacagcggcagcgctagtcatctcgggaggtttcctgccgccggcaggcgctggggaagaaggcggcatctccagagaccgcgttctgatgccccccgacctgcgacagaggcagacaaggaggaagaggagaagtgcggcgcccaaggcagagcctatggcgattccggcaatggcgccaccggagagcttcttgcccttatggccattttctacgccgcttccaccgttggtgccgccgccgccgccgctgccactgggaacaggcgtcggcgacggtgtctgccccgctggagcaggggacgggggaacctcaccagggcaaggccccaagggtccgccgcacaagcccgtccccaggaacgcggagcgcggctgcgaccgaagtgaggccgggatggatccgttcagctggttgaacgagacattgaactgctgcaacggcggtagcttcacatcggaaatctcgccggaaaagcgattattctcaaggagcaggacccgganngcgtgtgaggttgccgagctccgtcggaatgggcccggacaggtcgttcccgccgagcgagagcctgacgagccccgggagagcgagaatcgcntgcgggaacccgcccgacagcctgttcccgttgaggaagacgttacgaagcgcggcggcggaagacaggtcggctgggagcgcgccggagagcccgttgaggcggaggctgagcgtgtgcagcgccgtaaggttcccgagcgtccccgcggggactgtccccgagagcgtcgccccgggaagccgcagcaccgccacgcggccgtgctcgcaggtgacccccgtccacgagcacgcgcccgcgacgtccgaggcgttccacgccaggcgccgccccacggcgtcacggaacgccacgagcgcccgcgcgtcgctcgcgaggtcgtcggcccccgccagcgacgcgacgacgaggagcatggggaacgcgaaacggatgcgccgga

SEQ ID NO: 22848 - DNA, 1248 bp, Zea mays
tatggtcgtcgcgctggtgctagcggccgcccggattggtacattgttggcggtggagataatgcaagtggttccactgatacagttgtaattaatgcttccaagtttgtgtggtcagtggtcactagcgtctcagctagagatcctctagcttgtgagggtctcaccctttgctcaaccacagttgatggcgaaaaagttctaattgcctttggcggttacaatgggaaatacagcaacgagatctttgttttgaaatccaagccaagaaatttagtccaacctcgtcttcttcaatcagcagctgcagccgccgccgccgcttctgtgacagctgcctatgctgtaattactgccacagatgagaaaaccagagatattgttgctacagatgattttgatatcaagagagctcaacctgcaagtaattccaaaaagtttgttgctgaaattgatgtacctaatggagagactggtaaactagcggctagattggcagaggttcgcgatgaaaactcaaaactaaaggataaattagacatgacaaacttgtcatatggtgaattagcaaaggaacttaaatcagttcaagatcaactagcagcagagggttcaagatgccagaagcttgagtcccaaattgctgctgcacggaagagactggaatctgctggttctttggagaatgaactagaagtattgcatcaacatatatctcaggtggaggaaaccattgcaactactcagagaagaaaatctgggggtgtttggaagtgggtggcgggtagtacagaggtctctgacgatgaatagttgacaagcagcttccgaacaggaaacgtaagcggaggatctgctacagttttgaggcagcttgtctgttgccagttgccgggtgcttcctcaaggtcttgctcatggttgatctcgaaaatatgtctcccgaaataatcttgtttatcttcttcggtggtggcacctggtagaaaattttcctgggcagtcttagacattaattcaacagtaaaagcataacatcatgcaagtataccaaatactgagagcgtatcgcattggattattagcagcgctttgtttttgtcgtctggtacctattttttggctggcggttattacaagagcggtctcatattataaattattatatagggcgttcattggttgtgacgctgggaattgaggaaatatacattgcttataccgtaaatttagaaacatttatctggt

SEQ ID NO: 22849 - DNA, 2380 bp, Zea mays
gaacggcgcgcgcgcggcgactccgggctggggtctccgctcgtgaccacttccctcagatcaaactccgttatctccaattccctccctagcccagccagggaaccagtctcagtgaatcccgcgcccggatcaatctcgcccaaggaagcagctcttcacgacttgcttccagatccatccatccatccatccgaggttgggccgtgggggtgtcggtgcggtgggaaatggggaaggggatcagcggcgacgcccgcctcgccgcggcgccttacgaccagtgggtgctgctgagccccgccgggggctcgccgcgcccgcccgcgcgctacaagcatgctgcccaagtggttcaagacaagctgtacgttgtcggagggagtcgcaacggccgttctctatcggacgtccaggtttttgattttaagacatcctcttggtcagcgttaagccctgctagaggctcaaaacatcccaaccatgaaaatgatgccacaggtggatcgttcccagcattagcaggccacagtatggtcaagtggaaaaactatctcctggccgtagctgggagcacaaggtcgtcatcatcattaaataaggtttcagtttggcttattgatgtgcaagccaatagctggtctgctgttgaaacttatggaaaagttccaacagctcgagatggccaatcagtatccatacttggttctcgattactgatgtttggtggagaggataacaagagaaggctactgaatgatcttcatatacttgacttggagacaatgatgtgggaagaagtcaaatcagagaaaggtggtccagctcctaggtatgatcattcggctgctgtttacgctgaccagtatcttctgatctttggtggctcttctcactctacatgcttcaatgatctttacctacttgacttgcaaactctggagtggtctcaacctgatgcccaaggagcacacataactcctagaagtggtcatgctggtgctatgattgatgaaaattggtacattgttggcggtggagataatgcaagtggttccactgatacagttgtaattaatgcttccaagtttgtgtggtcagtggtcactagcgtctcagctagagatcctctagcttgtgagggtctcaccctttgctcaaccacagttgatggcgaaaaagttctaattgcctttggcggttacaatgggaaatacagcaacgaggagctctttgcttcagatctttgttttgaaacccaagccaagaaatttagtccaacctcgtcttcttcaatcagcagctgcagccgccgccgccgcttctgtgacagctgcctatgctgtaattactgccacagatgagaaaaccagagatattgttgctacagatgattttgatatcaagagagctcaacctgcaagtaattccaaaaagtttgttgctgaaattgatgtacttaatggagagaatggtaaactagcggctagattggcagaggttcgcgatgaaaactcaaaactaaaggataaattagacatgacaaacttgtcatatggtgaattagcaaaggaacttaaatcagttcaagatcaactagcagcagagggttcaagatgccagaagcttgaggtgctaaagttaaacatgcaattgattctctgatcctgaaaatacttattttccggtttccttcttatgcttctgattacttgcctttttatcctgaatctgtcaacttagtcccaaattgctgctgcacggaagagactggaatctgctggttctttggagaatgaactagaagtattgcatcaacatatatctcaggtggaggaaaccattgcaactactcagagaagaaaatctgggggtgtttggaagtgggtggcgggtagtacagaggtctctgacgatgaatagttgacaagcagcttccgaacaggaaacgtaagcggaggatctgctacagttttgaggcagcttgtctgttgccagttgccgggtgcttcctcaaggtcttgctcatggttgatctcgaaaatatgtctcccgaaataatcttgtttatcttcttcggtggtggcacctggtagaaaattttcctgggcagtcttagacattaattcaacagtaaaagcataacatcatgcaagtataccaaatactgagcgtatcgcattggattattagcagcgctttgtttttgtcgtctggtacctattttttggctggcggttattacaagagcggtctcatattataaattattatatagggcgttcattggttgtgacgctgggaattgaggaaatatacattgcttataccgtaaatttagaaacatttatctggtacccgagcccggaaaaaaaaaaaa

SEQ ID NO: 22850 - DNA, 1414 bp, Zea mays
cccaaatgttcggtttggagatgactaatgatgtgtggatgagtagatagggtcagtactctgtttctagctggattaggacggaccatagtttagtcccactgtttgaaaccaagcagtttgatgaagacaatgatctctgtcaactaaaattcgcaacctaactgatggaccactgtgcagtagctctaaagaacgacctccctcgtgctcggcagcacgacacggcactcatatgacagatcttggttttttcttgcaagacgttggcttcatccaaagaataccatcttaaaagggccctagttatgttccatttgagtaaaactccgccaaggatcctctcaaaaggaaatcaactgtgggttaacttcttaatgcacacctgttttctagatgaaacaagattaggctactttccttactgaaccgaacataagctggcactgcaatgaaactgaagtatataaaacatgagcagttgctttacagcatacaacgatggggatacagttggctgcatatacttggtaccaaccggccagtttagctgatcaggggctacaacaaaaaggccaaactaacagtagccttaggagctaactgtgggattgctagagctagacccattcagtcctcccacaagccttctctttgctgttttgctgcgatagcaccacacctcgaatgcctcggtgagatcaggatacctgaactgctctgcgttcttcatccactccgacaggatatcggcctggtcatcagacggcagcgctagcaccatcgagactattgcgctctccacattctgccacatgtctgaatccatctgcagagacatttcgcccttgctatttccatccagcgaacgttttgtcgtttggatataaggaagccatgtcttcaggagatggaatctagatggtgccgggagaaccactgtgccgtagccaacagcgtccagggcctttccagtcacttcgataagctttgccttgacagcccacaagcctgagctatacttgctgtcctgaaccactgaaagaatatggcacgagatttctgaccagccagaaacaaaggcatgcgtcatctcaatcttggtcgacagattagctacccagtcgatgtcagctaagctacacagaatccctttctctgcttgatcaggtgattgatcaaactcggttgccaacagatcaagcccggtcctaagtccagataacagttttgttataccttcctgcaccacagacccggccgcccccgccgtccccaccagagcagtttcatcgtcttcatggatcataaagtcagtttgctcctgagcagaagtcttgaggtcatccagaaaacgagggaacagcgtttccatgcacgtagcaaatcgtatggcagagatgaagacattctt

SEQ ID NO: 22851 - DNA, 1341 bp, Zea mays
acaatatacataagaacgacaagctgcacaatgagtattgaaacccattacatttagaatacatagagaaatcactgcaaggcttcaccagaaattgatttgaccccttttagagcttttgatgtctttgggttaaaatttggaaatcaagtcaagagtgcttctacataagaatttttattgtctctcattcatccacctattcaatcattcaacaagtgaaatgaactcaaccataaatacagactacccaccaaatgtacacaaaatttcagagcacaacagaaagagcacatgacattttaaaatacaatgacaatatacataatgaacgacaagctgcacaatgagtattgaaacccattagattttagaatacatagagaaatcactgcaaggcttcaccagaaattcatctgtgaatttcttttacaattgtgtcttcaccaacagaagtagtcggaagcaggtgtttatcttccaattcatcttcgtcagagttatcgttgctggtggtattggaaccatctgagaaacgacagtctccaagatgctttgtttcagttgactcaagccgcaagccttctggtagaaggcagttgcaaaaggcgcctagccttgcaagtcgattgacccaaccaggaattgattttcctgttaatctggtgctaagatcatctgtaaagtggttacagttcttggaaatgaggtggtaggtatctccatggtattctgaggccatcctctgaatgaattctcgaaattccaagggattcagagttgtgtggcctatgaaaaccgtacatctgtatatgaaccctgggcagctctttggttccacctcaaaaactccactcgatgggtgatcatgtgctccaaaactgtactccgatccatgaacttcgacggcagagtggaagatgccaagcccgccccagtggaggtagttgttgaccggcgtcaggtcgtacacgttgagaaccaccgggtaagttgccgcccccgccgcatccccaaccgccgcgccaccggagaccgccccgcccatcaggcccgccgaccctcaccgattttctcccctacctctgaggagatctcgcgcgcgccccgcacgccgaagactgactgaccgcgcgcgcagtcgcccccggcgcgcgaggcactagctactcgaggcgagatcgcgagggaccttcgatggagcagaaggggacgagaggcggatggagacgaaccagtcgacacgacgaccaaccgagcggatcgagagcgtgtccgggcgcaggtcacgcggcactgtctcaacggtgggatcaggagcccggccggcctcgagggtcc

SEQ ID NO: 22852 - DNA, 1399 bp, Zea mays
tccaatccacatagaattggaataacctaacaaggccttatatagaagattccaacactaacccctaaaggacatgtttgatacaagagctaattgttagctagcaaaaataatagctaaaattaactctagtacatcaaaataggagagctaacgaatgaattattttttttgtcaaatcttcaactagttattaccaagctaactaaccaaccgtagttaatttaagtttcttttttgctccttcttgtgacataacacatgatattctttaatacaaatggtacaaattctccgtgagcatattgcagctactagttcgaatagaaggcccccgcaactgcgagtcactcagccacagaaagaaaatataaattcaactacttcaagttgatcgccaaacgtaggcaaactttgctaggaatggtcaaagtaacgcaaaaggtgcacaactaaagtctagcaaaggtaaacttggggatgctagataagagacaacatatgctctactattgcattgatatggataaaaaatgaccagaagatgccctctacagctgcatattttcaccaatgtaaaaaataatcagtatgggaaatgctacagagatacctagccaatatcctgtcccccgtaaacaattgataaagaaccacctatcccactagcgctcttcagaattgtacttattccaagcctccttaacaagcgctcacgagtgaaaaagttagcctccctttatcgcaacaagtaacttgatatattcggaaagacagttatcaaattatcaacacaagacttgctttcgctagtcattagcaacaggcatacttccaaagattttacgaaaggcgtggccagagacgtactcacaatttagaatgagcaagcattttaaaacgcagtattactagatctgttaccagtctctcacggatgccaggttcgtacagattactaattcagtattgattcggtgttatttttgtattttctttgatgcagccagttttgggacatgatacactttgcatgagtaggctttttgtcaatcataaaatgaatgtccttgaaagcctgctggcaagtaagcctttgtatgacatgtcttattattcacactaatttgactatgatagttgtattgttatatccaaatgaacacatatcttacacattcagaaatgaacatgaagggaatgaaacagcaataggccagcaatgagaccgtaatgcatattccccatatataggtccatctaacagatatccatgtctggaacagagaatatggatagctgggtatgaatgcagaatatggtgctccattcgaaaggaaaagtcgaatgcttgcattataataaggatctgtgaagcaccacagcaatgcagaaacat

SEQ ID NO: 22853 - DNA, 1506 bp, Zea mays
gacataacacatgatattctttaatacaaatggtacaaattctccgtgagcatattgcagctactagttcgaatagaaggcccccccgcagctgcgagccactcagcctcagaaagaaaatataaattcaactacttcaagttgatcgccaaacgtaggcaaactttgctaggaatggtcaaggtaacgcaaaaggtgcacaactaaagtctagcaaaggtaaacttggggatgctagataagagacaacatatgctctactattgcattgatatggataaaaaatgaccagaagatgccctctacagctgcatattttcaccaatgtaaaaaataatcagtatggcaaatgctacagagatacctagccaatatcctgtcccccgtaaacaattgataaagaaccacctatcccactagcgctcttcagaattgtacttattccaagcctccttaagaagatcaaacaccttctcacaaatgtatttctgtctgattgtagcacctctttgctgcactttatctggatggacacaaagggttgccttcctgtatgccttcttgacaccagcagctgtgataaggtctgtgaggggaactgcctgccagccactgtctgaaccaagtatatattgcaatgtggacagcaatgctcgcagatttccttcttttccatttgaccatctcttgacttcaggatcaagaaattcagccagtctatgtttctcagcatgctccctctgcaccagcatatcccgcatattcttttcagcaagggctttcgccgctcgctcagctgtgcgttggtgcctttccaattttgctttatgtcgtagagctgactcaacctcgactacttcaacacaagaatccatgctttttccatgcttattataagccgtcttctgagatgatgcctcatgttgattgtcctgattaggtgccttaaaactatccttgaaagaggacctgaacttcccaattcgctcctttgcatctgcagcagcttttgccttttcaattgccctctcccgagcttcagcagttgctctctcaacggctgcacgttctgctttcattctagcttcccttgaagcctgctccacagctgcttgagcggttgccttctcttctttctcgtgggcttctgcggatgctctttgacgtgctgaggtgatcctttctaatgctattctttcagccttagctcgaacctcggcgaatgccctttcatgtgcttctcttgtagctctctgaacagcaagcctatcttttgctcgctccatttccccgtcccgctgttcttccaactctcttctttgtctctctttatcttgttccttctcttttcccattttgcattctttttctttctcttcaacaacttttacctccttctcgagttctccttcagcctcttttatgtcattcctcactttagttctctgaacattaagatcctcttctctggattttagaatagtttctgatgcagtaccttctgca

SEQ ID NO: 22854 - DNA, 2059 bp, Zea mays
tctagatcgcgagcggccaccctttttttttgttttttggggtggttttttttttttttttcaaaaaaaggtgaaacttgaacaagaatataaaagtgctagtcaaacatttgggtaaatcgcacagtacatgttagcttaaaagagctaaggttttttacagataggagcaccatggcgagttggcgagacatccttcagatgtctcctctaggctatatacgccttcaaaaaggccggcaaatttctgactactctgtctgttagccacttgactttgacagaagcgtttgccaccaaactgtcaatttcttcctcgcattgttcatagacaatgaagacaatgaacaaggatgccagtacaagtcccatcaaaaatctgaactgaaagttcagcattagtttgatgctgtacagaaatgcaaataccttcaaaagtaaactccagtcttcaccttctgctaaaagccttagtttatgaaaactcccattccatgcagaagccacacacataagtgaattcctcaatgctgagtgtgatacttcaaaatgatcagatgtgaccttctcgactgtaaaaccaaacacttctgaaggcagcacaccatggataaagagagcaagcgagagcactagaagaaatttggcagctgatgaaacaaaagttctgtctgaaagcaggaaccagtagaaaagcagaaacaatactgtgacaaatgaaaaggttctcttttcatccctccaaagaagaatatcagcagctgttccacttcctagcagcttatctgccttcgaggatccacaggagccctgttttcttgacaaccccaaattatctgctagttctgaaaatgacccaagagttctcataattccatcctccaatgatacaattgggtggtatccaagtaatcttctggctcttgaagtgttaaaggttctcgtacacgacaagaagtatattgtatctggatgaagaagaggggtggaaagcatttgaaaaccaagcctgtgatgaatcattttggagaacaaggctgcaaacaataacatcttggcaggaagattaatcctgggcctctgacaacccatggcttccatcatgcaattcataaactcccatgtttccataggttcgtcattggtaacaaaaaaagggcttcccagctacagaagctgcatttgaagacaaggcttgctcagcacaaatattggcatgggccacattttccacataggtaaagtcagacatgttactgccactgcctattacaaacttgcccaagggagaccttgcatatccagcaacaaacctcaccaagctggaatcacccggaccgaaaagattgctaggtcgcagcacgcacgtcctcaccccgtccaccccgtccgcacccagcaccatcatctccacctgcgccctcagctcgctcatcgcattcccgaacttgtcagggtagggcgcggagtcctcgtccgcgtttatcacatcccgggcaacagcagcgaccacgtcggctgagccggtgtacaccaccctcccaaccccggccgcgcggcaagccgcgagaagccgcctcgtgccctcgacggcgaggcggtggagggagaggaaggacccgtcgctcccggaggcggccgctgtggtggcgtccacatggaagacagccgcggcgccggcaagcgctgaaacgaggcgcgcggggtccgagaagtcgacgtcgtggtggtagacgatgtgggaggcaggcggtccgggcggcggggacggtgaggttggggaggggtcgaggatggcgacggcggaccagcggccggaggcagcgagcgccgcggccaggtagcggccgaggagggtggagcgtccgaacgtgacggcgcaggtgggcttgggcgcgggcggggacgggccgggctcggcggtcgccatcggtggtggggtggaaccgtgggagtgggacggaggtagggaacaggaagaaatgggggcgggggaggggagcacgaggggttttcgtttcggacgttcttggcaatggtctcgtgcttttgttttact

SEQ ID NO: 22855 - DNA, 1577 bp, Zea mays
  misc_feature (30)..(30): n is a, c, g, or t
gagccacagcaaattttactatacaaccancagaattggaaaacaaaaggtacagacttcactggaatttattggatcacaaacatatcaatcatgcctatgactaaaatgaatgaacaatctttcttataatacatgccttttgtgttcatgagtaacaccaagatacaaatctgaactcagactgagatggctaatggtacagtggtacagatgacttactattaagtcagcatttccatgaatgtcacttatgcttgcatcaagatatctcccaaggaaagaccaaacatagttgacacagaatgagttcgacatggatgtaatacagtgcatccattgatgagacctcctgaacttcaggatattgagagttggtagcggtatattttcactactcaaactgaatcaccaatgtggattaacttgacactggcttcctagtgatccggtttgttgtctgcatcacttcttataagtatgctgccttattcgagagtcagttcaagttttctagttccatattgccttcctcaagacaagctaggaaacaacctattcaattcatacagtcgcatcctccaggcttgcttcatacatgcattaagcttaggaagaaggaaatgaagcaacctcaagaggacaaaggagctagccaatgcaagacatgtatcttgatgaagtaatcggtctggtgaccttgcccacgataacagagaatcatccttttcagcctttttgccatgatcaactatagtaactgaatcctccattctctccaggcatgtagcgtccaatgacacaggattcaggcctgtaacatctttatagaacatagcaacggaattcatggcccgagatccatgataacgcacacgcactgtagagttcagaaggaaaatcgtcgggaatgcacgaactccataccttgacaatactcttggtttgatattagattcttcaaaagaaaaatgagcaattgttgggaaaaaggatgacagtttttgaaaatctgtcctgaaaattttagaaaaagggcaccacgaagcataaaaaagaatagcgacaaaatcctccctgttctgcagcacaagtgctactgccttttgcagggccccatcatccccctccacgaagccggcgcggtgaccccggagccctggggcgtccaccgctcgacaggtggacgcctgctgcaggatgacggcggcgacgggcggcctctggcagaccggcccctggccagcgacggtgaggagggggaggaggaggagcgccgccgccgacgacatggccgcgcccgccggaggaaaccctagcagatcgcgagcccgcatggcgcgagacgtcgcgaggcctctggttccgagcgagcggagggaggaggacccggcggggccgcggggcgcggtagtgggggtagggcaacggtatgggaggagggaggggagccggaaacgacggcgagctagctcggtcgccccgtttttcgctctctccccgtctggttgtgggcttgtggcaatgtggccgtgtggcaccgctcgagaaaaaaaaagcgctggctcaggcgtggg

SEQ ID NO: 22856 - DNA, 3547 bp, Zea mays
  misc_feature (41)..(41): n is a, c, g, or t
cattgggtacctcgagggccggccggggacgcttggccccntctcgtcagccacaatagtaatgcttagtacccgctagaacttcctcgttaagctgcttcctcctattaaacacgtcttccacaaaccaccaaagagttgagctgcttgcttgaattcccggggttatcaaaaggggggcttgcttgaacttaaagccctgcgccatctgccccggagcgccgccgcgcgagatgccccccaccgccaccgaagccacctcgtcgtcggcgaccagtgccacctcgtccacggatgccgacgccccgggccccacctcgccatcgccgtcccggcgcgcggcgcccactctgctcctcgtcgccttcctcgccgcactcctcatcttctccaccggcgacgatgccacggcgcagccgctcaacggtgtaagcttgcaaaacccagaggtttcatttgttccctcccccttggctggacaattttgtgagcgagtcctactatctggagtgccaaggttacatcttgatagttatgcaagccaaattcgtgtcaaaatgaatgtgtctcaatctattcctgataagttccattggaaaatagaggtttgctttcataggaatgcctctatgggtttatgccagtgtgaggcgggtgagtggcaaggttttcaaggtgggatgtggactgctgtaagttctccatatggaaacaaatatgttgatctgaaattggctgataagaaacctgctaggttcactctttccattcaggaagagtttcagaaatggcgtctggcttgccttggtattggatttgtattgctattcctgtcaccaattattagcaaatgggttcccttttactatagcagctctatggctcttggaatcctggctgttgttcttattgttattttccaggggatgaaactgctaccaatgggcaggaagagtttattttaccttgcaatttatggatctgtgttaggtgttggttcctatgctgtacactacttctcaacattggtctcttctattcttgaaaacttcggcttgagtgaagagttatacaaccctgtttctatcttcctgctggtagcaattgtcttgactggagctggttttggctattggatggtcaggagatttatcctttccaaagatggaagtgtagatgctgggatagcacagtttgtgaagtgggctatgcgtgttgttgctacatttttcattatgcagagcacacttgatcctcttctagcactggttgctcttgcttttagctggtggttatgctctctgttgactacaaagaaagttcagaagaccatgacccagaaacaaaaacaatcaaaggttctttctcagcaaatgcttactcaaggattgcccacgggtcctaaaatccagtttttaagtccatctaagacaggctttggaggaaccacatctagaacttccgccacacagtatggtcggagcaatttggccaatcgaggtctggtctgctcagcacttgcaaagcgtgcagtgcccaacgaagacgaagacgaagaccactactccaccttccacaacatccagccacggaaatataccaagcaggaatgggaggacttcacccaggaatcgactaggaaggcgcttgcggagtgcacagcaaccccagagtttgcccagtgggtcggtgacaacgcgcgtcgtctgcaagtagagaaagaggaggacaacttgtcagaggaagagatcatggagagctccagctcgtcggaagaaactggggatgaagctgatggagctcctggcctgatcagactgtggggctagcatgccggttgaacttgtaagagccccaagcatatatgctcctgccatttcacgtgtaaagagtagcaaccggtcattttaactagtgtagcagcagggtagggtggtagcagcggagatgctttcgcagttgttcggtggcagtagctggctagccatctcaggtcaattgatgctaggtttagctaactgtctgttatcagcggattcttagttctctagagctgatatatgtgtaatggtttaaacaatctaatcagtgactggatccagcattttgttgatctggttggaagttgggtcgttagcatttcttggcgctccatttcgacggatggactcgtggacagcatgtgtgtagacggtagagtggatccctcactgtgcagatgagataaggtcggcgagatgccatgcagatcgaacgcgcgatgtggtgcgaaagccaaatgcggatgagatgagataggattgtcgctgcttgaaggaacttggtagttctcggcagatcgaaagtgtgccgtgctgcgaaaaccaagtccagattggatgagatacgactgttacctctctttcggttggatgggaggatcttgacgaaagggtagtagccatattctttgcgtctgcacacactcatctgttctatctaggtacctgtcatgtttaaacatcataaagctcattatagtttatattatcaaacttagaaagctcctgagcaatgatagaggtagcgatgggcccctatactttaaagaattataccattctttcatcttacgattggggttttaccccttgccttttattggtttaatcaccaaattttgattttcactaatggtgttaaggagaggggtaaacagtgaagcctttaaaacaaacagcaagtatgacacattggtgaagaatcaaaccacagttggagacgcaaagcatctccgtttcacacgcacacatgggcatggaatggaaggcacgcgcgcgcacacacacatgtaccattttactcgtttgcttctctccgctactgaaaaaacagtttgacatgttattcaacttaatcagttgtgtattcattctcttcttccaatttgtaggatatatatatagcaataattatagattaaaaattaccaagatgccgacagggcagcaggtgaaatagagttcgcaatctgcaacgtgataggtttaaaccatttttttcgaacagatatcattttttttttcaatctgctaaacaaggtgctccctgaatatggccataacactaacatttgcaatagtaagatagttatgtgaatactccctcctcggtttcaatttataattcgtttgaatttttaccttgtgtttgaccgactcgtcttattaaaaaattcataattattataaatttttagtgtagtattgtttagcatataatatactttacttttggctttgcattttcagtttttcgcgaaaaaattgaataaggtgagccggtcaaacttggtctaaaaatgtcaaactaattataaattcggttggagggagtagaaaatattgaatgttactattagtagatgataaatattactgcgagatgtggcgggtgctgcaaaatagatgtggtgtaaaatggttacaatgagaagtagtgttgctcccttaagatactaagctatcaacagtaacaaatatttcaaagtgtattggtttatctgcag

SEQ ID NO: 22857 - DNA, 1349 bp, Zea mays
tgcagctgcagttcgttgacacaggcagcaaatgacttgtactgctgttcggctgtagcacatgaagatgcagccgtagccagcagagccaaacaacttagggtctgtgagagctgatcgtcctgtaccgcacgctgggctcctccaactgcctgttagctacaaatagacaatggctgaaacgcttgtcagtgtcacagcaagggtgagcaggccagcgttgaagatcggtagctggggcacggtaaatcgcttacaagatcctggcttcttttttggagagataataataataataataaaagaaaacttttttcacagcctcaattcgactttgttttctcggtcttcgcgtgctttgcatttgcaacagttcaacaggtccacaacttgtcgacaaaagcacagcacaagaggaactgagaatctgatttactagctatgttccatgtcattgtacataaactaccgacttgtgaaacaggaatcattaaccaatgcaaaagtctggttagcttctctgcagactccactagtgaatatggtgtgcattcactatcagtagctggtactcaaaataccatgatgccagcaaaatgcctcacagataacacaggcatttgctctttgaggtacaagaccctccggtctttactcttttgatgcactggctccagggcgtttctttccgccatacctctgctttccaaagctgaatgggacatacttgtacttgaccatatgcataatttgtcgcttcattgtcaggacaaagagcacaatccaataacagagaagtattggccagaagacaggaacatcgaatacagagaagaaggtcatgacgaaagcaatgcaaaaggcttttgttatggcataccagaacttgaactcggggaggcggcggacgaagggcttgaactcttcggagccgcgggtggggagcccgggcccggcctcgagcgcctcgagctccgggtcgaccatgggggagaggaagccgatgaggaggttgagcaggtagatgcccagcccgtaggtgacgacgtagaagccgcgcacgtagtagacccgaagcgcgtacaccgccgcggccacgagcgtgcccgcccaccgccccgccgtgtgcggcgccgcgcggtccaggtagtgctggaacgcccgcgacgcctccgcgcgccaccgctccgccgagccaccgtcgccgacgggggagggctccatggccgccgccgccgccgcttgggatccccgggcgggtgggttaggtttcgagcctggagggctgagtgggaatcgcaatcgcgagcgagcagactgcagacgaagaggatatcacatcccggccg

SEQ ID NO: 22858 - DNA, 1115 bp, Zea mays
agagaagaaaaaaaagcagctatgtttcaccgccattttttttttttttttggctacgaatcgctggtactagtatgcagtcaatgttggaaggtccaagtaacaatcgctggacagtttgattttgtcctctaggtcctggatcacaatgcgtttgcaaggatccaacaggtccacaacttgtccacaaagggacagtacaacagaggatccggaaatttgatctactagctatgctccatgccattgtacataaactaccgacacgtaaaacagaaatcatcaaccaatgcaaaagtctggtcagcttctctgcaatctccactctccactagcgaatatggtgtgcgttcactatcagtagccctggtactcaaaataccaccatgccagcaggatgcctcaaagatagcacatgcactgctctcgaggtcccacaccctccctccgtctttactccttagatgcactggcggcagggcctttctttccgccatacctctgctttcctatgctgaatgggacatacttgtacttgatcatatgcacaatttgtcgcttcattgtcaggacaaaaagcacaatccaataacagagaagtattggccaaaagacaggaacgtcgaatacagagaagaaggtcatgacaaaggcaatgcaaaaggcttttgtgacggcataccagaacttgaactcggggaggcgacggatgaagggcttgaactcgtcggagccgctggttgggagcccgggcccggcctcgagctccggttcgaccatgggggagaggaagccgatgaggaggttgatcaggtagatgcccagcccgtaggtgacgacgtagaagccccgcacgtagtagacccgcagcgcgtacaccgccgcggccacgagcgtgcccgcccaccgccccgccgtgtgcggcgccgagcggtccaggtagtgctggaacgcccgcgccgcctccgcgcgccaccgctccgccgagccgctggcgccgacgggggagggctccatggttgccgcttgggtgggttaggtttcgtgcctggggctgggggactggtgggaatcgcaatcgccagcgagcagactgcaaaaagagctcacgtgtt

SEQ ID NO: 22859 - DNA, 543 bp, Zea mays
  misc_feature (505)..(509): n is a, c, g, or t
  misc_feature (511)..(521): n is a, c, g, or t
  misc_feature (524)..(525): n is a, c, g, or t
  misc_feature (527)..(531): n is a, c, g, or t
  misc_feature (533)..(535): n is a, c, g, or t
  misc_feature (538)..(543): n is a, c, g, or t
ggttatctcaggtacgagtctgacgcccaacaagtccttcgtgagggtgctagcgtcatcagtccgcttggggttggcacattgctgggaagcgacacccgtcgttgtctcaggtgcgaggacaacacccaacatgttccccgcaggggtgccgacgtcgtcgactcgctctggtccgataaccgatgaggtgccatctcctgcctggccacggttgccccgtctccccctcctccggcgaggagggtggcggggcaaacccgggtgttcctcttccgccacggggggaagtcgtcgtcgagttcgcctccgccgggcgagccgacgaccgtcgttgttgtcgtgctgcgaggggaggagtaccatgtcatagctgccgtcgggggacatgaactcgagagtcccaaagcagagcaccgtcccccgctgaagaggctgctgaaggctacccatctggaactcaacgggaaagtgtttgtcaacacacagcagatccctgcccctnnnnnannnnnnnnnnnccnncnnnnntnnnttnnnnnn

SEQ ID NO: 22860 - DNA, 3544 bp, Zea mays
tgcatgcctgcagactgggaacactagaagccacatggtgatagattgttcaattccaccattccatgtgaatcatacagaaagcagatgactgctggcaaaaagaaagaacatcatgatatataactcaaaaggagtgaaaatatattgcactataaaattggaacatcaaaaggtgaactaatattcaataggaaagcaaaaaaatgcataatgaaaatggcacaaaagcacatagttccacaaggaaatgcagcctataattctcagaaaacgcattacattgtacagcagtagctactaaattctgatggagcaataaaaagctttgaacctagaacaataccaagtaattagtaccactgaagtggttgttttccagcagccaaataattactgataaataatcgaatacataaaaggggacaaatgatttcagacgcgaataccatgagacaaatttagctggttggttagtgaagggtgagtcaccaatggcccaagccaagtacagttgatgcaatggaaaactgacacaaactcggcatatcttattatcacttctacagattgaatctaaattggatagtatctaacatcgcaatcatatcggacaattgataatttcacatggacctgtgacaatcgtgggttatttggttggttggtgaatgcctggatggcaaatattagctagccagctattcaattgaaatctagcacaaaagcagcatattgctatggttgccgtatagaattggatccctagtaattaggtaaagtagctactagcaatcagctcagccagacatccagtgcggcggcgcctttggactaatgaggtcaggacagaaaccgcttttgttatggcataccagaacttgaactcggggaggcggcggacgaagggcttgaactcttcggagccgcgggtggggagcccgggcccggcctcgagcgcctcgagctccgggtcgaccatgggggagaggaagccgatgaggaggttgagcaggtagatgcccagcccgtaggtgacgacgtagaagccgcgcacgtagtagacccgaagcgcgtacaccgccgcggccacgagcgtgcccgcccaccgccccgccgtgtgcggcgccgcgcggtccaggtagtgctggaacgcccgcgacgcctccgcgcgccaccgctccgccgagccaccgtcgccgacgggggagggctccatggccgccgccgccgccgcttgggatccccgggcgggtgggttaggtttcgagcctggagggctgagtgggaatcgcaatcgcgagcgagcagactgcagacgaagaggattttcactcccgactcgcccggacttcacgtgctataaataaatataccgaaacttaaatcccatccgagattcttgagcattgatttcatctcaatcttcatgaatccggtttaagcttccaaactaatcctaaagtttttttaaaagaaaaatgtcaaatactgcagtctacaacatttttgttgcctatttctcaacagcaaacatttttttaggagtatgtataaagtgttacagatttatatttcaccctatttcacgaaaaccacacttttgcttttcacaaacaaatacaaaagaacgaaaagagcaccagtctggtgggtgggaaatggatttgtgaaatgttattactacaagataaacagataatatggttcttcaaaacacaaagaagaagcttactctaaacagcgaagcgtgatctctaaatgacagggaaactacggagcagcttactgcaattttactaggccgtggtctccactttgcctaaaaagttgccccaagactagttttgattaaactgtagaagttttggaaaggctgcaggctgcagctatattccgtttaattatttaatttctgcaattacgttttctaaacattgacgtagcaactgctacttaaaccgcctcgagttcagcgagcgggtttagtggagtctgggctacaacaattagagattagagatggcaacaggtatatatttattatcggattatctatatacgctcttagtactaaatctactcatacttataccccatgctccatgggtaacccatactcgctaagaagatcttaaattataatattccgaacactcaaatgtcaaataaatacataaaaataagtttaacctgaaatataacaaaccaaatgattacataacttgaaagttaaataaacgatagtcgaaaaagggttttattttaattttattagataataatagttgtatggtacagatatattttactcacggatatacggtgcgtgtatcgtaccgtttatccaacgggcagggattgttgttcattaacatatccaccaatataaaaatcatctcatatccacctacataagtattcgggttttcgacacccattgccatctctaactacactacaactctacgagacggtagacgggtgaaaacaacgctagaaatcggaagccatgtcttcatctccacctccttcgtccagctcgctatcttcatccagcttctcgcattcgaacagataaggcacgttgtcctctgaattatccttggtgtcatttatctctatgatgcggatcatcttctcgcagatcgacgactgaacagctcctccagagacgtcttgttcggagcctagcccaagaagcgcaaagcattcgccttggaactcttcatcggtggatgacaagatcagcccagcgattgattccgcaaggtcaggaacgtattcacgaacctgaaatgacataatgaaccgaatgatttagagtgcttattatgatacaacctgaaatgatataactaacatatggtattcttttcatgatagaattttatggtgcttattatgatgtcacgcttagcttatctttctctatactaactctaataaataggtgaccatttgcagcgtagttgcgtagttgatagaataagacaaattgtcctaagtgtatgatggcactttagccttagcttctacccaaatagcaacataatttcttcagtccaaaaaacatactgaataagttaatcaatagtagtaaaaaactaagaaatatgtacaaagtgcataccctctggccatggcaactaagaaaatctcctgcatgatctgctttcaagtgagttagagcagatttgagtgccttcctcaaaaggtatctatcctgtggagatccctgccgttcttgcatagcagtggctggagaaagtcaaggatagacagaaaatccaccctctacatatagattgagctttcactgaaaaaaataacttgtggatgaaaacaaaaagaggatgaagtgtgcaaactggatatcattcgtggtaagtatgaatggaaatatcaatacgagcaaatgccatgttatcccactcgagaacagcgtttccgtcatcacccatcaaacctccttttaacttgaaaccatagctttgccagtctgtgctcatcaacacatcaaaagaggactgcaatatctgac

SEQ ID NO: 22861 - DNA, 1568 bp, Zea mays
ttttttttttttttttgtccattaatatacttatcaatataaaaatcatctcatattcatctacatatcaagtcaaaccggatagatattcggaaccagatagatattcgggtttcaggcacccattaccatctctaactacaatacaactctacgagacggtagacgggggaaaacaacgctagaaatcggaagccatgtcttcatctccacctccttcgtccagctcgctatcttcatccagcttctcgcactcgaacagataaggcacgttgtcctctgaattatccttggtgtcattcatctctatgatgcggatcatcttctcgcagatcgacgactgaacagctcctccagagacgtcttgttcggagcctagcccaagaagcgtaaagcattcgccttggaactctttatcggtggatgacaagatcagcccagcgattgattccgcaaggtcaggaacgtattcacgaaccctctggccatggcaactaagaaaatctcctgcatgatctgctttcaagtgagttagagcagacttgagtgccttcctcaaaaggtatctatcctgtggagatccctgccgttcttgcatagcagtggctggagaaagtcaaggatagacagaaaatccaccctctacatatagattgagctttcactgggaaaaaacttgtggatgaaaacaaaaagaggatgaagtgtgcaaactggatatcattcgtggtaagtatgaatggcaatatcaatacgagcaaatgccatgttatcccactcgagaacagcgtttccgtcatcacccatcaaacctccttttaacttgaaaccatagctttgccagtctgtgctcatcaacacatcaaaagaggactgcaatatctgacaaggtacaaaatcttcaaagtacaaaacctgcaattgttgcagccaacaatggcataaactataagctcagttgaatcatgcttaactctaatatactttacgagagttattgtactgttagtaagtaagttataagtcaaacgaacaagtcatttccattgtcaaattaaaataagattgtcttggcatggggaatgtaccgcactagggcctaggagaaacaaatatttaggaaatgaaaatgtataactaaaaccttcgtggttcaaacctgcgtggacaagcaatttgccatgcaacaatctgaatcagatgcaatatgtgcaatcactatgactacttcaacatgtagtcggttagcttttcttctttctacatggtttgctgctccagttccaatctttagaagatctctgaagtaagaaggaagaaaaactaaaacttactaatcatgttatggaagcacaccaatctgtcctgacccgtgaggatgcataataccacactcagatgatatgcaagtgttcattagcatgccaatgagtgaatagacaacagaccagactacataaaggtttcgacataggagcttagcacatgcatgccagaaaggccgagagaatgggcttgggcttgggcgtgggcgtgggcggctcgtgccgggcaaatacacagtggag

SEQ ID NO: 22862 - DNA, 2037 bp, Zea mays
ctgcggttttggagaacctgcatctcctatgggttttgtatagctcactttgctgatttctttcctgttttgtgtctgtggcttagtcgtcctgattttaagaaactaagtgaacacaatgttcttgttgagtttagttccgttgctagagagtcatatcttgtcttagctgctctggcacaaaggttaccacttcttcattcagtggagcagcttgccaatcaagatctgggagtttctgccagttatattgagacatgttcttggagccatgttgtcccgatggttgacttagctttatcttggttacatcttaatgatattccctatgtatgttcactaatcagcgagcagaataggaatacagagcacatgttagagatgagttatctgattttggtgatttcttctgtgctaggcatgcttaattcaattttggaaagaatatcaccagatgtcactcctgaggataaaagttacagcttgccctggatacctgattttgtccccaaaattggcctgggcataattagtaatggttttttcagctgttcgaccactgttgctggtagaaatgcagaacatcagcctttttgctgtgcatctttggtgcagggactttgttatatgagatgccatggtaatgttgatgtatcattgtcttccattagctgccttcaaagattggtgcagctatcctggtctgtcgacagagtgatccagggagccacaaaatgttgttccgagtgtttcaatgagtctggaacaggtgaagctggcaaactactagctgaaggtatctccagtttatggcataatgatttgctacacttgctgacttcgcttttgccaatgatttcatcacaatggtccatatcacagaacatagagatgtttggtagaggaggaccagctcctggtgttgggtttggctgggggacatgtggtggagggttttggtctcttaaatgcctacttgcacaattggattcacaattggttgtagaattgatcaaatgtttctcttcagttcaaggaagtcctatcatcctcgatgaaggtgtgaagttagataatgtgactaacacagttgtgacagcttcaaattggatcagttctaccctagggttgtctctgattgctggacctggacaaatctatatgttggagaaggttttcgatatgatttttgaaccttccattctgaagtatctcaaatcatctatacataaatttacctctaacatggaattactgaaaccttttgaatgggacttaaatgaagatgaatatatgctcttcagcagtgttctcaaatcacatttcagatccagatggttagccatcaagaagaagcattcagataaatatgcaggagataatagcagcaccaagatttcaaaaacaccagagatattggagacaattcaagaagaaacagagttgtcagaagctgtaaatcaaccttgcaacacattaatggtagagtgggcgcatcagagactgcctcttcctatccactggattctaagtgcagtttgctgcattgatgatccaaaaggcacactctcaacatcagccaactatattcttgatgtctcaagggctggtcttatcttccttttaggtctggaggccatttcagctaccccgtgccttcatgctcctttgatctggaaaattcatgcactttcggtctctatccgctctagcatgcatttgctacaggaagacagaagtagggatattttctgtgctttacaggaactgtatggcctgcatctgaacaggttatgccaaaaattctgtaaaccaaactctatcgaggaagttaagggcgttgtagtgggcacttcagaggaagcgatggagatcagtagccttgaaattctcaggtttcaggagaaaattcatggaagctatactacttttgttgagagcctggttgatcaatttgcagctgtctcatatggagattttgtttttggtcggcaagtggccatttatctgcatagaaaggctgagccagcagtgggc

SEQ ID NO: 22863 - DNA, 2636 bp, Zea mays
gattataaacctcctcattttctactatgaaaacatgattcgcggccttgtcgttccgtcttttttcgctctgatatgtgattcaattcgacatacgcaaattctgaacatctcttgaccaaactgcatcggatacgtccgatgtccagaacgatgtattcttcgcaacaggcaccaaaatctcgtcaagcagcagctatacaattctagacagacaaaagaaacgcgaggtatgcctgccgcggcaatctgctgcgcacggtcgtcgggccgccggctacatcaagtaaccttcgacgctaccgtcgtccgaggggcgaccgtgctcgctcatgctccccctcagcctgtagaagctgcccctccccttggtgcgcagcgggccggaccagtcgtacatcgccagggactcgatcttgtccagcaccgcgctcgacgccgaccgtggcctgcgctcgtcggcgccggcagggtccgagccgtatcccagggggagcgccgggcccggagtggccggcgggtcgtcgttccacgagctcctgctgacgtcgttccacggggactcctctgttgcgccgcccacgaaggagccgctgcaggtctcgtcgccgcctccgccgctgtggatcagcttcagcgcctgcacgacctcgcccatgaacggccggtgcgacgcctcgacgtgcacgcacatggacgcgatggccgccgccttggccagcttctcgaagtcgtaaccggccgggagcgacgggtccaccagccgctgcagtccttcccgcgtggtgaggagcgggcgcgcccaggtgaccaggttctcggaccccggcggctgggtcatgtccacgggttttcggcctgacagcagctccaggagcaccactccgtagctgtagacgtcgctcttgacaagcagatgccctgtcatcgcatactctggggcaacgtacccgaaagtccccatgacctgagtagaaatatgatccatcccatctgatgcttcctttgccagcccaaaatcagcaaccttgggggtgaaatcgttttccagtagaacattgctagccttgaaatcccggtgaatgacatgagggttggcgtcctcatgcagataggctagtccccttgctgcgccgagggctattttcatcctagtgtcaaaatcagtcgggccatatattttatctgagccatgtagatgagattcaacacttccgtttggaacgagctcaaaaaccaagcaccttgtgctccgctcaatgcatataccaatcagcttgacaaggttgcggtgatgtagacgacttagcatctcaacctctgcaatgaactcgcggtctctgttttgatgtttccttgtgagcaatttgacagcaacctcaacaccatcttcaattacaccacgatagacgcgtccataacccccttcgcctattattttgttgaagctgaagttttctgtggccttctcaagctcagttattgtaaatgtcttcacggtggatgggcaggttcctattgttgaaccaaatgatgctgccgagctgctcgtaccagagaacgatgacctcatagctccttttctagtgatggacgaacttgaaatagggcccatagcatgagaatcccggcggccattgaatctccaagtgatgccaatggccaagcacgtcaaaacaaaaaccacagctgatagagcaattatggcaacagttttagagttaatcttgtggtgccttctattgtgtatatttgcaccaaaagggtcctcattactgcttactggacccaatgatccaggaataggtactaaagaagcaaggcctggataatgaacatatgtagcaacataatccaccaataagtggatgagtttattggcaccttcctttgcaaaaatctgttgctaatcagtaaggctgaagtcctatcaaatttctggccataatggcaccaaatcaatggtcactgttgtcttttcaggatcttgaagactactcccagcacccattatccgaacttgactctgtttcaagaatgtacctgctgccacctcgatttctaattcatcaattcttggaaacaattgatacggcgccacaccaagatcaagctgaatttgcataggatatacacaaccacagggtgaaccaattggagtcgacgtaagtggagcagaacaagttgttctgctgcaatcttgtctttctggcgaaaatgatgaaggtggtggggaagcatggtgtcttcttctgtgatgcctatgcactgggtgagcaataatggcgccttcaggttgaggagaaggggctgggccaggggctagtgcaggaaagcgatgctggtgggttctactccagaatccgaataagtatgatgcaagacttgttgagcttgatgttcccagttgcacgcagagcacgacgaggaggaggaggagcgccgctccccgcggcggcatcgcaggacgtcgcgggtaggagaggcccggctcaaggcgacgccgccatgtggacccctggcgggggatcccagccgagcaaatccgtctccttcctcgcgctctgcttccgcagcgctgctgctccttcctttcttttctttttttttcctcgccagagtcctttttggttctt

SEQ ID NO: 22864 - DNA, 1246 bp, Zea mays
cccacgcgtccggaagctcttgaaaccgcgcgtccggaggcatttgacaaactggttgaggggggaaaaatttctcctgttactgaaattacaccgcctctcattcctgaggaccttaaaactgcaatcaagagtgggaaggtccgagctcctacccacatcatctccactatttctgatgacagaggcgatgaaccatgctatgctggtgtccctatgtctacaattattgaacagggttatggagttggtgatgttatttctcttttgtggttcaagcgcagccttcctcgctattgcactcagtttattgagatatgcgtcatgctttgtgctgatcatggtccctgtgtatctggtgctcataactctatagttactgctagggccggaaaggaccttgtttccagcttggtgtctggattattgacgattggtccccgtttcggtggagcaattgatgatgcagcccgatacttcaaagatgcatgtgataggagcctcacgccatacgagtttgttgaaggcatgaaaaagaagggaatccgtgtgcctgggattggtcacaggattaagagcagagacaacagggataagcgtgtgcagcttctacagaaatatgctcacacacatttcccttcagtcaagtacatggaatacgctgttcaggttgagacctacaccttgtcaaaagccaacaatttggttatgaatgtcgatggtgcgatcgggtcacttttcttggatcttctatctggaagtggaatgttcaccaaacaggagatcgatgagattgtggagatcggttatctcaatgggctctttgtgcttgcacgatcaattggcctgatcgggcataccttcgaccagaagaggctcaagcagccactctaccgtcacccatgggaggatgtactgtacaccaagtgagaaagccattctttgcaaggcataataaagtattattatcgcctagagcttccagttgcctagcttccagttgcctgtacacttcattaaatcgagcacttgcaaaaaagaaagccagagagaggaagacgaacatcactagtcagcactagattgtgtgttttatgttgagttgcaaattcaggtcctgatttttgtcctgccatgaaccgttaggcgatattgtattggaaaggatgcttccgttattgtttcacgatataccgcctcagagtagaagtttccagtaaaaatgaactctgatttgttcgtcgat

SEQ ID NO: 22865 - DNA, 1322 bp, Zea mays
cgggtcgagccacgcgtccgactggatgccaagcgtgggggtgagttggaatcagcacaagctaagaatcaggcactaagggaagctggtgcagttgtgcctacatcatatgaagctctagagagtgcaattaaggaggtatttgacaaactggttgaggaaggaaaaatttctcctgtgactgaaattacacctcctcccattcccgaggaccttaaaactgcaattaagagtgggaaggtccgagctcctacccacatcatttccaccatctccgatgacagaggtgatgaaccgtgctatgctggtgtgcctatgtctacaattattgaacagggttatggagttggtgatgttatctctcttttgtggttcaagcgcagccttcctcgctattgcactcagtttattgagatatgcatcatgctttgtgcggaccatggtccctgtgtatctggtgctcataactctatagttactgctagggctggaaaggaccttgtttccagcttggtgtctggattattgacaattggcccccgttttggcggagcaattgatgatgcagcccgatacttcaaagatgcatgtgataggggcctcacaccatacgagtttgttgaaggcatgaaaaagaagggaatccgtgtgcctgggattggtcacaggattaagagcagagacaacagggataagcgtgtgcagcttctacagaaatatgctcacacgcatttcccttcagtcaagtacatggaatacgctgttcaggttgagacctacaccttgtcaaaagcaaacaatttggttatgaatgtcgatggtgcgatcgggtcactttttttggatcttctgtctggaagcggaatgttcaccaaacaggagatcgacgagattgtggaaattggttatcttaatggtctctttgtccttgcacgttcaattggcctgatcgggcacaccttcgaccagaagaggcttaagcagccactctaccgccacccatgggaggatgtcctgtacaccaagtgagatagagccattctttgcaaagcataaagtattattgtcgcttagggctttcagctgtctgtacacttcataaatcgagcagttgcaaaaaaagctcgaaattgtgattgttgatgaagttaggggcagggggagagacatcgaggggaggcactactagattgtgtgttttgtgttgagttgtttcacgatatacggcctcagaatagaagttccctttgaaatgaagtaacgctcgctgatttatgagttgataaataaaattaaaaaagacaaagaagcatagggcaaaa

SEQ ID NO: 22866 - DNA, 981 bp, Zea mays
gatccaggcctgtaaagcttgcactgaattatgttgatcaatggtccctgcagtatctgccgctcataactctatagttactgctagggccggaaaggaccttgtttccagcttggtgtctggattattgacgattggtccccgtttcggtggagcaattgatgatgcagcccgatacttcaaagatgcatgtgataggagcctcacgccatacgagtttgttgaaggcatgaaaaagaagggaatccgtgtgcctgggattggtcacaggattaagagcagagacaacagggataagcgtgtgcagcttctacagaaatatgctcacacacatttcccttcagtcaagtacatggaatacgctgttcaggttgagacctacaccttgtcaaaagccaacaatttggttatgaatgtcgatggtgcgatcgggtcccttttcttggatcttctatctggaagtggaatgttcaccaaacaggagatcgatgagattgtggagatcggttatctcaatgggctctttgtgcttgcacgatcaattggcctgatcgggcataccttcgaccagaagaggctcaagcagccactctaccgtcacccatgggaggatgtactttacaccaagtgagaaagccattctttgcaaggcataataaagtattattatcgcctagagcttccagttgcctgtacacttcattaaatcgagcacttgcaaaaaagaaagccagagagagaggaagacgaacatcactagtcagcactagattgtgtgttttatgttgagttgcaaattcaggtcctgatttttgtcctgccatgaaccgttaggcgatattgtattggaaaggatgcttccgttattgtttcacgatataccgcctcaaaatagaagtttccagtaaaaatgaaaaaaaaaaggcccctccggccagtgcatttgtacagacccgcattaggaacgtaggcattttcaat

SEQ ID NO: 22867 - DNA, 1505 bp, Zea mays
agagcacctaaccaacccggctaacaaagaaagttgtgatcatgacgacaacagtgatacagagaaagagaaggcgaaagagaacgcaatgtttgagaaaaatgacttgctaccactaccaggtaccagctaagcagccagtggcagagttctcatggagatcaccatcaaacatctggctacatgtttattcttacaagtcgcggatccattattctctacaaatgatcgcatcagcggttccgatagccgacgaatggcatgcgtctacggctgccgcctggacggttttttagttgacgaactctacctccgtgaacgcctcgcctaaatgaagctgaagggcggtgtcaccaacagactttgccatagttctgtaggaatactcggtgacgccggccacatggggcgttagaatgacgtttgggaatttcagaacagggtcctcaggatcaaatggctccatccaagcaacatcaatccccagaccagctagatggcccgattccaggtgatcaaacacagccttgtagtccagcaggcgtccccgagcaatgttgaccagatatgacccctttttcattgatgaaacaaacttatgatccacaattccaattgtctcgctggttaaggtcatgcatgctataacaatgttagcttcaccagcaaactcatacatatcttccggcccacctttcttgtcaactagctcatcgacatcagatggcaatgtgtccgatgaccaatttcttttggtagcaagaatttttaccccaaagggtcttagcctcttggcaacctcgatgccaatggccccaaatccaaggataaggattgttttgccaaataatgtatctccaactggaacaccaaggtctttccggttcacagcagtatccatctccttttgcttacgcagaatgcctagagtaagatagattgccatttctgcgcaagagacagcatttcctgtcgtacttccaggtattcgtgcaactttgattttgtgttctgtagcagcatttacatcaacaccttctaacccaacaccatactgcattataatcttcatctgagttgccttggcaataatatctgaatctatacgcttattttttactacacatatatgatagctgtgaataacatcaggtacctgctcaagacctacttcatcaacctgaatgaatggatagtcctgcaaatactccctggtgtagttagtagaagcaggccaatatggaccacagaatagcacccgggtaagagcgccgtgtccattcctctcacttggatcacccatttttgaatactgacacagcccgaaacgaaacaagcacctggcaatccggctcttgcaacttgggaggaggaaggagagtgcagccggtggtgtgcggcggcgtgacggggcagtgttaggaggagcaaggaggtggtgggatggcggccgagtctgccaactattgctccggccataaagggaagcgttgattggtggcgtc

SEQ ID NO: 22868 - DNA, 939 bp, Zea mays
ttttttttttttttttttatcgcgaaaacctcattcgtcgtacatgatggatatgacagtgttcacgatctgacctcctaatcgccgtccgagactacgacggctagctgaggctagtgcgtgaacaacaccaaaaaaaaaggtattatttttaaaactcagcctgaaattcagtcgaattaagaattgaactgaactctttctttactccaacaccatatttactataatttgggtattacacaaagaaagttgtgatcatgacaacatcagtgatacagagaaagagaaggcgaaagagaaggcaatgtttgagaaaatgacttgctaccactaccagctaaggtagccagtggcagggttctcatggagatcaccatcaaacatctggctacatgtttattcttacaagtcgcggatccattattctctacaaattgtcgcatcagcggttccgatagccgacgaatggcatgcgtctacggctgccgcctggacggttttttagttgacgaactctacctccgtgaacgcctcgcctaaatgaagctgaagggcggtgtcaccaacagactttgccatagttctgtaggaatactcggtgacgccggccacatggggcgttagaatgacgtttgggaatttcagaacagggtcctcaggatcaaatggctccatccaagcaacatcaatccccagaccagctagatggcccgattccaggtgatcaaacacagccttgtagtccagcaggcgtccccgggcaatgttgaccagatatgacccctttttcattgatgaaacaaacttatgatccacaattccaattgtctcgctggttaaggccatgcatgctataacaatgttagcttcaccagcaaactcatacaatcttccggcccaccttctgtcaactagctcatcgaccggacgcgtggg

SEQ ID NO: 22869 - DNA, 3378 bp, Zea mays
aacgttccagagaatgtttcaattgacttggctagaaacaaaatcaattctaggttcctaacgagtggataggaaggctattgatgcgcacacaactctcctagacagctaaggatataagaacagatttaattgatgttgaaaacgatttagttgctagtacatcatgcacgtttgaaatgagaagggcagcttgaagacttgaaatgtctatatattaattataaaagaaaaacgttagttgcgtatcattcataattatggcagctccaggatggccgacaagttggagcaaaatttcggaagcaattgaaagaatcaacagaacaacctgtataaatagaattcattccagtacataaacattttcttttgaattgttgggcttctcaccaaggagagaacccttcaaaaataggcgtatgctgcttgttgcagcgggcacacggtattctttagtaaaaggcgaaagaatagttcgctttgtgcccactgcgcagctgcgtggatctacgggtagcgcttagtctctcctaaatagcagcgccccccagctggtattagcttcatcgagcggtttgggattaaggaaaagagcaagcagccagaggcagttgcccactggaccagaggactgcgtgcgcggcgaagagcaaggaagcgaaggcccaccaaattagcccttagtgtcagaaagaaacacaggggtaccaatgtttaccaaattattaggttttctagccacgtctttctttccgtagcagaaaaataaaatgttatttgactatgatatgcattgctcgctcgcaataagcaagaagatcccgccctaacagtatcacatcactgtatgagcgtaatctatgttataagctaaataatgaatgcactgaacaccaaatttcctcaggatgccacggagtgtgtccaaagaaattcgaagggcatcaggatcgtaaccacgtagttttttttatcaaaattgtgcctcttgtgtcacagttactatattctgtggtgcatcttaaacaccaagtcctggttccttctctcatgggatacaaatcgatgaaacaaatggtccaataaatccatttggtgcaagtcaagtatttcactccatttgttctctattaaaaaaatagacatcgcattgcaaatcctataacaatttacagcgagaaaatccttttgatgcaattgtaccagtcagaatagtctgtaaatcctttccagctgaaagtaactatacttcggcaacagtgcacttcaagagttgaagatatttccaggtgagacagatctaccattcctctcatgagtagctcgtctgcgcaatggaggtgtgtaaacagttaccgggagcacccattcacccttctctcttttatcaacaaggagtgggtgctcgtacctagctgggtctgttccttccggagttgtgaagaactcaaatcgaagagaccactgtacagtgacctttgaggtacaaaaagacatagggccatcaatgggaatggaaaacagaaagcttgtctggtgaagatccgcaacaacctcatgatgttcactgtgtagcttggctggtgccgaattcctccttcttgaaggatgtaatgcgcgaggattaattgtttcagatgtttccagggctatagatacctcgaggcacctccgttttccagttccgtgaaagaaggtaagtgctccaccaatcatatcaccaaagtaataggttgagtcagaattctttggtgaaaaccgaagcaaaacttggtcatcaattcttatattataagatcttcctgtcgtaaagccttcagatccagctggatcaacattttttggcgtaagggggagtccagcatcatcttttgagtgatcagaatctggagaaaccctttgcccattcgatgtatggtctggtagcaaaatgtttagtttcctttgagatgccactaaacctccgtcatgatcatctgaaatctctgacactgacaatcgaggaattggattgtatgatgggaaattaggtcgttccacttgattgtaaaatagctcactcgtggagagccgtgatgacagagaatgcattgacaacgagctccttagggagaattcaggatgtgcttttgaaggattgtatgaggaaacagatgaaacttcatctttagaactatcatatccttcttctagatcaacattatcatttgctttgctccattctgaatcttcatcttttcccttccaaaatatgctcggttgatccaccgaaaaaggcagattccctaaaacatcttcttcatttagtaggctgctgcttttctgggaaacacgtatctgcaatgggactctagcttccagatgaattgcattattcacaagacctttatattggtctccattacccaacataactggccttccaaataatgtggtcctaacataataaaaatagcggatactgatgcccctataagatggcggcaaagtctttgggagctccacacgtgcaatgtacgtttttgttcgccctgcaccaattattactttagagaccagtgatggtgccgaacaatccagaaacatatgttcacctcgcctttgtttagaccctggtaagggcttaggaacagagaaccattgagtatccagcttctcaatccctttaagttcaaatgatagcacatctaacaacagcgagggggcatcctcgcctgacactgcctgcccaacatcatccttcaaactagctgggctacagatttcgatagtcacagtgactgaatcaccaggtctgtacgtctccttatctgtctggagtttcaacgttggggataactgctgtttggctgctgaatcaaccttccggtcctcaaaccatccaacacttcttaagaaggaaagcccttgcggaattggaagtttcagtgacatcgtataggagtatcagaccagtaataagctctaactcatcaaatttccgccaatggccgggtgctcgacgccggcgaagatcccgaatacgaaagacctggtcacctggcgtagggcggtggcagcgtcggccgcccagtcgtcgccaccagagacaggaaacaccgaaacaggaaacaccgaaacagagcgcaagcgacgagggagacgagtcccgcccccgcccggagggggcccccccattaaaggcccaattaccacgaagcggatatgtatatatgtgcacactgcgaagcaatcctaaccgccaccagcatccgcctctcttctcagtgccagccgccgtgcgctcgctctctctgtccctcaaggccttcgccggcgaagagcgcctagtcacccaacaggtattcccactccgtcctttgtcgtgtctgctcc

SEQ ID NO: 22870 - DNA, 786 bp, Zea mays
cagctaggactaggagtgccgagtgcactctgtctctgcagtatccttcccggccgatctgcatttcactcgttccacaccgtcgttggccggcccatagctctccccctcctggttagtgtagtgagcgcagcgacgagtgcaacggtgagagtaccgagatggctgagggaagaggcagtgcaagggccatcggcgccatggcgttcgccgttgcctgctgctactgctgcgtcgccatcgccgacgcagccaccacctactacgtcggggacagcaacggctggtccttcagcagccccagctggcccaacggcaagcacttccgcgccggagacactctcgtgttcaggtacatcccctggatccacaacgtggtggccgtggacgaggacgggtacaacggctgcacgacgccgccggggtcgcggacctacacgtccggcgccgacagcgtgacgctcgccaggggggacaacttcttcatctgcacccggttcggccactgcaacctcggcatgaagctcgtcgtctatgccgcgtgatctgtcagagctagcgactggtggtggtattgttgactgggtgcgctcaatgatcggctgtgcttgctctcgagcgaactggtctgtttgatttgtgctatttcgtgtaggctcagtcagtcgcttggttctaatccgtaacggcttctactacttttacaatgttgttgtaacaatacaaacatccagctttaattgaagctaacggatatcgcatgtttgaacaaaaaaaaaaaaaaaa

SEQ ID NO: 22871 - DNA, 2804 bp, Zea mays
ctgcagcacaccctcttgggtcttggctactaggaaacatgcacaaacaccacctatgcggctctgcctctgcatcttccctcgtttcatcgtgacacgcaatagctgaaatttgccgaagccaatagctgaatctttgttcctttgacagcgcgttgatctgagcgactacgagaagaattagaggaccaataaatatgaactctgagggcagatgtgtccatggaccatttttttaattatggaaacaaaatgttccagccttttgcaatctcttgcatacggccttacaaatcgaaaaaagacaatcatccatcgtaaacattcttcaaagtaaaacatcaacaaatcaaactccttctaatctagcgttggacctacatccatggtttgcaaagatctccatagccaccacctctaaggatcgacataccgcaaggacctcgtgttgaggttgttctttctgcaacaatctccagaactgagccaatatgttgccctgaatagaacctgcataattgatagttttggtttaaaagtaaaaacaacatcattgcgacaaaagccaaatagacaaaaacattgccgccactccaattagaagtttttttctatgtgttgtacatttgttagcaatccaggacctaattatatgattaatattgttcggtctctctatatttaaggcaaagtaaataattctccaaatatttctagcaaggtaacaatcaaataacagatgttgaatagactcattttgattacaaaagctgcattttaaacaacctttccaacctcgcttagctaaattatctttggtgagagtaacttcctctgactaaataccacaagaaaatcttaattttcagaggaagatttagactccaaagtatattgcgatttacagggggatattattcattactgctggactttttttttcccagcgagaagatacagcaccagctcgacaccagggttaaccggagcggcctcgtcggctaccaatgtctgccaagtgatgcgtgggatgacaggcatcggcagatctgcatcaccggctcacagtcacggccgctggcgtagtaacttcgcttgccagttgccacagctgaatctgggcctttactaccatatttttttactgatttacacccatcatgaagccgttgtcttcctgatgggtccatgtccagcagttgctaataaacatgtttgatggtacagcccgcctcaacctgtaccttgctcgactaaaagctctcttctggcccatcatgtgatcacggactggcgtcgggcgtcctatacagcattgaagctgcacagtatcgcgctggtccctcgctctctgctcgtcacctctgccgctctgcgcggtattgatttcctcggacaccgtgctccccgaccccgagcgcccatccagcagccagctaggagtaccgccgagtgcactctgtctctgcagtatccttcccggccgatctgcatttcactcgttccacaccgtcgttggccggcccatagctctccccctcctggttagtgtagtgagcgcagcgacgagtgcaacggtgagagtaccgagatggctgagggaagaggcagtgcaagggccatcggcgccatggcgttcgccgttgcctgctgctactgctgcgtcgccatcgccgacgcagccaccacctactacgtcggggacagcaacggctggtccttcagcagccccagctggcccaacggcaagcacttccgcgccggagacactctcggtacgtacgtctcagcattactcagcatgctggccgtctgctggtcactgaagatggccatgctctttctgtcatgcgtggtgtggctgcagtgttcaggtacatcccctggatccacaacgtggtggccgtggacgaggacgggtacaacggctgcacgacgccgccggggtcgcggacctacacttccggcgccgacagcgtcacgctcgccaggggggacaacttcttcatctgcacccggttcggccactgcaacctcggcatgaagctcgtcgtctatgccgcgtgatctgtcagagctagcgactggtggtggtatcgttgactgggtgcgctcaatgatcggctgtgcttgctctcgagcgaactggtctgtttgatttgtgctatttcgtgtaggctgtcgcttggttttactaatccgtaacggcttctactacttttacaatgttgttgtaacaatacaaacatccagctttaattgaagctaacggatatcgcatgtttgaacatttgctctccatgagaccgcccctagggccttgacgcctgtacgggtcgagagcgagccaccacgtttgctttcttgcagattgtttcccccccttttttgtttatctgaaagggcaatttttgtggatggcggagatccataccttttttgtgcgtgataaaacgggctagtaccacaaaagttaaaaccagtcgtgggttcgtggacaaactcgcttgcatctaggtatacacaattgcatcattagtttttttatagaaaattattggataattaattaattccttcatgtaatcagcaagatatatagaaatgccagctctcacggccttatgacctcctctatttcgatgtgcttgttaaaaagtctgaacatggaaatatggcataagccgaacctagaccacccaagggactttagttccatttctctccataattgttcaataatgaagtgtttggtttgagaaatcacttcatccaggatgagatagtgcaacatgagtccgttc

SEQ ID NO: 22872 - DNA, 893 bp, Zea mays
cgtggcgagttcccgttacaattcacaaggtcttcaatgcaaaattccccgacccctctagattctggaactaccgccccagccgaggagccgaccggccggcgaagtgggatgggggcgatggcggcggctcgggggcagaaggcgctggtggctctgccgcagctggtgaagtcgctgcggagtgatcccgtttccggaagcgcacgactcagacaccttccgtctctcaggaggaccttctcgttgtacgaccagatcaacctcatcgacagcgtccccgaagacgagctccgattccagtcgtatgatgatactggattcaaaattaacaatataaaatatgaaggcagcttgttgattgtagagaacaagataatgacatgggcacccaaaacgttctcagagataactgctgaaagtttatcaatcttcaaagttgtgcaccctatcccagagatcttgattcttggttgtggaagacacatccagccggtcagtcctgagctacgaaagttcattcgttcaactggaatgaagctagaagcagtcgattcaaggaatgcggcttcaacatataatatcctgaacgaggagggcaggccggtggcagctgcagttcttccctatggagtcgcttgttagtgttttttgccttttataccagtttggcaggcgttttcttgttggaatcgatagctaactgagctgaaatgtcggcatccgtctggaccatcgacaatgctgttttggtgtctaggaaaggccaccctaggttttgtagcatattgttccctttgtaatcgcgggctaacagaagagtcacgcagtgtacactacatggaatcgaaataagaatgatggtccctgtcatagtactttgtctaaaaaaa

SEQ ID NO: 22873 - DNA, 1133 bp, Zea mays
cgaatttccaatcgtcaagtgggaccccctcgaccccgcccggggcaaaatttcccgacccctctagaacgaccgcccctgccgaggagccgaccgacgggcgaagcgggagggaggcgatggcggcggcttgggggcagaaggccctgggggctctgccgcagctggtgaagtcgctgcggagtgatcccgtctccggcagcgcacgacacaggcgccttccgtctctcaggaggaccttctcgttgtacgatcagatcaacctcatcgacagcgtcccggaagacgagctccgattccagtcgtatgatgacactggattcaaaattaacaatgtaaaatatgaaggcagtgtattgattgtagagaacaagataatgacatgggcacccaaaacgttctcagagataactcctgaaagtttatcaatcttcaaagttgtgcaccctatcccagagatctttattcttggttgcggaagacacgtccagctggtcagtcctgagctgcggatgttcattcggtcaactggaatgaaactagaagcagttgattcgaggaatgcagcttcaacatataatatcctgaacgaggagggcaggccggtggcagctgcagttcttccctatggagtcacttgttaatgttttatcttctataccagttgggcaggcgttctctctttataatcgataaccaactgagctttgtttcgttcgtgctgtttcttggaagttctatatctgtcatgcatgtccaaagtagagttgtctatcttcctgcttttctacttcctctagcaagcccagatgcacagactgttggtatgttttggttgccgagggtacaatcatacatacaggcgaaacacttgccactctgctacgaactgggacgtgcgcccgcctggcgactggcgaggaccacggagtcacggacccggctgttttgccttctgttgatcgtcctaatttcagggctcaggcaggcagacgcgatgggatcctacgtggtaggagtactcgccagttcagatctcgcgggttaatatttactgtcacgtcatgttgtatcactatcgaccatatactataaattatgtaattgatttttgtcagtgtttatctgtgttt

SEQ ID NO: 22874 - DNA, 1565 bp, Zea mays
gtggttggtgtgcaaacattttgtcaaggtgggctcattatagtgcttcagatcttgttttctagtcctttctgtattaaaatgatttgcatcactttaatcatctatcatcctcatcggtagaaatattaaagtgatttgcatcatttgatatgtcattcttctccagagatctttattcttggttgcggaagacacgtccagctggtcagtcctgagctgcggatgttcattcggtcaactggaatgaaactagaagcagttgattcggtatggattttaatggtataattaataccgaagcagtcaactagaatgaaagtagcagtcaactggaatataacactagaagcaccgtttgatatggcattcttctccctttgcactgtttcatcgtcttttcctctttcgaaaacaaagcttaggaattccaataggaaggaaacttgtgattttcctgtctgcttataatacaatgcttccatggtttgcagaggaatgcagcttcaacatataatatcctgaacgaggagggcaggccgcgggcacccgcagttcctccctcgcgtcccacttgttaatgttttatcttctataccagttgggcaggcgttctctctttataatcgataaccaactgagctttgtttcgttcgtgctgtttcttggaagttctatatctgtcatgcatgtccaaagtagagttgtctatcttcctgcttttctacttcctctagcaagcccagatgcacagactgttggtatgttttggttgccgagggtacaatcatacatacaggcgaaacacttgccactctgctacgaactgggacgtgcgcccgcctggcgactggcgaggaccacggagtcacggacccggctgttttgccttctgttgatcgtcctaatttcagggctcaggcaggcagacgcgatgggatcctacgtggtaggagtactcgccagttcagatctcgcgggttaatatttactgtcacgtcatgttgtatcactatcgaccatatactataaattatgtaattgatttttgtcagtgtttatctgtgtttatcccctgtaatgctcgtccattgtactacctttgttctcgaatatttatcacatgttagttcattttaactaaacaatggtaaataaaaaaaacagaaagagtataatacttcatacgttttattttataattcgtttgactttttttaccttaagtttgatcgtctggtcttattaaaaaatcataattattattaatttttgttacgatattatttaacatataatatactttatgtatgcttttgaatttttcatttgctcgcaaaatttttgaataaatgagccggttaaacttagtttgaaaaagtcaaatgaattataaattggaatggatggagtattagtttcatcctacataaatatgagcgtacattgtcttttttttactatttttaaattgacatggacttagcggaaaaatacatagcaaatacaattatatatttataaaaaatcatttaaaagtacatggcttaaacataaaaataaat

SEQ ID NO: 22875 - DNA, 1028 bp, Zea mays
  misc_feature (830)..(834): n is a, c, g, or t
  misc_feature (880)..(880): n is a, c, g, or t
  misc_feature (891)..(891): n is a, c, g, or t
  misc_feature (921)..(921): n is a, c, g, or t
  misc_feature (948)..(952): n is a, c, g, or t
  misc_feature (998)..(1002): n is a, c, g, or t
  misc_feature (1015)..(1020): n is a, c, g, or t
ccggccgggaagcgccatccccttcctcgccccacacgccgtcgtgttggccgcgcctctcttcaaccttttcttgagcattggcgagagcccttcacatggtgtggtgctggcatcgttgttggcgacctctgcgcggtcggatctgcaaaggttgcagctagcgcgcctacagtacgtcaacatggtgcggcatctctttttgcagatccccaacttgctacgccgccggccgccgcatcggaactccttgcaccgcttgcctttcttctcccattcaaccggcaagcgttccctggctcaataacgcaactgggggatgtctgtcgctatctccatataggaaacgacaggtgcgacagatttagattttcaggtgatgcgtggtcgggatcgccggatcaatcaaaataagtgtgaaatttgagaggccgtggaacttccagatcgagtagtatccatccagatcgatatcccagaagaccaagcctggccatgaaacgcatgctaccccgatctcttcttcaccttttcttatccgcaggtaccaacaaaaaaagtgacccttttgacgacgtattgcgtgggcaaggcatgacagtgcgacaagagagaaactaacagagagctctgttcgttctgctgattgcttatgattcgactcgcagtggcggtagctgggagagcttgggactggccagacacgaccaactcaccgctgtaataagacgacttttatacatagctgacagtacgcaccctcagttcaggcgcaaggttgaaccaccatcgtcttttgaagcctggccatgaatatctagatagtactnnnnnatctacatagtttgtaatcaatataatttgcatattattcttcgcncccctttatanccatagcccaccaggccaatagctcatcgnctctttaccaccaactgatgttcaccnnnnnctgcacaggtaattggttttgcatgtctatgccaagcatcgtcacnnnnnggaccatgaatcnnnnnngtgtactg

SEQ ID NO: 22876 - DNA, 755 bp, Zea mays
ccggccggaaaagtttttttagaagttactgttacgagtcagcgcgggttgcgagttgcaggccgcaggaactgaagctcgcgctctgcaaaccttcatggcctccgaggcggtcgtcgttcacaccggcggttgccactgccggcgcttgcggtggcaggtcgaggcccccgcgagcgtagtggcgtggatctgcaactgctccgactgttccatgcgcgcgaacacccacttcatcgtccccgccgccaagttcaagctgcaggccggcgctgacgagttcatcaccacctacaccttcggcacgcacacggccaagcacaccttttgcaagacctgcggcatcacctccttctacaccccgaggtccaacccggacggcgtggccatcaccgtggcctgcgtcgaccccggtaccctgaagcacgtcgagtaccggaagttcgatgggaggaactgggaggattttttcaggaccagcgacatcgctggattctccaaggacgatgcagaggcggcggagtagcgggcaggtcagttcgtgttcttaccctcatgattcatgaggatcagttggaaacttggaattgcaaactgtgattttgtacacgaattgcaaacttgattagtcgaaattcgtgttccattcgtgtttgtgaattgcaaactttgattagtcgaaattgtcgaagcaataaacaagcaattgtctgtgtcggcccgggtgtgacaactgttgccaaggtggatttttc

SEQ ID NO: 22877 - DNA, 926 bp, Zea mays
ctcgaggccggccggggtagcagcctgtgggtgaggagcgactgttacgagtcagcgcgggttgcgagttgcagaccgcaggagctcgcgctctgcaaaccttcatggcctccgaggcggtcgtcgttcacaccggcggttgccactgccggcgcttgcggtggcaggtcgaggcccccgcgagcgtagtggcgtggatctgcaactgctccgactgttccatgcgcgcgaacacccacttcatcgtccccgccgccaagttcaagctgcaggccggcgctgacgagttcatcaccacctacaccttcggcacgcacacggccaagcacaccttttgcaagacctgcggcatcacctccttctacaccccgaggtccaacccggacggcgtggccatcaccgtggcctgcgtcgaccccggtaccctgaagcacgtcgagtaccggaagttcgatgggaggaactgggaggattttttcaggaccagcgacatcgctggattctccaaggacgatgcagaggcggcggagtagcgggcagatgttctctgttgatctggtgttgtttcgtcatcagtacatcatctcagttctgaaggttgaatcaaattatgtccttttccttgaactaggtcattcttcatttttgcaatgcatctctttaccccgtgttaatgatgacatgacatcattttattaagctgttaatccctcctatcttcataattgcacttctgggtctctgatgccattgcatttccttgttaaggacataaaaaaaatggcacaaaaccgtagatagcacaatcaagcaacaacacatggcatctgctcaatatggcgtggctattacagtgaatatcaaactgtgtatatgaacactgctacaactgattgcctgatgcgtaaatcaaaaaaaaaaaaaaa

SEQ ID NO: 22878 - DNA, 9422 bp, Zea mays
  misc_feature (247)..(247): n is a, c, g, or t
  misc_feature (1455)..(1455): n is a, c, g, or t
  misc_feature (1621)..(1621): n is a, c, g, or t
  misc_feature (2386)..(2386): n is a, c, g, or t
  misc_feature (7737)..(7737): n is a, c, g, or t
gatggcgatggttattaggtctacaaatacgaaccgtcatgctcatgcaccggtaggacaaattacctatggacctattgatgagagggataggaaaagatttgaatatcttaatgacaaaatttggaggaatgatgtcacttgtgttgacatgcttagactcaatagagggtctttcttccggttttgtaaattgtttagggaccgtggcttgttagaggacaccatacacatgtgtgttgagcancaagtagctatgttcctacacacaattgggcacaatattaggaatagggtcattcgtaccaattttggtaggtccggagaaaccgttagtaggtatttcaacaaagtacttcacgctgttggagagctacgcacggacttcattacgccaccatcatccgctacaccggctaaaattcaagggaatcatcgttgggacccttactttaaggtaggcatatacccaataatcacacaatctttgtgagagagtttaatgcttatagtttctcccaatgtattgctaaataggattgtattggggcaattgatggcactcacgtccgagcttcagttcctaaggaaatggaggccgctttccatggtaggaagagtcacactactcaaaatgtaatggcatgcgtagatttcgatctacggttcacatatgtcatagccggatgggagggaactgcccatgatgcgctgattttgagagatgctttagaacgacaaaatggtcttcgagtttccgaaggtaccataaatttgtgaaccacatttctttacacgtgtcatgtatctagttctatagctcacatacatgttcttatatggtaggcaagttttacctagttgatgccggttatggagctaaacgaggctttctacctccttttcgtggtgtaaggtaccacttgaatgagtggggtgtgaaccctgttcaaaatgagaaagaattgttcaaccttaggcactcatcccttagaattacagtagagcgtgcatttggttctttgaaaaggcgattcaaaattcttgatgatgctataccatttttccctttctcaacccaagtagaaattatggttgcatcatgcattattcacaattgggtcatagaagatggtggtgatgatgagcttatcctactggttgcatcatgcattattcaaaattcttgatgatgctataccatttttccctttggttcaagcctttcaaagtggtgctgaaactatagctaatgctattgaaaaggctgcagcaagtaaaggtttgccaaacggattgtttgaagcggtggacagccttcccggatttgagcttgagcacaagtctaggtactactctcatatgcttggtgatcctaatcttgcaaatggtttcatgaatgtgcccgtgctttacaagatcacaatgatgaccgatttcatgaacaagaatatntaggcttcctaggtacttaagtagacctagttggatgattctattgagtagtcatggactcttgtggtatggatgattttgagacatgcatttgtatccatgaacaatgctctttggatattcttgcatgtcatggtggttgtattttgggatggtgattgctgcnatattgaacattgattgtggctgctcattgttgacaatgtagttggtaatcacactatattggactgctcatatgttgagtattttgtgttgaatgtggctgctcatatgtaaccgcattgttgagaacattgtgatggtaatgagttgttgtatgttgatcatagtgtgttacaatttgaaattatactctagttccactcttgaaccaaacaaagaatggagtcgatccgttctacttcactccggaaccaaacaaaaaatagaaccgctctgttctacaataccaaacacagagcggaacggctccgctcctggaattggaatggagtggctctactccaacacactcttgaaccaaacacactcttaaaactgctggtagccctctcttgaagaacaatatattattccatctcaaaatggggagactaagtataagaaaatgaaaaccctagagctcttatgatgaataatattgtagttcaaaaaaaggttgatatatgtggcattcgtgtgtttatcaacgttaaaattggtagccctattgaagaaaaactctacgtctctgctacatacaaaaactaacgcatgcatgacattctaactaacaatcatcaaaaccaccatttcatttgctagaaattaaataggttcatagtcactaacctttctcaatatgggttcaccatttactcggatgccttttgtcaaaatttaattgaaaagaactctgtaaaattgacaaataactagcacataaaanttaagcaaaagctagtcatcaaaattattaagaaaactacaaattcaaagaagtagatatatgcttattaccaaccttaaaacatgaaagctactatttccatccttaaaaatccaaaaaccctacacgcgttttttttattttttttgtaaaaaaccgcaacaatgaaaagagaggtggataaagcaagaggcgttttctagaataaatgcgttgggggcggaggtgagataccgtaaagccattattactacctgttcaaaccaaaagccggcagcgatagcctatataactttgttggctcctgtcttattacaatgttagtatcgctgctattttgtaacttgagccgataatgacatgtatcatcattctatgattaaggcctcttctgttacttttagatgatgtttggttcggtgaaatgtaacgtgatccggttatattaccgcggcaactgattgcatcgtatcatgtttgtttgagccacaatgtaatctattaccctataatcgaatacggacttatagatagtgtgatggaataccagcacttatctgagctgaaccaaacaatctaagtgatgtcttacttctttttcatttacagtgttattaccagataacattacccgataacatttacgttaccgttcaaaatccacaaccaaacagcactttaagttaaccggtgatagatgaagtcctcagctcagcaggatgcacgtgctgccgttgcccattgcaccggcggtcgtctgtcgcacagctacccattcatgctctgctcggctcttggtcgccacctccgcttgtttttctcccttgtctgcatctgaaaatggatacgtagtagaccagagagcggctgggtaaagctactagccaaagaatgtgcaggaggaacgtgccgcctgtgacctgtgatagcggcatgtacgctgagctgagattgagaaaggctgcgacgtgtaatcgagtagaagacgttgcatgcagcgtgtcctacttgcttgtaggagtaggagtacaaggagctgagtaatgttgcaacgaggtatagtaggtggcatttctagcttgcaaacaccactattcttctgcgatacccctgaactccatgaatcctgctaatgatggccatctctcgtgacgcgtgggatcactattcactcggggccgatgcacccgtcctgctccgctagccgctaaccgctagcttgtcctcataatctactgtacagtctagctattagcgagagggtagaacacgcccaacgatatatagacagccccggccggccggccgctgaagcctgaagccatgaaagagaccaaggccatgcagtgtagagcaggagctgtctagcaacgcatgaaggactaccaaggccacagcgctaccacaccgtgtggcagtggcactggcaccacgggagaggggcgaggcgactgactgataaggaagaagcaggtccgagctcgccagcagctagccgagcgcgcgtggccgagatgggtggcgccggcggcggcgggaggaacggggcggcgacgaggcggtacaacaggtccaaggtgccccggctcaggtggaccagcgagctccatcgcaacttcgtccgagccgtcgactgccttggcggacaggacagtacgttctgttcctgtcttctcacctctcacgctaagcatgcatgcatacatacatacatgtctttggtttggtgtcctctctatatctctctttcctcgtcggccaaaatggccctgggctcattcatgtgctctcttcgtggtcgatgtcgactgcatgcagaagctactcctaagctaattctccagctcatggatgtcggagggcttaccattgcccatgtcaagagccaccttcaggtcagtcggtcggtccgcgcgcttcttctcatcttcacgcagcgatgtacacgaactggttacaatcatgaccaggagctccagttacttaaactaactcggctccctttgctctcggtgaaacagatgtacagaagctcaggacaagacattaggaggagaggtgagagagatgctactatactgtgtctttgtctttatctgttcctgttcctctcagctcaatttcttactagagcgatcttcttagtttttcccgttgatggagcctcttccttgggatttggggttaagatccttagctaaaacacaggaccgtcgtcttgacaccgctaaacagccatcattagctgcaagattgctcggcatgtgccatgcatatgcatatgttctgttgtctcccacacttgcacacgcgtggtgcgaaatggaaactggaaagccgaaccgctttttttagtgccctaaaccacctttatttattgggttactacctctcctcttttccatgtcggtcgttgccattagaggtgcaaccgcggcggctaggacatctggtggagcactactcattcgccattgatgaggagggaggccccaaagaattcgtctgctgcccacacatgaaaaggtttttaccgcctctgctagctgccgcttttattcatccatatctaccattccaacagaatgataaaaatccctaacctttggcacacacaccgtcttttgcctgctcgggtgaacagggcggaggcagggccagaagctgcggccacggccacggccacgcacgaaagcgtgcaggggaacagtgacatgggggctcctggcacccggcgctgcggcgatgattacacgcgagcgattcccattcccatggggagcagcagtagcaggagcaggaggataaccgagggcctcgcatggcagtggcagagcagcggtgccgcctctgccgctcgtgctgccacggccgcttccacgctgcgcgagctgggattctgggtgcgaggaaccgagcccttcaaggtacggcaggtaaaagaaatggtatatatataaaagaaaagctactgaaaagaagcattgggtaaaaagagggttatcaaaagaagatatctctcctctcttgtcttaactgcttttgcacgctgatctttctcttcacacgtctctcaagtcgtctcactcatctgcatgcctcgctttataatggagtacgtacctgttctcgcagcgtggcgagggcacgataagccatcgtccgtattcaggatcaggactcatgttagctgaaatgcattacgatagatagatacactgatacagcatactcctacatcctttgctagttttcgttagcctcagcagctgtcctgctgctcttggttgagaagaattattcttggcttgtagtagagtaggctgtaggctaaagccagaaacgatccagacgcaacatgagtggtgctgctgccgcctgttgctagtagcagcatcagaggagcaccagaaacggctattgagaacctgagccctcatgcatgcattcgcttcgaactcgtccaagacaatgatacgccaaaagaaggggcttttgcagcactccaacccccttgcagcgagcgagagcgttgccatgatgacgacgggggcggacgatgctgcagacgtgcagtacaggtgcagattcagaaagaacaaacaagcccccattaaagcttctctggtgccttgctccggccgacgagaaaagaggaagaggtgtgcaagggcgggccagcgagcgtaccggccgttcgcgtctgaattctcatgaagcacatgagcgcactgtactccttgtcgactacactgttggtccttgcagttttcactactgcaaagaaacgatctcaattatcagatgtggccacattcaataaggactagctagttgcgtcctaattgcagctctgataagaaattaattcaacgacttgctccttctgagctctgactgacgctgtgttttttgttctacgacagaccggcaggcccatggcaaatcgtctcagccctgtggcgaggcagctatcttccaagtccaaggagatcaagtgcggagacgacggacgcttcttgttcggcactgcgactagagacgaagcggccaggagacactcgccgtcgcggcggccagactccattgacccaaaggctgtggccgctgtctcttggtccagcgaaggaggcgcctgcgccctcccgccgccgctgtcgtcgaccggcttgagtgcgcgctcagggccgtcaggcagttgcgtattcgccaggcagagagttaacctggacctttccctgtccatatgtggatcatagcttaatcacccgtgctgaattttgtacattcaatgttccatgatgcattgcatgctgtcgatgtgattccgtttggatatcaatggcggcgtgcatgccagcgccacagcctgcggtgattgcccgtctagagtctagaactgtgtgttctaatgaagatctgaagaatggcagttcacatgttccgttctgtgttagtgttaatggtaaaggcgaaattgtctgctgcaagtgaccaacaaaatggaagcctcaaacagagaaatagtgtggaccatgtttaagacctcccacaaacttgggaggtgtttgggtcctacctgctaattgttgctagcagctaaaactagcatcagtagatccaaattgtctcagttataaaagaccgtaaaggtagatttagttattactagaagaaacgtctctaatagactctatgagtgactcttcaaatttaataactctccatctctgcacatctgctctttatttttgggtagcctacttcactcatcatatagagttctgaatttacaaagtctattggactagtctactcctttgtcgtgaaatctattttagagaatagctaaatcaataaatttagctaatttttttgttaatctcttggagttgctcttaatagcttataatgatttggagttgctcttaatagctaatttaaaaaggatcaaacgacggttagctgataggtgggttaataacactgctaataaaaaactactagctgacttgctcctgctagctaattaacgtcccagatcgaaacaggaccttattaggacactgtcagtgatccatgttggtcaaatgtaggtgtcctattacgaatacagtgctgctgtcaacctcccattctgccccttactttggctggcagctcctgttcctgcagggatttcctgagcaaagaagattcttcaattccttaaaacgtttctactttgttgcaagcattcaaatcaaggattgtgtggcgatgttgtttcagaaagtacacggacgatttgggggtaaattgaggttacatcatgttgcatgcctcttgtaattttgtatgagccatacatntctcagcatagatttagggagatttaggatctgtttgaatgcaatagagctaatagttagctagctaaaaaagactagtaaaattagctagctaactattagctgattttagttgagttgaaccagctaaactactaggtaaaggtagttgagatacagctaatagttagcctcgggtgtttagatgtcttcagctaaaagtaactaatacctaaactgttagctacattatttggatattttcatctaattttagcagttaactattagttctagtccattcagtatattcaaacaggagctttaactgtagagacgactaaaatttacctcttcctatacaagtataggagcaatgtactcatgagccatgactacgcaagtatgcatgatgtccttggcaccctccctgctggaatgaaacaagcagaatgattaaacatcagtcgtctcatatgcgtgcgtgtgttgtccatgtctactccatttgagctggtgtttgtcaaaagcctaagagccaggggcaaagctagctcgatgcagaccactgatctgctgctggctggctcaaggattgacaaatcccatcctgcgcgtctcgtccaaaaaacacactcgccagtttccgtgttcgcctttgatgctgggctgggtgaaagggaacggcatcaacccttttgtcaaaatcacacggccatttaccacttccccaaaagcctgaaaactgacggcatctcgcctcaaggacaaattattaccatgatgagcggcacagtagatcacagggggaaaagcaaggcggccaggccggaacaaaagccgtctcagaggctggtgtcttcagcaacatgcatcatgctttgtggctgcacacgatggacaaagttctgagacaaacagtggagagaccatcatggccggccagttttgacatttcggcacgctgctaaaaaaaaggacgacaagtacaagaaggcaagaactgaatgaactcccttctatgctgccacaaaacacaatttgacatccccaaaggcagacagacgactatttgtgcgggggcaaaggatgatacattgtccaaggcataccagtgtcttctatgattattaaaaactcgccttgattaatgtaaaaaaggacaagccctgatcatggtttcatgtcctcataaaaacaaggcttaattaaggcgatggtactctggtacaaataggcatgtgaaaaactgcatcggcagtttcccattacagatactctggttgacgaggcgccaccggatttcacttcttttttcctgcttttgcatcaggcaccaaagacctgacacaaaggcgaggtttggtcgagatgagttcggctggcgagaacagacaccccagccaccgaagatccaagaggtaccccggaaaccgggagcatctcaacgagtaccgcaacctggacatttgagcaagcataataaaagcttgtaagtaggctaaatgctgaggtggagaaaaaagaagagagagaggggagaagtgggttgtaaacttacaaacggcttagacacaaaaaaaccaaaccggcttagtgtaagtgcaatcaaccctaactgagagttttggtgattaaatgacaaaacaaactgagattctaacaagtttgctcctagtatgtatacagttttctacagacaggag

SEQ ID NO: 22879 - DNA, 1469 bp, Zea mays
ttttttttttttttagaactgaatgaactcccttcgccgctgcctcttttctctttttgacatccccaaaggcagacagacgactatttgtgcgggggcaaaggatgatacattgtcgaaggcataccagtgtcttctatgattattaaaaactcgccttgattaatgtaaaaaaggacaagccctgatcatggtttcatgtcctcataaaaacaaggcttaattaaggcgatggtactctggtacaaataggcatgtgaaaaactgcatcggcagtttcccattacagatactctggttgacgaggcgccaccggatttcacttcttttttcctgcttttgcatcaggcaccaaagacctgacacaaaggcgaggtttggtcgagatgagttcggctgggagaacagacaccccagccaccgaagatccaagaggtaccccggaaaccgggagcatctcaacgagtaccgcaacctcaggcgatctaagatcaaccactgagttctcagcaacggatttgacagcagcagctaccactttgaaacattgctccctatccatcaaagtctgctggtttgaaccttcattactgttcttctctgtctcatcaatgccccttctattataggcaaccgcaaactttataggcttgtcttcgtttgtcttgctcctcgagaagtcaaggaataactttgacacagtggcatgcaggtcttcttctgatagaatgcaagtttcttgaattgggaatatgcggtggcaccattgtggagatttgagtttcccggatctgagtgaatgaagtatttcagtaagcatctcaactacatgaacgcctccactaggaaatttaaagaagagcaagccacttcttgatagcttaaccagtgagagatttgaagccctgtcaacattgtcattcaccttggactggggtgagcttgtgtttccggtgcttccaattgattctgaaacactgctactattcccattcgttactgcctcttctaaacttcctgatgcctccgagcacagttttcttttcttaattgcatttttcacatcacatggttctgcatgttcagaaacacagcaatttgcatggtactcttcaaggatgggaatggcttccttggttgcacttttttcacgcttgatggggcacgtgatgaggaagccggaatgcgaacggaggaggagggaccctgatgcgcggtagtcgtagcgcgggaggttgatcaccgcggcgtgctgctcccacggctttagctcctgggtgccggtggaggcaggggcgtcggattcggactccggtggcagctcgtgggaccgagatggggttacggcttccagcttggcctccggttccggcgccgccatcttagagccaagagcactgggaccctggtgttttggtcggagcctcggaggtatggtgagggactgcggccgggccccggcgggcgac

SEQ ID NO: 22880 - DNA, 4023 bp, Zea mays
  misc_feature (743)..(743): n is a, c, g, or t
  misc_feature (1617)..(1617): n is a, c, g, or t
  misc_feature (2112)..(2112): n is a, c, g, or t
catagcctcttgttttattagtctatcatatcaagatacagaatgttcaggattgctgtgctgtgcataacacctaggagagcaactcagtaacaataaatcaaggaactaagtggttaaatgtcggtcactcttgttatgtcgacagtaataacctgacaaccaatgcctcactagaactgctgtacaatagatttgtcaagcacttcaatagctatatgagaatattcatgtgtaaacagtagtaatactgacagttggtgctatggcaaggcttaatgaggcttatcacttcaaatgggactgtatggtatcttctctattagttgggaatgaattatttacatcaactaactacaactattaatagagccatgtacatagtgagatgtgttgcaataattccaaatagatccgcctccctagatctattccctatctgtctatcaacatcttttttatgaattgtcaaaagatcacgacaggagcattatgaaatgcaaacttccaatttcataatgctattttcctgcatctctatctgcatcaaagagatcgaaaaccttctcagatgatcatgcatacagcagacctccacaagatactggccttatgttttctaagcattaagcaacagtggtatattaagggacgtaagctggagtccttgacaacaagccatccagaccacaaggtgtatcacatggtgaaaagatccccaaatgcattgtatcatgccaganattcagcgacttatgtagttgtaacctataccctttattttttatttgtagatgttgtgaacatatttagaaggggctaactgccaagtagactaaatactgatgtaagaactttacaaaagtgtacagctagttcactattgtacaattcataatgggtatgaaacttctcccttgtaggcatgacccaatatgagatttaagaaatgatctctaaaatggtttcaaagatgacaaggtgacccaaggcacacaccttatcaactaggcggcaaggcataactagacaccgaaggtgagctgcagccacctggacacctaggtgcctaagggagagagaactctagactgaagaaacataagcctaagtgcctaggcaacacctttgaaacagagatctttagactgaagaaacatatgcctaatacatagaacatatagaaaaagaaaccttccaaactaacagaactgttcttatctctagttttcaactcacaaggtgctggtgggttttgcagaaacagtgtgggtgatatatgaaccacgaataggtgtgtagatattaatgcaattgtataacatgacaagattaggcctctaattcataagcctgcataaaagtgcatctaccaacatgtgtattccacctcaaaggtgttcagattaaaatattaaattgcattggtaaacgaggtttgccctgtcatttatcatagcggaataacaaagtggttcagactgagatactagattccccctccctcctgtgccgcacactgtccctgcccctgctgcccaggctgccagcctcctacggcacgggcaccatggccaccgccatgtccccgtcgtcctttgccctccaacctccttncactacaatctacgcttctcatcccctaccaatctaagcccatcacaaagacatatatagtttatcattatttacatttagctattcagtccaatattatacaccttccaagtggatcccttctatcccacagaaaagtttgccctttctgcacttgatacccttatctatagctaccaatcctcaaaagttgttcatccatattctttattaatgataatgataggtaaagttctgaaaaacaggatccattaaccttactaaaccgcttgaaaacttcactaggatgaaatttctagggaacatggataaatctctctgaaccaggtgctgactgctacgatcccattgattagcagtgctactgaagaataatggccaattaagcacaaattcataatagtaagaaacaatctattcattcaaagaggaccaggcttagcccgggtggtgaaggcggcgaggtccccttcaccaggtcggggattcgatccncgatttctcacaaaaaaatctgcttgctgtcctcacccgctctcaggggagcgactcggctgtggctggctctggcctgggtgggcctttgcagtgtggaaagcctgtgagtcgacccgttagtgacgggagggcagggttcgggggtttctcggtcaggatcgttcgctgtgatcttctatccatggaaagccgcgagggtggtcttaccctccccggtcgagttttttttaatatattcattcaaactgcaaatgatgtcaaacacatgcaagtaagataaaatataaaactcaagtgaaagaagaaagtgtacttgacaccataggactgctttgtctcagcaacagcagatgattataagaaaatcgtgtgccaagtaccacaatataaacagagtgttattggcataattggggccaagagctcaacagaatctactatcttacaaaagggtgtttccactgttcatctttgagaaacaattgttgtcttaatagttggacatgactagtgtcagtttagtctttgttaccatcagttctgatgaaaatatactcacacatcaacgctacaagtgttcccgacatgtcttataaaaagtttctatttattgtgacattgaaacaaaactgagtgcaaataaataactagaaacagttgtatctatgctacaaatgtaaaagttgaaatgcacaagcacatattagttatgataaacttacagatcaaatctttgatatggttcctcaatttgtctggagtccagcaacatagttatctctggagcactttcgcccatcgtagtccttactccttaggtggatgaaatgaattattttagtactgcacccagcagatacacagttttttgttcattctggaagattgcactggagatgacatgcaaaacaatcagggtactgcacagaatgcgcttgccttcaccgccacccatcaataaacttatggcttgattacaacagccatgaaacaagacagaccatcaagatcataggatcttgtgacgagatgaatacaactagctccatcctactagtcatatgaattgatcttttcgtgtagcagtgatgcattaatcccaagcaaacaagggtttaactctattactgcctttaagtcctgcatggagatggaatttgtctctggaggtataacagaactctgcccaggaacatggttatgcactgatacaccatttattagctttcggcacagctgctgcttcaatgtctcatgccttagtttgccatgtcgagaccttgctctaactaattcaatgcaagatccaattaactgcttcatgaaaacatcaatgccattattcaacaaattagcacactctatcgagaccccttccaacccatttgctcctgccactttgtccatccttttcttcactgacgaagtatcacagagttcaccatcttcaatacaagtatcagaggtatcctttgaactcacagaagcaaggggtaaaggtatttgggccacaccaaaactgccatgacgtaactgaatgccaagtggtgcttgaatgaccaaagactactcaagtgaaagatgacattttctaagccatgtcctaatcaagcagtagatggatactaagtttcagtcccagtagtggaaattatttgttattcagaatcaagtaccggcggccggagatcgactgatgcatgagagtgctttgtggtggtggtgctcctcccatggttatcgatcgacaggtggtctcggaggtggtgtccacgttcctgctggtgttcgtcatgtgcggggcggcagggatctacggtagcgacaaggaccgcatctcgcagctggggcagtcggtcgccggcgggctcatcgtcaccgtcatgatctacgccgtcggccacatct

SEQ ID NO: 22881 - DNA, 2166 bp, Zea mays
agctcgctggccgttgctgtcggctaaactataatggaattggaagtccaactgcgtcaccttctcttcagacttctattgatccagcgtatatccagtaccttgctcaaattgcagctacctgggatgatcctctaatggacaggagccatctgggaaattcttacatggacttacttggtacacagaaagctaaccttggccctttacttcagtcacaaaagcaatatggttactgtggcaatcttggatttaaccttggttatgctggaagtccattggcaagtcctgttcttccctcttcacctattgcaccaggcagtccacttaggcatggtgaccgcaacatgcgctttccatcaggcatgagaaacttcggtaattccgttggttcatggaattcaggcatgagtggaaagatggatgctaatttgatgccctctctcctggaggaattcaagagcaacaaaagtaaatcatatgagctctccgaaatagctggccatgttgttgagtttagtgctgatcaatatggaagccggttcatacaacagaagctagaaacagccagtactgaagaaaaggacatggttttttcagaaataatgcctcaagctctcacattgatgactgatgtatttggaaattatgttgtccaaaagttttttgagcatggaagcactacccagataaaggaattggctggtcagcttattggacgtgtccttgctcttagtcttcagatgtatgggtgccgggttatacagaaggctatagaagttgttgatttggatctgcagactaaaatggttgcggagctggagggccatgtcatgcgctgtgtacgtgatcaaaatgggaaccatgttatacagaaatgcatagagtgcattcctcagcatgctatcgagttcattgtctcgacattctatggccaagttgtaatgttatccactcatccatatggttgccgagttattcagagggttctagagcattgtgatgatcctaagacacagcaaataatgatggatgagattctccagtctgtttgcttgctagctcaggatcagtatggcaactatgtggttcagcatgttctggaacatggcaaaccccatgagagatcagccattattgagaagctaattggccaagttgtgcaaatgagccagcaaaagtttgcctcaaatgtcattgagaagtgcttagcctttggaaatcctgtagaacgtcaggttctgattggtgagatgcttggatccactagcgaaagcgaacctcttgaggtaatgatgaaagaccagtttgcaaactatgtggtgcagaaggtgctagaaacttgtgacgatcagcagagggagatgatcctaacaaggataaagacacacctgaacacactcaagaagtacacatacgggaagcacatagtagcgcgtgtagagaagcttgttgctgctggagagaagcgccttgggcttcaaccagcatgcaccgccgcctgaagggcaaactctctaagttgtacagctaacagttgctaggtttgcctcatgtttttttctctactaaaaaccttatatgaaggccccttttggcctcgccaggaaaaaaaataaatactgtatgtttgcggggaagagtgtacattaattctgtagcagaaagaccccctacccatgtggcggaatcaagggaggagtgatgcgtgtgagtccgatcgatctgaaggctgctgtaaagaggaagatggaaggggaaggagtgagaagcatgtcagttactctgctgctgtacaaattaaacttagctcttagagtgaggagaaagtaagctgttagctgtctgcctaaaggaaagaaaggaaaaaaaagaagctggaggccattggcaccctgtttcatgtgttggtatagctgctgtggctctcctgttgtctgtctggcctttgttgtaacataaagctgaggcgcactagcctgccttcgttttcacagttaagctgaagttattagtatcagctttcctgaactgcttggtatgtaatgtgactgtgttttcttccttgtactaatgcttgtctcatgtaatccattcccctaatgtctgaatgttttaatctcaattttcacctctgaaacgttttttctaaaaaaaaaaaaaaaa

SEQ ID NO: 22882 - DNA, 1957 bp, Zea mays
agctctccgaaatagctggccatgttgttgagtttagtgccgatcatatgggagccggtttatacaacagaagctagaaacagccagtactgaagaaaaggacatggttttttcagaaatcatgcctcaagctctcacattgatgactgatgtatttggaaattatgttgtccaaaagttttttgagcatggaagcactgcccagataaaggaattggccggtcagcttattggacgtgtccttgctcttagtcttcagatgtatgggtgccgggttatacagaaggctatagaagttgttgatttggagctgcagactaaaatggttgcggagctggagggccatgtcatgcgctgtgtgcgtgatcaaaatgggaaccatgttatacagaaatgtatagagtgcattcctcagcatgctattgagtttattatctcgacattctatggccaagttgtaatgctatccactcatccatatggttgtcgagttattcagagggttctagagcattgtgatgatcctaaaacacagcaaataatgatggatgagattctccagtctgtttgcttgctggctcaggaccagtatggcaactatgttgttcagcatgttctggaacatggcaaaccccatgagagatcagctattattgagaagctaattggccaaattgtgcaaatgagccagcaaaaatttgcctcaaatgtcatcgagaagtgcttagtctttggaaatcctgtagaacgtcaggttctgattggtgagatgcttggatccactagcgaaagcgaacctcttgaggtaatgatgaaagaccagtttggaaactatgtggtgcagaaggtgttagaaacttgtgacgatcagcagagagagatgatcctaacaaggataaagacacacctgaacacactcaagaagtacacatatgggaagcacatagtagcacgcgtagagaagcttgttgctgctggagagaagcgccttgggcttcaaccagcatgcaccgccgcctgaagggcaaactctctagttgtacagctaacagttgctaggtttgcactcacatttttttctctctactaaaaaccctatatgaaggccccttttggcctcgccggaaaataaacactgtatgtttgcgcgaagagtgtacattaattctgtagcacaagacccatggggcggaatcaatggaggagtgatgcgtgtgagtccgaaggctgctgtaaagaggaagaagatggatggaaggagtgagaagcatgtcggttactctgccgctgtacaaattaaacttagctcttagagtgaggagaaagtaagctgttagctgtctgtctaaaaggaaaaaaaagaaggaaatggtgaggccatcagctccctcctgtggcttttcctgttgtctgtctggcctttgttgtaacataaagctgaggcgcactagcctgccttcgttttcacagttaagctgaagttattagtatcagctttcttgaactgtttggtatgtaatccaggtccctgatgtctgactgttttaattgcaatattcatcaccctgataaacttactttttgtttgttccttgttgagatgttcctgttgtaaatttcttttctttttgccaatgttgcggtcttcgagactgctcttgcccttgtttttttgcatggagtttcaagggagagattgggatggtacatgtcctgttgtagtacatgttgctgtctgtcatggccagtccggacggttgtggcgccttgtactctctcacagtctcactcgtgcttcgtgtgcgtatatgctgagtggtagaatgagtgcaaccagttttttcttctgaataatggagcaacgttgagtatatttctagggccatgatcccctgaatcctatctgaaccggctctataaatacccgtgagggtaggcagtggcatcgcatcgccag

SEQ ID NO: 22883 - DNA, 4210 bp, Zea mays
  misc_feature (3510)..(3510): n is a, c, g, or t
tcgagcggccgcccgggatcgatcttgcccgccagaggagcttctccaccgtctttcaggaggattcgtatcagcgtgatatggataggcagactgccagccacaatagtagtgaatcactatgttcttctggaatacagtatggtctaaatcgtggacctggaactattggaggcctgcactctagcaatagtttacgtaccctccgggcttgtccggacaatgatctgccatcaaatacatttgcttctcttttagggccatctctttctaggagtgcatctccagatcctgagcttgtgaggagggcccctagtccatcccttcctccaatcggtgtgaaagttggcaacactgataagatgaatggtggttcctcttctttccgtcgtagttcatccgcaatcggtggatctgatgatctggtggctgccttatctgggatgaacttatcatctagggcaatgagtgggcaaactatggaccagtctcagctctatcaggatgttgataacgtccagaagtttctttttgatcgacagggtgaccaaccaaatggcaatcagcagcactacatgaggcgtcctgagcatggacaatctaagttatctgatggatattctgccaatttggccaattcatccacgatgagaaaccagattaattctggcagtttcacatcttttgacagtttgtctcttggatctggctttccttcccctaggattggttctagatcccctggagggactgtatcttctcgacaaaatttagctggtatgtctaacatgctaaactataatggaattggaagtccaactgcgtcaccttctcttcagacttctattgatccagcgtatatccagtaccttgctcaaattgcagctacctgggatgatcctctaatggacaggagccatctgggaaattcttacatggacttacttggtacacagaaagctaaccttggccctttacttcagtcacaaaagcaatatggttactgtggcaatcttggatttaaccttggtggttatgctggaagtccattggcaagtcctgttcttccctcttcacctattgcaccaggcagtccacttaggcatggtgaccgcaacatgcgctttccaccaggcatgagaaacttcggtaattccgttggttcatggaattcaggcatgagtggaaagatggatgctaatttgatgccctctctcctggaggaattcaagagcaacaaaagtaaatcatatgagctctccgaaatagctggccatgttgttgagtttagggccgccccttcccggtgcctgtttctagaatcacgatagtattgtaagtttgtaacatgcaaataatcctactattttttgaatattttgtagtgctgatcaatatggaagccggttcatacaacagaagctagaaacagccagtactgaagaaaaggacatggttttttcagaaattatgcctcaagctctcacattaatgactgatgtatttggaaattatgttgtccaaaaggtaggagtgtatggaagtgctgcctggatatctgtctgaggttgtcttgtatcttttgttaactcggtgctcctttttctcagttttttgagcatggaagcactgcccagataaaggaattggctggtcagcttattggacgtgtccttgctcttagtcttcagatgtatgggtgccgggttatacagaaggtgcttgtcaattgaaataccccccaatcctcatgtctattataactagagcttggttattgttttttgccttgctaatgcgttgacggctcaaataaattaccttgcacaataattcataccgttgcttctgagtggtgggagtcatttgacctacagatttggtatattgttggtttatagttctatcctcctgattataaaacaagttagcatgaaaacacctgcagcaaaccactctaatatgagaagtatacattggatgtttgttggaaggctgaattgtatacattttgtatgtgcttgtacaattggtatatgagaagtatacacttgcatctctagaatttacataattggctggaagattgtatcaagcaacatgttgtttctgacaatattgatgatatatgtgcaggctatagaagttgttgatttggatctgcagactaaaatggttgcggagctggagggtcatgtcatgcgcctgtgtacgtgatcaaaatgggaaccatgttatacagaaatgcatagagtgcattcctcagcatgctatcgagttcattgtctcgacattctatggccaagttgtaatgttatccactcatccatatggttgccgagttattcaggtatgataattatatgcatcactcatccatttggaggcttaccatttgtaacacttaacttgttattacatcacaaattgctacagagggttctagagcattgtgatgatcctaagacacagcaaataatgatggatgagattctccagtctgtttgcttgctagctcaggaccagtatggcaactatgtggttcaggtcagtgccatgttcagttttgaaagatatgtatacatgttattcctgccttcctggttttgagttggtgggctgtgttgtgcagtaacatctctaggattatgttggtctcagtatgttgtttgcttcataactggtatcgtttgacactgaaatgtggatcatggactccctttccttcttccatgaaacatgggtattagtgaactactttgtatcagagttggttccatttgttgtagcacgcaactcaccctcagaaaacaccccaacacatgcaaaaagattaactggcttgccaaactgtggacgccacctgaacatcgtccagggaaaatgatcttaagcaacttcttggagctacactactccagctgaacatcataggaaagttgtggaccctggattttaccatagggtgtgccacacccacaccaaaagtttcacatgcacgttgctaaaaatccaattagcaattttgtaaacaactgtaaaatttgtcttataattcggtgtacaagtactaaataacataaatgggtcttaaattcaacaatttagtgcacaatggatgaataatcaacaaataataccctaattaatatttcctgatctaccgggtacattaatcaattgaactaacttgacgataaattgatctggttagtaactactaccagtgcaagtctgtaacatacattggcattggccttggggagttctgacttggctctgcagtactgctgcctgttccatgtcgccatgtgctgtgctgccgtgtggaacaggaagcaacaagagaggtgtgaggtacattggcattggccttggggagttctgacttggttctgcagtactgctgcctgtcccatgtcgccatgtgctgtgctgccgtgtggaacaggaagcaacaagagaggtgtgaggtacattggccttggccttggggagttgacttggctntgcagtactgctgcctgtcccatgtcgccatgtgctgtgctgccgtgtggaacaggaatcaacaagaggtgaggtgctgatgcttgtcggcctgacttgctactgctaaatggcctaacacaaccaggagactttagggttcggttgaataagctgagaggaggccaaagaagtcggttctgggaattcaccagtcgtggtgtgatgccggagtggcagaggtcaccgcgggcggtcctcggcttgaccagttggggtccgatgcagctgcaccagtcaccttattagctagtaatgggagtcagacttgtgcatgggagtgatatatttttttacaaagggataacttgtttggccggcttaggaataactaattggttttctttttatgttttctagttaatatgtagggaacttgctgaatttttgtggtgaaatggtgctactagttattaatctctgcaggttacaagtaaataatgtattggagataggtagtctttaacatggcttggactgctaatgttcatttttatttgtaaattgtgatactatgtatgtacttctggggataattttatggatattatttttgtaggggcaatagtgtatatcataacgattttgttaccaaattttgaaatgcttgactggagacattccaatgggttatttttcacctgctgtaagcagcgcacac

SEQ ID NO: 22884 - DNA, 1302 bp, Zea mays
  misc_feature (1301)..(1301): n is a, c, g, or t
tttttttttttttttttttttttttttttttttggaataaattgttcgattcatcaatcattagggttaacagggttccaacaaatggactccatacggtgttccaagcaaccaatgaactgacaataaactactccattaatactgttgtgctgaggggagacaatgaagctgggttacaagcaacatgtcgctatacaacatacaggagaagtcaatcttgaaacacttgccattgtgggcctggggccaaattgacaatcaatacaatgatgcaagtaaaaaaaaatcaccgtgagtctgactacaccttggcattctttctagcagccagtagttgtgtgctacctgaattatctcttggcgaaacagtataggatagcgtaatttgtgctgggttcggttccgcctcttcacggaatttgacatcaaaagcaatcgattggtagagacaaacttcatcttctttacagtagtaaaccttgcagtttatccttcccattgacaaggatgatgatatccttctgaacttcagtgatgccagcccttccgagtttagaaaaccgttcgctggttcaatctcaactgcattaggcggctctgtttccacatcaaatttactgcgggcttccttggagaaatggtaaccatcaggtactgtaactgcaagagacaagaatccttcctttgaagaaccaccatcgacattaataacatctgtatctgccgataatcgccgtcttaggcgtttcaacaccttcggttttggtgatggcggttgtactccgatcaactctagtgtcttcacctcagcacctttgtcactaagagttatatatctgattgcgttgttgtttgtatctgctacaagaagccttccatctccaacttcaacaagtcctgctggttcagaaagttgagctgtcaagcctggaccatccctgtatcctgcactccccgttccagcaatagttgtaacttttcttgtgacgggatctaacttttttatcttatggttgtaggaatcagctatatatacttgattgtcattggcataaacaacacccaagggatgttgaagtagcacatctgagccagtcccgtcataatctccaaacctaaacaaattttctggaaatactggatctcctccagccagcaatcttgagcctcctgtcttcagattaacaactcgaatggaactactttcactatcagcaacaagtaactcatgcatttcaaaagctaatgaaatcccagaaggctgtgcaaacgatgtgctggtggcgcttgagccatcna

SEQ ID NO: 22885 - DNA, 1761 bp, Zea mays
ttttttttttttttttttttttttaacacaaaaatcgccgcaaaatttcatttacaggcgtacagctactgctaagcattcgaacagcaagcactttgtatgacagaaagcattagcttgatgttaccatgcatgtatatgtgtatttactgaaccagcaaaaattctctacatgtggaatctcagatacagggcacaacagttgtcgaacaaaatcaatgaaaagctgaagaaactgatctctcgttcgttccatctttctcggtgaggcagacgatacagctatctgatatcaaccagctaatccgggccaagggagatcgggagcttctctcaggtgcgacccatcatttcgaaagccagtaaatgatcaggaagatggtgcaggccgcgatcactgccgagaggattatggtgtcctttgatttcttccgcttgatggcaccaagaagacctctgattaccgggaacttttcacccagctgcttcactttcccttgaatgtctccaaacatggccctctgattgttaagagctactcttgtgctttgagcttggccaattacctcatcaatctggttgatgctgccatgaatggaagctcgttccctgagcaaatgcactcttggcgacatgccaccggaggccctggactcggtgatgtcgtctcggacggagttgagtagatcggcgtgctccctcatggagctcaggttccccctcgtccgcctgaactcctgcgtgaactcgtggaggatgtcgcggtggcgcgcgagcttctgggagacggaggtggtggtggcgctggaggcggcgcagcggctcatggcgtcgttgacgtcctgcagcttgccgagcagcgactggatctcgaactccatggacttccaggaggagcggtcggcggtgggggaggcggcgcccgaggcggaggaggaggagcgcgcggcgaggcgcgcgtaggaggagagcttcacgtcgaggtcgccctccagcttgcgcgcctcccgccgcagctcctcccacccggactcctgcagctccagcgccgctgccgcgtccgacgacgacgacatcatctccggcacggcgccgcgcgagatccgatccggctaggggtctggggccggggccgcttgtgatgcgaaggagaagcgcggggagtggggagtactcccgatctggatccggccgcgtgccgtcgtggggaggttcggactcgcaaggaggatcaaacggccgcggcggcgacggaggaggaacgtctgttcgatcggaggcgagggcagtttagccggtggagatggaacggaaggaatcgtggctacacccctgcttcatcgcgatatttcatcacagtcccctccattccatcccatcctgtgtcgtgcaggtgcagtgttcattgttctgcgttttggcatttcgatgcgaatttcgtgcaaggaaaaaaaaacccgctggcgctccgttttgccacgaccggtaggaataggtccgagcaaaatcaaaaggcagcaacttctcatactttttttacaatcctctagagatcaaaagggggctaaattatgaattggcaatgctaaaaatggccatagagtagatacaaagagaatgcacaaattgaaaatgtgtgtcatagcccgatggacctacatacttccgttatgtgcctccatcttagttattataaccatgggccattgctgaaattactatatggtgctaaatgttacttgggctgctggaccgaaccct

SEQ ID NO: 22886 - DNA, 2372 bp, Zea mays
ctccttttattttaagattcactgcatcattattctttagagctccatgtatcattgaccttttttctcaaactttgaccaacaaatttatttaattatttaactactaaaatggaaagcataccattaaaactgtcactgaaataactttgagcataccttgtatgtcctttcactcaaaactcaaaagtgtatagaaaagacaaattggaaataacgaagatgccatatatttaaaaacagagggagtaacctttttccctatttatccttagaaaaatactactaataaaatgtaacaacagggatgattaaatatactattaaaaataactttgaggataccattaaaaatactactaataacagagggagttgccttgtatgtcctttccattaaaagtggaaagcataccattaaaactgtcactgaaataacttctgcacaaatgatactgtagaagctaaaatcttcgtgctaagatattaagaaaatagttttacatcaaagaagattgtgtctttctattctcagcatttaccatgacatgcatatgcagaagcaagacatgtgatacatgatatatcttgagagccaagactacataaaacacatatttgttcaatgtcaaattatgcatgaagccatgaaccaagaacaatattggcatcatgcactttcaattctcttggtagacctactgaatggtcactccatgtgcacaagaggataaagctacgagagagaagtagaaccagcaaggtgggaggtctcccacacttgcacaccttgcatctcttctcttgtcacaaacaagcggtctccacccccttcaatcatctgtatcatcccacgcttagcatccttttctgtgtccacatagcaactcctataaaatctgtcatcaattccttcatttttgggtctttcctttactcctgattgctctgtcaattcccctgtgttgtggcggtgctcttccagtcgggaccaaacctccaatccatcctttcggctgacaaaaacttgagagcggtgacagcacagaacactgccatagcctcctgcgctccctcgtggtcctgatgacatatacacccaggggtcatcgccaaggcatctcaggtctgccactgctaaatctcctgactttgagcaaaccttgtatattgcctgctgcttcacatccacatctgcatctgcaaatggatccccaaacctactgcttcttccagctccccctggctcgcttgtctcccacaccacattcccagaccgaatgtcccatagcctcatatagccagagtagccaaatgccccggaactaacgaatgacgcaaacaccagaccaagtgcctgcaggtgcaccactcgacctggtgccgatgacttagccgcactaccactttgccggccaatctcctgtgtaggcttcagagttacagggtcaacagccatgatgcagttttcccgatgagggcactcaaacgttgccaagatcggtgaattcttatcggcggcatcagctggaggacgggccgcaatggcgacgaccttcgccttgctggtgcgagtgtcagtgggatccgaccactgaacggaggcgacatgtttgccatcgagaaagtcgtacacgtgaagcccaggagcggagtcagacccaaggacggcgagactggagggcagctgcaggagggaggtgacgcggtggaggtgggtccgaatggtggcgcggtgatccagcgctggggagtaataggtgaccagcccggcgccatgggcgaggcatagtgacccgtcgtggtgcggcgcaagggcggtggagaagggctcggaggaggggcagagggtggaggcgagggaggctgagaagccgcggagcggcggcggagatagcgcagcgaggagctgggcgtgcaggccgtagaagttggcctcgtcgaggaggacgcgcgcggggaagtcgggcgctgcggtggacggggagcggatggcagcgaggacggcggataggagggctgggtcgcggtccacgaatgttggggtaggggaaggggaaccgatagacatggggagggaaagggagcttgcctccagcgagaagagcttgccccccacgttgagctgcttcatcatgccgctccgcccgccgtggacgatggttcccatggctgcagagtgcagactcaggaaccttgatgtggactgctggctgttgttcggctgtccaacgagacgacgacctctcttcagactccagccgtgcagagtgggtcccggccgcagacacggtgttgggactatttcaggacgatcaggcagcccaatccccataggcccatgatggggtaacaacacaaacaaacaaatg

SEQ ID NO: 22887 - DNA, 941 bp, Zea mays
ttttttttttttttttttagccgacatcatatggtacattacacagagctaaaagggttttcgcagcgtacagtttacccagtactccatctaaatattgggcaccctaactagttatcagtcgaattgttgccgaagagccatctcggtttcactcttccatgatgcatgtgacgattgccccctcatcctcttgaccttctccttgtctttgacagtggaacccttcttcttttcgggctcttttgtctgcatcggtctaccaccacactgagggcacaccataccctttccatgtgaataggtctttggtacaccacattgtagacacatccttagaagatcagctgcgtcttctggcccaggatttgcagcacctattactctttttccatcaatagaaccagctgtcactgaacctggggggttggctccagttgtggtaactcgctcgcggatagcaactatctgtggttttgccaccacaacagcacctggaggcggctgtttgctcccctctttcccacggcgatcgagtacaccgagggcctccgtcccttcctctggctcggcaaccctgtgcctcaaaaaatctggtggtcccgagacatcagcgaaggcctccagcgcggagggcagcaaggagcccccgtcgctgccgccggcatctccccccttagggtttggtcggcggcggagcttggggggcggctttggaggagcggactcctcgtcttcgtccgatccggcttcctcggctgacgaatcaccagactcgctcagctcggtgccagcgccggcgccggcggcgggatcgtcgtcgtcctcagcggaggagtagccctggagaagcgttaagctcattgtctggttattttttggttctttccgttcggctcaactgcctgcaaatctagtatagcaatttcatgccgtatggc

SEQ ID NO: 22888 - DNA, 1817 bp, Zea mays
  misc_feature (549)..(549): n is a, c, g, or t
  misc_feature (1000)..(1000): n is a, c, g, or t
cagaggtcaaagtcaagggacattttggacttttttccaaaacaaaatgggtgccaaatattaaacgaagcacaaactatatttgcactgaacgcgtgagacatttgcctacccaatgaaattaacaaagaacagaacagcagaaataaatatgagcaatagctacatgcctgaatgtttgcttcgccatcagcaagcttgaatggtggaccatcacatgttaatttcccagacacataaacaagatcattttctttcaagtgggaagcagctatttgtgcccagttatctttgaaaactatgggaaccctgaatgtaaaaaaaattgggacatcagaatattcgtacgggcgagaaaaatgggaaacaaatggcaacagcagacatgtcaaaaaataaaattagtaaaagtgttccagaaacaacaaaagatacttctggtggtccttagtatgtcttagactacaaatgcttgtgttggacattagcataccatgttgaaacaatggttataaaatatggataaataaaggcaaaggaacttctggnttttcagaataacgatatatggcagccaagcaggtccaaaatttggttcacagttatatgtacagataacaaggcaacaacggatttagttagtcatttcgatgcaatagagaacaaaaaaaaaaactgaaagatttgggagcaatcccgattccaaagtcacactataattatcataatatcctaaagtttaaaccttcatcccaattgcaatcactacggtatcgtacaaagtcattactgggtgtatgtaatagagaaaagggcaacaagggaaagcaaacaacccactcaccagaacttgggtgagttgatgccacggtcgtgcacgagcacggagaccgcgggcgcgccgccgtcgggcagcctctgcatgtgcacgggcgcgcagatggtgccgacgaggtgcacggcgttagcgacacgcggctggaacgggacagtgggcggnccgcggcagctcgcccgacagcttctctctctgaaacgcagccttcgcctccgagtccggcggcggcggcggtgctacaggggaggaggcggcagcgtggtctccggagtcccccgctggtggcggcttggcgcggcgggcgtaagcgcgcctggggggcgtggagagcgtcgcggcgtagggagaggtggcggcggggaggaggagacggtgggtgaggaggcgcgagaggaagtggtgatgcatggtggctatctggctgtagaaccctaaaccctagcgagggaggcacgcaaggagaaatcccagggagggagggggagccagccagcccaaaatgctagggagtcttttttcgaggagattttttttttcatatttggcatcaccttcgtcgagtttcaattgccatattggcattacaatcacacacggtttgaagatttgacatcactttttctaatcgtcgtttgtggatgtgttcttcctatcgtgcccctgtctcctttcttctccacacatctccgtcatgcaagcttatttcaccaaacatggccatcatcgtcggtgtgatcgcctacggctgccagcagctgggtcgaatatgtcgtcggcttctcgctgtccatgctcaccaactccctggtggtcggtgtgcccatggctacgacgagtgggcgcaacagctctccatcttccaggccatcgtcttgctggtcgatgggtttccgtcccactcgacgatgggtagcacggggaggtcattcatcctcgtgccgcgcttggcatcctcggtaatgattgttagaacacaaag

SEQ ID NO: 22889 - DNA, 2223 bp, Zea mays
ctgcagatgttgtctagtctttacagacagctcagctaggtgtctttctttggcctcctaattgccctgctgggaatatcgggtcatctcaggagataagacgttgccacaccaaataagtgatggttgtgcttcaaaggcgccgtgcttttgtcccacatggaaatggacgacgtctcatcctggccatgtagaaacaaacagacggccatcatggtcaggtacaactttcaaaggcgtcatcacagaggcaaggcaagcatctacaagatcttcctcatcagggagtttggacgaacaatcattgggagtcgacaactagtgcccaatcattcatttcaggtgatcatcatagttattaggactaggatccgacactaacgctgttcggtgctgtataatcttactactagtcctttagcggcccaaccgcctggacatagtaattagggtcataacgcaatgttgtgcatcctttgcatctccgcggaccgttttttttttttttttaaaataataaaggaccattttccattcatatgggcttttcatgggcctgtgggggccaatcatagtctaccaatgcatcttccataaaggtcctaccaggccccaaaaaaacagcgagcaacccatccatcagtagtacaacagagaaaatgtggggaatcattaaaagcctacaggatgtgataagcatcaatttggaaactatttacatcctgcatccttagttccttaccagtcaaaaatgccccaacctgaattttgttgtctgaatcaggagccagccgcacgagagacagacccaatatcaatttagcaagaggggcagagagctcgggcaggtttaccatggccgccaagctcatatcatatcgatcatgacagcaaggtttctttccttgtacccttgctacctcccttaaagttcaaggacggcagtgcatctaccgcccatcgaggtgatttggttcctatccatagagcttgccctgaatccttgttcttgaaatcaggatgctttagtgtcggcttgtctgatcggttgtcccaccagtttgctggattgttcacaagatctcgccacaagtcctcttcaagtctttgctttgacacagcagatgcatctgggctcttcatattcctccatacagtctttgtaccaccttcaagtctttgctttgacacagcagatgcatctgggctcttcatattcctccagtttgtactggttccgaaaggtttatcttttctttcagtggtgtaaccactaccgaataccaaatcatccagcttctcaagaactgatgttggtgcactgtcaagccagagtacctcatctgaaaccttgttcttaaaatcaggatactttgggctccttgaaccagttttttcagaggccggttatcaatccaatcttgaggtcgagatataacatcattccagagtttatttaacttatccgccttgtttttataacctgaaactgtgccaggcggaaatgtagaggtcgttttttttgcttcaactttcttttcagcctcaacaatctccaaaaatccttcatcttcatccagtatggcatccatttcaacagctttactatcgacaaattttagcgaatttgctaacacctgaatgtttgcttcgccatcagcaagcttgaatggtggaccatcacatgttaatttcccagacacataaacaagatcattttctttcaagtgggaagcagctatttgtgcccagttatctttgaaaactatgggaacccagaacttgggtgagttgatgccacggtcgtgcacgagcacggagaccgcggagaatctgccgtcgggcagcctctgcatgtgcacgggcgcgcagatggtgccgacgaggtgcacggcgttagcgacacgcggctggaacgggacagtgggcggccgcggcagctcgcccgacagcttctctctctgaaacgcagccttcgcctccgagtccggcggcggcggcggtgctacaggggaggaggcggcagcgtggtctccggagtcccccgctggtggcggcttggcgccccgggcgtaagcgcgcctggggggcgtggagagcgtcgcggcgtagggagaggtggcggcggggaggaggagacggtgggtgaggaggcgcgagaggaagtggtgatgcagggtggctatctggctgtagaaccctaaaccctagcgaacgtcgtgc

SEQ ID NO: 22890 - DNA, 2368 bp, Zea mays
aggttcatcaatcacttcatattccagtattcggggtactcggctccccctttttttttttttttggacaacaaactcccagtaataattttaccataagaatgctgtggaaaacagcaaagatggaccaaccaattcctgtaattatacagtagggcctgaagtaaaccaggtcagttgttagttgacgataacatgaacatttcagtccaggtactcggttgcagcggagatgccacatgttaagcaacacttcctgggataacaaacgctgagatggattttccgagctcaaaaactacgtacgtgattttctgcggcgcaccctagtttcagcgatcctatatgcggatgatggaggcattggtcttgtcgatgccctcgttgtagtaaagctccacaaatgtgcccccgccaatacccttcgccaacctcccagggttcacacagataaaccgtctgtcgtcgtcgctaccttctccaagggagagcaccttcacaaatggtgcgagatcagaaggaaggaggagaacatctggcgctgatgggatctccagcgcttccttagcgagtgacaagtctaacggcacaccgggggcaggaggatatagagggtagtaactttgctgctttagtatgtgtgaggcaagtctaccaatcctgtctccaggctttccgccaggtggcttgcgagaaatttcttggccactgagctgtttcagaatgtccactgtacaacagccaaaatttatctcgttggaaccgaagagacatggatttgccagaggagtaatctgatgggtggtatcttctagcaaattcaaatcaaatgcaggctgagggaaaacaaagtcatggtgagcatctcgcacagatggaatgagaattacacgaacggtgttccccagatactgggtaaagtcttgaatctttctcagaacttcaaaatgaaaaatgtcatgaaagctctggtcaatagttcccttttttatgtcaggatgatcagagtcaatgaagggtcccatcaatatgagaagctgaggcggctttcgacaagcatatgaaagaagttcttgaagtggctcaaacaacatattatcggttgttgtatagggacctgctgcgatgatcgatgacaatgctcttgacagagtgccagcgtcagaattttggtcgctttcattatcaatagcttgtttcttagcactgggaagttgagcatccacagagaccggtatggaatcaaataattttgatgcaacaaaacagtgtccactgggattgtggccttcaatacccacaacctgcccaggaaacaaagagaagtgatcaagatccttcaagtcaaggcgcacacactgccccctggagtgttcaacactgccctgtagcaagatagacttttcattcaaatgaccttccccgtcacaggctactgtaccgactgcaaacattttctcctctgaagcaagggtagcatctgcaggttgtccacaaaatccagatgcagaaaacaagctcgccgatttccgtatccgatcttccaagtaattaaatctgtcttccattctgtcatacatgaatctgcaacctggttcaggctgtgagcgctgaacttgtaagtaacatctttgactaggttgaactcttctaattatttcatcttctgtgatttcagcatttttacttggcacactaactgcgttatcagcattgagaacatactgttgggtaaatttatttactcgtgttgcaaaaggggtaatacgatcagcatttgttttggccactctgctggatgatggtctgtcacttgcccgaggagttaactcagagatagatgatccttcaggtgccttttcctgttcatagcctggtgtgtcatggaatgctgcttcatctacatgtgaattgcttaagagcatgtcaacatcgttactggagtaaatgtgaaggttagcttcttcttttattatcctgtctttaacttcattttgaaggtgtgacagaaaaccatcaagatacgagctttcgagctttaagccatccaattgcctattgaggtagtagacctcccagtttgagacgagatccgcggggctcatcttgtagttgatgcagtaggtcagcagcgtggagaggatctgggcggcgtcctcggggccggctcctccgatggagaagccgttactctggaactcctttctgatctcctcctccatcgcttcgccgctgcttgctcgctccacagcagaggacaatcggtgagcgggggcggcgactagatgacgtgggggagcggagagggaagagggatctggggagcagagcgaggcgggtagtgggaaatgcggacacgaaatcccgg

SEQ ID NO: 22891 - DNA, 1614 bp, Zea mays
ggacccccgaccgcccccgggcccggagttccaaaatgctcgcaacagccagccctacgtctgaactctctcggacgggtgacaggctaacagccgccgcccgccagctttggagagccacggtgacaggccgccagcagccatcgacggccctccctccacctcgccgtcgtccctcttcccccatctcgccgagccatcgtccctccacagcaggaccacctcaccgagccgtcgtccctccacagcaggagtgcaggaccgcatcgccgagtcgtcgtctctccacaccaggttcgccgtcgcggcgcggctacctcgctccggctcccagctcgtccggtccagctcactcgcggtcgcgaccatctccgtccacctcatccctccggcaagcagttgctatactcatccagggtcagatcagcaactcttgccttatcctgctggctggccgcagcaccggtggtgtggtggaggatggcatcgaaatacgtggccagggtaccgtctccatggtgggcgccacaacgtcgtttggttggttcatgggtttccgtctgctcggtaaaatgcggtgcattgggaggacgggatgttgtgtgcgctgctgttagcttcagaccatgcatcgacattcacaaggggaaagttaagcagattgttggttctactcttcgggattcatccaatgatggcatggaacttgtgacaaactttgaatcagacaaatctcctgcagaatttgcaaaatcatataaagaagatgaacttcttggaggacatgttataatgcttggctcagatcctgcaagccaggctgctgcactcgaggcactacatgcatatcctggtggcttgcaagttggaggtggaataaatttgcagaatgcaatgtcttaccttaatgaaggggccagtcatgtgatagtgacctcttatgtgcttagcgatggcaagatgaacattgaaaggctgacaaaacttgtcgagctggttgggaaacagaggcttgtgctggaccttagctgtcgaaaaaaggatggcagatatactattgtaactgacaggtggcagaagttcagtgatgtgtttgtggatgaaccggcattagaatatctcgctgccttcgcagatgagtttttggttcatggtgttgatgtggagggcaaaaggttagggattgatgaggaacttgtggaactattggggcatcattcaccaatcccagtaacttatgctgggggtgtgtcaacaatggatgacctagagaggataaagaaggcaggcaaaagtcgagtagatgtaactgttgggagtgctctagatatatttggaggagatttaccctacaaagatgttgtcctttggcacaagaagcaaagtatggttggccaagtgtcaaggaacatgtggtagcgatcagtattgccagaatttattgtgtatcgctcgctaaaagcatatttattttcattacaaaacttcattgtgcgtttgaactgcttagtgccttgttatcagttcaatgtttatgttttacttgtgcaaatgttctaatagtccaatccatgctgttgcagtttaaaaaaaaaaaaaaaaaaaaaaaaaaaa

SEQ ID NO: 22892 - DNA, 1677 bp, Zea mays
attcagaggaggatgatgcattgtcacagttgtctaactgtgccctaacacagaccggagcgtcgcggcgctatctcctccgcggctctgcgcgcagtcgtgttggcaactgcagcggggcggcggcgtgcgtccctgctgtgagcttcatcgccccgtatcaagctagtttaggctgtcagcgggccacaacttcagccacacaacccggaactccgacaaccctcgcggctcgtgccgccctctcccgctcggtcgttcccatggatccaccgcaagagttggccgccgccggccgcaagcggcgccggcgaggaggcgtccggaaccgcaaaaggctttcctcgcagaaggggctccctccagcgactgcgcccccaacgccggcgtccccacctgtcaagcggcggcgcaaggacatcgctggacaggccgctgctatgccgaagagaggcaacacctcgagtctactggacaagatgcgtgcaaggttatctggtggccattttagaatgttaaacgagaagctatacacttgcagtggagaggatgcatttgactacttcaaaaacgaccctaatctttttgatgtgtatcatacaggatatcaagagcagatgtcacactggcctgaacagccagtgaatgtaataatcaattggttgaagagtcagaatgcgtcatggactgttgctgattttggctgtggcaatgcagcagttgcaaaaaatctgaagaacaaggttttctccattgatctcgtttcagatgaaccttcagtgattgcttgtgatatggctcatactccattggagccatcctctatagatgttgcaatattttgtctttctttgatgggaatcaactatccaagttatttagaggaagcaaatagggttctcaaaccaagtggttggcttgttattgctgaagtgcgaagtaggctagacccgagcaacggaggtgctgatcctgaaaagttttctaaagccattatccagcttggcttttcgcttgtttcaaaggatgtgaaaaacagaatgttcattctgttctacttcaggaaaaaggaaaaaagtaaggtggcgaagagcatcgattggccacagctgaaaccgtgcttgtacaaacggcgatgagccgcttgtctcgtatccaccagtaatactgtagttgttgtagtagagctcttcaaaagtttcgtcaaaactgaaagtctagatttaggtccctccgtacctgtatggctgcatctgtgtgccacgctattccattattttccacattagctgcgtctttcatttgttggacctcacaagaaaagatcacatagggaacgatgcattgtttggaagcagatcatatataattcaagtctacttttcacatgctgcaaaaaaaaaaaaaaaaacaacgaaccaacatctggaccgttttcatttttcaatctggaatctggatcagcttgaaggaagtgctatgaccttgaatacttgatgaacggaagcattcgatgaaccttgctaaacgggaagttgaaaagaactttgcaaggacttttggttttcaattgatctccatccccattcgacgttatgggtgaagggatgaaggccgagcggtcgaggcatcaagtgaagttgcggaccattggatgagtcgagtggcgatccgtga

SEQ ID NO: 22893 - DNA, 2455 bp, Zea mays
gtgtgaagatggttatggactttttatttcaaaaatcaaagcaacgtatggtgatgactccactacggccggaatggactcatcattggaaaagaggacccatgtcgggtgccaaaaaaaatggagaaatggttaataaatcgagaccagacgctgagtagacatattcatccgtctgtatcaattaaggaccatactgattgttgtcctgctgatctaggaccctttaactggccacataccttgtcatgggtaagcttgaacctggctattccatacgtgaaaagacaatcgcgcactgggagcggagatatggtgagagtagcatgtatcctcctggcattatcttattatgttgtgaatggtataatcttgagggaaggacataccagatgaaagatgatggttacatcaagagcattaacatccaaggtcgatggtataagaatgatcctttcattgtagccatggaagcttcacaagtatttttcttggaagatacaaagttaggtccttgttgccgagtggtacaagaatttggccaccgacatatatttgatgttgaagagttcgataaaaagcaaccaattcatgaacaaatacaaatgagatgttaggaggcataccaagaggatattacttcattgagacatggtacattgggagacatagatcctgatatggatttgctggacatggacaatgaaccagacatccctattagtagagtctttgtcgagagcatccattgtcgatgagaacaaacaattgaaggtgaagaaatagagaacgaagattaagatgaaaccttccctgagtaccatagtccagatgaaggcaacatgtcagaagaatatagtgatgatgactaacttctgcattttagagcaatttgtgaaccatcaacttgtaccagtgatgattttgcatttttacaacaatttgtgaaccatgaacttgtatcagtgaatctattacatttgaattatgctattgcaatttgagtaccatactgatgcccataattcatggacatgatatatatagttctgggttacatactggatgtttcttatgaccactgacaaatgtcatggaatgcccataaaggcccatacttcatagcaaatgcaaatacaacagattcaatacattgtgttcttcaacacacaacttcaacagaaatgcccatacttcatcagccttgcctacttgagcactacaactacaagcaaaacgatggccaacaacaggaatagtgttacattcacacatccgcacacaagacaaatgcagcttcccattccttccctgttgttgccaactttgtccttcacctcattcagatttttctctaagctaacaattcttctcacaatcttaggaacttctattgtcgaagctgctgcaacgatcgaggaagtcattggtagatatccgttataatgaaagaacaccacatattcttcctcgaaccaatacctagtacatgttccctgcatccaatttacaaccaaaaggcaatgaaatctaggcaaaacaataatgaaattaagcaatgcaaattcatcaacttcactaacatgtccataagtcttcctaggacacttgaaatatctctttccctcattagacccaaacttggtagtggcagcaaacaccctcacgtccctacaatctgggcagattatcaacgacaacccagtgtctatatcgatcgtcgcctccagatcgacaccagtgggcagagtgcctacaacaacaacatcaagatgtttggatgcagggcattcctagctgcggttgaacgccgagtgagaccggtagatgatgaggccagcgacatcatctctaaattgacacacatacatcaattggggaacatgaggctgggagggggatgagggcgccactacacaacaaatggaggtggccaggagtgggatgagggtggcactgctgaccatgagcacctagggagagggtcagggggagagtccaccgcactgtcacttggggagagggaagctggctcagcccagagttcgcttggggcccgcgccatccactggccgcatcgcccaaacaccgtcgcgccatcgatgggggagagccggacctgcccccgtcgagcttgcctagaaggggagccgtcgcaccgtgctacgccaccagcccgtaggtagtccgttgccgtcgtccgcttcgctccgccagcaccttgctcgccgtcgttcgctctaccagcgcagtgcttgccctctaattcagctagggttggggtgatggggaaagtgcaagtagtcaagacataggggtagggtccacctacagggggtatattgtttctagaaactatcatttttttgaagtaacttattatgacatcgtgtaactatcacataaacatagatcacagcgtcataaaaatagaatcgtcaacctgttcctgcgc

SEQ ID NO: 22894 - DNA, 5238 bp, Zea mays
  misc_feature (3882)..(3882): n is a, c, g, or t
ggttttctagatttcttaataactctgtttatttaagaattaaagtgttgacgcctggtttgtggattgtctatcccttgtcaaatacatggggtgcttgcctttgctattgctttcagcaagttcgtcttctatagtagatcatcgttggatacatttataacttttgtgttcaattagttagatacctaaccattacaaaatcttcgagctgtttcttgtttacacaagcagggttatctgtcaaatttttcctatgttgcaagcaaacatcatttcgttcatttagctgtgatgatagtatatttggaacctaatattagatgcacataaagatatttacgattgatcttgtattctttgcagtttgaactattgtaatttccagcagcatgcaccctggacttaatgagtggattttttggctatatctcaagaaaacacacataaaagaagaaaaaacaccgaaacagccataaggctcaagtgctcggttttgagagacgagaaaggtgatgttttcagtttgagttaagagtgcaaatattaactttaagggagacaaaagtattttgtaagaatagagtaatagacaataacgcaatcgtggaccggtgagtgggcttggaatgatgcatgggctgggctcttatttggcagggacatgagaagaacgagacgacgagagtatacacacaacatgattgataacatctactttgaactggggtatatcgtatattcaggcaagtgaaagagagcggcttctttctcagggatgaccaacatgcattagtaggcagcacttccattgagaaatggtttctcgctctttcttcgcgctacacgtgtttttagtaggcacaaactgccaccgtgcacgagacatctcaattctctacgcatgcttactttaggcattaatctgatatcatgtccatccgcttcgatgactatagtgtatatacaaagaccagacagacaggagttcctcataagaagcaccaaaaaaacaaggtctctagaacccattcatctccaggagataggtgcgcctcttcatcagcgccttcgcagcaaacctcaagggtccatcgaacgcgcttgaaacaaaggcttcaacttccttgcgattgccatgaccatcgctggcaggcttggtgacaagcaaggttgcaccttgcagtgccaagccaccaggcaattcgaggtactgagcgtacttcagcttcatgttgcatgccggcacctgcgtcctgttagaacatggtgaggctgacaattggtgttccctgaaatcattcagctgctctgcccccatggagagtgcgccctgtccctcggcatctgccaagaccaggctcctcagcgtcggatggtcgttgatgatcgaccggagaagatagtgccttgtcgacgcggcaatcaaacagctgatagtccatacgacacggagtttcagcccaccattggtatagaaagattctggcatgcttcccttgtcatccggtgatggctcatgcccactgccagcggccttgcgatcaaccaaggttccacccaggatcacgcagctctgaagtgtgctgccatattcagcccgccacttcagcagaaccccctcctcgactgcaacatctccggaggggagctctacctgaagattgcgaacatgggagaagttcttcagcacctgcaccggtgaatgctgagagagctgagggaacagcagccgccctgcgctaatggggctccgcatgtcatggaagggcttggcgatcgcgaacagcatcatcttgaatagatgcgagatgatgttgtggggcttcggtgacgacaggttcagagcgtcatcggcgccgccgtccacggtcacaacgtggtcgatcttgacacgcacatcatggacgaggagaaccaggccactgaatcgcttggacacggcagagcacctgccgagtgaacgcacgtcctcgagcttgttcaggatcagcagcacaagagaatcgtgcaagcagtcgaattggtcaaactcatggaccgggtcagcgtggatccgagccttggcctgcatcgcccggttcaaaagccgtctctgctcgcttcttcagaagattgagaaggactctgaaattgctatgaaacagccgaatattttattgccgaaaatggcgtgggccagctaataaatcttcaggtctacgaattcaaccggcttcctgaaacaaacaaaagaggcaacgaactatagtaaacaacgaatgtgacggggaaagcaagctaagcaaaatgaatcacgcaattttgatgtaggaaacgaacacaactaaactatgagcaaagccacatcacataattatatcagatagaacacggaaataatatcactaaaatcgccaggcagtactacttctaaaatgtaaacaatgcttgaacatggtggcaatccattaaaactgaaaagagaattaactatgactcggctgatacatagatagaacttatccaataagagacaacgatttacctcaaaaaaggtcaccgcgagtgcagctacggacacatcaagaatccgaagtattgtgctgctccaatggcccgatctatcgcgggaagccagccggatccagagacgccgaaccggccaccacagccaacggcccaaaaatcggcgccttcacgctggaaaaatcaacgaatagctcacggactggagcacagctcagtctcgagaccaaacaatccgattgccgctacgatttgggagaccggttgacgaattcaggaggaggaaggagggtttcgagcaggctgcaggaggatgcggccttggggtgggggaatttttggctttgggcttcggggacggttacctttttttagtttagggcgaggagaaacgcgccggccgctggacgcggctttaataccagtactagaggtagaggtgtggagggcaatggtaggattctcgggggaggaaaagcgcgggccccgccagggcgacatgattcgttcgtgcgtgatccgcgacggcgtggcggctccgggacggtgttacggggataagaccgtctcaaacggctccacagagcgaaggactgactgtatgagcactataatcattctatattttaattatgttatttttatattattaatactacatgtatctcgtaacataataataatatgtattataataatataaatattatattatttttaaaaatttaaaataatataaaaatgttagagagttactggtatagatctgtgtcacacgcgggggcgttccggcattatatttctctttaatataaacataaaataaaattgtgtataaatgagagtttggactctagtggtgggctatatatttataccacctaactagaacatatattttttatgtcttattaaaataaagtctactcatatgatatatagaatatgtggcaatgcacaaaacctgactagaagactataaaagcatcaatttcgatgattgtcatgtgtcacgcacgaagcacgtaggtttatacctttaccagtgggttgttacctagatcgtaaaaaccactcaagcctctatttatgggtcgctaacccacaggtaggttatggaaaactaccaagtccaacgcgataggaagtcacgcggcgcaacgctcccacgtagtatcactcccgctagctaaaggaagacgagcgactgagcgagttattaaaaaatggggatcatgcttcttttcaactcagacctttctagaccttttagctaagataaaatgtaattgtcgggtatggtaattaggggtaccgataatacacccctaaaacgcaattaaaaccctaagaacaccaccaaagtacaatccntgaggtcgaaggatcaagagacacacctcgcccgagttggttctcgaacagggcgtgttctcaggagaatctctgtcccgaccgaggtcctctcaccctaggacagcggtgttcgcctcgcccgagcctgcctcgggcaagaaggacaagctcagggcaagacccatctgaagtctgctgagggacaaccgcattcaatgcgtatacctaacccacgaagacctgcaggtgtacgggaacaacaagaccgcagtcttgtcaaagattcagcaactgtgattatgcgtgcgaccacagtacatgcacgccgtataccaacttcggatgggacgcataatacgacaggggcacacactagccctcgggcgcaaactctgtctcgcctgaagcggaactcaccctcggggcaaaactccgtctcgcccgagctcggctacctgctcccccacaaatcccacaggagaccactccatcaaccgtggcgcacgtcttcgaatctcggaacgagttcggtcgcagcctcagaaggacttctgcctcgcccgagcctggctctaacctcgatatccgcaacggagaactccccaacatcatcaggtactgcagaaccgacgcatcgcctaagaagtttttccccatacttagcattgtgtcaaccactacgacatgggcaacccctcaccaggtgcttgggtacgtgaccgagccctcggctctcagcaaaaaccaagcaagtgcaagtcaacaacaagtacaagaccataccaccgtccaccggccataccatctacaggatacgaagacatctcctcgcaatatgcggccaactcccgtcctctaggctgctccccctggcctataaatagaacatacgtgttggtcacttgttctcaaatgcttcagcttgctcgaaggtgaagacgcgagatagtgattacaattcattgtgaatagtacggtgttactgttcatctatttataggcacgagacacagcccgagtaaaagtacatttatgcccctgacattcatctataatcataacacgaatcattaaggactaagtagtctttgtctcttttcggtcatcatcatacttggtcttcgttatcacatcaagccgaagctcttcggctatagctctgtccattattgtcaccttcgggctacatcttcaccctgccatgagagaagaccttcatcccgaagccgaagcctcctgtaataatccatgtcatactgaaaacatatggtcagtcatgtttttgaagaccttcggaagaaggccccgaacaatacgactacacttcacaagtcttctcctccacacgatatggcactagcctcaatcaaccca

SEQ ID NO: 22895 - DNA, 1943 bp, Zea mays
  misc_feature (6)..(21): n is a, c, g, or t
  misc_feature (504)..(504): n is a, c, g, or t
tttttnnnnnnnnnnnnnnnnagaactggggtatatcgtatattcaggcaagtgaaagagagcagcttctttctcagggatgaccaacatacattagtaggcagcgcttccattgagaaatggaaacacgcacatacttcacgctacacgtgttttcagtaggcacaaactgccaccgtgcacgagacatctcaattctctacgcatgcttactttaggcattaatctgatatcatgtccatccgcttcgatgactatagtgtatgtacaaagaccagacagacaggagttcctcataagaagcaccaaaaaaacaaggtctctagaacccattcatctccaggagataggtgcgcctcttcatcagcgccttcgcagcaaacctcaagggtccatcgaacgcgcttgaaacaaaggcttcaacttccttgcgattgccatgaccattcgctggcaggcttggtgacaagcaaggttgcaccttgcagtgccaagccaccaggncaattcgaggtactggagcgtacttcagcttcatgttgcatgccggcacctgcgtcctgttagaacatggtgaggctgacaattgggtgttccctgaaatcattcagctgctctgcccccatggagagtgcgccctgtccctcggcatctgccaagaccaggctcctcagcgtcggatggtcgttgatgatcgaccggagaagatagtgccttgtcgacgcggcaatcaaacagctgatagtccatacgacacggagtttcagcccaccattggtatagaaagattctggcatgcttcccttgtcatccggtgatggctcatgcccactgccagcggccttgcgatcaaccaaggttccaccaaggatcacgcagctctgaagtgtgctgccatattcagcccgccacttcagcagaaccccctcctcgactgcaacatctccggaggggagctctacctgaagattgcgaacatgggagaagttcttcagcacctgcaccggtgaatgctgagagagctgagggaacagcagccgccctgcgctactggggctccgcatgtcatggaagggcttggcgatcgcgaacagccatcatcttgaatagatgcgagatgatgttgtggggcttcggtgacgacaggttcagagcgtcatcggcgccgccgtccacggtcacaacgtggtcgatcttgacacgcacatcatggacgaggagaaccaggccactgaatcgcttggacacggcagagcacctgccgagtgaacgcacgtcctcgagcttgttcaggatcagcagcacaagagaatcgtgcaagcagtcgaattggtcaaactcatggaccgggtcagcgtggatccgagccttggcctgcatcgcccggttcaaaagccgtctctgctcgcttcttcagaagattgagaaggaccctgaaattgctatgaaacagccgaatattttattgccgaaaatggcgtgggccagctaataaatcttcaggtctacgaattcaaccggcttcctcaaaaaaggtcaccgcgagtgcagctacggacacatcaagaatccgaagtattgtgctgctccaatggcccgatctatcgcgggaagccagccggatccagagacgccgaaccggccaccacagccaacggcccaaaaatcggcgccttcacgctggaaaaatcaacgaatagctcacggactggagcacagctcagtctcgagaccaaacaatccgattgccgctacgatttgggagaccggttgacgaattcaggaggaggaaggagggtttcgagcaggctgcaggaggatgcggccttggggtgggggaatttttggctttgggcttcggggacggttacctttttttagtttagggcgaggagagccgccccgggccctcgacgcggcgtgaatacccccggccggcctcg

SEQ ID NO: 22896 - DNA, 1614 bp, Zea mays
  misc_feature (1600)..(1600): n is a, c, g, or t
cttcctcatatatgttgttgttctgtcttttgtttaattggtaaggcgtcgccttgctcgccttagtaagcgcctaggcgtcgcctaggcgtccaggcggtggcccaacgccttgtctcaccttaccgccttaagaactatgattggcatagacactgcataagattaagtatcaatttgtatatagactgacctcgtgaaccaggtgtcctcttttcctcaatgtaacattgacgaccaccaatcatcacaggggaagcctctatagcactctggacagatgtagaatcctcaaactcaacaaatccgtaacagaacccttggatcttattgcttctgacttgaatgccattttgcttgatggtaccaaacttcttgaactcatcctccagttgagtttcagtggcatttagaggtaaattcctcacatagattgcatgcgcgtcatcttcaggctcttggatattgccgttctcagggttggaactaaaaggcagcacatctttgacaggagcaagagcaggagactgcttctctggtttgggcggtgcagtcctagtaggaggtgcaggagcaggcaatgaaacttctttcatgactttgacaattgaggcgtatgacttctttggtgcctcctcctgcaacacaggggcaactgtagttgccaaaacagctgccacgttgtttggaacttcatttatcacttcaggaacaggttgttcctcatccactacttcctctggcggcggatcgtaaacctcagcctcctcctcctcctctcaggttgaggtggtgatcggtccacaacatgatgttcctgctgtggcacggcattacggtcatcaggggtggcaggctccacagcaagagtagatgtgccgttggcagccacagacaggactacagcatccgcctctggctgcgcctctacagcggtaggggcagggatttccccgacgaagcggaacatgtcgttgagcacgaagtagcccttctcctgcggcgccaggaagaaggactgcgagaactcgcggcgcactccgtcacggccggtgaggtggcctgtgacgagcacagtgacgccgccgccaagcgactcctgcgagtccaccgtcctgatctccgcttttgacacgtccatctccattatcttctcgccgattgcctccatagtggtgacggagtccatgccggcggctccggcggcggatgcggggcggccgaggcgactagcctcctgatagaagcggtacaccagatccggtgactggtgcagcacgaggtagtactgctgcacgaacgcgttgcccaccacttgcgcagacggcggtgcctcgggggcctgggcgacaggttgcggcgcggccatgaaggcgatggatcgggggacggaggagacctagggttttggtgcggcgcgcggctcccgtgcgggctgcggcggcgtgtggggcagcgcttgggttctggtggcgaaggagatggaggcggagggagggagaggtgtagtgcgaggcgaaggcggcaccggtataggggtatgggccggcttcccgtcccggccggctctcgagtttttttttcccggcccggccggctncgaggtacccaatg

SEQ ID NO: 22897 - DNA, 2145 bp, Zea mays
cgaaaatagaccaatattgtcagtataataaatactaagagaatcttttggcgtcgacacattgcaaagaaacatttaaatccttaccctagccactattaacttccctaaactgtcacttattccaacagtctaaaaaagctattaacctcaattcaacagaataaatgaataccagcagtaacaaaaacctagatgatgcgttgcaaaaaagacaacaaggcacatcagtcgacgaccgaaactagaactacatctgaataggtgtctaatctacaattactcaattagtaaccatttttgctgcctgcaaaaataatgatcaaggacaggaaccctcataatttgtatccaggcttctcttgtaatcccgcactgaaccaattgatgagcctctatgccaacttcaaaataatcttagagccaccgaacaacactcccaaaagacgcgcaacagctatggtgcccctcattttgaaggtgcgccagcagctgctgtgcggctaccacgaccaccagcatatccagcatggtcaaccctctggtagccaacatcagctccacgtaatgagccacctctgccaccacttctgaccccgtaatcagacctgtaactaaattcacccctcccgtagccccttcctccaccgtagttaccacgccctctggtaccttcacttctgaaactgttgcccctgcctggtgcgaacctgccgcctctgctggagcctcgtgaaccaggtgctctcttttcctcaacgtaacattgacgaccgccaattgctacaggggaagcctctatagcactctggacagaagtagaatcctcgaattcaacgaatccataacagaacccttgaatcttattgcttctgacttgaatgccattttgcttaatggtaccaaacttcttgaactcatcctccagttgagtttcagtggcatttaaaggtaaattcctcacatatattgcatgtgcatcaacttcaggctcttggatattgatgttctcggggttagaactgaaaggcggtacatctgtgacaggagtagcaggaggaggagactgcttctctagtttgggtggtgaaggcctagtaggaggcgcaggagcaggcaatggaacttctttcatgattttgacaattgaggcgtatgacttctttggtgcctcctcctgcaacactgaggcaactgtagttgccaccacaggtgccacattgtttggaacttcatttatcacttcagcaacaggctgttcctcatccactacttcctcttgcggcggattgtaaacctcagcctcgtcctcttcaggttgaggcagtgatcggtccacaacatgatgttcctgctgtggcacggcaccatgatcatcaggagtggcaggctccacagcaggagtagctgtgccgttggcaagtggagcagccacaggcgggactacagcaaccgcctctggctgcgcctcaacggcggtagaggcagggatgtccccgacgaagcggaagatgtcgttgagcacgaagtagcccatctcctgcggcgcgaggaagaaggattgcgagaactcgcggcgcactccatcacggccggtgaggtgacctgtgacgagcacagcgacgccgccgcctaaagactcctgcgagtccaccgtcctgatctccgctttggacacgtccatctccattatcttctcgctgatcgcctccatggtggtgaccgagtccatgccggcggctccggcggcggatgcggggcgagcgaggcggctggcctcctggtagaagcggtacaccagatccggcgactggtgcagcacgaggtagtactgctgcacgaacgcgttgcccaccatttgcgcagacggcggcgcctcggaggcgggggcgacaggctgcggcgcggccatggagacgctggatcgggggacggggggagacctctggttttgaggagaagcggcggcgggtgcggcgcgcggctcccgtgcggcggcgtgtggcgcgcttgaggtctggtggcgaaggagatggaggcggaggcgagtgcgcaggtagggcagctggggcttatgcgtacggcggatctggagccgtgatctggtgtccccgccccgggcccccggggcccttttctgtttat

SEQ ID NO: 22898 - DNA, 1322 bp, Zea mays
aacaagaacttgtaaattcatctgtttcatctttttccctagaattctttctttaaatcaatagcggtttattatcagtataaagaccgaatcctttggcgtcgacatattgcaaataaacatgtaaatcctgaccctagctactagtattaactactctaaaatatcacttattccaacagccccaaaaaggctattaacctcaaatcgacacaataaatgaatactagcagtaacataacattgcaaaaatgacaggctcaccaaccgacgaccaaaactaaaactacatctgaataggtgtctattctacaattactcaattagtaatcacttttttagcttttgttgcctgcaaaaatagtgatgaacaggaactccaaaaatttgtatccagccttttctggtaaccccgcactcgaccaattgatggatctctatgccaacttcaaaacaatctgagggccaccgaacgacacaggagacgtgcaacagctatgttgtccctcattttgcaggtgcaccagcggctactgtgcggccaccacgaccaccagcatatccagcatggtcaaccctctggtagccgacatcagctccacgtgctgagacacctctgccaccacttctgccaccgtaatccgacctgtaactaaactcacccctcccgtagccccttcctccaccgtagttaccacggcctctggtaccttcacttctgaagttgttgcccctgcctggtacaaacctgccacgttgctgtcgccgttgctgtcgaggtgtcctcttttcctcaatgtaacattgacgaccaccaatcatcacaggggaagcctctatagcactctggacagatgtagaatcctcaaactcaacaaatccgtaacagaacccttggatcttattgcttctgacttgaatgccattttgcttgatggtaccaaacttcttgaactcatcctccagttgagtttcagtggcatttagaggtaaattcctcacatagattgcatgcgcgtcatcttcaggctcttggatattgccgttctcagggttggaactaaaaggcagcacatctttgacaggagcaagagcaggagactgcttctctggtttgggcggtgcagtcctagtaggaggtgcaggagcaggcaatgaaacttctttcatgactttgacaattgaggcgtatgacttctttggtgcctcctcctgcaacacaggggcaactgtagttgccaaaacagctgccacgttgtttggaacttcatttatcacttcaggaacaggttgttcctcatccactacctcctccctcgtgc

SEQ ID NO: 22899 - DNA, 745 bp, Zea mays
atagaactgtaaaaaaatgcttatgatcatgaaaaaatgttcacacttactatgtctcattttcagcaagagtgtgaggaattagccaggaaggtagctgacctaacaactgagaatagtgctctcagagcggaacttgacaacctgaggaaggcttgccaagacatggaagcagaaaattcacgtctattggtgagcacggtaccaagtgtcacaaccacactgggaatgagcatccagccgccaaaggcgcagcagcatcatgacgacgagggccagctccacaagaaatctagtaataacagcaacgggaaaggaagccacaaaccggaggctaacactaggtgagagacaggtgaatgagaaagtgacagagatgagatgaggtgtttcctatctaaccacaacacccatcatcaaccagtgcgttttcacagcccgctggggggccatgtagagtcgccccccactgcagccatgtattatttatggctcgccgcggtgtgcgttttgtgtgtgtgttttttgtgtgtgtgtcgtgtaaacctattgatgtagctattgtaacaaaaacctagagagcctagaatttttatgtctgctaactcctgatgaggggggatgtaaccggccaatttggtgcctggtcgatcgtttagatgaaatgcgagcaaatatcatttgatagcccgcttcgccttgttgttgttgcggcctttttttgcgtctttgcgggagtctttta

SEQ ID NO: 22900 - DNA, 1284 bp, Zea mays
tccaccgcggtggcggccgttttttttttttttttcggcacattcctttgtttgaggcatcttttcttgaagaagtctgagagggtatcacaggtcgttctctataagaaagcaaaactatcttgtaatggcataatatggtctatatggtttgcgcgaaagaaaccaatggactattcttccatcttgtcaacagaacccaacatgtagttaatatctggggtgatgatagcacgcttgctgatctctcccaccgtacagcaatgtttttctctgatgttgattgctgcaacctcctgggaaaacatgcaattcgagccaaatgaaacatcaaagagagtgtctcctatcttcatcttcactttaccactcttatatacgagcattttccccatatagccttcaggaacctctttgagtttcgagccattgtgcgatgatggcctcatgtcctcacgtttctcatcgcggacttcgttagggtcagcacctgattgtggctgcctcggtaaaggaagagaggatggcaactggaagaagaggaactgtgattccgacgacatatccattaatccaagctgctctgctgcagataattcatcatcttgggtcctgctggcagaagattctccaaattcttcctcatccagaatttcaggatttccagagtagggcttccttagtgggagagtaacaggataatcatggctatagtcccatggttctgcatattcttttggtaacttcgaagctccacctgctgaagaatcctttttgggcatgggaaaatttcttgcataataagagtttccttgtccaaatgcaacctgtgtaccacttcttggcttttcgtcggacttaattcttgagggatacttgttttgcgacatcttaagtttcatcaataactccttatccaaagcatcctcctttctctcttcaactggttccttctttgggacaaccttagcaggtttcttctgaggtacttttggtgcgaatttaagtccccccttgcgaggtgggggtccaagggggccatctatttccttcttgactttgttcttatcatccatgataagaagtgtgaaacctgcaaaacctttccagagaggagaatgcgcaggaagagaggagggagacgccggccaggagtactacgccctggcagctgcggctggataggaagagaagggcgctcggcgccaggttccggccggcggcggcggcggctagagaagaaagaaaatggcttcttgcagtaaatggctagagtccaacctt

SEQ ID NO: 22901 - DNA, 1506 bp, Zea mays
gtttgaggcatcttttcttgaagaagtctgagagggtatcacaggtcgttctctataagaaagcaaaactatcttgtaatggcataatatggtctatatggtttgcgcgaaagaaaccaatggactattcttccatcttgtcaacagaacccaacatgtagttaatatctggggtgatgattgcacgcttgctgatctctcccaccgtacagcaatgtttttctctgatgttgattgctgcaacctcctgggaaaacatgcaattcgagccaaatgaaacatcaaagagagtgtctcctatcttcatcttcactttaccactcttatatacgagcattttccccatatagccttcaggaacctctttgagtttcgagccattgtgcgatgatggcctcatgccctcacgtttctcatcgcggacttcgttagggtcagcacctgattgtggctgcctcggtaaaggaagagaggatggcaactggaagaagaggaactgtgattccgacgacatatccattaatccaagctgctctgctgcagataattcatcatcttgggtcctgctggcagaagattctccaaattcttcctcatccagaatttcaggatttccagagtagggcttccttagtgggagagtaacaggataatcatggctatagtcccatggttctgcatattcttttggtaacttcgaagctccacctgctgaagaatcctttttgggcatgggaaaatttcttgcataataagagtttccttgtccaaatgcaacctgtgtaccacttcttgctatgccaacagagaaatgaactattagctaggtgtgcagcaggtcaaataaaagtatcactaaatttacaaaaaatgaataatccataacacttaagcaaacacacacacaaacagagagtattttctttgtaacaaaaaccttgccttttatactatatgtactaaacatcaattatagctaataaaaattttggtacatgctctacgtaatgcatttttaagacaacctaatgcagaagtatgtccctgtattaaatatagatgaatcccccacccaaagcatacaattataattagccaactcagagcacatcatacaaagatgcaaaccaaatcacatacttgtattttatcagctcaaaactactcacaatgttgcaacaaatattattttaggattgaaaaatgattttcaagtgaagtacggaagataaatatataacatagtaaataagattgctcttgctcctataagtgtgcgacatatgcaattgttatattgccagtttttatcaagtggtaaggaatgaatcaagagtgttcaatctacagcctcaaagattcatacttagaaatatttattgaagttaaaactgtaaaactgtcgagaaaatgctatgtgactaataaaaaaactcgacctgtggaggtaagaccgcctccataacattatattaagaagacctcacgcagggccggacgcgtggg

SEQ ID NO: 22902 - DNA, 2541 bp, Zea mays
  misc_feature (160)..(160): n is a, c, g, or t
catgtcagaaatttaatcatgaaggtctgttgcatttgtgcattgcgatgaatggacaacaaactctatgttgcacgatatgaatctcaagctacaaatacaaactagcattctcctgatattacaggtcgttatcaccataaggaataagaatgcaggntgttataaattactgctccctccgtagtcattttagctttcgatttttctgtctatgttcaaattgatgatgataaatctagacatgtatataaaacaaatatattatttattatatgatatatgaaaacgaattttactttgggacggagggagtattaaccttcaccacccaccacatgggtcgcataataatctatcggagaggtttcacggtcacggtgttagagaaacacaaccaccaccgatcaaggaactgaagcgagacatggaaggctatcgcgagtaatattggtaaacgcagatcacccgaggtatccgagccgggtgaaggcgagtcccgttacgaggtacgtctcggcggcggcgtgaccgacgtcctcccggaagatcgcctccggtccccgcgtggccgctgcgggggctcgagaagttgagcgtgaccgggccggtgcggcggcgcaggccctggggcccgtatcgtgggacgaacgccggcggggtggtcgctgtcgagatgcatttccacggcgatcgacgagcgcgagggtctcggcggcaggcggcaggcggcaggcggcagcgttgggtggagcctggatggagggggatgccgcatgccggggcgcggggcgagccattgggcctcacgggaacagagaactcacgaggccccctaagccctcccgttagagcccacgagtctctacaacagctggtagtgggctaggcctcgttttggttgggcaagcctgggcagcgatactacaaatgctggctgggcctttctgagtctttgactgggtttgccgaaaggaacacggcgccgcgctggctttgccagcgccgctgtgggcgacaaaaactgaagcggtggaacgcgtgcggtgccggcgcgtgtgcacgcggccggaaacggaccacggtttggagcggggacgagtggacgacagcccggccccggtccacagtctgttacgatgcgcgtcgggcgttgcgcaggtcggtcggtgcacggcacgtgctcgacggatgggcttgctctgcatctgctcagcgtgaaaagcggatcgcgatcacggcgtttatggggaaaaaatttcttcccagatgtcacatacctggagacctatctgaatgaacgaaaaaaatacaaattacaaattttgatctgtttttatagatcttcagctggtacataattagatatgcgtttgtatcctagatgtagagaattttttttccgtttagcggtactaccgcaccgcgccagcacagcccacaggtcaaatccaggagaagtgtgctagaacataatccgcagaagaagaaaaaaatgaaagattgaacaaatccatccaaaatatgtacacattttccgagttcatccatgttacaaaccagcgatgagtttttgagttacattatcttgtgtcagttatcctacattaaccggatgagcatcttcctaacaaaaaaaagagagagagagagaacaggtaatcaacggcgggcgagggacagggccacggggttacggcggcgggcggtgagcgagaccgatcgatcgatcggtccatcagagggcatcaggcgacgccgaggaagtcgagcgcggacttggccatgacggcggcgaactcgttgaagctgatgacgccgtcaccgtcggcgtcggcgtcgcgcatcatgcgcgtgagctcctcgaaggtgagcggctggccgatgcgcgccatggatcgcgccagctcggcggcggagatgtagccgttgccgtcgcggtcgaaggcgcggaacacctccaggagctgggcctggtcgacgaggtgcgtctgcgtggtgagcagcggcgcgatggcggccgccagctcgccgaactccaccgcgccgttgccgttggagtccatggccgccagcagcgcgcgggcctcctcccccgtggggcgcaggcccagcgaccgcagcagcgcccccagctccagctgcgtcaggctgccgtcgccgtccatgtcgaagcgccggaagatctcgcggagctgctccagctggctcccgcgcagcacgggcttcggcgccggaggagaggccggcggtgctgaccttgtcattgcttggcgcctagaggagacttgtggagagagacggaggacgaactgatccacaactgcagggatgatgaggtggagacggcgaccgggttatttacggagggggtggatctaccgggaagacgcgtcgcgagggcttttggttggtttggctttggctggagacagacagacagtgaggacctgcgtggacggaggttggagggaaagtccccggtcgctacgtgcgcgtcaaaacggcttgggcctcttagaattaggcatttttcgtatt

SEQ ID NO: 22903 - DNA, 627 bp, Zea mays
tatgtgtggtactaccctacaatgatgtttacatttttttatattaaatgcaataacgtgcgccgcgcccgcggcccgctgcgtgaaaactcaattattggataaaccacgaattaacatgtccttaacctactgttgtttcatgtagactgtcttaatccatagaagtcattgcatagcattattattttttcctgctgaattatctttgtcaaaatgttcagtgtgacaatcgttgttgcatatctcatgaagaagcatcaaatgagcctcgaaagtgccttgtcactagttagaagtaaacgacctcaagtggctcctaatggggggtttatttcccagctggagaagtttcagaaatccttgcaagtggagcaggaatggagaatgcaacctgtgcagcactgataattatactagtgttataataggtgcagaaggcctcatatgtagtgaaggcgtatgcgttgtaagagcgtcttgaccgcgtattatgacatctggataacaagcgaggccttggcaaactttatgatgtaaacagcaagcaacgttgttcatccattgggatgcagtttacatgttgaataatattcactgcaatttctcttcaaaaaaaggccccta

SEQ ID NO: 22904 - DNA, 1738 bp, Zea mays
agacaatcaataaaaaattttgagatgtttttggtggatagtttacgtgggtattattgtaagccgttgcaacgcatggacaaccaactagtttatcattaaaattaagttgggccaaaacactctacggggcatgtatgacatcggtttttttttctaccgacgtccggagaatttcattagcaatcggggccacagagagttaacaaaaaataattcagcgacagatatcttcgactcctcgttcgtggttccccatcgtcatcgccatggatttctcttaggctcacccgtccgctcggctcgcttccttccccactctctctgatcccgtcgcacttccctcctcgctgcagcccctctactattgcgattaccgtttcctcgctgccctttcctttttcggtcggcagcaatcaccggggcaagcgaaccctcgatttgcgtccccgctctctgctagcgcccctaaaagaggagcgaagcgatgtctatgtcgaagacgggtcaggccgcggagaaggatgagcagcagcagtcccgagggatagcactgatgcagggcatctgcgccgtggtgtaccgcaaggccgataacacgccctgccccatcaagcagggtctctacttgggatctgttggagcagcattcaataaggacgctctcaagagtttgaacatcacccatatcttgatcgttgcaaagtcactggatccagtatttccagctgaatttaattacaagaagatcgaagtacttgatatcccagacactgatctgttaaagcattctgatgaatgctttggtttcatagatgaagctataagctctggaggcaatgttttggtccattgctttgctgggcggtcaaggagtgtgacaatcgttgttgcatatctcatgaagaagcatcaaatgagcctcgaaagtgccttgtcactagttagaagtaaacgacctcaagtggttcctaatggggggtgaagtttacttttccagcatgagttaactgttgtttcaaaattgttgcatatgtctaattggcaccttgtaccttctagggtctctacttgggatctgttggagcagcattcaataaggacgctctcaagagtttgaacatcacccatatcttgatcgttgcaaagtcactggatccagtatttccagctgaatttaattacaagaagatcgaaggtaacttagctttctttctctttcctccctaattcttcactattttttttatctgcggaaaggtgttgtgagttcgctatgtacataacatctagattttatgtgcttggggcatatgaaacctgattcagtccttctctataaaactgcaaaactgcccatttgttttattatctgtcaaaatccagatccattacaacgactcaacgagagaaattgacagggtctgcgtatcaaggacccattggtgtttgggtcctgccacacttgaggaaataacgtgatcaaaaccagatgtgctatcttcactcttcaataaccattacagtggccaattgggccccattttctctggctgtttaatcaaatcttcagtagcacgtgttctgtggatttaaaactccttcagaattttctttagcttagtcaacaaatgtgtagtgtagtttactaaatatagtaaacctggcctacctcatatctggcctttatcacttcatggttgtttgaataattcttgtgcatataagttagttagcg

SEQ ID NO: 22905 - DNA, 1110 bp, Zea mays
gttcttttttcaccgacgtccggacgctttcattagcaatcggtggccacagagagttaactaaaaataattcagcgacagatatcttcgactcctcgttcgtggttccccatcgtcatcgccatggatttctcttaggctcacccgtccgctcggctcgcttccttccccactctctctgatcccgtcgcacttccctcctcgctgcagcccctctattattgcgattaccgtttcctcactgccctttcctttttcggtcggcagcaatcaccggggcaagcgaaccctcgatttgcgtccccgctctctgctagcgcccctaaaagaggagcgaagcgatgtctatgccggagacgggtcaggccgcggagagggatgagcagcagcagtcccgagggatagcactgatgcagggcatctgcgccgtggtgtaccgcaaggccgataacacgccctgccccatcaagcagggtctctacttgggatctgttggagcagcattcaataaggacgctctcaagagcttgaacatcacccatatcttgatcgttgcaaagtcactggatccagtatttccagctgaatttaattacaagaagatcgaagtacttgatatcccagacactgatctgttaaagcattctgatgaatgctttggtttcatagatgaagctataagctctggaggcaatgttttggtccattgctttgctgggcggtcaaggagaagcatcaaatgagcctcgaaagtgccttgtcactagttagaagtaaacgacctcaagtggctcctaatggggggtttatttcccagctggagaagtttcagaaatccttgcaagtggagcaggaacggagaatgcaacctgtgcagcactgataattatactagtgttataataggtgcagaaggcctcatatgttgtgaaggcgtatgcgttgtaagagcgtcttgaccgcgtattatggcatctggataacaagcgaggccttggcaaactttatgatgtaaacagcaagcaacgttgttcatccattgggatgcagtttacatgttgaataatattcactgcaatctcttcaaatgaaccaaaaaaaaaaaaaaaa

SEQ ID NO: 22906 - DNA, 1162 bp, Zea mays
ctcgaggccggccgggggagaatttcattagcaatcggtggccacagagagttaactaaaaataattcagcgacagatatcttcgactcctcgttcgtggttccccgccggcatcgccatggatttctcttaggctcacccgtccgctcggctcgcttccttccccactctctctgatcccgtcgcacttccctcctcgctgcagcccctctactattgcgattaccgtttcctcgctgccctttcctttttcggtcggcagcaatcaccggggcaagcgaaccctcgatttgcgtccccgctctctgctagcgcccctaaaagaggagcgaagcgatgtctatgtcgaagacgggtcaggccgcggagaaggatgagcagcagcagtcccgagggatagcactgatgcagggcatctgcgccgtggtgtaccgcaaggccgataacacgccctgccccatcaagcagggtctctacttgggatctgttggagcagcattcaataaggacgctctcaagagtttgaacatcacccatatcttgatcgttgcaaagtcactggatccagtatttccagctgaatttaattacaagaagatcgaagtacttgatatcccagacactgatctgttaaagcattctgatgaatgctttggtttcatagatgaagctataagctctggaggcaatgttttggtccattgctttgctgggcggtcaaggagtggagcaggaatggagaatgcaacctgtgcagcactgataattatactagtgttataataggtgcagaaggcctcatatgtagtgaaggcgtatgcgttgtaagagcgtcttgaccgcgtattatgacatctggataacaagcgaggccttggcaaactttatgatgtaaacagcaagcaacgttgttcatccattgggatgcagtttacatgttgaataatattcactgcaatttctcttcaaaaaaaaaaaaaaaaaaaaaaagttggtgctctctctcctgcatagatgcggcacatcaatcaaccttagaagaagaatactccatcgtgcatagatgcagcacaccgttgacttttctaaaaaactttgactagtcgtgttattcaaaaaaataatgagttattatttaaaaaaaaaaaaaaaaaaactctct

SEQ ID NO: 22907 - DNA, 1292 bp, Zea mays
ccggccgggagaatcggggccctcggggccggcccggaaaataattcagcgacagatatcttcgactcctcgttcgtggttccccatcgtcatcgccatggatttctcttaggctcacccgtccgctcggctcgcttccttccccactctctctgatcccgtcgcacttccctcctcgctgcagcccctctactattgcgattaccgtttcctcgctgccctttcctttttcggtcggcagcaatcaccggggcaagcgaaccctcgatttgcgtccccgctctctgctagcgcccctaaaagaggagcgaagcgatgtctatgccggagacgggtcaggccgcggagagggatgagcagcagcagtcccgagggatagcactgatgcagggcatctgcgccgtggtgtaccgcaaggccgataacacgccctgccccatcaagcagggtctctacttgggatctgttggagcagcattcaataaggacgctctcaagagcttgaacatcacccatatcttgatcgttgcaaagtcactggatccagtatttccagctgaatttaattacaagaagatcgaagtacttgatatcccagacactgatctgttaaagcattctgatgaatgctttggtttcatagatgaagctataagctctggaggcaatgttttggtccattgctttgctgggcggtcaaggagtgtgacaatcgttgttgcatatctcatgaagaagcatcaaatgagcctcgaaagtgccttgtcactagttagaagtaaacgacctcaagtggctcctaatggggggtttatttcccagctggagaagtttcagaaatccttgcaagtggagcaggaacggagaatgcaacctgtgcagcactgataattatactagtgttataataggtgcagaaggcctcatatgttgtgaaggcgtatgcgttgtaagagcgtcttgaccgcgtattatggcatctggataacaagcgaggccttggcaaactttatgatgtaaacagcaagcaacgttgttcatccattgggatgcagtttacatgttgaataatattcactgcaatctcttcaaatgaaccaaagaggggtaatagttggggcgcgggccgcctgcaaaaggaaccccaactttaccgaacccgggggcgtggggacacgcctataaactctcttccttaaaaagggggcacccccaaaaaattttcatatttcccccggggggggccgggggcgcggttttttttaaaaaaacagagcccgccggcggggggg

SEQ ID NO: 22908 - DNA, 977 bp, Zea mays
  misc_feature (906)..(906): n is a, c, g, or t
  misc_feature (909)..(909): n is a, c, g, or t
gggggcatgtatgacatcggttttttttttctaccgacgtccggagaatttcattagcaatcggtggccacagagagttaactaaaaataattcagcgacagatatcttcgactcctcgttcgtggttccccatcgtcatcgccatggatttctcttaggctcacccgtccgctcggctcgcttccttccccactctctctgatcccgtcgcacttccctcctcgctgcagcccctctactattgcgattaccgtttcctcactgccctttcctttttcggtcggcagcaatcaccggggcaagcgaaccctcgatttgcgtccccgctctctgctagcgcccctaaaagaggagcgaagcgatgtctatgccggagacgggtcaggccgcggagagggatgagcagcagcagtcccgagggatagcactgatgcagggcatctgcgccgtggtgtaccgcaaggccgataacacgccctgccccatcaagcagggtctctacttgggatctgttggagcagcattcaataaggacgctctcaagagcttgaacatcacccatatcttgatcgttgcaaagtcactggatccagtatttccagctgaatttaattacaagaagatcgaagatgaagctataagctctggaggcaatgttttggtccattgctttgctgggcggtcaaggagtgtgacaatcgttgttgcatatctcatgaagaagcatcaaatgagcctcgaaagtgccttgccactagttagaagtaaacgacctcccgtggctcctaatggcggggggtttatttcccagctggagaagtttcagaaatccttgcagggaatggagaatgcaacctgtgcagcactgataattatactagtggttatattaggtgcagaaggcncantatgtagtgaaggcgtatgcgttgtaagagcgtcttgaccgcgtattatgacatctggataacaagcg

SEQ ID NO: 22909 - DNA, 1673 bp, Zea mays
  misc_feature (6)..(13): n is a, c, g, or t
aacgannnnnnnnttcatataaaaaatgacgtttgggagtacatgacgagctggtgagatatattgggcaaggaacaacagcagccttttattacatgaccctcgttggcacatgggaaaaatgctcaggtcaagacacacggtcaagacacaccgtcactacaaagatgatacgtacatgctacagcctaacaacagatcatcgacagatgatatcatcgtcggatttacattagccatgcgaccaatatcgcaagcagatgatgttcaaggacagggatgagagattcctatacgaacaagtgaggcatcaaatcaaaataggcaactactactgctgtacagattcagagaacaagggggagctgctaaaggtttcgcagctgaaaagaagcctccgcctctggctcagataaggtcctggccagtaccagtgtcacttccatcttcactggagcccttcccgaacacctcttctatgacattgttcgttgacaaaaaatcatgcctctcccaaccagtactgaaaccgaagccccactcttttgtgtcacaatggtcaccaaagaacccatgttctgcaccaccacaaaggccgtcgtcactcctgtagtgattgccaatatcagtatgtgccccaccatcgcaaccaacctgatgagcctcaaatgatgtgcaagagtcatcttgtgcatctgcatctagcttcaacgtctgttgatcatgatctataaatgacatttcgggatgaccctctgacaacataccagccctctgcacaccattatgcctgtctccactggaattgtcaagctcgtcctcatcatcagaatctccatataaatccccctccaagggaaatggattgcaagcaacatcatcttgatcagtaagggactcgattggcatgtattcatcagttcttcctgttattggaaactcaaaatcaccacctgcctgccactcatcgtcgtcactgtcaatgttcgctgggtcgaacctgttctgctcagccctcttcctcaacatgaagacattgaagtagtagctcactagctctttgctggacttggaagggaaggcaagaggaagttcatcccaaaagttcctgcgcagagaagcacggtttgacgagaccacttgctggaacaaacgttcctcctcttctgaccaccttgaggcaacctcttcccccatgtcatagaaacccaactccctgaaggcgtctgcaccaacagaatccttcaaattttctcttgcttccatcacatgctttttcacacaattgattgaaccttcgtcaagacaatcacaacctgctttgcagtgaacaggctccaacaccaaagacgatgcatcagtaccaggcattggcacaacactgtttctgatccacttgacactttcgtcttcttcagttcttccaccaaatggcctgcactcaggtaattcagcctgatgatttgacccgataggaacaggtttcctcaaggaaaaagggccaacagattgatgaaagctggcaggccatagaccatgttcaacataggggagagcatgtgaacaatgggagaggtgaatgtacaccctcatattcactttcctcgctctcatatagtggtgcagtcaaagctctttcgcaagtacgtgtagtggggtagtcatgaaaaacc

SEQ ID NO: 22910 - DNA, 1141 bp, Zea mays
  misc_feature (3)..(20): n is a, c, g, or t
cgnnnnnnnnnnnnnnnnnngccgcccttttttttcttagtttttaggtcagtcgcatgggaattcccaatgtaacatatatttgaatttcgatcaatgacagcccttgttgcatgttgcaaagtagaaaaaggaaaaaaaaaagttgaggggtagaacggcgttgccgttgcatacgagaattcgacagatatatccctacttgtggttttccaaacaaaattgggatttttgtcctatatataagggggcctccagtgaagagtagatcagcattctatagaggcaggcaagccatcgatggtattgtgaacgtgcctagtgaggcagtgacagcggaacatgcaggcaagctgctagaactttaggcctcttcgtgagacttctggacgcctatccatctggcatagtcaacccacagcaaagagccaaggaatgtgttgcccgtacgaacgatgaagcacattgcactcagcagtagcttctggttatgcagcaacggctccagcatcctctgctcgatcacaccagccagaagctgatacctgaggttactagaaatggacatgtatacaccataggcaacactagttgagacgactggaatttccatgacttcgtcctcaaggtccttatcaacagccctctttgctttgagcgctgcattcgtgacactagtgccaatcaaagaagcagtagttcccactgccaaaagctttataccattcctcacaaaagctccaatcctctgcagaagtgagaatgaccttccagccatagcaatttggaaagtattatcagggcagttatagaaaaagttggcaatagctccagcgtttcttgccagtggcggctgtaaaccaatagttggagcaggaagatagacaagcatgacgtccgcaacaatcgccatgaccacatcagatatgacaacttcaatctctttgaagaaattgtcccccctcttctggaactcagccacggtcttggcgacgagaccgatgccgcactctatgccccgcccggcctcgaggagctcgtcggcgaggagcctctccctgaagccctggaactggaggagccatcggaagaagccgttggcctcgagttcggtgaagcggcgcacgatgtcggccccgat

SEQ ID NO: 22911 - DNA, 688 bp, Zea mays
tgcactgcagggtacactcgtctgtgtctgcctactccctcctccggctcccgcgaagcgactccaagaagcagcaggagcgtcgagctcgagcagcagccatggatggcgaggaggttggcaggaggggtattcctactctgctgaagccgtcttcctcctccagcgacggcagtgccggggaacaagagcacatcgcttctgacgtcactcagctcataggatggacgccgctggtcgaattgaagcgaatcgccagcgaggctgggatcgatgcgcggatcgtcggcaagatggaggcttaccagccactttgctccatcaaggaccgctctgctttgagaatgatagaggatgctgaggagaggggattgatttcgcctggagtcacaacgctggtggagccgacgagtggtaacatggggttagggttggtcctcttcgctattcagagaggttacaggctcattgcagtcatgccggctaaatactcgcttgacaagcagatcttgctgaggttcatgggcgcggagctatacttaactgatccggcccttggctttccgggcatgtttgacaaagttgaacagctccgaaaacagctgccaaagtacatgttctgaacccagtacgaacaagcgaatttgaagcccattagattgaccgggcctgagactggaggacacgg

SEQ ID NO: 22912 - DNA, 3252 bp, Zea mays
tgagtcgcatactgatcccttgtactacacaatgcgatttatcgatggtctcaaacatgatattaaaattgttataatggtacaaagacctccaaatctcgatgctgcttgtgcactcgcccttgtgcaggaagaggcgctggagtcatctcggcgtcagcgtgctgagcctttctccaaccggatggcttggccgcatatggcgtcgtctgaattcagcaagaaggaacaaccaggcggacaaaatcaatccactgacaaaacgactggtgacttcagtcgtgcatcttcaccagctgatcgtgtagcatcgctcaaaagctatcatcgtgctcgcagtttgtgcgaccgctgtgcggagaaatggtttcccggtcacaaatgtgccagcacggtacagttacatgccatcgaggaggtatgggatctactggcagtaccagaaagtgtcgaaggcgcacctgtcagcagagcagatcacatggaccatgcagaggagcggactcaagcagtgcaacagaaggcacagacagagggagtcaaggaagacaatcagagcccgcgcagccgtcgtgtaccaaagccaaataccaagtacatcggtgcagagtggcgcgtataggtatacggagttatacgtattgatgagggcaggtgtgccggtataaataatattgtaatcgtttctaaactcagtctggaacatgttattgtcgagtcggcaagaaaggaatagataccagagaaattcctggcgtgaaccacgggtgttgttcacatttggtaccagagccaatactggatcctccacacgggtactggacgagatcgcaatcgaagttgggcggcatggcgccagcgaagacggacgatcctttgtcccagcttctggcgaagatcgaggagggaaacaaggagactcaccgacgcatggaggcgattcagggggcggtgggaaatatggaggcggcggtcaaggtggtgatgacggagcagggagatcttcagaagtggaaaccggaggtggaagcgaaagtgacggagatttctgatgctctaaaggcgatccagatccagatgggaaagatggagaagaagccgctcggtttcgggtcgagacaggaagaagaaggagaagacggatttctgaagccgccaccatctgattcttcgaatttggagtttcgtcgtgaagaagggcggacccaattctcgcatggagtattgggcatgaactggatccagcaactactgtccgattcgaggctgctggaaaccattcctttggcgactggtcacatgggtccggatcgggtatacctagtatgagtttccctgtttttgatggatccaaccctaagctgtggagaacgcggtgtgaaacctactttgatttctattctgttgctcgtcccatgtggattcggttggccatcatgcattttgagggtgcgggtttattctggttacaatctgtagaacatcggcttagatacatgaagtgggatgaattctgttctggattgtataacagatttggaagggatcaacatggtaccttgattcgacacttctatcacatataccagcagaactcagtggtggaatatgtggaacagtttgacatgctgttacatcaactactagcccatgaaagccagttgacgccaatgatgatcacttccagatttgtggatggtttaaaggatgatatacaggctgtggtggccattcaacgcccagccgatctggacacagcctgttcgctagctctattacaggaggatatgttgacacaacccaatcggaaggaaggcaggagagtggaattgggtggttatactagaccctccaatccctccatgaagactgcgaccatggctggacatcaagtatcagttaccacaagtcggatccatcccttgtcggaagatcgtcgtaggccgtctgggagcggtggaaggacggaggatcagaaacttgctgccttgaagtcctacagaagagccaagggcttatgttttaaatgtggtgaaaagtggaattataatcaccattgctctaacagtgttcctcttcatgtggtggaggagatgtgggctgtgactgatcagggaaaggggtgcagaatttggtcagacctgttaaagtcaaagttgctgacgggtactatttgtggtgtgaaaaatgggtaccaagctgtcaatggctatatgagggaataactttttatactgatttcaagttcttgccattggacggttatgatcttatactagggatggactggttggaggatcttagtcctatgtctatagactgggctgcaaaatggatggagttcgtgtacaagggtaagaaagtgcagttacaaggcgtaactcctaaattaaaagcttgtactcccatgtctagtgtgcaattgaagggtttgctcaggaaggaagcggtggaacaagtaatcgagttgaggatcacaatgcggcccgaggcaaacactgttcccgatcagattgttgagttggtgaacaaataccaggaattgtttgcagccccaaaaggcctgcctccaaagaggttgtttgatcatgacattcctttgttgcctggtgtaaatcctttccgactcaggccttatcgatacactcctcaacaaaaaaatgagattgagaaacagattaaggaaatgttggaaggtggaattatccagcagagttccagtcccttcgcttcaccggtgctgttagtaaagaagaaggatggagagtggaggttatgcgtggactacaggaaactcaatgcttatacggtgaagaataggtttcccatgccagtttttgatgagattgcagatgagctgagtggagccaccgtattcacaaagttggaccatagggctggttaccatcaaatcaggattaaagagggagaggagtataaaacgaccttccatacgcataatggacactatgaatataaggtcatgccattcggtctgacaggagcaccggctacctttcaagattttatgaatcacatcttagctccccttttgagaaagtgtgttgtggtattcttggatgatattttggtttatagtactactttagaagatcacgttggacatttggaacaggtttttggtattctgacccaaaatcagttgaaactaaaacaatccaagtgtaagtttgcccaagacaaattgggaatttttgggccatgtaatcagtgctgctggtatttcgactg

SEQ ID NO: 22913 - DNA, 1083 bp, Zea mays
  misc_feature (964)..(986): n is a, c, g, or t
  misc_feature (1026)..(1038): n is a, c, g, or t
cattgggtacctcgaggccggccgggtagtaatcttatagtgatgtattttcaagtgttgatgaatgctgaaaaaaaaaaaaaaaaaaaaaaaaaaaaactcctatgggcgattgggttcctcgaggccggccggcggtcctgccagtagccagttcgacacgaaacacacagcaaaaccggaacagaaagccttggaagagccgaggcggaagcagaactgggaaggggagaagattccgatggggactaagaaacagggaggaggcggaggagaccagaaggtcctcctctggaggctgccggaggtcacctctaaggagctcggcaagataggccccgccctcggaatcggcatcggctgcggcgccggcgcaggcatcggattcttcggtggtgcagggttaggctatggatttcctggactcacattaggctttggagttggagctggatgtggtgtgggaattggctttggttatgggttgggcaaaggaattgcatatgatgaaaagaaaaaatactccaatgttggcaagatgttccaggaagctccacattttcctatggacactgtcggtgctttatttgacgagctggttataaacaccaagaagcttgtgacatcaacatcaaaaggaatcgaaaaatggcgttgagcggcagcactgcattgttgtctctataatcgccttgaattgtatcaacggagattgcgagcagcagttatcttgaacaggcaggacctggccctagaatgcagcctgttgcatgtcgtgactttctttctattgttcgtcagctagtagctttgtatttaggtaggatcctgagataatacatattatttctggtcgatatttattagttgcattgaactgtattctgggttgctcatcacttgtatgttaaattggaggaaaattgatgctatgagcttcaaaaaaaaaaaaaaaaggtgaatnnnnnnnnnnnnnnnnnnnnnnnacccttctgatatcagtgtgtggcctgcaattgttgtctnnnnnnnnnnnnnctctcaggctatcctcgccaccgtctattttaaactagtatgtct

SEQ ID NO: 22914 - DNA, 814 bp, Zea mays
gaggctcggccggggaaaccacagcaaacccggggcacctcgccgccggccccgaggcggaagcagaactgggaaggggagaagattctgatggggactaagaaacagggaggaggcggaggaaaccagaaggtcctcctctggaggctgccggtggtcacctctaaggagctcggcaagataggccccgccctcggaatcggcatcggctgcggcgccggcgcaggcatcggattcttcggtggtgcagggttaggctatggatttcctggactcacattaggctttggagttggagctggatgtggtgtgggaattggctttggttatggcttgggcaaaggaattgcatatgatgaaaagaaaaaatactccaatgttggcaagatgttccaggaagctccacattttcctatggacactgtcggtgctttatttgacgagctggttataaacaccaagaagcttgtgacatcaacatcaaaaggaatcgaaaaatggcgttgagcggcagcactgcattgccgtctctataatcgccttgaattgtatcaacggagattgcgagcagcagttatcttgaacaggcaggacctggccctagaatgcagcctgttgcgtgtcgtgactttctattattcgtcaggcagtagctttgtatttaggtaggatcctgagataatacatgttatttctggtcgatatttattagttgcattgaactgtattctgggttgctcatcacttgtatgttaaattggaggaaaattgatgctatgagcttcaggtgaaaaaaaaaaaaaaaaaagcggcc

SEQ ID NO: 22915 - DNA, 5007 bp, Zea mays
caagcaacacgtccgcgggccggctgatgccgacattttggtggtgggtgcccacccgcggcgcggccccttttcgcgctcgccgggctcgtccgtccgtccgtccacgcccctcatgtgatcttgattgatatgccgcgcccgcgcgcgactcggcggccgtccggctgttttcccttggatgaccgatgacctgacctctcccgcgcgcgtctcgtccatctaggattggatgacctcacctcacgaggctgaaggagcatgtacgtacgagcagtagctgtgctgaaaagtactagcactggaagctcgtccgtcgcattcacaggagattgccggatcggctggttcttcttctatcgactcaatatatttaactcgacttattagataaacttattatataaaaaaaactgttcatcatacatgccgctctttgtaccatgcatagagtagatctattaactttgtcacgcaaaaataaacacaaggaaacctgtcttggattaagcaaaagtttcacgttcaaatccatatactacatggcatacatggatggactggactgtcgcacccgcctgattgaaactgcgaaatgctgctttgaagtacggcgaattttgtaattacaacagcagagcgatgtttcgtgaccacaataacgccaaaaagggtttgctcaaattgttccggattaaagataattatttagactgatatagctatagtttatagagacaaaaatattatagaaactgtaaaagccgatatggattaaaactaaataagcaagaaaaaattcggttcacattttctaccatcaggacgtacctcacccgtcaagcggggaaaaacggcacctctaccttccaatcgagagtgagtcttatccgggaagtagtttccacggcgacaaagttcgctcacgttgacggtatgttaagacgtctctaatggctgtctcaaatagctagttaatgttaagctaaaataagaataaaaatagtaatttattttatcactagtatttggttttacacgtaatacactcaattttttagaatatgtttaattttatatctatttggtcgtcgctttttttctatattttctattaagtagaaaagagagtgaatttagttattaaaatagctagctatttggagacgctctcttatgtcttagcggcgcaactcggcgtggagatcgcagagggaggcgtgcgcggaggatgggacaacagtgcggcgatgcaggccgccgcggcccccacgtgtctttacgctccgctgcgtgcgcggccgatgccgatgccgacgccgacgctacgtcgctaccccgggcggggcgcgcactgcactgcctgacaccagctagggacgcacggatcgtgatgcgtcgtcttcctcgcccatggggcccccacgacgtgctcgcgccgcctggcgtggcgtgccgctccctgccccgctccaggtgggccctcgtgcggcggctttgcctttgcgtccgtcttcgtgcatccttcggccttcgcttttggggtatccgattttcgctccacgccctccagtctctcgttattgcctcagagcccttgctctagaagaaagtcacgggaaggattaagctgctctttgacagcgagttaagcgataataactattattcaccatattcgcttaactttaatccgtacagatttctattatttctacattattttggtccctatatattatagccgaagcagttaaaacaaccgactttaattcgaagcaaacattaaattacaactttttaaacagagtgagcttaaattaggctaatcacaaatatcatttcataacactttttccgacactgtcacgtcataaaaaaatgtcattaaactaagaatcaaacaatatctctcgttgcaaactaagaatgaaaccatactaattgtgtttataggcagtgctctagcttgatcacaggagaaaactatgtgtatagcgaacatgattttgaaagttttcacatcaacagtagatgggaatgatttgtgggaaagcagtgatatgctatatttttccattgtattctaatttattagattgcatgagaacttcggtgtaagcagtgtggactttttttttttaaaaaaaaagagagagaatacttaaagatgggttcacttgggaagaagacccggcagcgattgcgctaagaccatcagagtggagggacctaaaagggaaacggcacccgtaacacctgccatacgttacgtaattttgcaggccggcaggtggcataatcggaaaacggctgcctaattttaatggccgcctcgctaaagacgaggggcggcggcgaggacaggacagtcaaaccgctcgctgactgcgccgagttttattgcctctcgccgctccaccactcgcgctccggctttccgctgtctctgctgcccttttttaacccacccggctgcctataattgccgcccccgcccccgcgccgggcccaagacgcaatacacatacaccccctcttgcccacaccacctcgctgaaccggaagacccgcacacacacgccacttgtagaccatggcgccccgggtggcggacaagtcgcctctaccgccggccaccggcctggggctgggcgttggcggaggagtcggaggcgtgggcatgggcccgcactacagaggcgtgaggaagcgtccatggggacgctacgccgccgagatccgcgaccctgccaagaaaagccgcgtgtggctcggcacgtacgacacggccgaggaggccgccaaggcgtacgattccgccgcccgcgagttccgaggcgccaaggccaagacgaacttcccgttcccctcccagtgctccgtcgcctccggtgctgccggtagcgccagtagcaacagcaccgtggattcgagcggtggcggtagcggctgtggcatccaggcgcctatgcaggccatgccgcttcctccggctctcgatctcgacctcttccatcgggcggccgccgtgaacgcagtctccaccggcatgcggtttccgttcaagggctatcctgtcgcctgcccgacgccacagcagtactttttctacgagcaggcggctgccgcggcatccggataccggatgctcaaggtcgctccaccggccgtgactgtggccgcggttgcgcagagcgactccgactcgtcgtctgtggttgatcactccccttcgcctcccgcggtgacggcaaacaaggtgggcttcgaactggatctgaactggcccccgccggcagagaactaggcaggccggagtttttggctgacgacttagtagcttccttttcccttttgccttcatcaggaatgttacttgtggttgttttggtcctgtatggctgtattcttgttctgtagactaagagatggggagtcttgtaaatattttttttccgtcgagacggaaatgaactgagatctgttcgtctgtctgatcaagccggcgttgatatgggcttaagctatggagtattgattagtaattgccaagtactgaggatctattagttgttgaggggaaaaaatgacccaaacgaaatctgtccggaaacgctcccttgccatctttccattcaaagctttgttgcgaaacgcaggtctgcatttaatttgcgccgctgcgtttccgccaccaactactccgtattttgttgccgtcaaggtgacacgagaaatttactgtactacttgtttggtcagtgccgcctctcattctgcatggccttaataactcgacaaatcttgtttcctccttgatgaggctgatttggagccaagcgacgtgctcatcagctgaccgccgatgggttcaccgaggaagcagaactgcagaagcaacgttatccaggccactggtttccgcggctttccccgctccactaaagcaattattattgttctcaccgcgatcaatttgcggcgacggcgacgaaatacttttgaaatccttggttggtccggtcatggttgtatggcactggcagcgtcgaggagacggcagggcgcggccgcgtgcagatctttgagaaggaaaaaagcagatgccatggagcggggggagtcgtgggcctttggcgggaggcaggtgtggacgggacgactcctcgagcggtggggcggctgcatctttccgcaccggcgacgctctctttcgtacgacggaatcgccgctgcgttgtgctactcgtgaccttgagaataacgtgtgcgtgtgggcggcgacacgtgtgcgcggcggcaggccccgtcgttgccggctgcggatccgctgcgggcaccccgctctgccggccacggtggttgggcggtcgcgtctcgcggccgcgggcgtgccggatccgctgatgggccgcgggcgtgtcccgtgtccggggcggccgcgtctggatgccgcgcgaggaccgggcgtggtctcggccgacagctgtgggcctggcgcagcgtgagggccggcatcagggggcagtgattcgcgcggcggcagcttctcctcgccgtggggcccaccgcgcgccgcgcctccggataccggaggatttctgccttccgtcgttttacgcgcctgcttgttttgctctgctaggtgcacctaaggctatctactgcagttcacacgtaattataaccatatttaaactacactataaataaaaacaacagtatagaatagtttttaggctatccgcagtgaggaactttaaccagaacgctataaatatagagttgaatatgcagtaaaaaactgccgcagtggtgaactgtttgagttactctaaacggtatgaggaaaccaggaacactactttcagagtacatgcagctcttactcgaaacactgttgcagagtgccggaacgcctagatcggaggagagaaggaagcggtttgttggctgggaaaagaatagagttaaaaagaaatgatataatatgtgatagttggt

SEQ ID NO: 22916 - DNA, 2820 bp, Zea mays
cgctggcagccccagcagcgacagcaccaccctgcgctccccctgcggcggcagcgggtgtggcgtcgaagcgccggctgtgcaggcggccatgccgctgaccccggccctcgacctcgacctcttccacccgggcgggggccgccgtcagcgcggtcaccaccgccggcatgccctttccgttcaaggccttccccgtcgtgcgcccgaccccacatcagtacttcctctacaatcaggccgcggcggccgcggcggcagccgggtacaggatggtcaaggtcgcctcagcttcagtcaccgtagccgccgtcgcgcggagcgactccgactccgcctcctcgtctgtggttgatcgcacctgttcgcctcccgcggtgacggcaaagaaggaggtcagcttcgaactggatctgaactggccgccgccggcagagaactagtcgcaccggagttttcagctgacgactttgcagtttcctttttcccttttggccttcatcaggaattttagtgtagctctgggtgtttggtctttttttttcttgcatgtagagtgtagactatgatatggcggagccttgtacatagtactgtagtttttgtttttccgccgagacggagatggtctctaagatctgttcgtgtgtctggacagatcaaaccggcgttgatatgggctttaaaccatggagcatattgattaatttctatgtatactgaggatatgattgctcatgaaaaaaaaacgatccaaagaaatgtctccggtgaagcttcagacgtttcctgtcgatcttccattgaagactattttgttgccgtcacggtgacacgacaagtttacttctggtttggtcagggacgcgtctcattctgcatggccgttgtttcctccttgacgaggctgatttggagccaaacgacgtgctcatcagctgacaagtttacttctgatttgaagcagaactgcagaggaaggagccacttgtttgcgctgctgctttccacgctacgccatataacgacagtaatcatcgttctcaccgcaccacggcccaagcggcgacgaaataattttgaattccatggtggtatggcagcgtcaagtagacggcagggcggccgcgtacagtacagatccgtgagaaagaagaaaaaaaaggcagatgcgatgcgaggttgagccgagcggggagtcgtgggccttgggcaggaggcaggtgtggacgggacgaggacgactcctcgagcggtggggtggctgcacctgcacctttccgcgccggcgacgatcggttcgtacgagtacgacggaatcgcggctgcggtgtgctactcgtgaccttgagaataataataacgtgtgcgtgtgggcagggggggtcccgcgcgacacgtgtgcccgcagccaaggcaggccccgtcgtcgtcgttgccggctgcggagggatcccctgcgcgcgccccgctgtggctgggcgcctcgctgggaccgcgggcgtgttccgtgttcggggcggccgcgtactccggatgcggcgcgaggaccgggccgggcgtggtctctctcggccgacagctgtgggcctggcgcagctggaggagcggcatcagggggcagtgattcgcgcggcggcagccggcagcttctcctcgccgtggggcccgcgcgccgcgccgcgcctcgcctccggatcactgccgctttactacatgcgttggctttcttggtgcgcctaataattatgtacgactactctgcggtgcatgacttcatacggctgcggctatgcgactgggcctactcctttgggtttttttttttaaaaaaaacattttaataaaatattaaaaatttctctgcacggctgtttacatgtaaaccagtaatattcgttttcgtatttagaatctagaagtaacaggattggaaaagatctcaaattcacggtgcggctagtactgtttggacctttttgagagtgtggctgtgcactctgtaccatttttccttgctggacctggcctggacggcagggaacccacgcccgagggcaagggtaggaatcaatcagcgacgaggccgggcgcggggactggaggaaagcaatgggcgcacgtaacgcgggacgtggacgtgtgagggagcgggggaggcgcggtggggagcgtgggggcattgactgagacgtgcgtgcacggagggggcaccgatcggcgctgatggcatgccgggacctgcgcatgcatgctctcgtactgtactcactgccagttgggcgtggcggagagcagcgcggccgcgggggcacggaaatggccgcgcgctccgcttctgctcccttgctcgctgtggcgccgtgtgcggcggcttttttccgccgcgtggcccagtagctcttggatccaagcaacggcgggaaaccgcaccgggagctacgggaaaggcgcgcgcagagaaaagcgcgggcccggacaggcgttcgcggtgggcgtgggcgtgcgtcgttgtgaaagtggggacactggcgggcgcgtcctcgctcagtcctccacgtttggcgctgcgcggcgccataaagtaatttggtttctacccattacccaagcaaacgtgcctggcgccagccgcaatctcagctcgggcgttcaaaaatcgagtgcctacggttctcatgtctgactacgggctaggaaggaacctgccaaacaggcgcggatggagctgctgaccagcctctacgcgcggggcctggtaaattggtggggcgcgggcggcttcggcgacggtttgtcatagcgcgtacgcacaccgca

SEQ ID NO: 22917 - DNA, 4464 bp, Zea mays
  misc_feature (37)..(37): n is a, c, g, or t
  misc_feature (422)..(422): n is a, c, g, or t
cgaaaagcatagcaaagcttttcaccgggcggggggntgcggcttgcttttcgatcgggccgaaatagcggggttcgactcgaacagggcgccaatagagcggcgtgaggggcctaactggggaggttttaagatacgcgagcggcccgccccttttttttttttttttttttttttttttttttttttggttccgggccccccctcttgtttttttttttttttttttaaagtgaaaaaaacatttcatctatatgattgtttcactacaaaatgaacaaagaatagttttatacaacacatgtcccgctttttacaagcaaacctcacaccataaaccaaacaaaaatgtcacccttgctcagataaatggtgatccttgttaaatgacataaagaaatctctttttttcactgagggcnagaatatgaacataatcaagagagacgccgtgtgactggtcagagtataattcttccctttccagtgcatccaccatactaggaacagcaatcttctgttactactgcatgtacaagtatattcccaaagagattccacgtttacccactaaaatgtccaaaagaatgttatgtaattctcagtgtagtcaatccgtgagcattgacataatttgttccagggtatgtatggggaatatttacctccgtgtaagttctgtaggcaaatacaaaactttgtacagtcagcaggaatagagatatacaataacgccagctggtacctgccggatcctcaatcttgagaaaggtcggccctggataagtagttattatcctcagcaatcaaatcaatagaaaaaaaaattaatgcaaaagaatgagcctctccacaatgaacatatccaagccagtaaaagtaggtatttcgccagcactacaatgagttgtatcacctgtatttccccatactgctctccaacctctgtatgcttgcagcaacccggccaatgtttggttttgagtcaatgctgtaatcatcgctgttgttgacacttccagtgttagtctgtacatcggtgttactagcatcactgtttgcaacaattccagagttggatttcacattagcatcgacggtgtcattgctcttatcactggtgtcattgctcttatcacttccattgatcggttttatgtccacacacttggcattatcagcactactaacaattttagtgctggatttcgtatctgatgggtccctagcatcactgttagcagtgcttccagtgttgcactttgcatcgaagttcttgatataagaattaacgacacttctaatgctgcgcttcgcatctttgttgacaacactggaagtggtggtgtccacattactgctcttgtcatctctgctagagatgttgtcagagttgggctttatatcgacagttttggcatttctatcagtgatgttacctgtatccagctttacattagagcttttggcgttactgatggtgatgcttccaatgtggggcttcatatcagaactcttggcatctctattagtgatggagccaatgttcggatttacatcaacatttttggcaagtccgttagcaatgcttccaatattgggctgtacatcagtgttcatggtagcattgctggtaatgcttctggtgttgtattttgcatcagcagtcttatcacaagttccagtgggtccgccttttttgcgcgtcgtcgcggccgtggtacaatttccgctggtgatgctccctgggctttgggccaggtcaatgttcttggcatcattattgttaagagactgacaagttttatcctcgttataatgaagccatggatgctttaggcagcctaaagctgttggcctcttctctggtgcaaagtcaagtaatgggcaaagaaaattggcaaattcccgggcatcagattcagaaattttgtatttgtcaacaaggacacgttcaatggatgataatttcagccttcttatccgcttcagatctccatggcggtcaaaatattcctttgatcgtgttcccatggttgcaatcttcttcggcaccttgccaagtagttccatcattaaagccaagtgatgatcctcatcttcactgtatccatggccttccttgggtgtaaatagtatttctcctgttgcgagctcaaaagcaatacatgcgaaggaccacatgtcaacagaaaacgagtatcctgcacctagaatgatctctggcgcccgatactgccttgtctgaataaaatctgtaaattgcttgtcagcccagcaagcattcccaaagtccacaatcttgcatgtcatatcaattccatccaagctcctttctgagcgtgaagattccacagctgattttcttttctcagcaagctttgcaagcaccctccttgctctcatctttagcttattctcaatcgcgttaagaccagcctcaccgttagggtacccctcaggcctctcaaggttaggtttaagcccagagcgaatggggtccttggagggatcaattgtggagacaaggagaatgttctcaagcttcaaatctgaatggatgatgccaagctcattgtgcaagtaatcaagacctaccaaaatcgacttgcatatttgcctcaccctatcgaacccgatgcctttgtaccggttgtactgtaccagcttaagcaagctatctcccagtaactcaaagacgaggcagatatgctgcccgttcggccccgtgtgcttgaagtgatctatcagctgaatggtgcatttgcagttcaacgggtccctcttggtgatctctgataggaactcgatttcatgaagagcagcttgcgcaaactcaggcgcactcttttggatcttcagggccacgtatctctgcaggcgcgagagtaccatttgtgaaaacaatgttctttttttcatccaatttcataactctaatcaaagacaccagagtatccagagcaataattacaatcacggttatagttaatcatggttatagttaaacgtaaggcacattattactatgagaaaaggacattaaaagatcggtactggcaactgggtttatttttgtattgtacggctagtgaaatagatgaaaactttaatttggcattgtttccctccagacctgaacccacctgattctggttgcttgggaacggaagagttaaaagctttctcttcccaatggcagcggcaaacggatgaaccaaactcccagatggggcaagaaacgacaaaccgaatccctagtctagtgaaatgaagcctataaaatccgagtgagtgtcggacagccccgtcgcaatcacaatcccgcgcccattcccctcgcgtggggcccgattgcagggcagggcagggcgcgcgcgaggtggcagcggtacttgcgatccgatcaagcgatcgaccggtggcccgctaatcgacaaaacgcgagatctaggcgggcaatcgcattacgaagcggaggggagggatcgcgccggggaaggcggacgatctttagtctcccctcgatcgctgaggatgcggggagatgccgcgatctcatgcggagggaggaggccagagggcgcgcccacctacctgtgattggacgtcgaaggcgagccagacggtggagaagttgccccatccgagcttccgctgagcgacgtagcggccggcggcgaactggtccccggggcgtacggcgtggtagccacccttgcggtacccgtcgacgccctcgtcgtcttcctcctccacctccacctcgtcgcccgataaggacggcgacaacgacgacacccgcgacatgatcctcctcggtttccaacagggatttcaaggcgaggcccgcgtaggtgtccggcgatcccaccgggggcgttgcgagctcttcttccgggttaattggggtgggatgggaatcgcgcaggcaggtggtggtgggtttggttggttaaaacttttttttgggggggcgggctcaggtggcgggggagggagggacggagagcagcatcccttcccgcccccccccgccctggacgacagagcgaaatggagaggaggacgcggggcgctttcccacgtcgctcctcctattttggatgtattgaacgatcacccacgacgacagtttcgattccatcgtcccatcgccaatcaacctgttcttcgaacttctctcttttccatcctgaacaatcggcaaaagcaaatcatcgtttgcctcacttttactgaaaaaaacgtgacttttaatgcactttaaatttaccctctttgaactttaatttatatataatataatgctctctcggtttcaaaaaatattcgcttaaagttaactaaatttatataaaaaataatacttatatctccagataatttattatctctaaatacttttattacaagaatatatcaaacgaatcgtctattgacatgagaaattttaatttgtac

SEQ ID NO: 22918 - DNA, 1084 bp, Zea mays
tgtcaacagaaaacgagtatcctgcacctagaatgacctctggtgcccggtactgccttgtctgaataaaatctgtaaattgtttgtcggcccagcaagcattcccaaagtctacaatcttgcatgtaagatcaattccacccaagctcctttctgagcgtgaagattccacagctgattttcttttctcagcaagctttgcaagcaccctccttgctctcatctttagcttcttctcaatcgcattaatcccaccttcaccgttagggtttccctcaggcctctcaaggcaaggtttgaggccagagcgaatggggtccttggagggatcaatggtcgagagaaggagaaggttctcgagcttcaaatctgagtggatgatgccaagctcattgtgcaagtagtcaagacctaccaagatcgacttgcatatttgcctcaccctatcaagcccgatgcctttgtaccggttgtactgtaccagcttaagcaagctatctcccagtaactcaaagacgaggcagatatgctgtccgttaggccccgtgtgcttgaagtgatctatcagctgaataatgcatttgcagttcaatgggtccttcttggtgatctctgacaggaactcgatttcatgaagagcagcttgcgcaaactcaggcgcactcttttggatcttcagggccacgtatctctgtgactggacgtcgaaggcgagccagacggtggagaagttgccccagccgagcttccgctgggcgacgtagcggccggcggcgaactggtccccggggcggacggcgtggtagccgcccttgcggtagccgtcgacgccctcgccctcctcttcctcctccacctccacctcatcgcccgacaaggacggcgacagcgacgccacccgcgacatgttcctcctcggtttcccacgccccgcgtttcggggattccaaggccaggcccgcgtaggtgtccggcgatcccaccggtggcgtggcgagctcttctcttctgtttcgggttaattgggctgggaatcacggaggcacgcggtggtgcgtttgccggccggacctcgaggggtacc

SEQ ID NO: 22919 - DNA, 4553 bp, Zea mays
  misc_feature (1287)..(1287): n is a, c, g, or t
agtcacagcctccattcaaggaggcaaagttgcaactggattgtgttcaccacgaggatgtaccgagtccggtctggagaaggatcgatgagccttcataattctatcttgctccaaaacatcggactaatgttttggtaaatcatgacagaataacaatccctgaaatacaggcgcccagagtttgacgagaaatgtgacacgtcattggatgatgtggatgttgtcttcaatgattcagaggtgggtaaatggtgcatttttgttttctatctcatgcagagtgtcactggttttacttacaggccgcttttgcaattgttatttggcctcattcaggtgcaccacgtgccagagaagaaagaagaagaacatgtagctctctcaatgcattcgaactgatttcaaggccagcagtcctaaatcttgggaacctatttgactcggagcaggcctcaatccacctccttgcaatagtaacaaatactccctccattccaaaataatagtcattttagcttttgatttttatgtctgaattcaattgaatgatgatgaatctagacacttgtacaaaatacatacattaattattgtataaatatattaattgtctaaaatgagttttaatttggaacagagggagtgtgaaaccatagtttccaagaattaaggaaactattcttgtaccaaaaaaattaagtaaactaactctggctagactgaacattaaagtatttcgacaaattgatttatgtgtagtttacttagattgaaacaaaactgattgttttttcaacaaattgagcagcaacttacaagagagtattgtgatatttatatttctggtttctgtgtagtttttatacatggtacgtaactgttgccactgcaggcgcgcgcaacgcgcgtctaatggcctagtagtggtaaagaagggagtgcacaagaggagctgtccgtgttaagaccctgggccgagatcaacaaccaaagtactcaagttgttcgtgtcatcgcgtgtagtggagaagataagagtatgtttagttcactgtctaacttgttacattttatttaatttttttatctatgattagttatttaattcgaacgactaattttaaataaaatgtgacacagttagatacgaaccaaacatgcttcaagtctgaagcatagagcagtgacagaagtcggtgagaaggtccaagaactcgttgaaggctaaccagcggtatctgggctctgactggatatcaaggtcggcccagcccatgtaattgncgtgagcgactagcacaacaaacctatcttacgccaggagtacatttgccctcagcttcccctgcgagtgtcagccatgaggaacaacattgatggcgctggtaacattctgatgcgatgcgagtttctaaacggtacagtagctcaacatccagaataatgtaagccaatttgagggtaatctggtattctgctgttacactagatgatcctggttgcagccagatacatggcgcagcaaaattgtctaaaatcacacacgatttgtggagaatgcaagtctgcaagccagtgagtgactaacagttatcagcatgcatcctgcggcagatccgggatggcactatcgctgcaaccctattcttgggactgcctcagctgaaccaacaagctgtagggatacagtatgccagaaaggctcacagatgacaaactacctgctgatatgatcaatctctatcctttcttttaccagttatggactcatccttactttctgccagcctccgtcgcaccaacttagatcttgttcagttataagggttgaaatctcatcatggatttaatctatatctggatcacgtgaatccatacatcatacataatcccatggtgagattaaatccatcacttaatctatgtatctcttaaagctagttattcttttgattcatgcattctaatataaaattgtgcaatatcttcatggatttgttccatacttaatataatccatgttttccatagtttaaaaaaactcaaacctttggttataattcatggtgggtttaaccgaataaaaaattaagtagacttagattattttggtcatggattgtgacgtagatttaatttcaattcatgtcaatccatagctggattgatgtaaacgaacaaggcttagatgcctcacttggaggaatttcgtggacaaatccactagtcatttgaacacataaggacttgttcgtttacaccaatccaactctggattagcatggattggaattaaatcaatgtcacaatccatgccctaaaataatccaaacctactcaatttttttatttggttaaaaccatcatgtattataaccagggtttgggaattttttttaaactatggaaggcatgattctccatctatatctcattaggtatggaacagatccatatcgatattgcacaagtttatattagaatttatagatcaaaagaaataactaactttgaaagatacattaattaaatgatggatttaatcccaacattggattgagtgtgaggtatggatttactccatctagacctagattaaatccatggtgggatttcatcccttgtaaccgaacaaggctaaagtgaaaagtttccatctatatgatcgttcaccatgaaatgaacatcaaagaatagttttatacaacacatgtcccactttttacatgcaaatctcaaaccataaaccaaacaaaaaatgtcagacacccctgctcacataattggtgatccgtgttaaatgacataatgaaatctcttttttcactgacagcagaatatggacatgatcaaaagagatgctgtggctggtcagagtacaattcttccctttccagtgcatccaccataaaaggaacagcgatattctctaccactgcatatacaggtatattcccaaagagatttcatatttacccaccaaatgtccaaaagaatgctgtgtaattctgagtgcagtcaatctgtgacaattaatacaatttgttccagggtatgtatggggaatatttacctccgtgtacattctgtgtgcaaatacaaagttttgtacagttagcgggaatagagagatatacaataacgccagctggtacctgccagatcctcaatcttgaggaaggttgtccctgtatttcccgatttgcatttcccagatttgcacctttactcatgctgctctccaacctctgtatgcttgcagcaacccgcccaatgttttgttttgagtcagcgctgtaatcaccgctgctgtcaacacttccagtgtcagtctgttcatcagtgctcttggcatcagtgtttgcaacaattccagtgttggatttcacattagcattgatggtgtcattgctcttagcactcccgccattgctcttagcactttcgctgatcggttttatgtccatacactgggcattatcagtactggtaaaaattctagtgctgggttttatttctgatgagttactagcatcactgttagcagtgcttgcagtgttgcattttgcatcaaagttcttgatataagaattaacaacacttctaatgctgtgcttcacgtctttctttacaacacaggaagtggtagtatccacattactgctcttgtcatctctgctggagatgttgtcagagttgggctttatatcgacaggtttggcatttctatcagtgatgttacctgtatctagctttacaatagagcttttggcgtcactgatggtgttgcttcccatgtgggccttcatatcagaactcttggcatctctattactgatggatccaatgttcggatttacatcaacatttttcgcaagtctgttggcaaaacttccagaagtgggttgtacataagtgttcatggtagcattgctggtaatgcttcttgtgttgtattttgcatcaacagtcttatcacaagttccagtggagctgccttttttgctcgtcaaatcaatatttgtacagtcaacggtggtgatactccctgtgctttggaccagatcaatgctcttggcatcattattgttaagagacccacatgttttatcctcgtcatgtttaagccatggatgctttaggcaatctaaagctgttggcctcttctctggtgcaaagtcgagtaaagggcaaagaaaattggcgaattcccgggcatcagattcagaaattttgtatttgtcaacgagaacacgttcaatggatgacaatttcagccttcgtatccgcttcagatctccatggcggtcaaaatattcctttgatcgtgttcccatggttgcaatcttcttcggcatcttgccaagtagttccatcattaaagccaagtgatcctcatcttcactgtatccatggccttccttgggtgtaaatagcatttctccggttgcgagctcaaaagcaatacatgcgaaggaccacatgtcaacagaaaacgagtatcctgcacctagaatgatctctggcgcccgatactgccggacgcgtgg

SEQ ID NO: 22920 - DNA, 951 bp, Zea mays
ccggccgggagaaacaccagaaagtacgaagtagtgctctactgacagagtttgaactcaagaggaggcgaggcagaaccgcaatcgcgaccgcgacccgcaggtgacatacatacggtgcgagcgccggcagccggaagcaccggtgacgaagccttccgtgtcatcaggatcgcaggtgcagatttcgagcggaacagcttcgtattatttccgccggcgaaatttctggctcgtttgtccccgcggttctgctgaggccagatttcctcctgcggcgttgaattgcgcgctcgacctagggttttgtttcgtttcgcgggcgttgggaatccatccatggcgaggaagatgctcatcgacggggaggtggcggccgtcgcggatggcgggcactatgactacgatctcttcgtcatcggggcgggcagcggcggcgttcgcggctctcgcaccgccgcctccttcggagctaaggttgcgatttgtgagctcccattccaccccatcagctcagagtggctaggaggacatggtgggacttgcgtgatacgtggttgcgtacctaaaaagatactcgtgtatggtgcatcattccgtggagaatttgaggattcgaagaattttgggtgggagattaacggagatattaacttcaattggaaaacgctattggaaaataagactaaagaaattgttagattaaatggtgtgtatcagaggatccttaccagtgccggtgtgacaatgattgaaggggcaggcagtctagttgatgctcatactgttgaagttagccagcccgatggttcaaagcaaaggcataccgcgaagcacattttgatcgcgactggtagccgtgctcaacgtgtcaacatacctggaaaggatctggctattacttctgatgaggccttgagcttggagggagcttcaaagcgcgctgtaatc

SEQ ID NO: 22921 - DNA, 2026 bp, Zea mays
agacgggggcagagctggcaagtggcaaggctgcgcagccgcagagggactttttgtgtaaaatgcggtgggaaggtgcgctgcacctgcaagcagaggtgtgctctactgacagagtttgaactctcaagaggaggcgaggcagaaccgcaatcgcgaccgcgacccgcaggtgacatacatacggtgcgagcgccggaagccggaagcaccggtgacgaagccttccgtgtcatcactcatcaggatctcagggttttgtttcgtttcgcgggcgttgggaatccatccatggcgaggaagatgctcatcgacggggaggtggcggccgtcgcggatggtgggcactatgactacgatctcttcgtcatcggggcgggcagcggcggcgttcgcggctctcgcaccgccgcctccttcggagctaaggttgcgatttgtgagctcccattccaccccatcagctcagagtggctaggaggacatggtgggacttgcgtgatacgtggttgcgtacctaaaaagatactcgtgtatggtgcatcattccgtggagaatttgaggattcgaagaattttgggtgggagattaacggagatattaacttcaattggaaaacgctattggaaaataagactaaagaaattgttagattaaatggtgtgtatcagaggatccttaccagtgccggtgtgacaatgattgaaggggcaggcagtctagttgatgctcatactgttgaagttagccagcccgatggttcaaagcaaaggtataccgcgaagcacattttgatcgcgactggtagccgtgctcaacgtgtcaacatacctggaaaggatctggctattacttctgatgaggccttgagcttggaggagcttccaaagcgcgctgtaatcctgggtggcggatatattgctgttgaatttgcttctatctggagggggatgggtgctgaagtagatttgttttatcgaagagatcttcctctaagaggttttgatgatgagatgagagctattgttgcaagcaaccttgagggaaggggaatcaagttgcatccagggacaaatctctctgagttgagtaaaacggctgacggaataaaagttgtaactgataaaggagaagagctcattgcagatgttgtcctatttgcgacagggcgcacaccaaactcccagagactgaacttgcaagctgcaggcgttgagattgaccgggttggagccatcaaggttgacgaatattctcgtacttctgctcctagtgtatgggctgtgggtgatgtaacaaaccggattaatttaacacctgttgcattgatggaggcaacttgctttgctaaaactgtgtttggtggccagcaagttaagcctgatcacagagatgttccttgtgctgttttctccattccaccactatctgtagtgggcctcagcgaagaacaggccttggaggaagctaatggtgatattcttgttttcatctcatcattcaacccaatgaagaacagcatatccaagcgccaggagaagactatcatgaaactggtagttgatgctgaaactgacaaagtacttggtgcatccatgtgtggaccagacgcacctgaaattatccagggcatcgctattgcggttaaatgtggagccaccaaagcagacttcgacagcactgtcggaatccacccttccgctgctgaagagttcgtgaccatgcgcaccgtgacgaggcgcttgagcccgacatccaagccaaagacgaacttgtaagcaagaaattggtattctggggaaatgttacaccggacaaatactctggtttcatcacgttggtaatttttacgtcattggaactggaaccatgtatattgaaggaataagttgtttttttcatggcaacacaccgaaaataatgagaccgtggactttcttgatacaaataatgagctcaagcagagaacgtttatggttggttctcaaaaaaaaaaaaaaaaaaaaaaaaaaaaaaaaaaaaaaa

SEQ ID NO: 22922 - DNA, 2334 bp, Zea mays
ggacagacgccactccttttactgcggttcctctttttgtccttgtcttttcttcaaacggccagacaatgagattacatattatacattattatttgtagcacagtgaaagaagttcgtgagcaagtaacagtcaaggactcccgcatctccatataacataccaaaggacaagatcaaaacttcaacatcgaactggacgcaggcacgcaggcaatgcaatggagcacggaggacacagagctctcctactgtctcgtgtttggttccactcttttgggtatctcagtcgatcagggctcctcagggatcacatgagcacccaccaccattaccagatgatgcggctctgaagctccgctcccactggtccacaggcaccgctgcggcatgtggagtgtggcgagggtgcttctccctcttgtcacccttgatctgcttcagggcgtgcttgagcgctgggaggagtgcttccaggcattctgccacagcatttgggttgccaggcatgttgatgataagtgttgatcctctgattccagctgtggcccgggatagcattgcgaatggtgtaatcttcaaactttcttgaagcataacaaatgtgagaccaggcgcttctttctgtatcaccatttttgttgcttccggtgtgacatctctgggtgtgaagccagtcccacctaatgtcagaatgaggttaacatggtcaatatcactccattgtaccagaatgcccttgatcttgtccacttcatcaggaacaactgcagtggcaaccacagttgcaccacccagtttctctgatgaagaattcactacagatacagctcttgggccactcctatcagggccagcacctgatgaaacagtgtcacttacagtcagaattgcgactttaacttcagcatcctgtggagatgcaatctgagatacatctgcggaaatactttttgcagaaggaccacgagatggatacggatttgaaggagtaggcagtttatctgaagaagttattatgtctgaaataagtatggcttggatagatgtcccagctgccaatatttgtccagtggatggtatttccagcagggcattagcagatttcatactaagaagacggctactagcctgatggccagtactctcagcaacaaaaccaggtcgaccagatccatcatcaagcacccatctaattgctgcacggtgaaactctgtacgatgtgggtctgctcttaaaggatgtgatatgcgcacatgcactctttgcagatgagggtttgaccagccagagagaagacggattgcaggaacaacaaaaagattaaagcaaacaatacagctcactggatttccaggcaaaccaaatgcaagaactgttttagatggctttggcgtgtcttgtgtggtgatctcagcaaaggttaacggctttcctggtttcatctggatcttctcaaagtgaattttacccatctttgccaggcaaggtttgacaagatctctgtcgcccatggaaacaccaccagaagtaatgattatatcagcattagaacgcaaagctgcatccatatgctccttgagactttcttcagtgtcctctgcaatacctaggtcaaccactttgcatttctgctgaatagcacaagctagaagcatggctcgattggaatcacgaatctgaccacggctgagggtggcagtggctggctgcactagctcatcccctgtggagaatacagcgattgttggtcgagggtacaccttgacagtggttacacccactgttgcaagtagcccaatttctgcaggacctatatgctcgccagacttgagcacaatcgaatccttctctatgtcacatcccacactgcggatgtcctgtccttgggaggcccgcgcaagaatcctaaccctcttggacccatccgctccgccagggagctgctcggtgtcctccacctgcacgacggcatcggcgccatcgggaaccggccctccggtggtgacgtaggcgaccgtgccggggacgacgaccacgccgagggcgtcgtcgcccgccctcgactccgtgaccacaggatactcccctggcccatcggaggccacgacggcgtatccgtccttgatggaggcgcggaagggagggagcggatcgggcgcgcagacgtcctccgcgaggacgagcccgagcgcgccctgcagcggcacggcgtgcggctccgcgtggcccgccgccgcggacagcaccgccgccagcgcctcctccacctgcagcatctctctccctctctggtctcctctttttctctctatcttccctcgtgccgaatt

SEQ ID NO: 22923 - DNA, 1052 bp, Zea mays
gagctcactagtctcgtgccgttttttttttttttttttggaccagccaacatttctgtccactttattcctcggtgcacttgtagaacaacgctctgctctctgcactcagcattcctgggtctgctcgaaaatgagcatcattgatcaatcgacactgagtgacacacatcacacgtacactttccctagtactagtagcgctcaataacgtacggggcccacacgagagcataggcatgtggcactcgccgtcgttggcggcggagcgtcgtcgtcgccctcgaacgacgacgattagtggacggcggggccccatgccggatacatgacgtatcctggatccggctcccctgccggcttgaccgcgccgtgcatcttgtggaacgggtggccaggcgacgccaccgccgccgggccgagagcgtcctgcttcacgtggaatggatggtcgggcgacgccgccgcgggtccgtgagcgtcctgcttctcgtggaatgggtggtccggtgactccgctggccctggccgcccgacaacgccagcaccgccgcctgcgcgcagaggcctcggcagggcggcactggtctcgcagccgcggtcgtcgtagcactgcccgtagcaggccttcgtcttcgtgtcgtcgtcgccatcagccgcgcggcgacggtggcaggactccctgacgcaggcgagctggcagttcatggggacgaccgcggggcgccgccgccgggcgtcgggcgcgcaggtcttgtcgcaggcgtagctgcagtagtctctcatggacttgtccttggagatgcagtccttgaagcagtagtcgtagcactccgcgtaaccgccacacgcgagcagagcagcgccgccgccaccgccaccatggctgccaccgcaaccgcgcgtccgccggcagccgccatgcctgtcctcgcactgctggccgctcacttgtactcgcactgcgggccgcagactcgttcgcgtcctactgtcctagcgcgctcttaaaagccggcgggcagcgagccagccgtgtgtgtcacgccggt

SEQ ID NO: 22924 - DNA, 1821 bp, Zea mays
ttagctttattatgcttttcctatttttagcatgacaaattcttaaatgaaatgtgtttcaagaaataggtggattttttgtttccttaaaaaattgtttattttaaaatatggctagaaagcctagtcatttgtaaattttaatttctaaagacgaatcgactaaaaaactatttctacgattgcttgagagagagagagagagagagagagagagagagagagagagagaggtgtgtgagagcgagaggactctactccagcaaatggtgtgtatggccgtgaaaacatatggttctgtattatagattatattgtttacagaaataatagggatgtgatagaaagactattgtgacctagtggaagtcctcagatttaataaatccagaaggtgtgaacgatataaaaaaaacgagtatacaaagagctccaggggtggcgcagccgcagccctagcccacaagtccacagcgcatgggtgtgcgtgtccctctttcgtccacagcccacataatggcttgttcggttagctctcaatccatgtggattgagtgggattgaatgagtttgaatcccaaataagtcaaacttcttaaaaattttttctaatcccattcaatccatatgtattgggaataaccgaacaaggcctaacagaattacagcttacaggtgatggttaggttctcagagcacacgcagcagtttcacagaatgtctttgttcacaaagaatccgtaagcgtccagtgaatatgtttcgaagataatttctgtccgccgccccttttctctgttgtctcgtgaaccagccaacatttctgtccactttattcctcggtgcacttgtagaacaacgctctgctctctgcactcagcattcctgggtctgctcgaaaatgagcatcattgatcaatcgacactgagtgacacacatcacacgtacactttccctagtactagtagcgctcaataacgtacggggcccacacgagagcataggcatgtggcactcgccgtcgttggcggcggagcgtcgtcgccgtcgaacgacgattagtggacggcggggccccatgccggatacacgacgtatcctggatccggctcccctgccggcttgaccgcgccgtgcatcttgtggaacgggtggccaggcgacgccgccgccgccgggccgagagcgtcctgcttctgcttcacgtggaatggatggtcgggcgacgccgccgccggtccgtgagcgtcctgcctctcgtggaatgggtggtccggtgactccgctggccctggccgcccgacaacgccagcaccgccgcctgcgcgcagaggcctcggcagggcggcactggtctcgcagccgcggtcgtcgtagcactgcccgtagcaggccttcgtcttcgtgtcgtcgtcgccatcagccgcgcggcgacggtggcaggactccctgacgcaggcgagctggcagttcatggggacgaccgcggggcgccgccgccgggcgtcgggcgcgcaggtcttgtcgcaggcgtagctgcagtagtctctcatggacttgtccttggagatgcagtccttgaagcagtagtcgtagcactccgcgtaaccgccacacgcgagcagaggcagcgccgccgccaccgccaccatggctgccaccgcaaccgcgcgtccgccggcagcccccatgcctgtactcgcactgcttgctggctggccgcagactccccggcggccctcggggtacccgagctcttaaaggccggcgggcagcgagccagccgtggggcacgccgtcccgccgcctcgaggtaccaa

SEQ ID NO: 22925 - DNA, 529 bp, Zea mays
aggcccgccagtgtcctgcttcttgtggaatgggtggtcaggcaacgccgccggccagacagcgtcctgcttcttgtggaatgggtggtccggcaacgccgccggccagacaatgccaacgccgccgcctgcgcggagaggcctcggcaggccggccttggtctcgcagcggtcgtagcactgcccgtagcaggccttcatgtcgttggcatctgcacggcgacggcggcaggagtccctgacgcaggcgagctggcagtttatggggagtccggcgacggggcgccggggcgccgcgtcgggcgcgcaggtcttgtcgcaggcgtagctgcagtagtctctcatggacttgtccttgttcatgcagtcgttgaagcagtagttgtagcagtccgcgtacgcgccacccacgagcagcggcagcgccgccgccgccaccatagccaccgcaaccgctcgtccggcagccatcctgtcttcctcctccgctcgtccgggccgctcactccactcgcactggctactgcag

SEQ ID NO: 22926 - DNA, 1003 bp, Zea mays
attcctcggtgcacttgtagaacaacgctctgctctctgcactcagcattcctgggtctgctcgaaaatgagcatcattgatcaatcgacactgagtgacacacatcacacgtacactttccctagtactagtagcgctcaataacgtacggggcccacacgagagcataggcatggggcgactcgccgtcgttggcggcggagcgtcgtcgtcgccctcgaacgacgacgattagtggacggcggggccccatgccggatacatgacgtatcctggatccggctcccctgccggcttgaccgcgccgtgcatctggtggaacgggtggccaggcgacgccgcctccgccgccgccgccgggccgagagcatcctgcttcacgtggaatggatggtcgggcgacgccgccgccggtccgtgcgcgtcctgcttctcgtggaatgggggcgccggtgactccgctggccctggccgcccgacaacgccagccaccgccgcctgcgcgcagaggcctcggcagggcggcactggtctcgcagccgcggtcgtcgtagcactgcccgtagcaggccttcgtcttcgtgtcgtcgtcgccatcagccgcgcggcgacggtggcaggactccctgacgcaggcgagctggcagttcatggggacgaccgcggggcgccgccgccgggcgtcgggcgcgcaggtcttgtcgcaggcgtagctgcagtagtctctcatggacttgtccttggagatgcagtccttgaagcagtagtcgtagcactccgcgtaaccgccacacgcgagcagaggcagcgccgccgccgccaccaccgccaccatggctgccaccgcaaccgcgcgtccgccggcagcccccatgcctgtactcgcactgcttgctggctggccgcagactcgttcgcgtcctactgtcctagcgcgctcttaaaggccggcgggcagcgagccagccgtgtgtgtcacttccgccggctcgaggtaccaat

SEQ ID NO: 22927 - DNA, 937 bp, Zea mays
  misc_feature (925)..(925): n is a, c, g, or t
tgacagccctagggtgcagccgtgcatagcatttgcggcagatcatcttgtcctggttgtacttgcgagcgagcgcctgcagcgagggctcaatgatgccaccgcggagcctgagcacgaggtggagcgtagactccttttggatgttatagtccgcaagggtgcggccatcctccagctgcttcccggcaaagatcagccgctgctggtccggcgggatcccttccttgtcctggatcttggccttgacattgtcgatggtgtcgctgctctcgacctcggccctggcggtcggggccttttttttttttttttttacggtaataggctcattagacccaaaaaaagatcaccagtagacaaaattcttggaacgtacctcgtttccacaactgatattagaaagaaagataacctgcttatttaacaacagatcaaatccgttgagtgcaaatcaatacagtgtatgatctatgacaagctctgaaggtcagggaccagaataggcaatacaacattcattcttttagtgcagatgactgtccagaagaaagcctctctgatctcgccttgttagccttttccatgtaatcttggtgagattgatgctttgcccctcgcgtcatgaagtaccatgggacgccgaagacggcagcgaagatggcgatgccggcgacgacgtgcttcttctcgccactgtaaaggtagtgctccatccgcgcgcggatacccccgccgccggcattcgtggcctctccgcccatcgcaaacgcctggtaattcgctcgtgcgtgcaggcactgagtgttccgtgtgactagggttcttttggcggccccacaggtcacacgaattttagggcaacgaccgctatgcaagcattcgcccccgcccgccccgaccatccgatccattagattatganccaactaaagat

SEQ ID NO: 22928 - DNA, 2831 bp, Zea mays
tgcattaataataccgtgaagttcttaacaggtaatggaagggactaaacataatagcaagatcattgcagcaatacttaaacccctccaaaaagaaccataggcttcactccataaccaaagcagatctccatgtcctgttatcctattcatgctcttctccattatagtcagcaaagccagcaatactcacagtacatgacaagccagaaaaacagcatttattttatgtgtcaccagtcgttccatcttgttttttttattgagctacatttgttccaatttaaacaatcagaaagttacatccacttctatctaagaaaaccaccatctatctaaacttgcatcagtaaaatgaggacaaaaaaggcagaagcatcctaatttgaatatctacaaatactgccatctatctgtattcattaatgacaaatttccatatagcatgcaccaatgattacctactgaaacttaaatgaacacaatctattacactatgcttaaccttcaccatcaatggtccgttacttaatatccccaatttagacaagttagaatagcaccttgaatcaagctgaattctgattctacacaataccataccaatgcgcaatggcataaaaaaattgggcaaagctatccaagtgtcactacaagttgaacacacaaaacaaactaaacaagggtccgtactgatttaacattcaactactacaaacaaacaatataaagtcatcagcaacactaaatactggggtgggggatatacaggttcagatatacttcaacagtaatagctgctgctaagcccgctcccctgttgaaccataaccatcaaagctttgagctaacacagcttttacaccaacctttactcgaaaactaacatgcaagcaaccgatcgggatcggatgcaaaatcgggaacagcgacaggtcaaagtcaatccactcaccgaaggtaactggagctcgacgaggctaccgtcctggttgccagcaagcttgagctccaccggcccaaccagctccacgtccctgacgccggtgtcgaacccgaacgcgccttcggcggggacgacgtcgaccccgtccggcccatccacctcctcgacggccggcgcggaggggagtctccactccacggcctcgtcggagaaccgcgccagcgccgccgacccgcccgcccgcgcccggaactcgtaccgctgcacggagccgacgcggacggcgccggcgtcgagcggccagaccctgacctcggcgtccggatcccagtcgtacttctccgagacggcgtcgatgacctcctcgaggaaggtgggctccggggccaggtcctccagctccgggtcggcggaggtggaggcggagccgttggaggaggcggtgaggaaggaaagcgaggcgcaggcggacggcgagggggcggagaggagcagcagcgcgaggaggagagagattggagggagggccagggaggaggaggccatggagggtcggaggattgaggaagggtaggtctcctggcgggttctcttccccgacgaagggatctcctcgcgaaggatgaggatggtggtggtggttggtgcgctcgtggtatacgccgtaagcacaggctgacgtgtgagcccggtgagcgagattgataaaatgctcgggtcgtctggcaggcttgtttggaagacaaacaagcccaaaacggcctttcgcgcagttgggccgagccgccgctggccttttgcagaagcagcgacaattgggaacgtgttatatagctgtacattgctgattgggaccatgtctcctcggtgcgtgcactgactctcaacgcacgagagattggcaccgaaattcctcgacgcaaaagctccaacgtacacactaaggtcctgtttggaatcgtagtatttttgcagttttgaaacaatactatggtatttgatgatactatagtattggagctcaaaaggtgtttggtttgtatagtcaaaactcagttttaaatatcatggtttacgcaaaactgtggtatttttggagtttttgaaactccactcatgacctcggttttcttctcttctctctacatatactttgtttttccaatagaaccaaacagatctcggttttgaacaatactgtagttttactgtggtaaagcaataccgtagtatttttgtcatgtacaattgtaaactatggtatctcaaaactacagtatttcaaaactacattcccaaacaggccctaaggctctgtttggaatcgtagtatttttgcagttttgaaacaatactatggtatttgatgatactatagtatttgagctcaaaaggtgtttggtttgtatagtcaaaactcagttttaaataccatggtttacccaaaactgtggtatttttggagttttcgaaactccactcatgacctcggttttcttcttttctctctacatatactttgtttttccaatataaccaaacagatctcggttttgagcaatactgtagttttactatggtaaagcaataccgtagtatttttgacatgtacaattgtaaactatggtatctcaaaactacagtatttcaaaaatgcattcccaaacaggccctaagtggcaggaccatgaaaaagacaagattttcttaagcttaaattactgtagggagggcctacagtatttttattgcttagtcaaaataaaaaatagaaaaacaattacagggaagtaaactaaaaattacaatacatagcactgaatctaggtcctaattttatcccctatctctagtttgactcagtgacacagtagacgcaattctg

SEQ ID NO: 22929 - DNA, 2359 bp, Zea mays
aacttattagttttgtacccctacgtctcaaaatataagttattccaattttttcggaaagtcgaagcgttttcaagtttgactaaatttatttatacaagtcatagcatgtacgatatcaattatatatcattagattctccattaaatatatttttaaactatatctcataaatctttataattctcgcaatatttttgattaaactttaaaaatgatacttttgattaaactttaaaatttttggttctccaaaaatcttggaatgacttatattttaggatggagtgagtattttttttttctccacctcaaaaatatataaacaactttgtgagatttcaaatttgtcttaaataaaactaaaaacttgggatgtgttttaatgctggataaccgcctaatggaatcgattctctagaaatcaaaatggaaaggaaaaggaaaaggaatggagatataactgccaaaattgctaaaaaaacaagatgaggatagttgacattctctagaaagaaaagaaaatgaggacgattattttagaatggacggagtattttactgttctgaaacgggcagtcgttgagctgatggccaggagtaccataaaaaatgcagataatgcagtaaagattaaaataatacgggttgaaaaatcaacaatacatgcacggctataaaatttaacaagaaggcatatgtactcagaagatgcgtgccgcgcccccccgcctgtgcttgttttttttttttttttttgaacaatgtaagattgtacccctgcattgctagatgcaatacaaaatttgaacattatgttacaacccatttcacgttcaggcacacttccagcctaagtatacatgaaatcgatgtatatgtgtaatttcctatcagccctacgagaagtagatgacagcagaatctattaccactttacatccagcgacagcggttctggtggcaaaatgaatgacagaaactttgtgaaggaaatatttgaagtcaggctgccccaagtagtggtgtccactactggaaattgcctcctaaccttcttcaccgaaatagccttcagcctatcgtcatcttccactctagctataatgtcaactggaactcgctggaccatgggtctcgttttccactctggaacatcttcccagatgggatcatcctcagtgacatccctttcaaactccaaacggaatttcaccagaggtatcgatgtcactttagcttcaatgaagtgcactgaactattctcctggtttcttttgctaaaccaagtcttcaagatcttttcaagctttatcagtcttgggctaattgaggagaacaaaaattctgagatcaaccgatttgatatatggactttatacttgtctgacaataactctatagtgtcatgtgaccttaagaaagtcttcacatggcctccagatacacttgtttgatgcacaacaattacgactgatcctacaatacccacttgaagtaatggggcacaggttgagtagctcaaaggccatatttggcttaggtcgttgttactagccaacaaacttccatttgatagaagacctatactgtgagggtgggttacagaaactttctgtgcaccaatgacctttaatgcaatgccatccgcaacaaatatcctcttaagccttgtgtatgtggcattccccgaaggtaactggagctcgacgaggctaccgtcctggttgccagcaagcttgagctccaccggcccaaccagctccacgtccctgacgccggtgtcgaacccgaacgcgccttcggcggggacgacgtcgaccccgtccggcccatccacctcctcgacggccggcgcggaggggagtctccactccacggcctcgtcggagaaccgcgccagcgccgccgacccgcccgcccgcgcccggaactcgtaccgctgcacggagccgacgcggacggcgccggcgtcgagcggccagaccctgacctcggcgtccggatcccagtcgtacttctccgagacggcgtcgatgacctcctcgaggaaggtgggctccggggccaggtcctccagctccgggtcggcggaggtggaggcggagccgttggaggaggcggtgaggaaggaaagcgaggcgcaggcggacggcgagggggcggagaggagcagcagcgcgaggaggagagagattggagggagggccagggaggaggaggccatggagggtcggaggattgaggaagggtaggtctcctggcgggttctcttccccgacgaagggatctcctcgcgaaggatgaggatggtggtggtggttggtgcgctcgtggtatacgccgtaagcacttttt

SEQ ID NO: 22930 - DNA, 666 bp, Zea mays
tttttttttttttttttgatgacataattcgttcatatatcatttcgctaatcgcagcaaatagctatagagctatatccttttcctccactaacatttgtgtgtccctgttcctgctatgttacagtgctactctcgcagctcataaaccctcgaccataaacgccttgcatatcgtgtttgcttgtaaagaaaataaactttgaaaataggccatgtcgtcatataaaaatgaacctttttaggcaccagtacgccgtagataatgtgttccatgagagaagtgtgataatgagatgaagcctggcttagaaggggctggggttgcttcgccaccattgacgtcgcgattgatgtcacgccccaacagccaaggcagaacgacaaaaaaaatgagaagtagaactcatggtgagagtggagttctagaattgtcgtattctcgtcatgatttatgagtagttggggcttgtgtggccgtttgtcatgccagacgaacgggcgcgctgagccgtagcgttggttgggggtgggctagcaccggaagcctccatctgacgctttgtgtggtcgtgcatgaagcgggaatagcttgagaggtttgtaggaggagggggagacatggacatggagacggagccgtagtctgatcgagcaggcatgatg

SEQ ID NO: 22931 - DNA, 779 bp, Zea mays
ggaattcgcggccgcgtcgaccagaaagtcagaaatggatgctaattcagttaagcccaactctatggatataaaccatttgcaagcaaagacacctaaaaggttgataacaaaagtttcctctgaagttactgaaattgaagggccagaaggtattgaaaagacaaaatctgtcccagtaaagttcaaagtaggggcacctgataaatccttggagaggaacatgtcagtctctgtttcactcgtttctgataaacgcgtcatggatgttacagacagtagatctactggaaaggtaaacaagatagtgatacctaataagctgaagtctgatgatttccctcctgacactccaaagccatctgttgtatttcggcctcctgctgaggaaaaggatgtacctcgcaaaaagatcaccatcaagcagcctaaaggcatagaccagcaaagacatgttgaatctaggagtgttcaggaacccaccagaaagacaagaaaaattgtagaattgtcgagttttgaggataaaagtagagaggatgatcattgggttggtggggaacccagccaggtgaattcctcacatgggaggaggctgggtctggaagggaaaataagcaaagccacaatggaaaatgaaagatcctggagagattttgaggagcgaagagaaatgccacaagcaaggctctttgatgctacgatatatgcatcaagggaggaagatcatctaaaggcaaaaaaaaaaaaaaagaaaaagaaaaaacatgaattcaaag

SEQ ID NO: 22932 - DNA, 2248 bp, Zea mays
  misc_feature (15)..(15): n is a, c, g, or t
ctgtttccgatccancgacgcatggagacaagtcagtgcagcgccactacacaattccaattggctccatttattttctagcgaagtagaaaatatcatcaaagcctggaagctatccaagcacaaatatagataaatatcggcacaagttatgtgtgcagcttccagatgctgtgctgctcttgctgccacacaccgagccaaatgactgatcgaggttacaaaaaaacatgatcattcaacagttgtgaaaaacggtacggcctgtgcaaacccctgctgcatattgcaaatgcgcctgaacaaacccttgtatattagcatatatccttttgaaactgccaccacctccaagcagtcgtcagaattgctcgttccagtgccttacatattacaacaaccaattattctcctgtcttaaaatccattccaggacaaaactacagtccataacacatactctgcttctgattttactgccgaacagatccaccgaatctcgtgtcatttgtgacaaatgtggggcatattacaaaaaaagaaatggccaccgaccacaacctgaactcattatgcgtatttgtacgaactccctcataaaatacatgagagaaaactaatctagcacactatgttcattaggtttgggctaaatctacccactgccaaaccttgagctcaccagttccatccccggtaaaaaataaaccaccaggacccatctgtattgccctaatttcttttttggagaataatctgcctctgtcactgaacgatggcagatcatataagcggacagtgttgtcatttaatgaacacagtagcacaggttttgactgtgcgtcaggcataccactgagggcaagtgcaccctgatcctctttgtgtgtatatgttacttctaagtttccactctctgtagcggcccaaactcaacaaaatgatgatgtagatggcgaataacttttattgtttgatccaaagagcaagataatagaaattgatcccagcaaagcacggacataacaacatcggtatgatcagaaagagtctgtatgcactgcaaagttgccaaatcccatactctgatagttttatccattgaagcagaataaagcctcatgcctcctactatcaatgaaacaacagcaagcttatggccatctagagaagcagctggctcaaaacagttagttgcggcactaaatctccatgctaaaatcctcccagcttgtgttgcagcaaagagtaactcactggcaacggcgagtgcatagacttgcccagttggtccagtaaggctcatttccgctgctgtttgcatattccaaaccttcactgcatcaggtattccaacaaataaccacggaccttcaatgatcatacacccaacctcacgacccatggtgatgacaccagcacactgcccagtttggcaatcccacatgcgaacagttccatccttactcccggaataaagcttgtctgacccagcgggcagtgcaatgcccgtgacaccctgctcgtgtcccttgagcaaggtaagcatcgcgatactatcgcttatgcagtagctgtgcggatagcggcacctctcgccatagctacattcggtaccggcgagaaagtacttgcagggcctctcaggcggcttgtggctcgcaatcccgctgccccctcctgggcccttcccccatctattgtgatggccacctcctcgtcctccggtgttggggttgcgccatacgttccccccgggtccagtggggcgcttgggcggcgcagcctcggggagctcgctgtggaggaaggggcacggaaagcggttgcaccgaccggcacgccagtagttgcagacctttccgttggtagatggtggagcgccgccggagcccgggcctaggcgattgtgcactcgtttgttgccgaatcgtccgtcggcctctatgtccatgggtggcggcggctagggtttgctgggctcgggagaagataagcaaacaggtaatatggtgaacgcaaccttggtgcgtgcggcggcgggtaagccggatagatagattgatatgagaagtagtcggtcgcgtggaggcgacgcggcgatggctcgccggagcgggtggggagatccggatcggagaggaaaggagcggtggcctggttgctgggtcgggtttagctaacgcggtcgcgggcagaagggagggcccgacgtcggccccccgctgcccccgcgttgaactgtctc

SEQ ID NO: 22933 - DNA, 2098 bp, Zea mays
ttttttttttgaacaaacccttgtatattagcatatatccttttgaaactgccaccacctccaagcagtcgtcagaattgctcgttccagtgccttacatattacaacaaccaattattctcctgtcttaaaatccattccaggacaaaactacagtccataacacatactctgcttctgattttactgccgaacagatccaccgaatctcgtgtcatttgtgacaaatgtggggcatattacaaaaaaagaactggccaccgaccgcaaccccggcccgcccggcgtctgtcgctgcctgctctgcttgctgcgccactccaaacccaacccaaaacccccacacgagatctgcgcagcaatggcgacgcggtgccacgtcctgctcctcctcgccgccgccttcgcgtccctcctcgcgctcgtggccgcggaagggggcgaagaggggccccgcgggcgccggctgctcgtcctcctggacgacctggccgtgcggtcgtcgcactcggccttcttcggctcgctccaggcgcgtgggttcgatctcgacttccgcctcgctgacgatccaaagctctcgctccaccgctacggccagtacctctacgacggcctcgtgctcttcgccccctccacaccacgttttggtggatcagtggaccagaacgcagtcctcgaatttattgatgctgggcatgacatgatcctggcggcagattcctctgcctctgatctcattcgtggcattgcaacagagtgtggggttgattttgatgaggatccagaggcaatggttattgaccatatgaactatgccgtcacagatgttgaaggtgatcacaccttgattgctggtgacgatcttatccattcggatgtgatactagggtctgaaaagattgaggctcctgtattgtttcgaggaattggacacatggctaatccatcaaacagtttggttctgaaggttctatcagcctctccatcagcatattcagctaatccaaagactaagttagcgtctcctccatcgctcactgggtcagctatatcattggtttcggttatgcaggcaagaaataatgctcgggtgctgttatctggatcactcgatctgtttagcaaccggttcctgaagtctggtgttcaaaaggctgatagcaaaacaagatatgagagagctggaaacgagcaatttgtggcagagataagcaaatgggttttccatgagaggggacatctaaaggctgttaatgttaggcatcacaaggttggggagaccaatgaaccaggcatgtaccgcattaatgatgacctggaatactctgttgagatctatgaatggtccggaacaagctggaagccgtatgttgctgatgatgtgcagcttcaatttttcatgatgagcccttacgttctgaaaactatgtcgactgacaacaagggtttgtattcaacaaccttcaaagttccagatgtttatggagttttccagttcaaagttgagtaccaaagactgggatatactggtctgtcttttacaaagcagattccagtacgtccttacagacataatgagtatgagagattcataacatcagcgtacccatactacaccgcctcattttcaacaatgggtgctttcttcgtattctcgtttgtgtacctgtaccacaaataaaggactcatgggagcgcacaagtctctggaggctgacgtgaccaagatctgtgggcactgaatgttgtgctataagccaagagttacccggcgccaattttatggaaccatgtttttgtactgccaacttagataacatttgacgaccgtgaccgcactcatgggaaatttactcgtgctaggatgttcgatctgcccccacttcttttttttctttcttggaccctttctgatcagcacttgtcagaacgtttacagtctatagcactgaaacgtgattttggaagtactacacccccagtaattttgcactcgtgcccagttctgatttctgatcctgggtgtggacttcaaagtctgcctattatacttccgcaaaaaaaaaaaaaaaaaaaaaaaaaaaaaaaaaaaaaa

SEQ ID NO: 22934 - DNA, 1781 bp, Zea mays
attcgatctccaatcggacggcctagacggctcccttcctctccttgccacacttgcgctcctcttcgagactccgagttgtcgtctccgtcgctgctggctgctgcgccactcccccagccccgagatctgctcaacaatggcgacgcggcgccacatcctcctcctcgccgctgccttcgtgtcccttctcgcgctcgaggctgtggagggcctcgaagaggggccccgcgggcgccggctgctggtcctgctggacgacctggccgtgcggtcgtcgcactcggccttcttcggctcgctccaggcgcgcgggttcgatctcgaattccgcctcgccgacgaccccaagctctcgctgcaccgctacggccagtacctctacgatggcctcgtgctgttcgccccctccaccccacgttttggtggatcagtggaccagaacgcagtccttgaatttattgatgctgggcatgatatgatcctggcggcagattcctctgcctctgatcttattcgtggcattgcgacagagtgtggggttgattttgatgaggatccagaggcaatggttattgaccacattaactatgccgctatggatgttgaaggcgatcacaccttgattgttggtgatgatcttattcaatcagatgtcatactggggtctaaaaagattgaggctcctgtattatttcgtggaattggacacacggctaatccatcaaacagtttggttctgaaagtcctatctgcctctccatcagcatactcagctaacccaaagactaagttatcgttgcctccatcgcttactgggtcagctatatcactggtttcggttatgcaggcaagaaataatgctcgggtgctgctatctggatcacttgatctttttagcaaccggttcctgaagtctggtgttcaaaaggctggtagcaaaacgagatacgagagagctggaaatgagcaatttgtgacagagacaagcaaatgggtcttccatgagagggggcaccttaaggctgttaatgttaagcaccacaaggttggggagaccaatgaaccaggcatgtaccgcattaacgatgacctggaatactctgttgagatctatgaatggtctggaacaagctggaagccatatgttgctgatgatgtgcaactccagtttttcatgatgagtccttatgttctgaaaactatgtcgaatgacaacaagggtttatactcaacatccttcaaagttcctgatgtctacggagttttccagttcaaagttgagtaccagaggctgggatatactggtttgtcttttacaaagcagattccagtgcgcccttacaggcataacgagtatgagaggttcataacatcagcgtacccatactacactgcctcattttcaacgatgtgtgctttcttcatattctcgcttgtgtacctgtaccacaaataaaggactcacgggagcgcacaagtttctggaggctgctgatgcgacctagatctgtggccaagtgttacccggtgcaattttatggaatcatatatttgtagtaggccaacttagctagaattagacgaccgtgaccgcaatcatgggaaatttactcgtgctagtaggatgttcgatctgccccacaatttttttttgttcggatccttctgatcagcacttgtgaaaacgtttacagtctgtagcattgaaaggatgacgaagcatgtagtgattttgaaactaaaaaaaaaaatcaaaacgcactcgtgccccggaattt

SEQ ID NO: 22935 - DNA, 1541 bp, Zea mays
tgccttaaaaggtgtttgtttgaaaaatcaatctattctagaaacagtgcatcataaattcattccacaaatttaatgaaataaactcattcctcgtaatattactagttattagactataagaaataaaatggtgattaattaactcattcctcaaaccaaacacgctaagtttttcactcaaccattttgtgtacagctaagtgcaagatgtttgtaaatactccctctattttaaattgcaaattatttttaacattatttttacttgcacctagatatagaagctacatctagatctatgattgctccttttttttttttttttatcagatcttataatttagaatggaaggagtgctttatagcaacagcaaactttgacgatctacaatccaaccatgattttttactagatacaaccaaaccatgctgataaagaacttgcgacatacaatatagtcttcagtttcagcactcagaattatgaccagcaggcaaaagtccaatgaaaacctgttaaccttttggcacgctaccagtagtacaggagcacgagcactaaacgaggaaatgtgctaacaaagttgaagatacgaatgttgtgagttctcgttccagaggaacttccggacaagcatgaggccagacgaaagacgacgagcaaaatggctctgcatcatgtgacaaaacgtagcggttgctgcttacgtaccaaggcctggtgcttctgccccgcaatatggaactcgtacactttttggctgttcactacaacattgcacacttggcagatttttacttcgccctgcgctgctccagcctcaaggactcgcctcttcttcacctccagatcttcccgggttgctgctgagctgctcttcttcttcggctgtacagagggcaccacacagttggatacagcaacaggtggcatacttggaccgatgacattgcttgggggctttataattggtttacgggtgattgagtcttgtaatttctccaaatttttcttgtgcttctttccctgcttatggctcaggagaacttctagtgtatcacactgaatcttgcacacctcacatggcgctggttgcacagtcttcggctttttcttcatttgtttcctcaagacatatttcggcacaggatacccaaaatgagcattccactgggcatggtgcaagcctggggctgcagctggttgtgtaattccattggaggctctggcaactgctgcctacagaaagattgtttgtacctggttaataacaaggatcaagacagaagaaaccatgtaaccagtacatggcattaagtataaccaatctaaacagtacaattgtacacatgacgtggtttacatgcagttgtacaacatatatcacagggtgaccaaacagtaataaatacaaataaaatcagggaacaaaatgaggttgtagaactcgtgaaggtcatagagcttcatgcacagaaaattgaaacaaacttacaggtaaaaatcaataagggcttgttcggttagctctcaattc

SEQ ID NO: 22936 - DNA, 1319 bp, Zea mays
  misc_feature (1310)..(1310): n is a, c, g, or t
ctcgtgccgttttttttttttttttttggctttatacttcagttcttttgatttagtcatgatttatattcagaatttgatttaaaaatgtctaatatttcaacacttagaagaagaaaaaaaacatcttgaactttaggtcggtgataacacaaaaagaggaccctttagctagaaataatgcatctgttcgcttggcttgttgaaaaaaaaacaacgttggattaaaaccaggggcgttgttgactgctgtgtgctgtgctatagactcaagcgagttacgatgaccgttcaccaagggatttcttggccatcccacgcgaagaacttgccgttgtcgcctttcttgacgctgtcgatgacggagagaagcctctgcacagagaactccctcgtgaagagtttaccctcggggacattcctctgaaacggcctcgagaggtcggtgtccacggttccaggatgcagcaggacgcaggcgatgttgtccttcctgccgaactccaccgacactgtcttggtcaactgattcagcgctgttttagaagctctgtacgcatgccagccacccagagcgttgtctcctatggagctgactcgagcgctcatgtttgcaacaagcgcgaaccctctcctagtctcggagcggcctccgatcttcagcagaggccacatgtgcttgatcactaggatagggccgactgcgttcacctcgtatgccagcatcagggacgacttctgaaccttgcttagcgtagtctctggctgtatcacgttcgggatcgagaggatgccggcggagttgatcagaaggtcaagagaaccgtgggtctccgtgattgaggccgcagctgcctctatggtgctctcgtcggtgacgtcgagcggcagcacggtgaggcgcccgggcgcgtgctcctccctgagcttctggagctcggccgcggaacccggcgtgcggcacgtagcgacgacgcggcctccatcgcttctgcgcagcagctgccgcacgaactcgaggccgatcccccgggacgccccctgcaccaaggacacgccgccgccggaggccgcagcggagaacgccctcgcggccaccgccagcctcgccatcgctccccttctcaccggcggattcggcctcgacccctcttcttccttctcctccgccctcccttccacggattcacatcgatcttcgatgcgaattatgcaatgcggcaggattggattgaaacctcgggcgcagtgcagtgcagttggatggatggaccgggaagtaatggtggcgcccgcccgtgctcggctcncccggccgg

SEQ ID NO: 22937 - DNA, 671 bp, Zea mays
  misc_feature (41)..(41): n is a, c, g, or t
  misc_feature (227)..(227): n is a, c, g, or t
  misc_feature (229)..(229): n is a, c, g, or t
ttttttttttttttttggaggatggtaaaccgggttttcanaagttcggagaggctcatgttgtactataacgatgatgcaagccacgctgacgctgtcacttattagtggggcatgctttactctgcgacagtgccataccatgtaagtacaatacactctgctgcaatttcaacgaacatggttgcagttattgtcgaccctatagcactaagtttttttttcananatggccgtccgtctccggaagcgaaggagggtcctcgagtcgtgtgaccttcagcacgcctgggacttttgacagccgacgggcctggttgttggtgatgagcgcgctgaataccccgagctcactgtcgtacgttgctctccgcgctgcttcgacgctgccgagcactttggcgagcaggcggtagttgtagtcgagctcgtccacgccgtcgtccgggaagcggaccgtggcctcgaacaggtggatctcctggcctctccgcttcggcgccgggccgacggccgcggcgacgacggcgagcgccaccaggacggcagcaacgaccggggacgttctgccgcaggtcgtcttcatgttttttttcccccgcagttagcacgggttgaaggcttgcagcgacgactgaagattttttttttttttggggctcggttggggt

SEQ ID NO: 22938 - DNA, 1077 bp, Zea mays
  misc_feature (126)..(126): n is a, c, g, or t
  misc_feature (882)..(885): n is a, c, g, or t
aaagctgcttggagaggatgaatatgaacgttgtgagggattattgcttcagagaacccttgatgcgatgaaagatgttgtctactgtccaagatgtcaaactgcttgcttggaggacgtaggtanatgaagcagtatgttcaagttgtttgttcagcttttgcactctctgtagaaatcgccgccatattggagagcaatgtatgtctccagaagagagacttatgatcttggagaaacgccaagaatctgggaatgtgcaaggagatcagatgaaagttctacaggaactacgcagcctgaaggaaattatgaaggattcaaaacagtgcccaaaatgcaggatggccatatctaagacagaaggatgcaataagatgcattgtgagaactgtggggagtacttctgctatcaatgcaaccgtgcgatcactggatatgagcatttcaggggttcgtgtgtgcttttccctcaagaggaattggacagatgggaaatgcaaatgaatcaaagggtcggacgccaaattgttgcacatgctcatgctgcaatacatgggcagaatggtcaagctcatccttgccctacatgtcggcaaccgtctccaaagatcggaaacaacaaccacctcttctgttgggcatgccagaagcatttttgtgccctgtgtcataaggctgtccaaaagcccgcacagcattatggccccaaaggatgcaagcaacatacggcagatccctaaatgaggttttcacacatgtgcatcaaccccgtggtgccagtgcagtttccatgtgttctgtgcaagtacagataaatacttgtcctgggacgtacttcactcctggattccattttttttttttttttgctgcgagaannnngtttccgtcgtcgttgtacctacagtaacagttttgcagtttacattcgggaacatgaacaggaactgttcattcattcgttgaataccagatgaattgttgagaatactcgcatattgaagacacgattgaacaccaagtccaaaaccgatagaaccttgtaaaattttaaaagggaagattatttgttgt

SEQ ID NO: 22939 - DNA, 1302 bp, Zea mays
ttcctaccacgcgtcccttctttcgtttcctcgaccatttctttttttcagtcacattgttcaatagacatacattttattaaatatgcagggcatcgtagaagagaatggttctcccttccaaaaagcaaaacaaaagaaactcgtatagtcgatcgacgaccatgcatcacatttccttttcctcgatcttctcttatttccgcggaaaacaacgaaggaaacccaaccaaggaaacgcatgctattgcttaagcatcgccggaggagctggtcgatcgctcgctcactcacgggcctgattgttccggtcacctgtcgtcgtcgtcgagctgagacacgctcctccagaagcccgtgccgtagaacctggcccacacctccttctcaagctcccccgtctcctccagctgcaaggcgggcttcaccggcagcgccaccgcctcgacggcgctggcgtccaccttgacgacgacgccggcgttgtccaccgggagctcgtagatctccgtggcctgccccacggaggcggagcgccgccgcccgcccttgctcacgcgggccgccttgcggcacagcgccgcgggcgcgcgcaccgtggcgagcaccacgacctccaccatgacacaggggaagcagcagcacacggccgcacagcccgccgcggtgccgccggccacctcgctgcaggtgcggtgctgccggatgttgatgtcgctgtcacaacgctgaggagggcgacgccctggccccgggcggcgcggtgggaacgccgctgaccgccgcatctggtgatgccctttcgagacctgcaccggagcctgcgaacggtggcgtggggcgtcgccggccctcgccgccgccacggccacggaggtcgtcgggcacgacgcctcggagcggcagtgctggtgggcgtgggccctgttggaccggacggccgccatggcgagctctggatggccctcgacggcgcggcgcccgcccaaggtggatgggtgggaggccgcggaaggcagacgtgggcggaggagccatcgccgccgattaattataataatgaggttgttgcgggggctcgccgtggcctactgcggcgaaaccggtaggccactacccaattttggccggtgattgatgattagaaacgggcaaacggccgggcaccgagcccagcttcacctagtggcacatgctgacatgctgtttggtttgttgcatgaagcgtcacaaggtatctaactttttttttaaaagattagttcttcaatttaagcaactactaaagtaggctccaaatta

SEQ ID NO: 22940 - DNA, 1146 bp, Zea mays
  misc_feature (765)..(765): n is a, c, g, or t
ctgccatgtactgaagaagagaatgaatttgtgtttcactgttccaatcacaagaattggtccagaccatacgaggtcagtacctcgaagcttatcgagcgtaattcatgtgtgtttcaatctgcaactttacagatatcatgcaccttcttgcctactttacaaactacacgactgaacttgcatcgaacattacatttttgcaatgagctcatactgctctgatatttttcaatgtcctttagtgcctgctttagtttgccgctgacatcacccaatgcccacaccaacgatatatgtggccgtggattcgtgtaaaattcaggaagaccatgcaatcgatacacttcatctaccataagtatctgcctcgttatctctggcaaaccagttcttgtaacttctagtgaaacaaatgaccgtgtacaatcatcattgacaaagtgctcccatttattgaactccatccagtactgttgttgtggctggaacttctggcgaagcattgcaataaatgagtcaatctgatgcacctgaactgcaacaggtcttcccaagcttacatgaaactccctgctcagaagcactttctcaagcttctgttcatctttgcacaattcagaaagtgcatagtctgcatcaacggcatagagatccggcacaagagatgcagctcttttcatagaaagagccagttgtttccttgcatcagaaggtatgacgacagggatataaacatgtacagcatagttgccttccacatgnggggaagctccgcccacgcgtcccccctgcgccatcgccgagtaatctacgaagttggggggctggaggaggtcgaggggaggaggtgggagcaaggccgaaggttccgggacctccggggcgcctccagagacggaagcaggctcgccgcgcgtcagagtcggtgtcggacgcgtagctcgccatgagcgcgtccatcggttccttctcccgttggaccccagccggtggggacgtgggtcgacgacgcggccgcgtgagaagtcggcggcgagcgccgcgctcgacggctagtgctgcagcgggcggcgctagcgaagtggcccggtgggaggcacgggggcgcaggcggagagtagcggcgctggcgtggagagtggt

SEQ ID NO: 22941 - DNA, 844 bp, Zea mays
gagagaaaaaagatattttttttttttttttaatcagcgtgaaccgacagatccggctcattgcttactctattcagatcagacaccgacgaaaacgttttaggatcaggcaagtagaagggaggtcgtaagagatagtagcaggcaatgcagccaaacaccttttttttttcaggctaccaaaggaaacgaattcaggctatagacgaaggaacgccctggttcgccagaacaaaaggattacatgagttggagcaggatggatattacagttgagtagaaattattggtggatcgaaagatgatgtgaggaaccaatgcctgtcctgctctgctcccctccccccaagaacttgaagctcccctgcacacatgctgaagctgatccgaaacctgttggttggatccagaagctcctgtcccgcacgaggagggccaggcagcggcagcggcacagcgaggaggcgcgagcgctgactgaggggtcagcagcacgggtagacggcgacgcagcgcctcctgggcggcgcgcagaggagcatgaacaccagcgcgatgatggcggcgaccagcagccccaggaggttgaacccggcctcctcctccgcctcgttgctgcagcacagcttgcccatctacccaaccctcaggcagctggtacctggctgcttggctgtacgtgactgctgctgcactcactcggaatttcgttatgatccttggctttgaaggcattgcaggggagggaggggggtaggcagtggttggggcatcgctatcgcgcctccctcccatcatccccatccccccttggttgttaatgggtcctaggcagcttgggcca

SEQ ID NO: 22942 - DNA, 1116 bp, Zea mays
gataaatggtttttttttttttttttttatggaaatgtgatcaacgagaacaaatgtaatttgtggataaaaaacccgcagaagcattgctcccagtagcatgagccttcttgcacaccttatcagaactgcaaacaaacattacacgcatccaagggtctccttatgccaataccaggtaaacggatgtataatcagctgggcaggcgtcggtcgggtcgccgccgcctcatgccctggccccgtccccgccgatcgaggggatgattcaccgcgcgacgccggggatgttgacccaggtcaggcgcaggacgaggtcgccggtctcggtgtccctgagcctgagcaggatgtcctgggagaccttgccgtccttgcacgtgatgtggctgtcggtggcgaggcagctgcccttctccgtgtggatcgtcttcatcaccgtgccgtcggggacgtcgctcaggtcctgcttggcgatctccacgaagttgaggatggagaactcggcgttgcccatgctgtcgtccttggtgaacgtgtcatggtcgaagagttcaatcttgaccgggttcatcatgtttgtgatggacagggtgagttcctcgttccattccggattgatcgtgcggtattttatacttgacttgactttctgctgtccgtggcggaggacgacgtaggggtcgctgctgtgggtgagggggtcgcagatggccaggtgcactcctcgcaccaccctaaccttgagcagccccagcaggcactccatctccctcgatctcctcctctgtgtccccgaccacggcgacgcatgcagcaggacgacccagcagaagggcctgaccgtcaacggatcggaggacgtacgtccgacaagcccggccgcgtcaacaacgggagatgtcataaaagttttgcttgcccggcctggcttggcccccggcccggagctagggagggaggcaagagtatgcagaggctggacgacaaacgcggggagcggccggctctacgcatgctcaaatacatgcggctcccaaactgtctcgtcgctgtctgtgtcgccttttctattctatatacctagtccataattaataagctcatcccggccgg

SEQ ID NO: 22943 - DNA, 981 bp, Zea mays
atggtatagcttcacagatgttgagaacaagggccggttcccgtataaacaaaagctgagcacaggcattgctcccagtcccagtagccggagctaagctaactgcaaacaagccagacacgcatgcaagggtctccttgtttgccaatacctggtaaacgtacggagccacatttacagacttcatatcgtataatcgtatatatttagtgtagtaaaaccagctgggcaggcgtcgccgcctcatgcagcaggggattcacatcgcgacgcctgggatgttgacccaggtgaggtgcaggacgagctctccggtctcggtgtccctgagcttgagcaccatgtcctgggagaccttgccgtccttccacgtgatgtggctctcggtggcgaggcagctgcccttctccgggcggatcgtctttatcaccgtgccgtcggggacgtcgctcaggtcctgcttcgcgatctccacgaagttgaggatgcagaactcggcgttgcccatgctgtcgtccttggtgaacgtgtcgtggtcgaagagtccaatcttgaccgggttcatcatgttcgtgatggacagggtgagctcctcgttccattctgggttgatcgtgcggtattttatacttgatttcactttctgctttccgtggcggaggacgacgtaggggtcgctgctgtgggtgagcgggtcgcagattgccaggtgcactcctcgcaccacccgcaccttgagcagccccagcaggcactccatctccgtctacctctctctctctctctctctctcgctctgctctgtctccagaacaccgagcaaaagctagagggcctgaccgtcaacggattggaggacgtacgacaagcccggccggccggagacagccagacacacaagctttgtgctccggcttggccggccgcacggagctaggccgggagatcgaatcacggcccggccggcctcgagggacccaa

SEQ ID NO: 22944 - DNA, 1586 bp, Zea mays
attttatttattagtgggttgagttgggtccaaggtttttatcgtcacgcgtcatcacaagcatactccatccagtacaatactgttggtctagccggcggcggccgcgtccctcatccagtcatcccctttccgcgatcaaaaccgagctagggttttaggtgcgggggagagggtgaggagcggacggaggcgcgccatggacaaccccgagatgcagcggttccttcagcaagagcagcaaaaggcgatgatgaacgagatggttggcaagctaacgagcgtgtgctgggacaagtgcatcactagcgctcccgggagcaagttcagttccggggaatcaacctgcctgaccaactgcgcccagaggtttctcgacatgagcgtgatgattgccaaacgctttgagatgaagtgaggcgtcgacgccgaaagctgttacctagtcaatcaccctgagttttttaaccctttgatttgaggttccattgagcacttcgaacgattcaacagagtttaatgtactttctatattgtatctactgcctcgttgggcaacgtgttgaagtgtgatttgagccggttgaaactggattatgtacactttctgtcctgagtttaactaaagtttagcccgtgtcacgaaaaaaaaaaaaatatcaatcacgggttaaatatagtattaattacgtttcataaatttgtctagtttggtcttcgtttatataattagttctataattatactatactaggtcagtacccgtgcattacaacgggaacatataataccatgataacttatatacaaaatctgtgttatattgttataaaaaaatatttcataatcaatttgtgatcctagccatacataaattttgttattttaatctagttatttcaccactacattgcaactatcagtatcatgcagacttcgatatatgccacgatttgtatggtctcatcattagagagcacgagcacgttccacacatgccggaaaaattccctcgtacatctttagtcatcagacatgcaccaccatatgctcttgcttaaacaaaaaggtaagtgtgtatgtgtttgcgaagagaattaaagacaggccggcacaaaagctaccctgacggtggcgaggatgacgaactggtcactgttgtcgatcctcctctgtgtcacctctgtcgccaagatgacgccacaatcctcgatatagtagtcgtcgaacgcacgcgacatgacgagtaccgatgactcttggttgggctgccaaacgaagtgcaccccgggctcatcagcgaggtagtacccctggccgttgcaccaccgaatgcgctattccactacatacatcatgttcgaggacactcacacaacgtcagcaacgtccatcgtcccagcgcacaagaattcatgtccggtcagtagcgacttacgtggcaggttgggcttcaggtggacgatgagctagacggcgtgatggcgtcgttgtcggatgcggtgtccagaacaacccgagagtcgtcgacgttggcgacaaccatgaggccccctgcttaacgatggacagtgtagtgcagggg

SEQ ID NO: 22945 - DNA, 784 bp, Zea mays
ataaggataaaaaaaaaagattgtcccaatacttgtaccagccggcggcggccgcataaaaattcccacatcctcttctgcaatcaaaaaaccgagctagggttttagggggagacagagaagcagacggaggctccatggacaaccccgagatgcagcgattcattcagaaagagcagcagaaggcgatgatgaacgagatggtcggcaagctaacgagcgcgtgctgggacaaatgcatcaccagcgctcccgggagcaagttcagctccggggaatcaacctgcctgaccaactgcgctcagaggttcctcgacttgagcgtgctgattgccaaacgcttcgagatgcagtgaggcgtcgtcactcgaagctgttgcctggtcaatcgccctaagcttttcctttgatttgaggttccattgaggactttcggacgattcaacacagagtttagtgtttttttttatgtcttacccactgccctgtttaggcaacgtgttaaagtgtgtttgagcctattgaaattggatttgtacacctcctgctcttaaacaagatctctcatggcatacctgtcagcatcctaggtacttcgatttatttcagtatggtgagctcggatatcaggcgaaggagatctatgagatgtaagatatagtttcgcccactggtactatttttccattgccagataaaattgtcatcgtcaaggaataaacagtggagaccattctcctcgacgggtgcgactttgagcacgggctcgtcgtcatggagttgt

SEQ ID NO: 22946 - DNA, 2521 bp, Zea mays
  misc_feature (1306)..(1306): n is a, c, g, or t
  misc_feature (1598)..(1598): n is a, c, g, or t
aagtgtgagtattattagtttgtacgtataagcaaactagctgtggacctagtttctcaagtttatgagggcttagctgtggcagtcatgcaaagtttagatgtcaactgtgaaatttgctacctgtcctccatgtagttttgcataatttggtttatagtgataaatgtgttaactaaaatacttaactaaagtaaatgcttatcatgtgttacctaagtaggggatgtcctaatcagtcacttcagctcttagaggataatcttagaccttcaatttaggtaatgctcaccattttgttgagctactgtttcagatcataaaacatatgctatattaatctttcaccttcttgacatcttgacctactcgctagcaatgtcacataatctcccattgtttgatgatggtatcccctgtttgcatttcttcaatctaaccttcttatccagatttgatttattcgagccagcatgcacatagtcgttaccatctgtgtgtgaaaattccttacctcaatgtctgcgattcactcagaaagagcagcagaaggcgatgatgaacgagatggtcggcaagctaacgagcgcgtgctgggacaaatgcatcaccagcgctcccgggagcaagttcagctccggggaatcaacctgcctgaccaactgcgctcagaggttcctcgacatgagcgtgctgattgccaaacgcttcgagatgcagtgaggcgtcgtcactcgaagctgttgcctggtcaatcgccctaagcttttcctttgatttgaggttccattgaggactttcggacgattcaacacagagtttagtgtttttttttatgtcttacccactgccctgtttaggcaacgtgttaaagtgtgtttgagcctattgaaattggatttgtacacctcctgctcttaaacaagatctctcatggcaaaaaaaaaaaaaaaaaacgcaagcccggttcagtttggtgagctcggatatcaggcgaaggagatctatgagatgtaagatatagtttcgcccactggtactattttccattgccagataaaattgtcatcgtcaaggaataaacagtggagaccattctcctcgacgggtgcgactttgagcacgggctcgtcgtcatggagttgtacatgctgattatttgcccctagaatgacaatcatttcctaccattaccatcaacatagtataccgagtgtagtagccacgagtagactaaaagaaaaatataaacttaccatattgtgaattaaaatttatttagagccatattttatattcatttttnaactaaaatttatttagggctctatcattttgtgtagaaacatttgggttacaatctattactacctgacccttatgtacacgactagaggtgacaatagactctaaattttatactataagatttaaggattggattagaatcggactatattttattttattttttaactaaaatttatttagagtcctaatattttataaaaaattatttagatcgcgatctattaccacccctgtgcgccacacgaccaccctattctagtccttcagtaagagatggtgcggagcgntagtatatataaatggaaccattgttgccgtctgattttcatgaaactgttgatgatggtatctgattcttgtatacgattgagatgtttggtcggataactgaatggttggttaacccatcttgtcgctggatgacatattctgctcaaatcaatgtgatatttggtgatccattcaatcaaaccagtcagttgtccgtgtgttacaacggcttacaacaatactactcatataaattatccaccaaaaaatttcaagattttttattgattgtctccgctctccatataatatattttttgatttagctaactgatgttattatttactccatccaatatgtcttggtacaacacgatccttgcaagagccaagaacgtcggcccgtagtactagtctaagccgacacgattatattttttattttacaaaaacatatatacatatataatttatatttaatattaaaaacatctgaatattatgttttactggttagacaactttacttattgtctttcgctcttcttccatcacagaaagacgtgaaagtgcatgtctagtggttattataagaccatcggtagcgctcgctctgggtcttaggtttaacgtcacgtccgtcgatttagcggcattgtgttttaagtggcagacaacgttatcatcgacaacgatcaacgagacagctacagtgactttgtcaatcttgaagatcaccgtgcaattcgccgaaaaaaaggaagtatatagaaaaggcagttacctactcaccagtatgctgatatttggtgattcattcatcaagtattactagatgagtgtccgtgcgttgcaacgggaacgtataataatacgataacttatgcacaaatgtatgttatattgttatgagaaaatgtttcgaaatccattgtgatcc

SEQ ID NO: 22947 - DNA, 510 bp, Zea mays
attataccctcgaaagctcgaaagatcccgcggcgcagcagccacccttctctcctctccgctcccaatctttgtcgtcgcctccctcgaagtcgccgctgccttcattccaccatggcgcttcacgccccggtcctcgtgatgaaggactcgctgaagcgggagtctggcgcgaaggttcacaaagccaacatccaggcggccaaggctgttgctgacatcattcgcactacattgggtcccagatccatgctgaaaatgcttctggacgctggacgctgatggccttttatttaataaatttgtaaattatatccaaccagttcatcagatcgtggccttttatttagatctaagaacaccaacacgcttaggcatttagttggatataattcatatgttgtacccaagaaagcagcacttaccgatgaactatatcttatcagtcgtgtaaacggaatgaaatataacaaaattgtttttattaaaaaaaaaaaaaaaaaatccgta

SEQ ID NO: 22948 - DNA, 2322 bp, Zea mays
tgcgtcccgcgccccccggcgcccggccggccggggaacacacaaaccgccgccgccgctaccttcaccactgcggactgcaccagctgcccgccgactactccgtttctcttcctagtacattgccgcgtcgaaggcgaggtcctcagcagcgccggcggactccgctcgcacgccatactcagcctactccgtcttcccctgtctagcagacaccctcttcccctctccactcccaatcttatcgtcgcctccctcgacgtcgctgctgcctccacttcaccatggcgcttcacgccccggtcctcgttctgaaggactcgctgaagcgggagtctggcgcgaaggttcaccaagccaacatccaggcggccaaggctgtcgctgacatcatacgcactacattgggtcccagatccatgctgaaaatgcttctggatgctagtggaggtattgtggttactaatgatggtaatgccattttgagggaaatagacattgcacaccctgctgccaagtctatgatcgaactaagtcgtacacaggatgaagaagttggtgatggcactacatctgtcattgttctagctggagagatgctacatgttgcacaggcattcatcgacaagaactaccatccaactgttatttgccgagcatataccaaagcgcttgatgatgctattgctgtacttgacaaaattgcaatggctgttgatgtgaatgatcgtggggcaatgctaggccttgtgaagagctccattggtacgaaattcactggccagtttggtgaccttattgctgaccttgctattgatgctactacaacagcaggtgttgaccttggtcagggtatgcgtgaagttgatatcaagaaatacattaaagttgaaaaggttcctggtggtcagttggaggattctagagtccttaaaggagttatgatcaataaggatgtcgtggctcctgggaaaatgaggagaaagatagtaaacccccgtatcatcctgttggactgccctgttgagtataagaaaggagaaaatcagaccaacgctgagttgatgaaggaagaagattggcaggttctgttagagatggaggaagaatacataaagaacctgtgcggtcaaattctaaaattcaagcctgatttagtcataactgagaaagggctcagtgatctcgctatccattatttgagcaaggctggggttagtgcaatccgtagacttaggaaaactgacaacaacaggattgctaaagcttgtggagcagttatagtgaacaggcctgaggagctccaagaatctgatgttggaacaagagctggcctgttcgaggttaagaagataggtgatgagttcttttcctttattgttgactgtaaagatcccaaggcatgtactgttctgttgaggggagcaagcaaggatgtattgaatgaagttgagagaaacctgcaggatgccatgtccgttgcaaggaacattttgaaaaatccaaaactccttcctggaggtggcgctacagagctgactgtatcagcaacactgaagcaaaagagttcttcagttgaaggtgtggaaaagtggccctatgaagctgctgctctagcatttgaggcaattccaaggactttggcccaaaattgcggtttgaatgttattaggataatgacacaacttcaaggaaagcatgctaatggtgaaaatgcgtgggttggcattgatggaaggactggtgatattgtcgatatgaaagagcgaaagatctgggattcctacagtgttaaagcacaaacgttcaagacagcaattgaggctgcttgcatgcttttgagaatcgatgacattgtcagcggtatcaagaagaagcaggctcctggagcctcagctccaaagcaaccccaaattgaaactgagggcgatgctgacaatgagcagatgattccagagtagaggctgtggcgaacctgcactggcaaagttatttactagtgtcaaggtagcacttcgagcagagttcattttggtggttagccttagcttaaagatgcaccttgttttatatagtttgatgagtggtacgagggttttgggatccaggttttgagtgtggttgctgctcgttttgatttggactgatgaaaaagcagtgaaactagcctttatttatggctaactttgcctgttgtatgccgcaaatctactttttttcttggcaacgtctcgtttcgcacgatccaaaaaaaaaaaaaaaactgtctttttttcatgacccgagcttggtcttaccattacaactttacaacttcgggtc

SEQ ID NO: 22949 - DNA, 3325 bp, Zea mays
cctcgacgccggccgggccgggcggttccactttgtcattctccatagctccggtaaccctactcccggcgacggggatcctgcactcttgggttcttgcatcccgcataccctcgaaagctcgaaagatcccgcggcgcagcagccacccttctctcctctccgctcccaatcttatcgtcgcctccctcgaagtcgccgctgccttcattccaccatggcgcttcacgccccggtccacgtgatgaaggactcgctgaagcgggagtctggcgcgaaggttcaccaagccaacatccaggcggccaaggctgttgctgacatcattcgcacgacattgggtcccagatccatgctgaaaatgcttctggacgctggtggaggtattgtggttactaatgatggtaattctattttgagggaaatagacatcgcacaccctgctgccaagtctatgattgaactaagtcgtacacaagatgaagaagttggtgatggcactacatctgtcattgttctagctggagagatgctacacgttgcacaggcattcattgacaagaactaccatcctactgttatttgtcgagcatacaccaaagcgcttgatgatgctattgctgtacttgacaaaattgcaatgcctgttgatgtgaatgatcgcggggcaatgctaggcctcgtgaagagctccattggtacaaaattcactggccagtttggtgatcttattgctgaccttgctattgatgctacaacaacagcaggcgttgaccttggtcagggtatgcgtgaagttgatatcaagaaatacattaaagttgaaaaggttcctggtggtcagttagaggattctagagtccttaaaggagttatgatcaataaggatgttgtggctcctggaaaaatgaggagaaagatagttaacccccgtatcatcctgttggactgccctgttgagtataagaaaggagaaaatcagaccaacgctgagttgatgaaggaagaagattggcaggttctcctagagatggaggaagaatatataaagaacctttgcgctcaaattctaaaattcaagcctgatttagttatcacagagaaagggctcagtgatctcgctatccattatttgagcaaggctggtgttactgcaatccgtagacttaggaaaactgacaacaacaggattgctaaagcttgtggggcagttatagtgaacaggcctgaggagctccaagaatctgatgtgggaacaggagctggcctgtttgaggtcaagaagataggtgatgaattctttgcctttattgttgactgtaaagatcccaaggcatgtactgttctgttgaggggagcaagcaaggatgtattgaatgaagttgagagaaacctgcaggatgccatgtctgttgcaagaaacattttgaaaaatccgaaactccttcctggaggtggtgctacagagctgactgtatcagcaacactgaagcaaaagagttcttcagttgaaggcgtggaaaagtggccctatgaagctgctgctctagcatttgaggcaattccaaggactttggcccaaaattgtggtttgaatgttattaggataatgacacaacttcagggaaagcatgctaatggtgaaaatgcgtgggttggcattgatggaaggagtggcgatatcgttgatatgaaagagcgaaagatctgggattcctacagcgttaaagcgcagacgttcaagacagcgattgaggctgcttgcatgcttttgagaatagatgacattgtcagcggtatcaagaagaagcaggctcctggagcctcagctcccaagcaaccccaaattgaaactgagggtgatgccgacaatgagcagatgatcccagagtagaggctgtgaccaacctgcactgtcaaagttgtttactagtgccggaatagcactttgaatagagttcattttatttgagtgttggtggttagccttaggttttatatatagtttgatacactcgtccgagggttttttgtagtgtggttgctgcgcattttgctttggacagatggacgaactttgcctgttgtatgccgtaaatctacctaatacatggtaatgctgttgtttcccatgataagaaatgaataaaactcttcccctcatgatccgaacgtgattgatagacgcatacagtaaagccattttttcttgaagatacctacaccagttcttggggactgtagaatacaattctctaatcaaggaccacgtttctacatcgaagttgccattttgtgttgtttctgttgtggaggagctaaaagaaaactttatattttggatgacgttttgaggaccataatcaagtgaagagtaaacttcactctgcgaacagtataaaacagtgtttttggataaactaaagccattttttcttgaagatttctacaccagttcttggggactgtagaatataattctcacatgtataaaaatcaatgaccacgtttgtacatcgaagttgcccttttgtgttgtttctgttgtggaggagctaaagaaaactttatattttggatgacgttttgaggaccataatcaagtgaagagtaaacttgactctgcgaatagtgtaaaacagtgtttttggataaactatggacaaactgttgtaaacggtttgagtatggagatggataagctgactatctccagcaggttaccgatttccatacttatatttaaactctactctgcgaacaatctacagtgcagaatagtgtaaaacaatgcttttgggtaaaggtatccttttcatcaatatttccatatagttgtaagaaattgttggtacggtttcacagacaaaggcaacaatgagattgcaaatatggactaaattccttggagattgaacaaaactgcgtttttttgatggtgaaagaggataattatgggaaggcgttcgccgttattttaccgtaccatgtgtcaaaccataaagagacagaacaaccactggcggagctaggatctctctgagtatagggccggatataacactaaaacgatttataccgcctaaaaatttaaatgacacaaatgcatagataatgacacatgtaaacttcatttgatgacaataattacaatttaacataaaattggcttaaataagtgattacctaattaagaataataataattcttcgtctcaatggccaattcatcaattgtttggattgttttcatagaaagacttcctgaaacctaatagaattatgttaaattgatgaattgaatgtgcctcgcagatttgtccca

SEQ ID NO: 22950 - DNA, 2369 bp, Zea mays
ctgcagcttactaggcgaatacttgactattatgcttgatctcttgtcttctggaacttatattttctcatcttcagcatacaccaaagcgcttgatgatgctattgctgtacttgacaaaattgcaatgccggttgatgtgaatgatcgtaagtttgcagtgaaatatatttttcctggatccgggcacttcaccaatggcacatttgtgctttagccctttcctcttgcgtgcactatgtgttaaaaaattatactgatgtcaccgaatttaccattaatgcaggcggggcaatgctaggcctcgtgaagagctccattggtacaaaattcactggccagtttggtgatcttattgctgtaagcatctttcttccatgtggaacttcaacaattccccccaaattatagttcactttggctttgctctaagtcaaaattcttttatttaaaccaagttaacaaaaaggaaaaaaaatcaacagtccaactccaacatctacaacatcaaattagtatcattaaattctccatgaaatatgttttgatagtgtatttatttggacttgtgaatggtaatatatttttctaaaaacttgttcaaagttagagaaaattgacttaggacaatgccgtagtgacgaaataattttatacgggaaggagtatcacctatctaaccttggattttactcatttgatacctcatgttgctgtattcaggaccttgctattgatgctacaacaacagcaggcgttgaccttggtcagggtatgcgtgaagttgatatcaagaaatacattaaagttgaaaaggttcctggtggtcagttggaggattctagagtccttaaaggagttatgatcaataaggatgtcgtggctcctgggaaaattaggagaaagatagttaacccccgtatcatcctgttggactgccctgttgagtataagaaaggagataatcagaccaacgctgagttgatgaaggaagaagattggtaagagatatccatgtaccacaatgattttacctaaatacaatgcatgcataattttaaagtaatttggtagaattctaaggtatattatgtggcaaactttattgcaggcaggttctgttagagatggaggaagaatacataaagaacctgtgcggtcaaattctaaaattcaagcctgatttagtcataactgagaaagggctcagtgatctcgctatccattatttgagcaaggctggggttagtgcaatccgtagacttaggaaaactgacaacaacaggattgctaaagcttgtggagcagttatagtgaacaggcctgaggagctccaagaatctgatgttggaacaagagctggcctgttcgaggttaagaagataggtgatgagttcttttcctttattgttgactgtaaagatcccaaggcatgtactgttctgttgaggggagcaagcaaggatgtattgaatgaagttgagagaaacctgcaggatgccatgtccgttgcaaggaacttttggaaaaatccgaaactccttcctggaggtggtgctacagagctgactgtatcagcaacactgaagcaaaagagttcttcagttgaaggcgtggaaaagtggccctatgaagctgctgctttagcatttgaggcaattccaaggactttggcccaaaattgcggtttgaatgttattaggataatgacacaacttcagggaaagcatgctaatggtgaaaatgcgtgggttggcattgatggaaggagtggcgatattgttgatatgaaagagcgaaagatctgggattcctacagcgttaaagcgcagacgttcaagacagcgattgaggctgcttgcatgcttttgagaatagatgacattgtcagcggtatcaagaagaagcaggctcctggagcctcagctcccaagcaaccccaaattgaaactgagggtgatgccgacaatgagcagatgatcccagagtgagtagaggctgtgaccaacctgcactagcaaagttattatttactagtgccggaatagcactttgaatagagttcattttatttgagtgttggtggttagccttaggttttatatatagtttgatacactcgtccgagggttttttgtagtgtggttgctgcgcattttgctttggactgatggacgaactttgcctgttgtatgccgtaaatctacctaatacacggtaatgctgttgtttcccatgatcaaaaaaaaaaaaaaaaaaaaaaaaaaaaagaaaggaaaaaaaaaaaaaaaaaaaaaaaaataaaaaaaaaaaagaatacaaaaaccataactcattctatattgacacattaaaatccaattcactgg

SEQ ID NO: 22951 - DNA, 3815 bp, Zea mays
ggtatcgtcccggatcagcagcctcgccatcgggctgctcggggtcgcggctctcttcaacgacgtcgccttctactgggtggtgctgatcttcttcctgcagaggggccccattgctcctctctccgaggaaatcacagaccctgagaacagctacatcggcatcggtgctgccattttgctgttcgggcttctggtctgcctgccctacccgttcccctttgacccgtcgcagttaactgatatggatttcaacttctgagaaaaggaaaccaaaaaaaaagcagttacaactcaccggatgagatgtatttaacctgtcggctctgtattctgctgtgtcatcttttgctccattgctccttgtagtagccaataaaagcagagctttcttgtgtaagcttgcctgttgtattagtaggatgctcgatcagagtagaatatagatgttattttggctgtaactgttacctgtcagttgtggcttatcaacaataggttccttgtcagagtatgatctatcagattcatacgcgatacttagcgttttggataaggctatctccagtaagggtctgtatatggtcctgtacgttaaatttagaggacgtcgagctcctctagtcctttagcagcacacggtaaagcgagctcctctagtcctccagtagcacacggtaaagcgttcgataaaaatagtgtgctttgctggacactctaagtttagaggttgtacggtcgttcgctatccatggcttctactcccttttgtctcgttaatgaaaagttgcgtataaaataagaatgagtaatattatttctatagaagatagaatttagaggacgctgttggaaaacgaggtgatatagataacataatcttttagagtgcaccgtaaaaaacatggaataattttttagaggatgaaatttagagaacgctgctgaagatagcttaaatgatgtgtttggtttgattttttagctttagcttttaccttctagaaatcaaaagccaaatcaaagggctatattcaagaaacagctttttctaaaaacaacttttttgtaaaactgaaagtacctatgaacctcttttcaatggtttttcgaatggtatgaaaatatacatgaaaaactattagcaatttccatcaaacggattttagcatttttaacagctcacaacttacaacttttttcaaagccacggcttaataaaacataccctaaatataagcagaataagcagacctaggacattgtgcgattgttgtgccagagcccttcaaactgatactgctgctaccttatataaaaaaatactcctgcttaatttgtttaactacacattctaggagacgttacattagcgacactgaacgttgtggagcacaaacgttcagccatcggaacatgttccactaccaaatcgcatgtcactataaactgctctagagatttatcacataaaggacacttttcaatagtgtattaaggtccatggttaaaattgcacatggagctgcagagcatgacacgacacgaaggaactggatagatattgaacattcgaagaacctaaaatataacaaaataataatgctcgtcaggtactcgatatcttccaccctgctgctctgaacattctgtagccaaatggttccatcagaatcatgccttttaaaccttttggaagtgaaatcaccgtccatagggtcctgctctatcgctgcacaactcatcatccatataaataccgtccaggcacatcaggttgttgttgacgctcggctcagagctagcgttgctgcttgttgcgagcggtgagtctgagacactcattggtctgctccttgtggatcctgaacgtgcgctatgaacggatgatggagggatacttgtcataagaggccgtaaattgtttggaatgctgcgccttatgtcctgtaaacagcaaattacacctcaaggtcaatcaactgaacatagataatgctgttaactaaactgagaataagtaaaacataccatatgtcgaagtgccatgtccagtgatttcttcgacaaagtcctaccaaagcccgagctatctggggaatttgaagttttaccagatacactgttcaggctagatctttgatcatcatgctttggaggaactagccttctcatgttcacaaccctttcaaccatcttattacccatttgaactggattcacactgtcacctccattgagatgtgaccttctcactgctggcatggagctccctgaaggcacgctgccacttaaagtccttcctctggagggagagcaagactgccgtcttggtcgaccagctggcccactctcaacagagcaagatctagaactaggtgccccaggtctgcccctagtggcagaggttggtctttctggtagcgatgtccttaggtttggaggtgcatcaagagagaaaccaggcatttcagatggtttccatggtcttgatttgacagtaggggagctgcctcttgaaggtgttggcgctgcagttttcgctggtgaagaacctttgggcattgtcgaacctggtttggagattgaggacgatctaactggtgcagctaagttaccatgctgggccgaaggggcagaaggtcgccttgttggagttgatgcccttgatgtaggcttgctttgtgctggtatggagggtctggatgatggtgttgttgacctggtagcaggtattgatgaccttgcaagtaggtgttgatgacctactagcaggggcagatgctctgcctataggagctgaagtcctgctagcaggaccaactgccctgcttgaaggggtcgttgacctggctgatggaagtgttgatctcaaagtcggtgttgacgaccttgacacagaagctccagttttggcaggaacagttgtccgggaagtgggggtcgaaggccttgaacctttggaactagctgtcaatgtagggcgtccagttggtgttgaaggccttgatgaattagaagtaagacctccacacgatgatggtcggcgggtttgtagcacctgagttcaggctgttcgatgatgttgtcctcaatgggaggttggttcttgatggaggatctggatggttggacaactgaaataacatattatgagaagatataacagaaagtaatgaatctgaagatttacctatcgtacttatggaaagtataatgtaacatcacaagtaccttacagaaaggatttccaatgaggaatcataaattatcaatgcaataaggatttatcacctgaccttccacgataaagactagtaaggctttttagacaacagaggccagcataaaagcacacttcatgtaaaatatataacacaataataaatgttatctttgcagttaatcttataataggtccagcagacaacggattatctttggggaccttgcctgccacaggaaatctgatatggcaatatccatcaatctataaagtacagtttcatatccaccatgaggtggaatttcaccaactttatgtctgctgcttcgaaagttagggatactgcttacgatagtcttgtacagttgtaaacttctaatcccaagaaccaaagtacatcttatgttcaaatgactcacccttgattttaaggcagttggacgagtctttggtgttccagcttggctcaccggggaccttttcgactcaacttctagagatgggaatagtggagttcctggtggtgtcagaagcctgaaagaaacaacttgattgtgagaacagttacataataacttcaaaactgcag

SEQ ID NO: 22952 - DNA, 2281 bp, Zea mays
tgctgcacccgatctagagatccccctgctgcctcgtctagtatccaacagcatgggtgcaaacaagctggaaatggcaacactggtacttcattcaaccttatacattatttatcttgattaactgaccttattactcttgaactgaactctcttgggttatattatatggaaagcgtaatgtaaatgcagcttaaggctctcttcaacaacaaacgctaaagcgttcggtacgctatatttagagtgtagcttcgtccccaacgtctccaacaagcacctgtatagcgttcgctaaaatttagcggagccccagcgtccgccaaatctagcatctcctgtccgtccgctattctgtcagctcttgtactgggagctgtctgctaccatcatagcgccaataaaaaacaaacaatgccagaaacgtctccgctgactagtaaaaaagaactgaaaaatggaactaaaagatcttctgtggacacatgtgagaacgaccatttcatatattcgacatattttagttgtacataaatattttactatgtattctacaatgatttgtaatttgttgcaaaaatacgattgcaataaattatgttaatatgattgccaaaatatatacgatgagatatagaacaaatattgtagtttatggattctgttaacactataactttagaggaccgaatttagagaacgttgctggagactgagaagatatagaggacagaatcttttagagtgtgctgtaaaggacagagaatatttctttaaaggatagaatttaggggacgctgctggagacagcttaaaagatgtgtttggttggattttttagctttagcttttaccttctagaaatcaaaagccaaatcaaagggctatattcaagaaacagctttttctaaaaacaacttttttgtaaaactgaaagtacctatgaacctcttttcaatggtttttcgaatggtatgaaaatatacatgaaaaactattagcaatttccatcaaacggattttagcatttttaacagctcacaacttacaacttttttcaaagccacggcttaataaaacataccctaaatataagcagaataagcagacctaggacattgtgcgattgttgtgccagagccattcaaactgatactgctactaccttatataaaaaaaaatactcctgcttaatttgtttaactacacattctaggagacgttacattagcgacactgaacgttgtggagcacaaacgttcagccatcggaacatgttccactaccaaatcgcatgtcaaagatgctataaactgctctagagatttatcacataaaggacacttttcaatagtgtattaaggtccatggttaaaattgcacatggagctgcagagcatgacacgacacgaaggaactggatagatattgaacattcgaagaacctaaaatataacaaaataataatgctcgtcaggtactcgatatcttccaccctgctgctctgaacattctgtagccaaatggttccatcagaatcatgccttttaaaccttttggaagtgaaatcaccgtccatagggtcctgctctatcgctgcacaactcatcatccatataaataccgtccaggcacatcagattgttgttgacgctcggctcagagcttgcgttgctgcttgttgcgagcggtgagtctgagacactcattggtctgctccttgtggatcctgaacgtgcgctatgaacagatgatggagggatacttgtcataagaggccgtaaattgtttggaatgctgcgccttatgtccatatgtcgaagtgccatatccagtgatttcttcgacaaagtcctaccaaagcccgaactatctggggaatttgaagttttaccagatacactgttcaggctagatctttgatcatcatgctttggaggaactagccttctcatgttcacaaccctttcaaccatcttattacccatttgaactggattcacactgtcacctccattgagatgtgaccttctcactgctggcatggagctccctgaaggcacgctgccacttaaagtccttcctctggagggagagcaagactgccgtcttggtcgaccagctggcccactctcaacagagcaagatctagaactaggtgccccaggtctgcccctagtggcagaggttggtctttctggtagcgatgtccttaggtttggaggtgcatcaagagagaaaccaggcattcagacccggttccatggtcctcgagccgaat

SEQ ID NO: 22953 - DNA, 1601 bp, Zea mays
ggtattggaggggtttaatttcccttctagtcatttttgattatgagagaatttaatctcctccgatccccttctgaattggtgtaaccgaacatgcccttattggtgcaccatacgcctgctagagtggacgtgaccacaatcataacacctatacctagcactacagaagaccatgatggcctactgtcgaataaactcgtccgaaagggtagagcaacaccttttcgaccaccatcgtgagggcccgcggccgtctagaagactctcgagttttttttttttcttttttagtgaacaattattttaatcaaacaactttcagctttcttacaaccattagccacttcctcacagctaaatcagattgttcagcaatatgtagctaacccaacagacactaccatcccctcttcaacgttgcgtatcgactcaacacagcaagcaaatcactaattaatttgaaccaacttagaaggcaatggaacaggcaaccgtcgcacaaacaattgcttaacaaaatgttaccagatcaccggaggccgaggagccaaggggaacgcgtcggccggcagcgaagttgcggggcggagcaaggaggctagttagtgcctgctggatatgctgaaggaggtgaccttcatgggcgtggccaccaccagtggagcctccggggagtcgctgaccgagtacttgtcgtgcatgaagcggctggccacgatggactcgtccttggggatcaccttgtagcaatagcagctcttcagcccctcctggtactggtagcactcgtggtggctgttcttcacctgcaggaagttccacaccacgctgtacttccccaccgtcgccactagatgccgctcctgcttcccgttctccgtcacctgcgcaacaatcattggacgagagctcaaatgccaacaaatgcacatgtccgctcatgctgggtggtgggtaactggtttttttttgttaaatcagagaacagagtttggggtgtttctagctgccggaaatacattaaccatttgagatcgcagggctgatccaagatgtgctagatgtttcgttagcataggttttctagtttatctgagaaccacgaacattaaagttcacagcgtatcagtagttcaaaacagaaacagctcaaacaatatgcaccactgaaccgcatccaaatggtacaaagaagcatagaaggtggctcttaacaatacatgcatcacgtgcatgtgcgggatggggggggggcctacgtagctgaggtcctaggtgctcaggcgataaactcaattttaagattttaagaaatgaagtatttagaaacaccatcaatgaaaaggtagataaatttgtggtggatacatggctctgctagtttgataatggccatcgaaatgattctagaatcaaaactgaattgaatgccttgagcggtattatacaacataacactgtttttctagcatgatctttcatgacaactgaaagtaagttaacatctgtggaacttaagaagcaacactccttagcagtaacagacatgcatcagtcatggcatcctagagtaatcaaagtttaacatcaacaaacga

SEQ ID NO: 22954 - DNA, 3005 bp, Zea mays
cagacatgcatcagtcatgcatcctagagtaatcaaagtttaacatcaacaaacgaaacagcagtatggcacacaactgtaaaactgcagaagacatgtattcaaatcaaggatgtaattaaattaaacaggggaaaagacggaacattgtaagccaagccacataagggcttgttcggttagctctcaatccatgtggattgagcgggattggatgggtttgaatcccaaacagctcaaacttcttcacaattttttccaatcccatccaatccatgtgtattgggaataaccgaacaagccctaacaggatctgccaccaatatagaatcgaactacttctacatgatgcacaaattagacaatataaattgataattgcaggtcactaaatatagcagtttaaccaacactgtcagtcagttttgatcacgcataataccaaaatggcaaaatgctatcaaacaacaacaacaacaaagccttttcagtcacaaatcgagctgaaacccaacatgaacctctagttacgaattacgattaaccaaaatgctaccagagaaatgcataatcttctgtgtggtgaacggtggtaaatctgaacaaaagtccataataaaagaagtggcaatatatactcacccaagagaatcttccctccctgaacctgttgtttgctcctgctagatgagagtccagtgggttgagcttcagcagccttggagcagcaatacggttccccattctaccactaaacccagtcttctcctttccatctttgtcgatgaagatggtgcatacaagaatcaggtacgcatctgttgtcccaagaatccacttcccatcatatgtcacgtcgacatgggtaatgggcgaacccaacccaggaaaggctgtctttgccatcctcatagagctcttagaatacaggcgaattttcccatctaatgatccaacaacaattgaaccatcaccagttgaagcaaagcactgaaagtttgtcccccgggagaactgatgcccctgagtccactgcaacactggcgattcagttgcacttgccaacttctgcacaatgcccctgcgatctctcatatcccaccggcacaactggttgtcatccagtcccaagaaggtggactcagacgaatccagctgagcacctttgctatcattggtgatatccctcatgttaatatctgctccatccttctcaaacttccattctgaaaccaccttccccgtctcaatgtccaactgatgcacccccttggcgtgtggctttccatcagtggctgggctcatcagaagcatgttggtctcggcccgcataagaagagcctttttcggtgtcgagaagtttgtgctccctccagaaaacttcacggacatgccctttccatgtatcccatgctcgaaattcctcacgacctcaatgcccttgtctccaacaaggaaactgttgtccagcgcgccaagcgcaaggctcttgattccacttccttcctcgacgggctcctcaaactcccgcagatcctccagcacggccttcagtagcggtgtccgcgggggcatcgggctgcccttggggcccggggagaagccgtcggtggcgtcctcccatatcgactcgtcgccgtcctccgggcgcgcccacgccgcgaagtccttcccgaataccttggcgcggccctcgtccgtggcggcgacgccgtagctgttctcaaacatacagctgtggtgcttcgcgcagaagtcgccgaagccgtcggagtgcaggaacttgagggcccatacgccgtcggcgacgaaatccacccggcgctgcgcggggaaggccttgagctgcagctcgggcccgaccctggcccggatcttcgagcccacgacgaggcaccacggcccgccggcggcgggggcgtcgtcatcctcgtcgtcgccgtcgccggcgccggcgccggcgcgcacgaaggaggcggcggcgaggcggtcggagacgatccacttggcggagggagaggagccgccgatgtggaggtagagcttgacggcgttgagcgcggcggggttagcgctgggggtgggcccggagctagggttcggggagatgggctcgttgtacttgaggtggagctggcggaggtggcggtcgatggcgtcgatggaggcgggggtagccgcccctgcgccgctggctaacttggaggagacggaggccgggggaggcgtgccgtagtcggaggagttgtcggaagcccggggggactcggcgtcctcggagtcagagtcggataggtcgaggtcctcgcggctgtgcgaaccccccatggcggcggcggctgcggcggttggtttcggcgagaaggtgaggatggaggagcggaggaggagcgtgcgggaaattgaaatttgggggcggtgatggaagagatgggggcccccttggccgtttgccccggccgcgactgcaagtttgcaacttgcaagtgggaggagagatctgggaagcgaatagtcccccaggccatgattgaagaccaaacggccgttgcattgcactgattcaaaatgttcaaattgaagtagcacatcgtcagtcactctcacttgcgccactgttccatccatccacttgttccaggatgtgatgtgaactcagagttaacaggtgactttaaaaatagctatatactccatgtagtctaaattatataaaaaaacatcttgattttctctcacagtgagtgagttgaatgtactatagatttaggcatataacaaagggagcagaaagttaactgactcaagattactgattcgatcctcttgagagcaaaaacgtttggaggaggttgcattcggtcttgtaaatcaaatacaaacaagaaataaatctagacaaatttggactagataagcaaaacctagtcaaaataggctcaagccagttttcctaggctttctatgtggccttgtacaaacccagacatgccactgatttgtct

SEQ ID NO: 22955 - DNA, 3578 bp, Zea mays
  misc_feature (690)..(690): n is a, c, g, or t
  misc_feature (3023)..(3023): n is a, c, g, or t
gagatacatgactctagtagtttgataatggtgatctaaatgatattagaatcaaaacttaattgaatgtgtttagcagtattatgcaatgtaacactatttttctagcatactaaattttcatgacaactgaaacctggtaaccatttgtaataagactataaaaagcaagaccccttagtagcatagtaactgacatgcattggtcaaggcatcctatagtagccaatgtttaacattatcagaagaatggcagtatggcacacaacagcaaaactgcagatgacatgtactaaaaatcaagaatataataagaattaaacaggggggaaagcctaaacattatagccaaaggccagataacagcatctgcgaccaatataatttaaccacttctatatgtcacaggatgaagcaatagaccatataaattgataataattgcacatcactaactatagcagtttaaccaatgctgtcagttttgatcacgcagactgccaaaatgctaccaaataagtgcattatcgtttgtatggtgtacaatagtaaatgtgaccaaattcataacaaaagtggcaatatatactcacccatgagaatctgccctccctgaacctgctgtttgctcctgctagatgagaatccagtgggttgagcttcagcagccttggagcagcaattcggttncccattctcccactaaacccggtcttctcctttccatctttgtcaatgaagatggtgcatataagaatcaggtatgtatctgttgtcccaagaatccacttcccatcatatgtcacgtcgacatgggtaatgggtgaacccaacccaggaaaggctgtctttgccatcctcatagagctcttagaatacaagcggatcttcccatccaatgatccaacaacaatcgaaccatcaccggttgaagcgaagcactggaagtttgtcccccgggaaaactgatgcccctgagtccattgcaatactggcgactcagttgcacttgccaagttctgtacaatgccccggcgcgacgtcgtgccgaatctctcatatcccaccggcacaaccggttgtcatccagtcccaagaaggtggattcggatggatccaactgggcacctttgctatcattcgtgatatccctcatgttaatatccgctccatccttctcaaacttccattctgaaaccaccttccccgtctcgatatcaaattgatgcacccccttggcatgcggctttccatcagtggctgggctcatcaggagcatgttagtctcggcccgcatgagaagagcctttttcggtgtcgagaagtttgtgctccctccagaaaacttcacggacatgcccttgccgtgtatcccatgctcgaaattcctcacgacctcaatgcctttgtctccaacgaggaaactgttatccagtgcgccaagcgcaagactgttaattccgctgccttcctcaacaggctcctcaaactcgcgcagatcctctaacaaaggcttcagtactggtgtccgcgggggcatcgggctgcccttgggacccggagagaagaagccgtcggtggcgtcctcccatatcgactcgtcgccgtcctccgggcgcgcccacgccgcgaagtccttcccaaacaccttggcgcggccctcgtccgtggcggcgacgccgtagctgttctcaaacatacagctgtggtacttcgcgcagaagtcaccgaagccgtcagcgtggcggaacttaagcgcccatacgccgtcggcgacgaaatccacccggcgctgcgcggggaaggtcttgagctgcagctcgggcccgaccctggcctggatcttcgagcccacgacgaggcaccacggcccgccggcgggcgcgtcgtcgtcctcgtcgtcgccggtgcgtacgaaggaggcggcggcgaggctgtcggagacgatccacttggcggagggggaggagccgccgatgtggaggtatagcttgacggcgttgagcgcggcggggttggcgctgagggtgggcccggggctagggttcggggagatgggctcgttgtacttgaggtggagctggcggaggtggcggtcgatggcgtcgatggaggcgggcgtggccgccgcccctgcgccgctggccaacttggaggaggcagatgccggggtaggcgtgccgtagtcggaggaattgtcggaggcccgggactcggcgtcgtcggagtcggaatcggataggtcgaggtcctcgcggctgtgcgagccccccatggcggcggaggctgatagggtttcggcgaggaggtgagattgggggaggggaggaggagcgtgcgggaatttgaattgggagaggtgatgggagaaatggggccctttggccgttttgcgctgcgactgcaagtctgcaggttcccggccggcctcgaggggcccagtgggagagatctgggaaatgaatagaataggagacgaacggccgttgcacacttcactgattcaaaattttcaaattgaagatccatagcactagcaccgtcactgactcttactcgcaccaactgttccatggtctgaactcagaggcaagagattacttttttttctaaaaaacagctatttcttcttattaaactgatgcagcctcctcgctatacattgcgtcacgtcaccaaaaaaaatcatcgccgtacacatgtctcttaccgcttcatctcctgtgctgtcctagattgtattaaagaggggggatcttgaccacgtctttgttgccgcttgcacgtcttcttgacggtatcatagcaggaggtgacgacgctgtcgaggacgacagcggcagcgcagctgcttccattggcctctgcttcgtctgactgtcgctttctaaggtaaagagatctgttgtcttcatttttttccttttttgttgcttactgtagcttccatgcgtgattcattcatttctctgatttttactttgcaaaaactcaatgttagtacagctataacttttagtttngcgttgtactaaccatctacaacagcaagcatgcatgctttttctcctttttttctaaaatatttcaaactctatgtgttttttttctaaaatattgcaaaatctaagacagtttactatccacataccttagccttttgctgccccaaccgagaacccccatccattcgtccgtacacttccagtaaatatgtttctttcatatttgtgtatgctgaatcctacctttttagatgacgttttctctcatacaaaatgagattgagatataatatttccaaagggaagggagatttttttaccgctaaaaaaggtgagtctatggtacaatatattcatagaaggaaagagttattactaacctttcttcctttggtcaactgcaggagatactccattttttatataattacgggataactactctattttattctattgggattggcttctgaagggcatttctattcatgtttaaatactatggggcagaaacttttctaaagtctttatgtgtgtttcatgctccctgctcacttaaaaggatactgtatg

SEQ ID NO: 22956 - DNA, 1031 bp, Zea mays
cgtaaacatagacacgactaacagcatcaagaaagtcccaatatttaggccaattttcttgctctttgttggtcaacaaacatatattttggttctccgacaaattatgatgagattatcatatatagtccaccaagaaaaggaaacaaaacaagattcatctattagtatgatgttacaccccaacattagaagcaatcaaccgaccctagcaatcatgctgagaagttagcagcacggagccagtgactgcttgatatgctgaaggaggttgagcttcataggcgcagcacagagctagtgaccgcttgatatgctgaaggaggtgaccatcataggggtagccaccaccagtggagcctccggggagtcgctgaccgaatacctgtcgtgcataaagcggctggccacaatcgactcgtccttggggatcaccttgtagcaatagcaggtcttaagcccctcctggtactggtagcactcgtggtggctgttcttcacctgcaagaagttccacaccacgctgtacttccccaccgtggccactagatgccgctcctgcttcccgttctccgtcacccatgagaatcttccctccctgaacctgctgtttgctcctgctagatgagaatccagtgggttgagcttcagcagccttggagcagcaattcggttccccattctcccactaaacccggtcttctcctttccatctttgtcaatgaagatggtgcatataagaatcaggtatgtatctgttgtcccaagaatccacttcccatcatatgtcacgtcgacatgggtaatgggtgaacccaacccaggaaaggctgtctttgccatcctcatagagctcttagaatacaagcggatcttcccatccaatgatccaacaacaatcgaaccatcaccggttgaagcgaagcactggaagtttgtcccccgggaaaactgatgcccctgagtccattgtaatactggcgactcagttgcacttgccaagttctgtacaatgccccggcacgacgtcg

SEQ ID NO: 22957 - DNA, 1000 bp, Zea mays
ttttttttttttttttttctttgttttcaatggcaatgctacaaaccttttataaagaaaaactaatggtgatgcaaacaccgacaggaattacacggctataacaattgtacaatcttacaacagggcgaggcctccaggttcctggtcttcacctcaccgcatgttccactacctgccccagttttcaggtttcctcctatccaattccaatatgttgaggtaacttccagctcggcgactaggtaaatacggcacactctacagtaagtacacaactgctgacagttgtacaggtgaatccgtgcatgtgctatcctggggatccacttcgtcaacaaaacgacaaacagcatggcactggttagagttcctacatggccaaaatttacagcaatctcaccccataaattcatgctagaatcctttcttgaactaaggtgttatggtttccagtgcccccatcaacatctggcttatagatgctacgttctgggtgattgcccagcatcagaaccatctgctgatgaactatctgtgtccgtatcactagaggatgaacccgagtcactgctagagcttccagaactacttgatctaccagcattctctcccttctgatcttccaaatgaccaggtgatgattcacccacacatctctcattatcatctgctgcactttccttaggtggatcaacatcaactgttttctggttctggaatcggggggggggcctacgtagctgaggttcttgtactgcaggaatttgatcctgatccgccttgccctgcctcacatgttctaccttctccggctcctgatcaggatcagcttcatccggccttaccgcagaaagctcagccttccgcttattcttagttatactcttcctatagtttgtcacgaatctatcgagctcccataatgtttcaacatcaaagctatagatatcaacctcaatctcattgtcgtgctgactgagtcggacgcgtggtcgcc

SEQ ID NO: 22958 - DNA, 1607 bp, Zea mays
gcctgcaggtcgactctataaggacccccctgctgcactttccttagggggatcaacatcaactgtttctggttctggaatctgtaacggaaagacaacagtgagaaccgcacgtgcaatattccataaaatttagtgatggcactgaatactatcaaccataatcataccagttcttgtactgcaggaatttgatcctgatccgccttgccctgcctcacatgttctaccttctccggctcctgatcaggatcagcttcatccggccttaccgcagaaagctcagccttccgcttattcttagttatactcttcctatagtttgtcacgaatctatcgagctcccataatgtttcaacatcaaagctatcgatatcaacctcaatctcatcgtcgtgctggctgagtgacaagttcctcttctttatgatctgaacaacattgtctagcttctctggtggcaaatcctggaggttattgctaagccgctgcttctcccagaatgtcatatccctcttattgggctcccttgccttgggcttctttaaaacttggggtctgccagtgtgtgtcttcggggtagcttctatcccggcagcatgaactgtcgaatcagacctctctaacggcctagaattatctatctcctttggctttggctttttgggtgctgctgaggatggtgtaggaggctgtggtgatagctgagctatctcagcctcaatctccggccacttctcctcgaacatgttaagcagctgctcggccatgaagtgcacgtcctggcccttggggttgtacgtcatggcgttctggaacgtcagacgcacatcacctgcaaattcccgtggtgacttgtactgcccggcacctagctttgacttgactgtgccgaggtccatgggtttggtgatgattgtatggtagtcgtgcaggccaagcgcgctcgcatctacgggcttgttgaacacccagctgtgcttgtgcttcatcagcctggagagcagagcggcgcaggtcttgaacacgggcgcgtagagcttgcgccgcgcctccgccgagaggtgcggctgcgggactccgccgcccttcttagacttgtgcttggacgccggcgggtacggcggatgcggcgtggaggggtcggtggcagagagcgccgaggagggggcgggagccgggagggagttcaggcgcttgacggcggcgcgcacctgggagagctcggaagagaggcggcggcgcagctcccggcgggcggtggtcgtggagggcagcgaaaaggtgacggtgggtaggagctggccgttgtgggcgtcgaaggaagggacgctgggagccttggagctggcgtgagatttgcgcgagtagggtttgccggatggcgagggcggcccggaggccatttttagcgggtcaacggctgcggcagatcgtggacggcggcggatcggaggcgcggatttggggatttgggcggaggaggcaccgcacgacagggagaggggaggggaagggggtcggtgtggtggtgccgtggtggtggtggtggcggccgggtggggacaacggcggcagccgctagcctgcttgtacctgtccctgtc

SEQ ID NO: 22959 - DNA, 1320 bp, Zea mays
ttcgatatatggggcctatatatggttagttgaataccagtcatatgcaatggaggtctctacatcgacccaaaaaaggagtaacatggaatatcacgatatcattacatgaaaggatctatgtttctatttctaataaattagagagcttaaattcgcatgacaggaaagatgatacatagagaacattattcaagtgaagaatgaagctattattcaataataatggaagttctatcacttcaacttcattatcaacaccattgacgactttaatgcatctttctcctctttgaagggtcctcctcgtatggaatccctttattgatcaagtgcttcaggaaggatggacaatccttctgatgatgccctgacttttcgcaccagtagcaagcattcatgtccacctctttgtttttcagatggtgatcattctgtggagccttgccatgtgccttatatatcccaacatagttgatagaatcaccacgtgaagccttaattctttcctcttcttgcacacacatggcaatcagtttctcaatgccccaattgtctggttgtgagttataattaatctcaaaagcttcaaattctttaggcagagaggcaaaaatcaaatagaccagaaactcatctgggagcgccatttccataggtttaagcttggaagccatgctggccatcttcaatatatgctctcttactccaccgccagtgtatttatcggtaagtagcctttcaattattgtgcatgcataagcctttgaagagatagtaaagtgactctccaccttactaagatactctgtagcggtggtacatgctgggaatgctcccctgattgtatccataatagagctcttaatcaccatcagacacttgcggttcgattgatcccattttaccttgtataggtcatacttcatttttattggtgcatgattgcgcacacgagcgttgaaatcatcatcgctctcgttctcttcctgcaccgggtctaccggagcgatgggacagggatcagtgatagccagatcaatatctaacaacgcaagcgccagctcaagcttctctcgccataactcgtaattccctccgttgaggggcgggatggagtcgatgtaattcatggagttgcctccggggaagcacggatcgtggaggaggaggggctcgccggcggccggcggatgcggagtagatagcggtgagccggtgagcgcgggtgcggagatcgcaggtagtggtttacgagtggaagactggaaggcccgccacgggggtgcctaataaaagaggcgtaacaaaactatcgat

SEQ ID NO: 22960 - DNA, 3403 bp, Zea mays
  misc_feature (849)..(849): n is a, c, g, or t
  misc_feature (2887)..(2887): n is a, c, g, or t
  misc_feature (2908)..(2908): n is a, c, g, or t
cggacatttttcacagtttctgtttccttgggcgcaccgaggggtcgatgcccagacactgctcaatgattgagcgactgaccccggcaaggtctaaagcagaccatgcgaagacatccttgttgcggttgaggcaggaaagaagtcttgcttattcgtttggcaggaggtcttcgctgattaaaactgtttgcttaggggttgcggggtcaagggggactgtcttggttccctcgttgctctgcaattgtgcgttaacttttttgtttttggttgttcgaggcatgctagtgtcttcgcattctgtcatgagacaatgcatattacgatgtcctaggacgaagtctctttctatattcctagctgcctgctgatctccatatattgttattacaccttgagggcctgcgattttcagcatatgtagagtctatgtattgctgcctcgaacttgtgattacaccttaagggctcggctcggtcatattgcgagcctgaccgagaggctcggctcggtaacggctcgcgagcctcacactaaatcatgtttagagtataaattatatattttttattatatataaaataaaaaatttatgtataatatatttttagactacaatataagtgtattgtgtataagttcaagaaattcaataaaatagtttaaaacataataataatatggtataatagtatacttgacgttgttagctcggctcgcaagaaaccgagccgactcggctccgctcgcagttctagcgagccgcaaaaacaggctcgactcgggctcattttggctcgcaagcctcaccaagcccgagccaaattttcacccctagatagcgngccaatttatgtttgtgcttgtaaaaaggtcaagtgtatgagatcctgcaactgtgttacctacaagacaatcctaattgcacgatctgaattctagaattacctatgtttacttcgatgaaacagcagtcataggtagtcaatttcgaaatatttgacctatatattgttagttgaataccagtcatatgcaatggaggtctctacatcgacccaaaaaaggagtaacatggaatatcacgatatcattacatgaaaggatctatttttctatttctaataaattagagagcttaaattcgcatgacaggaaagatgatacatagtgttcttttttcttgtgaagaatgaagctattattcaataataatggaagttctatcacttcaacttcatcatcaacaccattgacgactttaatgcatctttctcctctttgaagggtcctcctcgtatggaatctctataaagaatttgcaacatgaatagttgcacctatcaatccaccaaatagatttcacataactaaaatggtctcatctaccaatgtaattgcatcctcacctttattgatcaagtgcttcaggaaggatggacaatccttctgatgatgccctgacttttcgcaccagtagcaagcattcttgtccacctctttgtttttcagatggtgatcattctgtggagccttgccatgtgccttatatatcccaacatagttgatagaatcaccacgtgaagccttaattctttcctcttcttgcacacacatggcaatcagtttctcaatgccccaattgtctggttgtgagttataattaatctcaaaagcttcaaattctttaggcagagaggcaaaaatcaaatagaccagaaactcatctgggagcgccatttccataggtttaagcttggaagccatgctggccatcttcaatatatgctctcttactccaccgccagtgtatttatcggtaagtagcctttcaattattgtgcatgcataagcctttgaagagatagtaaagtgactctccaccttactaagatactctgtagcggtggtacatgctgggaatgctcccctgattgtatccataatagagctcttaatcaccatcagacacttgcggttcgattgatcccattttaccttgtaaaggtcatacttcatctttattggtgcatgattgcgcacacgagcgttgaaatcatcatcgctctcgttctcttcctgcaccgggtcgaccggagcgatgggacagggatcagtgatagccagatcaatatctaacaacgcaagcgccagctcaagcttctctcgccataactcgtaattccctccgttgaggggcgggatggagtcgatgtaattcatggagttgcctcctgaaatttaaattaaaaaagtgagaaaacatttttaaaaataatttgcatgctttaatttaatgttgataaaattaaaacatactccctccgtcccaaaatatagttccttctaggtttctttttttttctgtccacattcaaatgaatgataataaatatagacatacatacaaactacattcatagattaattaatgaatatgtgtttagtctaaaacgaattatattttgagacagtgggagtacaaaatatgcttcaacattaattctacatcaccgttgggaagaaatagaactaataaatggaaaactcaaaaataaactttacaatattgctaatatcaactttggtcagaaaattaacaataataaactcaaaatttacaattgccaatttaatttttccattggttcaaatttaaattcggaagataaaacatttttcatgcaacagtttcatgaaaaataattcatttagaagcataaactctcttatctactctataataaaactatcttgttgaatcaaacttgaataaagataaaacatcaaaattcatcaaaacgagtttccgacaaaaggaaaaaattgtcgctatgcgaaaaacgcccactagttgtggcctatgcggcccaaagccctctngcacgcgctctcccgcgtctnaagccgcaacctgggcttggaccaggaattatctccccgacctaggctcaatctgccccgagcgctgatggccgttcaatcccacggatcagatccaacgatggagcgcacattttggccagataaaatcatgagcacaatcgacgctggccagaaccctaaccctaagttctgttagctcttcttcgcgatcgacgttgttgagccgacggccactacgtgtcgtcgtaccgctggatctcgttgccgacacgatggccagtcgaggctgagtcgacccttcttccccattctctcttccttcttccccattatttcttctccaccgcaacaaacaaaggtgaggcgaagcgaggtgatcagcaccactgaggcccctcgtcggtgtgcgcgtttggccgaggctgagtgcactgtcatcaagcggccttgcacgtgttgttgtgaagccccatgtgtacggccctggtctggtgcgttcactattggaggtgg

SEQ ID NO: 22961 - DNA, 817 bp, Zea mays
tggtgccaaatcacaagcaaactactccatcaaccaaaccatcactgccaccaccagcagccaaattaggtacaacaaggctaataatcattcgaaaatgacgttctcgcccgtttctgcaccactacaacaacaataacaacaactggaaggggtgggctgcaacccaaggggtgttcaattaccattaccattacggcattaccattaccgatcctgcgcgagaagagggagcaggagcgcaggcacacgaccacaccctaccgcctcagcactggcttgtaaagcacgacggtcacgaacttagccttgaaccggtgcgtgatccccagagcaaccatggacctcgtgttctctttctcgatgtaaaggtggttcagaaccacggtctggggctggggcagcgggctcgactcgtcttggcttggtgggaagctcagcagcgtgtgctgcagatgaggtggcatcagtgggggctcccggccttcgtcttcattcccaggaacagggttgtcgtagctggaatccggtgaaggcgggacttcaaatccaacaacgtggaccccttcatggtcatgcatgccttgttggtccatattccaacagcctgttgccttgtcctgctgggtgctcctcgctggcgaagagaccaacaagagcctcagcacctggcttagggcggcgtcggcggcggcggcccaccggtcgtctgagagcgagagggggacgagagagagagagagacagagagagagagagagacaacgcacgagccgacgatggatgccgcggaaggggggatgcgggttaatcccgg

SEQ ID NO: 22962 - DNA, 750 bp, Zea mays
aatctggtcgcggtcggacactcggcggacgcgggggctggtgcaggtccagggccaggtggtcgtgtcgccgcctccgctcccgcccctcgccgctccgcgtgtcactcgccgcttctcttccattccaccccgcccccattctccctcctcgcgcgtcgcgatgaaagaggcgcaggcttgagcgagaggaccgcgctggacaccaccgcatgctagggtggcagggaggggagagaggggagccgagccgaggacgatggcgctgggcgtgttgttccacggcgcgcagctagcgctggatctggcggtggccgggatgtcgctggcggtggcgctcgggttcttcgccctcatcactaccttgctctgctccgcggcgttcctccaccactccaagcccgccgcgtagtcatagcctccacagcgaccaacgcgtctcaacctctggggatcgtaatactgttgctggtataattcctccacatcaattgcagaggaggtgctttaatcaactgctttatagcacttacagatgcaaagagtagtcgattgcacacatcaggtgatagctataggctcttgtaccacgtgtatgtttctttatgctggtttgtaaacgagatgtttgtactttgtactatagtttttgtaatcagtctctctttcaagatttacgtctcatataaatagtatgtgcattgtttaattcgcatgtttaacggccaaaaatgaaaaaaaaaaaaaaaa

SEQ ID NO: 22963 - DNA, 2068 bp, Zea mays
gccccccccccccctttcttccctttttttttttttttttgaccggtcaaaatgcagagagccggcacatccgcaatcataacagctgcgtctgttttttggtgccaaatcacaagcaaactactcctcaaccaaaccatcactgccaccaccagcagccaaattaggtacaacaaggctaataatcattcgaaaatgacgttctcgcccgtttctgcaccactacaacaacaataacaacaactggaaggggtgggctgcaacccaaggggtgttcaattaccattaccattacggcattaccattaccgatcctgcgcgagaagagggagcaggagcgcaggcacacgaccacaccctaccgcctcagcactggcttgtaaagcacgacggtcacgaacttagccttgaaccggtgcgtgatccccagagcaaccatggacctcgtgttctctttctcgatgtaaaggtggttcagaaccacggtctggggctggggcagcgggctcgactcgtcttggcttggtgggaagctcagcagcgtgtgctgcagatgaggtggcatcagtgggggctcccggccttcgtcttcattcccaggaacagggttgtcgtagctggaatccggtgaaggcgggacttcaaatccaacaacgtggaccccttcatggtcatgcatgccttgttggtccatattccaacagcctgttgccttgtcctgctgggtgctcctccctggcgctcctcgtgctaaagaatttaacgacaaaaaaggaatctggactatcatgcttagtaggctcttgagggtcctcattggttttttacagaaacatctactgcagattgcatgtgttgcacacgttcactaaatgtttcgatgtcatttgtatgtaactggaagtagatgtcctttgtgctactcatccatagatttggaaatctattgattctattcctcatcattacgaagtcagacacactctatttgtccctgtattgtggtgattactttcctttgcagttaactggaatggaatttatatctggtgtaggttgagacggtctcactttaagattatctggctttgctgtgtactgcaacaagtcttgaaagcttttaagattatagaccttgttagtgcttgggttctatgtactcccgcgacctcttgcagtatgtgttcatgagacctttttcgttacatgagtagtagttacttcaagtctatgttcagctgtgcgttctttgttttaggttttggaatcgtcagagacaatctgtgataaggtttatcaggttttggaatcgtcagagacaatctatgataagatttctctgagagacaaacatacaccacatgtttataattcgaaaaggtcagtccatttatttcttgttgtactgaaacaaatccgataacagggtcaggttggtaatagctctctatgttgttggacagtgatagtagctgatttacccctgcaggcccccaccgtcaatcagcgtccctccccctaacaccgcaatcagcacacctttcctgatgcagacagtttccaatcgaagtctcttttccatctttcctgagacagttctggttgattttccatttctcttttttttccagtctgaaacgaaccgaactaatgctgcaacgtaccttacctttagaattggtgtcaagtagagtaaaactatataggataccaaaactatctttcattgtgcatttttctcaagcagagtaaatatcagcattttctacttgttagcagtgggtaggggatgcacatgtttgcgtgtaggactgtgaataacaccgatgtttcacatatccctaataaccatcacccttatgcagtttgattctgatgcaattagttcatggatggatatgtttttgcgctgtccatctctagaatgagttaaaacatatttcttgctcatgggagtactgcaactgtaggccattatctggatgtctgcagtattatctcaggcaatactactttgtttgtaggaaccaccgccagcaaccatgtcccactcgttgagccttggcgc

SEQ ID NO: 22964 - DNA, 739 bp, Zea mays
cattgggtacctcgaggccggccggggctccgcgtgtcactcgccgcttctcttccattccaccccgcccccattctccctcctcgcgcgtcgcgatgaaagaggcgcaggcttgagcgagaggtccgcgctggacaccaccgcatgctagggaggcagggaggggagccgagccgaggacgatggcgctgggcgtgttgttccacggcgcgcagctagcgctggatctggcggtggccgggatgtcgctggcggtggcgctcgggttcttcgccctcatcactaccttgctctgctccgcggcgttcctccaccactccaagcccgccgcgtagtcatagcctccacagcgaccaacgcgtctcaatctctggggatcgtaatactgttgctggtataattcctccacatcaattgcagaggaggtgctttaatcaactgctttatagcacttacagatgcaaagagtagtcgattgcacacatcaggtgatagctataggctcttgtaccacgtgtatgtttctttatgctggtttgtaaacgagatgtttgtactttgtactatagtttttgtaatcagtctctctttcaagatttacgtctcatataaatagtatgtgcattgtttaattcgcatgtttaacggccaaaaaaaaaaaaaaaaaagcggccggtttaccctggatgcttaatcggcaaaataaatttctctcaaaaaaaaaaaaaaaaaaccttag

SEQ ID NO: 22965 - DNA, 1225 bp, Zea mays
caataccacccggggacgctgaaaccgaagatgcaaaagcacactgtctgttgtttatctgaaacaatcagagggtcaaaactaaccatacatccatcaagtaccagataaaggcaagcgcacagagtgcatgtgtgtacagacatactgtcaacagacaccgcgtggacgaaaaaacaaggctagaacaaactgtatgacataaccgagggagtggtgttaagcaaagaagaaggcgagactacacaccaccataaaaggtggacccacacggctccaccatgagataagggacaataacactcaaccataaatggtggatccacggataagatttgatgttaatatgttagcaccttaatcattttttacactagatatattgcctttattatgttgacagattataaaaagacagagtcgtccacataacctgttgtcacagcttttttttttttttttaatatgacagttttgataattatgtcataaaacttcccgcggagccgtggaggctgaccttaaaaactgttttgcagccatgcatacaccattgcataacaccaacaccaagtctatgtcaaccaaactgttctatgattgtactaccagcaactcggtggatgttgaacgcatgtctgtagaaacggaaactttgtgcattttgcagaaactaggagacgtaggttctatggttacatctgacattcagtttgttcagtactactactacaggctgctctccatctccagtctccaccgacaagtactgaaatttgtgaggcagtacagacagcaggcggggggcacatgtggatacgcctatttcacttcagctttgcccagtggctgtacgcagtgatgcagtttacaggtcttccattgctagcagcaccgattgctgcagtcaccggttgtgcaggataatcagcagccgtgaatggttggagcagcctgtggaagaacggggaaagcgtgctgcatcgtgccagccagatgtggctcctgctcaaccaaaggagctcccaagccatggtacagtggttcaagagctcctgtcatgtgtgctgctgactggtttggaggaacacgcgcaaccaaaggaccgaacaacatatctgggccttgagagcgcttgagtcgtgattgatgctttttgccacctagatggatgtcaaatacagctcttgtatcacaagtcacgttgcaaatgttgcagactagc

SEQ ID NO: 22966 - DNA, 1044 bp, Zea mays
gaatgtgttggtgacgatcctgcgaaaaatatcctagtcttgttcatgtcaatattctcccccagccattcggttagtgtcttgagagctatctcgaaaccatcgaccatttccatctcgtctaactttgcatcaccatcttcgaatgaaccatacatgaccttcatcctcatgtcatccttctgcttcctccaccacaggtaagaattgaagacaatgatgtcggcatccctccagacactggcatgcttctcaattctgtctgcccttatgatccggtactccacccggtggataatggggttgtcgctgttagactccaccagtagtggtgaccagtagaaatctatcgttgcgttgtattccaatgccttgaaggagatgagtgagccattgaaggtgcgtatcttgagcctgtcgtcaggtattgaggcctccaccatgcacacgagagagacccattggttcctgttgactgagtcgcccacaaacaccattctcttgtttctcagattttcaagcagcttgatggcatcaaatcttgggaggtcgcatccatgaccatgaggctgccatctccagtgctggtacatggcatccttcctgccatacttgtcacaggccacctcggggaagatgaaggagcacttgagcccgctgtacaatgggcgggacacgttgtcgtacacccaccttcccctggaccagttgcactcctcgttgctggcgtccccctcttgggttgtccctcttatcgccggttcttgcagcccggattccagcttcacctgcacttcttggcgtccatgctcgactgccacttgcacttgctcttcctggcctctgtcgaggaggaacacgatggagctggctaggatgaagaaagccaccaaggaggtcacgatgctcctaactccaaccggagagtggagcaccgtcatcttgccaccacctgctgctatcgccttgtgactggcctctgtcttcatcctctcttcaggcgccccggccggcctggcccccctcttttatggccacctatcg

SEQ ID NO: 22967 - DNA, 1798 bp, Zea mays
gaacagcaaactcagatcattctatttcagataatcactcagtttacataaatccaaaaaatggttagcagcagatcctagaattaatgttggacaacaagcgatttgcagataattcggtggtgttctacttgctcaatactggaacagcaaactcacatcattctttacataaatccaaaaaaaatggttagcagcacatcctacaattaatgttggacaaaaagaacacgatttacagatactagaatgctgggcaagacagatctcctgtctgtctctctctacatgtaacagcaggtgcatccctaataatctaaacggagcagctggcaatctgtactgcactgtacactacatataacaaggccatgtccatgtgtaagcaaaacgaacctgaccgtcggcctagcttcctgctataatgcatcatttgcgctgctgcgtgaggtagccatacaggaactcgttccagacgtcggggacgcctgggaggcaccagtgcgtgcagtccgcgtagctggccgggtccgcgatctgctccttggtcaggggaacgaactgcctcctgaacaccgtgggatgcccgtccttgcggtagtcggacagctccgtgatgttgagtatctggacgcgtatgcctctcggctccagcgtccgccggaagtaggacctggccatggccatcaggctgtagtccgtggttgcagccttgtacccgccgccgggtctgtagctgatcggctccgtttcgttcaggcacttgttcttgtcttgtccgccccagttgctagcccaggaatgtgttggtgatgatcctgcgaaaaatatcctagtcttgttcttgtcaatgttctctgcaagccattccgtcagtttcttgatagctatctcgaaaccatccaccatttccatctcgtctagctttgcatcaccatcttcaaatgaaccgtacatgaccttcatcctcatgtcatccttctgcttcctccaccacaggtaagagttgaagacgatgacgtcggcgtccctccacacgctggcgtgcttctcgatcctgtctgcccttatgatcctgtactccacccggtggatgatggggttgtcgctgttagactccaccagcagcggcgaccagtagaaatctatcgtcgcgttgtactccagtgccttgaaggagatgagcgagccattgaagatgcgcatcttgagcctgtcgtcaggtatcgaggcctccaccatgcacacgagagagacccattggttcctgttcaccgagtcgcccacaaacaccagtctcttgttcctcagctcctcaagcagcttgatgccatcgaatcttgggaggtcgcatccatgaccatgaggctgccatctccagtgctggtacatgacatccttcctgccatacttgtcacaggccacctcggggaagatgaaggcgcacttgagcccgtcgtacagcggccgggacacgttgtcgtacacccagcgcccccgagaccagctgcactcctcgtcgccgccgccgccgccggctcttatcgccggttcttcttggagcccggcttctctgtcgaggaggaacaccacggagctggctaggatgaagaaagccaccagggaggtcacgatgctcctcactccgaccgccatcttgccacctcccgctgctgttaccgccttgtgactgccctctgtctgcttcatcctttcctcaggcgccattgtgcttatcggctctcctcttttatgctcacctgtcgagtctgtagtacactggggcaaatccaatgct

SEQ ID NO: 22968 - DNA, 890 bp, Zea mays
tagatatcttgagtgtaatgtacttggtattttaataaaagcttcctttatcgatcgagttccgcgagtgtcagccatataccattttttattttgcatgattgcttgcaggtgctgcttacaacgccaaccacgccgacagatcggatgaagggaattgcacaagcttcagaaggatttctctatcttgtgagcgctgtaggggttacaggtgcacgctcaaatgtaaacttacgtgtagaacaccttcttagggagatcaagaaggttacagacaaaccggtagctgttggtttcggtgtatcgactccagagcatgtgaaacagatcgtgggctggggagcggacggtgtgattgttggcagtgcgattgtgaagcagttgtgtgaggctgctactcctgaagagggtctggaaaggctcgaggagtacgccaggagtatgaaggctgctatgccgtgagctgatctcactccccgtcacaggcaaggtaattagaacatggttttagcaatattctgggcatgggtttggcattcagaactcatcttagtgctgtacgggtcgttctccggtggtgagaacgaagtctggctttgcctataatagaaaagggttaaactgagttagtgcgacattttgatggaaaagcgagtgattgcgagatatcagttcatgcttattggccgctccttgggcccggttccgctgaaagatggaaatgttagggatgaggttgccctggcctccttgagaggataggaataagagaggataagttcgttatgatttatatggctttccgcttgaacccccccagctggtgtccatggggatgcgggcagaccagtgtctgattggctgccctgaaaatgacattcccttcagcc

SEQ ID NO: 22969 - DNA, 1531 bp, Zea mays
cttgaattaaaattttgtcaggtttgagcctcagttactgcccacagtcgccacagatagacctccagtaccagtcacacacgtgacactcgcaatcgcaaagtcgcaagcggatcgcaaactcgcaatcaaggctgctcccctccgtctccgtgttcgccactcggttcaccgcccgccgccgccgagacctcctcctcgccggctactcctgaccccacaaaggcagcgctcggaggtggccctctgtcgggtggagtggtggacacatccgcgcccatggccaacggcggcgctgcggccggcaagctcaccgtcgccgagaccttctccaacctcagggagcaaggcaagagtgcattcatcccgttcataactgctggtgatcctgacctggtaaccacatcgaaagcattgaagattctcaattcctgcggttcggatgttatagaggttggcgtaccatactcggatccactggctgatgggccagttattcaggcttctgcaacacgggcgcttaagaaaggcactacacttgattctgtcatagagatgctgaagggggttacacctgagctttcttgccccattgttcttttcacatactataatccaattctgaaacgtggtgtgggaaacttcatgtctactatcaaacaagctggcatacatggacttgtagtgcctgatcttcctttggaggagacagcgttgctgaggagcgaggccattatgcacaacatagagctggtgctgcttacaacgccaaccacgccgacagatcggatgaagggaattgcacaagcttcagaaggatttctctatcttgtgagcgctgtaggggttacaggtgcacgctcaaatgtaaacttacgtgtagaacaccttcttagggagatcaagaaggttacagacaaaccggtagctgttggtttcggtgtatcgactccagagcatgtgaaacagatcgtgggctggggagcggacggtgtgattgttggcagtgcgattgtgaagcagttgtgtgaggctgctactcctgaagagggtctggaaaggctcgaggagtacgccaggagtatgaaggctgctatgccgtgagctgatctcactccccgtcacaggcaaggtaattagaacatggttttagcaatattctgggcatggggttggcatccataactcatctagtgctgtacgggtcgttctccggtggtgagaacgaagtctggctttgcctataatagaaaagggttataaactgagttagtgcgacattttgatgaaaaagtgagcgattgcgagatatcagttcatgcttattggcagatcctttttttggctgaaagattgaaatgttagggatgaggttgccctggcctcttgagaggataggaataagagaggataagttcgttatgatttatatggcttttcgcttgaaccccaaaagaaaaaaaaaaaggatgcgggcagagcagtgtctgattggctgcactgaaaatgacattaccttcagacaaaaaaa

SEQ ID NO: 22970 - DNA, 2503 bp, Zea mays
ttttgacttcttgctaagattctggcaaattttcaatcagctggaagagtcgaatgaaaatcaatcatatcatacaattataacgtatggagagaaatcaactgaggaacttcggggcaatcattccgcattcgagaatcatcaatgaggctcattataagcagccaaggatatacaacgggctgcaaatctctgccaaactccagcctttctataagttaaacgcttgttagaaactgcaaaactgtacaacaaagagagaggaggatctactttggtaaagttaactctgaacaatgaacaggattaatccgctaggctagactgaactaccgccatgaaagacataaaaaccctcattgcatatgagaccacactgaatcccggatcttcatacgccacttcatcaagccacagaaacttaacttggcatccaagcttactgcatgcccaacatgcttgtcgagtgcacagaggtctaaacctttgactgagctatagctacgaagatggaaatgatgcctatataagtacagaattacatggtattgatctggtcaatgctcttctggaccacgcatatagtctgggtaatatgtgttcttgttgatcttgcggcaacactgatgagtcatgctggcttctgaagtgagattttagttcacttggatcaacaatcactgattcataggtgttttaaaagagagtagatccctttgcagagaacacctcactacacatatgaatcttaaggtttggccgacttgctaacaacatgcaaatgcttgtcaaccattttgcccacaaaggattcaatcttaattttccttttatcatcaagaaactcaagagtagtcattgatttctctccttctgagcatgtatcaatgatcttgttaacagatttgcgcatgattgttttgtacccctctcggtcgatcttttttcctctatataatggcatcagcagcgaggctataaagttcacgagaccctgttttatatgctccacacctcttgattgccgctcagatgcaggtttgctatcggcaccctgtgaagcagaactacggcatgtgtgcttctgactacttgaatcatcttcatcaggtatgcgtatccgactgtagaattctttatcagcctccatcgcctgtgcctgccacctctcaatggctagaggatccttgacaccatcaatgcagattgtatcagtatccacccatgcccttgtaaaccgaccgtctacaacaacagtatctgttgaatgatcctgagcgtttgctaggcaagctgtctcatttgagtggctctgctgagtaaaattatcatgagacattttcaagctatcaccatcagcgtacttggtgttttcaggcaaatccttaacttcgccattcttggaatcattttctgatatgcactcaagtctcccaaaattatccttcaatgttctttttcttgcatcagattcgtccaaatggtgatcacgcatcacaaaagattggaacgacggtatctttggaagctcacgaggcacacttatctctgcctctacagatgcatatgcctgtgcagctgctatagcagcagctcgagcagcctcagcagcagcgaatgcagcagcttcttcctcagacataggaatgccacattcctccaccttagattcaataccatgttgttgcttttgggaaagcaacttgccatcagacatagcagctgtcacagtttccaatttcatttccttgttatcatacttcttgtttatctttggtggtgattgactacttgcgaatcttgtacgctggcgctgggacactactttattgttgtccaaagttccatttggcacacgtaaggtaggctttcctgattgcagatccttactcttggtcttactcgattcaattgatggcattcgacgcagcaatttgagtccgccgttgctatccttttctctacgaaaaacttcaatccacacactgaccaactgccgagctatagcacgaatatctcggcttgtgtgcacacaaaccttttcctttacagtcttcccaattcctgataaacgtacagctaccagatcagtggaaacaagcacaagcaaacgcacacagtgccgcagtagttgagtagcatttttcccaagtgaatcaagtatccaaaagtttagcgtacttagtccttctttagacccagcaaatgatttaagaacatctgtaggaagcttcaataactccttagccaaatgtaggcgccctgatgttgtctttgcactgaagaacatttcttgcagcaaagattccttgctaacaattggatacattgcatcagatgagttcttacttagagcagtcgaaagttcacatgcttcaagtctatttgacatgtccttgacttcatttctttcactgtctgtctgcatttggtatgtctgtagcgtttctacctcggcaatatagtcactgccagtgttcagtaagtcaacgatgcgaacagc

SEQ ID NO: 22971 - DNA, 984 bp, Zea mays
gcctttttgttgttgagcggcggggctagccgtttatacctggcaaccactacacgacgagggcaatgaggcgaacggcggcgttgctatcggcccactgcggccgcagcatcccgttggcgctcgccgacgtgctcgtctgcccactctctaagcagcctcttaggtactgcgaggtcaacgggtctttggtcagcgactccgctggggtggcctttccagtacttgatgggattccttctcttgtaccaaaagatggaaagttactcgacgaccaagaagtgaaatcagaacaagagtccagcactagggattcttctggttgaatccttgtctatgcaacatctaattgaagcaatatgttgtagtaaatcgacggtaataaaaccaagtgcttcttgtcggaaatcgtcaccatattgccctagaggatgaggtgcaccgtttctgttgagaaggctaatatggttgtcttgaaagacaacaatgaaattggcaaacatagtttctgctttattttcttttactggaataactattctgttcatatactgcatctgatagtacaaaataatagttggactcataattcaaagttatcatgctcaaaggcccctagggcagaaaaaaaaacagttggcttgcttttctttagagtagcaattagctgaacctgccaaaatatgtttttgttagccctgattttggtggatttccccgaaccagccaatgatattatattggtaaaagtaaaaataaagtggacaagggaaggcggcttgtcaggcaaagagaagatctaaagataggattaccatctatctatattgcagagtttgctggaaacgcaaaagaaatactatactcctaggtagcacctgtacggatctccttccagaaaggaaaccatagactgaatggtgggtccgccagcatagcatgaactgtactagtagaagcatgtgcacgctgcaggcatgcaag

SEQ ID NO: 22972 - DNA, 1121 bp, Zea mays
  misc_feature (2)..(25): n is a, c, g, or t
annnnnnnnnnnnnnnnnnnnnnnntttctttttttttttttttttttggaccataggaaatactaatttattactgtagtagagggactttattacatgtaaatatgacaagaaattagcttctcaacatgagcaactgatcaaaggtttcagttgcacaaatcctcaatcctcaaaaagaaccgataattcaagccctcatgagctaattacttagccgaactaaactcatacactcttgcatggctccttgaatcaagacgaacacaaaaaaaaacattgaatacaactctggaaatgattagcaagagttattctataagccacggtgcttgaactgattcccattggcagagctcgccttctttgaaccacagttcaatttcacgcttgccattatcaggactatcacttccatggacaacgttccttccagtttgaactgcaagatcaccccttatagtccctggttcagcttgaagggggttagtagctcctattaatttgcgagctgatgcaacaacaccagcaccctcccaggccatgcagacaacagggccagaagttatgtaatcgatcagcttaggaaagaaaggtttatccttcaaatccttgtaatgctcctgcgccaagtccttggggcactggaaaagttttaagcctttcaacaaaaaccctttcttctcaaagcgagaaataatctctccaaccagaccacgctgaacaccatctggtttgatcataatgtagcttcgctcaacctccgaggaggcgacgatgcgctgcgggacggcgcgagccctggccgccctcccgctccccgccggcgccgtgctcagccccagcccgagccggccgcggggcgtcgttgaagcggcggcgaaggagagggacgccgtcggccgcagcgcgcaggacggccggcgaatggtcccagcaaggggcggcgccgtcctcgcgagagccgacatggtctccatcctttaccacgagtccgtgcgaggcgagagcagagcacagcacgcgacttttggattaggagaacagcacaaaggcgcccttccttctaacagccaagaagccaacccacctgttaccccaaaattctccgactccaact

SEQ ID NO: 22973 - DNA, 1997 bp, Zea mays
cggtaaattctggaagaacctatttaataaagaaacatgttttgattttttttttgcgctcaagaaataccaaaagcacacacaaacaagctcatttaattttagaaaaaaaaatctacgttaaatactctgtaggatatttaaattatattaaaagaacgttatattaattattctttctactcgaccatagacagcactggcctccgttggtattggcagcgctgtggggcttctagttccttttttttggcaacgagagagaacgaacgctaaggggtatttttgtttattttagttcctgtagtgtcctcgagtagaaagagcccagttctacgctgggtctagcgatggaaattgatgatacagatcaattgtcccgagatcagtgggtcgatagaaagagcccagttctacgctgggcctagctcactgcacttccatcagcggctccaaggtagtcatttcgaaaggaatcaagagcacgggcaaactcataacacgcagagtagcaacgttaacgtcgcataagctgtagcaaaatcagcaaatcagtgagcccaacaagcaaacaaaatttcgacgatttctcacgtcgctcaatctaacaaataatggcacaccgcaactgactttaatccagctggtaccgtgttgtattgcatgcaccatccatcgcatcgcttcttcccaccagcaccaggcctgatcaggcaataacggcggtagaaatgggtcaactgctaaaacactgtataggcttccatcttatggggaagcccaggtctcaccatttcactcgtcgtctgaattctcgaacttgatcgagtgggtttgcaggtcgatttgcccgcccctgtaggtgccacgcttcttcttggttttctcgtgcctaaacccccttcccttgacttggccaaggatcctgttatgcttgtagaaggatcatgtagaagtccttgatcccttatcgtagttgaaagaaaacagaacgtaacagcaacaaccaacaagtactgaccttcccttgacttggccaaggatctcctgtgcctttgcgccgtaaccggtgtctgcgccaccctgcaatagaggtatagcaccaataggccatacaaggtttagcttgataaatgctagtctttcagcatgtgcatgtatgatcaacaaagcagaaaagcaccttagcccaatacgagttatcctgaagcctgtcatctgcaaatctgacgtcgtccaccttaatacgttgaaatggggtcacagtcttgggctacagtggataaacaaaaaggaaatttatcggaatattgatgacattgatcagataaatgatgcctacttcaacttgctcagaacaggaaaggctgatggtcccaataagatgtcactggtcagattactcacagtaatctctattatacaaagtactgacatgcaatgcaatgatgccagtgggatccaaaatctcaggcaatgattttctcaacatcctcatggtgaattcaggctagtggacatcattaccggcgaccaattattgtggatgcatttctgaaccataatgcaaaaagcaagttgctaaggaagctagtagtgaatgaagcatctggtataaacaggatctaagaattatggataacgcctcctaaggttattaaactacaggaaacaaagtgcaaaaataaagggatatagaccaacagttagaaagcaagaaagaaagctgcatacctcagatgaatgtttctgccttttgcttggttttgtgttgctttcttcttttttatcctctgcaaaaccattgcttagactttcgttggctgtgcaatcttctttcccagtcacagggggaatgcttccttcaacttcttctagcttccgttttttgccagcaactgcattttcatttgacgacttcccttggttaccttcttcaatctccattacactcttgttcgcatcatcttgttttgggactgaatctttccctgcag

SEQ ID NO: 22974 - DNA, 1708 bp, Zea mays
aaaaagaactttgcgtgtttcacagttttatgatctgcattctttctccggaatcacaaaagtacgctgttgttatgttctaccagcaagtcatatgttccttaaacaacacacatggacaccttccgtatccgtttcacagcacccaaaatgtatatatgttgcaagcactccaacacagagatgagagaataaatatgctacagacacagttaatcaactatacaatgctgctctgcagcaccaactgatagacttagcctcacctacctgtcatgtcagagtagggcgtgttgggacaatttcaattgtcagcacatcagactacagctgctagtgatttcatccgattagggaggaggtggggtttttagccttggaacagtgaaacttggcgggaggagcacaggtgacacagcagctttaacttgcagaagccttgtgtaacatctctggttaccacacgacatggaggacttgaaggagctacgcttgcgcttctgattagtctcagacgcaagtgctcttgtagtcttcacttctcgcctatcaggtgtgacctgggaagttcttgatatatcctctaaaggtagccattcagacttagattttctgtttgccttattagcatccttcttcaacatcctctgagtctccggttcaccatcttcatttttaccagttttatgatctttatccttaaccaaggagcgcaagttttgcagctcatcctcaagaattgagatcctctgtttggcatttgacacctctatttgtaatttatcaatttcaccatccttcttttgggctgccgcttgcagctcatctacattctgtagaagcttttgtgccgcttcggtagtctgctttacctctatgtgcttgctcttaatagttccagtgtaatctttttccatatttttgagctggttccaaacaaaattcttttctgcttgtaatgctgaaatttccttgtccttttctgatctcattgtcttgtaagctttctttaatttctgtaactcttccttagtatatttcccacttttctcgtgatctgaattgtcggtgctaatctgcacctgactttcaaccttcttcagtttttcctttagctcagtattttcagcagccaaattcgaaatacaacttttgaagttctccaaatcactctcggcaagttctgcgagtttctgatggcagtgaatctgaagctccttgccgccaagacgcgccgccgtctcagcctcaaggactctcttgctgagctcctcgtccttgcagatctgctggaggcggacctgggagatctcctggcgctcgcggctggcgctctgcaggaactggagctcggagatgagatgctcgcgctcgacggagagctcctcggcctgcgcgtacgcctggcgcagcatcttcacgagtcggtcgtacgcgcggcgccacgcgggcaggtacacctggcccggaacgccgggcgcgggcgcgccgtcgtcgtctctggccatggaatccgctcgaatcggagagcagagggaggcagagccgcagcagggacggccgccgcttggggtttcctgtggatctgcgatttgaccgtttgagccgcgaggagcggaggagcggtggcggcgtggagcggaggagcggagcggagatgaccggtccgttgaatcccggccggcctcgaggcaccctatatgactat

SEQ ID NO: 22975 - DNA, 866 bp, Zea mays
ggcccccccttttttttttttttttttttcacaaaacgtatgcgtcacacgtttccattggcatgcctaacgtagcacattctgcaaggcggcccccccccacctttttttttttttttttttggagattataccatcctcgtcatgtttgtgtgtgttaatgctcaattaaccgagtagcacaccacaacgatgatttatacttcattactgctgatcttagagcaaaataactatcaaccacatttggagactagaagcacataagaatctagaaatgtactttcttatttctgggaagccacaaacatcagacaaaaaactttattattgaactataactcataagaaatctaaaagagggcaccaccaatgatgggttgttggtagaacgctgttgggtttgtcaaagcaagttggttgaatggcagcaattgttgcagttgtaagagggtgccagcgttaggcgcagcgtgctggtagaacggcaacaactgtggttgtgtcaagaaggtagcagggctcacaccagctagctggctgaatggtagtagttgttgctgctgtaaataagcaggagagttcaatgctgccagttggttgaatggaagaaattgctgggggtaggcagcaggtagctggctgaatggtagttgttgttgttgcaaataagaagcagagttcaatgcagctagttggttgaatggaagaaactgctgttgctgagagtaggcagcaaggtttgctagcacaagttgttgtagttgttgtgccctgatgttttgtgccaataaatgcaccaaaggtaactgctgtaatagggctgatgattgttggagcatctccccccgcggctcaaattcgct

SEQ ID NO: 22976 - DNA, 781 bp, Zea mays
ggccgctttttttttttttttggccgcttttttttttttttttttcacaaaacgtatgcgtcacacgtttccatcggcaagcctaacatagcacattctgcatggctatagggtcccacctaacaaagtacatatttttggagattataccatcctcgtcatgtttgtgtgtgttaatgcttaattaaccgagtagcacaccacaacgatgatttatacctcattactcccgatcttagagcaaaataactatcgaccacatttggagactagaagcacataagaatctagaaatgtactttcttatttctgggacgccacaaacatcatccaaaaaacttcattattgaactataactcataagcaatctaaaagagggcaccaccaatgatgggttgttggtagaacactgttgggtttgtcaaagcaagttggttgaatggcagcaattgttgcagttgtaagagggtgccagcgttaggcatagcgtgcaggtagaacggcaacaactgttgttgtgtcaagaaggcagcagggctcacatcagctagctggctgaatggtagtagttgttgctgctgtaaataagcagcagagttcaatgctgctagttggttgaatggaagaaattgctgggggtaggcagcaactagctggctgaatggtaattgttgttgcaaataagcagcagagttcaatgcagccagttggttgaatggaagaaactgatgttgctgagagtatgcagcaaggtttgctagcacaagttgttgtagttgt

SEQ ID NO: 22977 - DNA, 2153 bp, Zea mays
gttttttttttttttttcaagcaacagaggaaagccaatctgctgctacaattatcatatccaacgtttcgatgtcaaatcccccaattacaattcttaagacacgtgtaagtataccatttacccgacttctcttcagttccagcctttcaaaacaagaccttgcacgtcagcaaataaatctcccatctcaggagataagaatgtacccttcatcagaggccgtggatgaactcggcgaggcgccatgccggctaacaccttccctgaccttgccatgctgctccgcttcgtgctggaacatcgaaaccaggtgctggagctccagcttcctcaccttcaccttctcactgttaactggattctgtaacccaagatacagcatccccatgccgattaggacgatccctacaaagaagagaagtcccgcgaacaaaccaaaagcgtagggggtgttctgcgctccaggtatgccatcgacgttgattccgaaaaggccagtgattatggataaaaccatgccaccgccgccaaaaattgccagattatgtgtaactctgaggcttctatcttgtagccatgcacggacagtgctctgcataacatcctgaatagtgaacaagcgcccgcgcacagcttcctgctcttccaacatgtccctcgtacactttctaatactctctagaatagctcttgtggcattacccctcaaatgtctgagaagctcaattaatatctcttcccttgcatgaagtgaccatttaaccctgattacctgtgttgctaaccttctgatttcctgattcagtatgatgctaacaagattaagatcttcatgatttctcctattcacaaatttcaattcaatttcatctgcttccccaaatacatatttccggaataatctgtcatcccaacgtgaaagacggctgaccaaatgtgcaattacttcatgcactgatctaggtgtttggcttccaccagcaagaagcaactcctgcacttcagtcactcctaacacatttatattggatgaagggcctttgacatgcattgttgtaacaagaaaattttgtgcttgccaagacctaagcacaataggtatatcttcctcttcatgatttgggtctcctattgactggccaagaagctcaaataacagccctcctgcaactctaactgggacctcgtagagcaggtacttcatccggtcgcttatcagtttgctctcatctctcagtgcaattctgatggcaggatgcatccagtgagcgctattcaaccatgcatctattgaaggatggcctgcggtgacatgacaccaccaagtaggtcccacagggcgctgccagtatggagctgcaagatcagccacggtgtaatcatcctcgctatcactcatctccatcaactcattctcccagctggagtctgactgaaccctcaggaccagctcggcgatcctattccatccaataggcacccatttatgatccaaaatctccccagcatacaatggcctatctttgagcactgaaggatcgttactgaaatcagtctgctgggggttttccaacacaatgctctcatccactttcggctcagtgatctggtgcccattccttcttgagtgcttcctcgtacacatagtggggcccttctcctgtatctgctcagttgccagccatgatttgtgctgaacaggcttcctgtgactcttgaccagctcaaaagcacagatgagcccatccgtccagagctcgctccctgggatgggctctttccctagactgggcttggtaacaccgtcttgtgtcttgggcatgctgctgacgtgaggcggctcctcctcctctgcaccattcatcttcccatcaaattatatctacctgctgcacgccgccgccgccgccgtaggtatcctccaagccatcggcgtcaccccaccggtggcggcttcaaacgccgaggccgaagtcagtgagcaatatctctggtctggacagcaagaacgggagaacctgagcttgatgccttgatccagattcttttttttttcgaatcgccttgatccagattcacgactcacgaacaaagcagcaacggcgtagccggcctcgcgcccgcgccatggaagccgaacccgaaggccc

SEQ ID NO: 22978 - DNA, 2143 bp, Zea mays
aagaaacgatcacagccgcgatctcaagcaacagaggaaagccaatctgctgctacaattatcatatccaacgtttcgatgtcaaatcccccaattacaattcttaagacacgtgtaagtataccatttacccgacttctcttcagttccagcctttcaaaacaagaccttgcacgtcagcaaataaatctcccatctcaggagataagaatgtacccttcatcagaggccgtggatgaactcggcgaggcgccatgccggctaacaccttccctgaccttgccatgctgctccgcttcgtgctggaacatcgaaaccaggtgctggagctccagcttcctcaccttcaccttctcactgttaactggattctgtaacccaagatacagcatccccatgccgattaggacgatccctacaaagaagagaagtcccgcgaacaaaccaaaagcgtagggggtgttctgcgctccaggtatgccatcgacgttgattccgaaaaggccagtgattatggataaaaccatgccaccgccgccaaaaattgccagattatgtgtaactctgaggcttctatcttgtagccatgcacggacagtgctctgcataacatcctgaatagtgaacaagcgcccgcgcacagcttcctgctcttccaacatgtccctcgtacactttctaatactctctagaatagctcttgtggcattacccctcaaatgtctgagaagctcaattaatatctcttcccttgcatgaagtgaccatttaaccctgattacctgtgttgctaaccttctgatttcctgattcagtatgatgctaacaagattaagatcttcatgatttctcctattcacaaatttcaattcaatttcatctgcttccccaaatacatatttccggaataatctgtcatcccaacgtgaaagacggctgaccaaatgtgcaattacttcatgcactgatctaggtgtttggcttccaccagcaagaagcaactcctgcacttcagtcactcctaacacatttatattggatgaagggcctttgacatgcattgttgtaacaagaaaattttgtgcttgccaagacctaagcacaataggtatatcttcctcttcatgatttgggtctcctattgactggccaagaagctcaaataacagccctcctgcaactctaactgggacctcgtagagcaggtacttcatccggtcgcttatcagtttgctctcatctctcagtgcaattctgatggcaggatgcatccagtgagcgctattcaaccatgcatctattgaaggatggcctgcggtgacatgacaccaccaagtaggtcccacagggcgctgccagtatggagctgcaagatcagccacggtgtaatcatcctcgctatcactcatctccatcaactcattctcccagctggagtctgactgaaccctcaggaccagctcggcgatcctattccatccaataggcacccatttatgatccaaaatctccccagcatacaatggcctatctttgagcactgaaggatcgttactgaaatcagtctgctgggggttttccaacacaatgctctcatccactttcggctcagtgatctggtgcccattccttcttgagtgcttcctcgtgcacatagtggggcccttctcctgtatctgctcagttgccagccatgatttgtgctgaacaggcttcctgtgactcttgaccagctcaaaagcacagatgagcccatccgtccagagctcgctccctgggatgggctctttccctagactgggcttggtaacaccgtcttgtgtcttgggcatgctgctgacgtgaggcggctcctcctcctctgcaccattcatcttcccatcaaattatatctacctttcttgaagtcgctggcaaaccccgtccaccgcacgctacgttataagcaagcaagagtacagtgaactagcttcgcaggttggagcagcaaaaggaattttcaaggaggcggaggcggaggggtcaggtgcggaggtggaggcggttaccggagcgcgagagacggcggtgagggacccgggtctgagcgtgggacatgtagagtggattggagtggggtgcttccagaatcggaagcgtgggc

SEQ ID NO: 22979 - DNA, 3216 bp, Zea mays
cccacgcgtccgaacaaagctaatcctggtttccacaaaagcaactcaaacttctaaaccggcccaaaggtctaagccaagggaaaaaccttttttttggtgaaaaggagtgggcatgtctcccacacagaaggcgagatattgtattggatggtgaaagcaatgatttatttgttgctatggaaggatttgatgaaacatttgaagtttcttccaaaggagagaacaagaatcgcaaagggcttcttaactggttcaaacttcggaaacatgacggtggttctaatgctccaagcttaggtggtgaccaatctagcctgaggaaagcattggctgccccttggacacccgtagaaattggacttaattctcaaacagagcaagagatgtctaattctcccgagaatctatcagctaacctactgagcattgaccatgaagaatttcattctgatggactttatggagaagaagttttttgggtacaatatatgagcacatctttttttgtttattctactactcatctaatcagaaccaatgcaggatacgtaagtatccttgaaagttagcactgtgataagtttgtgtgctaaatggttcgctgcaataaatgtattcaatccacgtaaggcatttctttttcagaagctactagcagtggtacatgtaatgccttaaataacccaaatcaaaatttgagttcttttgtaggataaaatttcagtagatggctgtaaatgaaagtaaacacacgagtagataaatgttgaaattccctatgcaatcagtattttctcatactaaaaataacactatgtaccaacaactaaaaagttcttgaagcctaaaactatgctatctcttgatcaactaatggatacaaatgtcgcatcatcttgtttgttttgaggaatagactaaacaaattgtggtgttaccatctgatacatgtaatggtgacaggtcaccagaaaaacatcagatcatgttgatttattgagagagcaactgaagatcctatcagaggaggttgcattacataaaagtgttctaaagcgactcgtcgaaggagctggaagaagcacaatgaatgggcatgtcgaggtaattttcctttctgcaccattcaatatgttattgtggtatttcttgttgttgaaaaccataaactgtatatatttgaagatcgaaatgaaaaaggtcagtgacgagattaaggacaagcagcagcagatagcacatttagaaaggcagattaagggggagcttgaccagttagaacatacaccggtatattatctgcagtcaattagttttcaattactttttattgtattaaactgttgcaacggttttccagtctcatgctacgctcctggagcaggtcaacgagaaagcatttgaacttgaggtacataaactctcctcagagcatgcattaaaaagatggatagtagtttacccttgtttatggtgaacctggaggtggagtcaaaggaatcagagtagagaatatagaatgaaagccccaaaatgcttcatgtttaattttctcattcttgtcaaccatataactaatcaagagcatttgaggtaacttaatttttccctagtctagcctaggatccttgaccctcaagaggtggcaaagtattaatagatactccactacagtattgttttttcagtgtttgtgtgccattcttgttctgcctgtattttataaaggctcctttttttgtttattgcaggtgaagacagcagataacagaatattgcaagaccagctacaacaaaaggtaacagtttgattgtaagttaaattaaccaaaaagcacaatcttatatcattccacattgtcttgttttcagacgagagagtgtcaggcattagaaagaaacagttgcccacttacacgaacagctttcccaagctcttgaagctaatgatttattgtcagaaagcatcatatttcagcagtacacagacaacaaccttcaaactggatcgcaaattcacattgaaaatccagaatctatagatatctctgatgaactgcatcagaaggcagagcaggtttgccttttctctgcactaaggatcaaaatcatttcgatcaactacagagtttttgttgtagtagttattgtgctagatttgaggaatttgactaacattatctattctctcaccagtcagagattagactaacattatctattctctcaccagtcagagattgatgaattgaagcaaagattgtgtgagcttactgaggccaaaactcaactagagacccacaatcagaagctgcaagaggaaagcatgtacgcaaaaggcctggcctcggctgcaggtgtggaactgaaagcactgtctggggaggtcaccaaactcatgaaccacaacgagaggctcgcgaacgatttggctttggcaagaaattcaacacgagtgagaagtggtcatagggttgggaggagggatagctatactaaacggcttgagccagcgagtagaagagatgttcatgctagcagtgagagggaatcagctctggaggtcatgcttatggcgaaagaccaaagagaggcagagctccaaaagaaaatcgaggagtccaagcagaaggaagccttcctggaaggggagcttgcgaacatgtgggttcttgtggcgaaactgaagaaaggtcaggtaattgaccaagatgatgtctcgatgccgtacccaatggatcgtgattcatgaccctagacaatgacaaaaacaattattgaatcggctatgcttcggcattgcactttccttgtctgtggtggtttgcaccagtgtgaatccgtgtatctatattgccggtagttgtaattagctggattggaatcttgtaatgtatataacaatcagattttgccttgttctcaggattgtcatgcctgtctagtttgttcagggctttcaacaattatactgtacatagattgtcgagtggaaagaaatgaaaactcgagcccggtaatgcatctcccccaaataaagtgttttgaacttatgaaatcacacattgcattttgaagactaagcaatttgaacataacggtgcagtgtgaggacacagttttgttgatcagatcacctctccttttgaaccatcctttattcctttcctattgggcttcagtgctacgtaaacgatcttacttttagagata

SEQ ID NO: 22980 - DNA, 890 bp, Zea mays
tcggaatttctttcccaagctcttgaagctaaggatttgttgacagaaagcattcagctacgtaggcccccccccaacaaccttcaaactggatcgcaaattcacaaagaaaatccagaatctatagatatctctgatgaactgcatcagaaggcagagcagtcagagattgatgaattgaagcaaagattgtgtgagcttaccgaggccaaagctcaactagaggcccacaatcagaagctgcaagaggaaagcatgtacgcaaaaggcctggcctcggctgcaggtgtggaactgaaagcactgtctggggaggtcaccaaactcatgaaccacaacgagaggctcgcgaacgatttggctttggcaagaaattcaacacgagtgagaagtggtcatagggttgggaggagggatagctatactaaacggcttgagccagcgagtagaagagatgttcatgctagcagtgagagggaatcagctctggaggtcatgcttatggcgaaagaccaaagagaggcagagctccaaaagaaaatcgaggagtccaagcagaaggaagccttcctggaaggagagcttgcgaacatgtgggttcttgtggcgaaactgaagaaaggtcaggtaattgaccaagatgatgtctcgatgccgtacccaatggatcgtgattcatgaccctagacaatgacagaaacaattattgaatcggctatgcttcggcattgcactttccttgtctgtggtggtttgcaccagtgtgaatccgtgtatctatattgccggtagttgtaattagctggattggaatcttgtaatgtatataacaatcagattttgccttgttctcaggattgtcatgcctgtctagtttgttcagggctttc

SEQ ID NO: 22981 - DNA, 973 bp, Zea mays
ttttttttttttttttggatatctgctttcaaagcggaaaaatcacagaatacatctgtacatatccagccagctcgataccaaattcagaattgcgaacaaactaatctggaagaaggctaatacaatgcgctactagactatagtaacaataaaattgtatgctactaaagtccgccagggtaagggaaaaaaagaggaaaggccaagaaagaacaagggcttccatttatctgttatatgaattattattagcagcgccactcatcaaggtcaaaatcatcatcagatccacactcaagaaacaagccagtagacttgcgaaagacgataaatgacttgccatcctggttcacccttctgacagaatgttccgcatgtgttaccttctctgagattgtttcgtcaagttccgataatgtgttggtctcctgcttcatatgatgttcgtacttctcaagcaatttcttcttttcaacttcaacttttgacaacaggtctctgaaagtctgcatgtgagcatccttttctttacagaacgtatcatatgtttcctgaaacttgctgtactcttcgttcagtgaactctcacactgctctttggaagtgttagacagtacttttagcaaattctgtctttcctcctcaaatttcagttgggtttcttctagcatagtctgaatatctgctgccacactggcaatgacctgctcacagatcttctgcccgtccttgttggccccacccttgataagccgcagcaggcacacgatctccctgaggtcactgaccaggtccccgtcagagtcagaaccagagtcgccgccggaggaggcgacgtcagagtggcggggccgcttagccggactaggagtgccgcacgacgcggccatccgtcctcccccactgcgatgagtcgtcgtcgtcgccgtcaccgtcgctggacgctgggtggaaggaagaaggtgggaat

SEQ ID NO: 22982 - DNA, 3603 bp, Zea mays
tgttatcttaacttagaaaaatataaaattaatttcattattttttttaaaaaaaatcaagatctatctaatgtatatagtttggagttgctctgatacacatattcataattttattaataacttgagaaggatcaggagaggacaccaattatattgactatatcgagtagtgggagtacaataagaacacaaaggtcatatcatcattcacatcttgattatgtagtcatgctactagagttgctaatgctttatttaaatacatgatgatggtttagttattgtattacattatcttattttgttttcgaccttctaccttgtattaaaatttcttaggttaagtcatatgactagttctatgcatcatagtttgatgtgtgatattgctttagggttttcgatggttattgatgtgttttaaattagatagttttattttgtgaggtgccgatttgtgactttctgactatatgtatgtatgtgcaatgcttgtcatcacttgtatacatgagatattgctttaattgtttgtgagatatgtttttatccttctgaatttgtgaatatttatatgctatcactaatttctattggatgtatgacttatgtgatttttaggtcaattaagcatacatgttatgatgtttattgatcgtattttagatttcgaccataacatattgaactttcgttttaaatattctcaaactatcgatgccgtttccgttttttagagttatcgttttcgattttattttcgagaaaaaaataaaaacaaaaatagttatagtgttgatcgatcgttttggtccctacctgctatttgtgctggagctgtgcaaaactcaaatgattttgctggcaaatttagtgcattttgattaggaggtcgtcccattttggcgacttggcagcatgcaaagaaaggctctacagcgttaaccatcacgattcaggagcaacggtcacctggcttcgttctgggccgaacacctcgcaaaccgcctgggtgctcgcccgtcctcctgaatccaagcgcgacccttcctttggcgtggcgtccccccatatccccccagggcccggtacccgcctctcgcgtcgttccgttccgccatgcgcgcaccgaggcacggcagcatgcgcgcccacgtcgccctggccttcgcggcgctggtgctggccggcgacgccctgcaaccggcgctggccggcggctgcggcttcgactacaaggatgccctcagcaagaccatcatattcctggaggcgcagcgctccgggaagctgccgcgcagcaaccgcgtaaagtggcgcggcgactccgggctcgacgacggcaagctcgccaatgtatggtgaattggtgatagatatggtggtgttcgtcgtcgtcttctttctccatttccatttccatggacattattaattggtcgtcctcgccccttgttcatctcatggatgctgatgcgaaactgacacatataatgggatgtcctcccaactgattaaaaaaaagatacaatatatcctgccagtggcagccatatatagcggtatggcactgacaagagcttaatgtgttatgtggccgatggatggatggatcgaccgacgcgagcaggtggatctcaccggcggatactacgacgccggcgacaacgtcaagtacgggctcccgctggcgttcacggtgacgacgctggcgtggacggcgctggcattcaagcccgagctggagtcgaccaaggagctgaagcacgtgcaccaggccatcaagtggggcaccgactacctgctgaaatgcgccgccaggaagaacaagctgtgggtgcaggtgagcggccggccggccggcgtccgtgcgcgttggattaattacgatcgatcatcgtgacacgtaccatcgtcaggtcggcgatcccaacctggaccaccagtgctgggtgcgtccggagaacatgaaggcaccgcgcacgctgtacgagatcgactcgaagacgcccgggacggagatcgccgccgagacgtcggccgcgttcgccgcctcgtccatggtgttccgcgacgacaagaagtactcgcgcaagctgctgaacaaggcgaagctgctgttcacgttcgccaagagccacctgggcagctacgacggcgagtgccccttctactgctcctactcgggctacaacgacgagctgctgtgggccgcgacctggctgtacctggcgacgaggcggcaggtgtacgcggacttcatcgcccacgaggccatctcgtcgagcgtggccgagttcagctgggacctcaagttcccgggcgcgcaggtgctgctggccgagttcaacatgacctcggcgggcggcgcgcagaacttcaagtcgcaggcggacaacttcgtgtgcgcggtgctgccggacacggcgttccaccaggtgttcatcaccccgggcggcgtgatccacctccgcgacggcgccaactcgcagtacgtgaccagcacggcgttcctgctggtggtgtacgcggacctgctgctgcggacggggcagacggtgctgtgcgggaaccagccgctgcccccggcccggttgcacgagttcgcgcggcagcagatggactacctgctgggcgccaacccgcggcacagctcctacgtcgtgggcttcggcgccaacccgcccacgcagccgcaccaccgcggcgcatccacccccgtgctgccccccggcacggacgtcaactgcggcctcagcttcggggactggatggcgcccgacaagcccaacccaaacgagctcaccggcgccatcgtcggcgggcccgacaagaacgacggcttcgtggacaagcgcggcaactcctcctacaccgagccctgcacctacatcaactccctcgccatcggcccgctcgccgcgctcgccgtccgaggcgtgcagctcgtcgccacgcagtgatctatccccatgcgtgcgtgtgtgtcccgctgtttcgtttcttccctgacatgatatgatttctactccgttactgatgattcattgattccggccgcccccgcattgttcattatattaggtgacgtctgcgggcgcgtgcggggatccatccaaatctctcactcgctattgtttctgtacgtacgtacgtgtacgtccaagattataatgatactcataataatctcgtcgcaaaaaaaaaaaaaaaatgtgcgcccggttaggtctctgttggctgttaggggacgggcgtgcgtggagcggtgcaccgggttctggaccacccaccttttccgacgagcgcggatacatgtacacgtacggatgctcgctcgtgtgcgtgcgcgcccgcgcgcttcagttttttaaccggaacaaactttttgtttagaaaatctatgaattatatattgtgaaagtatttttcatagaaaatctaaaaacataaatcatatgccatgaatctatataagtttttttccttaaaaaatcggtagttacaaatatagatatttgacttaggatagatccaatacagcatgtaagggagttttttttttggtttaggtagtactcactttggtctaaatgcaca

SEQ ID NO: 22983 - DNA, 1756 bp, Zea mays
  misc_feature (1499)..(1499): n is a, c, g, or t
tcgcgtcgttccgttccgccatgcgcgcaccgaggcacggcagcatgcgcgcccacgtcgccctggccttcgcggcgctggtgctggccggcgacgccctgcacccggcgctggccggcggctgcggcttcgactacaaggatgccctcagcaagaccatcatattcctggaggcgcagcgctccgggaagctgccgcgcagcaaccgcgtcaagtggcgcggcgactccgggctcgacgacggcaagctcgccaatgtggatctcaccggcggatactacgacgccggcgacaacgtcaagtacgggctcccgctggcgttcacggtgacgacgctggcgtggacggcgctggcgttcaagcccgagctggagtcgaccaaggagctgaagcacgtgcaccaggccatcaagtggggcaccgactacctgctgaaatgcgccgccaggaagaacaagctgtgggtgcaggtcggcgatcccaacctggaccaccagtgctgggtgcggccggagaacatgaaggcgccgcgcacgctgtacgagatcgactcgaagacgcccgggacggagatcgccgccgagacgtcggccgcgttcgccgcctcgtccatggtgttccgcgacgacaagaagtactcgcgcaagctgctgaacaaggcgaagctgctgttcacgttcgccaagagccacctgggcagctacgacggcgagtgccccttctactgctcctactcgggctacaacgacgagctgctgtgggccgcgacctggctgtacctggcgacgaggcggcaggtgtacgcggacttcatcgcccacgaggccatctcgtcgagcgtggccgagttcagctgggacctcaagttccccggcgcgcaggtgctgctggccgagttcaacatgacctcggcgggcggcgcgcagaacttcaagtcgcaggcggacaacttcgtgtgcgcggtgctgccggacacggcgttccaccaggtgttcatcaccccgggcggcgtgatccacctccgcgacggcgccaactcgcagtacgtgaccagcacggcgttcctgctggtggtgtacgcggacctgctgctgcggacggggcagacggtgctgtgcgggaaccagccgctgcccccggcccggttgcacgagttcgcgcggcagcagatggactacctgctgggcgccaacccgcggcacagctcctacgtcgtgggcttcggcgccaacccgcccacgcagccgcaccaccgcggcgcatccacccccgtgctgccccccggcacggacgtcaactgcggcctcagcttcggggactggatggcgcccgacaagccaaaccccaacgagctcaccggcgccatcgtcggcgggcccgacaagaacgacggcttcgtcgacaagcgcggcaactcctcctacaccgagccctgcacctacatcaactccctcgccatcggcccgctcgccgcgctcgccgtccgaggcgtgcagctngtcgccacgcagtgatttatccccatggggccgggcatgaccatgcgtgtgtttctcgcgcgctgtttcgtttcttccctgacatgacatgatttctactccgttactgatgattcattgattccggccgcccccgcattgttgattatattaggtgacgtctgcgggcgcgtgctattgtttctgtacgtacgtacgtgtacgtccaagattataatgatactcataataatctcgtcgtaaaaaaaaaaaaaaaa

SEQ ID NO: 22984 - DNA, 1831 bp, Zea mays
ccgccgccatgcgcgcaccgaggcacggcagcatgcgcgcccatttcgtcttggccttcgcggcgctggtgctgggggggggctccctgcaaccggcgctggccggcggctgcggcttcgactacaaggatgccctcagcaagaccatcatattcctggaggcgcagcgctccgggaagctgccgcgcagcaaccgcgtaaagtggcgcggcgactccgggctcgacgacggcaagctcgccaatgtggatctcaccggcggatactacgacgccggcgacaacgtcaagtacgggctcccgctggcgttcacggtgacgacgctggcgtggacggcgctggcgttcaagcccgagctggagtcgaccaaggagctgaagcacgtgcaccaggccatcaagtggggcaccgactacctgctgaaatgcgccgccaggaagaacaagctgtgggtgcaggtcggcgatcccaacctggaccaccagtgctgggtgcggccggagaacatgaaggcgccgcgcacgctgtacgagatcgactccaagacgcccgggacggagatcgccgccgagacgtcggccgcgttcgccgcctcgtccatggtgttccgcgacgacaagaagtactcgcgcaagctgctgaacaaggcgaagctgctgttcacgttcgccaagagccacctgggcagctacgacggcgagtgccccttctactgctcctactcgggctacaacgacgagctgctgtgggccgcgacctggctgtacctggcgacgaggcggcaggtgtacgcggacttcatcgcccacgaggccatctcgtcgagcgtggccgagttcagctgggacctcaagttccccggcgcgcaggtgctgctggccgagttcaacatgacctcggcgggcggcgcgcagaacttcaagtcgcaggcggacaacttcgtgtgcgcggtgctgccggacacggcgttccaccaggtgttcatcaccccgggcggcgtgatccacctccgcgacggcgccaactcgcagtacgtgaccagcacggcgttcctgctggtggtgtacgcggacctgctgctgcggacggggcagacggtgctgtgcgggaaccagccgctgcccccggcccgcgcgcccgccctcgcgccccagcggatggactacctgctgggcgccaacccgcggcacagctcctacgtcgtgggcttcggcgccaacccgcccacgcagccgcaccaccgcggcgcatccacccccgtgctgccccccggcacggacgtcaactgcggcctcagcttcggggactggatggcgcccgacaagcccaaccccaacgagctcaccggcgccatcgtcggcgggcccgacaagaacgacggcttcgtggacaagcgcggcaactcctcctacaccgagccctgcacctacatcaactccctcgccatcggcccgctcgccgcgctcgccgtccgaggcgtgcagctcgtcgccacgcagtgatctatccccatggccatgcgtgtgtgtcccgctgtttcgtttcttccctgacatgacatgatttctactccgttactgatgattcattgattccggccgcccccgcattgttcattatattaggtcgacgtctgcgggcgcgtgcgggggatccatccaaatctctcactctgctattgtttctgtacgtccaagattataatgatactcataataatctcgtcgcaaagttcgcgtgaaaaaaaaaaaaaaaaaaaaaaaaaaaaaaaaaaaaaaaaaaaaaaaaaaaaaaaaaaaaaaaaaaaaaagggcggcgctcgcgatctagt

SEQ ID NO: 22985 - DNA, 2046 bp, Zea mays
tttttttttctttttttactctgaatttaaatatattgccttgtttaatatttaacataatcaaatgacacattacaaatcttaacactacaaaaaaatgtatttccatttagaattgacatttagggtaccaagcacaaagaataaagtactaattggaatgtgtatttcaaaacggtggaaattatgggaataacagacatgtacatactgaacagcataggcgaagcatccccactcccactcacctcaaagggctaccgcatatttatccaaagatgcgaggaagtaacaggggatgttgcaggtcctcctaaaaccatttccactttcttatcgtctttcttcctcacaggtgtggagcattcattgaaatcgagcacccgtgcctctaccatgagtatcgatggaggtttgcttgtgacatgctcatgcttcaaagctgtattttctatattttctttgtcagagttttccttgttatgttgtttccatgggcttccatttgccagaacttcatgtgcttcctccacagcagaagcactctgctcattaatctgcttcaccaatcctaaggcatcaaaagctctgcttgctgggctcatgaagtatgcatcctggaatggtgtgaacacaggagacttccaggcagaaggagattctaagcctcttttaatacctggagtatcagccaatatgttcaaatactcgtaatctgcatcaatgcaggctgcagatttttcaacatgttctgatggctttgatctagaaaatattatgtctttagagttagacaaagcctgtacagtggtatttagctccggaattcgaaaatttggaccattcttatgtgtattatggttgtcaacactgctcggagtaagaatccctgaagaatgctttgcattggcttcattttctccttgatcagcaatttcattcaaattttctttgttttcgtgacaaagcttcagcttcttttgaaatgcactctctttcggtgaaactaaatcagctgaatcatcaacgctatccatgcaagatttcccaactcttgtagaggatatgcctgagctcataaaatccctttcagtatttggtttcttgtcagttcttatatcaggaactggagataaaagatctctgtgcctttttttcattatggacggggtgcacatgaatcttttggcagcattctttagcacagcatcagggctcccatccctagtaggggagccccacaatcttactggggtagggaagttcaaggatgtcctcatcaactctcgaatgccaagaggactatattctgggagatcgctggagtttacaagctcacagctgacaaagggaaattcaaaactccgaaagcaaggaggttcatagcatagagctccagcatcctcctttttacttaatatggtgtcaccatgactagataatgcttcctttccaatgcaggctgcaggctccaaacatgattgttcaacatcaacttgctgtttcttttcagattctgatattctgcccataggttcagaagtcttgtttctgtcatcttcgctgctaatatatgaattttgttcaggatcaccagaagcattgtggcaagttttaatctccaaattttggcgagaaacaggatagtaacttgtctcagatttgacaccagatgcattagaagcaccatcagaagaaataaagcctggtggtaatgacattacagaactctgatagtacacccggccgccctccaggttccctggttcagatgtctgcaatgggtaaagtggtgctaaaaagctgcctgcagcttcagacgagtatgcacctgattgaatggaaatatcctggcacttttcagattggaaaacattatcattttttatgcccatttcgtatatcacatttatgttatgcacacatccagaaacactaggtaagatgggaacacatgggtgtatagcatgtggtacaaagacactccatcattttttgaactatcataatctctgtgtcatgaaaatgaaactgcagctcattaga

SEQ ID NO: 22986 - DNA, 2719 bp, Zea mays
tttctcgaaatctaaccagactagagaagtagaaggacgacaacgcttggcgctgtgtttgtccccttcatcttgaccttcctcaccaccgccttggtgttcatcactgacatggacgggatgctcactgctatggtcgaagagcgctgcagcatcctcccggaggtcatcctcatcgtcatctctagccaacccgcacaaccgcctctcctcgttgtcgtcaatctcaacagtttcatcgtcggagacggccatcgacccacgtcggagtcctggttcctcaacggctacaacaggaatacaatattagggttagggttacataataaaagaggttagggttagggttaccgaataagctggagcaccgggatctccgtaggcgacgtcgattggtcgaccgttgatgaacaaccgatccggccacccggttcctcgacggatttgaatccggagcaccgtagcaaccgacggcgtatgagctcgagggagacgacgaggtagacgaggatgatgttgtgtcgtgtgctagtgtcggacagtggccaccagttggtgtagatgacaccggagggggagaagaagataggagttatcgagttagggttatggataggagttacccggttccacaaacgcgcaaatccgttgaggatggagcggggtagaggatctccgacgacggacctgagcggaggaggagagccggagagaggggagggagaccggagagaggacagattccagcggaggcggagggaccgagggaggagttcgcggctgtgtggtgcgagagggagagttgtccacggacgaggcgtttagggtttagcgcgtgggcgcggctttgggatatggggggcgggggcatatggcgctttgggtgcttggctggctgggcttggcgcctgggccgtgccaacccagtttaccgtgtcgggcttgggccgacactatagggccgagctggtggtccaggcacgacactgtgtacgaatggaccgggtcgtgctttttagtgtcgtgcccgggccaccccaccgtgttagtgccatatggccatctatacccgtgcgacggtgactggggtcgacagcgtcgtggctgtgcgcggggatgagggaagagagtcagagagaggttggacggtggtgtggggcaaattgagggacgaaggaggcatgggcaatggtacagattgacgacaaatagaaagggagatgcagaacgaggaggtcaggctacccttacatccttaataatcagtagagataatatactttaaatatagctttgatttttttttcattttttgcaatttttttgaatgagacaagacggtcaaatttggtgccaaaaagtcaaacaaaatataaattggaatagagagtacaatatgtttggaactccagcttgtgcgatttgagctttctgatcttctgttcactacagatgtaagtgtatatatacagcagcgattatcggtaaatttaacatgtattcgtgttctggcctgttttttttgtttaagcaagcacccgaggtgttcaatctatgtattcagaattccaaaggtacaaatattctggtacagttttgttgtgccttctaaacctacaccgagctgttaagggcgcataacaaaacgcaagggaaagaaaaagaagaccatgctgctaggatttgcaatggaaaatcacataaaaaggaagcagctgctgcttcctatgcaagctactccgaaaattttcctcaaggcgctctgcctcaaactcagtagcatacaagtggaaaacaatggtctacacgagaacatccttaagcttggccttctggtcagcggttagggttttcgggaataacacctcgaatgtcacatacaggtcacctttcttgttgctttggtatagtggcatgccttcacctttgaacttcctgatctccttcggtttggtgatgcccttggtgccaatttctaccagatggttgtcaagatgcttgattgtcttctcgaaaccaaccagagcttgcagcagggatattgtaactgttgcatgcaggtcattgccttctcgtttgaagtggctgtgtaatgctgttcggatcctgaacttcaaatcgcctggttcgccatcaatcttaggctcgccttcctcgaaaaacaaaacctcctgtccatctttcattcccttctcaatatcaacagtcaagaattcaccttctcgtacaaatttcacatttggacattggtcgcagacctgctcagtcatctgttgatacattccaggacctatttgtcgatggtaaacttcgttcctacagttgcagcgcctctttcctggtgctggctttatgacatttttctctctccaaacctttaatgaaccgcccatgtacaagtcctctaatgaagcatccagttcaacaatcacctcatcaccttttaaaatttgttgttcctcctcttccatcccaccaccaccaccaccaaaaaaactgctaaagatgtcctgaatgttcattccaccgccacttcctctcccgccttggaactgcttcaacccctcctcgccataccggtcatagatcttcttcttctcctggtccgtcaacacctcatacgcgttgttgatctcagcgaagcgcctggtgccgaatcccgcccccgcggtgtcggggttcttgtcggggtggtacttcagcgcgagcttgcgctcgt

SEQ ID NO: 22987 - DNA, 1560 bp, Zea mays
tttttttttttttttttgttctacaatctatgtattcagaattccgtaagtacaaatattctggtacaattttgttgtgctttctaaaactacactgagctgttaagggcgcatgacaaaaccaaaagggaaagaaaaagaagaccaggcaggctgctagtatttgcaatgcaaaatcacatacatgaaacgcagcagtagcttcttcctatgcaagctactgagaaaaatttcctcgaggcgctctcgcctcaaattatcagcagcatagatgtgagaaacaatggtctacacgagaacatccttaagcttgcccttctgctcatcggttagggtttttgggaataacacctcgaatgtcacatacaggtcacctttcttgttgctttggtatagtggcatgccttcacctttgaacttcctgatctccttgggtttggtaatgcccttggtgccaatttctaccagatggttatcaagatggttaatggtcttctcgaaaccaaccagagcttgcagcagggttattgtaactgttgcatgcaggtcattgccatctcgcctgaagcggtcgtgtggtgctgttcggatcctgaacttcaaatcgccaggttcaccatcaatcttaggctctccttcctcgaaaaacaaaacctcctgtgcatctttcattcccttctcaatatcaacagtcaagaattcaccttctcgtacgaatttcacatttggacattggtcacagacctgctcagtcatctgttgatacattccaggacctatttgtcgatggtaaacttcgttcctacagttgcagcgcctctttcctggtgctggctttatgacgtttttctctctccaaacctttactgaaccgcccatgtacaagtcctctaatgaagcatcgagttcaacaatcacctcatcacctttcaaaatttgttcttcctcctcttccatcccaccaccaccaccaccaaaaaagttcctaaagatgtcctgaatgttcattccaccgccaccgcctcccccgccttggaactgcttcaagccctcctcgccatactggtcatagatcttcctcttctcctggtccgtcagcacctcataagcgttattgatctcggcgaagcgcttgttggcctcctcgttgtcggggttcttgtccggatgatacttgagcgcgagcttgcggtacgacctcttaatctgatcctcggacgcgcccttgggaacttgcagcacgtcgtagtagctcttcccagcaatggccacagcgagattcaggaggacgaagagcgcggccgcaaaccgcgctgcccctcccttccccggcgtcgccatcccgcccccgcctcctcgagaggcctcgccgcacctctctcctcggccctcacaatccggtgtttccgcacggttgtcagctacggttaacgatcccgagcgtgaagagagacagcttctccctcgccgttctatccctcgtcgtcctcttcggctcttccccgccgccaccgtcgccgtcctccgtctgctgcagtggccttttggttcctgcggttt

SEQ ID NO: 22988 - DNA, 2210 bp, Zea mays
ctacatttatattctctagactaccaaacagcttcatacagattataatctatttatattttaattctggattatataatttagattataatccagattatataatctataagctgaagcaaagaggaccttaagtagccctttcctttgatctttttaatccgtcacggatgagtatgacgaccgatgatcgagattacgtttttttaaggagatctggagtgaaaggctacctttccaaggtgcccaaggaagaagaaggggatgctgtgatgatgactttgggcaggtgcggtcgtgcaaacacgatgctataggaatgtaagcgtttttagtacaatactttagtaccgtgagattcgggctagagattttcgctgagccctgcattgtattgtattgagcctaataattgaagcgagcgagtggtggcccagtggggaggagtatccgtagcatgatgccatcatgtgtgctgcgtgcactgtgcacgattttggggtgggggcctatcgctcgccaaggacctaaacgcaataacgggatcattccaacgtgctgggtacaaaacgacacccgcccgatacaaaagggccgaaacaaagggtccttcctccaaaaagcagaccatatccccaggcaaaggccaaggccaagcgagacagggagggaggagaagtaaccaagtgtctcaagcaacctaccgcccgcccgcccgccggccgcttcatttcctccactccacactcaccacgacacaccgccctcttcccttctcttctctcaagaaagaaccagctagcgcgcgcgcgcacacacaagcctgaagcctccccatacccgccatgtctgcgtcgccggagttctacaagccagcgccgccggcgttctcgccgtgcagctcgccgctcctgctgcccggggcaggggcggcggtgggagcagtggccgaggagagcgccgccgcaaccgtgtcgcagcaggaggaggaggactaccgctgccggacgccgacgggcggggagagccaggtgaggccgccggggacctgcccgccggcgccgcggaagccgcgggcgcccgcggcccccgcgccgtgccggaagcgcctgttcgaggtggaggtgttcagcctgcggctggaggagctggagcgcctcttctggcgcccgcgccccgcggcgccgccgccgccgccgccgtccgcccagaagaagcgccggagggtggcctgcccggagcccaagaagagatagtagctaccttcgtctggcaggtgctagtcgtagtagtagtacaggtcgtgtagcagcggtagctagctaggtgcagagccaagtggttttggcttggatcgatcacatacagcagcttattattaggatcggaggtccatggtagggggggtgcttaggagaggactgctgtacttgtactgctacagctcgtcggcacatctctctagctagtttcctctatctatagctcacaatcagttcctgtagttgctagatgctgttcagtgtgtgtatgtggtgatgatagtgtcatggtgtcaaaaggtgtagcgcaatactagctagctagctagctgtaggcactaggcaggagctgcatgccctgaatctccattcttccatgtagcccctgtgtgtaacgaagaagctaagctcacttgtaccactagcgtcacatatatatactctcattcacttgttacgcgatcagctccatcttcttccgtgtgcagtgggtccagcgcagggcagtgtccgatttagaccgccggcagcggcggcgcgcttaccctggctgcaagttgcggcggtgatattgaagttatcatctaactggtgatattgaagttatcatctaactggtgattatgtcaagttggctgcaagttcagaaccaccattagaggcagaagcaggacttattgcctatagtcctagatagatcaagattaggatggagggtagaacatctaattgttgaagcaagacttattgcatacatcatcatcataaattttatcccaaaatattgtttttttcaccaaatagagttagagggacaccctttttgaacctaatagagtcatataatgcatcatacttattgtatagtttgacaagtagagttctagtatccatcaacttattagtataatatgtatctgtaagagaagttaacttcctaagaatttt

SEQ ID NO: 22989 - DNA, 1105 bp, Zea mays
  misc_feature (101)..(101): n is a, c, g, or t
  misc_feature (520)..(520): n is a, c, g, or t
  misc_feature (524)..(524): n is a, c, g, or t
aaaagcagaccatatccccaggcaaaggccaaggccaagcgagacagggagggaggggaagtaaccaagtgtctcaagcaacctaccgcccgcccgcccgnccgccgcttcatttcctccactccacactcaccacgacacgacacaccaccaccctcttcccttctcttctctcaagaaagaaccagctagcgcgcgcacacacacacacaagcctccccacacccgccatgtctgcgtcgccggagttctacaagccagcgccgccggcgttctcgccgtgcagctcgccgctcctgctgcacggggcaggggtggcggtgggagcagtagccgaggagagcaccgccgccgcggcgaccgtgtcgcaggatgaggaggaggactaccgctgccggacgccgacgggcggggagagccaggtgaggccgccggggacctgcccgccggcgccgcggaagccgcgggcgcccgcggcccccgcgccgtgccggaagcgcctgttcgaggtggaggtgtntccntgcggcttgaggagctggagcgcctcttctggcgcccggccccgcgcgccgccaccgccgccgccgtccgcccagaagaagcgccggagggtggcctgcccggagcccaagaagagatagtagctaccttcgtgtggcaggtgctagtcgtagtagtagtacaggtcgtgtagcagcggtagctagctaggtgcagagccaagtggttttggcttggatcgatcacatacagcagcttattattaggatcggaggtccatggtaggggggtgcttaggagaggactgctgtacttgtactgctacagctcgtcggcacatctctctagctagtttcctctatctatagctcacaatcagttcctgtagttgctagatgctgttcagtgtgtgtatgtggtgatgatagtgtcatggtgtcaaaaggtgtagcgcaatactaggcactagctagctagctgtaggcaggagctgcatgccctgaatctccattcttccatgtagcccctgtgtgtaacgaagaagctaagctcacttgtaccactagcgtcaatatatatactctcattcacttgttaaaaa

SEQ ID NO: 22990 - DNA, 4900 bp, Zea mays
  misc_feature (1483)..(1483): n is a, c, g, or t
  misc_feature (2813)..(2813): n is a, c, g, or t
agctcgactccagggtgttgtgcggctgcagcgacttcttcgccgccatggccccgcacgaggacgctgctgccactgctgctggtgccggcgctgccgggaagacgatcgaggtggacggggtcgataatttggatgctttcagggctgcagtggaactcatgtacgaccctgatccaatgcggggtcttgcagctgccggtgtgtcaagggctatagatgtgcttgaggtgaggaagaccaactactctgattcagtactgttcacccaattttttttttcactgtctatccgaaaggctttgctgctgctgttgtatcggaatggcaatttaacggttttgccagcaaaacgggtgactccaagcttttctagtcaatttatgcctgttgccacattacatgcttttgacttttcaaacccactttattttgacacataaatcatgcagtgtgaattgctccctccattcgcataatgaatatttttaatttaagtgtgtgcagtaaaatttttaaaactttttccactaatgtcatgaaactatcaatatttatctcatgaaacactgtcaaattactattttcaatgcctttcttaaagacatgcttcgaaaaagtaatggttcaagcaatgtatttgatagcatgtccttttttttaaaaaaacagaggcacaagttacttactacagatataaagcatgtttggatacaagaggtaattgctagctagccaaaattaactctagtgcatcaaaacaggagggctggattttttgccaagtcttcaactagttgttagccaactagctagctaaccatatcaaatttgggctattttttcgccctaactagtaactagctatgcatatccaaaacttgtcttataatctctttttcccaacatttctactatagaatgtggataaggtgctactagtatctcaagcacttgaggatttaggcacaagtgtgtcatgctccagaacaagtcaacgacagatatgttagtgtttttagatatccatgattgctctatggtctacgaagttctctaagtagccgctgttgttttccaatatcagtgtaacacctttctaaggctaatatcttttattctgctatactaattagttgttacattgttatttctctgttatgtagaaccaccataatttcgctcctgaatcagtgttttcttctctgtcaatgttatctggcggtctgattaatttttattagtcagcctaatcggtcctaaaatttgactaggcatgattagggaacaagaaatctattcctctgattagttgtggattgccagttggacattgtaagctgggctgcaggatggtcaactggcctcttggatttctttattttggtccaatggggtttccctcacatacacaacttcacagcagagtggacactgctctcttcccatatccattgcacagccgccagccgcttggaagctnatgtgcctggaaaagcagaactgcagcatcaccgtttgccacagcactgttctctgcctgccatgacctcccagctgctgctgcctcttcattgcatccacaatccactggtcagcagatcttgtggcgtgtagccattggttcccctgcccacctcaggcgggtcaagaactgtctgggtgctgaagctgccaccacctgaccaggtcactcctccaacagtcgagctccaagggattatggagataagctcctcatcaaatttcacaagaatctgctgttctggtgcttttatactcctgcttcttgatttatagtattcacaatatagtatatatgccaacatatactggacaactatatggttgactctaggcccaactagtcaggctggtcttgacaaattgcaattagtctctcggtccgacccctggctactaggatcaactagatgaccatataacagtatctccctattagatatatttcttagttggatgagttacatcggccaatgtagctaatatgtatcaaataactaaatcgggtattctaaacttctattccagcaatagaatgaactatacatgtctttctgatgaattaacacactgttctgatacaattgagaaatatttactttttgcaaaatgcgtagagtgagttttgtggacatgctacatggtagtacgatggcaattcttctttcataagtaatattccctccgtcccaaaatagtattcgtcttagcttttgttttttatgtctaaattcaaatggatggtgatgaatctagacacataaaacacatgcatcaaatattgtataaatccattaattatctaaaacaaattttaatttgggacagagggagtatgttttttttgtttcccaagctaattcgtatattgaagtagtgaatttgattgaactgtagagtatcttgattcttgaatgtaggggtggtaatggattgcgatccaaatggttctttacaaaatggtagaaccctaaataaattttagttcaaaaataaatagaaatatggtccgattctaatccgatctgatccttaaatcttatagtgtaaaatttaaagcccattgtcacccctacttgaatgacaataatcaatatccactggtagtttatttacaactggtgctgcttagatgtgacgttttgcaaatacagatctaagctatatacttgaattagatttgtgtcgaaccatggaactataattgtaagggcacaggaatctttccttttctattaacttctttaatccagctaattcaatgcttattacacaattttactaaatgnatgctctgttttgaaatgtaggtatgctcctctatcatgttcagcaagggaatcaaaacatgtttgacatacatagaagctgttccctggaatgagaacgaggaggagaagctgaagaatctctttgcaagattcacttttgacgaagcaatatcccaggatatactggcaagactgcgaccacacaactggaaaagctcagatgacctcgctgtacagcttattcaatctgtcactaacagcaccagcactatggcaagaaaagacatgcaatctttggtgaatggtcttctaagcaaaagttcagtctatcaaaaggactcgtcaggattaaacaaggagagcctgtatcagatctgttattcatgtctagagtcactggtggacctctttgaagaggccatagaaccaacatattacacaggtcaggctgtggtagttagagggagcaaaccactgatcgagcgaatctctacgcaaacagagaacctcaattggctattggatattctagtaaacattgacattgcagaagaatttgtagaactgtgggcgaagcaaggcaggctcattaggatgcacgagcaagcatcagcgatcgtcaggtatgagctaagtcgaatatcagctggtgtgttcattgcacttggtaaaggaaaagtgcagtgtcgtggtgacgtacgaagcctcctctttcatggatggttcagcacaatgttgttggattttggctggcttcagcgctgccccaaaggtctcgacctaagatcgttggaggagaatttagggcgaggccttttaaccctccctctcaggcagcagcaatgtttgttcgaggaatggttccagttctatgcgaccaaaggacccgagtgtccgaaccttattagagctttccaggtatggtggagaaggtctttcattagatcattggtagaacctcaaaactaagtttttccttgatgtactagtatgttgcgtgtatgatttgtaaaattgcaactgttctgatgacccttaaaaatgttttttcgtttgtagtttagttcttcccattgtatgtgaatagctggatgaatttgcttgaggataacatctgcggcgtggagtatgtaataacccaacccagtcatatgtcgaacttttgtactttttgtagcatgtcagtcaatagtgtccgtgcggccaggggtgtttgaatgcactagagctatacaattagttgaagacatcaaaatagtctaactaatagttcaactattagctaatagctagttactagctaatttcactaacaatttttcagtcaactaactattagttgctctagtgcattcaaacaccttcttagcctatggctttgatcgttgaattaatgcagcggtaagagcctacaatgataacgaagtcttttatagaaacttgcagtggtaagagcatacaatgataacaaagccttttacagaaactcagtagcttctaagagcttgaactctcgaaagttaggcaaaaatgatcataagttacatcgggagctacacttcttggttggaagttagggtgttggaagtttttggtcagaagttggtctaacttccgacggtgcacttagaagtttattaacttctgacggctttaaatgccacttggaagttaacttagttgtgacgtcgtttgaggttttgatgcaaatagctatttaacttccgagcactttaaatgcacgtcggaagttatgtattaccttccgacaacttgtaaagcctcttgaaagttaatgtttattttgaattttatcacatttcataacaaaatatacacaattagaatacaattcataacagatacaatatctcatccattttatcacaaaaacacatcatctcaccataatttcaatccatttcagctcgcaataactcaatatgcatctcaagtttcaaatctcacaaccaagtctcaagtctcacaaataactcaatgacacatctcaaatatgtcatgtacttaccaagtctaaagtctcacaaaacaaacatgaaaaccaacaacaaaagcaacatcactattgtcgatcatcatcgggc

SEQ ID NO: 22991 - DNA, 1653 bp, Zea mays
gctcggtacccctgccagccgttaggaagctcgtgtatctgggaaaagcagaactgcagcactttcagttgctaccgcactgttctctgcctgctgtggtctttttgcaaatacagatctaagttatatatttgaattagatttgtgtcgaaccatggaactataattgtaagggcactaacatctctccttttctattaacttttttaatcaggctacatcaatgtcgattacgctcaactttactaaacgatgctctgttttgaaatgtaggtatgctcctctatcatgttcagcaagggaatcaaatcatgtttgacatacatagaagctgttccctggaatgaaaacgaagaggagaagctgaagaacctctttgcaagattcacttttgacgaagcaatgtcccaggatatactggcaagattgcgtccacacaactggaaaagctcagatgacctcactatacagcttattcaatctgtcactggaagcgccagcactgtggcaagaaaagacatgcaatctttggtaaatggtcttctaagcaaaagttcagtctatcagaaggactcttcagggctaaacaaggagagcctgtaccagatatgttattcatgtcttgagtcactggttgatctctttgaagaggccagagaaccaacagattatacaggtcagattcttgtagttagagggagtaaaccactgattgagcgagtctctaggcaaacagagaacctcagttggctcttggatattctagtaaacaatgacattgcagaagaatttgtagaactgtgggcgaagcaagacaggctcattaggatgcacgaacaagcgtcagcgatggtcaggtatgagctaagccgaatatcagccgctgtgttcattgcacttggtaaaggaaaagttcagtgtcgtggcgatgtacgaagcctcgtctttcgtggatggttcagcacgatgttgttggattttggctggcttcagcgctgccccaaaggtctagacctaagatcactggaggagaatctagggcgaggcattttaaccctccctctgaggcagcagcaatgtttgtttgaagaatggttccagttctattcgaccaaaggtgctgagtgtccgaaccttattagggctttccaggtatggtggagaaggtctttcgttagatcgtcggtagaacctcaaaggtaagctttttttcttgatgtactagtatgtgttgtgtgtatgatttgtaagattggagctaaatgttttgtttactttagctcttcccattgtatgtgtatagttgggtgaatttgtttgaggatagcagctgtgatgtacagtttatcgcagatggtatggttcttaaatcaataaaactctatccggtcttatgtcgaacttttgtagtaaaatatatgctaatctatctaaccaaatagaaaaaaatgtttatttcatctatcgaaccaaacagcctgcatagatatctatatcctaagatctacttatgatcatccacccttgccatcaaaccaactacaccctaagcattcttgaaagcatgtcatgtgactaaacaagctgatccttcttttcctccatgttgctgccattggcaagctttgatttgtcggtctcaatggtctgcag

SEQ ID NO: 22992 - DNA, 2864 bp, Zea mays
  misc_feature (1327)..(1327): n is a, c, g, or t
  misc_feature (1525)..(1525): n is a, c, g, or t
  misc_feature (2081)..(2081): n is a, c, g, or t
attgttcgaaggagaagagagcatcgtcccaaccaagctcggaccgtccggcctcggacaggaaccacgcaattgcggtttctcttactcccgttaggtgtgttacctggtgttttgttagcctttggccttgctttgcctcctttgtaagctggtgtccccggcaatgctatgtttcgtatctgtgaaaacactttcttgctttctaggatttacctccatcagttaaaaaaaataagatactttatacacctcttcctagaattttaaggaattttctttgttacatcgaattctgtcaacgcggcttgcgtaaactggtcgctttgctgtaacgaagtataaccatatacatattaaccacaacagaacagcaattccgtagtcgcattgctctgtctccggtatgtatactgggataatatgtacagggcattcttgcgatgctgtttacacacaatcctagacagaccttcgtgccattccaatttccagcaaaaactcaaggtcatgctagaaaaactcaaggtcagagtttcagctgccccatatctctcgtgtcacttccagtgccctcgtcgtacgcatgcgtgtggtctggatccctcctcagggtgaagcttgcttcctcggcttcggggcagcccggcctctcggtaaggaactgctcccagaacttgtcgttcaccaccacctggggacctgtatgttcttcagggggagcttggctgccccgatgcggcctacccgttgcatctgctgcggccccagcgtgacctgaagcctccttctggttctgggtagcatcatggcatctgtcaggcatgccgtcgtccttctccatggtgggtgtggtcacctccggtgggccatccttctcatccacagtgttcacgtttgcatcggggatttggcttctgaccacatccattggacatgatgcaaggctgaggttgaggtggcatggcaagaacccgtcgtcatttgcagctgttgtaaagctcacactcttcgagggacagatggatgttccagtgtcagagagctccatcatctgtggcaccagtggaaggcactccatgcctgttctctcgtaatctggatgcttcccaagagggctcccgttatcttcatgtgagctttgggtgctcagggtgatgaggttgctttccgccattgcaggacagagtccaagcttcagcttgtcagagaagtgctgattcagaaggttacccatttcttgcctggaactactgctatggtcatcgaaaaagctagtggcagtttcggtagcatccgtgatgcattcaagcccaggtagccttcncttcttgtgaaacgcgtccgcaaagattggggattcctctgccatcttaacgagcttcctgacaaactgaggattcttcctagcctgctgcaagaagctgagcatcttcgtctgtcgctgctccatgtcaagcactcgccgctcaagatcttctaactggttcacagcacctgactgctgctgattgaatttccagangtcagcctggagggcagctttctctcgtgaaagcctgtcaatctcatcctcaaataacgcacgctcattgtcaggcagggcacctggctgatggctatggctgtggatgggtttcctcctgtggatattcttcagcaggtgcttctgtcccttgacaaagtactcattagcaaattcccagcgctctgggtctattttgcgaaaaccctgcagcattgacattttcttagtgggtttccattgttttagggaatcaaaattgcttacgcagttctttcccaaacagttcgctgttacaagtcaacaaagatgctgttacacaaaacaagcaagcatcacgcaataatatcaaagtgattcaagtttctttaaggactggaacaagcacaaaaaagcattaggaaaaaagtggtatatagatcttaatagaatgaaaagtttacatatgcttattacctcactaaacgaaaaaaaatgactaatgtctacactatactctacagttaacactagtgattcacttaaaacatatagagccggtccaacagacaagtgnatggaagttcaaactgggtcctaaactcctaataccggagttcactgcagggaacctgaaattccaggtggaccggagcagaaacttgcagtgggagtagagtgatttctttctatgttttttgcaaccatttgtgtacattttcactttgaaaatattgaaacaacaagtgaaaacaccaggagacctgacttttaccgagattggactagaaaaaaaaaaccccagctcccggtgaagatctagaaaacagaaattctgaaaccagaatcccaaatccatattgccactttttctacacgctatgaacatatctgagccttcatgttctcagagagatcaataggatccaaaagaaatgacttgtgcatagatacaacatagaggtaagaactacattactaaacaacaatagaattaatagccaaatggaggccacaggccacagcacagagttcaaatgcagaccatgctactggatttaactacaatttatattgattataaatgaaattagaaaggtggacccaataaaggaacatggttgacaaatattcaacagaaccatggatgctggattaacaagatcaaccctgatccaatccataaactagttgacttttataactcaggttattcatggcacaagccacaagagcttcttcatttggaccaaataatgagcacaccaatcagcacccgaactaagtccggccctccatttttctgatactacaaaaggattatcttcaaatatgactgtcaaaccaagtcggtactcat

SEQ ID NO: 22993 - DNA, 2495 bp, Zea mays
agacatttagataggctattggatgatttttttttaaaaaaaattatatttatatagactaggaagaatatagaaaaccttttcaaattgctcttagaaagggttagttaatggactagctaattattagctaaacctctcaaatatccattagttgttagttacttcaacttaagtaaaaacttattagttagctaacaattagccctaaatgtttggaacatatcctaatcaatcacatagagaaaaatatattgcagaatccccaagtcaaggaagcaggagccagcatgttgccattccttttcctgcacgttgcaatcggtggcggtacattgcccgttacatgcaaattacctaaacccactcacctcacgcttgcatacagtaatcagtaaatcgcgtatgacatgcaaatcacttctcaagaagcgaatgggaaagcgaaacgtgtggtaatttttttagaacaaagagagtaccatgtaatttctaatacaaattgagactaatacaagtatgcagccgctctcaaagcttctgttcctgatgcacgaaaatcactttccgtgcggagaactttaaaaatttcatgcgtatcatgaagacattagtccagctttgttttccgaaacaacaacttatggttgataaaatgtacagtttctcattttttttctgaaataaaccgtctatccagactgactaacgacaacgcagcaaaaaaagggaaaaaatgtgaatatcacacaaacagagcaaatgttaaacacaaaaagaaaaggaaaggaaaagcctcgaagcaatcacacatgcaatgcgaacagcctaactgcccagggtcattgttgcgcctgcaaggagcaaacctgatgacacgatgttagtgcctgatgtagagatgtttctataattgtagaagcatcaaatggtaaaatgtagctaacacgtcttctctcagagatactgctcatatattctcgcttggttttcttcccaccataacctggcatgcatctcactgaatctctcccggctgaatctgacgcggcgtagttctctgatgctaccaggcaaagctcgaatagtaatatacacgccaggctcgtcctcttctacccattccctctcttcgtcacttgcgttgctgacagaggctgaaagttcgcccgatccatcgacctcttcaggagatgagcttgtcctcactgatgcaccaatagacgtctctgtcttcgcaccactgatgcttgataactcaggcgtcgatgccagttcaactggatcacagaactggtgcccaaggtagcggtctttgcggtaaacgttgcgaagatgactggattggtgctgaggacaatccgaagatgaatagcctatggcttcactgccttttagtggtctgggtgaagtacgtagcaattgccccttgttaagcggtgctgtagctggggtatcgtctttggagatctcactgtcagaccttggaatgcttggcagaggatcaacttgactgttagacttctgaacgttgtaaagctccatgaccttctcgtaattttcagtccaccatctttgtgcttgccatttgttgaacatttcacggctgaatcggatgcgcttcagaccattgccgccccgcggcagcgagaggaaggtgatgagcaccccgggctccacctgggcgacccactccttctcctcatcctcctcgctgctgccagtcgccgttccctcttcatcgtccccttcctcgtcgtcggcgaggaagtcggtgcgcgcgctgaccgatggcgtgatgtcaccgctggacatcgcgccccccgtgcgcagccccggcgtggatgctgcggagctgccggcgcgctggtacgcgcagtggaagcggtcggacccggactccgcgtacgcgccgtggtagtacggttgctgccgcccgcgacgccgccggggaggacgaaccggcgcagggcttgcagtgccggtacgcgcccgatgccttcagcgccatgtccttgatctgggcggtgagcaccctgatggcctgcctcgtgccgggcgttgccgccgattcgcccccgcctccggcgttggcgcggtcatcgtcgtccgacggctcgcgcagcggcggcgcgtcgcccgggagctgcttggagcacgcgatgcacgtgagcatcgcctctggcggacctggacctgacgcaagcgcgcgcccctcggatcccgcgacggagcctgagagaggggataggacgggaaggcgcggcgcgggtttataacagagcggggaactcgcgcctctgtgataagagtcgagctctcgagctgagggcggtaatggcggatcaggatccggcgtttagacagagtcgcggtgtgggggagattattgacattacggaacaatacactactgggtttcgacgaaacggaatcatatggacggcttcgaccttttagaggaataaacgattgacgtaagttgatatggggat

SEQ ID NO: 22994 - DNA, 1968 bp, Zea mays
cacggaccgtcgacacctccacgaatagcatcgcccgctgattcgctttcttcacgttcaaccaaaattaaccactggtatttgccatatcattttgtttttttctcaaatgaaaacactgctaaaaattattattattcactacggaacgacgagcactgcttttgtagaagcgcgttaagaaacggttgtgcatcgcagcgcaggcaaagaaatgaagcaccgaacagtgaagaactaacgaaacaagctcaacagagtccgtttcagctttctcgtattttcgtatgtgtatgacaacaatccacgcctcgccaaacaactgaatccgctgcgcatccgacaggatacgtgaaaaaaaatcaaagaacggtgggccatttcgccatcgcctcccgatccgggcggcgcgctatctgaaccccatcctgagagagtggcttgcctgcctcacggcgatcctgtcagaagtgccagcgcccgggcgcacggcctccggcagcgccgcgtcagagagcaccagcagaacggccgacggaggcgggcactgggcggtgacgaagagccgggtgatgtcgcggaggggcgtccgccgacgcggcaccgccttgctgcccccgcccgatctcttcatcgcctggcgcttgacgacgatgccacgcgcggcagacgacggcggcggcgcgttctccttgtcgcagccgcagccgcagccgccgagactgctgagaaccgccatctaggatggatggctctaaggtgtgcggacggtgctctgaaggtggacgcgaggaggcgaggagagagaggtgatctgtcgtggagaaagaggagggggacgggatggctccgcaggaagtggtgctcgctggtagtatttgtaacttgtcaagggttggtggaggaggccgtgccgccatggctctgaaaattttgagcttgggggagaagaggtttcagaggcagggagggaaagccatgggtccgtcgaagtttttcgggatcttggatgggatgggacgcggtggggggtatgctttccagatttgggttaatttcggtatggggtcccgggctagagcgggtctgtttttgtccggcgccagctgcctcgcgggggcgcggccggaaaaatgcgaaggttcgaaaatgttctgcgcgctttggcgagggactccgcgaccgcgagggactcccgaagatttgcgccaaatttggcgcgtccggctgcacgtgactgactggttggcgccgatgctgcgctacgcccatttgcccaccctccgtcggtagcaaaacaaaattcggctgatcatctattagcatcagcctttatctacacatctctatctctacttctatggcacaccgtgcccggatgataaaaggacatcagggccggttctgaggttttatggacccagaaccaaacaaaaaattggagctctttaaaactgtatatatatatatatatatttactttcttctaagtacataagtaaatttttgaacgataaaagtctataatgtatcaaaacaacttcaaatctttgtacatattacctcaaaaaaattctaacatttcttgatgcgaagtcattgataatagttttactatcaacctcgtctaataatttctctcaatacataaagtagtcaatccattgagacggtcttaagacatcattgaccttaaatagttcttcaacaatttcaactttacaaagcttatctcagtcgatgccacagtcacgtcaagggcacagtaaataatatatgataagcgattgaaatatttggatccgaatctatttgctgaacatattaaaaaatctccatagaaagcggcaggtcgtcaggccgatgtcgatcatcggccagccagatggatgaaaccaaggcggtggacacagttttggtaagttcaaaaattgaaaacaggtcggttgttactttagcaggccagat

SEQ ID NO: 22995 - DNA, 1093 bp, Zea mays
taagcgtacttccgaatagcttagaagacaaatttttttttttttttttcatgctttgacgtcgctcactatactgaattactgatactctggtgtttcgtacacaagcaggataaacattatttatagttacgctttcagaagcaacagaagccgctcaaagtcaaaagctttggagaactcaaacagcttctcaaagcgtggtcctaaactttggtatttgctgtacatcaggcacggagcttcagaatgcttcttgtaaccctgggatctactcaacgtgtttgttattgatcaagaaactcccttgcctttccgcactggaagatcaatactgatctgactgagtaacgatagcctcgacccgatctatcgatgcatgcaaccttccatagttcatactgaaggctggttctcctgtgccaacagccccatgaatctcaggaagcacatactctgctttccatccaatcctcaaatcaaaccctgggaacaagctgagttttgacttgtttcttatctgagacacaccatctccccccaggcaagtagaaagcttccacttccatccagttgcattcagttgaaaattgtggccaatgccaacctgtagatttagaaactttgtgactggtatcttcttggaaagcagctgtatgtcgccactgatgggcttgtactggaacttccatttccgctcgtaatctagaggcttcagtactatctttgcctcaaagtcattgacctcaagattgtagaactcgaggttgaggccgacgcggaggccctgcagctccttgcggaacttgaagtggagctcggccggcactacgttgatctggtacagctcgtccagcgtcgtcggcccctccccgaccccgccctccaccccggcgccgcttgcggagctcgaggccatcgtgtgagagaggggcgccctttactctcgccggtggatttaggcggcgcagccaaggcccgccgcttgggggcgatggaacagagcgggccgccgccggccgtaatctggtgatgtggagatttttcagctcacaccctcaaatcatcgtatactctgcatttaggacccggg

SEQ ID NO: 22996 - DNA, 1085 bp, Zea mays
ggtaccgggccccccctcgaggccgctttttttttttttttttttcgctaataatgtcgaagcaacgacatgtttattcaaacacaaatgcaagtgtcatgttacatgatggaattattaaaccgtaataaaagcggattcgggatcgctaatgctaataatcccaatgttccaatgcctagtcttccaatgtcccattgcaggcccattcagttcccgcgcatcacggggcaaccgcctgagccatcaggggcaggggcactcaagaagccggcgaggaagttgccgcgctcgtagaagtactctgacttgtccaccttcatgtcttcgtcaacatggaagatgcagacgccgaagagctcgacccgctggccgtgcggcgggtggcccttgaagggcccctccatgtagccccagtggcggaacttgaaggcgatcctgggcgggccgctgtagacgtcgagcacctcgatggcgaagccccgcgggaaggccgtggtgaaggtggccatggcggactccacggtctcgctgtccgggtcgtagatgcggtgctccgggggcagcttggtgcgcaggaagttgttgtagccgccgatggccatcacctcggcccgggtcagagcgctcatcccgttggtgctggcagagtatttctccgagttgacggtcttctggtcctcgggccgcgccttgtgcaccagctccatctcccagctcttgagcagccgctgcaccttctcctccagcgagccctcgggccacacctgagtcctctcttcctcgaagagcttgttgaccacgtcgtagttgggcggggcgccgtacctccacacggtgtccctctcgccctcgccgtggatgaaggagcggtacttgtcttctcccacctcggcgcccgccattacagcctcctcgcgtcttgcctcggcactcggcaggtcgtcgagggacaccggtcttggccgcctgccgcctgctagtatttgggactaggagcaaatggagtaggacggctgtcaaatctgccccccttgtataccctacattattatttgcggaacatcagatcccggccggcctcg

SEQ ID NO: 22997 - DNA, 1047 bp, Zea mays
ccgctaatatgtcgaagcaacgacatgtttattcaaacacaaatgcaagtgtcatgttacatgatggaattattaaaccgtaataaaagcggattcgggatcgctaatgctaataatcccaatgttccaatgcctagtcttccaatgtcccattgcaggcccattcagttcccgcgcatcacggggcaaccgcctgagccatcaggggcaggggcactcaagaagccggcgaggaagttgccgcgctcgtagaagtactctgacttctctaccttcatgtcctcgtcaacatggaagatgcagacgccgaagagctcgacccgctggccgtgcggcgggtggcccttgaagggcccctccatgtagccccagtggcggaacttgaaggcgatcctgggcgggccgctgtagacgtcgagcacctcgatggcgaagccccgcgggaaggccgtggtgaaggtggccatggcggactccacggtctcgctgtccgggtcgtagatgcggtgctccgggggcagcttggtgcgcaggaagttgttgtagccgccgatggccatcacctcggcccgggtcagagcgctcatcccgttggtgctggcagagtatttctccgagttgacggtcttctggtcctcgggccgcaccttgtgcaccagctccatctcccagctcttgagcaaccgctgcaccttctcctccagcgagccctcgggccacacctgagtcctctcctcctcgaagagcttgttgaccacgtcgtagttgggcggggcgccgtacctccacacggtgtccctctcgccctcgccgtggatgaaggagcggtacttgtcttctcccacctcggcgcccgccatcgccgctgctgatggcaggcttacagcctcctcgcgtcttgcttgcctcggcactcggcaggtcgtcgagggacaccggtcttggccgcctgccgcctgctagtatttgggacttggagcaaatggagtccggaggctgccggctctgcctctctgtataccccactttattattgcgagatgacat

SEQ ID NO: 22998 - DNA, 3202 bp, Zea mays
aaaaaacgccgctcataacccgctgggtgccagtgtggtaccggtacccttccctcactctcccggttctttcccggcgctggattcagatccgcacgcttctccatttccgtaaagctccgcgcctcctcctcgtctcttcactccaaatccaccgaggccatcgcctgggccccggggaaacccctcgcgctcgtggccctgtgagcagccgcagccatggcgcagccgctcgtcgtgaagaaagacgacgatctcgacgaggaagagtactactcgccattcctgggcatagagaagggcgccgtgctgcaggaggcccgagtcttccatgaccctcagcttgacgcgcggcgatgctgccaggttatcaccaagctcctgtacctgctcaaccagggtgacacctttaccaaggttgaggctacagaggtcttctttgcaacgaccaagctgttccagtctaaagatgcgggccttaggaggatggtgtacctcatgatcaaggaactctcaccttcagccgatgaggtcatcatagtaacaagctctttgatgaaggacatgaatagcaaaactgatatgtaccgtgcaaatgctattagagttctttgtcgtattattgactcaacccttctcacccaaatcgagaggtatttgaagcaagccattgttgacaagaatcctgttgttgccagtgcggcccttgttagtggcatctacttgcttcaaacgagtccggaagttgtaaaaagatggagcaatgaagttcaagaggctgtgcagtcaagagctgctcttgtgcaatttcatgcccttgctcttcttcaccaaattagacaaaatgatcggttggctgtcagcaagcttgtcactagcttgaccaggggttcagttcgctctccgttggcccagtgcctacttattcgctacactagccaggtgattagagagtctggtgtgtaccaaggtggagatcgtcctttctttgatttccttgagtcctgtctccggaataaagcagaaatggtcatacttgaggctgcaagagcaattacagaactgaatggtgtcacaagccgagagcttacacctgcaattactgtgctgcagttgttcttaagttcatccaaacctgttctcagatttgcagctgttcgcacacttaacaaggttgcatcaactcatcctttggctgtcacaaattgtaacatagacatggagagcttaatctctgatcagaacaggagcgttgcaacccttgcaattacaacactgttgaagacaggcaatgagtcaagtgttgatcgtttaatgaaacagatgaccaactttatgtcagacatagctgatgaatttaagattgttgttgttgaagcaataagatccctgtgcttgaagttccctctgaaatatcgctcattgatgaacttcttgagtaatattctacgggaagagggaggattcgagtacaagaaagccatagttgattcaattattatactcattagagatattcctgatgcgaaggaaagcggtttatttcacttatgcgaattcatagaagactgtgaattcacctatttgtccactcagatacttcactttttgggaaatgaaggccccaaaacatcagatcccagtaaatacatacgctatatatacaatagggtgatacttgaaaatgctacagttcgagctagtgcagtcagcacattggcaaaatttggtgccttggttgactcactcaagcctcgcatatttgtgctcctgagacgctgcctgtttgatggagatgacgaggtgcgcgatagagcgaccctttacctcaaattgttaggtggggaagctacagtgggtgagacagagaaggatgtgaatgaatttctcttcggctcacttgatgttccattagtaaacttggagacgagtctgcggaattatgaaccttcggatgtaccttttgatatttcatctgtttcgaaggaaacaaaatcccaaccccttgcggagaaaaagtctacaggcaagaaatcagcaggtccagcatctgctgtcagtggctctgtttctacagttgatgcttcgtatgagaagcttctttcgtctattccggaattcgctgattttggaaagctttttaagtcatctgcacctgtagaattgactgaagctgagaccgaatactcagtgaatgttgtgaagcatatttttgatcgacatgttgtgctccaatacaactgtaccaatacaattcctgaacaattgcttgaacaggttattgttttggttgatgcttctgaggctgacgaatttttagaagttgcttcaaagcctttagaatcattaccatatgattctcctgggcagacctttgtggcttttgaaaagccagaaggtgtcattgccaccggcaagttctcaaatatcctgaaattctttgttaaggaggttgatccatccacgggtgaagctgaagatgatggtgtcgaggatgagtaccagcttgaagatcttgaaatcgtttctgctgattatatgttgaaggtgggagtatctaacttccgaaatgcctgggaaaacatggatccagagactgagcgagttgacgagtatgggcttggagtaagggagagcttggctgaggctgtaagtgctgttataagcatccttggcatgcagccttgtgagggaactgacgtggtcccaagcaattcaaggtcgcacacttgtctgctctctggtgtgtttattggcaacgtgaaagtcttggtgagactgtcatttggaattagtgcaccgaaggaggtggccatgaagctggcagttagatctgatgatccagagatcagtgacaggatccacgaaattgtcgctaatggctaaaaacaatggtagtatcttttttttactccttttcttttggctttcatgctacgggaagtttgaggggattcaattaattagagtatatgtaagtttggtttccagtcgaatctatcattcgttgcaccatcattcttccttgacacagtacaccagttttgggttgttttggatctgtacaattttccttatatactgaggacttaaaatagtatacgcaataatatgcaggtaaagttttgctggaaaaaaaaaaaaaaaaaaaaaaatacaagacaaaaaaaaaaagaaaaaaaagaaaaagattactataatc

SEQ ID NO: 22999 - DNA, 3315 bp, Zea mays
gccggccggggttacccccgcctgcccgggccagtcgtttcccgggggcgctagattcagatccatgccgcacgcttctccattcctgtaagctcctgcgcctcctcctcgttgcttcactccaaatccaccgaggccaccgcccgggcccgggggaacccctagcgccgccgccggctcgggcgccctctcgcgcgcgcgtgcgtcgctccgacagcagctgcagccatggcgcagccgctcgtcgtgaagaaggacgacgacctcgacgaggaagagtactactcgccattcctgggcatagagaagggcgccgtgctgcaggaggcccgcgtcttccacgaccctcagcttgacgctcgtcgatgctgccaggttatcaccaagctcctgtacctgctcaaccagggtgacacctttaccaaggttgaggctacagaggtcttctttgcaacaaccaagctgttccagtctaaagatgtgggccttaggaggatggtgtacctcatgatcaaggaactctcaccttccgccgatgaggtcatcatagtaacaagctctttgatgaaggacatgaatagcaaaaccgatatgtaccgtgcaaacgctattagagttctttgtcgtattatcgactcaactcttctcacccaaatcgagaggtatttgaagcaagccattgttgacaagaatcctgttgttgccagtgcagcccttgttagtggcatctacttgcttcaaacaagtccggaagttgtaaaaagatggagcaatgaagttcaagaggctgtgcagtcaagagctgctcttgtgcagtttcatgcccttgctctccttcaccaaattagacaaaatgatcggctggctgtcagtaaacttgtcactagcttgaccaggggttcagttcgctctcctttggcccagtgcctacttattcgctacactagccaggtgattagagagtctggtgtgaaccaaggtggagatcgtcctttctttgatttccttgagtcctgtctccggaacaaagctgaaatggtcatacttgaggctccaagagcaattactgaactgaatggtgtcacaagccgagagcttacacctgcaattactgtgctgcagttgtttttaagttcatccaaacctgttctcagatttgctgctgttcgcacgcttaacaaggttgcatcaactcatcctttggctgtcacaaattgtaacatagacatggagagcttaatctctgatcagaacaggagcattgcaacccttgcgattacaacactgttgaagacaggcaacgaatcaagtgttgatcgtttaatgaaacagatgaccaactttatgtcagacatagctgatgagtttaagattgttgttgttgaagcaataagatctctgtgcttgaagttccctctgaaatatcgctcattgatgaacttcttgagtaatattctacgggaagagggtggattcgagtataagaaagccatagttgattcaattattatactcattagagatattcctgatgcaaaggaaagcggtttatttcacttatgcgaattcatagaagattgtgaattcacctatttgtccactcagatacttcactttttgggaaatgaaggcccaaaaacatcagatcccagtaaatacatacgctatatatacaatagggtgatacttgaaaatgctacagttcgagctagtgcagtcagcacattggcaaagtttggtgccttggttgactcactcaagcctcgcatatttgtgctcctgagacgctgcctgtttgatggtgatgacgaggtgcgcgacagagcaaccctttacctcaaattgttaggtggggaagctacagttggtgagacagagaaggatgtgaatgaatttctcttcggctcacttgatgttccattagtgaacttggagacgagtctgcggaattatgaaccttcggatgtaccttttgatatttcatctgttccgaaggagacaaaatcccaaccccttgcggagaaaaagtctacaggcaagaaatcagcaggtccggcatctgctgtcagtgaccctgtttctacagttgatgcttcgtatgagaagcttctttcgtccattcccgaattcgctgattttggaaagctttttaagtcatctgcacctgtagaattgactgaagctgagactgaatactcagttaatgttgtgaagcatatttttgatggacatgttgtgctccaatacaactgtaccaatacaattcctgaacaattgcttgaacaggttattgtttttgttgatgcttctgaggctgatgaatttttagaagttgcttcgaagcctttagaatcattaccatatgattctcctgggcagacctttgtcgcttttgagaagccagaaggtgtcattgctactggcaagttctcaaatatcctgaaattcattgttaaggaggttgatccatccacgggtgaaactgaagatgatggtgttgaggatgagtaccagcttgaagatcttgaaatagtttctgctgattatatgttgaaggtgggagtatctaacttccgaaatgcctgggaaaacatggatccagagactgagcgagttgatgagtatgggcttggagtaagggagagcttggctgaggctgtaagtgctgttataagcatccttggcatgcagccttgtgagggaactgacgtggtcccaagcaattcaaggtcgcacacttgtctgctctctggtgtgtttcttggcaacgtgaaagtcttggtgagactttcatttggaatcagtgcaccgaaggaggtggccatgaagctggcagttagatctgatgatccagagatcagtgacaagatccacgaaattgtcgctaatggctaaaaacaatagtagaatcgttttttttactctttttttgttttgacttgcatgctacgggaagcttgaggggattcaattaattctagtatatgtaagtctggtttccagttgaatccatcatttgtcgcaccatcattcttcctttgacagtgcatcagtttttttttggttgatttggatctgtacaattttccttatgtactgatgcttataatagtatacgcaataatattcaggtaaagttttgatggtaaaaaaaaaaaaaaaaaaaaaatataaaaaaaccggccaatgcgcaagggtcttaggctattacgtggccaaaaatgttaccaagtaagttaatggacgaggactatgacatggagctctacaattggacaaaggggggcctctttataggaggccaattttgatccc

SEQ ID NO: 23000 - DNA, 2177 bp, Zea mays
gcacgagaccattacctagaacatcctaatcgaaaaccaaagcgagcagatcccccgcccctaaccgactcccctcgcttccattccattaatggccgccaccaagagccctccaacacacacctgacctccccttcccccctctctccgccgcccgttccccgcgcctccgcccgtacgtcccgttcccggtcggccggccggtccaaagggaggggaggaggaggaacgcgggagtcggggcccgcaccgatgctgagctcggcatcctcggccgcgggagcggccatggggatgggcggcggcgggtacgcgcaccagcccccgccacagcgcgcggtcttcaccgccgcgcagtgggcggagctggagcagcaggcgctcatctacaagtacctcatggccggcgtccccgtcccgcccgacctcctcctccccgtccgccccggccccgccgccgccttctccttcgccggccccgccgccgcgtcgcccttctaccaccaacaccacccgtccctgagctactacgcctactacggcaagaaactggacccggagccgtggcggtgccgccgcaccgacggcaagaagtggcggtgctccaaggaggcgcaccccgactccaagtactgcgagcgccacatgcaccgtggccgcaaccgttcaagaaagcctgtggaatccaagaccgcctcgtcgtcgtcgcccgcgcacccgtcgccgccccagctgtccaccgtcaccaccaccgcgcctctcgagccccttgcagcggcggggggcaaggtccacggcctgtccctcggcggcggcgctgctggctcgtcgcacctcggcgtcgatgcttcgaatgctcactatcgttatggtagcaagtaccctctcggagctaaaccggacggcggcgagttgagcttcttctcaggagcgtcatcggggaacaactcgaggggcggcttcaccatcgactctccatcagataacaactcgtggcactccgccctggcgtccagcgtgcccccgttcacgctgtcgacgaagagcggggactccggcctcctgcccggcgcctacgcctcctactcccagtcccactcccacatggagccgccgcgggagctcgggcaggtcaccatcgcctcgctggcgcaggagcaggagcgccagcagccgttcagtggtgggatgctcgggaacgtgaagcaggagaaccagaaccagccgctgcggcccttcttcgacgagtggcccgggacgcgggcggactcgtggccgccggagatggacggcgcgccgcgggccggcaggacctccttctcctcctccaccacccagctctccatctccatcccgatgcccagatgcgactgacgaggaaccgtcgatcgggcggccactagacggtggacgctcacgctcactagtgcgctgtcgcctggagtggagatcgatcgtcacgccgccgccgcctacgccctcgtcctacctatttgttttgccgtagtgtattgtaccgacctcattaagaacagaacagaacataagtctctgtgtaagagccggctccttcctgttcctatggttgtactagtagcgtgctttgtatttgttgtacccctcaagaccgagaatgaaacccgcccgccgtcagtctgtctttgcgttttagtaaaaaatgcgagtgtttcgtgtgcatttccagatggcgaatcggatacctctgtggtgtcttagaaggtgttgcgacttgcgaggtgacagacactgcacgtgagagcgtggctctggctcgtgtctcgtgcgcagccggaacgaacctgcacctgaactggaaagggcggaggaatgggctcccaagttggcaggcagcagcttttttgttgagctgagctgaaataaaacgggaggacgagacaggtcggggtggctggtggcatcgtataggcaaggcagctgggtccgtcaggcggaggtggccgcaccaaaaaggctgccgcctgctgcctgcggctgcgggcgttggtgctctgctctggcgagtcgtcggcatggccggcaggtgtcgcctcatgccgtgccatggtcaaagcccacggcgacgccctgagccccaacggccgaccacgaaatgcccggaccgccagaagagagagaggacgtcacgtcgtctgcag

SEQ ID NO: 23001 - DNA, 1797 bp, Zea mays
ttttagtagtagaaccgagcacccctcactgatttctttagcaccaatcaaccaatttgtagcaagcataacgacacattcaactgtgcggttgaaggtcgtccaaatggtgagtctatatacatcgagaataatcacaatctaatctaaagctacgtacgcatgtacagatcgatggtagccgtgccgtgtatgttatatacactcaactactggccactgtagaaccactgtactccaaaccagccgtcttctgggccaagacctgcctgaaccactccacggacgccttgggtatccgtgtcaaattgttgttgtagtcgatgtagtagagcccaaaccgcaccgtgtacccggagttccactcccagttgtcgagcagcgaccagacgaagtagccatggacgttgcagccttccttcctaattgcgtctaggaggttagacatgtagtccttgtggtactgtatccgtttatcatcctgcagatcatcctctaatttcgaaaaccggttgttcgcatcatccatgccgttttcagtaatgatcacgggcggattcccgtacttttctttgatgtgcttcatcagcttgaacatgccccagggcactatgtgcagccatcctgacgctgccgtttctcctattttctttccatgtctataagcagtaggtatgaccgcagcatcagttgaagcatcattcattacaagtttcctgatccgcattctgtcgttcctaacatacagtgtggtgtaatggtttatgcccacaaaatctagtgagcctgacactaacatcgaagcccgagctgaaaactgaggcagcctgtcgcccacaagtttctgcatagaaggaggatagtggccaaacattaagggatccaggaaccatccaagctcaaagtccattgctcgtgctgctgcctctgtgtcctcatcaacatctgacagtggctcataccacttagaatcgagtgcaatgccaatgatacctccttgttctttcttgaaatgctgcttataagtatgaaaggcaccagcatgcgctaagagtatgttgtgagctacgacataaggctcagtcgatgatttgccctccctgcaaaatatatgagacagaatagaacacctcccaggtgcctggatgccaaggtcatagccttcaatcgcaaaattatggggctcattgaaagtgatccagtgtttcactctatctccaaattccttgaagcaagtagaggcatagtgaacaaaatcatccacgatttgggagtttaaccatccaccatatctgtcttctagtgcttgcggaaggtcccagtgaaagagtgttacatatggttgtatacctttgtctaatagagtatttatgaggctgttatagtaattcaatccttcttcattaggttcaccagttccatttggaaagatacgtgaccacgagatagagaaccggtatgcatccatgccaatgtccttaatcaagtccacatcttccttataacgatggtagtgatcaacggcaacatctgcattgctgaaatctatcacccgtccgggtcgtcttgtgagagtatcccatattgtaggtccacgttgaccctcgttgacagcaccttcatactggtaagctgaagaagcagtgccaaagacgaaaccttgagggaagtctgctctccttagagcttcagcacaagcagcgaagctgataaggatattaaccagtgtcagaacagccatggcgtatccttcagttggtagcactaactcatagtgtttttagtctaagaataagt

SEQ ID NO: 23002 - DNA, 1637 bp, Zea mays
aagtaatataggtgaagaaatttatgaggtgtttggtttgttgaatcactctatccaaaatgaagtggtgcatcatgagtctattcctcaaatttggtgggatgactccattccacatattagtactaaacaattaactatgaagaataaggtggtgatggattaactcactccattttgcaaacaaacaaaaaaaagaagtgagaaaatgatgaactatatcattcttcaaactaaacactccattagtgaaaaccactgccgacactctcaacccgcggccgaggcatcgtgctacagcagtaaccgcgctaccgcggcgagggccacttgaacacagtcgagtctccagccaggggaggcggaggacagaggcacgggtgccggcggagatggcggccgcgggagttcccggagttgctgcgtcgcttttgcacagactggagcaggccacggcgccgcgcgggcagcgtgcaacaactgtctattacgtactaatcagtagacaagtttgccatatcttttaagccggagcaaatgtcttcctttgttcacagagaattcgtatgaaatttattgaacatgaaaaccctgaaaatttagtgagcatgtaattacgtatcgatgatcatttgtctctattttcttgctccgaatttggagatgagtttgtatcgccacaccgcctaccggcacccttggccttggtgcacttccagaatccagaccgtgcattcctggtctgttcgaacgtggcaatcactcgtcaaattgacaccgctaccccttgcataaacgtgagatagttaaggcatgcttatacgtttgacacatcacacacttcgtctagtgcttaacatacgggcgccaggccgagcggctagcatcgcgcgctctcgctccggcggcgttcaggggaggacggggacacgtgccggacggacgacgtgcctagctgggtccggctcccctgccggctcgacgtcgccgtgcgtctcgtggaaaggatggtcgggcaacgccgccggccagacagcaccatgcttcttgtccaacgggtggtggtcggccaacgctgctgctggccccacaacggcgagggggcgctggagcgtggcgtccggatcgcagaccttctcgcacgcgtagctgcagtagtctctcatggacttgaacctggccatgcagtccttgaagcagtcgtcgtagcagtccgcgtgcgcgccgcccgcgagcagcagcagcaccgccgccgccgccgccgccgcagccaccatggccgccgctcgtccagcggccacccccatctccctttgcgcctattggacgcaatctgctcgcactatggtgtgggctgcagactcgatcttctttgcgtctgaggaactgcttggcgcccggcccgccgcgcgtccttttataagacggcggccgacaagcgacccagcactgtctgtcacgccggacgcatgagatcgaggagggagataggcaagcgtgcaggtttttcgcacatccgtgttgttgtgtcgtcgtggataacacgagcaagaaatatacaagagcagtcccaaaccaacactaccaatagtttttaactttctatagtccccacaaactactaaaacacacctctc

SEQ ID NO: 23003 - DNA, 1002 bp, Zea mays
ttttttttttttttttactaatctatcggggcaaataccattgacgaaatgcagatgaaacagtggctacatatgccacagaatatcctgcgattctttgtacgtggcaaagaccattctgataaccactttcctgacgtcaagcagaactaacacaacaaaaaaaaaagacaacaaaaacgaggaaacctctaaaacattgccataatacagtgtgtaactcacatagtgaaaaaacaaactgaaaacataacaacaatatatagcgatcatgccaaataggccgggggggggggggggagcacaaatggatccgttggcataactgatatctgaaccttcaagtcactgcagcagtgcatgtgtggccgtgtgggtggcagctcccgtccattaatgtcaaaatctcaaattttcttatttgcatgtttccttagcatcatctgtgcctgagtccgagtcactggcattgtaccctggacgtttattgctaactttccatactgtagaccgatatcttgatgctttctccatccaaactcttgccttgtgctcgttcttgttgacaccgtatccgctgcggtacatctggccgacgagcacctgcatggtgatgtcgccggcgcgcgcctccttgagtgcgtcctggaaccaccgcctcgtgcagtccgacaccacctccgcgagcggaaccctctcgtccgcctctagcccgcacgccgccgccaaatcccgcacctcggcccgcccggagctggccgcggcagcggcggcagcggatttcctgggcgtatccagcggggcagacggcgtcttatctgccctcccggcggatgcggcggtatcggatgggacgcgaaggctgcgggcgtacgagcgaaccgcggcggcggcggcggcggtggcggcggcaggtaggtgcttgcccatgcaaatgtggggtttcttgggaggggaacagaggggaatttgagagaaatgcgggggctcttgtgcgaaaag

SEQ ID NO: 23004 - DNA, 2326 bp, Zea mays
  misc_feature (2266)..(2267): n is a, c, g, or t
  misc_feature (2278)..(2282): n is a, c, g, or t
ctaatcgaaaagtatttatagcgagcgtcctggcctctcttctccctgctcgctcctagctggggtggggagggaagaagaggacaagcatgcagcacgccaacgcgcggcgcgagcataccgacagctccagcctccagggaacgactgaaggagtaggagaaagacaaagaacaagtgtgggaaacagacaacgagaagaccgacgagccgcgacaccgccaccgccaccccgctcctaagtcctagctcctcgtgctacaaaggaataaaccaaggccggcccatgtcttcatctagcggttgtaaccgcggccgagcagtcctcccagtcactgcctctctcgttcccttcctgctcctgctcctcctcctcctcgtcgtctcgtgcccggccgccctggtggtctccgcgacgcacacgcacgtgcacgggcacggcggcgccaccgccggcgccgcgcgggcgtccttccgtgccggggacgagcgggaggcgtacgcgaggatcatggcgcgcatggccaggatggacaaggactccaacatgacgatccaggttccttcccttccctgcagctgctcctgctcctctgccccagctgtgcgcgcgcgctgccggttccggcttccggccaagcaagcgtgcaaatccaccacctcgctgtcgtttacgtactctagctctttcgtcgtgtcgtgtcgtgcgtgtgtgtgcgcgcgcgtgtgcagagcgccgacggcgacgtcatccactgcgtgccggcgcacctgcagccggcgttcgaccaccccaggctgagagggcaggagcccgaggacgagcccgtggagaggcccatgtccaagggcgccgccggtgaggaggaggccggcgtgttcccgcaggcgtggagcgacggcggcagcaagcggtgcccggcggggacggtgccgatacggcggacgacggcgcgcgacgtgctgcgggccagctccgcgcgccggttcgggatgaaggcccgcggcagcagcagcagcaacgcccgccgcgactccaccagcagcggccacgagcacgcggtggggtacgtgacgggggagcagttctacggcgccaaggccagcctgaacgtgtggccggccaaggtggcgtcggcggcggagttcagcctgtcccagatctgggtcatctccggctccttcggcaacgacctcaacaccatcgaggccggatggcaggtgagccctgagctgtatggcgacagcagcccgaggttcttcacgtattggacgaccgatgcgtaccaggagactgggtgctacaacctgcactgctccggcttcgtccagacgaacagccggatcgccattggagccgccatctcgcctacctcggtctacaacggccggcagttcgacatcagcctgctcatatggaaggacccgcaccgggggaactggtggctgcagctggggtcgggcccgctggtggggtactggccgtcgctcctgttcacgcacctgggcggccacgccgacatggtgcagttcggcggcgaggtggtgaactcgcgcccgtcgggggcgcacacgcccacgcagatggggagcggccacttcccccgcgagggatccaaccgcgccgcctacttccgcaacctgcaggtcgtcgacgccgacaacagcctcgtcgccgccgccgcgctccgcctcgtcgccgaccgcccgggctgctacgacatccagggcggctacaacaccgcctgggggaactacttctactacggagggcccggcaggaacgtgcactgcccgtgatctgtctctgtctctgttggtagccgacgcccgacgacgatcgaccatgaatatacgtgcacagatagacatacagagagtgaagaagaacgtacggatcaccgaccctgccggagttgcatcgtcgctcatcaaccggccggacatggatcgtataatagcaccactgctagtcatatataagctacatctagtccctcgtttagttactgcatgcatgctaattagtttttaagcagcccagctgcgtacaccgcggggacggtaacagagaggcaaaaggtttccaactttcgatacttgatgtatgtgggcttctttcgtttgcattggtttgattttttttttgtcttgagttatgtatatacatcaagaaatccacatatagtattttcttcgtcaaaaaaaaaaaaaaaaaagcttatcgttgtggtcgccctcgagggggggcccgtacccattcgcnncccccctcttnnnnncccccccccccacttatactcctttctttttttttttttttttt

SEQ ID NO: 23005 - DNA, 1912 bp, Zea mays
  misc_feature (24)..(24): n is a, c, g, or t
gcgtttcgcgccagttgcgtgtgnaaccaccatgtgtcaggaggacagctgcgccgtctcatggcaaggagcaccccactcacgcactttggaaccggtgcattccgatctgagggcgcccctggtgggggtttggctgtgactgagcttgctacatcttttgctgcatccaggtctctcatttgggggggagggttcccgggggccgagccagaatacctcccagcgatctaccctgtctgtgccaagctcacgtcactaaacttcagctttgcaagcctaaccgctgcggaactcaagccagttattcgcaactgcaccaatcttcgcactttttgggtccttgataccgtgggcgatgagggcctacgtgctgtggctgatgcatgctctgatctccgtgagctgagagtttttcctttggatgcgtctgaggattctgagggttcagtctcagatgtcggtcttgaggcaatctcaaaaggctgccggaagctagaatcaatcctctacttttgccagcggatgacaaatgcagcagtaattgatatgtcgaagaactgtcccgagcttgtagtgttccgcctctgcattatgggccgccaccgccctgaccgggtcaccggggagcccatggacgaaggttttggcgcaattgtgatgaactgcaagaaactcaccaggctttcggtctctggcctgcttaccgataaagcctttgcgtacattggaaaacatgggaagctaataaagaccctctccgtcgccttcgccgggaacagtgacatgtccctccagtatgtattcgaggggtgcaccaagttgcagaagcttgaggtcagagacagccctttcagtgacagggggctgctctccggactggactacttctacaacatgaggttcctatggatgaactcttgcaggctgacgatgaggggctgtagagatgtagctcggcagatgcaaaatctggtggtcgaagtaattaaggaccactccgaagatgaaggggagggggagaccgtcgacaagctgtacttgtatcggtcgctggcaggaccgagggatgatgctccgccatttgttaccctcttgtagcactggtatttgaaggacagccccgcaccgtactgacggacatgtttgttaggtcattccttaccatcaagttgccatggccagcgagggaaagcgtagcgtcccgtgggtgatattcacaagttgctgcaggagcgctcgtgtaaaatcaagtaaagaacctgccgattattccttggaacttgatctggcatgggggcggcatccagagttggggcagttgaggagcacatccagacctagtatagcagtgatgggtagtaactgattgcacaggaactgactgcacactgactccagtcagcaggctccggatggttctttggcagtggcacccaagtctccagttatttacctgccatcttccgttccattttttcagctcagaccaaggaatggcggcggcgctggtgcgtgctgcctatgccgggaagcttcaatgctccaccggccattacttataagttctagtggatccaaaactcaatcccgctatttttctccccctcccattgtttgtagcactccagagttgtttttgtagacctgtagaccaccactacccctttcctccgtcccacccacgccctctgctattttaaatcaagaagctactggaggagacctcggaattcgatcggcatttgcttggttcgtgcgtgcccccacccaccctggcggctgcccgtcaacgtcactgttccattgcttgccagttgccatgatcgtcgtgctcctagatattatgaggtcgaccgcgacagctctgtcgctataataaacgcccgtagcctagcctgtgtgttgaaat

SEQ ID NO: 23006 - DNA, 828 bp, Zea mays
  misc_feature (62)..(62): n is a, c, g, or t
gaagtaattaaggaccactccgaagatgaaggggagggggagaccgtcgacaagctgtactngtatcggtcgctggcaggaccgaggaatgatgctccgccatttgtcaccctcttgtagcactggtatttgaaggacagccccgccggccccgtgctcacaggcatgtttgttatattattccttgccatcaagttcccatggccagcgaccgatagcgtagcgtcctgtggatgatattcaagttgctgcagcaggagcgctcgtgtaaatcaagtaaagaacctgccgattattccttggaacttgatctggcatggggggcgggcggcattcagagttgggggcagttgaggagcacatccagacctagtatagcagtgatgggtagtaactgattgcacaggaactgactgcacactgactccagtcagcaggctccggatggttctttggcagtggcacactggcaccctagtctccagttatttacctgccatcttccgttccattttttcagctcatctcagaccaaggaatggcggcggcgctggtgcgtgctgcctatgccgggaagcttcaatggctccaccggccattaattacaagttctagtggatccaaaactcaatcccgctatttttctccccctcccattgtttgtagcactccagagttatttttgtagacctgtagaccaccactacccctttcctccgtcccacgccctctgctattttaaatcaagaagctactggaggagacctgggaattcgatcggcaaaaaaaaaaaaaaaaaaaaaaaactcgagaaaaaaaaaaaaaaaa

SEQ ID NO: 23007 - DNA, 5798 bp, Zea mays
cagcggcgagccaatacttagaccagcgtatatatatgtgcgcgcgcgctatatgcatttctaatcttttgttaatatctcactgttaccagagttactactgcttgattatcactaacacatactgatagcaccatgaattaattaagggtggttgatgaaaacagtgatttgtactagctaaagctaggcatagtactatgtacgcacagatacaggaatagtgataagatacgaaaatgcagaggcacataaagcacgcgctagctgcatgcgagttgcgacgcagggaaagatacaaaggaggcagccgcagcgaaaagactgcggccgcgacgcgttgtaaaagatggcttcgttttactgcggcgcgcgacgggcgaaagcgtatggcgtataactatatggtgatcgggtgtgcacggcgtggtgcatgcaaaccctcgcgggggcacgtacggcggaataattggagctctgaatttgatgtgtgactagacgcatggtaccagccctgatctggccgtgtcagccctggccggggggtcgggtctcggtgcgcggtaccgccggaccgcccagccacaccgcgggacggcgggagcaactagtgttacaaatccaccggccggccggggccggggcttcgaattcatgtctctgtgcacgcacaccgcatgcatatactagtcctgctttaaaaaaatggattcccccaccctagctatctcctgcgcactgtgcaagcttccactcattttgttctgggttaccgcgccgtccctatgggctatgggtggtgttgtgttggtgggcagagcgagccgcaccgcatgcatcacgtacagcggctggtggcctggctgcctagccaatcgagggccgagaccaccatgtatgtgcctctctggccgtctggcacatagctgccggccggccggtgcagctaaccgcggcacggcatcgatgctgccaaaacccggccggtaagatccgtccccgggggccacgttttactgcgcacccaccacgactacacgtactacggtcgtgggcctgccgcggttttttcctgccgcgaatgatggatgggggtgggagacacggcccggccggtccccggctcagaagatggtcgcagcagcttccacctgggccccccgctgccccgtcccggcatgcatgcgcaccgccgacccctgcttgcctgcctgctcggcctcaggcagccacagcagcgcctgtctctctcggcgctctactcttcctttccttcgttcatcgcgcgttggcgccagcaggcgcaaatccccaatccaaaaaaaacaaacacggtgaaatttcaaccccacctatcgcaactccatgtgtgtttatgcgggcatatacagacacacaacagctgaacaacatcagaactgatctatcatgccttcagtagtgttctgtttattaggaaaacaccaaagcacgtcttcttgcgtggaacaagcgtactgattccttgggctacgtgcgccgccccacatgctcctccccttcccgtctccactccactcaactcaccagtggcgtggtggggccagggtacgtgtcacgcaccaatacaccgcaagcaacgtgttgggccactgtctcgatggctccatcagacagacaatcacactccactcatacatactgtacaggcgagagggagagagagatcctatcatcagtcatcctaatcgccggtccgtcactcttgatttgcggtccaagacgcccacggtgactaaacaagggacagcatcatcaattaccgggcgatgaaatggggcgcgcaggcgcagacatgccgtccctggcagccgacatgtcaatccccccggcgccttgacgcagatcgatcactcatcgctcgccggcccgcccactagaagcggtcgcgctcaggccttcaggtctcgcaattcccggagattctcggggacactagcgcctcaccctgccacccatccatccatccaccccgcagcccggcgattgcgatgtgatccggtgcttctgctgcgcctgcgcggcagcagcgcaccgcacgtatcgacacgcacgatcgacagtagattaggtacgagagcgagacagaagaacatgcctccccattctttcacccactagtgcatgtagtgtagtatatatactacgtggtaccagcaggaggacaagtataagtcagccacgccaaagtactagcaggaccagtctgcggtatgcatgcacagctcagaacgccgatctcgaatcctgataggcgcagctgggcaatcaatatcagtgtctgttcccgcctctcagcacaagcagccaagcagaaaccaccaggcacatcagggtaggatgaatatgtgtgagcagcagcaggcttgttaccttgcttcacacacaacggggtttccttgttatgtatatgatatgatcatacttgggttcagttttcacaacctttcggtaaaacaccagatcggttagtgttgcctctatcaaaggaaaatcatcttcagacatctctctctctcgcttgcatctcaccatctactgccgcgagttagtaatcatcttgaaatagaaaaagaaaaggtagctaggcaaccctaaaccatgtattgcatccccacctgcatcagcctcgtgtggggtatgctcagcgtcgcgatgcccctcctgcagttcctcctcaggaaagcatagaaatagttgatcaccagcttcttgacgaagaacgactctttccgggccctgatgtctccgtgcccaagaaggtacaccacgcccgactccttggccttgtggatgaaagatagctcgttgtccatgcttgatccctcctccaacgacatgcttgatcccagggctgagttgtcagcaccgcctgactcgtcaataactcttgatgatgaagaagcaatctcctcttcagagtctttgtcgtcattatggtcgctctccagggagcgttccagggagcgttcctgggcctctcggcgtatgaacttttcaaggctttctatcagaagctgttcgaatgcttggtggttctccttgcgtacatccttatacccatacctagcaatacagcggaacatatggtagttctttgcgcacaccgcgggccgtacagtgctcataaataaccatgcaactgtatacagatttgggttctgaaggaacatgaatacagcaaagattgcatcttaactcttgaagagcaaaggcaagtaagaatgaggaacacacaaggaccaagggaatggaggaagaggcattcagtgtcactctaaccataataccagtgagggcagcagatattgtagattttaaaaatggctgaagaataaatacgagcaaacattcacaaaaaggatttgtacaaattgcatgcagacatcaggatggtgcccagaggggggagggggaagggatggaacataagtacataataaagctaccatttcatgaacagaactcttagcaacatgataacagtgccggcaaatatcaggagatgaaacgagctaaaagttcaaaacaacagccatgaatcacctaatgacttcaattaatataaatgcatctgggttcactataagagcaaactcagcgctacagaacttcagagggggcagtaaaactactgcacactccaaaaagagcaccagcctgtggcccttcctacacagtaataatgctggcagaatagttgatggctaactgagtaactgacacacatagttgctctctaacagattctaaatcaagatcagggcatcatgcattacataaaacataaaataaagtgccatagtatcaaacatttgtagatgcaaagttgtctcaagtttctaatggacatacaagaaactccaaaaacaaataacatcaatttaaatcagagtatacacttatttttagaaactcggaaagatgaagttcgaacctagcaatacagcggaacatatggtagttctttgggcacacacgacggaagaggaacctttcattctgaggcacaactggaactgggacccatttgatgcagacaaaaatgatcatcgaatgcatggctggcagtgtagtgaggaagtgaccaaagattgcaggaacacccctgaccagttcattatagagcaatccaataccaggcgccctcactgtaccaagattgcagcctagctgtatcaataaatccattgaaagtttttgcttgacttcagtttcgtacttcaatttggttccatagttccatatgtacattaccaaatacaatacagctgcaaataccaaaagcacccaacttccatctgctgcacttcccaaaactgaggaaaagaaaaataactccagccccagaaagaggttgagaaagcatagaactatgacgatgttgacctgccatatcagaagcattataatggtgaccaggacagtggtcatcatcatgaccccaagttctgctatgcctgcaaccaagagcagacattagaaatattctgtagcgttgatgattggattggagaaataagaatagcaagcttattaatttaaaaacagtggatcaataaatactacaattagagtggaagaaaacaaccatgttaggactaatcttgtcatgtatggatgatgggctacatgaaatcagtgttagtataatcctagttgctgatggtctttttgttagtgtgtcttgtcagtcaaggtctgtacagtgaagtcagcccatctagtcttcctcttagtttttagggaagtcactaggtaatttctagggaagaactagggctgttttcttgttttcttactcttttttcagctataaataagtgaaggcaccagcaagcagcaggtcataacagcccaacagaagttgaagctatgtgagccagatagaggcttgattgtgaaggtcaagcactcaagctagtgtgtatgtgtgagagtaatgcttgattgaagaataagcaaggtgtttatgtgtaagcttgtagtgtgaggctatgaaatcaatatataagagaaacaaagttattttgtttccaacaaaccacatacataacaagataacactcgaaaatagggggggtcctaagaatcgttgctattttacatttttttccttgcaggtagtcacttgtagttgtataagtaaatatagtagtcactatagcaatacagatgacgtgaaggagacgaaaacaccacctagactatgtgttagatatgtgtgtgtgcattatacagctgtaatgggcttaggcccagcccacataccaattcatctaataatatagcagtccaaccctccgcagggttttggggtttcccatactatgaatgggtgtaaattgcaatcagatactgataaatgttcacttattcagcagatcgctgttatcaacaaatagttcaggactacatgcattccaataacaagtagaatacctggagcataaacatagctgaaagcatactcaatgaggaaattaaactacccaatatttttgaaccaattcaaattcctctcttcacatatgtataccctaatcagattatcagatccacacttgatcatgatagaatcatagtgaggcaggccttctagatcacccatagttccatacatgatataaaaaaacaaggtggtgtttatacaggcaaagaaaacgagtatattgcctaaaaaaaaaaaaaaactcgcccgtggagggaaagaccgccctcccggtattccatataagaagagaccgaaacaatggtcc

SEQ ID NO: 23008 - DNA, 742 bp, Zea mays
ggcccccggccggttttttttttttttttttttttagtagattcagctttgtcttcaccattcaccattcaccaatgaaaagcaaaaccatcacaaatgcgaacaacgcagtcgcgaccatcacattacaacaccagcactgctcaactgcgcacgaatccaaccaacaagaacattctgccatgaacttacatactataccatataagttaacaggttcttattcttcttatatacataatgtaccaggtcaggttctcacatgatcgcagctgacaattaaacaccactagtgctgcaacataaaaacatgtacaaggtgatggatgactggtgcttccttggaagtaggtaggttcgtatacgactcccaactggcggaaggggtccgggcgagcaaagaagcggcggcggcaatcagtcgaggtcttggtcgtcgaagtcgtcggggaaggcgttgaagaagtcggcgtcgggaggcggactgggttggcggtcgtcggcgtcgacctccatcatgctgccaatggcgatgctgatgcccatggaggaggaaggcgctgcgtcctcagagtccatctcccccgcggagtcgtcaccccagtccaccgccggcgaggtggagttgttcatctcgatcccttgagggaattggggtggaacctactggaaggaggaagtggaagaggactagtctagactctacaggtgtgtcccggcccgtcccgccccccggggccca

SEQ ID NO: 23009 - DNA, 703 bp, Zea mays
ccccgcggcaggatcggcaccgatgcgattcaaccgcggcctcgcatccggtgcggaggtctgcaattggggggaggctcctctccgccgttggaaccgctgcggcgtcgcagcctgtgcgactttcctgctggttcctcatccctcagggacagattttgcattctttggcattactgtttgatggcagacagtagtgctccttctctgtggaggcattggggcaaaaggcagttgaactgaacgggcacatcaatagtctctggcctccaagggaaattgggaaattcagattgaacgtggctgcatcatttttcctttcattggtcttttcagcaacagcgatccattctcgtaggggggagagagagagagagagagagggagagaaatcaaagaggagagtgatcatggagcatgtgatcggagggaagtataagcttgggaggaagattgggagcggatccttcggagagctatatctcggtgttaatatacagaatggagaggaagtgggaataaaattggagcctgtgaaaacaaaacatccacagctgcactatgaatctaaagtttatatgctgctgcagggtggaaacggtatcccacacctcaagtggtatggtgttgagggggagtacaatgttatggtgatcgatcttcttggcccaagcttggaagatttgtttaattcctgcaacag

SEQ ID NO: 23010 - DNA, 2173 bp, Zea mays
  misc_feature (1036)..(1036): n is a, c, g, or t
gtctgcattgcattaaaatcatacgctttttaattcttggatgcttggtcatgaaataaacttaacctgacgattgacgaaggagaagctacttaatctaatgctttcaaaaggagggaaacacaatgtatttgtttttcatgtacctgtacttgtttcatccagaacaaagcaggagagatgatctggagtctgttggctatcttctgctatattttttaagaggaaggtttgtcccgaaaatctgtatattttactgtatttcctcttttactaatactatacttgacatgcttttacgttatgcttagcctcccatggcagggccttaaagctggcactaagaaacaaaagtatgataaaattagtgaaaagaaaatgcttacctcggcagaggtacttctttttgccaacacgaacattgtaatcctgtcatggtagctgttgcagacactgtttgaactaacattgtcttaaacagattctgtgcaaatcttacccgccggagttcgtctcatatttccactattgtcgctccctgcgatttgaagacaggccagattactcttcaatgaagaagctctttcgtgatgtatttatacgggaaggtacacacctttcttctgagtgaccccgctaatgtgaccattgttctcgcctgcactatgatccggtgttaggaaactgggtctcattatagattaacactgtaggataccaatttgattacgtatttgactggactgcactcaagtaccctcaaatgggctccaacaacaagcttgttcaagtatgtctctctaatcttatatctatgtcttgtctacattattggtgaattactattgtcttttcgtttcactaaaatgccattatgtttcttaaattatctagcaaccaagtgcaagaatggctggagttggaccatcagttgagagaacagacaaagcttccagtatgtctcctggtagttaattgcatttggaccattgctatgtgaaaattgatcgattgacctaattagttgcgtttttgncagtgggacaagagatccgggataggttcactggtgctgttgaggcattcgccagaagaaatccaggctctgggcgccctgcagatcattccagtcattccaggcacaaaagctttgcagattcctttggaacgtccaacgaagcagtaagtatccgatttattgctcttgtagaaaaaaagtatctgatttagctgtggtagctagtaaacatgaatggaggtattaactttttaaacgaaaatatatacttagtgtcaaatccactaaataaaagatgagtctagtgaattgaaaataaagggcatttcctcttttccatgttcttagtattttgctgaaaatctttctgctaactcagatcagttcttaagaagtgtattataatattttcatagattttttttgatggaaatataatactactgtactaacttacttatctggcacgcaccaggttgccgactcatcagagaaaacgcgcatcttgtcccggggagggagctcgtcgaaaatgcccgcagctccgtccacccggccgacctcttcgggggactgcagtgaccagaaccgccggtgggtctccggcagcagtggcggcagcgggcgcccgtcccccgcgcagaggctccaccactcgggaggcgccgagaacagcaggtcgtccccgcgctcccccgtggcccggaacgcggccgggaggggaggctccgcctcgcgggacaacacgacgttccgcagcctcgagcgcctcaccatcaccaccagcaggaggaagtgagctgccgaggaccacgccgacgaattctgagagtggaaggcggttactaggccgaggaacttttgcgggatccttgctctctgcagctaaagcaaatcggcaaatagatgatggatggatggttacaaggctgccatgaaaatgcaccctttccccaaaccccagcgtatagtataacgctctccccaaactccaagagggaagacaactccaaagtacaatgcaatcttgattctgtcgatctggcactagttttaaggtgttattgcagaatccctccatttgaccataaattttaaaaacgtatacaagaatctgagttaattttgtttacagggtaaaaaaaaaaactcttc

SEQ ID NO: 23011 - DNA, 1352 bp, Zea mays
ctcgaggccggccgggacccacccggtctccagaacagacaacccgtccttctccttcccatcggctccacacaaccagaaggttcttcgcttcactctgccctgcgccgccgccaacgctgcagccgcagttgccgcaggcgggaacttggacgtgctactcgcgactgctctcatctgttcccgcgtaggattcgttcacaatggcccgtgtgtatgtcggcaacttggatgcacgcgtgacttccggggaactcgaagatgagttccgtgtgtttggagttctgcgaagtgtttgggtcgcacgcaaaccacctggttttgcatttattgattttgacgacaggagggatgcagaggatgctattcgtgatctagatggtaagaatggatggaaagttgaactatctcgtagcaccaatggtcgtggcagtcgtgatcggcatggtggatctgagtcaaagtgctatgagtgtggtgagactgggcactttgcacgtgaatgtcgtctgcgcattggctctggaggtctaggcagtggaagacgtcgcagcaggagcaggagccgcagtcgcagccctagataccgcaggagtccgagctataatagaaggagctatagccctcgttatcgttctccaaggcgccgtactccttcaccggctcgtggacgcagctatagcaggtcgccatagtacaactgtgacaaatatgcatctccctcgttaacggagtaatgatggcagatactggtgtagcaggagcttggcctgaagcccgtgcctgattcttctctgtgtgaggacttggttcttggtttggctgtggggaacaaatttggaactgtcgtcaactgcatgacttcagttcaggtttaaaaccttatctagcttattgtgattgtcttgattatgccattaaagaacttttaagatttgtgtattatgccactaagacatattaccttctctgtgttaaaaaggcatgttctgcttaaacgactcggccaactacggctctcagttgtagtcttcatggttttgttcctccattcttggcacgtccttatctgcaaatgaatgtcaaccttccattaccaaaaaaaaaaaaaaatgaagctccgtattcttcaccaaagatgctacttcgtcacaaattagtaacattctttcccccatatagttgatatggtttgagtgtactgagcactaacaattgcagctcatgaaaataaggcccttgatttttgtcatagaacaagagcggctattttaattgcagcactcacatgaaaataaatctactctgcatgccggggattgaggcgactgaagtgtgagccttcaggggta

SEQ ID NO: 23012 - DNA, 1829 bp, Zea mays
ggtccgtctctcgttctctccttcctatcggctccacacctccacgcaactggaagcttcgcttcaatctgccctactcctccgccgcctccaacaccgcagacgcagctgccgcgggcgggagcttggacgtgctactctgctctcatctcgtttccgcgcaggaattgttcacaatggcccgcgtgtatgttggcaacttggattcacgggtgacttctggggaactcgaagatgagttccgtgtgtttggagttctgcgaagtgtttggattgcacgtaaaccacctggctttgcatttattgattttgacgacaggagggatgcggaggatgctattcgtgatctagatggtaagaatggatggagagttgaactatctcgtaattccagtggtcgtggtggtcgtgatcggtatggtggatctgagtcgaagtgctatgaatgtggtgagactgggcactttgcacgtgaatgtcgtctgcgcattggctctggaggtctaggcagtggaagacgtcgcagtcgcagtcgcagtcgcagtcgcagcaggagcagaagccgcagccgcagccgcagccctagataccgcaggagtccaagctatagtagaaggagctatagccctcgttatcgctctccaaggcgccgtagtccttcgccaactcgcgcgcgcagctatagcaggtcaccatagtacaactgcaacgagtaatggtggcaggtactggtgtagcaggagctaggcctgaagcccgtgcctgatacttcttggtgtgagaacttagtccttggtttggctgtcaggaacaaatttggaactgtcgtcaactgcatgacttcagttcaggcatgttctgcttaaacgactcggccaactacggctctcagttagtcttcatggttttgttcctccattcttggcacgtccttatctgcaaacaaatgtcaacgttccattactagctgccttcgatgtttcatcatgaaattcttcaccgaagatgcaacttcatcacaaattagtaacatcctttcccctcatatagttgataaggtttgagtgtactgagcactaacaaatgcagctcgcgaaagtaagaccccttttcgtcatagaacaagacagctattttaattgcagcactcgtgtgaaaatatatctactctgcatggtgggattggggcgattgaagtgtgtggccttcagctgcacctagttgggcatcccaggaacctagtcaggctgactacagcaagaggcgcatcctttgactaaacatgtttgttttatttcttgtggtttgattcttcacttctgttcattgtgttctgccttcactgcaccctattggattggtagtggtcgaacaatgcttctgtctgtggtaagttattcttggtacaatggctcttctttacccctgatcagtgtatgttggactttctgatagagttagcaccaattgtagtataaatatgttcttttttctctggaaggtaattgtaattctatctgaatactccgatttgagatataatctgctcttgtcaaatggttttttaaagatcattctagtttcacctgtagctttcttccttttgcggccttaggcaaaggcaatgctggactcccgcatgttgcaatattactttcttattgcttggcattcatgctgcgttaaggtcacttactcatggaaagaagaatggttcctgttgctcttacagtgcatttgcgttctgtagaggatgtggtgcaccagtgtaattagctcggttaatctggtgtggcttgagtaaatttatggaaattactttttgagcc

SEQ ID NO: 23013 - DNA, 1020 bp, Zea mays
cacccggtcccccgcccccggcccgggtccgtctctcgttctctccttcctatcggctccacacctccacgcaactggaagcttcgctgcaatctgccctactcctcttccgccgcctccaacaccgcagacgcagctgccgcgggcgggagcttggacgtgctacgctgctctcatctcgtttccgcgcaggaattgttctcaatggcccgcgtgtatgttggcaacttggattcacgggtgacttctggggaactcgaagatgagttccgcgtgtttggagttctgcgaagtgtttggattgcacgtaaaccacctggctttgcatttattgattttgacgacaggagggatgcggaggatgctattcgtgatctagatggtaagaatggatggagagttgaactatctcgtaattccagtggtcgtggtggtcgtgatcggtatggtggatctgagtcgaagtgctatgaatgtggtgagactgggcactttgcacgtgaatgtcgtctgcgcattggctctggaggtctaggcagtggaagacgtcgcagtcgcagccgcagtcgcagtcgcagtcgcagcaggagcaggagcagaagccgcagccctagataccgcaggagtccaagctatagtagaaggagctatagccctcgttatcgctctccaaggcgccgtagtccttcgccagctcgcgcgcgcagctatagcaggtcaccatagtacaactgcaacgatgctgttatgcacaggtaatggtggcaggtactggtgtagcaggagctaggcctgaagcccgtgcctgatacttcttggtgtgagaacttagtccttggtttggctgtcaggaacaaatttggaactgtcgtcaactgcatgacttcagttcaggtttaaaaccttatctagcttaattgtgattgccttgattatgccattatagaacttaatatttggatgtattatgcgactaagacatattacctttcttctctgttgaaaaagcatgttctgctt

SEQ ID NO: 23014 - DNA, 1535 bp, Zea mays
cgttctctccttcctatcggctccacacctccacgcaactggaagcttcgctgcaatctgccctactcctcttccgccgcctccaacaccgcagacgcagctgccgcgggcgggagcttggacgtgctacgctgctctcatctcgtttccgcgcagttcaggaattgttctcaatggcccgcgtgtatgttggcaacttggattcacgggtgacttctggggaactcgaagatgagttccgcgtgtttggagttctgcgaagtgtttggattgcacgtaaaccacctggctttgcatttattgattttgacgacaggagggatgcggaggatgctattcgtgatctagatggtaagaatggatggagagttgaactatctcgtagcaccagtggtcgtggtggtcgtgatcggcatggtggatctgagtcaaagtgctatgagtgtggtgagactgggcactttgcacgtgaatgtcgtctgcgcattggctctggaggtctaggcagtggaagacgtcgcagcaggagcaggagccgcagtcgcagccctagataccgcaggagtccgagctataatagaaggagctatagccctcgttatcgttctccaaggcgccgtactccttcaccggctcgtggacgcagctatagcaggtcgccatagtacaactgtgacaaatatgcatctccctcgttaacggagtaatgatggcagatactggtgtagcaggagcttggcctgaagcccgtgcctgattcttctctgtgtgaggacttggttcttggtttggctgtggggaacaaatttggaactgtcgtcaactgcatgacttcagttcaggcatgttctgcttaaacgactcggccaactacggctctcagttgtagtcttcatggttttgttcctccattcttggcacgtccttatctgcaaatgaatgtcaaccttccattactatctgcctgcgatgtttcatcatgaaattcttcaccaaagatgctacttcgtcacaaattagtaacattctttcccccatatagttgatatggtttgagtgtactgagcactaacaattgcagctcatgaaaataaggcccttgatttttgtcatagaacaagagcggctattttaattgcagcactcacatgaaaataaatctactctgcatgccggggattgaggcgactgaagtgtgagccttcagctgcacgtagttggccatccaaggaacctagtcaggctgatttcagcaagaggcgcagcctacgactgaacttggttttattttttgtggttttgattcttcacttcttccttgtgttctgccttcactgcatcttattggtagtggtcgaataatgcttctgtatgtggtaaatcattcttggtacaatggctctcttttttctgctgatcaatgtatgtaggaatttctgatagacgccgttaattgtagcagaaatatgtttcctctgcaagataattgtaattatatgtgaatactctcaaaaaacataaatttgggggtaaaa

SEQ ID NO: 23015 - DNA, 2158 bp, Zea mays
gttttttttttttttttttttttttttcaataagcatgatttactatttgcattctcatcccttcctattttacctaaaattaaaggttctagtcctcagttttttttttttttttttggatccacaattcgttccagcccttaattaattttaattacaaaatgaacataaatagagtttccagctcgctcgcacagtcacgctccgttccgttcactgtgcaacaaacaaaaaacagagccgctccgtccgagattaccaaacacagaacagagcggctccgtttctagaatcagggatggaacgactctgttctacttggttcaggttcgttcactaaaccctctaatgggtctagtctcgcgctaggatcacatgagtgaccatacaaaaatcacgcaatgaactctacaagccagtatgtcactggaatttcttggcttcatctggtagatagcaattcttatcctcactgtcgggtggtggcggcacaccaaatacccagtccagcacattcaggtacttggaccggaagacttctctttcctgcgcatagcagtgcataatgatagaggtagctatgctgaacacaaccacatcagctcgctttatctgcagtattggagggcagagtcctgcatcggtcatccatgtgaaaaaactctcgatagctctggcaagacagtacagggatatctcaatcctcctgctcttcttctcgatgagcaaagccaggcctgttggaaacgtgccaaggatgacaagaggggtattggctctccggaagatcctaaaaagcaggcaggtccaagcccatgcagatgcacagtatactgagagaaacagactagatcttgctactcctagaaaactcttccctataattgagtaaggccttttcatgagatgctgcctatgaactacaagtgcagggactaagtagactggaacatatacaggaactgctcttccatatgcttgtaacaagaatgaaaagacatgtcctgtacatgactggttaccatgcacaattgagcaaggcactttcatgtttggatctagctttatgtcaacaccaacagatttgtagtacttctcgatacccgctaagttactgaaagcagtgtggttgactacatccttcacaccttgcaaaatagtaagatcttttccaccatgcttgtttagaaatgatttatatgatgatggcaaactgtcctgctttaaaatgtatgctgacaaaatttgtgcagatgagacgcacataaggaagacatcaccatgtgaccaagtcaaaggtttacagatttttccaaaacgcttgctctttattccacaacgggatgcaagcactgctgcacgcatcagaatgtatatagccaagctagtatgctgagttcctggtcctgtcaggagcatagaaggaccagcaatcaacccagctaaaaatgacctccaccttgctgttctcttacgtccccagacggcggcgatgtactcatcgacggagacgtagctgccggcaaaggtccccaagaacaagccatacctcacagtctccttgaccgcgagcaccacggcctcctcgttggtcatagctccggccttcctcgatctgggggagcggcggctgcggatgcggacgaggacggagaagagcgcgaggccgcccttgaggcctgcgccgatggcgaagcccttcgctgccgcctccacgcaccgccgcagccaccggagctcgccgtcccccgcggccagcgccggcggcgcggcgcacttgacgttcacggcgcattggagatcctccggcggcgggggcgccatgagctggccagcgatgggggaggcgcggatccccccaccaagccaccacagtgaggaaggggaagctctgctgagggcaaatggggggtggaatggtagatgcggcagttaaactaaccaaagttgttcttgctttggggctgcgaggcgcgcgtttacgccagtgcaggcagcgtgacttgccgtcagcggagctctacgactacgcatcttcgtatttgcaggcaatttcccctacccgtcagttccctgaaataagaaccctggtctcagaaatttactcctgatatgatataaatcttattatctcagaaaaaaaaaaaaaaaaaaaaa

SEQ ID NO: 23016 - DNA, 2420 bp, Zea mays
  misc_feature (430)..(430): n is a, c, g, or t
  misc_feature (1201)..(1201): n is a, c, g, or t
  misc_feature (1504)..(1504): n is a, c, g, or t
ctgcatcgattgatggaggatcaaatcgtaagggcagaaaatcattttaaagcacgtagtcaaagtgttatagcggggttgcatcatgtaggaacgatatgattaaaagattaagaaataaatttcaataagcatgatttactatttgcattcttatcccttcctattttaactaaaattaaaggttctagtcctcagtaggtgtgggggtggtaatggatccacgattcattcgagtccttaattaattttagttaaaaatgtacataaatagagttcaatccttaaattgccagtataaattttagagcccattgctacccttaaccctcatctctaattaagaaaatcgtagactatctccatcatactccatatcatactccttatttcaaacttcactctgcaaacggtataaacagtcatttanatgacctgctggagatggcttggtaaagtgagtctatgggcgggagatgtggtcaattgtgcaagctctgaactccatctccaagttcttcagccagaacggtctataagaaaacaaaagaatgagaaattccatttaaacaatttcaaggaccataagttatattcgcatgacaacaacaacaataaaggtcataagttacaaccacatatggtcatttaatgaccagggcatcgtttggacaaatcaattaattaaaaaatctatcttgctatatccactaaagtcccgattttccgaagagtcctgtacaaggttcgttcactaaaccctctaatgggtctagtctcgcgctaggatcacatgggtgaccatacaaaaatcatgcaatgaactctacaagccagtatgtcactggcatttcttggcttcatctggtagatagcagttcttatcctcactgtcgggtggtggcggcacaccaaatacccagtccagcacattcaggtacttggaccggaagacttctctttcctgcgcatagcagtgcataatgatagaggtagctatgctgaacacaaccacatcagctcgctttatctgaagtattggagggcagagtcctgcatcggtcatccatgtgaaaaaactctcgatagctctggcaagacagtacagggatatctcaatcctcctgctcttcttctcgatgagcaaagccagacctgttggaaacgggcctggggaagtaacttagtatcatacggctanaggattaggaaaagatgctgaattcatgtgctgaagttgttctgcataccgtgccaaggatgacaagaggggtattggctctccggaagatcctaaaaagcaggcaggtccaagccctgatatatagaagggaacaccattaattgccatcccaaggaaaaaaacaattatacaccttggtccttactgcaagagcagaataataaatagtgagctcaccatgcagatgcacagtatactgagagaaacagactagatcttgctactcctagaaaactcttccctataattgagtaaggcctncatgttttaagggacatggaacagttagagaaactgcattcttttataaaaaatggagaaggcagcatttcagctttgaatagacaaatatgtaattatattgttcacgagttctgcttgtttccattttcactttttcagccaaaacaggataagtttatggagcacaatcatccctggcacatcaggctcaattgatgcagcgtatgcatggtttttgtatgcagaaaaacttctctcccaattaacaactaaacttgccactgaattgcatcaacatatattagtataccttttcatgagatgctgcctatgaactacaagtgcagggactaagtagactggaacatatacaggaactgctcttccatatgcttgtaacaagaatgaaaagacatgtcctgtacatgactggttaccatgcacaatctggaaagcaaacacaagaagttagatcatggagggtaaagaaaattaacaaaaaaaatgaaaacagattaggtgtagatagttcggaccagagaaaggtatgccacagaattgattctattttctggatgcttgatatgtcaaacttcaaagtacaatggatagtagctcaatatcattcatatggatcttaagacttactgagcaaggcactttcatgtttggatctagctttatgtcaacaccaacagatttgtagtacttctcgatacccactaagttactgaaagcagtgtggttgactacatccttcacaccttgcaaaatagtaagatcttttccaccatgcttgtttagaaatgatttatatgatgatggcaaactgtcctgctttaaaatgtatgctgacctgcatagaaaataacgaaggaaaaaatcactatgtctacagaatttatggcatgatatatatgcagtcttgatcttg

SEQ ID NO: 23017 - DNA, 1467 bp, Zea mays
ccggggcctctttctcacgcaccttctgttggctcctcctccgtcctcccccaagcgccccctctcggccggtcgcaaggtctgcggctctgcgcactggtccgattcccggggagggggatttgatatatatcgagagagtagtgtttgttccccccggattcctcatccgtggcgcccaaaacctagagatccttttttgcgcccgattcggtcccgttagaggggatctgtgtacctcgccgccggccggcgctgtcgatctggttgtcttccacggttggtttccagacggggactccgccggcgcggcgcggcgcggcgctcacccgcatccgccgccgcttttctaccgcccgcggggctgggtccggctctgacggttgagtctggtggcgcaggcggaactgcaccccatggaaatggaatcgagagaacttacacgctgcttcgcaaccgtattatgcagttattactgaaaagataatacagtacctatggcttctctggacgccgtgcgaggagacctcgccctgctgattctgtacctgaacaaggccgaggcgcgggacaagatctgccgagcgatccagtacgggtccaagttcatcagcaacggcgagccagggcctgcgcagaacgtcgacaagtccaccagcctggcccggaaagtgttccggctctgtaagttcgtcaacgacctgcacgctttgatcagccctcctgccaaggggactccgctcccgctgatcctactcgggaagtccaagaacgcgatgctgtcgactttcctcttcctggaccagatcgtgtgggcggggaggacaggaatatacaagaacaaggagcgggcggagtttctcgggaggatagcgttctactgcttcctcggctccaacacctgcacggccatcatcgagctagccgagctgcaacggctgtccacgtcgatgaagaagctggagaaggagctgaagcaccaagagctgtacaagaacgagcagtaccgcatgaagctgcacaagtcgaacgagcggctgctggcgctcgtcaagtcgagcctggacatcgtggtggccgtggggctcctgcagctggccccgaagaaggtgaccccccgcgtcacgggcgcgtttggcttcgccagctccctcatcgcttgctaccagctgcttccaagcccaccagcaaagcagagcaagtgaggactcccactccaagcactgtttaccaggaaaataatcccccccggataggtttgatttggttgccacatccccttgtatggcagactagactaatatatgtaatcatcatcataataattgataaaccatcccactatggataggtttggtcaaaaaaaaaaaaaaaaaaaaaaaaccggaaaaaaaaaaaaaaaagcggccaaaaaaaaaaaaaaaaaaaaaaaaaaaaaaaaaaaaaaaaggggcgggccgttttaaa

SEQ ID NO: 23018 - DNA, 842 bp, Zea mays
  misc_feature (3)..(3): n is a, c, g, or t
agngagagaatcaaaaaggacgtccttggcgtggtgtcctcgtcctcgtgcccatctctgtcccaatcaaactgattgatccgtcgcccgcagggccacagcagccgcggcgaggtcgtccgtcggattcggaggctcaggcggaactgcaccccatggaaatggaatcgagcgaacttacacgctgcttcgcaaccgtattatgcagttattactgaaaagataatacagtacctatggcttctctggacgccgtgcgaggagacctcgccctgctgattctgtacctgaacaaggccgaggcgcgggacaagatctgccgagcgatccagtacgggtccaagttcatcagcaacggcgagccagggcctgcgcagaacgtcgacaagtccaccagcctggcccggaaagtgttccggctctgtaagttcgtcaacgacctgcacgctttgatcagccctcctgccaaggggactccgctcccgctgatcctactcgggaagtccaagaacgcgatgctgtcgactttcctcttcctggaccagatcgtgtgggcggggaggacaggaatatacaagaacaaggagcgggcggagtttctcgggaggatagcgttctactgcttcctcggctccaacacctgcacggccatcatcgagctagccgagctgcaacggctgtccacgtcgatgaagaagctggagaaggagctgaagcaccaagagctgtacaagaacgagcagtaccgcatgaagctgcacaagtcgaacgagcggctgctggcgctcgtcaagtcgagcctggacatcgttggtggccgtggggctcctgcactgggcccc

SEQ ID NO: 23019 - DNA, 1222 bp, Zea mays
cattgggaccctcgaggccgcctcgaggccggccggcgtccttggcgtggtgtcctcgtcctcgtgcccatctctgtcccaatcaaactgattgatccgtcgcccgcagggccacagcagccgcggcgaggtcgtccgtcggattcggaggctcagttattactgaaaagataatacagtacctatggcttctctggacgccgtgcgaggagacctcgccctgctgattctgtacctgaacaaggccgaggcgcgggacaagatctgccgagcgatccagtacgggtccaagttcatcagcaacggcgagccagggcctgcgcagaacgtcgacaagtccaccagcctggcccggaaagtgttccggctctgtaagttcgtcaacgacctgcacgctttgatcagccctcctgccaaggggactccgctcccgctgatcctactcgggaagtccaagaacgcgatgctgtcgactttcctcttcctggaccagatcgtgtgggcggggaggacaggaatatacaagaacaaggagcgggcggagtttctcgggaggatagcgttctactgcttcctcggctccaacacctgcacggccatcatcgagctagccgagctgcaacggctgtccacgtcgatgaagaagctggagaaggagctgaagcaccaagagctgtacaagaacgagcagtaccgcatgaagctgcacaagtcgaacgagcggctgctggcgctcgtcaagtcgagcctggacatcgtggtggccgtggggctcctgcagctggccccgaagaaggtgaccccccgcgtcacggggcgcgtttggcttcgccagctccctcatcgcttgctaccagctgcttccaagcccaccagcaaagcagagcaagtgaggactccgactccaagcactgtttaccaggaaaataatccccccggataggtttgatttggttgccacatccccttgtatggcagactagactaatatatgtaatcatcatcataataattgataaaccatcccactatggataggtttggtcactccaaacactgttttttttattcatcgctcggagcgtgcatgctaaggcccgtttagtttgatggactaaacattagtctctctattttagtctctaaattgtcaaacgatgagactaaaataaagactaaactgtttaggctctagtcactcaaagggactaaaagtgcctaa

SEQ ID NO: 23020 - DNA, 1681 bp, Zea mays
aagcaacccaatacgccatctattcccgtcgctgtcgtccacctgtttttttcgttgatccgcagccgccccttccttctcccatttcggcgtctcgaagccagtagattattcatttctcgatccacaaatccctccacactctccatcccgaaccctgaaatcgaggagcgcgggaggacgccgcaaagcgcgttggctcttagggtttgccggtagggttgggaggctccgatccgggcgcgcaggcatgaggattcgggagctccgagatgggctggaggtggaggacgacgagcgggaggagcagggatcggaggttggcagtggttacggggaggttgtcgcggttgtgcgactgcgggcgaagcgcgctatcgttggtgccggcgcgagggtcctgttctatccgacgcttctctacaacgtgctccgcaaccggttcgatggcgagttccgctggtgggatcgcatcgacaagtatgttttgctaggtgctgttccgttctctagcgatgttctgcgcctgaagcaacttggtgtaagaggagttgttacactcaatgaaccctatgaaactctggttccgacatccttataccaggctcatggaatcaatcatctcaaaattcctacaagagactacctgtttgccccatccctggagcatatttgtcgtgcagtggattttatccattgtaatgaagtgcaaggtggtagcacctatgtccactgtaaggctggaaggggacgaagcaccactatagttttgtgttttttgatcaagtacagaaatatgactcctgaagtagctttggatcatgcgaggtctgtgaggcctagagtgcttttagcgcccgcacagtggcaggccgttaaaatgttcagcaagctcaacgctagatgcctttccatacagagctcgaacccaacttgctcagcactatctaatgaggaatccagtgaactgtcaagcacgatgagcagcagatgccttcggattcagagctcaaatgaggtctcgataacttgtgaagaatccaatgaagcatcctttggagaccctgaagttgatggctacaccaccactgagtttgacaccgagcattttgttttacctcgttgtcgaagtatgctgtccagaccaacgagccccactgggtgtagtgatgcagtcttcataaccgaagaagatctagagggctatgagacctacgccgatgacgggaaggacgttgtcgaagtgcaagtagtggttcgccacaagcccatcatgaggaaactctcctgcttccttgggtccttgaagcttaccggcaattgcgagccaccacctggccgtttgaccgaggttcgagcctgctaggtggatcagctatggtttccgcatctgtttttcgctctttgtacatcggcagagtgtaattaccggcatgagtttgcacagcctgcggaattccctcgggacagaactgtatgttgtggcatgtgggtggcgagataaatttggctatcgggagccgggagacctgtgggttgttgcagggagtgcgagagatctgtgtgcatatctggtatgaatgttttccttgtaataaaaagatgtttccttcttgtaataaaaaagatgtactccctccattaataaagctgcacttttcccacaaaaaaaaaaaaaaaa

SEQ ID NO: 23021 - DNA, 4228 bp, Zea mays
  misc_feature (61)..(61): n is a, c, g, or t
  misc_feature (1799)..(1799): n is a, c, g, or t
  misc_feature (1965)..(1965): n is a, c, g, or t
  misc_feature (2631)..(2631): n is a, c, g, or t
cttttgtgttatattgtaatggactatgtgatgtatttatgaagaattgtgaattgtagantcttgatattttggtgaactgtgacgtatttgtgaaaaattgtgatattttgtgttaaatgtatgtaattctataattaatgtttctgtcatattattgtgattatattgttgttgaaattgctgttttttataatttttttctctgaaattacttattttcggcgaccaaatggtgaccgcggaaatattgctggtaaaattttggcggcctctattttcgacaggtatggccgtcgaaaattaatgtttatttttggctaatatttttggcggacagaatcagctgaaaatacgcttaaaatagtttattttcggtaggaatagtcttattttcgacggcttctacccgcaaaaaatgattgtagctgtttagtgtccgcttgtccagttcatgtagtcgatggaagtgcggtgtgttccggccggcgccgacggtggcttccgtgttaggcacgtcccacgttacgcatcgatctgacgatccctatgtctctcctcccatggccacctgatcggcatccctgagcaagctcgcgtcactcgtcaggtacggtggccaggcctgcaagttcgccgatcgagcgccacgcgacgagtgctcccagctgcctccccgaagtgcttgccgtcatcactcaggagtcaagcatatgcgcacatgcatcaacactgtagttttttctcgcgttgacgcgttatccaaaaaaaaagtcaaaaaggaatcagaatgcattagcctacctgttgctcgcttccctgtctgactgaagaagctgaattgccgctgccggccgggtgcatgcatggcattgcgtgcagactgcatgcgaccctgaacctgtggaatgatgcagcggtacctgttcattcctcccctggaagacaacgactagacaagcaaagcatttactcattcgttcgttcgttcgttccaatgtcaaatgacaatgcaaaacgtctctccctctcgttcgtagcctcatctctgatcctctccacgcactgccaccgtcgtctagccgtgcgcacgcccgtgctgctgggtgtgtatatatacatacaaagcatgcattgcatacgtgtacacatcgcagcacacagctgatcacacgacgatcgcgatcggttgctagctgaatccatccaccgatcgaccatgaggtcctcgacgcttgcagttgcagcagcggttcttgtcctctccgtgctcgtcgcgtccggtggcgcggcagcgcggcgaccggtggtgatgaggcaggggcagggcggcagcagccctggcgccagcgccgtgctgcaggatcgcgtcgccatggcggtgcagtcgacgagcacgaattcctcggcgcagccgtccaactgcacctacgggcacaactccggcggcgtgtgccctccgactcctcccgctcccggtgcaggccactagccactagcagtagcagcaagttcccagccacccgccggaaacgcctcggctggacttacaacagacatttcgtgtgtagcttcgagtcggcccaataaatccctagagcccagatcgttactcttgtgtattggagtatcaagtatgtattttgacgtgagaacaggctgggcctgttggccgatctcgtagcccatgggcttcagcccctaccgacacaggtttatcaattggtgttattttttatttccctcaaacaaactgttgttttatatggagagagataatggcaagagcttcgccgacnaatgtatcgttgttatacatgtccatatgggccaacccgttggacggcccatgacctgacccgctcaaaacccggcacgacatgatgcgcgtgtcgtgcttgggctgcatatgcgacccgtggtgtaagcacggcccgacccaactaaagtgcactgcccggcacnggcccgacacacgcacaccggcacaccgccctctcactccccacacgcctgctcgttcgagaaacccgtatctcgtctgatccccattcgcctccctcgccgcctcgcgtagacgcactcgctcgtgtagttgtcttcgacttcgatcggtgctcagcgtccaggttcaagctcctctcgtccaccccgttggttgtttccccctcgtcaagaatctggtgctctggtttcaggtctagtttccatcattgctcgcttgctccacttccaggttttagatccactctaggtatcagcttccagtgttatgttctctctgttcttaccttctactaccttctagctacccctcttgccctccattccctcctaccttctttgtttggaaaccctaatcctcgatctttcaagatctccgctctatcttccccttctcgatgaatctggtgctctggctgcgcaacgcaagtgatagtaccaccatctacatcttctctacctctcgagttctttgttggttaccctgatagtaaccatttgttgtcgtttttggtgtagttcttttgctatttgtgtgtcgtgaggaactagatgagctgagtagaccatggatttagatccgaccgccgaggaggaggagcggagacttgaagatcataacaaggnggaggatgccatgcgcttcatcatggaggtggccatggatttagcactctggccgatgggaactagcagaccagcataagcaacacatagtggacaaggagaccaaagatcttgaagctacatttgatgctatgtacctggatgaagacccaagcaagtagtcatgagtgacagtgaactatgtgctgctgctacaatagttgctacctgttggagttctgtttatttattctgtacacctcttgtaatgtctatgaatctggacctggacatgaactgttgaacatttgaactaaaacctaaaaggagctagttgtacccttttcattcctagggttttctcataatatgtgagcttttacctagaaaggtttgtaacgatgcatcattgcactaagtctccattagtattcacttgcgttgtgatgattaagggtgaaaacggccggtaacggtcggaaaaaacctctcaccattttcactcgcataattttttgttcggtcagaatcggtaaacgggaaagtcagaaacggataacggccggtaaattccggtatatcgaaaacggataaattcgagcaaaatagctcgaaattgatcgggaaacggtaactataatcgaaaaagctcacaataaacaaatcctaaccacacatatgttcattcacatccacatacaagtctcattcacaaaagtacacaaaacacaatcttgtccacatataattggtcatacactcatacatgtccactcttaaattttaacacacaacacataagtcttaaaacacgattgttcattcacattcacatacaagtctcaaccacgcaaatatacaatacatagtcatgaccacacataaatgatcatacatgttcactgaagttttaaccatatagtatataagtcttaaacacgatacaatgatacataaactagaaatcatgtggcatgtcatctggatcacttgatatatcttctatgacatctgaaaaccctaatccctaacgagtatagttcttgcctccttggttgttttgtgggccaggaaaatacggttaaatacgggaaaataccgaattttcccgagaaatctgaaaacggacggtaaatatgtctcaccgtttaccgtaccgtttttgtaataacatatcccgttctcgccccgtttttcgcatatcccgaaaaatctgaaaacggtcggaaaaatttggtaaacggtaacgaaaatttaccgaccatttacatccttagtgatgattttgatatgaatattgtgaattctgttatctaaatgctgtgaattatgtagattctagatttgtgcactgtagttgtgttatctgaatgttgtgtactgtaatctagatatgtgcactgtaattctcttagtatactggaatttgtgttgtttggtatgataacagggctgatgagctaccgacacatcgtaccaccgtccgagtaagagttagcaggcgtgtcgagcttgggtatgagtgcagtccggctcggcacggaactgttggcgtgccaggctcggcccagccatattcgtgtcgggccaagtcatgctcggggctgggtgggcccgg

SEQ ID NO: 23022 - DNA, 790 bp, Zea mays
ttttttttttttttttattttttttgcttgcttctgttcacaccacctcgtaaaattctcacagtcaagtcaagtcaagcccgtgaaggaaatcccgcagaacaagagtagagaagtaaaaaaaaaaaagagaaacgaaaaaacagttgcagtgctctcgtcgtctgcctacaggctacagcctcactggtggtacccgttctgaattggggccgtgggccgtcctgaacccgttggcggcggcgaggccgaggtcggcgcaggagctggaggcgggcttcttggccacatcatccctcccagtcccagtcccagcgcgccgtagctcttgttggtcctgtgcttgtaggggctgcccttcttgcgcaggtcctccaggcagcgcacctccgacatgcacgcgaacgactgcgacttgccctcgtagtaccgcgatagccctttcttggctgggagctgctgcgacaccatggacgccatgtcgtagatgctgtccgagttcatcctccgcagcggcggcacgaacgcgcggcgctcctggtcgcacgagccctcgccgccggagacggacggcgccgtctcgaacagctcctcgtccccctcctcgcggtccgccgcgcctccaagccggtagctcatgtcgctctgctctgcagcggcaaagcctcgctccgtctcgctctcgctagcggctcacccgaacaacccaggagaaacgcttctccctctcggtctcttccgcttcgcttccttgggctccctctccctcccggcctcgtggttcccaatg

SEQ ID NO: 23023 - DNA, 957 bp, Zea mays
ctgcctggactaccgtgcttcgtattcacaggctaaaaagcagcaacagtgcagaacgggcaacggtaagttcctcttgctgttcttgtgacaaatcacaccacctcataaatttctcacagactaatgcgtccgtgaaggaaataaatcccggcagaacaagcagtctagaacgggaagaaggaaggaaagaaagaaagagaaaaaaaacagttcagtgaccctcgggaggaacaaaaacgccttcctccagttgcagttgcagttgcagtgctctctggccaagccgccaacctgccctgcctactggtggtactggtacccgtcctgaatcggggacgtcctgaacccgttggcggcggcgaggcccaggccggcgcaggatccggaggaagggggcttgttggccatcatcatccctcccagcgcgacgtagcccttgcacgacgacttgaccttctgcttgtaggggctgtccttcttgcgcaggtcgtccaggcagcgcacctccgacatgcacgcgaacgactgggacttgccctcgtagtgccgcgacagccctttcttggctgggactagctgcgacaccatggacggcatgtcgtagatgctgtccgagttcatcctccgcagcggctgcggctgcggctgcggcacgggcgcgcggcggcggcggtcctgctggtcgcacggaccctcgccccccgccgcgccggcgctagggaagcggtcgccctcgtcgtcggagtcggcgtcggcgctggagacggacggggccggcgccctccgctcctcgtcgccctcctcgcggtccccaagcatgtcgctcgctcgctcggcaagcctcgccctcgcccgaacgcaagaggaaacgctgctgaccgcttgcgttgcgcccttttcggtcgcttttgcctgtgtttcgtttcgcttccttgcggatcccctctgcgtgcg

SEQ ID NO: 23024 - DNA, 3065 bp, Zea mays
tttttttttcccccctcttgtctttttttttttttttttttaccacaaactaatctgaaactttgatacaggacaaattagagcaagtgcaaagcacgtttacaccagaccgcccttggcagcttttgtgtacaattctatgggcctataacttgctactatcaaactaaaatacagttcaaaacgaaaggtgctggactggacgcctatgtatgggaaacaaatgctgctgactgactaaatatcgacacggagggccgtcaagaaagctagcgtgtacggagaggtggacttgccgaagggcgtgcaccaccgtggcagcttctccaccacccttgccacctgcggtgtgactctattcacatctgttcttagtttcaccagcaaaggagcgtccgctgcttgtttagcttctctctcagatggtttgctagacgaccagtatagcgtcagctggaacttcgtcggcgagttcttgccccctgcaaactggattgtatgccacccatctatctcgctcttatcaccaggtaggactatcttctccgaatccacttgaactgtgaagtcatcgattccatctttgttgattccaagcgtccaacgcgtcgatgacttggtatccactgatactactgtctgtcgagcaccacctataaccgaatcactttctacaaggagcacaggaacctcagacctgctccatccggtactgctctctttgtaactccaacagcccggcttcgctgggcggacgctgccaagtcagtagtcatgttccttccgcaagaaaattcttcgcctccaaggtccactaattcattcgtcagctttccaggtgtattggaaaacaaagagatataggatactggttctatatgcccgccatgtactcctgtggtatcgacgacatgtacaacgtttacagatcgagcgacatcctccgtaaatgctggcacaatgccacttgatgccaaagcaattgaaagaccaaaggataaggataatagcaaacccagaattcttttatcacctgagatatgaatgtatgaaagcagatacacaaacgtggaacaaacgacaacagcaatggcaaccgaaactattacatttccaagccagtctggtagtccgccaggattcctgtcaatacgtactatacttccaacaattacatccgccatacgaacagccaaaccagcagaagacacaactggtgcaaccaaacccacaaccaacgtgacaaccttaagctgtttaggtagccgaacaggggagagagtagcttccaaaaaaccatatgcaaaagcaggagaaacaagccagatgagtgctatatacgatgatccaaccttgaaatatgttcctagtatcagagctattaaccactggacaaaacccgatttaaaaatccacctctccgcttccaggtcagtaacattttctatcatgctaggagttatgcccgcgcgtccgttggaatgcacgcgtcgaagatgcctcttcaggagaataaatccaatatgctgaccaataaatgctccaagcagtgcaggtgaaccaaataagccaatagttaaccatggatttgcaacatatggaataggaaacggacacatatagggcagagcaaatgctaccacaactggtaagcagatagaaaatatccacattagaatgatgctcaaacatgatattgcaaaggacaccagtgcagggtgtccacccataagcaatgatgttccccatattagaagtgactgcaatatgattgagttgtgaaacatggtagcaagtcgcagcggatagaccaccatgtactttcccaggatatcgaagtaaacagctctatcctgctctgtctttccttgcttcctttgttgtgcatctttcaaaaattttggagatgctgcagaatggagtaggaaagcaagcatgttatctccaatatgctgaagagaccctggtttcagaagcgccatcttgtcattcttcgtatgatacacagatgttgtatcggtatatgcaaaatcaagtccaggaagacggccaacttcctcatatatttgaaaatcagtagcagattttattgcgccagaactaaaaacatcctgtgaagctatctgagcagatgggtatttggctacagctgcaaagctttccaatgcccaatggtcagtaccctggaagagtgtggatttcccactgatacccatagcttccagatcaaccgcaaatattactgaatttctccagtggtgctgagttataaaactatgggcgccatcaagaccctcttcttctccagtattaaataaaaacaagataccactcttaaacccatgtgcccactgggccactccccgtgcaagctctaacatgactcccacacatgaactgcaatctccagctccttccgttgtcgaaacagtgtcaatatgagaagaaaccagaatcaagttttcctcagcttctggtaaatatttgggagtaactctcaatagcacatgctttaagtctgaatacaagagagtctttcccttggaaagaccaccagatagacgatttgcgcctatatctgaatagcatgatcgaggggatctgaaccgactgggtgaggacccaagcctgtcaaatactttacatgcttcagcgccgaagcttccgagaaacccctctttccagcctgctcagcatcaaggggcaaaggaaggcttccaaactggatctgataaacagaccatgatccatgaaggaacactatcagcaatcccagtagcaaataagcacccctcctattcttgcggctgtcatcatttgaatcagttgcccgatcaactttgggattctcacgggttgacacagaagagccttgtcctcgaggcattctgataatctgtgcactggagtctggaggagagttgggcagcgaacgaggcgacgctagggttccgtgacgcggttgcgctggacgcgcgcgcgtgctggtcgtcgactcgcccctcccacccgcccgccgaggatggagagcgcggagaagaccccgcgtgccggcctgcccggac

SEQ ID NO: 23025 - DNA, 997 bp, Zea mays
cccccccctcgagtttttttaccccctcttttttttttttttttttaaaagaaaatttcgctttcttttttttttttttttaggttcaatagggagtctataatacatcaatttaaataccaagtaaacaacggtattcctcgctacagatgctttctagaacaggtacaacaaactgaatttagagcaggttacaaacatttttggcgtcaatttgcctttcctgctaagtgtatacttcaggttgctaccctcaggctacagaagaacagaacataacctgattatcctacattaatccatcaggtcaattcttcttggattgctgtctatttccagttgttaaattgttttctgtgaccaaagcactagcattattctttggtgaggcttcaccagccaagggtggagagttgttcttggcagagaaatctgctgctgaagatggagaatttcccttctcatggctgttcttgtcgcgggaaaaaaattctgggtttgcaaatgatcttgtacatggccacctgcttgaccgaattgtttcacctccaacaatggtttctgattcaaaaatgttccctctgtcaaaagccttcttagagaaaaacttagccttcagacgggctgcaaggattgcttgatatctattgattttttgtccatgctcttgggttactgcttctgagtcgttgtcccgcggcaagtggagcttggcctcctcctgcttcggtacagtcgcggcggcagcgtttccttcctccttaacccggtgttgctccgacgtcggggcgggggtggcggcggcggtagcagcagctgctgctgcttctggcggcgggacaggggcggcaccggcggtgcgcagccacggggaggaagccatcggttgcgcagtgatacggaggccggtctgccgcgaggccggcgctgggaaatttttgctggtgaattgataggagagtgcgaatgcgaatcgctgcctcgtccacttattctc

SEQ ID NO: 23026 - DNA, 2990 bp, Zea mays
cagtaagcatgctaacagcataactaacagttaaaaaggtatggtggaaaaaatcgcatactgtgttgctttcgtgttttctacagctctcaatgcttgcatcgagaacgagaactgagcacattgaacatgacaatataagtctgcataatcctgacagtaagctgctacatcagcacaaaacaaggtatataatttacacttcaaaaggaaacatcttacgccaactgctgctaggtcaaaggattaaaaagtttcaaacacaaaaatttaagtacagagcaagctccagcttcaagtgcaaacttatttagcatcgccagatggtggaactacatgaagaagctcctgtggagttgagcctggatccaattcatagcaccccttgggagcattatgagcttcttctccagtaaggacatggaatggcacttggtgtgaaaaacacatcatctcttcccttggtatcctccagcttctcgttgcgttgtgaacaggcttaaacactgacacaaacccaggaaccttcacaataggcatcacagaaatgcctctggaaggactgtagctgtcaagaatctcgaccagttcatacttgtaaatcatatcatcagctgtgaattgatcccagtcaggggaccaattctggtacagagcccagatatcacctttcttaggaaaaattctgataatgcctcctggacctttgtcatacttgaccttatgtgagaagatattcacttggtcagtatgtttggacacatcaaacttgaactcaccacaggtcttggagtatccacacgagagccaactggaggctccgaactcattagagtcgtttgctttgaggtggaccagtctaactttaaaagggcgagtggaaatgacttttctgatcaaagcataatagcgaggcataccatcttcttcatcatacatggcccagacttgatcattttgaaatgaactttcagaatgatcaccaaaactggaaaaatctgcatcaggaacactgtagaaatctgcatcaggaacaggaattttgtcagagcctgcatcaggacatacttggttcaaacagccatatctggcaggcatatggtgctctgttcccggagtagcaccagttacttcatctcccagttccttcttgtgttgcttgcggtttctcctcgtgtatactatgcgcacttcaggtacaggccatgacttcagcttttctttcaacccaacctgtttactgctcttctgcctctccttttcttcagaatcaacccttctgctaaccaactccaagacatctttttttggatcaactgaactgctgctttgcttcatctcaattttattgacctcattttctatgttgcaaacaccttttctgctgcttttcttaccattctgcatcttttgtttctttttcacattggctttcttgctactgagctcctgcaatttctgagcttgaagtttccccttttcaattaggatgctacggacatctaacttcatgagcactctgccaaagctggtccttccaacatcactagaagattcacaattaaaatcaccagaagacaccttgtgtttcttggcacctgatgtttcagaggttgagcgaggctttctttttactgggaacaccggtttgcatccatcaccatcagggtaggaggctgctgactgccaggttccttgcttgccagcattggcgtgttttctctttgcagcttcatgctcccttgttgctgcatttgctcgtctggcagaagagactgcatgtgcatgtttccttgcagcatgctgcagaacttttgtgcaatttgcttcttcattagcgggtatactagctccagctgcatcatcttttctaatactatcatgtgtctgttggaccgtatgtttagtactttttgcacatgttgcagatttgaacactgttggatcacaattttgattgccctgtgacactcctgcctgtactcctggagccaccatgccaggaactgtattgccaccaatgttattattagtagacataggcatcggctcagtcgggtaaatctgaacacttggtggtcgaacttcagcagcaacaaacactgcatgacaattatgacacttcagatggtggttgaagtattccctggagtactggaagttcataagacatgaccagcagagtgtccagaatgtttctattccttcatgggcgaggtggggcgccacttccctacgtctggcacagaatctatccacacttgacatagaggagttggaattcttacgggcagttgctttgaagttattctgatgcactcctagggcatgcacacgcctcctgtggtcatacaccgtcctcttggcagtattggacaacacattccaagcatccgagatgagattaaaagcggctttagcacaaacagagctatttttgtcaggatgagtttggaaggccaacttcttgtatttcttcttgattgcctcctcatcagccatgggtggcacctctaagatcccataccagtcattttcccctgcaatctttgtctgtgcccttacgtggacatctaaggctacaatcatctgatcaatgccctcaagcgtctcaaaaagagcctttgctttgagggcaaacttcttcgcacccgtaatgtcattctccctgaactttgtttcagcaatatcctttgatcgcaccgcgtcatctctgttgcactccatatcgaatcgggaaggagacgaatctgctgtgcggaggactcctagcatccgacggggaggtcctcaccctgcgcgacggcgcgacggtgcacgtgaataatgcggacgtcacagggagggtgctggcaatggacgaccacggagtcgccgaaggcaaaggggaggacggggtgccgctcacctcgtcggcgacgagccgagaggaggcactagcgaggaccgcccgcgtcgcggggcgccgcgagagcttcgaggggagatcg

SEQ ID NO: 23027 - DNA, 3866 bp, Zea mays
  misc_feature (676)..(676): n is a, c, g, or t
ttaattcggcacgaggaggcggcgatcgtggatgggcagcggcggggtcgcggggcgtgggttgtaggagcggtggcggtggggaagccagagtcggagcgggtgcttgcgctggtctccgcgctggggaggaggggagggagcggcgggtagggatgaagcgcggcacgggggcaaggaatgggttgctgccgagctcgctgcggatcatatcgtcctgcctcaagacggtgacctccaacgctggctccgtcgcgtctaccgtgcgctcggcgggcgcctccgtcgccgcctccatctcctccccttccgaggacgagaaggaccaggttttgtgggctggatttgataaactggagcttcaaccatcatcattcaagcatgtcctgcttgttggttattcaaatgggtttcaagtgctcgatgttgaggatgctgcaaatgtttgcgagttggtctcaaaacgtgatggcccagttacgtttttacaaatgcaacccactccagttagctctgaaggcattgaaggattcagagcatcccatcccatgcttctagttgttgctggtgatgagacaaatggcctgggtgcggttcaaggtggtcgcttaagtgctcttatcagagacacaaacagtgagcctcaagctggaagttgcatttctaccccaacggnttgtccgtttctactctttgaagtctcacacctatgtacacgttcttcgattccggtctgctgtatatttagttcgctgcagtccaaggattgttgctgtagcacttgcagcacaaatctactgctttgatgctgttactcttgagaacaagctcagcgtcttgtcatatcctctgcaaggtgcacctggggtaaatattgggtatggcccgatggctgttggccccagatggttagcctatgccacaaatactcctttattgtcaaacacaggccgtctaagtccacagaacctcacaccttcaccaggagtgagcccatctacttctcctagcagtggcagtttagttgctagatatgcaatggagtccagcaagcaattagcttctggtattattgacatgggatataaaacattttcaaagtaccgccaggaacttctaccagatggttctaactcccctttgtcatcaagcccaggcaggagatctggtaaaattccttccagtgtgcatccactggaagctgacaatgcaggaatggtagtcatcaaggatttcacttccaaagctgtggtctcacagtttagggctcacacaagtcctatatctgctctttgttttgatcctagtggaacacttttggtgacaacctctgttcatggccataacataaatgttttcaggatcatgccaacttgcgttgctaatggcacaggcgcaacgcgctatgattggacagcatctcatgttcatctttataaactgtatcgtggcatgacatcagctgtcatacaagacatctcgtttagtcattttagccaatggatatctattgtttcatctcgtggtacctgccatatttttacattgtccccatttggtggtgatgccagcctgcagccacagaattctcacagtgacgggccacctcttgcgccatgtcagtcaaggccatggtggtcaaagccgtcctttctgatggaccaacagcttcatcaagttccctcaactgtgacaaattcggtagtcagtaggataaagaataacaattctggttggctaaatactgtcagcaatgtggctgcttctgcaagtggaaaactatctgtaccatctggcgctgtaactgctgtttttcataattccatctaccagggttctttgccagttccatctaaggctaatgctttagaacatctactggtgtattcgccatctggtcatgttattcaacatgaacttttaccttcttcaggttctgagtcctctggtagcagcccaagagttggttcaggtcataactcgcaactccaagatgatgagatgcatgttactgctgaaccaattcaatggtgggatgtgtgccgtaggacaaactggcccgaaagagatgaaaacattgcaaacattgtactgtataaccaaagaagcagtatgatggctatggatgtttctgactgtgaagatagcgagcattcggattccactgcatcaaatgatggtatctctgggaaagagattatgagagtccgagaaaggtcaagctggtatctatctaatgcagaagtacagataaactcatggcggattcccatctggcagaaatctaagatttgcttctatgtgatggaccatcctgctgcagagtcggtcgaatcagttagcagtggtggagaaattgagatcgagaagttacctcttcatgaggttgagatcaggagaagggaattgctccctgtattcaagcagttcctatattctgagcgacattctagtgataggaacgttgcaaatggaaggagtaatgcaaatggaggttttcagaatgtcttgtccgtcatcaatgatgtacaatatggctctgtaaaggataatggtgaatatgaaaccaaatcggtggctcctttgtctgggttttacactgatacgagggaaacggttaacacaaatggtctagctacgcaaacattctctggacctggctcagctgttaatcttcagcaagtggggaagcgcaattctattgaatctcctaatgctgcaattttggctggcaaggcagagaatgatagcaatggctatatatccacgccacctgaaacaaatgcatctatcagatccttgagcagctattgtctcttggatggatctgttaacggaatgccgtctcctgcaaatagcgcatcatgcaagcctgaaacaaccaataattctgtgctcagcaatgttgcaagcactgacgtaacaaatgggtgtctcaccactgtcgattctggacagcaggaggcgtctgattctcacagctcagtggagtttacccagtatttccaagagggctattgtaaaatatcagaactcgatgactgccgtgagttaactgaagctgttactgatgctgacagcagcagcagccactgcgagagagagaagcctgaggaagatggggataacgatgacttgcttggaggagtttttgccttcagtgaagaaggttgaacttactatagtgccttgagattgagatacaacagaaaaaaagtgctcaaaacatccagtgtgccatagtatgtagacgatggtgaaattctactaggttttcatggaataaagctgtgcggaatcgatcatctgccatggtacatagtacttttcaaggtaaaccttgcacctagttctcaaaatatgaggccaagattcctccaggcaatttactaatctgcggatccacgttgaaacttggaaggagttggtgttgtcgagaagttgctattgcctgccgcaacaccacttccttatagtgttggtttgtacatataccgtgagacccatttgtttcgtgccatacttccgttccggggcatttgggtggttctgaatcctgtaccttggcagccatatttgttgaccgtctctgccagggcctgtgaatgttccatgtttatttgtacatatacattgtgttttgtcggaaaaaaaggaaaaaaaatctagcgacaattgatgtgatataactttataaacattcagtaaagaaaattgcattcacgatgttatgcttaaatgcatgtgctggggtcctgcgccagagtgtggcacttggatggagtcgcgaaagttcccaatctggtagacactccatgcttcggtgcttaccagtatccgtcccggtcaccgttttttttcttctt

SEQ ID NO: 23028 - DNA, 1524 bp, Zea mays
tactttggtcgattttggactcttttcttctcttaatttaatgatgcgcagctctcctgcgcgttcaagaaaagaacagttatcattttgtaggaatattgcaaatgaagttttttaaagtgatatccttagtaatttagctaataaacattagattagtatatggaattaactttattcctggtgtcgccttctttatattatattgaatgtaactagtgggattatgcaatgacgtaggaatattgcaaatggaggctttcagaatgccttgtcccacatcagtaatgcacagaatagctctgtaaaggataatggtgaatatgaaaccaaaccggtggctttgtctgggttttacgcaggtaagcatatgatgtcaatgtatatgtcattgttgtattatactattgttgattggaaaatctttctattgtagacacgaggaaaacagctaacacaaatggtctagctaggcaaacattctcaactgttaatcttcagcaagtggggaagtgcaattctattgaatctcttaacactgcaattgtgtctggcaaggcagagaatgggaacaatggctatatatccacgccacctgaaacaaaagcgtctatcagatcattgagcagctattctctcttggatggacatgtggacggaatgctgtctccaaatagcgcatcacacaagccagaaacaacaaataattctgtgctcagcaatgctgcaagcactgatgtacaaaatgggtgtctcaccactgtcgattctggacagcaggaggcgtctcattctcacagctcagtggagtttacccagtatttccaagagggctattgtaaaatatcagaactcgatgactgccgtgagttaactgaagctgttactgatgctgacagcagcagcagccactgcgagagagagaagcccgaggaagatggggataacgatgatttgctcggaggagtttttgccttcagcgaagaaggttgaacttactatatactgccttacttgagatcgagatataacgaaaaatgtgctcaaaacaaaacattcagtgtgcaatagtatgtaggggatggctttcatggaataaagctgtgcggaatcgatcatctggtacatatttttcaaggtaaaccttgcgcctagttctcaaaatgtgaggccaagattcctccaggcaatttactaatctgtggatccacgttgaaactttggaaggagttggtgttgtcgagaagttgctattgcctgccgtaacaccagttccttagcgttggtttgtacatatactgtaagacccatttgttttgtgccatacttccgggacatttgggtggttctggatctcgtaccttggcagccctatttgttgaccgcctctgccagggcctgtgaatgttccatgtttatttgtacatatactctctgttttttttgggagaaaggaaaaaaaatgtagcgacaaatgtcataactttataaacattcagtaaaggatttgcgttcatgatgaaa

SEQ ID NO: 23029 - DNA, 6113 bp, Zea mays
  misc_feature (831)..(831): n is a, c, g, or t
ggactagagactaaagcagtttagtccctattttagtcccactgtttagctatttagggactaaatgagactaaaatggagggactaatcttaagttcctcaaaccaaacgaggccttagtaaagctgctctataacaaatatcatattttagattcattttttaagatatgcaagagcatactcttagtaagcaaccaaatagactctgagcacacacgacatcttagggcatgtttggcaacaacgtttcttaaaaccatggttttataatactatattttataattgtcatgacaatactgtagttttgactagctctaaaatgccatgattttgaaaaacattgtttggatacaacattttagccaaaagctagccataaaactttgggtatgagtggagtttccaatatttcaaaaatattatggtatctaaaatacgatgttttgaaaacattgttttcaagaatacaataaaacacctataccataaaggcataaaatactacagtattactaaaaacaatggtattgactagaaactataaaaatactttactttcaaacatgcccttaggctatggccgagagattgggcatatgaccttgcaaaaaactattttacactatagaacacactatttacaaaacagagtttgaaataggagatggagataaactgctagagatagtcttagacatggtgacttacggcaagctgcggacaccaaccatacagagccatattgttttcataggacctgcattcgtttgtaaggcatcgaaaagctgaatacaagttacagattcaaacaaaatgaacaggtttnattatgaatactttatgattggtaaaagaaacaaaacaagaaaacgttgttcaaactgtgatcatgcagttacaactccaagggttcgctgaataagacaccacgaatcaaaaagttataaacactcgatgccactaaaaaaacacaggcaggtagatctttgatggagcacaattcactcaaggttaatttcagtaaaatctggataaagagaacagaactgaaaaatacattatgcacgaatcactttttcaagatacagttcagggattagcacaatacttctacagaggccacaggcatcgagttaaaaaggctttatcaatgcctgctttcatataactagttctctctcttgctctctgttactttcttcctgaaaacttcgtattacagtgattgattaattaattaacggaaaaacgaaaaaaaatgaatcaggtcaaggctgtctgtcacgaggcaaaccaaagtggcatgagtcgtggtgtacaatacacaatacagcaccacaatgtgtcagggctcttggctgttcacacgtttctgaagctccaacatctcctggtgattcgggtccaaggagagggcggctctacaatcacggagagcgctgggtacatctccaatgtgctcgtggaaagccgcacggagatgcagcaaatgcaggtccgctttgaaggatatcgcacggctgagctccgctattgcatcattctccttgtggctatccatcagcactgctgctcgatatctgtatggataaacacgcaaaggatccaattgggtcactgtttgcaaatctgtcatagtttgttctcgttcacaatattctgagcgtttctcataagccgaagcattgtttttagctttttctatcaactttgtcatctcttcatatgcagcttccctgttgttcctcagaaaatgtacacgagcaagaccttgatgggctctagtgtgtcgaattttcaatgcacttgtatagcaatcagctgctgaatctaactttccacaatcaacatagacaccaccaaggttattcaatgcctgacccttccgaagccggtctgaagggcatttcaatgcatcttcaagaagtgagataactgtcgcagaataagaaggatcaactcctgaatcagccaaaacataggctttcagaaagaaagcttcaaatgatctttgaatggaaatagattcttccgctttttgtagggcctccccatagtgccccgtgtcatataagagccacccctcatatactagtcgttcatgctcagttgctgcatgatgccttgccaattgcaaactgcgcatcgctgcctcgggacagttcaacctaaggagcagcaaagattgcctaaagtagaggacaccttttgctgcatctgactcaagcatccgatagatcactgaaagggagccaatatcatcaactgatgaccagcgctcataaagttgtagccaacactcagccgtattccactgctcgacatgtgcaccaagaagagtgcctattttggaagcagctacacgtccttccaacatccgataatcaggtgaaagagtaagaatcgcatggatatcacagatagcagacttatagtcttcaagagccaggtatagacagatccgtagctccaggcactccaatgctaacttgaaacccaagagtcggttaatttcctctaaggcatgtttagcatctttttttctcatcaaggatgcagctcgatacatgtaagggtaagtgagagtaggatccagctcgcttgctttgtcaaggtctgccagctttctatcaccttcagaatacaaagacctctccagatacatccaccccagtggcaaatttgatgttatcactgaactgagcttctcataagccaaagccttttggccttgaatgccagcgactctagcaataccagcaattgaatacacatgaccggcagagaaggcaacctcaaattggtgttcagcttcactatattcctttctcaaaagtctaatgcatgcaagttgatgaaaagctatttgcttctgagtaggggtaactgctagctgcacaagcttctctaacaataatacagttgtttctgtcctcggatcaatgttcactcctgccgcactccgcgagcacgtccgcaagaagcaggcatgtccaaccatgataagttgttgttgtgcagttgcacctaagaagaggctaattactagatcatcagctagacaatcgggaagttcctgtaaaaaaatttgcaagcaagaagcagcaagaactggcgcattttcttcaaatgccaacggcatgagctcaacagcatcctgccttgttgaaacaaatgaagccagtttcctatcacaagcatcttttagcctgtcacaacaaaatgtgtttgcaaacaccaggatctccaataagatttccacaggaagatcccctaaactacatgtagaactaaactcagaaacagctctcatgccctccaacgaaataccattctctgacaaatcaacaagctcaagctgtgactcattgaacggtccattaagcatggagcaaaatggtattgacaaagacgcaatcttgcacctatcacatgtcaccctaccatcctgtacttggaaggttaccatggaagaaacttgagacgaggagcttgtctcccatgaaccaattacctcaaaattccgcacaggcatctcagaggcaacatcaagtaaaccaaactctcgacagcatttctgacatgatgccggacccgcgggtatgatctcctccccctgcttctcgtaccgcaaccatgccccaaatatgactttctcatggacgctgcttgcacaacgccaggcagagtggaggctcctctggcgcaattttgcttctccaaggccccgaaacacctgggactggaccaagtacaggcctggcagctcgctcggcctacattgttcaagctcctcgtggatccttgacagcacctcaacataatccaaaggcttatacaatggcactacatgtggctcagcaatcttgataagtgactcaatggaggaaggcgagtaggacgacttgggcagcttccctcgctccacctgcagccatgactgcgggttgaaaccatatccatggatgcgctgctcgtcgcacggcgactccgacaggaagctgctcctcatagagcacaggagcgagaagacctcccaaatctccacactcccagattttcaaacgaatcacagatgtaaatcgcgagggactggcgtaaccacgccaaccgcagaagctcacggaggaaaccaggaaatgaacctacaaatcagaatccacactaaccgccgctaattgggggagaagaataaagtgtcgcagaggcagcagcagcaggaaaagattggaatttggtgcctggagccggaacaaatccggcgagggaaggccaaacggcccgtgaaatcgtgccaagaacggccccaccggaccgaatcttggccgggaaaagatgcagcctccggtgcgcacccgcaagcccccgcgcgccgggcagaattcaacggatcaaaccgggaacagggcgattgttagcgggaggaaggaacagggcgcgtggggcctgcagatagtggatgcgagcgagctcggattcagatcctgcaggctcagcgagagcaggaagacgaagagagaaaagagaaagggaggcgactaggcgagcccggccggcctcgaggtacccaatgaagaaaggagattttttttaacatttagaactaatttgggaacctatttttccaatagatttttatttttccaagaaaattagagcaagagccatatatgatctaatttttaatccaaatatcaataaaatataaaaaaataaataacttatacatatggaagtagcctagaggtgtgaataggctacacctgaaattttccactaaaaacttcgagatagtgtcaaatacaagttgcactggtgcaaaccggttcagttgattttgtttacaactgaacaagtttgaacctgctcaacttagattagataaacaattaaacaaatgtgacaaagtatttagagattatgctaaagtcttgccctagagaaaatccactcgaatagatgaatatgaaccaaccaacaaattaaagcactcaacaagaacacacaagaacacgctatttatcccaaggttcggcaaccaccacaaaggtgtcctactccccgttgaggagcccacaaagggccgggtcttttccaaccctaatcctccacaagccgaccaccaaggtcaaggcaatcttttctcaaatttgctcaaagagcgggtaatacaaacttcttggggtcgtccacaaatttggagactcccaagcaacctctaaccgtcaaggaacacaaggctccaagagtaacaaatctgcacaaggttaagtttgcaatgagctcaagaacaaagagaatgggagaatcaagatgaaattgacagcgcgttagatcgacttcacctcacaccaaggatccttcaagcgattgaaggagatgcgatttcgggtgtgagatgagaattgaatgcccttgtttggagtttggtcagctgagaaatcatggagagagcagaagtaatgaagagagagtgtggggggtatttaaaggatcccccaaaagctgacagccgttgggagaaaagagtcgaaaactggttgaaccggtttacagaccggttgaactggtttccaccagaaagatctcggttcactgacatactcagccggagactcgaccggatccaaaaccgattgagccgggaaaaattttggttgaaccggattcacaaaatatctgcaatgatttttctgacaactctgactatcagacaggtcagagcagggatggcagaggaacagtccagaaaccggttgaaccggttttaggtccggttgaaccagtttcaaaggctgaaaagcaagttttgaacattttgaagtgaacaaaggtggaactcttgtgggaagtaaaaatggtttttctcaaaggcattcatgatctagaaaagtgttctctaagatgattttgaaggattttgaacttagctcattgcattacttacttaaccattgcggatccctcttaattgaacggcgattcctataactcaagaattataaaaagaacactgccgttgtttccaagcagttggagcactccatatgatgtagaatttccatccgttgtgctttatatttttatgctcataagatctgtgcttca

SEQ ID NO: 23030 - DNA, 1636 bp, Zea mays
cattgggtaaacaaaccagaaacccgtcgaaaccccagccccaggccgccggttgctttcgcttcgccggagaagagctgagcgcgatggcagcggcgcaggaggaagcggcggcggcgccgccgagcacggagagcgatgctaccgagacggaggaggcaccaccaggcggcgcggagagcgatgctacggcgatggaagcggcggcggagtactcgtggctccagctccgcttcgaccgcccccctcgccggctctaccacttcgcccgccagttccgctccgccacttcctctggcagcaatagtagcggcgagaacttcctcaagggcgtaaagtggtcgcccgacgggtcctccttcctcaccagctccgacgataactccctccgcttgttttacttaccggaggaagcgtacattgcggcggagcccgttgccgaggccgctgtcgaaagtgaagattcttatggagctttcattcaggcgaacgagggtgagccagtgtacgatttctgctggtacccgtgtatgtccttgtctgacccagccacttgtgtatttgcaagcaccagtcgtgatcatccgatacacctttgggatgccaccagtggggaactccggtgcacataccgagcatatgatgccatggatgaaataactgctgcactttcgatttctttcaattcttcaggatctaagctatttgctggatacaacaaagctataagagtgtttgatgttcatcggcctggcagagactttgatcagtattctttactcaaggggggtgaaggaccaactggtataatatcttcaatttccttctctccacaaaatgggatgcttgctgttggttcatacagccagacaactgctgtgtatgcagagaataatatggagcctttgtatgtcttacatggccagcttggtggtgttacacaggtgcttttttcgaaagatgggaactatctgtatactggagggcgcaaggatccgtacatattatgttgggatattcgcaatactgtggacattgtttacaagttgtacagatcagctgatactactaatcaaagaatacattttgatattgagccctgcggtagacatctagccactggtgggcaggatggcatggtccatgtatatgaccttcaaggtggtcaatgggtaaccggctaccaagcagcagctgatactgtaaacgggttctcgttccatccataccttccatttgctgtaacatcatccgggcacagaagatttggcatgcaagatgagtttgaagacgagttaaacttggcaggtgatgagaacagctgctctgtctggatgttttcttcctcacaagaagcttgaagcatttagtgaaaatattggatcaggctgaagctaagcgaagcattggatgcacattcaaatctattgtcactttgatgttcgtgtgcagagagcatcgcggcattgaccacttcctgttgtgttggctgtaattggtgtctgcaaaatgcaaatgtattcactgagatctatagaattaatgacttatttttttgacgaaggagcagagccccccatttcaaaaaaaaaaaaaaaaaaaaaaaaaaaaaaaaaaaaaaaaactcgagggtggg

SEQ ID NO: 23031 - DNA, 761 bp, Zea mays
ggggtttccataataaggttgtacagatcagctgatactactaatcaaagaatacattttgatattgagccctgcggtagacatctagccactggtgggcaggatggcatggtccatgtatatgaccttcaaggtggtcaatgggtaaccggctaccaagcagcagctggtatgtctcttctgaacatgtgtttccagaggaggtttaacagtgtgtttggttgtgaacctggcaaaaggtgctgttccaggtggctccccaggccatcgatttccagctcctggtggctggatcgacctgcctgggcgagcgccccaggccagtctcccagccaagcatgccttagtctgtctctatttctatattatatccattttaatcttatatcaacttgatcttagatactgtaaacgggttctcgttccatccataccttccatttgctgtaacatcatccgggcacagaagatttggcatgcaagatgagtttgaagacgagttaaacttggcaggtgatgagaacagctgctctgtctggatgttttcttcctcccaagaagcttgaagcatttagtgaaaatattggatcaggctgaagctaagcgaagcattggatgcacattcaaatctattgtcactttgatgttcgtgtgcagagagcatcgcggcattgaccacttcctgttgtgttggctgtaattggtgtctgccaaatgcaaatgtattccctgagatctatagaattaatgacttatttttt

SEQ ID NO: 23032 - DNA, 1694 bp, Zea mays
  misc_feature (1682)..(1682): n is a, c, g, or t
accgtccgccaccaaatttcagaccgtctgctctcacacagagagcaccgtcagatggttaattccattgtttagtatcaaatcggcaccaacaccttctaaaaaatatacataaacataactcttgatccttactctccaacgtcgtaatatcgtcctcatgtatttatctccctgtctctactcgctattgattcgtttgattattattgtatgagtatttatgtctctactctctagttattcacgtgaatattattgtatgagtgttttaagtctgcttgcacccatgtgctaagccatgtccagtttaacacacagaagccatgtccttgttcctgtttgaatctttagttattttgctttaattcatgggatgtttagataccatggtctaaattaaagtgactaaagtttagtcattttagaagataaaactccaaataaaaagggctaaaagtaactaaaatagtaagaatgtatcattttaatcacttttagctcttcctgtttaaatctttagttattttgctttaattcatgtgatccaaacgtgcacttaatcagtatagcatggtcgtccgatgtctccacgataacgctgcttctgctacatcatcgtatttgttggtagccaaaaaaaaacgatacagggctggcttccgtgcaaaatatgaatctattcgatggccacgaccctagcagcatatacatacatcaacacacatgacatgtagcttcagttcgggtggtgcgtatcagcgtatgtacagacagcgaatggaatcgctcttttttcagaagtcttatgcatatgcacaagctggtaagctagcttgcttgatccgtaaaccatacactacattacagctgcagatggatcgtagatttgggccgctgtggcatgatcatgcccagcccaggatggcacaccttaagctgcgcctgtccagagaaacgtcaggcctggctcactctggtcgcgatggcagaagcatactcggagatcgttggatcaggtgactgcctgaggtggacgatgacggggagcagctccgaagaccgtaggaagttcctgcagatggcgtggtcgcacatcttccgcagggcgaagagcacgattcttagcggagattcggttagagcatctcgtctgctggggctcagggcaacagtagagtaactgcccaccatcttcagcagcgcctgaattgcgccttgggagacaatgtcttcgcaaagcatgtctgagttcctcactagattactgagcgcgcctgcagcgttgcctttggttttatcctcctcaggaccaagaagtaaggtggtgagttaaggtatggaccgtctcaattcttcatacagcatatcattatgataagcagcatttccaacggcaaaacatgcaaactttcgtgtgcgcttgtcaggatcagaacacctgtcaaccacgagctggatcaccttatttgctagatcttccatgtcaacatagtcaagacaacgcagcataccccccccaattccaacctctagtagaacttgaatgtactgaggcatgttttgctctatagttttgagcatttccttattctcagtaccaatgcgcccaccgggtgatgcaacattaagcaggaaaccactattgatggatgcagatgctgacggcagtttggagaacnctgcactgcaac

SEQ ID NO: 23033 - DNA, 945 bp, Zea mays
  misc_feature (31)..(31): n is a, c, g, or t
ctagacaagggggaatacattatagagtatnccgtttacatagtgaatttaaaaataaagagtgggatagggagtcaggctacggagaggccctccttttggtgttggagcctgctctcgggccttttatgggcaaacaaccaaactctttatattccaattccactgtggatcccagttcaattctcggtttgaccttacaaaagggcaactagttcagaagtaactcaaatagtaagttttgtgtgggtgagacaatatattaagaaaaaaagacatttacaagaaacaaaaacattggtgagctctgccgattttataacagcacgtatcatgtatgtatgagaagggggactaccgcgctggatcgtgtcaaataccaaatgcggttatgtttaggctagtcaatcttctcggcaatcggagaatgaaatccatcctggctccttctcggtccatggctagacataagggtggcaggatttttcactcctggtcaccttggggtccaacatgggcaggatactttgcagaaacatctgcccaggtgctttgtccttctgtcagctgcttcaccacggacgccacctcgtttatgtccacacggatctgctccttgctgtccctctctcggatagtcacgtttgttgccgaatccactgtcacggcaaatggaacaccaatctcatcggtcctcgcgtatctcctcccaatagaaattgcagtagtatcaataatgtgtgagataccagcagttgttaatgccttggcgatttccttggcagtagcatcaaactcttgattcttgacgagggggactcgtgcccacttgataggagccacaagaggaggaaaccggaagacattcagttgttcctaatatgatttgctaggccttgtgcaaaatgagtgctcaaacaagcagtagatgatccggccaaacca

SEQ ID NO: 23034 - DNA, 2339 bp, Zea mays
cctccccgccggcgcgcccaccccactccccctctccgtggtttgtccgctcgcatccttccctcccttccgccctttcctcccacttgctcgccgaacccagagccccgcccacctcttttcggttttttctcgccggcggttgtgccaggatcgggctttgggctccgtgcatcgacgcgccgccgcctcctgatcgcaaagggtgtttcccccaggctttcgtgctccggaagtggcgagattcgccgagaaaggtcagatccggtggcctggttcgagcaacagtgtgttggcgtatcgatctgcattggatcgtcgggcgattcgtgtgacggagacgacgtcctctgtggtggctccggtttgctcctcagctctagatctggaaggactgggtgatctgctgcctcaagcagcttgaggtgcattggaaagtgaccatctttcccagacatcggcacaacgtaactggacatggaggctcttgtggttttcccggagcagcacagccaccaccatcaccgccaccctggtacccgcagcaagtcatcgggtccatacttttcatcaccgcctaactctcgtggcttccgtggaatgaactgccggtctttccactctggtcgttgcgtcggtgctattccattcccagcacctcctgctcgcacctactcatccccagagcccaagacacccaagcagcaaccacgccatggtggcaagcgaagccggccaatttccataagcctctccacatcccctccctcccattctgagctctgggcaggtccagcattctccaactctccaccacctagttcgcttcccatccccaaattctcgctccgccagaagcgcagcatctctctcgagctgccaccggttgaacgccctgatgatgtggtggtcaggctgcattctaaatcagcaccttcatccccagttgagggatatgggtatgacttcttcaatgacgatgcaatcgctagtgcgatagcaacggagaatctgaggaggattctccagctggatatcgcagatcattgaataatgggaggatggaagggtggttcttgtgtacataggttatctttcactgacagctttctacttgcattggttgtgtatagggtaatggtgatagatacttggtggttgtaagatatggtcaggatcatgggagaggtgtaggttgtaggtgaagcatcttcagaagcttagacggttgaaggtgatagtgccctgttaggtgttattaaggtggggtctgggtcgaggatggggttgcacggcagttggtagtattcacctatatgcttccttcatctcttaggtgtaggatttaaacctttttaaaaacagcatcatttgcatccacagtacctgttctgagctggcggtgggcactctgccatagcagtaacatacgtcctaaccccaaaccagatgtcaaatatttgtagggtaccatgcatcttacatacccttgcatacttatttccttctgtcctctagccaactggctctaactatcctcgcttcctggtgctctgcaaagaacaccattatctcctcagcagctcttctgttttttttggtaaggaagaagctgcgtggaagatggaagaaattctgctctctccgtcttgttcgaaactaactttcctatcccgcccctttgttgcatatctggcatataccatagtccatatccgtcgcatatctccaggcttttatgttcatctagcgctcctgcattgcatctagtgcccttagtcagttagcatgctcattcgttcccacttcaagttcatgaaccagtttgagggttctgattttcttaaaacgtcgaaagagagtctggattctggatcccttcgtgcaggcaaaccctgatgaggttgctctgtagtgacataacgcccaagctagctcgtgccggtgttacacgcttctgtagccctgcgcagttttagcactagcagtgaagcagcagtactgctggatctagattagtagtcatcggaaatgccgaggtttggtcagttatcttgtgctctggtgttaaatcagcagttgcattgtgtcgttgtttgtccgctcctatgttgatgttagagctactatgttgatgttgcacctgctgagcctgtcatggctgtcactccttgaggattattttggttattagttcgtcggcggagttgcggagtttcgtctctgcgtttgatgaaagtggtaatccgaactgtcaggacaaatttaatattttaaaataaatatgtataaaatttgatgttgatctttatttaaaaaaaaaaaaggcccctagggcc

SEQ ID NO: 23035 - DNA, 1036 bp, Zea mays
  misc_feature (4)..(4): n is a, c, g, or t
  misc_feature (25)..(25): n is a, c, g, or t
  misc_feature (74)..(74): n is a, c, g, or t
gcanacttatttccttctgtcctcnagccaactgtctctaactatcctcgcttcctggtgctctgcaaagaacnccattatctcctcagcagctcttctgttttttttggtaaggaagaagctgcgtggaagatggaagaaattctgctctctccgtcttgttcgaaactaactttcctatcccgcccctttgttgcatatctggcatataccatagtccatatccgtcgcatatctccaggcttttatgttcatctagcgctcctgcattgcatctagtgcccttagtcagttagcatgctcattcgttcccacttcaagttcacgaaccagtttgagggttctgattttcttaaaagcgtcgaaagagagtctggattctggatcccttcgtgcaggcaaaccctgatgaggttgctctgtagtgacataacgctcaagctagctcgtgccggtgttacacgcttctgtagccctgcgcagttttagcactagcagtgaagcagcagtactgctggatctagattagtagtcatcggaaatgccgaggtttggtcagttatcttgtgctctggtgttaaatcagcagatgacattgtgtcgttgttacttcagtaacgtgatataacggtcctatgtcgtgaaactagctcatggtgttagaactagaaaccatgttgctcagagctactgtgttgatgttgcacctgctgagcctgtcatggctgtcactccttgaggattattttggttattagttcgtcggcggagttgcggagtttcgtctctgcgtttcagataagacccttgatgagtagctagagattgcagtagtcactactgcgttgacgcgtttgctcagctcagctcgtgtgtgctaaaacccgttcgatcgctgcagtcagactcagctcgtgtgtcactctattggcgtgtcatgtaagaggtcgtttggtttgagtgaggaatgaagtgattcatctttttgtccctcctcacttttttatttggtttatggaatagaatggattgatcc

SEQ ID NO: 23036 - DNA, 1382 bp, Zea mays
atgagactaaattgtagggactaattttgagtccaactgtttgtcaatctatgctttatttggtctcacacggacgtataggggtgagcgaggttatattgttcttgtcttcttgttgtcagtgtgtgtgcctttgatgtaaatataaaaatagaacttaattaaattcaaaattcagtttgcaccactcggtgttttctagctaccccatctcgttcagattcattttcatatgagcactacacaactgaaatattatgtaagcggaaatatagtgaactcgtccctgtaaagcttaactaaagtagaacactactatagaactgattttacaagacttgttgttttgtttacataggcagttaaaaccaccaaaactaaggacacgactatggatgtctctaaaaacacgcaattacttggaaatacatacaaaagaaacaaattaacaagttcacttaattacttggaatttctccatcccaggaaaaacaatgtgctttctgagttgagctacatgagatagctaagatttagagtctatgtatcagctatactgttggtaggttttgaagaataatgagctgcaatataggcatgcaaagactgcaactccagcaataaaattttgatatagacacttgttgtccctggtggggataaatgcctctttcagtacgtttgtgagcttaaacacccggaatgataccgacagaaatatcgtcgtagtaagcaaaaagttaagcatcggataatctggtaagaaagatagaagcaactttggctgtccgttcggaatactagacctgagccaaatgtgaaactgagaaatataactctccattgtaattttgccaagccaaacaaaaagagacaaatgggtactcctcaactgttgggtgcaattgcgtaggcagacataaatagttataggaatccacgacgtgtagggatggtacttgttatatgtatgtttgtccagcttgtagatatattcgtaccacagatagccggccattaaggaagctgtaacaatggttcccttgattaacactctcaccttagtcccagattcttccagcctttccatccatctttcaacgttggggtgaaagtaagcataaatcattcctggtgccgaattcaaacgatcaaggccagagcggaagcgccattcgtgtaacaggggtaagttcatcttagaaggctctgggtttttgtaacctagcagaaacgtaaatggtgcccagaaaatttcaaacacaccaggaatttcccatatcagaatgacagtcaagaggcagcctgcgatcttaatggccatgactgatgggatctcatcgttcttagttaaacacccggccggcctcgaggtacccaat

SEQ ID NO: 23037 - DNA, 4331 bp, Zea mays
cgtcagtagaaacatcgtgattgggcagacccagacgaatgcttaccgaattcgattacaaaagttagatacttaggaacgatttatagggtgtttggtttgagaaaagagggcgattcatactcctcacttttttttgtttaagtttgtgaatgaaacttaaacttgagatgcagttgtaaccggacaaggcagtgcagatagatgcactgtctgggtgctgagtctgcccctggattgagttgatgtatcaccgagaaatgagatcatctcaacaaactgatgaatttcatgatgtaatctttatagttagttagtaataatatgagaaatgatatcatctcaacaaatttgatgaatttcatgatgcaatcttattttaaataaagtgatttctcaatcgaaacaccctcttaatccctgaagggactagggagaaccgcgcatggatgggaagggtattcgctctgacagacgataggcactggttcagcgcagatgataggtgcaagattttgtttgtggcagaagaacatatgacactccccggttttggtttgtgatcataataacaagattaaaatggttccagcgtcggcctacacttatagaccatgcaaaagaacacagaagtcatgatgaatctcacacgaaatgagatgaatctactactactagagctagatataagccatcctagagagcattttgttcttcggcaagagagcaatttgacctccggcgagcccgattcaggttggattcgcctgtgcaccaccgaaaagtcgccgcctaccctgcatcctgcgccgcgctcgccgcgccatcgtcgagcacctggacgcgatcagctccgcggcggccggtagcagccgtgtgccctcgaaaagcgcgctcctctggtactcgactacccacgtctccggttccagccgcaccgccgccgcgctctgcctccggtgggcccaggagctcccgttgctcgcccgcaccgtcggccacacctttccgtcggaccactgcacgcaaaagagacacacgctgggggagttcaccgagctggtggtgcttagttacggcgaggaaggggggctggttcttggctgttacttacctcggtgatctcgccggagaggagggtgaggtgccgcgccgagagtgctcttgggaggagaccggaggtgcggagtgggctcccccagacgctgacctcctccgccacggatttgtacaccgtgcagcgccagtggaacacctgctgatcattctgcatcgacatatttggggaaaaaaaaagaccagttatcgatggcctctaatcaagaaggaatgagagagagcaagaaccgcaaggctggccatcctggtggaatcgccagacggagtctcgcgagctgcaattggcgatcccctcaccgccaacaagctggcggaccctgcgctccatgacgtgcagcttatgttccaggccgccaggcgcgaggcgcgcatcggcccccacccgcgccacggcttccggcgatagcttgggcccaaaccccctggccgcggcctccgggacgagccccgtgtcgacccacatgaggagcaggaacccaataacagtggcggcgtacagcagccagtcgtgcgaccgaacgccggccctcgcctcggggcccccggccgcctcccgccctggcgcccgcctggacttggccgtggaccgcatcggcggcgtccacggcggctcggtggcgtcggacccgtcacccgaccccgaccccgcccccgcggcgcggtcacggaagaagagcctccggtccctggcgcccccgaagaacctgcgcgcctcgggcgcgcgcaccaggtcccgcgtggcgtcgatgctcgcgaggcacatctcgcacgagcagttggcgtccttgcggcacccagggtagtagcagctgtcccccgcggccgcgcgcgccgcccacggtagcacgacggcggacggcggcgtccccgtggacgtggacgcggaggcgcgggcggacgggttggagttggaggagcacgaggaggccgtgctggagccgcgcgacgcggtgggcgtcccgctggcggtggccgccctcctgggcacccccgcacccggatccatctccctcgtctcgtccatgggctcgtgctcgtcggctgtcggctggttggctggctggctggtggggtttctcgggttgggatcggtgttatacggtggccctggccgacgaggtgttcgaaatttgaagcggcctgccggcgcaacggcttctgcgagcaacggtcgactgagctcggtttctcttgcgtgtggtgtggtgtgtcagtgtgtggcaggcaggcacggcagaccgcagatctgatctgggcccggaactggatgcaccgccgaaatggatccgtgggggacgcgggacgccgactcgagcgacgctgacgttgccttggcccagaaatcgagatgggccttgagccagttagtagatccttgtcgtggtgtgaccggcccggcccctgcaccgccggaaacaagcgggcggattctcggtgagaaaaacgtgctggccgtcgtttatcgtcaaacaaatgtttggtataaactctagattgatgaaaatcgtatctgaatccaatatttataaatagaaaaatcaaactatgaaatactaaagaatcaagagtcggaaacacgacgatcataagggcgaatggatttattattgtaaacataaacagacactggttcaggaaacgcgggccgcgtgctccggtgacgggcgagcatcggacggacggctgccagtgccagtgccacagcctgcgacgttgacgggccgcgaacgcgacgaggcacacgcgtcagctctggttgatcctactggcgggaggcggcaaagcatccagacagccgcgtgcagccgcgtgcgcgctatctagctaaggcaggcaaaacacgagctgcttgcgcgtgtgtctgcacgtgtgcgcccgcccgtccctcggcgaagcgcacgcgaccagggccataggcctcgcatcgcatgggacacgagctagctagacccccggcccgacccgacccttgttttttcctcagtgacgtcgcgccggacgggatcgaactgggcggcgggccgcgtctggcgaccctgcacgctccatccagatcgacgactttgagggaggatgacgccgaccagtggcatgtcattgtcgacccaattatcttaagatctctcctgatctcctccgtcccgtgcctaggttacgagcaagtgtcaggctgccagcggagctaataatccctgggtttcttatctatcgagcgtcggtttgggttcgtcgttccaccacatcggaagcttctgcattcattgtactcttccgtcttcgctgtgagtgagcgaggtgcagctttcgccatgcatcagtcgtttgaccgggatcacgtagtacgtactttgctccgaaggggttctggcaatcaggctttaaaaaaaaggccgacgttacatgtgcacgaccgcgaactgcttaatcagtgcttgtttggtagagctctgttccataattttctagcttggaaagctgattctctaataaaattattctaagtgatcctctactgcaagtgaatctatttgacgaaaactgtttgtcaaataggttatgaagtgattcatgaggggttaaagagtgaggatcatgttgggagtgatgggaagtgtgtttttttgcttacattttctagtacaaagtagagactaattcactccactcccaacatgtttatcgtttgactcggcaagagtaattctcgctgggagcggaactgtgatagctcaaccaaacgctccctccctgtctgcactcgtcctcttttcagctccgtaatctgattctgctacgcttgcggttgcaggctagacagagattagtgtcgtgccggagatcctcacattcattatcaccagtcaccacggaacctgaccatcttagatcctgggaatcctcacattcatccgatggtgagtgcaggcggtggtgtgacacgacaggtcgtggaggtgcaggaattcagaaccagcacagtgttggcccaaaagtgcatggtaaaattcagaagcatcaagcagcacagtcctcccgtcgttgtcgtccacctcgcaagatcgatctttgactgccactaatagtctaatacgcttttatgtcctagtgtgggtcataatccattgcccacactgctccatccatccgctgattgatcaacatgcatcaatcaataaagaaaaagaaaagtatgttctgacgttcccttgcac

SEQ ID NO: 23038 - DNA, 1539 bp, Zea mays
  misc_feature (13)..(13): n is a, c, g, or t
gggcccgtttttnccgggctcgagttttttttttttttttttttgatagtcgcaagattttgtttgtgatcataataacaagattaaaatggttccagcgtcggcctacacttatagaccatgcaaaagaacacagaagtcatgatgaatctcacacgaaatgagatgaatctactactactagagctagatataagccatcctagagagcattttgttcttcggcaagagagcaatttgacctccggcgagcccgattcaggttggattcgcctgtgcaccaccgaaaagtcgccgcctaccctgcatcctgcgccgcgctcgccgcgccatcgtcgagcacctggacgcgatcagctccgcggcggccggtagcagccgtgtgccctcgaaaagcgcgctcctctggtactcgactacccacgtctccggttccagccgcaccgccgccgcgctctgcctccggtgggcccaggagctcccgttgctcgcccgcaccgtcggccacacctttccgtcggaccactcggtgatctcgccggagaggagggtgaggtgccgcgccgagagtgctcttgggaggagaccggaggtgcggagtgggctcccccagacgctgacctcctccgccacggatttgtacaccgtgcagcgccagtggaacacctgctgatcattctggtggaatcgccagacggagtctcgcgagctgcaattggcgatcccctcaccgccaacaagctggcggaccctgcgctccatgacgtgcagcttatgttccaggccgccaggcgcgaggcgcgcatcggcccccacccgcgccacggcttccggcgatagcttgggcccaaaccccctggccgcggcctccgggacgagccccgtgtcgacccacatgaggagcaggaacccaataacagtggcggcgtacagcagccagtcgtgcgaccgaacgccggccctcgcctcggggcccccggccgcctcccgccctggcgcccgcctggacttggccgtggaccgcatcggcggcgtccacggcggctcggtggcgtcggacccatcacccgaccccgaccccgcccccgcggcgcggtcacggaagaagagcctccggtccctggcgcccccgaagaacctgcgcgcctcgggcgcgcgcaccaggtcccgcgtggcgtcgatgctcgcgaggcacatctcgcacgagcagttggcgtccttgcggcacccagggtagtagcagctgtcccccgcggccgcgcgcgccgcccacggtagcacgacggcggacggcggcgtccccgtggacgtggacgcggaggcgcgggcggacgggttggagttggaggagcacgaggaggccgtgctggagccgcgcgacgcggtgggcgtcccgctggcggtggccgccctcctgggcacccccgcacccggatccatctccctcgtctcgtccatgggctcgtgctcgtcggctgtcggctggttggctggctggctggtttttcgattaggatgttctaggtaatggtctcgtgc

SEQ ID NO: 23039 - DNA, 5013 bp, Zea mays
  misc_feature (3573)..(3573): n is a, c, g, or t
gtagaatgagtttttataccgcagcaatttagttcagtctctcctaaacttttttcttccctgcaaaacaccaacaccacgtgcgatttcattatttgaatcaaaaacgcaaaacaccatgtacgatttcattatttgaatcaaaaacctaatcgatgtatcgctgggttacatattagaggcttggtggcattaattgattaataatcccatcatcgtcattgatctatcccgccgcgctacgatagctagctctccaacattcctcactctcgatcacccttctcacctcattgtcgtcatccttttcgttttcattttagacttgtgtaaaaccttacacacagcaggtagtatgagttccaaaggcaatccatagactaaggtactcgaagcagcaaattaacaattaatttacggcacaaaattgactgtcggatccacaaggtattcacaaacgagagtgctggccaaattaagcaacaaccatatctagccatttttacagtgcagtgctaataatgctaatgttgcctagtccctttgaagcactaagaaatttcctgcaacaaacatataccctcccagtggtttcctcagcaatgaactcgccccacacaaaagtcgcctagctcgaagtactgctgaagacgaccaacctgatgatgctcgatcggtgccgctgtcattttttttatgaagaaactaaagaactgcgtttgtgaaggatggtgttacaccactgccagaatcacctgtgttacaacaagtaatcagttcagcatgacaagatgtattgtgtcatatagtttatcttcgtttttggatttaagtatattattcagcatgacaagatgaaccgtggtgctgtattactgcatgctatcagcttagtaattgctatcataagcatcatcagttcagctggaaccaaatgtattttatcatcgcccatctctcataaggttaatctgtatgttactggtgctgctatttcttatcacataatgagttgatcaggtgcagctacaataaggttgcttttttttgaagtgttcacttttatgtaacaagtgttgcgtttcactattccagaagtattaattattgagaagagcctttatccaatgccctatgatttcgaggcaccttttcctttttttttcttcttctattcttattgtggccttgcttaaatgctcctcggccacattaactactttaaatcatgaaggttagcaagattcaggtgcaaagctcccaatcagtgagatttaccatttgttgaactttcagtactcggctgagaacttatatcagatactgaaggatcagcatggctgacagaacctccatgtgcttcgacatggccaaccatggactgctctcttatctcagaggcttctttctctggggattcgctttgctccacagaactcaaactaggtccagctacctcactggaagaaacctccattcttgatgatgaacccccttcttcgatggttgcttcaacaacaagagtacaagcatgacctgcaatttgattctgtgctttagggaaaaaaacaatgacaacgttatgtcacatttacaactgactaattcatcgtagtctttggttaccatcttttaggacaggtccgtcaattactaaaccagtaggtgcaggcctctcgcttcccgaaggacttgaatcatatacaggatccacaacgtgggtatcatcaacgaccaccacttccttagctacaaagtaggcaaacacttataagatgtgggattcattatacaaatcgctagctgaaaagggatatatcactctctggtacctggtggttcaatgtcattcacttcaaaaggatcatcagtagtttcagttgatgacgacgtcaactcaagatcattcgaatgtggtgacatttgattcaatccattgcttgtgatatctatttcttgatggtgttgcatgacattaggatcctcttgccatgtattctgggacaaactaaaattttcactctgttgtgcttcctcccaatcatttatatgttcaccagacagtgatatgtcatcatcagaggaatcactaattaagacaggtggttccatgtcaaggggaaagagaaacctcccttgcatgccgagctatatgtgcatgttcctctgtttgactgaaagaagattgttgtccttggtttgagcaatcctctagaacatccttctggctttcttggtcagcaactgaagaagtactatccgagtcttgagcagagctggccttagagttgctcttttcactagtttctccttcaagaactggatctgtcatttcctcgttagccattttttcagtcatgaagtatggtctgaatcgggaaggctgtgtatcttgcaaaaagtcactaaggaatggtgctccttcagtgaagctctcatgcctcctcaacagtgcactctgtaaatgacatgctacgggaataggttcatcatggcttgagttggctcctccataagagctgctctcgtttgcttgctcacttggtagatcaaatgggtatctcgtttccaacagtgcagatggagcagaatctgggaagttatcttcattgtaaggaagatcaaaaggatttttcctaggagcaaaaacagcaggaatttgaacattgggcggggggggccctcctagcgggggtaaggaatcagtgctgccaaactctgccaagttcctgtctgcgtatttccttgcccgacgcctagcaattagggtctccaacctttggttacgctcaatctccaagcacccgatttttattatgttcttctggtcatcagcagtccatgcaacaactttaacatgttgtttcccctcgcgggatatcctgccgtcgttgccctgttgattctctgttgtatcttcggtgctactgtcagagtcaccatcttgagaggaatttgacgaattgctgcccgacctaagatgatgaaatgcatggagcattggagcaatatcagtatctgaaccacctgattcacttgatcctggttcagaagaagaggctacaccacgagactgcttcctaattttcttaacactgtttttgtgcttcggcgctctctcttcaccagacggaattctaggaagaggtacacccctaatagatttgctgctatcatggatattcaaactccgagtattatcattttttttgtagacatgatctttttcagggttgttcggttcaccgtacaccaggacgattccaagaaagatgccagcgattaggaagataggtgatgtggtgacgatgagggtgaaccagccgaagaagtacttgtacaacacaagtaggaaaatcagtaagcagatagctgaaggatggcgttgaaagaatctgcctgtggacctcagcggtgccatttccttcaaaacatttttccatttcattgcaaggtttttccacactctgcaacatgtaagaaatgaccttcagcatctgaaaagatttgtagagcacaacaagaaacaaattattttatggtgataaatctcagattttgcacattttgcanaagcaaactaataaatagtcacactatttatgtgattactgctttgcaccaaaacagtgattacagttcctttgaacagtaaagcaatcacattcctgttcccaactcaatcttcattgattgtatatttatttgcacacttggggtttacgtgccaaattttctgatttgaactgaacccattcaaaccgtgatcaagtgagtgaacttaaaaagtactgctcccaactaatgtctgatcctttttattatttttttaaagtaccatcagtacccattgaaaagaattattttttaaaaaaaatattggcattagcagcatcaaagaatactacgtcaaccgaagcaaaactctgtgcacactcaaagaaaacaccatggggaagccatctaaagtgtattgtactatttttatgccctcgtttccaaataacctgatccccaaagagtcacattgcaaccgatttctcacattaatgtattaccgatgcatcaggaggtggccacacatttctctgtgcggcaagcttggctatcatattttgtgcgggaaatgattcttttggcggaacaaatatgccggatcaccttatgagttaggaattatgatggttctaactaatcaataataaggcgcgcgatcgaagtgactagaaacctaaaaatctagaaatgtgggcatcaaacaaatccgcggggtcagagagaaaagaaggcattggaattgaagcatggcgacaaaaaagaaaagaaaagaaaaggagaatctgtagaatgaacgagcatttctagccgagttcccttaccaacgagagaagaaatcgggcagagtcagggttgatctgcgctccacggcagcagcgtcgaaaggcagacgctaggacggcgaggacgcctacgggagagggggaggaggaggaagagcggcgagccgcgttcggcgcggaaggctcttgcctccggacgcgacttctctcctcccgtgcgtactcctgcacacgtggcgctggaaggaggaaacgagacttccacgaaacggtagccacatctccacaagttaaaaaaagtgggagaaaatgagcggtccgaaagctttatcctttcaactctcatgctccgcactccgcagttttcctgcttgctcgagctgctgccctgctgctccagtgctccacaaccagccggagtgagagaagccgtcaaacacctcgctctgtcgccgctcaccgtcaaatacgtcgctgcaacgccatctgcgacctccgtccttcgcgcctctggagccgtggagtctggcgtgggtaaatctggattttgaaggtagccataactctttttgttgttgatttttttccttaatcctttaactgaaattatatttttttggttgtcatcgagatctcagttttagaggtatccatagctttagctctgttgaca

SEQ ID NO: 23040 - DNA, 1340 bp, Zea mays
catccttttcgttttcattttagacttgtgtaaaaccttacacacagcaggtagtatgagttccaaaggcaatccattgtcttttttttttttagcaccgaattaacaattaatttacggcacaaaattgactgtcggatccacaaggtattcacaaacgagagtgctggccaaattaagcaacaaccatatctagccatttttacagtgcagtgctaataatgctaatgttgcctagtccctttgaagcactaagaaatttcctgcaacaaacatataccctcccagtggtttcctcagcaatgaactcgccccacacaaaagtcgcctagctcgaagtactgctgaagacgaccaacctgatgatgctcgatcggtgccgctgtcattttttttatgaagaaactaaagaactgcgtttgtgaaggatggtgttacaccactgccagaatcaccatttgttgaactttcagtactcggctgagaacttatatcagatactgaaggatcagcatggctgacagaacctccatgtgcctcgtcatggccaaccatggactgctctcttatctcagaggcttctttctctggggattcgctttgctccacagaactcaaactaggtccagctacctcactggaagaaacctccattcttgatgatgaacccccttcttcgatggttgcttcaacaacaagagtacaagcatgaccatcttttaggacaggtccgtcaattactaaaccagtaggtgcaggcctctcgcttcccgaaggacttgaatcatatacaggatccacaacgtgggtatcatcaacgaccaccacttccttagctggtggttcaatgtcattcacttcaaaaggatcatcagtagtttcagttgatgacgacgtcaactcaagatcattcgaatgtggtgacatttgattcaatccattgcttgtgatatctatttcttgatggtgttgcatgacattaggatcctcttgccatgtattctgggacaaactaaaattttcactctgttgtgcttcctcccaatcatttatatgttcaccagacagtgatatgtcatcatcagaggaatcactaattaagacaggtggttccatgtcaagggaaagagaaacctcccttgcatgccgagctatatgtgcatgttcctctgtttgactgaaagaagattgttgtccttggtttgagcaatcctctagaacatccttctggctttcttggtcagcaactgaagaagtactatccgagtcttgagcagagctggccttagagttgctcttttcactagtttctccttcaagaactggatctgtcatttccc

SEQ ID NO: 23041 - DNA, 1758 bp, Zea mays
cctctatagtcgacctgcagtgaagtccttcccgagggatgacccaaagaagccctgtcacctcaccgccttccttggctacaaggctggaatgacacacattgtggtgaggtcgagaagcctggctccagtaagttcaatcatcatcataggtcgcggtttttacgtcacgttctctatgtatgagacaactactgttgcttttgtggctaacataaatagtcaacaacgagactaaggattgctatgggttgtgcatgagagtagtaacactgttgattttgtgcagagctccacaagaaggaaacttgtgaggctgtgactatcattgagactcctccccttgtcattgtcggacttgtggaatgtgaagaccccccgtggcctacgaaccctcaactctgtctgggcccaacaccttagcgaagaagtgcggagaaggttctacaagaactggtgcaagagcaagaagaaggctttctccaagtatgccctcaaatacgacagcgacgcaggcaagaaagaaatccagttgcagcttgagaaagtatgcttcagttatccgtgttattgcccacactcaggtgaggtttgaatttacttgtcattgtacgacagtttagttataaattgtgctatgctcacatgctatattctttatctgatttcagattagaaagatgaagggtttgaagcagaagaaggctcacctcatggagatccaggtcaacggtggcactatagcagacaaggtggactatggttacaagttctttgaggaggtccctgttgatgctgtgttccagaaggacgagatgatcgacatcatcggagttaccaagggcaagggttatgaaggcgtggtcactcgctggggtgttacccggcttccccgcaagacccacaggggcctccgcaaggttgcctgtatcggtgcatggcatcctgctagggtgtcgtacactgttgctcgtgctggtcagaacggataccatcaccgcactgagatgaacaagaaggtttacaagattggcaaggccggacaggaaagccatgacgcctcaactgagtttgacaggactgagaaggacatcactcccatgggtggcttcccccactacggtatcatcaagggcgactacctgatgatcaagggttgctgcgtcggccccaagaaaagggtggtgactctccgccagtctctgctgaagcagacctctcggttggccctggaggagatcaagctcaagttcatcgacagtcgacacctcgtccaagtttggacatgggcgcttctagaccacagacgagaagcagaggttctttggcaagctcaaggcctgagttgctgtcttgctgatggtgtcaagcgaaatggaaatgtattaccagatagttttttgtttttcagattcagctttgttggagatatcataagaacatgtttgatttgctagtctgagttgattctattgcgggcggctgaagttatattacttctaatgaactcgaaagtctctgtgattcaagcatcataggcctgagttgatttgtcagcttgcaagtggggtgcctttacatgcgcaagcccttgccaattttgagggaatctcaaatcttcccgcccccaaaaggctcttgctcaattcacccgtttttttactgtaatctacggtaatcgtggtcagcacatctgtctacagtgaataaacccggtaattgttttgaatttttaaaccaattatcttattattcccc

SEQ ID NO: 23042 - DNA, 2562 bp, Zea mays
ttttttttttttttttttgcacccgcattgcattttttatattacctttataaaacaagcagtggttcgccctaaaaacaatttattactcaaccattcctttattcctgtgtacttacagatgtataattccccctttgccactattgccttcttgcaatgatacttcacacatcgacgggatgttgttccccctcacttcctagttcctatacatttacccaacaacacttaagcaaaataaaaacagaagaatcaacaggcaaatacaaaaatgttactggcctccaattccatttccatggagatcgctgctggagaaagctagggaggactcagagaggaaactctttctgaagagcgtcgaggttgcgggcgtcgcatgcggcaatcatgtcagctcttgaagcgttgccaagagaaatcctcaagtactgccaagcgttgtcagcttttgggttcattgtaactgcccttacatagtatcgaatggaatcctcatacagaccctggttggcatagctgattcccatgttcgcccatgcacgcacgtagttgggtttcaagtctagtgcctgctgatacgccaatattgcatcagcactctggatgctgtttgcttgggttgcaccaagcttgttccagagtgagtagtcctgtggtttgagctgtactgctgtcttaaatgaagttatagctttatcatactctcttgataggttgtataagactcccagaactacatgaacatctgcatcttcaggtgacatctgagcagcgtcattaaacaatctaacaacatcaggaccataaggtgaatcagttgactgcggagggacaaggccaccatattttggatgattctgaagccacctataaagataccttaatgcttctccctgctccaattcatttgtgtgactaacaccaagagcaagaagaacttcaaggtttgtcggattagcttccaacgcacgcatcattgctgcaatggcctgttggtcatcatcattttctgcatgtgttatgcctaacaacctccaaccttcagcattatcaggattcttcaaaacttcggcctctaaagcaagaacagcttcacttaagaggcccttgcggaagagctcctgtccttcctgcattggattagggtgaccaacatacgggttgttctcagaaaaaacataaacccctcgagaggcgcctgaactttgtttgaaagatgacaagtgttcttggaactcatctacccacggatcagcagagctttcgccaaaaccacctccactgaattcctctgcccattcatcagtgacatttaatttcgagaactcatcaacccagctctcatttagcgcaccttgattatgttgactagagaactcactaacccacttatccgccccttgtgaaagctgaaacttgggatcattattacttgctaaagtttgtgcaagcattcgggattgctccatagcagccaggttggccatgttcactcctcccatctggcccatggccatctgagactgatgctgttcaaactcagaggcccacccattggggccatattgttgttcgaaagactttgcccaattttccggattattattttgtttgccaaactcagtaatccatttatcagcggtattatgcatcagggcaggacccatagaactttgggactgggtcccagtactcctgtagtcctgggtattgtccatgcataggtcctctcatacggttgtctatatcaagcgaatgcagcaaagtattgacctgagcctgtatatattcttccggttggtcagaaaaaatatgccgtgccattatgcagctacgatcacgtatgcactgtttgtcactttcagataaaccaagagcagctggtactggaagaggttgaaatggcacaccagctgggccacttgtgagaaaggaatgcaagacaccagacaacactctttgtggtggaccatccaatggcggctgaaaggttgttcctgcattgttataaatttgctcaaaatctggaaagtgtgcttctattccaccaagttcaggaacccccggaggccgaaaagacttaatccaatcattagcaggaccaccatgaataaagtcagagccctgcacaaaaggtcgctggtcttgtttgaactcattttctgaaccagggatgtttgacaagggagcaggcgcgctgaagccagatgtagatggaacactaacagaaccaggaagttcctttattgactgcgccttggaggactggccaaggaaggcgttggcgagggcgttgagggggttggacgacgaggcgccctccggcgcgcagttgttctggcccgtgaccaggtgccgcagcgccatctccgccgccggacgggcgcgcgcgctcgccgatgccggaggtgcgaggctacggccgacgtttcggttgccggcgacgtgggccggtccgcctcgatgtgaggagagggtgagctggagccgcgcaggagacagagtcggagtcgccgtgcggcactgcggcggtagcttaaccggcccggccggcct

SEQ ID NO: 23043 - DNA, 2857 bp, Zea mays
agacacaactgatttgggcgtgcgcattacattatgatataaaaggttacaaagcgcattatttattgcctgttgatacaaatcagtattcaaactcgaaacaagtaggggttgatcctaggggtgtgtccccaaaataaatagtttattaatcaaccattctttatttatgttgtgcgtcccgtaagtgtgtatgtatagtacccctttgccactattgcctactgtgccatgaatgcttcacatcaactggatgttgttccctcgcttcctagttgctacacattcccccacttcctaaaaataaatataagaatcaacaggcaaatacaaaacgctactggtttccaattccatttccatgaccacaggtgcagtcactcggcttgctagtgtgctgcttccttccatggaagctctaatgccttggaccggagggctcacagaggaaactctttctgaagagcgtcaaggttgcgggcgtcgcatgcagcaatcatgtccgctcgcgaagcattgctaagagagatcctcaggtactgccaggcattgtcagcttttgggttcattgcaactgcccttacatagtatcgaatggaatcctcatacaaaccctggttggcatagctgattcccatattcgcccatgcacgcacgtagttgggtttcaagtccagagcctgctgatacgccaatattgcatcagcactctggatgctgtttgcttgggttgcaccaagcttgttccagagtgaatagtcctgtggtttgagctgtagtgctgtcttaaatgaagctatagctttatcatactctcttgataggttgtataagactcccagaactatatgaacatctgcatcttcaggtgacatctgagcagcttcattaaacaatctaacaacatcaggaccataaggtgaatcagttgactgcagagggacaaggccaccatattttggttgattctgaagccacctataaagataccttaatgcttccccctgctccaattcatttgtgtgactaacaccaagagcaagaagaacttcaaggtttgttggattagcttccaacgcacgcatcattgctgcaatggcctgttggtcatcatcattttctgcatgtgttacgcctaacaacctccaaccttctgcgttatcaggattcttcaaaacttcagcctctaaagcaagaacagcttcacttaagaggcccttgcggaagagctcctgtccttcctgcattggattagggtgaccaacatacgggttgttctcagaaaaaacataaacccctcgagaggcgcccggactttgtttgaaagatgacaagtgttcttggaactcatctacccatggatcagcagagctttcgccaaaaccacctccactgaattcctctgcccattcgtcagtaacatttaatttcgagaactcatcaacccagttctcatttagtgcaccatgattaggttgactagagaactcgctaacccacttatccgccccttgtgaaagctcttcatgtgcaaactgatctgcccatgagtttgcattagcaatgtacggtgtttgaaattcatcagcccagccactggattgggatgctgaaccttcttttacttgattatcttctataataagttcacctcggctcatctttgaaacaaactggaagaacttagaattctgaaacttgggatcattattacttgctaaagtttgtgcaagcactcgggattgctccatagcagccaggttggccatgttcgctcctcccatctggcgcatggccatctgagactgatgctgttcaaactcagaggcccacccattggggccatattgttgttcgaaagagttcgcccaattttctggattattattttgcttgccaaactcagtaatccatttatcagcagcattatgcattggggcaggacgcgtagaactttgggactgcttccagtactcctgtagttctgggtattgcccatgcataggtcctctcatacggttgtcaatatcaagcgaatgcagcaaagtattgacctgactctgtatatattcttctggttggtcagaaaaaatatgccgtgccattatgcagctacgatcacgaatgcattgtttgtcgctttcagataaaccaagagcagctggtaccggaagtggttgaaatggcacaccagctgggccacttgtgagaaaggaatgcaagacaccggacaacactctttgtggtggaccatccaatggcggctgaaaggttgtccctgcattgttataaatttgctcaaaatctggaaattgtgcttctacaccaagttgaggaaccctcggaggccgaaaagactcaatccaatcattagcaggaccacctcgaataaagtcagcaccccgtgcaagaggtcgctggtcttgtttgaactcattttctgaaccagggatgtttgacaaaggagcagacacgctaaagtcagatgtagatgggacattaacagaaccaggaagttcctttattgactgcgccttggaggactggccgaggaaggcgttggcgagggcgttgagggggttggacgacgaggcgccgtccggcacgcagttgttctggcccgtgacgaggtgccgcagcgccatctcctccgccggacgggcgcactctccgacgccggaagcgcgaggctacggccgccgattcgatcgccggcgacgtgggggcggtccgcctcgaggggaggggggagggtgagctggggcctggagctggagccgtggaggagccggagtcgccgtggagcgtggaggcgttggctttgcgggtgtgacgcccgtcctgagtcccggccggc

SEQ ID NO: 23044 - DNA, 1897 bp, Zea mays
  misc_feature (37)..(61): n is a, c, g, or t
  misc_feature (222)..(227): n is a, c, g, or t
  misc_feature (229)..(233): n is a, c, g, or t
  misc_feature (278)..(328): n is a, c, g, or t
  misc_feature (403)..(432): n is a, c, g, or t
  misc_feature (446)..(464): n is a, c, g, or t
  misc_feature (505)..(540): n is a, c, g, or t
agccacttgtcagtactgctgcaggtagctagcgctnnnnnnnnnnnnnnnnnnnnnnnnncaatgctggacgctgctaaatattctctgcagtgaagcacgcacgttgcttttccttcactccatccatcggccaccaagttaatgcattgcatgccagctggcccatctgattctacatcatgtaatgtaggttgatgacgatgatgtgtcccctcagcnnnnnngnnnnntgacactcattgatcattgctggaccggactagactagacggtcnnnnnnnnnnnnnnnnnnnnnnnnnnnnnnnnnnnnnnnnnnnnnnnnnnnacaaggttgtgcacatggacgacgatcccatgtactgctatctcttgtccgctacagcaacgaatgtgcgaaaannnnnnnnnnnnnnnnnnnnnnnnnnnnnncatttgagagacannnnnnnnnnnnnnnnnnnccgatccgatccgcaccggccatcggccgaggtgaaggacnnnnnnnnnnnnnnnnnnnnnnnnnnnnnnnnnnnnttgctgtcgtccaggctcatgacgctcccgccgccgtccgtcaggccgccggcctccgcgtcctgccagctcttcaccatctgcagcagcggcaggggcaggtcgatgcccaggtagtcctcggcctcgtccttcacgggcctccacttctccaccatgggcaccagcacgttcaccgcgtgccccatgtccggccgctgcgacggctcccgggccgtgcagtgccccgccagctccgcgatcacgccgatgctctccattgtctcgccgtcgcccacgtccagggccgggtcgatcgccgcgcgcagctgctccgcgtccttccgtatctggctgaaccagtacgccaggtgccgggtctcctcgccctcgcccacgcggctgtcgtcgatggccgtcgtccctgttatcagctccagcagcactacaccgaagctgaacacgtctgctttcgtcgagatcttcccggtaactgcatactcaggagccaagtacccgaacgtcccggcaagtctggtcgccacagagtagttcccatccggcgcatctttcatgagcccgaagtccgccaccttggcccggaagtcgtcgccgaggagaatgttcgctgacttgagatccctatgtatgaagcggtggtgccccaggttgtgcaggtactccatcccacgggcaacatccagggcgatgttgagacgcttcttccacgagagaggctccagctgcaactgtttccagtggaacaggtgcttgctcagagccccgttgggcatgtactcgtacaccagcagcctctcgttcccttcgatcgcgtatcccagtatcgacaccaggttgcggtgccggaccttggtcaggacggcgatctcggcctggaactcgtccaaggccttgttgctcaccgccacggcctccatcctcttcaccgcgatcatggtgccgtcgtgcagctcccctctgtagaccaccccaaatcccccacggccaagcacattgtcctgggcgaagttcctggtggcgccacggaggacctgcaccgcgatcacgaaacttcccgcctccaccacgtgcacgtcgccagcctggccgctgctgctcccgctatgggacgtgccgctgctgctgccgccgtcgttggtggccaccacgatcttggccaggttgtccggatcagagctattacggggatgcaccaccacggaggctgcctgcggcggcaccgacgctcttctcttgcacaagaacacggcgcccacggagaccagggcgaccacgctcaccgcgactggaatggttgtgcccagcaacacagctgatgaggccttcttcccacccccaggggtcccccctgcactat

SEQ ID NO: 23045 - DNA, 857 bp, Zea mays
  misc_feature (7)..(15): n is a, c, g, or t
gtggatnnnnnnnnncgtcttgtcgactctgttttttttgttgtatagaaaacaacatcacatctttattacataataggagcttttgtacaaaataactaagtaaaatacatcatatgacgacgacgatcctccataatcaaagttaactagaagacgacggtctagaccactctaaactcgccttcatgattctcctccagcagcatctgctcttgacctttttggtgaaactccagatacttctccaattcaagctccaagtttctcgtaacctcgctgtccttggataagcagacgcggtcttgcagtgttcctcctacttgagcttctcatccagctggccgtgaagccagtgtgccctccaaagaatcgaatgcgacagaaggcgttccgtcgagtaaccttcagtctgcagcttcgagataaaactggtatacatctcgtccatccatcgacgggcctctaagtgctgaggtttgctgttctgtgtcgagctagctagcacgagcccgtgtacgaaggaccttaaaacatcggctggtgttgcctccttgtggatgaaaacgtaaacgatgccttgtttatccagcaaaaagtagttcgcgttttcatagtggtatcttgtttttgcaatcaccaacatgtcactgtgtgtaagcatcgaggctttagcacccaagtgcacacgctcatgtggcagtttaattctgttcagtttcctccagtttgaccaagaaggaagaatatgttcctgctgggaaaccctccgtggcacaagaacttcaccacattccttgaagtattgtagcaagatggaagctctctcatagtttagcgtagtgagtgaaagtgac

SEQ ID NO: 23046 - DNA, 1874 bp, Zea mays
ttttttttttttttttaaagcggcgcggatggacgtagtgtgaaccattaacatgctgaactcgagcgtacaggccagcacttttatcgtgaagtccgtccatatgctacatcctcgaaggtcgaagcggttaactatatttggtggtgctcggtgcagctcatgcatctatctttcatcatgcagtcatgccatgcacaagcgaacaattaacacgttctcaccctagctaataatcgcgtcctgggcgatatacctgtgacctgtccttggataagcagacgcggtcttgcagtgttcctcctacttgagcttctcatccagctggccgtgaagccagtgtgccctccaaagaatcgaatgcgacagaaggcgttccgtcgagtaaccttcagtctgcagcttcgagataaaactggtatacatctcgtccatccatcgacgggcctctaagtgctgaggtttgctgttctgtgtcgagctagctagcacgagcccgtgtacgaaggaccttaaaacatcggctggtgttgcctccttgtggatgaaaacgtaaacgatgccttgtttatccagcaaaaagtagttcgcgttttcatagtggtatcttgtttttgcaatcaccaacatgtcactgtgtgtaagcatcgaggctttagcacccaagtgcacacgctcatgtggcagtttaattctgttcagtttcctccagtttgaccaagaaggaagaatatgttcctgctgggaaaccttccgtggcacaagaacttcaccacattccttgaagtattgtagcaagatggaagctctctcatagtttagcgtagtgagtgaaagtgactgcactgccttgtaatttgcatacatatggaacatcgtaagagaaagaaaagatgcccatacactcaaagcatgccctctggtaatttgagctaacagcatccccaaccccatccctaacattgtagcaagtgtttcctgactgccctcctttgcagaaatatcagctgcattatttgcaagtgcaaaatgctgcgttagtgctgctctagttgctccactagcaacaccagtgaatgacctagacaggctgcctaagcacattataactatcaacgatgaaggaaacagagggctcaaaagatccatcaacattccaaggtcattcataaagtctgcaactagacgccacattttagcattgctatcaagattagatccctggtaaaaggtgaacaatatccctccaagcattcctgtcaagtccctcagaaaccactgaaaagtagcacctatgacagttgcggactgttcccccactccgattgcccctagaagagcttgtgtagacaacattgcacggatgtatgtggagagaccctgcaacgtatcccacatctggaacgggacataatccggagtcacgctcccaggaaagccctcaggcacgaaggcgccgagcatgcggctcccgatccgctcccaccggctgccgaacctgtgtgcggtgagagaggaggcggaggcggtgaggacggcggtgcgggagagcgcggaggctgacgagccgctccactcctcgaccgtcagccaccccgccgtggcctcgccctccgggtgcgacgcgtccattcctctcgtgcgcgctgccggcgccgggatcggttggctgcctcccggagaccacgcctcacccgcgggccgtggcgtggcggccgatcgcacgatccgatccgattcagcagatgcgcatcggttcgaacggagaccacgccgcgcgcactactcacagaagagcagcgcagcacagccgacggtggagtttttctgggagtgtagtcagtagtcagtactcggtgggactggtctcagct

SEQ ID NO: 23047 - DNA, 1937 bp, Zea mays
acagtgggaagtaaggcgtctgttgctacttggtttacgagccagagacgtctcttcacggagagacggctctaagatttttttacaaataacccccttaaacaccttaagagactccacattaaacaccactgtacatgccctaaagcggcgcggatggacgtagtgtgaaccattaacatgctgaactcgagcgtacaggccagcacttttatcgtgaagtccgtccatatgctagaacctcgaagcggttaactatatttggtggtgctcggtgcagctcatgcatctatctttcatcatgcagtcatgccatgcacaagcgaacaattaacacgttctcaccctagctaataatcgcgtcctgggcgatatacctgtgacctgtccttggataagcagacgcggtcttgcagtgttcctcctacttgagcttctcatccagctggccgtgaagccagtgtgccctccaaagaatcgaatgcgacagaaggcgttccgtcgagtaaccttcagtctgcagcttcgagataaaactggtatacatctcgtccatccatcgacgggcctctaagtgctgaggtttgctgttctgtgtcgagctagctagcacgagcccgtgtacgaaggaccttaaaacatcggctggtgttgcctccttgtggatgaaaacgtaaacgatgccttgtttatccagcaaaaagtagttcgcgttttcatagtggtatcttgtttttgcaatcaccaacatgtcactgtgtgtaagcatcgaggctttagcacccaagtgcacacgctcatgtggcagtttaattctgttcagtttcctccagtttgaccaagaaggaagaatatgttcctgctgggaaaccttccgtggcacaagaacttcaccacatcccttgaagtattgtagcaagatggaagctctctcatagtttagcgtagtgagtgaaagtgactgcactgccttgtaatttgcatacatatggaacatcgtaagagaaagaaaagatgcccatacactcaaagcatgccctctggtaatttgagctaacagcatccccaaccccatccctaacattgtagcaagtgtttcctgactgccctcctttgcagaaatatcagctgcattatttgcaagtgcaaaatgctgcgttagtgctgctctagttgctccactagcaacaccagtgaatgacctagacaggctgcctaagcacattataactatcaacgatgaaggaaacagagggctcaaaagatccatcaacattccaaggtcattcataaagtctgcaactagacgccacattttagcattgctatcaagattagatccctggtaaaaggtgaacaatatccctccaagcattcctgtcaagtccctcagaaaccactgaaaagtagcacctatgacagttgcggactgttcccccactccgattgcccctagaagagcttgtgtagacaacattgcacggatgtatgtggagagaccctgcaacgtatcccacatctggaacgggacataatccggagtcacgctcccaggaaagccctcaggcacgaaggcgccgagcatgcggctcccgatccgctcccaccggctgccgaacctgtgtgcggtgagagaggaggcggaggcggtgaggacggcggtgcgggagagcgcggaggctgacgagccgctccactcctcgaccgtcagccaccccgccgtggcctcgccctccgggtgcgacgcgtccattcctctcgtgcgcgctgccggcgccgggatcgctagaggctagaccgggcgggataggttggctgcctcccggagaccacgcctcacccgcgggccgtggcgtggcggccgatcgcacgatccgatccgattcagcagatgggcatcggttcgaacggagagcacgccgcgccggacgagtggg

SEQ ID NO: 23048 - DNA, 1414 bp, Zea mays
gccacctagatccaaacactctgacaaagggagtatgcagtagttcttgttgattataaaaaataaaataaaatattgcaaaatgtgaattagggtgttacaaagatgccaagtcgcgaaaaagatgcatcgcagacatgctcgtcaaacaaaatcgccaggctacttaagtgaagaattatgtgtagactgtagagtacaaatagctacatactttgcctaaatcaacaaaactgctgttacaaccagtacagccgaggcagagagaaaccatcaagatgtaatccggttagattaactgaatctatttgtagaattattcagtttggtcgacttccatggctttgatagagtctaacagaatttctcttaggctccgtctcctttctttcgccaagctaatgcactccttaatagtcgccatgcatgtcactgcacctccaagtttttgtaatgacactaggcggtctgaagaatctacaacaacagtcacataggtctctattatcgattcttcttcagaagttgggtccgctaatatttcatctttatgaagtgcacatgtaagggacaatggaatggcaccaagtgtcagtttcctcttttctctgtttactaattcaaatttgttttttccatcattgcctccaacagtaaataatctaccatcatcaccaacagaaactaaaggaatctccaaatgtgtgaaggcagccactgctgaaataagtgcagcatcaaacagagacccatcagcattcaagcaatagatatccaggtacgctagccaagaagccttcccagtgatcaaacagaggtccttcaaatttagcattccagaactcgtcaaaacgtcttcaagggccttggagatgacgggtgcaacgtcagtgggtcggcctggcctaaccagcggggagcagataggcggcatgtggaactcaacagcgacggatccttcgtctgggtgctccgccgggggcgacatcacctcgagcttgaccgacgcgagcatggcggtgtcgccaaggcgggcgagagcggaaccatgcgcggaggagacggcgccgagggcgacggtggtggggcgggcctctctgaggcggcgggcatcgatgcggacggactcgccgaggtggcgctcaaggaaggccaccgggaaaaggcggcggtacgcctccacctccatctcgccggcaaccccgctggccgcagccggtttagtctccgccgccatcctacgtttggcggtgggctggtgcctggtggtcggctggtcgactgcgccgctgctgaagcttgtcgagaaaagccttcgcggggcgtgcgggagcgcgcctgtagacctgttcaatccgccgctcagttgaagagaagtttttcgattaggatgttctaggtaatggtctcgtgc

SEQ ID NO: 23049 - DNA, 3278 bp, Zea mays
  misc_feature (142)..(142): n is a, c, g, or t
  misc_feature (1665)..(1665): n is a, c, g, or t
ggtggtgctaagatgtggttgatgggagatggtgtcagctctttttgtaggggtaccccctcggtcttatataggcgaccagagggttatccccttacaagctgtaatcactatctattttacctaattcctcctttatcanggcatgtatcctgcttatttggagttcaatcgattcttcaaccgagttaacgccgagtgtttagccctttaggtgtgcgcaacctcttcgcccaagatatcaacgcttcagtccgctcataactcggacgtccggtctccgtcctcctgggtcgagctcacccagcctagctgtggcccgatgacccgtctcgcaaggcaagtcatcgggggacccatcagacggctatgacatgtttctatgttcgtgaggacctggagatatctatcccctacagaggacgacaaggtgtataggttaaactcaacctaggtgggtggaggcaacctagccaaacaggaaaatggggagacatggattagagggtagggcttcagcccaagcaaaaagagggaagggttaggctagaacaagtctaagttaaaagtcattcaaattacatttttacattaattgagtggttttgaaggtattttttttatcctttttaagtcaaaaaatatctgtagatattttataaaaattttaaaccatagaaaatatctttaagtttttaaaaattccaaaaaataaagataaattgggttggataccctaaatgaaaacaaatatttagagcttatgaaaatatctctagatactttaaaactagttatagctataaaaatgggaaatataaaaaaaaatctagaaaagttcgcaaaacattttggttgatatataaacatgttttaaaaacttatatcaataaaaacataatgcatgaccatcataaaaaaagtagcataaatacattcaacattattgcattcatgttatttgcagcttacatgtttgttatgtattttaaaacacatttatatgacaattacaatgctttttgaattttcttttttagatattgttttcatttttctaaagctagatctattttttaggcatgtaaacacatttacatgagttttaaatattttatttgggtctggtacattccatcctatctccaaaatttcttctgggtttttaatagcatagagacattttctacggtttagaaactttatcaaatatatatatctagtttttaactaaaaaatggcaaagaacactaaaccaagacagagaggtaataagaacggttttgaaaatatttataagataaaatatttggttttaaaatttaaggaggtgaatcagactatgtttatttatggaaacacattcgaataatattactccactctaggcatatcgacggagataaggttagagataaagtctggctaattgccatcgcataagcagatttaattgagaacattcattttggatccccatgccctcaaagatgggaatagcaaggatgttgtcagcgtcctccttcaaggaagtgtcctggactaatcgagaatcccaaattcctgtaaacggatcaattagatcagacaatttatttaaaagagaaccatttctagtctcccctctgggatgccatggatcagaccatatttttcacttggctnccatctccaattctccagattattccttcctttagcaactggaggcctttcatcagaatgctacgccatgtgtatgagctcatcacataaatcagactatgttggtagttcaggtacgtatggtggactttttccaaaaagaagtgatttggcccaacaggagttttaggatttttaaaagaggattttaaaaccaaattagagttcaagtgttgtaacaataaacacttaggtctggcatgaataaaaaaaactttataccctatgttaggttagatgtaatttataaaatatattttcctcctctcataattatgcattagttctaatgaaatcttgaaaaataaattaaaatactgcaaaatgtgaattagggtgttacaagatagcaacttgcgagaaatggtgcattgcagacatgctcatcagataaaattgtctggctacttaagtcaaaaatcatgtgcggagtacaaatagctacatacttggactaacccaacaaaaatgctgttacaatcagtgcagccgaggcacagagaaccatcaagaaataatccggttagattaactgaatgtatttgcagaattattcagtatggtcgacttccatggctttgacagagtctatcagaatttctcttagcctcagcctcctttctttcgccaagctaatgcactccttaatagttgccatggatgtcactgtgcctccaactttttgtaatgacactaggcggtctgaagaatcaacgacaacagtcacataggtctctataattgattcttcttcagaagttgggtccgttagtatagatcctttatgaagtgcacatgtaagggacaatggaatgtcgccaagtgtcagtttcctcttttctctgtttaccaattcaaatttgttttttccgtcattgcctccaacagtaaataatttaccatcgtcaccaacagaaactaaaggaatctccaaatgtgtaaaggcagccactgctgaaataagtgcagcatcaaacagagacccatcagcattcaaacaatagatatccaggtatgctagccaagaagccttcccagttatcaaacagaggtccttcaaatttagcattctggaactcatcaaaacgtcttcaagggccttggagatgactggtgccacctccgcagatcggcctggcctaaccagcggggagcagatgggcggcatgtggaactcaacagagacggatccttcgtctgggtactcggccgagggcgacatcacctcgagcttgaccgacgcgagcatggcggtgtcgccaacgcggacgagagcggaaccatgcgcggaggacacggcgccgagggcgacggtggtggtgcgggcctctctcaggcggcgggcatcgatgcggacggactcacccaggtggcgctccaggaaggccaccgggaataggcggcggtatgcctccacctccatctcgccggcaaccccgatggccgcagccggtttggtctccgccgccatcttacgtttagtggtggacgctgagcttgtcaaaaaagggttggggcatgcgtgcgggagcgcgcctgtaaacctgttcaatccgccgctccgttgaaatgat

SEQ ID NO: 23050 - DNA, 1348 bp, Zea mays
tttttttttttttttttggagggagagctggagagcagccattcttgacaattgacatcaacgaacaatggacgcgacgcccttgagcgacgagcgccactggagactagagcgtaggcggtagtcctggcatcgagcaagtttcccacgcgaagcttgcttctgtccacaccacacctagctgctgaaagaacgagagattgcttctcctaaatcaccgaacgggtcacagccaccagctgtgcacacgagagaacgagcgtgaggtgagaagctaagagcaaatgcctagctcacactttattcagctcttcaagacttcttcagttcagaaagatttctttactggctagctagtaaacctgacgaggtaggaaaccatctccgagttcaccctctcggcctgctcctgctggagaaaatggtggccctcgatgacggtgacttcaagatctggaacggtggactcgaactccgcgctcttgatgtactccccagttccaaaggactgggcaccgatgtccttatcgccagctatgaacttcacaggcactgtaatcttcgctccgttccagggtgcaaggagtctcgagttcgtctccgacatgcggtagtagttgaggggtccaatgaacccggacttgtgaaacttctcagcatactggcccagttcttcctcgctgatccaaggaagtggcgagggagacgcctccaggaagtctatgatctccaccccaggaggagcggtgacatcatctatttcgatggagtagaacttttttaggacagttgcgacatcgtaacgggcgaatgcgctctcagctcttccagcctcctggaactgatttatgtaaaagccctcgccaaacgccgcgaaggcctccgtgatggggcgagcgtgtgcgtgtcgagcggagtacggtacccccagaacgacggcggcgcgcacccggtccggccggaacaggcagaggagccacgccgcatgcgcgccccagtcgtgccccgccacgaacacctttgtgagttggaggtggtcgaggagcgcgacgacgtcgccgacgatgtggaagatggagtaggcggcggggtcggacggcgcggaggagtcgccgtagccgcggaggtcgggggctagcgcacggaacccgcgggcggcgagcgcggccatctggtggcgccacgagagccagagctccgggaagccgtggaggaggagcaccgccggcccatcctcggggccccgctcggcgacgtggatggagacgccgttcacgtccgcgttccagtgccgcacctcgcccgcgtccatgctatgctgcatctctgacacgcgggtcgcctgttt

SEQ ID NO: 23051 - DNA, 2988 bp, Zea mays
gtaccgggccccctctcggctttttttttttttttttttgtgcaacaaatcaataagactatctttattttcctttctagtgtctgaaatcacaatgcacaaacattattctcacaatcatctagtgctaaaattgtggactaactaaaaacgaatcaactattcccagaaagagcgacccaaacaatgaatgctcaaggagaccacacacatcacctgatcaccccgaaatcctagcaattgttagtataccctccaagtttccacaagctgatgcaagtacgagatgtacactaccaataactacggtcacgacgataaggacaagagatcctcaaacaccgtccggacctccggcctctccgatgctgaccggatacaccggagcgcgatgcgcagtatgccatccagtgcctgtggggcgccttccgagctctcaacacccgtgatgtgcctgtcgtagcactccgagacacgctcctccagatccagcatcctcacccagtcggtcaggtcgaccacgccatcgttcatgcagatgatctcaccggcaatcttccctgtcagcaactccagcaggatgacaccgaaggcatacacgtcgctcttcagagatgggcatggcttgctggtgcttgaaaactcaggaggggaatatcctagcgcgccggcgtttaggacctgctccgccatgccgattggagtcatcagcctgtgaaggctgtagtcagtcaccagagcagatggagtggagttctgaatcaggacgttagacgacttgatgttgccatgtggaatcacccgctcgttgtgcaggtaatctagacagcgggcaatatcaatcgcaatgttcagccgctgtccagctgataggggtgggagattccgctcatcaaattcagacaagtaggtagacagagatgtggcatctgcatagtctgatatcatgatcctctcatgctctttggggccccagtagtagccacgcaaggggacaagattggggtgccttacactgccaagcttctttatttcacgggaaaattctttcttactcttagcaaagccctccttcagccacttcactgtcagcatgtacccgttgtcaagtgtagccttgtaggatgtcccatggcagctcctgccaattatctcagcaggggcacaagagagctcttcagccgtgaacacaactgaattgtcgaaaagatgtaaatccccaaccagtttatcaggagagtgcactctaaggatagagtgatgatgctgggagcgtgcatcaggaggcgacgatgataaagaaggcatcgaagactttgtgctgtctttacgggctgagctactacctgctggttcgttgaaataagcagcatcaattggcgcatcttgggcttcatgtcgtctttccttgccaggcaatgaaacagctccatactctgcagaaggtgacgattctaatgctacatcatgcatttcagttgttgaaatttctgcacttctctgagcactctggacttgacccacatgtttaccttggccagtacctttttccctacttttccagctactgatcttccaatgaacaagcaaaagcgcaataatcccagtaacaaatacaacaacacagataatcaatgcatatagaatcccacgcttcaagccgtgtcttgcctcatctgatttgtcagaaccatttaatgattcagagcgaggaagaacgagcaattcgttccctggatggaaagatgaatctgggaatttcagtaaattacttggaacagagccagacaggtagttgtaggaaacattaaattcgaccagatcatcagggaggccatcaggtatgctaccattgaaattgttgcttgataagtcaatgtataacagattcttaagtttggtgattgttcttgggatttcgccagtaaagttgttctgacgaaggttcagcaatgtcaacgcgctcaaatcaccaatgcccataggcagtgagccgtgcaaaaaattgcttgaaagatcaacataggagaggtttgaagtttgcacaggaagaatggacaagtctatagaagtcgagttcttggtatcggaatttcgaagggggagagtccctgtaaaactgttgcctgaaagattaagaaaagtcagcttaaccgctgtaaacagatttccaggcaaaggtccatgcagctgattaatgatgaggccaatgaaaatcagctctggataggttccaaggacgattggtagtggtccttatagcgagttgctggaaatgctcaaagatgtcggccttaaaaattgggttgtctcatttggccaacttcctgttgatctgtttgagctcagatcaaccatctggagataatttccctacgttcgggcaactgataagctcccatacagcatgtttctactcagatcaactactgaacagctcccaaatgtgatcggtaaagttcctgaaggtcctctttttgtctcaccttagctcaataaaagttaaaataaaaacagcataagggtttgctttgttttatcatggttcatggtaaatttgtgccatttctgaacttcttttagtttgatgacatgttgtccaaacacttttgaagatgtgttgcacactggtacttgccacaagctcacaatttcttatcttattttgatttttttcatacaattttttcagatcaagaactgaggtggttatcatttttcataggggtgtccctttcttttcttaagaataactagattctaatccaatatctttagctgcaaaaccatccttttcctttgatgttatcgcttatattatgatttttttcctacgcgcgttgggcgcgcgccagttactagtatatactaagatgcttcatccacgcaaggagaaagtatacaacgattgaagaatgttccactcaatatatactgagatgcttcatccacacaaggagaaagtaaataagtccactgcctcctgca

SEQ ID NO: 23052 - DNA, 1299 bp, Zea mays
  misc_feature (1298)..(1298): n is a, c, g, or t
gagtctacactattgactttaatcgagaagtagcgactagggacaatgtattgcaaaaactagtggatccgacgtctgtgatctgtcaacaaaaacccggacccacacggccgcctcctacatgtccaccctccaaatcgaaaacagatcgaaatcctaggggtagggttaccctccaccccaatccccatcgtccgttccgatccgatccctcaccgtccatcaatgtcccactcccaccatgacggaagcaagccctaccagccgcgccgggggcccgagcgctccccgcagccggcggacgggatagccgtcccgcctcctgccgccgttgccccgtcggtggagcacctcgtggcggccgccgccgaggcggaggcgttgagccgcttgggcgcggaacaacagcagctgctgcaggggcacgagcatgaggttggggaggaagaaggggaggacgaggaggaagacgagatggaggacgacgacgacgacgacgatgagcaggaagggcagcacggcggcatcggtgtggagcacgttcccatggacgcagatgctgctgctgccgccgccgtggcggccgctggcgcgcagatggacccgcactcggtgttggtgcctgggaccgtgccacccatggcgaccaaccagctcaccctctcgttccagggcgaggtctatgtattcgactctgtctcccctgataaggtccaagccgtgcttctgctgcttggaggcagggagctgagtagcctgagcggagcgtcgtcctctgcaccttatagtaagaggttgaactttccacatcgggtggcatcactgatgagatttagggaaaagcggaaggagcggaactttgataagaagatccggtacaatgtccggaaggaagttgcacttaggatgcagcgtaatagaggtcagtttacatcttcaaaaccaaagcctgatgaaatagcagcatcagaaatggcagctgcagatggctctctgaattgggcactagttgaaggccgacctccatctgctgctgaatgtcatcactgtggtattaatgcaacagctacaccaatgatgcgtcggggacctgatggaccaagaacactatgcaacgcttgtggcctcatgtgggcaaataagggtctcctgagggacctatccaaatctcctgtacctcttcactctatacaacaatcagctccaattctaaatggtggtaacggaagtgccatgtctgcgcttggctctgagctagagaatgctgcagcagccatgggcaatggccacgagccatng

SEQ ID NO: 23053 - DNA, 1526 bp, Zea mays
  misc_feature (1525)..(1525): n is a, c, g, or t
actacgtcgtcttcgtctctccaacccggggacattttccaccctccaaatcgaaaccagattgaaatcctaggggctagggttaccctccatcccatcgtccgatccgatccgatcccgccgctcatccatgtcccaccacgacggaagcaagccataccagccgcgccgggggcccgagcggcacccgcagccagcggatgggatcgccgccccgcctcccgccgccgttgccccgtcggtggagcacctcgtggcggccgccgccgaggcggaggcattgaaccgcttcgccgcggaacaacagcagcagctgcaggggcacgagcaggaggttggggaggaagaggaggaggaggacgagcaggaagacgagatggaggaggaggacgaggatgagcacgaaggtcagcacggcggcatcggtggggagcacgttcccatggacgcggatgctgctgccgcggcggcggcggccgcagtctcgcagatggacccgcactcggcgttggtggctgggaccgtgccacccatggcgaccaaccagctcaccctctcgttccagggcgaggtctatgtgttcgactccgtctcccctgataaggtccaagccgtgcttttgctgcttggagggagggagctgagcagcctgggcggagcgtcgtcctctgcaccttatagtaagaggttgaattatccacatcgggtggcatctctgatgagatttagggaaaagcggaaggagcggaactttgataagaagatccggtacaatgtccggaaggaagttgcacttaggatgcagcgtaatagaggtcagtttacatcttcaaaaccaaagcctgatgaaatagcagcatcagaaatggcagctgcagatggctctctgaattgggcactagttgaaggccgacctccatctgctgccgaatgtcatcactgtggtactaatgcaacagctacaccaatgatgcgtcgcggacctgatggaccaagaacattatgcaatgcatgtggcctcatgtgggcaaataagggtctcctgagggacgtaacaaaatctcctgtacctctccaagctacgcaatcagctccgcatctagatggtggtaatggaagcgccatgtctgcgcctggctctgagctagagaatgctgcagcagccatgaccaatggccacgagtcatcgagtagtggtgtttaatccagcgatggggtaaaagccacgaggagcatcatcccggagtgatctctgcagtaggcggtcagctgctgtactataattgagttggaggctgcttagatatggaatccttccatttaccttggtgccctgtagttaagagctatgacagtgctttatcccgtgtcatgtttgcagccgctgcgtctataacgaagctatttcttgtcttgaggcgtgactgttaagaaccgttgaagtccactcagttttaaccgtgcagcaacgtcttcgatcaagaaaaaaaaaaaaaaaaaaaaaaaaaaaaaaaaaagggcggcnc

SEQ ID NO: 23054 - DNA, 1729 bp, Zea mays
gattggtcgtctaatgctgctatgcatatcattatttgtataattgtttcgaaactacgtgtgcttgtattgttaaaaattcacggagaaagtcatttccccttgttcatttgatccttatacatctacgggataaatttctcctggggccattagtctgactgttgctcaaatcaatagttgctataatgaaaatggtccattccagaaccagattgtcttgtgaacaatccccgccaataccgtagtgttctttcctaccatgtcgaggcgttgatcaaatcctgtatctgtatagtcacaaaactgatacagaacctgacttaaatcagtcagcaactgaggcttgcaaaccttctttgccagacgtggcattggccgagattggttccctgtaccactcgttctcgtcgcgagtgagcaagcaagcctctgacacaaaaacatccttgtagtcttcatcgtcatacacgaatgcaggaggatccggtgaaccaataccaacaattgtgcttccacttcctgacataaaaacagcactataatcatcccggccagctgcaataattcgtttcttcaacctcttaagtgagggcaacacctcaaaagctggaggctctaggtcattaacacaaacatcttgtgatatcccattctgagttatttcctcgagcagggtcatgggatcagcttgacttgtttgttccaacctgaatcgcttgtaaacttcagcagttgagcatgcttcaggtggctttataagaaccattggtaaattttccggcaagggatttgggatatcttggacaatctctcctctacctgtacaatatgctgctcctcgtgaaaagaaaaaggggatatctgatccaatctcaccagaccactcttgaagatccttctctgaagctatgcagccagcaaactggttagcggcccatagtgcagttgcagcattactgcttccaccaccaagaccagcaccagttgggaccttcttatcaagatgtatccagaagaagttattagtcccagttttctgtcggtaaaggttgagtgccttgatgatcaaattgctttcatcaactgggacacctggaacattggttgacaggcgatctctacttttacttggtgacaatgagaatttgatagtatcacccaaacttatgacatgaaatagagaagccaggtcatggaacccatctggtctcttgcccgttatcctcaagaacacattaattttgcaaggtgagaataggttaagccgtgtcatcccagcatccttgtcaatttggtctgctatctggttaaacctcgcttgtgggtcataagagacctccacttgcctccttccctgctcgaacgacgcggcgactctcaggctgacaccccggcagccactgacccttgagccaggcctcgcagagggagacgcccgcgccggcggtcggccctgggaacggagattcctaggcccgcccgggctggcgcggtgggacgagtagaggctctgggacacaaggtgcgcggagcaagccatggctgctgctgctgccgtggctatccgaggagtagtgcgcttgctttagacttgatacttgctttagacttgatatgtcgaaataaaattatggggtcggatatgacgattggtctgagactccaaacgtctgctccggtcaaggtcgcgttcggcgttccttgtcatcaccatgtgtttggccat

SEQ ID NO: 23055 - DNA, 1284 bp, Zea mays
tagcgtggtcgcggccgaggtaccactcgttctcgtcgcgagtgagcaagcaagcctctgacacaaaaacatccttgtagtcttcatcgtcatacacgaatgcaggaggatccggtgaaccaataccaacaattgtgcttccacttcctgacataaaaacagcactataatcatcccggccagctgcaataattcgtttcttcaacctcttaagtgagggcaacacctcaaaagctggaggctctaggtcattaacacaaacatcttgtgatatcccattctgagttatttcctcgagcagggtcatgggatcagcttgacttgtttgttccaacctgaatcgctgcagcacaagaagattcttgtaaacttcagcagttgagcatgcttcaggcggctttataagaaccattggtaaattttccggcaagggatttgggatatcttggacaatctctcctctaccggtacaatatgctgctcctcgtgaaaagaaaaaggggatatctgatccaatctcaccagaccactcttgaagatccttctctgaagctatgcagccagcaaactggttagcggcccatagtgcagttgcagcattactgcttccaccaccaagaccagcaccagttgggaccttcttatcaagatgtatccagaagaagttattagtcccagttttctgtcggtaaaggttgagtgccttgatgatcaaattgctttcatcaactgggacacctggaacattggttgacaggcgatctctacttttacttggtgacaatgagaatttgatagtatcacccaaacttatgacatgaaatagagaagccaggtcatggaacccatctggtctcttgcccgttatcctcaagaacacattaattttgcaaggtgagaataggttaagccgtgtcatcccagcatccttgtcaatttggtctgctatctggttaaacctcgcttgtgggtcataagagacctccacttgcctccttccctgctcgaacgacgcggcgactctcaggctgacaccccggcagccactgaccctcgagccaggcctcgcagagggagacgcccgcgccggcggtcggccctgggagcggagattcctaggcccgggcgggctggcgcggtgggacgagtagaggctctgggacacaaggtgcgcggagcaagccatggctgctgctgccgctgccgccgtggctatccgagtccgaggagtagtgcgcttgctttagacttgatatgtcgaaataaaattttttggggtaccca

SEQ ID NO: 23056 - DNA, 1521 bp, Zea mays
cggacgcgtgggtgccagtgccaccatctcgccgtcggcgtcggctcgtcgcctgagagccgaggccacgcaggcacccgggccgggggatgtcggcgccggcggcacaggccgtggtggcgctggctctcgcggccatcctctcgaccccggcgccccaggcggacaccttctccaacgtcccgcccacgctctccgggggcgacgggaagcaagagcggatcaagcaccccaggtcggccaaggcgttgcagtgcacgaccaagtgcgtcggcacctgcatccgcggcggcggcggcgcgcccggcgaggggcccctcaacgtcaggaggcccctcgtggtgttcaaggacggcttccgcagccggcagtactggtgggtactactactacctgcactacagccccctcttcttttcactatagcagatgctaccactgctcgtgggtcaccaaagatgggcaggacggaccctgagacgggccagaggaacaacatgcccaagcccaaagttgttggagcaactgccatggctgcggtgcaggctagatatgggatccggttcttctgccaggcctccagaagcagaacttcagaggcgacaagggtaataaggtacagtaaaccagtcagtaacatataggatccagagacatttgctagcaacaaaatccgagaaaagctgttaagagtgatgcgtagtggtcttgataaccgttaatgcgatgaacgtcaggaccatgatgaacagatacaatgcataaatagcaccatgatgaacttaagtttttatctgggagtaggagttatgtacagtttttcttttaatgaaactcgacaagatgtcgagacggacgaaccgattaaggaattccaaagataagcatctgacttccaatgacacgggtcaatccagtgactgctatctcaaatcttgatactcccatggttgctggatataaacttacttttccagacatgctggtaactcgagagacagctcttacactgttgagcggtctatcagggatttggacttcatcacttctgttggcagttaggctgtcattcaggttgtctaggcagggaagcatctgaatctcggatagcagttaatttaacgatcccgcatctggcaggaagaggtagcgaaaccgagaatcaaatggaacgacgccgaaagtacgggtgcccaggagactttgccgccgttgagacacgcagtgatcgacaaacgtagcttgctgctggggtaggaaatgcgagatccagatagggaagctgttgtcgtcgacaaagccacgggcaaagcagtgcagtatcttaggggccagaagcttccctttccgactcactcctaccgatgctctaatgaaatcacgctgtgcgtcttgaagttcttccctcacgttgttagccgtgtaaatcttcaccccgggagaagaatacattccacagctgagagcaaacgtcagaagtggctcaggtgccgcaatgcagaactttttctgctcctccga

SEQ ID NO: 23057 - DNA, 1346 bp, Zea mays
ttttttttttttttttgcttcactcagattgctctactttatacaattgcaaccataccagtaaggatacaaaatttcaaatagtcaattgttgtacaccggccgggcttgggatttgatggtctgacccaattagtaaggcacggttgcagtgactgttctgtgcctggggtctgtcaggacggagcaaacgttaacaaagcccacttttctcatcgtctcctccaaatccagcatgtagtactcgtccaggaaaggctcggtactcttcatcagagtgaacaaaactggggatagttcctgaagtactttggacttcggcgaattgtctgttaaggcgattgttcctcctgggcgaaggaccctgaatgcttccttcaccaatgcggttattgctcgtgctgggcactcatggcacacataagcaagggagacaaggtcaaatgaatctgaagacagcccggtcgcttcaccattggcatgaacccagcgaataggctttggccgtgacagtttttcttccttttgtgccgccacagcaagaaagtacggtgataggtcgagcccaacagcttgagctgatgggaacttctcggcgaggtatctggtgcttactccaacagagcagccaatgtccaggatgtcgtttacctgacagttccccgagtacttcagatgatgctcctcaatcacattcagccagttgccgcggacaatttggttggcctcttcgattgatgtagcctcaggtattgccctctttgcgatcgacattgttgcaggctccgcctctgctgcagccagccatgatagattcccttcgtcgtaggcatgaaacgggttgagatagtagtcagggtacacgaggtttgggtcttggattctctcgaacacctcgtacacgtccgactccagcacctccttcgtcatctccctccacgggatgttcgacttctccgccgtcctgatgatgacctcgcgggaggcgagcttcaataccgcgtagagcggcttgaacgcgatgagcgcgccaaccagacgcgacagcgtggtctcgccggaccacgccggccgttccagcgccccctcctgtggcacagcagcccccgttttagtgaccgccgcgacgacgataccattgccccggcggcggcccgagaaacctttgccggcggtggcgatgacgccggcgcgcgcgaggatcgccgccatgtttggtttgctcgtcgctttccctgggctccagtttttggctcgtagtggtttttgacctctcgctggcgggcgggctggctagagcgatgcccgccggccgcggggcccgccctcgccataggattcgcttc

SEQ ID NO: 23058 - DNA, 3679 bp, Zea mays
taaaccaatattggattccctttcactagcttatttgcatcttccttagcaaggcacacccaaacttaatcacagtacttgactagattgacagaaaatattgattagtaaaacattatttgccagacagataggaatagattccattagaatagctcaatgattcaatatagcttgctcaattaaatttcatgatgaatctatagtaacagcaacataactcaagttgctgtgtgcctctcacattttcattggctttattctggaaatcgacatgtgtggcacgacatagatcccaaagaatgtgagattgccggaggatcaggatacctcaactcagtgtcaacacagcacaagctagattttgtaagggaaaacaggagaactgctgggagtatatgacaagaataatcgaatgtcttgttgaatcgatgctagaaagtagaaattgagacaaggtatccatgtcgtatcgtaagacagctatgcgtcagcaaaattgcagtgaaggggaagttgcaggagatgactagcaagacattgacatatagcctgagaggacaacaggacaggatgattcgtgctaaggagcgaaaccgagagcacgccgtaagtgggtcaggatgaccaggtgagggcctcacagccgagcattccctggccacgagcagccgtcacgcggcccgcggctgccccctgggcgacacagagacggacgcaacaacaaactgaaagcccaccacatttcgatggcaaacgcggattggggacagtacagtatagattctatcggatttggcgttttggtccacttgtgtttcggattgaaaaccccaagcgaagagcatcgtcttttcagtttctggggttgccagggagaagggggctgcaaaggtaggggaaaggcttttgcgggtacctgccgctggcgctttgcttccgggaaccctccactgtcgatggactgcggtgggagtggggaggagagtgggggacagcggcgtacattccctccctcgccgtcgtcgcttggtcgcgaccgcgacccacacgagacgacgctgccggcgacgcgttggcgcgattctgatataaacagagtcgctcgatgtgttctcgtatcgagtgctactttctccgtcttgctacatcagctccggaaggtgataccgatgaaagaatgaacagaattaccactacggttgtgtttggtttgagcccatccttggtttaagttcatttaaattgaaatgatgtatgataagtttattccttaaatttgataggaggattctatttcttatattagtattaataattaactataagaaacgagatgttaatgggtcaattcatctcattacacaaatcggataaaattagtgagtagtaaaaagatgatagactagtccattttttaaaccaaacacctcatgctttttcttcgcttgggtcctactttcagaaagaagttccgttgtcattgaaaaataaagtatttgtacaattttgaaggtatttagtttttaggcactaatatgtagtctatttattaaattttatttgtctttaaatatcaaatacagaaactgaaactatattttaattttccatattttgtaatttaaaaactaaaattgaataaaacgaaaaaataaaattagttaatataaaatcaaacaccctcttattcttttatgttagttgagaatgatcaatgtcttcctaatgtttaaggtttataagctagaatgagaaagaagccgagaagtatcccacggtttccatctaagcgctagttcaggaacccgtcttcccaatagatttatatttctgtaaaaaaaatatttattttctttaaaaattaaaaaatttcttagtaaatggaattatcaaactaatcctaatgttgttaaaaatgctggtatgaaaatatcaccattactattatttcagcctggttgcatagaagtcataatttttcggatagatatcacaagctgcgatggttggctgcatgcgagtgtacaactatctgtgtgatgtcgctgccatatttgctgaaatccccatcatacactttcgatctaaatcgatatgaaactttatatatttttaaacacaacaattaattgttttttagttataaacacttctctccacaacaccactctattcacttagctttaattcgtatcgatttatactgtttcaataatattctttgtctctatagatacaacagtataaataatcgactttaatctaaagcaactagcaagacattgacatacagtgtttttttttactgcaacacacggcatatgatatgagcgaaggtaatcagtttttagtgtttctgcagcgtgggcccaatgaatcccaagtccaaacatcagtcagattttgacatttccgcagcgtttcaccgagagccacaagcccgcaagcaacaaatccgcgctccctgattcgccatcctcttcaccaagttaggcgacgactggcgcccatcgtcgattccccgttctccgtttccgtctcgcgtgtttggtgctttcgatctccccaaggcggcaggcggcagcgccgtacgcgttgcgggaagattttggttggtggattgttggcggcggctccactccgtcccagtgcactggtccaatccaaatggcggccaataatagcgacccgatccaggatcagctgggggaaggaggcgcgggcgtgaggcacgaggctgaggaggaggaggtgggggaggagacgtcttctgccgcggcgcaggcgaccgcgacgacgatgctgccccggtcgagctcgcggccgcagctggacctcagcggcgcggcgatccacgggacgctggaggaccgtaaccctaccatccttttgcccaaccagtccgacgacatctctcacctcgcccttgacatcggcggtacgtgcgtgcgccgtgcgcgtctcctcgtctccgtttcactgttggactcacctaacgttatcaacagtgtttatcgcttcgtagcagtgtaagtttctgtgttgagttggttaagcaaggtagatgagatgcgggtttcttagcaattttcagaagttggcacttccgcctgttagttgctagcactccacaccgaacgttgtcagattgctactgcatctcagctcaggacgactgtgtcacttagtgcttaccactcaaaatgtgaaccattcaccattgtaagagtgtatctgcgaattgatagtggtgataccgataacatgctacttgcaacagtaagccgtcaaggtggtactctgcatatggcttccaactcttgttgttcctcctgaactgttaggatatgtgcttgatggattaaaatgtgccagttttctataattggttcataaatttatttttcattgtcaacctgcaattgcaaacaataatttctcgactgtcatagggtctgacattttgtactctaaattttgaaaatgtatgttttgattgtttttcctctaggatctcttataaaactggtgtacttctcgcgacatgctgagctctccactgaaaagatagcacagatatccacaaagagaagacttggggatgttaatggtggcaggagaaagctaccgattcttggagggagggctcacttcgtaaagttgagactgggaagct

SEQ ID NO: 23059 - DNA, 1608 bp, Zea mays
tgaatatttctgctccaggtagaggcacaatatccccttctttgttcttacgcgtgtgtgttctaacatatatttcatctcttctcgcagggcgtccttgttgctcggcctacaagaaaacatgatttggtccagtaattgactagaattttcataaattaaactaatgattatacaaactagtgattataatttttttaccagttcatgccccacacgagcataactcttgctaccagctgcatgcgacatagtcagctttgaacgattatctttacctctgtttgtacgaacctacaacataaatatgaatctatcaaaacaataatacaaattcattcatacaatagtttaatgaaggtttatatctcaaaaagcaattcaaaacaaatcagcatgtacttcagtttctggatacatccaataagttaccaaccactcccaatcagattctttcaccctttcatcccttttagcaataagctcctcaaaactcaatgttccatcaaactatttgttctttaggtcatccttaaagtctctccacttttttgctgcatatgttataacataatctatactagattcatccacctcatagtattcctgtttcaacaaaaatgcagttgattaccaaatcttctcacaataggctaagtcaaattaacttactaaatcagattaccttcacttttgtccataactcgaacttctttttagaatcaactagtctccaatcctcacaagaaactgagatatttttcctcaccaaagtttctatgaaattaccaaactctttgttgttcctaccaacaggttggccatattcattaagggtaatgcagattttaggcccaccactatttgaatatatgttcttcgaggttgttgggccccttcctttccttatattttgatgcccaataggttgctctgcttattacagaagataaaacagatgaaaacctttctagataactattttcaaaattgctacaataaatttaaagtttggttgatttttaccttcatcattgatgggattttcagattcttcataactattttcagaagtactatcctcgtggttatcatcaacaatatccctttcagtccttgatcgcaaagtaggaccattagttgaagctgctaatgtccttgtctacacacaaagaaatgaaaacattactagtcgccaagacatggggagtacatgcccgagtaataatgagagaatcaatagatcgagcatgcgaaattgtatgtgcatgttcaaactaattaaagatcatctagatattggcgcttccttttttgaaaacagttttagaaaaacagcgatacccaatatatttgccgatcgttttcacaagcaacaaagcattactcagccatgtcagccatattcaaagttgagactgacccccttgattttctacctaatgttacctacctctgtactacaatatagatttttaagttgttctaagtcaaatatccaaaacaagttgatagttatgataccaaatgagtatctttagatatattataaaaaataccttcataatttatacttttaaagttgtaggtgttaatgatttctctgca

SEQ ID NO: 23060 - DNA, 1156 bp, Zea mays
ttagtaataccctgggttttttttttttttttaaaagtaattagcgccgttgcttgtttcttattgaaataaggatgttataccagtccttgagttgcctcaggctctgtccattttgagctaagctcaaataaactgatgttgtggtgtgcaggttcctgggataatctctgtatcagcgaagctcctgccgacgatacagaacctggtgaacaaagtggcagccgagcagcaggatgagcaccggcaccatcaccagcagcaccctcaggtagcagaacccgtacagccacagatgcagccgccgccgctgctcctgagcccgagaagccccatgagcgagctgcggaggctgcacatgccgtcaagcccacgcaaggtagcgtcgtcctcctcgtcgtcgtcgtcgtcgtcctcctcgtctgccgtatcgtcccctaggcacgttggcgaggatcagaagcaaagaccaggggcagctgcgcctgagaaccagtccaccatcgctgactcgatagtgtgatccatcagccatggtggtgtagagactgtggcattaaaagtacacaaggtattgaggattcatggaccttctgttgtcccctagctatctccacgcatatatgtgtagtgattttcatcatgcttcagtagttaccaagacagaaataatccagaacccttatgttgcaacccttcagtttttgcaagccaaggagggacaatccatagacggacagtttgtatctgacgtcatttttcagcatataaaatacatatgtgtgtatagaaggcagaaccatagaggagctagtctagggttttgttcaatgtgtgctagaaaaaatgaccctacgatccacattcgaaaaaaaaaaaaaaaaatctgctgagactgaccaaccaatacgggagacgacgcggcacgtggagaaattcgtccggctgccgctgccctcctcacatggccgctagctgccgtcttctagcatacggtagtagctagctgtgcctgtgggcggccgactgcgagagaccacgcgacgtgcctccatccagcaggcgcactgcatacacaaggctaggtccacggcatgtgaaaacgtacatggcgtgtatctggatttctgatacatacggtcccatgtacatgcgc

SEQ ID NO: 23061 - DNA, 938 bp, Zea mays
cccctgcacgcccaaggcaagggtgcactgcacagcatacgcaaaacggtctaggtacacagcatcatgtgaaaacgtgacgtgtatctgaattctcatgcataccgtcccatgtacatgcacatcggtcacggtgagacattcaagagtggcagacgtagacctctcccaactggagcggacgaccaacctgctgcctgctgctactggatatccatcccggcccgccgggccctcctgttttgtctgtttagtacgtactacatacacacattgcattgcaagtgacacatgattcgatacatcaaggtttcaagatctttgccagatcctgggctcagcttgcagtgtcctctctaatgctaccactgatcgctcgaattcctactggaaactggagaatagctaatacaacacgagaacttttatgtcctaacattagcttaaactacctgagctagtagtacatcgcacgttacaaaactggcagctacctacctacccctaccccttcctcccgctcgtcccacggctacgacggcgccgtctccttgaagctcttggtgagccagatggctgtctcccggggggaagccatctcggggccgaacggcttcagcaggatgccaagctcctcgtaccgctcctgctgcagcagctgcgcgctgaactccagcaggccctccagcgcctcggcgcgctgctggtacgacgacgtgtcgaaccgctgctgcaagtgatgctgctgctgcctcgacgacgagtcgctggacccacggctggacgcagccgtggcgttgcgccccgacgagtcgctcgcggcggtgtccccgtcgcccgcgcgcggcgccaccgcctgcaccgtgtacttgtccttcgtgatggaccgggtgctgaagggaggcgtggagcaggacagcttcttgttcatgggcgcc

SEQ ID NO: 23062 - DNA, 844 bp, Zea mays
gaagacattctcaagtcatgggcagcgtaccttactatatcatgtgggcaacactgtttttggagagcaaatgaactccatcacagtcatgctgaagaagaagtacaagaaatacctgcaagcggggggggacaagcttgccagcaacacacaagctaatcggaatacgagactcaagcgaattcttgaagaaacaagagaggctgatggtgaaagtgatatacgagataggatgcaggctgtccgcctccagctctcggattcaattcacaatctgcatgaggtcttctccagcagaatatttgttgctatttgccgaggtttctgggatcggttaggccagattgtgttgagatttcttgagagcagaaaggagaacaggatttggtaccgaggatctgactatgctctagggatccttgacgatgtctttgcatcggagatgcaaaagctgctgggcagcgctctgcaggacaaggacctggatccaccgcagtcagtgattgacgcccgctccatcctctgctagggcgtgtggcaacagttttctctacagattgcttcagcaaaaggccggcgttggtttagtttttgttttatatatattccttggtgtgcagaatatgtacagatggagacaaccgattattcctgttcatagtgttttgctgaattgttcaaataaatagtggttaaaaaaactgtagcccgtaaacaggttagagaacacaatctgtacttgattgtgtactttctacctcagttcttgccttccccatctaattccatccaaatattgtaccctgaattgagtgaaccttgatacaactgattcttgttggct

SEQ ID NO: 23063 - DNA, 1182 bp, Zea mays
atcccaagacggtcgctgatcccaatccgatcagtgcctcagaagtaagaaactgaccgcaggcatctcaacttgcatgaagcgagcgacggccatgcagatccctctccagtctccaccgtccacgccgaccccgcctcctccaaacacggccacccactcacccgtgctccgtttaaaataggcatagcatagccatcccacgagcaccgcatgcacgcatgtagtttctgcagaagctagccaggcagacgagagagcgagtcaccgcgagaaggggatcgcggaaagtgagagcagaatcaacaatccacctgctcatcgagtcgatggagatgaaggttgctgcctcacggccaggatgcaagaaacgccccccgagccgtctccagaagcatgcgccagcgtcgctgcaactggagcaggctgtcgccagtgcggggacgggagcaccgcccgcggtgtggggtgacgggagggcgccgatcccgctcctgtcgccgctcgtcgtgtcgcccatggtgccggtctgggaggcggaccagacggggggcgccaggaaggagggaggaggggaccaggccgagggcaggagcggtgccgagcagcagcagcgcggcgccgccgctcggcatggcagcagtggggagcaccaggtgcacgacgtgacaccgaggccgtcggcgcccgcgctcggcatggggtggcggcacccagcgatgtcgacgcccgtggcggagccggcgtcccttgtgcccttattccagtcgcagtgcgcgttggaggtgcgcaactcgcagcagtgagggggaatcatttgctcaaccaagcagccatgcccatagtagtgcgctcgagctcgtgctcacgacaggcgccgctacgatgtgagaagacgatgacgctttcgtcctcgcaggctattctcgtcgtgatctatctttgaacaactagcattggttttgctgctcttcatcagtttatcgtaatatctttacaatgtggtcacagttctttgtgaatataatttaaacctatatggttttgccatggctggatgttcgaaaactatatatctatttgaaacgacttatctagctttagaattacactgttgttatgatccggtaaagcattggcatttagggcaatccagttatgatggcctccatgttgtgacag

SEQ ID NO: 23064 - DNA, 755 bp, Zea mays
  misc_feature (679)..(680): n is a, c, g, or t
ttttttttttttttttgcggcatacacaagatatatataaatttatatcgctgctgacaacactggaaacctgcaaccagcagctgtgctaaacaactaaccacttgactaataaacaccattactactagcgaaacagggggacactgttactactagctagcactggtacaggcgaaacacaaacaattcctttgataaatactctaggacaacaaagcaaacgcccttattcatggagcccacggcaagcttcttttgcaagtaaaaaaaaaggttgcaaacagagggacgagagagaggctctagctgcggctgctggtagccccccaccaaagcaagcaaaagccactcgtggatggatggagaaatgacatgttatctatcatctccatgagcgataaatccctaatccaacatttttcaaatctcaacattcttgcatcagctaacacctctctctcactcgaaccccttattattactgttccccccgaaccaccaaactggatttctaagcttctcctccatctccaccaaagaaccaatatatcaccggatccaaaatgaacagacctaccactgatgctaacgctactactgtcttcctaactctgctgctaacacactacctaacaaaaggtactcggaactatttttttaattattaggaatgtanngctggagcgacgaccacgcgaaggctggctggctgtcgccggaatctttgtggtggtggttcccttcgtctgttc

SEQ ID NO: 23065 - DNA, 4574 bp, Zea mays
  misc_feature (150)..(150): n is a, c, g, or t
  misc_feature (346)..(346): n is a, c, g, or t
ttccccggccccccgttggtaaaccccggcccgtggaattaaattaggggcgcccaaaaaaaaactaatacctcgcaagcccgcggacgtaaacttgggacccttaaaaaccgccccccccttttttttttttttttttttttttttttnttttttttcctcctttttttttttttttttttttttttttttttttttttttttttttttttttttttttttttttttttttagtagtgaaattccatatattattgtaccacaaagccatgagaggcatacacaagatatatataaatttatatcgctgctgtcgacactggacccccccccccagcagctgtgntaagcaactagctacttaactaataaacaccattactagtagcgaaacagggggacactgttactactagcaagcactggtacaggcgaaacacaaacaattcctttgataaatactctaggacaacaaagcaaacgccctctactcatggagcccacggcaagcttcttttgcaagtaagaaaaaggttgcaaacagagggacgagagaggctctagctgcgtctgctggtagcccaccaaagcaagcaaaagtttctttttttttgttggggaaatgacctgttattttcctatcacctccatgagcgataaatccctagtccaacattttttcaaatctcaacattcttgcatcagctaacacctctctctctcgaaccccttattattactgttccccgaaccaccaaactggatttctaagcttctcctccatctccaccaaagaaccaatatatcaccggatccaaaatgaacagacctaccactgatgctaacgctactactgtcttcctaactctgctgctaacacactacctaacaaaaggtactcggaactatttttttaattattaggaatgtagctggagcgacgaccacgcgaaggctggcttggctgtcgccggaatcttggtggtggtggttcccttcgtctgctccagtcggcggcgacctcactcaagaactgtggcacagtgcctgcgaggcagcccggcgcttctggctcgcaagcatggcgttgctccgactaatcaaggcctcgtgatcaagaacaaatccgcctgggtaacgaggctgcgcgccgaggtcgtcgaggttgaggttgagagcctggacgacgcgagcagggaccagaaccgtcgaacaccctgtctttttcttcggctctgccggggagccagccggcctgggaagaaacacgccagtgccgttacgctcgcgcttggggccggaaggggtgaggaacacggcacgcatgccagaggccggagccgccggcgcgtggtggtggtgctgctgcggcttctgaggcgggaggcacgccgccgggttcagaccaagcagcgcgtcgccgcggacgcagccgacgggcttggcgcatgcgccctggcgcgcgctccacgccgcggcagcggcaagctgctgccgctccctctgtagcttgagcagttgctgttgcttcaggagatggaactgagcagcctgcatctggcgctgcgagaccaagcgcgcgaaggggtcgtagtagtgcccaccggcagggactttggcggaggagggaggtgcgattggcggtggcgagggcttgcgtggcggctgcgcgaacccgctctggccgtggaaaccgttggcggccggcaccggcacgctgttggcggcgcgcatgcgcgcaacctgtccggccgcctcgtagagcagatcccacgggtcggcgggcctctgctccaggggcgacgacggcggcgacgtgcccttggacgccccgccgctggggctctcctgccccgacttgggcagcccgcacagcgtcgactgcggcgacccaaccgtcacctccgccttggccgcgggagccttgcgctctcccccgtcgccgaggaggcccgcgaggcggcgcgagagccccgccaggctgtcctcctcgtcgctctcgctccgggccgccacggccgccttctcctcctcggagaagaagtcgtcgtccaaaaagtcctccggcagccagaactcctccccgaggtccgcgcactccgtggtcgacatttcctccactctcgacaccgtcgaagaagcctgaaaagcccaccgccgaccggtggaatgagcacagcgcccggaaccctggcggaccagcggcagcagcagcaacaacaaccactgcgtgcggctccctctccaaagcagagagaaaagcggcgggtggatggatggatggatggagtggggagtagcggcgtgcttatcagcgaaaagaggtgggagtggcacggcgagaaagagatgggggcgaggaaggcgaacggaatgtcgacgggcgacgaggcggtattaaaaaccggccgaggccgacgcctgggactcttctactcttataaaaaaagaggacgccgaggagagagaaaacagcagccatccggaaaatcattttcttttcgagccattttgcgccggtgcaactcgaaggcgtggggccaccgagacgcgccgtagctcccgtatcgccctcccaaatgcctctctccagtccagtccccccggtgttcactgcgctagtttattgcgcgtatttttttttccccaccgcgacacgcaaggccggacggcgggtgggagagtactgtgcagaagttggaggagagtacggatatacgattggcgtccattatgtgtgttttaggattcttttcctgtgcagtagtacatgttgcgtcatgccaatgccacgctgcccactccgccattcgtcaaatggtttggcgaattttcagtatcttctggttgcggtttcaaatggtggttgaactaatttttaggaggggggaacgactcccgtttctggtcgtgcaacactgtgtggctggctctgtatcccttgacattatttttgccagagggaaaactacggatggccgtatgaacaaaatacgatgccagttggtgacgcagagaaggcagtgtcaccgcgtgttgtcgagactcgagagctaacgttgggtgtgtcacacggtcacgagagttttgcgtccagccgtgtccgtttgcgagtttttcgtggctttgggtggcgtttacgtttaatttttgcacggcgttaaaggcgtgagcgctttaaagacagggaggggtacggagtggaacaggggcgtgtgacgggaggtgattgaggtgctaccgggtagtagtacggtacagctcacgtcgaaaaacccacccctgcccgtttcgactgcagccacgcgtctctacagcgaacggaggcgggttaaacaggggcccaccggttaactggcgactgcctggctgctgagcccgacggctcgactgctgcgccgacgaagcggtgtcgctgctcaccggcccgaggagcgcgcaccgcttggtgaggcgtgcagccggacaagtaggcccggtttttttaaaaaattttcggtctcaactctcaagcgcgccgcgcctgcgacggcgcgtcacggtatctgatttttattttttttgtcctgcgttcagtaggccacacagcgcgcagaaatttgaattccagagcgctgtgtacacgcccgaatttctatttcgggttttttctctataaatccgagctgtactataggccaatttacatgggcctgccaggcgtgctgacatgacaaaacagttcctctggacttttggagtagtggtacagtagtagggccatcattgttgcagtcgcgcatgatatgcggtagcctactcgagtccgaggtctacgaaccacaattatctctgaccaaaatgtaccgtagagtagtgtatgagcgtctgtcatagatttactaagccaaaaagatcggtaaattttcggaagtgaactgaataataatttaaatagtagcttaataaaacattggtttagcaagtcagcttttccaaactgtgagacgtaattcacactcatgtacgtaaagagttcatacatgagctataacaactcttgtatcggtcggattacttgttttacaaacttcgctctactagtgttgttcttcgcattttttattatgtaaacatggtatttttcgcagaaccttattaagagtgacatataactttccacgggcttagccacaacctccaagagcaataagcattgtatgcttcgaactcgaccaactagtgccacttgatacaatctctaaacacaacacgttggataacgctatgacacacaatcatatgcgtcttctattgatcacatgtacatataagtccaaaggtaaacaccttacttaggcaacacatcgtcaaggcgttctcaattctctcttctctcgcatggccaacactttttattttatagttccaagtgttaagtactccctccgtttcgttttatatgtcgctggatagtacaaaattgaactatccagcgacaaataaaaagaaacggagggagtagtcattaaaacccttggtcacaaattagcgcgatgtcgggtggtccaccacctcacttttagatgaaagcc

SEQ ID NO: 23066 - DNA, 1250 bp, Zea mays
  misc_feature (542)..(542): n is a, c, g, or t
  misc_feature (577)..(578): n is a, c, g, or t
  misc_feature (581)..(582): n is a, c, g, or t
  misc_feature (614)..(614): n is a, c, g, or t
  misc_feature (647)..(647): n is a, c, g, or t
cgtgatcaagaacaaagccgcctgggtaacgaggctgcgcgccgaggtcgtcgaggttgaggttgagagcctggacgacgcgagcagggaccagaaccgtcgaacaccctgtctttttcttcggctctgccggggcgccagccggcctgggaagaaacacgccagtgccgttacgctcgcgcttggggccggacggggtgaggaacacggcacgcatgccagaggccggagccgccggcgcgtggtggtggtggtggtggtgctgcggcttctgaagcgggaggcacgccgccgggttcagaccaagcagcgcgtcgccgcggacgcagccgacgggcttggcgcatgcgccctggcgcgcgctccacgccgcggcagcggcaagctggtggcgctccctctgtagcttgagcagttgctgttgcttcagtagatggaactgagcagcctgcatctggcgctgcgagaccaagcgcgcgaacgggtcgtagtagtgcccaccggcaggggactttggtgaggggaggtgcgattggcggtgncgagggcttgcgtgccgccggcgcgaacccggctnncgnncccgtgaaaccgttggcggcctgcaccggcancgctgttggcggcgcgcatgcgcgcaacctgtnccagccgcctcgtagagcagatcccacgggtcggcgggcctctgctccagcggcgacgacggcggcgacgtgcccttggacgccccgccgctggggctctcctgccccgacttgggcagcccgcacagcgtcgactgcggcgacccaaccgtcacctccgccttggccgcgggagccttgcgctctcccccgtcgccgaggaggcccgcgaggcggcgcgagagacccgccaggctgtcctcctcgtcgctctcgctccgggccgccacggccgccttctcctcctcggagaagaagtcgtcgtccaaaaagtcctccggcagccagaactcctccccgaggtccgcgcactccgtggtcgacatttcctccactctcgacgccgtcgaagaagcctgaaagtgcaccgccgaccggtggaatgagcacagcgcccgggaccctggcggaccagcggcagcaaccactgcgtgcggctcttctccaaagaagagagaaaagcggcgggtggatggatggagtggggagtagcggcgtgcttatcagcgaaaagaggtgggagtggcacggcgagaaagagatgggggcgaggaaggcgaacgg

SEQ ID NO: 23067 - DNA, 1849 bp, Zea mays
tcctatatgttggcgggcattgtggatacaaattggtcaggacattggtagtacctatgaggccatgactgaagagcaggccaaaatcactctaaaatcctgaattcctaacgacaactcaagttgccctctttgtatcagtcgtatccatgttgttcacagaagaaaaacgtatttacaaaaatatttcacgtgatcagcattgtaccaagctgcacgtcgcatttcagaaatttctgcattatcacatcgtgatcgagagaaatttaccctctttctttagcagcattacacatacagatacacctcaaatgcaaatacgaaggcacagatgatacggacatgtacagcatcatcatcaacaacaaaaaaccccatatcatttcatcgaacaccttccatgcgccatccacaacaagcaacctagattgaaaggaggagagacgtatctacctcgagggcctggcggtggcggcggcgcttgcggagctccttgacgatgcgttggagctcaacggctcggaggaggtttctgggccgcgccgcccacagttcgatctccggcacaaggagtgtgctcgggtggcccagcggaaacagcgtggaatcaaggctcagcgaccgcgccggcggtggtcgctcctccgcgctgttgctacgagacgaggggggcacggggagctgtcctccgcggcggtggcggcggcggccaaggctgagcaggcggcgtgccggggcgaagagagaggccatggcgtggcggatggcggctcgtccgctggcttaccgtagtccgtggggcgtggggcctttggcttttggccatttcggcccaattctcgttggcttaacttcttacccttcccgcgaaaccctcgcatctaacctccagctatgctatgccccgtcctgaaaaacaatgggtggtttcaagaaggccacgtcgttaagaagcactcgtcggcctccgccgcttcgcccgcgcactcgaggtacttgtcgaggataggtgcgttactcaagatgaacgacactgatggggcggaagcaacactggaagggtggcaaacggtgtgccttggttatctcgaagccttgatggttatagccgaagtcttgtcatcttatggagaatgcagcggctcttgtggatgatgccgtcaagaagagagtgaggaccatggtcataaagtttttggattgatagggtcaaggaacgggatcaagaaacgtggtacgctatttgtgagaggtttttacatagtgataacgaaaatgatctcgtgttttctgatcggggacagcgtttctaggttgatggtcgctaccactgtagacgtttattgtgactatagtgacgacaccttatgcaaagcaacaagtaaccgtagccgcagcaggggacatgactgttgaataactatgttaccacggatcaccatgaactctcttccctcctgtcagcagtttagatgcgagaagatattgaaaactcgtctcccttcccagaagcatgacaaagaaaatacgagacacatgatgtagcgttgggcctctagcctctttctcttgtgagggggtactggttcctttatatagagacgtgagaccccttagggttataagtggtatttgcccagataaccctactaggatttcttaacactcccccctggacgaataccgcaaccaacacatgcctcattaaaactcccaaaaactcgtgggaaaatatggagaaagagcgcattgtgacacatattgcatttacagtttattgccttgttaaaaacctcaggtgagaaactttaggaaaactcaccaaaggaaaacatagtacatcagcgtc

SEQ ID NO: 23068 - DNA, 2200 bp, Zea mays
atttcatcagattttgtaaagctaatcatcaaattgggccaagtagacacaatttgctatggtttcctttctaaaaaagggagtttgcatatcaatgaattttatcatattaatcactattcttataatatcttgttctgcctctcgcccgcgtgggttgttggccgatcgacgtagctgacgtctgttgcccccgaccctcacaccgcactctccctcgcacgccgccgctatcgtcgtccctagatccgtgttcttcttccctgtacagacgatgcatcctcacaccctctcctgtgctcccttcctccaacgatattacatgttcccgttgcaacgcacgggcactcacctagtataccttctaagttctaacccatgtggactggagtgaatttttgttcagccaaaacgggtatcgcttcgcatcattgatatgataactatagttattacgaagtggcgaaccaaacaccaacataaaacttatagctaatgaaaacaaggagctatcaaaggaaggattataactaactacagtattaatttattctactactagcacataggatcagacagcagcgctgaaacaccgacaaccagctcaggcaataacatccccgcgaggagcttccgttgcctcttcagccttcatttcttccctcgcacgagccctcgacaaagcctcggtcatatcagagtccactggcacagcagctttcagcagactaacgaaagcttcgacatccttgacctccccctcgtctccgaggtacttaagtatcatctcaagcatggaaggcctagggatccagccagtattgggggcgtgcacagagagggcgttcttggtcatctcataagctttcgccacatcacctttctccgcatagccgattgccacaatcccccagctggtcgaaggaggcgtctttcccttcttcaagaagccgtcgagcagcatctcggccctgtccagcaaggccttctggcggtaccctgtgagcaggacgtttgggacacggaagtcgaatgagttttggctagactcccactccttcagcaagtcttcagcttctgtgatctcatcaagcttcacgagcaccgaaagcatattcatgtagtccctgttaatgtacctcttacagttcgacatttgcaccgcccatagcctcttggcttctgatttgtccccaaggttgccatacagggaaatcaggtgcctatatgcatcaggatcctgtttatccagttttgcttctgctttgcttaacgcagagtatgccttctcccttaggtcacccttaatgtagttgcttgccacaacagcataggtattccagtcaacaacaatctgaggctcacattccatctcctccagggtgttctccagcccaaaaaagtctgctcttgtgccataagaatttatgcatattctgtagctaaaattatcaggaacaatcccattgcttttcatttctgccatcaccgaagggaccctctcgtgctgccctattctggtatagaggcccatgaggtcattgtaggggagcgtggagaacacgaaacccagctctttcatattccgaaaatgggccaacgctttgtcgaccaagagttctcgtgtgtagcagttgagaagtgcaccatagggtttctctgtcttatctttgtcagataggttattgaagtaggtctctgctgcttcaaccccatggatttgaccaattaaatccaggtgaatagcatgatcctttggcagaaatttgacgtgacccttgagactcatccactcagagacctcgagggcctggcggtggcggcggcgcttgcggagctccttgacgatgcgttggagctcaacggctcggaggaggtttctgggccgcgccgcccacagttcgatctccggcacaaggagtgtgctcgggtggcccagcggaaacagcgtggaatcaaggctcagcgaccgcgccggcggtggtcgctcctccgcgctgttgctacgagacgaggggggcacggggagctgtcctccgcggcggtggcggcggcggccaaggctgagcaggcggcgtgccggggcgaagagagaggccatggcgtggcggatggcggctcgtccgctggcttaccgtagtccgtggggcgtggggcctttggctttttgccatccccgcggcccccgtggtacccaatg

SEQ ID NO: 23069 - DNA, 900 bp, Zea mays
ccccccgcctcgtgtttttttttttggcgaaaatgctgcctcaccactcattacatttgaaattttccgacccgtggatcgatgcaacaacagtccagacctgcttcaatgttgaaggccatggtagcttgacaaatcgagctttcgtaccatcaaaaaaagggaactgtttccagagtatgacatctctaaaacataaattgccatgcatgaaggaaacaagacaacagccctttcacggcaccaaatgaactacgtgactctgctactactccctcgagctgaaactctccatccaaatgcatcgtatcagagctcactttcagtttctggatttgcaccgccagatgtcttcccgttgacggcgataagctccgtgtcgaagaccagagtcgctccgcctggaatcttcggtggggagcctcgctcgccatagcccatctttgcaggtatctttagcttccgcttttcaccgacgcacatacctagcaatccttggtcccagccttttatcacttggccatttccaagagtaaattcaaacgggtcacctctgtcatagctagaatcaaaaactgatccgtcagtgagtgccccacgataatgaaccttaattttgtctcctttgtgtgcttgcaggatacatgactcaggtttgtacttgacgccgatctgaagctcggtgacgtcgctggacttcttggccgacgctgtcaggaggatggccgcggcggcgacggcggctgcgaggcagataagctgccgcttcttccccatcgcgctttctcctacagtcctactccacgaccgcggtcgctggaaccttccttcctcgttcccgttcggctctttccgagtttcaaaagaggagaggtttcccggccggctcgaggtcccaat

SEQ ID NO: 23070 - DNA, 856 bp, Zea mays
ggccctagcggccgttttttgggctgctttgttgaagaccatggtaggtttatagacaaattcgagttttcatgagatgtaaaggaaactgttctgggagtacgtaggcagtcggggttgcatagactgatagaccatcgggcaaaacctgacttgtttctgttacatctctgtagcataaactgctatgtggaggaaacagcaaccgtttcacctaatgaactatgcgacgctgctactactcctctcgagctttggaactctccaatgcattgtatcagagctcactatcactctctgcctttgcaccgccggatgtcttcccgttgacggcgataagctccgtgtggaagatcagagttgctccacctggaatctttggtggggagcctcgctcaccataacccatctttgcaggtatctttagcttcctcttttcacccacgcacataccgagcaatccttggtcccaaccttttatcacttggccatttccaagggtgaattcaaacgggtcacctctgtcatagctagaatcgaaaactgatccatcagtcagtgtcccacgatagtgaaccttaattttgtctcctttgtgtgcttgcagcgtacatgactcaggcttgtacttgacgccgatctgaagctcggtgacgtcgccggacttcttggccgacgctgtcaggaggatggccgcggcggcgacggcggccacgaggcagatcagctgccgcatcttccccatcgcgctctctcctgctcgacacagtcgctcgctggaaccttcgagacttcgacttcaccagtcccggccggccgcgagccgcccaatgtttgggttggaaccgcttctctg

SEQ ID NO: 23071 - DNA, 805 bp, Zea mays
tttttttttttttttttttttcggttttttttttggctgcaatgttgaagaccatggtagctttatagacaaattcgagttttcataagatggaaaggaaactgttcgaccatcgggcaaaacctgacttgtttctgtgacatctctatagcataaactgctatgtggaggaaacagcaaccctttcacctaatgaactatgcgacgctgctactattcccccccgagctttgaaactctccaatgcattgtatcagagctcactgtcactctctgcctttgcaccgccggatgtcttcccgttgacggcgataagctccgtgtcgaagatcagagttgctccacctggaatctttggtggggagcctcgctcaccataacccatctttgcaggtatctttagcttcctcttttcacccacgcacataccgagcaatccttggtcccaaccttttatcacttggccatttccaagagtgaattcaaacgggtcacctctgtcatagctagaatcgaaaactgatccatcagtgagtgtcccacgatagtgaaccttaattttgtctcctttgtgtgcttgcagcgtacatgactcaggcttgtacttgacgccgatctgaagctcggtgacgtcgccggacttcttggccgacgctgtcaggaggatggccgcggcggcgacggcggccacgaggcagatcagctgccgcatcttccccatcgcgctctctcctgctcgacacagtcgctcgctggaaccttcgagacttcgacttcaccagtgccggcccggccggcctcgagg

SEQ ID NO: 23072 - DNA, 1980 bp, Zea mays
actaaaaccaggattccccagttctcatgactccaggattgcgaggtcttcattatcatcagcagaagacagtgaagatgaaaatatgatggcggttgatgaaaccatgtgctcaagaaggtcccccgcggccgccgccgcgcgggtgaggatgcggctaaaagacaggcaagacgaagagagtatgctctcatgtgaataccctgacttttatatcggagatgactccttcagtaaatcagaagttgagattccaaaagagatgtgtggtgaaacaagtggggaattggagtttggcactccgacttctggccgctcttgggattttctgagtagaagtggaagtcctttctctgcgtcatgctctagtcaggcatcccatagaagggagccgtcagtagttagggaaggcaagaagaagattttagagagattgtctatggtatcatcaacagtcaatattgaggaagaaatggaaggtcgcagaagtacaggcacacttggtgacatgctcacaatatcgaaagtcaaggaccaggaagaaattggggctgaaacactggggagcccagcacctgagctggaacctgaggagcctttctcatgtttgccaagatctcgatcccttccactttctttgtcctatggagtcgctgagtcaaatggaataacctctggcactcatgaagctgaaaaggaaagaatcaggaagtcgtcatcgtttagggaaaaagtttctagcctgttctctaaaaataagaaatcaaccagggagaaggtagatccatctgtgagcaatagactcaaacatggaggggctgtgactactggtgatgtgaaggaaatctgcaaccatcttgccctagacaatcttcagaaacaacatacttgtctaaacacagatgagaagaacactgtgcaaggactcgtgactagttcttgtgagaccaatagtgcagctgatatccctgccaaggatatttcctccatttcaagtcttggtgtcccaggaatctttggtggccttcaggatgaacctagtcctgtatctgtactagatggaccgtttatatgtgataacaataggaggctactgtactcatctgaaaatttcatcacttcatccccacaagctttgtcaaggtctcccctgatcggatcattttcacggtcactgtcatgggaggatcccccgctggaagtcatgtcgccgaattcgttgagactctcaaggcttttctcgaaggctgatgaagatctagattcactgacgtttatccagaagctggtccactctcgaggcacgggtcgagaaagttgcatattagctgaccctttggacccgagtttgctcgagaagatttcggattacgaagaagatggaattaagtttgggaaaaggcggcccaaacagaggctccttttcgacgccgtaaacgaagcgctcatcgagcttgcttcgatggcggaactggctgcgtacccctggggtagatcatgctcttcggagcacggggattgcaagaacggttccagcagtaattctgcggctgaggaaatctggcgggtcattaggaactggtcgatacttgagaagtaccctcccggtgaagctattgaaagaaatctcttgctggagatgatactaaagagggaggtggcggaggcagccagcgctgacacgactcggttagagacgtttgatctcaacaccacggtctgcgccatggtcttggatggcctggttgaagagacagttgtagatctgactaactactgctagtgaggtacctctgccctctaactaataatctcgcgctctgctccctagtgttggtgtttggtgtgatacttgctgccgtaacactgctccatgctattactcgctcaaatgtgatgccaaataaatgggtctctacgttgtttacgtttcaaaaaaaaaaaaaaaaaaaaaaaaactcgaggggggggcccggtacc

SEQ ID NO: 23073 - DNA, 1325 bp, Zea mays
tgataccatctcatctcagtgaatcatcacacgtacagacagcatcacagcactcacccagcgcgcagtacaacgcaaatggccaggctgggagcactgattccgctggccatcgtcctgctcgccgccgtcgcggccactgccgcgccttcagacaggccacccaaggcgcaggggcccaagccgcacaaggagaaggagaaggagaagcccaagcccatgaaggtgaagtgccgcccccgtaagctctacccttactgccccggcaagccgatggagtgccccgccgagtgttcccagtcatgctacgccgactgcagctcctgcaaacccgtctgcgtgtgcagcgtgccgggggcgtgcggcgacccgcgcttcatcggcggcgacggcaacgccttctacttccacggccgccgggacgccgacttctgcgtgctctccgaccgcgacctccacatcaacgcgcacttcatcggcaagcacggcgccgacggcatgtcccgggacttcacgtggatccaggccatcgccgtgctcttcgacggccacgagctctacgtcggcgccaggaagacggccgcgtgggacgacgacgtcgaccgcatggagctcaccctggacggcgagcccgtgcgcctcctgccgggaaccgacgccgcgtggacgtccggcgccgtgccggcgctgtccgtcacccgcaccagcgcggccaacggcgtgctcgtctcgctcgacggcaggttcaccatcagggccaacgccgtgcccatcaccgaggaggagtcgagggtgcaccggtacggcgtcacggccgacgactgcctcgcgcaccttgacctggccttcaagttcggcgcgctcaccgccgacgtgcacggcgtggtcggccagacgtaccgctccgactacgtcaaccggttcgatgtcaaggcctcaatgcccaccatgggaggggacagcaactacaccacgtccagcctcttcgccgctgactgcgccgtggcgcgttacgcgccgtctggcggtagccgtgaccgtgacgacggcgttgctatggtgtcagagatcgctggcatcacctgttccagtggcatgggtggtcaaggcgtggtgtgcaagaagtaaccaaggaggtgtgcttctacttgccgacgaaagcacgagagttaatcgggtaaactatatatgatgttaccggaattgtaactgctatgatatataagcgtgggtgtcttcatcattgtcatgacattcacaccgcaataaggcttgccactggttgtggtattcacatttgattataatacaagtgtatttgtgat

SEQ ID NO: 23074 - DNA, 1077 bp, Zea mays
cggccgctcgaggccggccgggaggcgtacccattcaagtcgatcaatcatcagcaacaaaaacactatagtaactactgacagcgtgagggcgctcgcaatggcgagccgtttgggagtcgtgctggctttagcggctgtcgtccttcttgccgcagcgggggccgccgccgggcaatccacgccacggccacccaacgcccagggcccgaagccgaagccgaagccgatgaaggtcaagtgcaccgagaaccgcaaggagaacccctactgtttcaaccggaacatggactgccccgccaactgcccccagtcctgctaccccgactgcaacacatgcaaacccgtctgcgtctgcaacaccccgggggcgtgcggcgacccgcggttcataggtggtgacggcaacgccttctacttccacggacgcagggacgccgacttctgcgtcgtctccgaccgcgaccttcacatcaacgcgcacttcatcggcaagagcggccacagcggcatgtcccgggacttcacctggatccaggccatcgctgtgctcttcgacggccaccgcctctacctcggcgccaggaagaccggcacctgggacgacgccgtcgagcacctggacatcaccctggacggcgagcctgtctaccttcccgctgacctcatcgaaggcgccaagtggacgtccagccgcgtgcccgagctgtcggtgacccgcaccaaggcggccaacggcgtcctcgtcaccgtcgccggaaagttcagcgtcagggccaacgccgtgcccatcaccgaggaggaatcgagggtgcaccgctacggtgtcaccgccgatgactgcctcgcgcacctcgagctggcgttcaagttcgacgccctcaccgacgacgtccacggggggggcgggacaaaagtaacgcctccgaattacgccaaccattttcaagtgaggggcccccatgcccccccatgggaagaaaatgccacctttccccacctcccacccgggtctcccccccgaatgggaggggggggggggcttatgggaggtcaaaccccgggaaaaacaacggg

SEQ ID NO: 23075 - DNA, 975 bp, Zea mays
cgacctgcagtgtttatatttggcagatatttaggttttgatatcagtactacccatccaataaagaggtgcttgaattacagaaacataaaattagatcacaagtatctttctggattgtaaaacagttattgacagtatagggacctataaacagatttctttttagtaacttggcttgaaaatgattatttcttcttcccatccttgttcatattgtgctaaaagatgtgcttgttgcattagagtttaaaatgacaatgcttgataaataccgtatgttagggaactgttgggcagacgtagatttcatcgttcatgaataattctgttcgatgtttgttggtttctttcaatccttctctctgttttaacacccttgttctcggtgctctattgtcttggcatggaaaagatctggccttatggtgagacccagcatacaagtcagtgtgtgccctacgtttggaggaagtgatcctggggtacgtgcagaagttgtccattcattgaaagaggaattgaatctgatgtgtggcctctcttgctcacagcgcccatcagcttatactgctctctctgtaagctctagttgacatttctgattggttctttctaggattttagtgtggatgtaacatactctctacatggcagattggacgatcaaagtggaatggtcaagtgggcagttctggagtggtaatcaccttggaaacacctcttaataacattggaaggccgtcgttatctgttcaactgaatggtggttttgagttgtgatccttatgactcctgcactgaagctgtacatactattgtatatattgccatcactaatgttcgtgctccattgtcatggagacggctactcagctgatcaacctagaaaagtttgtggaaagtgggctgcaggtaggcttgcaggttgtttttgttactgtagtctataggtctaaagtcttaactcagcaa

SEQ ID NO: 23076 - DNA, 2040 bp, Zea mays
  misc_feature (520)..(520): n is a, c, g, or t
atcctcctcctcgcccctgttcctcgcgtcttcccgtcgtctccgactcgcttccagttcccgatttgccgaacgccagcgacgccgtcgcatggagatctccttcgaggcgtgggagggcgtgcagcggcacggccaggacctcgcggaccgcctcgcgcagggcttcacgggcctgctccaggcgccgccgcagttcccgtggccgccggcgccgcacaagcggatgcccttcgacatcgacctccccgtcgtccccttcggcgccggcgtgccgaaaaaggacctccccttcccggccgccgccgccgccgtctcctcggtcatcgacatcggaggcaggctaggccaggccggcgccgagcttggggcgtccgtaggcggggccgtgcagcacgccgtgcgccatctgcccgtgccgttccgcaacgcccagatccggcgccgcacgctaccgccggcgccgcctcaggcgcccctgccgcccgcgacttcggtgggcgagggcgcggcagggcgntccgtcgaaagggctgctgtagataggtgccccctcgaggcgggcggccgccgccgccgctgcggccactgggagcgcggctgcgtcgagcgtcagcggccatgttagcggggacgatttggacgaggacgacgaaggcttcggctgcggtattgggactcttggaaactttaagaaggccaacggtactgtaaatatgtcggcaacatacaattccaggagtcaagacatcgagagttctgttgttgcacatggagacctctggaggctagaggcatcgcgtggtggatcaacttctggaaatggcacttcgcctctgtaccttgttcagttggggcctctactttttgttcgagactctacacttctgttgcctgttcatctatcaaagcaacacctgctttggtacggttatgatcgcaagaatggtgtccattcactctgtccagctatatggtcaaaacataggagatggttgatgatgtcaatgatgtgtctcaatccaatagcttgttcgtttatggatttgcaattccctaatgggcaactaacatatgttgctggtgaggggatatcagccagtggttttcttccgttatttggtgggttgcttcaagctcaaggaaaatatcctggagaaacaagagtgagcttttcttgcaagaataagcgtggcacaaggtttactcctatgtttcaatggcctgacaagtctgtttcgttaggagttactcaagccttggcatggaaaagatctggtcttatggtgagacccagtatacaagtcagtgtgtgccctacgtttggaggaagtgatcctggggtacgtgcagaagttgtccattcattgaaagaggaattgaatctgatgtgtggcctctcttgctcgcggcatccatcagcttatactgctctatctattggacgatcaaagtggaatggtcaagtgggcagttctggagtggtaatcaccttggaaacacctcttaataacattggaaggccgtcgttatctgttcaactgaatggtggttttgagttgtgattcttcagactccagcgctgaagctgtacataccagtgtgtatatattgccatcaccaatgttcgtgctccatagtttgtggaagtgggctgcagcctgccggcttgcaggtcgtttttgttactgtagtctataggtagtctcaactcagcaaatcagctgccatggtacccaacccatgcgggcacagaagtcaactactttgttgttcaatcattatgacaatccttaggtcttatttggatactctcgtattcacattaatctcacgtttattgaagtggaatttaaattaatttacactccaatcaacttcaatacatatggattgaagtcaatacgagagtatcgaaatacggccttaagggattgtgacgcttgcagcaggtgagctcatattagaagttcgtgaaagtggaggaccacgtaatcatgcaagagaaaaatccaaaaaaagaaaaaaacggacgcgtgg

SEQ ID NO: 23077 - DNA, 2926 bp, Zea mays
ccggcccacacacactacgccttttttttgagagggagagaggacacgcacaacgcttcacactctctcggtggccagtggcctggtccgttcggctccgatttcccgattcgattccaaccatccctctcccggcgtcctgccgtcctgcgggagggaggtgcaagcggaaccagcccggcaatggcagctgcgcggcggccgggggcgaagcccaggggcggcggcggcgcggggaagaggagcgcgtggttggcggcggacggcagcaagcgctggggggaggccttcttcctgctctacacgcccttctggctcacgctctgcctcggtgtcgtcgtcccattcaagctctacgagaggttcacggagctggagtacctgatccttggcttggtgtccaccgtcccggcgttcgtcattcccctattcctcgtagggaaggcagatagtgttagaaatttcaaagatcgatattgggtcaaggctaatatttggattataatttttagctatgttggtaactacttctggacacattacttcttcacagttcttggcgcgtcatatacttttccatcatggaggatgaataatgtacctcatacgacatttctcctgacccatgcttgtttcctgttctatcatatggcatcaaatatgacacttcgtagattgcgccactctacagctcatttaccacagtctatttgctggttatttgaagctgcatggattttagcactgtcatacttcatagcgtacctggagaccctagccattgcaaatttcccgtactatgaattcgttgaccgggatataatgtacaaagtaggttccttgttctacgcaatatacttcatcgtcagcttcccaatgttttcaaggattgacgagaaagacgagaagtggagcctgtccagggtagccgtcgactctctgggcgcagcaatgctggtgacgataatactggacctatggcgcatatttctggggccaatagttcccgtcccagagtcgaggcagtgtggccaaccagggctcgcatggttccaagcgcagaacggaagcacctgattcagtgaagctgcaagttctgcgtttccacttgaatacttcatcatcacctagcattcaccgaggcggagatcttagagcaataaccctcgagagaaatcatggcctcactccttttgataaatagctgtgccttctgtggccggatgcaattgtgcaaatgccactttcagtagttatatttgtatgttttctccgtttggtgaattacagagagatatgtctgtaacgtgaacaagatcatgctgttctaattcctgaaactctatgtggtgctttgtgatcggattattaaaaaatgtcgaaaacttaaattgaaaaaaaaaaaaaacgatttgattacagcggcatccgattacgttgttgcattgtttgagccacaacttttaatgtgctaccatgtatgtaatcatatacgaactaaaatgcagtgttatctagtatgcctcccgccaaagtgtaatgcgataccagaacttacctgatctgaaccaaacaatataaataatagcttactttcttttccatttgcagcgttatcaaataaatagcgtttacattaacggccaaatttcacaaccaaacaacacagcaattccaacttattctgactatagacatgttacaagaggtaccaaagtgtccttaataccatgctttcagtcgacattacgttgtaaattatgttgtgaattctccaatcattgcacatctattgtattaatatcttactattacttttactctcacaactgctggaatagctcagttggttagagcgtgtggctgttaaccacaaggtcggaggttcaagccctccttctagcgttattttttcatttttcatctttatgatctgttttttttttgtctttttttttttgcatttatcgtcttattctacggtgccatgatttttatagcagtttggacacaaattgttctccttagttctgaaagctacatggagccggctgatagtttggacagaacacctttttatagcagtcaatcgaacacccgtttggtgccatgatttttatgctcttaccaagttttattcaaaagccgttgattagcgattatataagtcaaatataactgacgtagagacacttttagctaaaggtaacttgtctgaggaagcatatcattaacggatcgaagcatcagcctgaaaccatgcacacgcagaaaacagaacggaaaggataagcgctagctacacctgttacatgcacgtacgtgtcacgataacgcatgcctgcccggatatatagatgcacgtcctcgtcgtcgtctagcatttgccttcgtcatgcatgcatcccgtggtcaacatgtcatcgatcctgcggcgtgccgctgtcaggtggcggacacgtgctgcatgccacggcgccggcggccggccggtgatgtgtgcgtgtgcctcgccgttcgtcctacctgccggtggcgacacgccaccaagcaacctccggtccgatcgatccatttgtcgcccgggattggtggtataggtaaggcgggctgacagcaacacacggccgacgctatcaaaatctagctctttttcgagttgtccacgtcttttttccaaagacaatttatcagtcatctagcaaaaaaacaaactttgtccagtgtcacttttggcgaactaagacacttgatatataactcctttatcgagcgcaaaacaatctatatagacagactctcggtaaatgagcattttgctaagtgtcacaaaacacgacactcgataaagaaccatcgacagtcgtctattattgacggcagttaactataccgagtgtcaggaattgacacttgacaaattaac

SEQ ID NO: 23078 - DNA, 851 bp, Zea mays
tcgggattgaagaatttctctgaccaagaagaatgcatcatcaatctaaatgacattcctgggggtgccaagtcatttgagctagttgcaaggttctgctatggtgtgaaaatagagctttcacctgcaaatgttgtctacctacggtgtgcctcagagcatctagaaatgactgaagaagtagctgaggaaaacctgattgcacagtcagaaatgttcctcaaccaagtggttctccgtaactggaaagattccttggcagcattggaaacatgtgatgacctactcccccatgctgaagacctccagattgtgaacagatgcatcgagtcattggcatcaaaagctactagtaatccaaacctctttggatggccgataagggaacatggcatgatgcaaagtcctggtggcagtgtactatggaatgggatcagcacgggtgcaaggcccagaaatttcaattcagactggtggtatggtgatgcttcatcattgagttttcccatgtataagaggttaatctccaccatggagtctcgaggcatccggcctgaaataattgctggttccttaacctactatgccaagaagtatcttccaggacttaggcgtcatagtcatagcatgggcacaatgcctcttactgctactctatctgaggttgaacaaaaaaatttacttgaggagatcgacaggcttttgcctcttcacaggggtatagcatcgacaaaagttctgcttgggctccttcgcactgccatgattctgaaagccagccccacgtgcatttctaacttggagaaacgaattggcatgcaactagaccaggccactttggaggatctact

SEQ ID NO: 23079 - DNA, 986 bp, Zea mays
cttctataatttatatacatgttcaaataattacaaatctctctgttccaaacaagcgggcaagcaaatgaatgatatcacgatataccctatatttccctttctttgtagccatttctcacccaaaaccataaaaaaaaggaaggaaaaaaatcacaactctcaatctgggcactcctaaaaaaaatcttcagttccctgtaactccacaagtaactgtaccattctttctactctttatcggtagaagatatcagtccgtgtgctgctgcagaagaaagtgaaactgagaattctgcctcagtagcgggggcggttccacatcggacggatcgatgtgaagcatcagccgagctatgtcatccaacgatatcggtatgcttgagtcgtcgtccagcaagaacgaactgtttggagtagttactgagtcgtccgttgtcatcgttctcatccttccaatgacctcttgagatacgccttgtgcaccgtacttgtcgtcccagaacatcgttgctatgcggtatatttgagttatgctcaaaacagggcaaatctcattcgtaatttcctccaggattttgtgtgatttctgatgcaaaaccaggaacccgactgcctgcctaatgtgttgcagttcatcccaggacgtccctacatactcttcagttgtcctagagcaccactgctccaggtcttgtaaaccagcctttaagaactccccattgctaaaagagctccagccccgtcgaagcagcaagctgttgaagagttgcacattcaagtatgcaaatacttggttaaatgttttcctgattatcaccggagctacatagttttctttcatcgtttccagtgtatgatccaggcacttgacaatgttttgccaatgcagacttgatgcttgcctagctagtgaattacagtgtatgctttttagtgatccccgtgatgacctcacacggttagctcttggagcctgtatgcac

SEQ ID NO: 23080 - DNA, 1762 bp, Zea mays
ggccttttttttttttttttgtttcttgaaacatttcctattttaaacttcactctgtaaaaaaaaattgtatgatcatatgtaagatttaccggagacaacctaatagccctgaagtttgattgcccaacaaactgaaaccattgatgcaaccacagtagcgcaattctacaaactcatttcagtgcggcacctcgataactcacaatgtatttctcctccaaaacattctaccgcgaccaaactaactcgacgcacactttctatggtgtgactggtcactggtgtctatgcattgtagttgtcgaggcccaggtccctcaaggcagacgaggcagcatctttacagcttccgtgcagggccatggcctttctaataagcttttctgcaccatcattaagcaggacggtcctgttctcagggtttcgggcaacaagattgcgaatcataaggcatgcttgcttctgagtctgcccggaggaggggaacctttgcattgactgtatagccagtgtcccatagccttcttccattgcacgtgctgcattttctggtgacctcagtgtgaggaccgtcaccatagacataacctcttgaattatagcaggatcttcagaaaatctggatgtcaactttaggaacctatcaaaaccacctcgctgaatgataatggacttgtttgcatcgcttgcagcaagcttggacaacaaagagcagcaagatcttgctacaactttgttcttctgctcacctgcctcgtcgatgcattgaagaagcacatcaattccaccattttcagatatggaacggcatatttcatcattgactgcaatcgactttaaagcagcacaagcagatggcaaactggaaggagcgacttgctcacgaagtgcattgacaagaacttctgcaaccccgatttcagcaaatctccgggagtatccatatacctgagaagctaccactcggttgtcatcaggtttcaacagaacacgtatggcatcatacaaactttgcacattagattttgatttatccttcataacccgcagaatgagttcatcgaccttcaggtccataaaggactctttcacaacttcattgccagcagaacctgctgccacaacactaaatccagcatccaataaatctgaattttctgagcctccttgcaagagatccatgacaattttgggtccctcacttcgtctgaacttttcagtgcttgccacatcacggagtacggagctcagactcttcaaggccgaagcaagcaacctctcctgctcgacccgagcggacgcgcacagggcgacgagcgcctccacgacgccattccgtaccgcgatcgctgcattctccgaaccctcgccggagcagcacagattgcgcaactcatcgagcagagagacgagtccgtcgagatcctgctccgacccgccgctggcgctgagagaggccttcagttcgtccagaacccgcaccaccgggctcacctccgccgcggtggcctctcccggcacgcgcttaacgatacctgagagatcggcgccctggagggtgagcgcctcaacggcgtcagcgagggcctcatcggggtccatgccgaggtcctccatgttctcccggaccatggagtcgaaggcctcctgcgagatcgagatcgccatttgcttggtctgcctgtagggcgtgggtgcgggacgccgggactgcggggtgccgccggtgctgctgaatggaactcattgtttttttttt

SEQ ID NO: 23081 - DNA, 3170 bp, Zea mays
agtactgaaattgcgtaattttctaacagcaatatcactgaataaatagagtgaggaaaacaacgagttgaaactttcaagagttcataccgaggagacactatgatttatcgtccaatgaaacagaaatagaacaaataggttattgtcctccaatctacacatataataccgcggagaaaacaggagtaatataatcgtattgaagctttctaccgagaatatactgtgatatcgtccaatgaaacagaccccgaaaaaatttcctctccccatggggtatcgtaagcttcttgaactaattcaatctgcctaacatacacagaccaatcctgctgcgttgttgaaggctcccaacttctcttgagcacacacttgtgatgcctcaggattccctcttgttcgataaattctgcccagcttccttggtactcgtgctgttcccctacgtttcttcgatgatcttgccatattttccacagtcgctccccgacaactacgatgcttgggcgatcagcgccacgcgaaaccacacaactcaacgctaagctgagcaagtccctgaccacatctccatccacgcgatcctccatacggtaatccaatatctcattcatgaggtcgtcatagaatttctcaagagcccattgtacaacactgctttgccggtggttcatcaatacatcccagtcttgtggcccatgagaagatatgatttctaagagtattattccaaaagagtagacatcagatttggcagtgagctctgaggtctccaagtactctggatcaatgtagccccctgttccctttaatagcacgatattaccactttttgacagttcagaacagcacactttggctcggtagctctctgtcagtaggatgtttgacgtcctcaagttgtaacagattaaagcgtccccagaacacaaatggagataagtcaatgcaatagcaatatcaagggcaatcactatacgttgattaaaattcaggattctcttacgttggtcatgtaggtgttccctaagagtgccatttggaacatactctgtgatccgaatacactcatctttttcatcaataaaacctaagaatctcaccaaactccagtgattaatttttgtaaggagcttcacttccataagatgttttgcctcttgaacgtggccctttttagctctccggatgataacaacctggttatctgataatacagccctgtaaactgcccaggttcccccttcacctaactcaaataaaggtgagaaattatgagtaaccttctgaacctgcttaaggcttaagtttaaagatccatctccaggtattagtgcaggcatttttgacttgtccggacggcgtaaagttgatgggatctccttggatggtgtgcttactttagaggatgaaatagtatccactgagagttcagaagtggtgttaaaccttggaatatgtttgattgttgagttgtcgataccaatagctttaagggcaccatcctcagtggtcaactcacgtgacatatttgtcctagatgaacttacagtttcctttgaaatcttactaccagatgcttcttgaaatgcatatatcttctggagctcaaaagatgaaagagcttcaccatctatcactactttctcaagagtctgtatggatctaagccattgcaaccaaccagaaggcatcacacacccacttatctctactttttctattggtggagatgagaatggccccagaggctgccaacatgacagaaccatgttactctcttttatcccggccggcgcacacttaggcacagatggtttgaagacaagcttagagcaagatagaacagataactcctcaagattgggaaacatgaaacagggactctcattgttggctgacaagagtatagacagctcttctaaattcagtgcttccagtttgaggtgagtcaatttccccaaggacacaggccccccagaaagacccatctctagatttgtgaggttgggcatatctttaatatgcaagtaacgcagattttgtagatggccaattggagggagagcactgcagttatgcaggtggaacaaacaaagattgacaaggtatgggagtgaagtcagtttgttcatcatccatgtaggaaacacattgcctgtatatttaactagcataaaatgctccagagtctcatttggttggaacttctccagcacttcctcatctgtatattccaatagttgatcttgagctgattgggacctaggaacccattccagcttaaggaaacaaacctccagtcgattctgcagattcaactgctcagcaatacgaaggcctcgggaaccgcctgtgatctctttaataacaagctcatcggttgttgtgagtgagtgataatcatagtcagcagagcactcggtgtgtccttgaagagaggccgctaatactgggtccatcgtcagcacagacttgagacttgtaatttttgctaatatacctggccatgtttggtgtacattagaggatggatgcattggagcacaaccagtgaggttcagtgtgtgcaacttctgaagccttgcaaaagacataggtatgtcaagggaagtttctgacagatctagatattctaagttgaacaagtaactaatagattccaggcaatcaacggtagggaggcaatgggaaagattcaaaaacttcaacttattgaagttttcgaaatagtatggctgagtctgaagatttaggcaccgttgtaggttcagatactccaaattggttgttagcatctcagtacttacatgaagtgcttcacagccagccagatcaagaattcgaaggtacttaatcattgcaaaggagggggggagaattcgaagtctacaacatctccggagtataagaacttccagtttctcgaggtttgtaacagattcaggaaactgctgaagttcatagcagcttgataggttcaggaacctaagaaaataaaggttaccaaaagattctggtaactgcttaaggttgaaacaactagataggcttagatcctccaagttcactaaattaccaaataaagcaggtaagtgtcgcagcatagtgcatcttgataaatccaaaattcgaagattgataaggttgcacagatagtctggtag

SEQ ID NO: 23082 - DNA, 2008 bp, Zea mays
  misc_feature (1803)..(1803): n is a, c, g, or t
ccccctccctcgagttttttttttttttttttttttttttttttttcttccaaaaatctaaaagctaaatttacccacagagaatactttttgggcaaaacatttttacacatacaatactacaatggacatttttacacatacaatactacaagggacggggaattcaaggtacactaaggtctggtttggggactagaaatcacagggggattggatgacactgagggagaaattagtttatttctccttcaatctccctttgtcacaaaaccaaaccagccctaaggctgaatttactggtatgaataagtgaatgtgcaaaacattgtttagacagtgtgaatttgaagtagacggtagaatcgtcatcaactcagattaatagggcaaggtacagttatccactactagtggatagcaccactgggatacgtaatccggaaatccttaccatgatcaacatgtgtaaagaaagagaatcaatcaaggacgtagcaaaagcatacttgcaaagggccacaatgcacactgaacaatgtttctttcactttgctcctgtaggtgaagaattactggattttattttatgaattttcaggaaagatagtttgaatgaatttcaggaagcgctccgagtagagactgggttccacgacagatattgacaatgagttatattggatgcacttgtaagcatgctcaatcttcttccttatgctgtactcctgcaagatatcaattattcccaggtacagcaccacatcatacacctgaccattatcttcactgtcatcatcctcaaccgtctgttttgccctggccggcatgttaaccccaagttggatctggagccttgcggtgcctggaagcaagagatctacttcctcaaaacttgcacttgatgatcgaagacgggccccccttatatgggaaccaatgacaacatcattttgatcactagctcgctgaaccaaaaccagtccttcaggactgttcaaaacatcctcctccagagcaccttcttctgaaagaacagccagcctatctggtaggattgcttgatgaaaggatgcctgtgtccgtaggctttgaggagcccggaaatgaacgccaagaagcaaactataatccattattgcgtgctgctttagaaatttgctatcggtctcaatttgcgcaagcaaagtctgccgccaagaaggctcgagataaaatgaatagtttagatccaagtctttcagtgttgtgttctcgtcgatttttactttgtctgttgagcggcctaaggatgaacctttcaagtcaaacctccggtgaattctaagttcagtgcaaaacatgtttcccatcactacaaaccggaacttttgactgctggacggtttaaccctgtggaggccaaaaaacttagttatgagtgtgttctcataggtacggacatggtgataatactctggaagcattcgtagaagaacctgcacttcagacttccgtagagtcttgatcataaatcgatcatcctgagatagaaagaagacacttccactctttccaggagaagatagctccctaagtgcgtcacttccacaaatggaaaccatataatccgctgcatcaatcttgaacatctccctcaaatttctgaacaccattgggcagtagtctttccatttaaaattatcagcatgatgtgaaggagtaagtcgtgaaccatttttggggaagttcatccagaaacttgctctggaaccataatcagaagctcgcacttcacgtctctgaataggtgtaatctttccnaactgtatacctagttctccttcgcattttgttgacacttcacctccggctgacggccgcgggcgtggtggctggtggtttcttttcttcaaatcaaaattggcgagtcgccggcgacggcaccgccccccacggggagtgtcggttgaggtttgggttggactggactgaactgggctcccggccggcctcgaggtacccaatg

SEQ ID NO: 23083 - DNA, 3014 bp, Zea mays
ccatcacaataacccgactctcggacccacgacgagttaagcccggagggaaaaaggacaaatcacacaaaggcacagggaatcgcgccaccgtgggacgcgtacggcgcaccgcccgcccgccggatctgcgccggcgacgcgcccggacgtcggatctacgccgccgcaggaggggggaggcggcgctgtggccgttctctgcccgcgagcgcccggatccgtcccgccggtgacttcatctccgctaatcctacagataggcaaaactctaatctttgtcaaccatcaagttgatgcagaggtggtgaaaacatcttctcttctccaaagactgctgactgcaagttgcaaaagtttgtcttcagcttgctgtgttctttcttccctctctggcggagtacacgagaagtttgtagatataggcactaggcagctcctttcagctcttctatgtccagggatttggactgtcctgttcagacacagatggctgtggcagtcctggaccggagcttcagcagtgaatatcctggaggcagcagaactgaggggaggcaactgagctggaagagagtctttgtgcaaactgacaatggttctgtccttggcattgagctggagagaggagaaaatgtgcaaactgtgaaaaagaagctgcagatagctctcaatgtgcccactgatgagagttcactgacctttggtgacctgggtctgaatgatgatcttagcagcattcgcaatgactcaccgttgcttctcaaaaggaatcagattcaccgaagcaattccacaccttgcctctcccctactggccaggatgtttggcaaagagaccggagtggacccattgaaatacttggctgttcaagcccttcatctcggatgaagcagattgcgaaggatgtcattaaggccataatgaatggtgtcgacccagttgctattaacagtgggatgggtggtgcctactacttcaagaacatttggggagagcgtgttgcaatcgtgccgcctcctcccggcgttccttttgccccaaacaacccaaaaggttttgttgggaaggctctggggcagccaggcctgaaaagatctgtacgagttggtgagacaggcttcagggaggttgctgcgtacctcctcgactatgatcactttgcaaatgttcctcccaccatgctggtcaagataacacacaccatcttcaacgtgaatgactgtgttggctgcaaaagcaaagtattctgcaacaaatcagagtctgtgagcaagattgcatcactgcaggagttcattcctcatgattttgatgccagtgaccatgggacctcaagcttccctgtatctgcggtgcataggatcggaatacttgacattaggatcttcaacactgacaggcatgctggaaatcttctgatcaagaaggttggtcctggggctgacaatttcggagagcagacagaactcattcctattgaccacggtctttgtcttccagaatgcctagaagacccctacttcgagtggatccactggccgcagtcgtctgttcccttctccgtcgaggagctcgaatacattgcaaaacttgaccctataaaggacgcagagatgctacgcgtggagctacctatgatacgggaggcgtgtctcagggtgctggtgctgtcgacagtgtttctcaaggaagctgcagcgttcggcctctgcctgtctgagataggagacatgatgagcaggcagttcactgcaaaggaagaggaaccaagccagctcgagcttctctgcatggagacgaggaagtgggtcgaggaaagagagttatttcttcccgacgaagccggagttgaagacggcgatgatgacttcacccagttccctctcgacagcgatgccttcgaaccgccagctttctgcaagtttggcagcgtgaagacaagttccaggaatccactatccaagctggacgagtgtgacgaggaagacggagacttgtcggaagaggagggcgagcacggtgacgtcctgaccagtggtgcattgccccagaaggttcctcccatctccaagctgtcgtcgtccatgaaggggcttggcttcatcgggaaatccaaaccctaccgtacaggtggcgtccccaagggtaaggtgacaggtagaactaactacagtggcaaagccagcgagcatcagtccgggagccggagcgccaacgagctgctcccgcccagcgcgagtttcgtgaagctgtcggacatgagccgcaaggagtggagcgcgttcctcgagaagttccaggagctgctcccgagcgccctccgcacccggaagcacagcgccggcgtcggccagcgcccgatgccgaggctgggcacgtcttgccagttttgaaggtgtagaggagaagccaccaccaaggtaaaaaaaatggatgtatacctccgttttagctctggtgtcgtgcaggtgcagcagtcagcaggtattattataacaaaaaagcttgtaggtgtatggagccagtagaagaggttgtctgagaataagatcgtcgatggcacagatgagatgagcttggattgcaggagagtggtgtgtttgtgcatagtgttttgacatatgagatgcgttgttcttttctttttttttctttttcttttttgtatatagtgagtactcctgccgcctcgcaacaccgggctcgatctcggccgttacctgatggttggtggtgagtgtgcttggcatcgcctgtgttctgtctttgccgctgtaccattttggagacgcttaccataatatgaacagctgtgatatgatatcgctacagatatatgcataaataacacctgatagtctgcttcagtaacatgtgtatgtttttgttttccattctgtggattctgcgtgctggactggacgtgggagggggaagaaaaaaagagagacgttgatacagtagctgagtatagaacgatccataacctactgcaggtcgactttaaagg

SEQ ID NO: 23084 - DNA, 1947 bp, Zea mays
ctaatcaaaaaggcagttcactgcaaaggaagaggaaccaagccagctcgagcttctctgcatggagacgaggaagtgggtcgaggaaagagagttatttcttcccgacgaagccggagttgaagacggcgatgatgacttcacccagttccctctcgacagtgatgccttcgaaccgccagctttctgcaagtttggcagcgtgaagacaagttccaggaatccactatccaagctggccgagtgtgacgaggaagacggagacttgtcggaggaggagggcgagcacggtgacgtcctgaccagtgcattgccccagaaggttcctcccatctccaagctgtcgtcgtccatgaaggggcttggcttcatcgggaaatccaaaccctaccgtacaggtggcgtccccaagggtaaggtgacaggtagaactaactacagtggcaaagccagcgagcatcagtccgggagccggagcgccaacgagctgctcccgcccagcgcgagtttcgtgaagctgtcggacatgagccgcaaggagtggagcgcgttcctcgagaagttccaggagctgctcccgagcgccctccgcacccggaagcacagcgccggcgtcggccagcgcccgatgccgaggctgggcacgtcttgccagttttgaaggtgtagaggagaagccaccaaggtaaaaaacaaatggatgtatacctccgttttagctctggtgtcgtgcaggtgcagcagccagcaggtattatataaaaatgcttgtaggtgtatggagccagtagaagaggttgtccgagaataagatcgtcgatggcacagttgagatgagcttggcttgcaggagagtggtgtgtttgtgcatagtgttttgacatatgagatgcgttgttcttttctttttttccctttttcttttttgtatatagtgagtactcctgccgcctcgcaacaccgggctcgatctcggccgttacctgatggtggtgagtgtgcttggcatcgcctgtgttctgtctttgccgctgtaccattttggagacgcttaccataatatgaacagctgtgatatgatatcgctacagatatatgcataaataacacctgatagtctgcttcaggtacctgtgtatgtttttttctttccattctgtggattctgcgtgctggacatcggagggggaagaaaaaaagagagacgttgatacagtagctgagtatagaacgatacataacctactgcaggttcaggaatcaccaagtttggttgaatgtacaaagagaaatagaataaggtggctacgttttttatagtgtttggttgaaaatcaagcgggagcgaggtgaacaccggagtgatttttgggacggcgtgatccaaaaaatcgaggggacggtggcgccccgactcatcctactttgacctcaaaccaaacacaccgttcaaaactttgaccttaaaccaaacacaccattcaaaagaatggcccccagatctagcacatcgtcccacgtgcgtgctgcccggacttcatgattggttgatgacttcagtgtggggcccatccgagcacgcgatcgtgtttgaccgcttggtgctatgaatcatttcgacgacgatgatatctagttttgaaaaaaaagggccagccttttgactcggttttcttcctcggtgcggcgtgtttcgttagcagcatggactgtgggctcctccgtatggtggcatggtgccgctgcacgtctcgtctcgtctcgtcagcgtggtgttatccatcacataataactggcatttttaaccccttttattgacaatcaggttaggtggccagttggtctcagagccggccattaatgcgtgctattttccaagcgagaaaacatacgataaagctgtgtttgtcgctgatgtagagaataaaccccccatcatgcactga

SEQ ID NO: 23085 - DNA, 786 bp, Zea mays
tccccgtccccgtccccgcccgccggtacaggccgcctcgcccccccggcgccggccgggacctcaacacagcaccaccaaccaagcaacctcactcgctacaaacaagaaacaacaagcgaaagttttctctcgagagaggaggagaagaccaacaccgggaggagatggcagcagcagcagcgacgaaggcgtcgtcgtggatggtggccatgagcgtgggcgccgtggaagcgctcaaggaccagggaggcctctgccgctggaactacgcgctgcggtccgtctaccggaccgccaaggccaacgtgcgcagcggcagcagaagcttcgccgcgcagcgggacaaggacctggccccggcggcggagaaggggcggcaggacaaggccgccgcggaggagggcttgaggaccgtcatgtacctcagctgctggggacccaattaactagcctttcgtatcttagctggtctttggccttcttcagcgaccgcgagctcgcgagctgattattgtaaatatacgacgatgatcggatgatgatgatgatgaaaagttctgccacttccgttcgggcgttttggactgtgtacgatcgactgacttctgatcctgtacaatgtactggcgtgaaatctgagagctttgagtccacgattccaaattccaagtagacaggagggagggttcatcgcataccggcgttgcattccctgtccttttagatgaagtttatgctcaaaatacagtatcttataagtttggtccaaaaaaaaaaaaaaaa

SEQ ID NO: 23086 - DNA, 2846 bp, Zea mays
aaaaaactaagtacaatttagaatagagatgagttgaatggtctaacttctcatttctaggcccctatagccctcctgcagcagcactacctgaatgtagggactggaatttggacggtgggaactcgcaattgcaaaaaaagaaagaaaggagaaagcagagagatggccgttactcacgcccgactcacatctctccctagccatggttatttgttaacccgtgttccttaacccctctttaacccatccctcaccccctacttgaggcgcaccactcctgcccctgcgcacgaacacaaagtacagacaccaggaacggttgaacaagcgtgggtgggagctgggaagcagaggcggccagtgggggcaccgggaggtggagctgttgtgccaaccgagagttggtggcgcggcgccggccgccgggcagggactggtggtgctgccttctcggagtgtggcagcggcggcggcggagcagtgccagatctgcgactccgacggcgcaatccaccattccctggccagtgggggcaccgggaggtggagccgttgttccagcaaccgagagttggtggcgcggcgccggccgccgggcagggattggtggtgctgccttctcggagtgcggcggcggcggagcagtgccagatctgcgaccccgacggcgcaatccaccattccctggcctccgcattgcatcaggtacgggtgggggttcctcgtcgacattcctgggggtgtcccatttccactggtgttcatctcatcaattctgccgagtctctgcattttcttcccattttttattcgattttttcatagccgggtgagcaaaaggtgacatatttggcagtaagtaactatgctttcttgcacatagatgcagcacagctttaattctagtagcttctggaacaattgtttcctttattatgttatttcattcactaagctctcaacttggatgcccgattgcacagcatggtgaatcaatgttaggtgctagtcttctgccccttgacgccataccattaggcgtttgcttcttcatctgcttttagcagaagctgatctgtgtcgatcgatctggcatttgtgcagcagagtttgtgcctgtgcagagctaccgctgtagtgtagatttagctcgtgcctgtgcagagttatcatgaggaagcttccttatcttctatttcacagtccatgtagaacaggactggtgctagagtggattgtatgtcatggaaagaatcttcttgtcttgtttcagtgctttgttagtttcttctctctttgggctatgatgataatctcctctaattctttctgttcttgcaggatctaacaatcaacaagcaagcttgtccagtctcataagtaacagctacctggtgtagaagggttgctgctatctgcctgtcttcaccttatggtaatgtctagcaagttgtaaaagatgtctgtcactgtctgatgatctctgctgtgagtctcactcgtctgctgaacttgacgggtgcagaaggaaacaagagaggagcaagaaaggccggattctggcagcttcctctagtacattggctgcaatttctctttcagtttctaccatgcctcgcaacttggaatgcccagtgcagacccagatggcagtctcagccttggaccgaactcttagcagtgagtatcctactaaaagcaaaagcgagaccaaggttggtggatggaaacgtgtttttgtccaaaccgatgttggttgtgtcctggctattcaattgaattgtggtgacaatgcacatacggtcaaaagaaagctgcaggtggccctaaattttcccactgatgagagtgttctgaaaaatgatctcagcaccattagaaatgatttccctttgcttctcaccaagactttcatgcatcgaagttcctccacaccatgcttgtctcctagtggcaaggatctccaacagcaaaaagataggggctgtccaattgaactgttagtatgcccgagccgctgttctcgaacaaggcagctcgtgaaggatgttgctagggcaatcaagaaaggtgtggatccagtacctatcaaaagtgggcttggtggtgcttactatttcaggaacagcaaaggtgagaatgcagcaattgtgaagccaaatgatgaagagccttttgctcccaacaacccaaaaggttttatagggaaatcccttgggcagccaggcctcaaaagatcagttcgaattggcgagacctgttttagagaggttgcggcgtaccttctggactatgataactctgctaatgtccctccgacgttacttgttaagatttctcatcctgtgtttcatatgaatgaagacatcaattttgctaacaaaaatattgctgatggtagcattcaagctgttagcaagactgcatcatttcagcagttcattcctcacgattttgatgccagtgaccatggcacctcaagcttccctgtttctgcggtccataggatcggaatacttgacattaggatcttcaacactgacaggcatgctggaaatcttctgatcaagaaggttggtcctggggctgacaatttcggagagcagacagaactcattcctattgaccacggtctttgtcttccagaatgcctagaagacccctacttcgagtggatccactggccgcagtcgtctgttcccttctccgtcgaggagctcgaatacattgcaaaacttgaccctataaaggacgcagagatgctacgcgtggagctacctatgatacgggaggcgtgtctcagggtgctggtgctgtcgacagtgtttctcaaggaagctgca

SEQ ID NO: 23087 - DNA, 655 bp, Zea mays
  misc_feature (15)..(15): n is a, c, g, or t
ggccgcttcgaggcncggccgggccccgaaaaacaggcaaacacacaacacaaccaaccacctcactcgatctctcatcactcgcaagtccagcgatcaccaaccagagctcggctccaagcctccaactccaacccaaggagacagatacgttcgcagatggcgggtgcagcgaaggcgtcgtggatggtggccatgagcgtgggcgccgtggaggcgctcaaggaccagggtggcctctgccgctggaactacgcgctgcggtccgtccaccgcaccgccaaggccaacgtccgcagcagcctcgccgcgcagcgggacaaggagctggccccggcggcggagtcgaagaggcggccgggcaaggccgccgcggaggaggggatgaggaccgtcatgtacctcagctgctggggacccaactaggaggactagctagggttcactgttcagttcattgctggtgctgggttcagttcagacctggctggccggttgcctcctgcgattgtaaaataggaatacggtcacgacgatgaatgatgatgacgatgaaaagttctgccactgtatgtttcaggcctgtgggctcaaaacaagaattcggtggtgcttgatggctgaaacatccaaaaaaaaaaaaaaaaaaggtgac

SEQ ID NO: 23088 - DNA, 752 bp, Zea mays
gccggcctggtctctcgaaaaaaaaacacacaacacaaccaaccgcctcagtcctcactcatcactcgcacagtcgcaagtccagctatcaccaaccagagctcggctccaagcctccaacccaaggagacagatacgttcgcagatggcgggtgcagcgaaggcgtcgtggatggtggccatgagcgtgggcgccgtggaggcgctcaaggaccaggggggcctctgccgctggaactacgcgctgcggtccgtccaccgcaccgccaaggccaacgtccgcagcagcctcgccgcgcagcgggacaaggagctggccccggcggcggcggcggcggagtcgaagaggcggccgggcaaggccgccgcggaggaggggatgaggaccgtcatgtacctcagctgctggggacccaactaggaggactagctagggttcactgttcagttcattgctggtgctgggttcagttcagacctggctggccggttgcctcctgcgattgtaaaataggaatacggtcacgacgatgaatgatgatgacgatgaaaagttctgccactaaaaaaaaaaaaaaagtcggctcaaaacaagaattcggtggtgcttgatggctgaaacatccatatccatgtgctggaacataacagtcggtgatgccaagcatgaaatggcaatctcactcaggtcgtgggatctgcccccctatggccgggtacaacccgagactgtgtttcagctcagttcctgc

SEQ ID NO: 23089 - DNA, 8993 bp, Zea mays
  misc_feature (7560)..(7560): n is a, c, g, or t
ccacgcggccggcccggccggttttgacattaacccgtctttggtcccggagggaaaaggacaaatcactcacacagagggaacaaaagggcacaggaatcgcgacagcgtgggaggcgtacggcgcaccgcccggccgccggatctgcgccggcgacgcgcccggacgtcggatctacgccgccgcaggaggagggaggcggcgctctggccgttccttgcccgcgagcgcccagatccgtcccgccgccggatatatatatcaatcaatgcccctgtgatatcgagcttcagttgatgcagtggtgaaaacatcttctcgaaaaactgctggctgcaagttgcaaaagtttgtctttcccttgttgtgttgttgcttccttctctggtggagtacacgggagaagtttgcagatacaggcagctcctttcaaatctcctatgtccagggatttggactgtcctgttcagacacagatggctgtggcagtcctggaccggagctttagcagcgaatatcctggaggtagcagaattgaggggaggcaactgagctggaagagagtatttgtccaaactgacaatggttctgtccttggcatcgagctggagagaggagaaaacgtacaaactgtgaaaaagaagctccagatagccctcaatgtgcccactgatgagagctcattgacctttggtgacctagttctgaataatgatcttagcagcattcgcaatgactcacccttgtttctcaaaaggaatcagattcaccggagcaattccacaccttgcctctcacctacaggtaagaatgttttgcaaagagaccggagtggacccattgaaatccttggctgttcaagtccttcatctcggatgaagcagcttgctaaggatgtcattaaagccataatgaatgatgttgacccagtcgctgttaacagtgggatgggtggtgcctactacttcaagaacatttggggagagcgtgtggcaattgtcaagccaactgatgaggaaccatttgctccaaataatccaaaaggttttgtggggaaagctctgggacagccgggcctgaaaaggtctgtacgggttggggagacaggcttcagagaggttgctgcttacctcctcgactatggtcactttgcaaatgttcctcccaccatgctggtcaagataacacacaccatcttcaacgtgaacgactgtgttggctgcaaaagtaaagtgttctgcaacaaatcagaggctgtgagcaagattgcatcgctgcaggagttcattcctcatgatttcgacgccagtgaccatgggacctcaagcttccctgtatctgcagtgcataggattggcatccttgacattagaatcttcaacactgacaggcatgctggaaatcttctggtcaagaagcttggtcctggcgccgacaattttggagagcagacagaactcattcctattgaccatggtctctgtcttccagaatgcctagaagacccatacttcgagtggatccactggccgcaggcatctgtccccttctccgaggaggagcttgagtacattgcaagacttgatcctgtaaaagatgcagaaatgctacgcatggagctacccatgatacgagacgcatgtctcagggtgctggtgctatcaacagtatttctcaaggaagctgcagcgtctggcctctgcctctcggagattggagacatgatgagcaggcagttcactgcgaaggaggaggaaccgagtcagcttgagctgctctgcatggaggcaaggaagtgggttgaggaaagagagtcctttcttcccaacgaagccggagttgaagatgacgatgatgacttcacccagttccttatcgacgacgaggatgattatccggatgccttggaaccatcagctttctgcaagtttggtagcatgaaggcaagttctaggaatccactgtccaagctagatgagcgtgacgaggaagacggagacgggaccgaggaggacgacgacgacgatgacatcctgaccggtgcattgcctcagaggatctcgtctatctccaagctgtcgtcatccatgaaggggcttggcttcattgggaaacccaagccctaccgtacgtgccttcggaagggtaaagcgacaggcagaactaactacaccggcaaagccagcgagcatcagtccgggagcaggagcgccaacgagctgctcccgcccagcgccagtttcgtgaagctgtcggacatgagccctaaacagtggagcgcattcctcgacaagttccaggagctgctcccaggtgccctgagcgcccggaagcacgctgccggtgtcgtcggccagcgctcgatgccgaggctgggcacgtcttgccagttttgagagtagcagaagagaagccaccgaacccaaggtatgacgaacgcgcttctgttcgagctctggtgtgcagcagccaagcaggtacggagtattatatatgcttgtagtaggtgtctggagccggtggtggtagagagggtccgagaataagatcatccatggcatgtgagatgaggttgcgggagaaggaagggggttgtgtgtgtttgtgcatagtgtttcgcataagagatccgttgttcttttttcttcttctctgtatatagttaagtactcctactgctactgcatcgcagcaccgggcacgggctgggatctcggccgttgttacctgaacgatggtggtgagtgtgctggcgtcgcctgctctctgctctgtctttgccgctgtaccattttggaggcgcttaccatattatgaactttgaactatgatatgatgttcgctacagattatattgcataaataacacatgttctctgtctaccaggaatatgtgtactgtacctttccattcagtggagcctgcgtgccacaaaactgagaaaaaccctgctagagctggaaggaacggtctagaacttaggttcagaaagcagaagcatcaaagaatgaccccagatctactactacaccccatgtgctgcccgtactccatgattggttgattacgtccgcgtggggcgcatccggacacgcacgtatcgtgtttgaccactcggttctatagatttcatttccatgatacctagcttggaaaaaagtggccagccttttgcgggtggagaagagatgagtgattttttccccttctgataatcgctagcagcatggaccgtggggctccgggatggtgccgctgcacgtctcgtctcgtgtcgtcaccgtggtgatatctacaagtgacctttgagcccttctgcgttcgcaatcaggttttaggtggccagtcggtctcagagtcggtcacggtgcacgttattttccaagcgagaaaaaaattgacgagataaagatgtgcctgtcgctgagcaaagagaatactcggtcggatctgggggcggaagtcctctgcccgcggttcagtagggtatggcaggcagcatcatgtgccgagtccatcgctgttggatggacaccggtggctccgccggcgactgcgatcgagctgccgtgagtccgtgactgcgagagcgaccacctgcctctgcctctgtcctactcatagccacgtcacgcaggcagcaccttatcccggcgccaacgtgggccccaaagtgcaaaaagggtcgcgtggtcactccgccactgggcgctacaggatcaatgatcacaactgcggcagagggcgatgccgtggcgctgtgctggctgtcgagggccgccgtgatcgcagagcagaccaccggatctcgcgatcagcgctacagtttttcagactgcccggccggccaggctgcgaagcttccttctggagccaaaatatctaataaagcctttatctctagccatctgtccaggtcaaaacctgatctggaccgtcccctagctttctttttttttttttgactaaagagatggtcctcctacttatagcaggcagctctcccgacggttctttgaaaaaaaacaaaaaaaagattacagtgtagtgtaatcattcgtacaagctgcaactcagaacacgtttgtatgcgaggcccatgtttgtttcatcggatactgccagccatccgaggctttgcaacaccgcgggctggaccacgtttcatctatactctttaagatgggccgaaacgttgacatgccgctttaggcccgcaaaagtgtgcaacagcagctcctgtattctcaccatgctactatgctagcacattgtacaaccaaaatcgcccagtacactgatctcagattgttccatgagtgccaggcacgggctccgtgtagcgtggagagggtgttcctagctacctatgcagctatgctagccaccatctgctgatggctactgcgtggtcagactcagacgtactactatctagtcagcctcaggggggtcctagggtgtcccggcggcgagctcaaccagcggagcgccgttgttgatcgggcggtggcgacgagcatccagcctgtagttgtagtccatgccggcgaggatctcaggcgccgatgtatccgtgccgccgccgccgccgccggcatgccttggtgcttggaacgtggcatgggttaccgggccctcgctccttttacactggaaggaaattgcggcctggcagtataagcaaataacactgctagagcatagcagaccatgcagaaatgcatggaatcgccgaagcaagcaagatggcgacgcactcaccgggccatgtacagcttccgcaggtcaggtgcatccgccccctggtgccctcctgcagcaacgagatcgacatgttttcagataaaaacatcatgcaaatctcagtgtccgtgctgttacatcctataacctgcccggttgtttacatcagaaaggcagaaaccacacttcactacgtaatgagcgatactaatagcagcttagttggaagatagcatagatctttttagcagaggctagaaccaggggaagaagtgtttgcctgctttaagtctcagttattccttggcgggtgagttctcggagtgcggtagtcggcacagaacggcacgaggccggcggttctgctcctgcgcccgacaacggcaacctctacagttgtttccgctccatggacatgggcagtgtttgcacctgtgctcttcttggctccttccaccacctcatcacgcccgggtgctgccagtgtcttgcgtcctgtcaaccatctccgaccagtcgacagtgcagcagcagcgtcgcccagtcgttcctgcattgttttttttttgacaacaagaagcagagcatattatcgctgacctgtatggatcatgtatgtactactgagtactgagtactgaccttgtgtgcttcggcagtggaggcggccgacagggagagcagaaggagcggcaggagaacacctgcgcacctcatgttgcaacaacaagggagctgctgtgcctgtgctgcggctgcggattcaggcaggaggaccaggatcaaaggcaggcgaaaggagaggtttaaggtggcaggcgcagggttttatatatatattgccacagtgtcagcgatctgcatctgctcgtccgaagaaggctgctgattcgctcaagctttggcagaggcgcaaattaattaaatgctagtcaaagcgaggcacggcgtattcaaatccccgcctgacacgggccctctagaataccaaatccgtccttggtcgcgttgcgcctttccatttttctgcttgtcgcgctcgctcgccgatgcagacacacacagcacggtggtcctctctctctcgcttcggttggcctgcgccgcacatggagggtgcgaggccgcgagccgatcgagcagctgcagcccagcgcaggagggggcggtggagaccggcccctggctccggcgcgcgcacggcgctccggccgaccacttggcccaccgaccgacgcggccttcaagcccgtcgtccctcgcattggggcgtctgctgctgccgatgcagtgcagtacacgcacgcatctctgtcgccatccatccatgcatgtatgtatgtatctatgtggtggtcgggaggcagtgctagagatgcggtgtccagcgtgcgatattgggggttgcgtcgcgtgaggtgagatgcaggccagctccgcctccggcgcatgcagggagctcactataccaacgataatctcggggattccttcacaggagcgcaggctaatccgattatctgagcttaattacctgcatgagtgcatgacaccgagttaaacaaaacggtcatcgcctcgtttacatctgctcgccacgacgtggcggaacggatcgttgagggctggggcaccccgtgcagggaccgtggcagtgccgcctgtgaagtctgtggcaggcgttcatgtccattctccagtgccaacgcacagcagcagcagacggcaaccggcaggtcggcgagagtccagatgtgcgtgccgcgtcgggtcgtggacctgctgtgcgcgcagccttttgttttctcgtttttgacttccactgacgggatgcgggcgggcacgcacacggctttcggcatggcagctagcgcctagcgcgcgtgcacgggcgggcgtgcggcagtgcccgcgccggcacgggtccgcgaggccgcgaccatgtgtttcaggcaccggtgtctggccggccgcaaaacgtgccccagtctcccatgccacacgcggacacgccggtcaacctatctgggctgggaggatacacgccttcagggcctggctggcgcgagcgtgttgatgcgtcgtgccgaatgaacaacctagggtcataccgttacgcaatttgtacaagtaaagtttaaaatagaaaatgaagataaataagctattgcagataggaaaacaatgttaaaaggaataatagaactctaatggatgtaacaaagatcacgcttaaagaattacaatgggtaaaaagcacaatgttttggacgcaggcgatcaacaccgcttgttatgccatcaaccggctctaccttcaccgaatcatcaagaaaacatcatatgtacttctcacttctaaaaaaaatctcaattttcactttgatattaaatttatttcaaatgggtattttttatggaagaagaagaaggtccacaccgatttattgggtcctcacatgtcgctcgggccggtaggttccccaccaaaccaatattatcaaatatgattgtgtatcgtggcaacgtacatatattgtactagtctggactaactatttgttttcgatctaaatttttataatatccattctagaaaataaatgtattatgatatggaggaggaaaacatgtttcacattgttcacaatttttagacgatcattcctttttcacctctatagtagtatagtagttgaagaagaaaaacgaacttttatagttgttgaggaagatcaaatatactcgtgtttttctcgtggtcatggtggtgaaaaaatccatgttctagagaacctgaattgttgggcgnttctcgtgtaagagccccagccgtagtccaaattcgagtgaagcagcccagatagcacaatggaacaggcccaccaaaccaatattaccaaatgtgacgtccacaggctcaagccgttattcactatccagcccacaagcttccagcgaagtggcggattccggaatggtttaaatgagggactactaaaataaagctaaattttttagtctgaactaaataatataattgatatttagtatgacaaagtaacaaaatataattcaaatattaaagaaacgtgtagactaaataagtagatacaaagtctgtaaatgcagtactcaatatataccgctcatgagttacgattatgaggcattcaatgtctacaaatacatcttgctcaataaagcatagtatgctattattcatccatccatctcccactttgtgtttttattttggtcatagcacaaaaagtcaagagcaaaggacaatgaacattttttttgcaatttagccccttttgcagtgtttttccacaaatatgccctctttgtttgaatctagaatctagacctttacctgggcgccatctctattgctactgacgttacactactcaacgccaatatcgctggcgcctaggtgtcaaccccgcacgtcgacgtggctggggtcgacgccatgattattggcgccgaggtcaacaccacagatctcgacgccgagctccatagtataaattgtatcctttgaccgtcagttctttttatctccttcatctcattttccctcctcatccatacggcagacatcccctagatcaacaacttcgaccttagaaacttatattcgatccattggtattcggtgacaagataatctccctcattttttttatcgatttggtttatttgaggtgtatgtctttattattagtgttagggttttttgaatcattgctaatctttgtattatcgtatcatagagctgctaaacaaaaagtaagcgttgtatataatgtattattgaatcgtagtacttctaattttcgtattatagaatttagtgctaatctttagccatgttgttcagaatattatgtggaagacagtaacaaaattttgtacagttttttctgcatcattttctctctacgaccgaaaacgtgaaaaaacatccgaatacgaatttatatctgcgtcaaaaaatttatcgattatttaaaaatatatagaatgaatttgaagtttattttttatgaatcttaataagctcaaggctaaaacaagtatataaatttgaacaggaaattctataatctattttggccgtagaagatagaagacaaaaaaaacatcgttagcatggactgcatagtgctgtccgaacgtggcgaatcccagaatcccaccggcaggtggcagcaggcggcagctagcaggatg

SEQ ID NO: 23090 - DNA, 2363 bp, Zea mays
gagagctgaggtaaaacctggggttccatacagaatagtgaaagtatcaattacaggtttatcaaggtagtatatacacacaactctaggttttcatgattcttccaaacttacaacggatcacatttatgacgacgacgaaagcactactggataaaaacttgcgatgcttctatgcaattattttctagggtgaccgatatctcacaagacctcgtcttcttgcacgtacatgccaccatcggtctcgacgggcattgaaggtggggttccaggtggaatgcaggaagccccattttctcctgcaatagtacacaatgcctccgcgtcctggatagcccggtcaagattgatctgaccactgagctcattgatgaacttaaggagggtatcgaagtccatctgctccccaattatccgctgacgatattttttcaagattgctacgcacaagtacaagtggaaatgttctgacaaataatgggaccacagaacttcccataaaagcatgatctggtcgaaactgaactcccttttgaattgtataagaacccagcggaaacagaagaaatagttcaagcagtcattttgcctaaaatagttgtgcaatgaaggatcaagaagctccacaagcttggataatgcaagtagctgagcatgcatgccattctggtcacgattaaaattggcacctagacgttccatcagggaagcaaagcaccaaaatgattcagactcatcctccatgacataaagtatgggagccaaaaagtcactcattccttggcaataaccaaggtcgaaattgtagaaggaatatgttaacagaatatcacgtaaaactacaacattctgattgtcatctccttcataatagggaatggacctatctgttctcaccacatctttgtcaattaggccttttctttccctaaacttggtgaatcttttagcttgggtggctgagatactcttccactgagattttatgacttcatattctgctcgtttcatgacagcaaggtattccctctcagcatatgttgaatcatattcatgataccccaacaagaatttccagacctcttttctcaaagcatgatcaactcccccatagaaaacctttttcctcagtgcctttgaatccataatcctaccttcacgatctaagaaagatgtccactcttcgacacttaacgggtgatctcgttgttttccccatacgagaggtaatggatctgactcgagtgttgctgagggtgccgaagccttttctggtgttacatactgatttttatgtttattagttgatttattatccaaaatgtattgatgttgttggcgtccataagcatgagcaccactattgtctcgaaaaaggcttgatgtagtatctcgtgcaaatttagtaaccaatgagaatttctccaagacttgaattgaaagatcacgacctggatcatttgatttgtgattttgctttgagctatactgagacatgctagaagttgccccatgtctaacattatccccatgcctggactcatcaattgacccagtaaaactgagtgaattttgtcttgacatggcatttgctactgaggctactcctggaagctccaaggatgacaagcttttctgaaggggatcttgaaagtcgttgacgagaaaaacattaggatcgtcatccgacctgatgatgaatacatgttgtttcagtgttgcaaacaattcacgaattccaccgttgtagaaatagaatggagggaaagccaggcctgatgagagaacgattattacgtagtccagtccaaacgttggggtgtacttacggatgaagcgtacatcacttaaaggcaaggccttgatagtgtacagatttctatatttttctacttccacaccgactgaactggttgacaaagagccggctccttcgtttggctcccaactcaggaacaatgatccctgctgcagaaacagacgcagcttcccgctgatacgactggaaccatactgcgacgggtggatggtcacacgctccttctcatataccacatccaccctcgcagtctcctctgaggctctgtccgcgggatcggtccgcatcgccgtctggtcagaagcggcggcggcgtagtcggagtcgtcggagagatcgtagaggtccggcgagcgcggggaccctgcctccgctgctgttacgtctcctccacgcatcgccacgcgaaggggtgcgatctcgggtttttgctgaatcccaaccaactcttcttactgctgaagccgggctggaatacttggggctgatatcgcgtctgagaacaccgtgttgtttgcgtgttgcctttgatgtgtttaat

SEQ ID NO: 23091 - DNA, 4420 bp, Zea mays
tggtatgctagtacaggttggactgcatgcgtttcgtattttcgttgatgactattgagtattgacaaaaggagaggagtaaatactcgttgggccatagcgttttgggctgccgagtgcggggtgccggggtcacgatgtttttttgccggggtcttggctggtagaaaatcgacgtgtataaggtgcaactgtgaagtcgtcggggtcggctgaccccaactcgccaacgtagcttcgcccctgtcaagggatgatggtcgatggcttggtttcctcctcacttaccaccaccaccaatcacataccacgacagcagatggaagggaacagagaggatgtttcgtccgtctgaggggcctaatcttgttcttgtctgggcgttgttctttcatgttggagagggtcactcatggatggaccgattgacagctaccgtgtgtagctagtcgcctggacagcagaccgagagatctgagtctagctttgctcctcctgaaaccatatgcgcggcatttcgcttgtggatggacgtgggcctagtattgtcgtttccaggtttcggtggctaataagttccgtccgcaccaccccgtgcaatctttccgggttaacacttcctttttccccaatttgagaatctgtgggctgcaaaagcgtgagagaggtttgaggggagaggccggatttgctgtttagtgcaacttcaacatcctgtcactcgtcatctaaacagagcaaaattcactagtagtcatgttcctaactctcgaaaatttatatcctaaagcctccaaacttgtaaggcgacgtaatctagaccaactcttgcacgtatagcatttgtgccatttgtgtgtgtgtgtgtgttaaggtgcaagtttggggacccaaatggtaccgcccgtataagtttggggaccaaatatttaaatttagaagttggagatcagaagagaaccaccaccgtacagcagttttggactttggagactcgaatatcataactctggagttagggacctgaatgatcccgtcatgcaaggtgtaatggccgcctgtgcactttacttgtactaataaaaatctaatcctggcgctatgtagtcttctaggtactcaaaaaagaaggtttaatcatacaaggcctcggaacccttgtcacaacgagcacgcccaattgtttttgtttcccataaaggtacgcgcgccatcattgcaaacctgttttttcaagccgcgttttgggacaaaattattttgccgagacgctaacgctagtgcaaggaagcatccaagctcacgtcaccaggggctgtccagagcccggaagagcaaacaaacaagtctggtctcgcagcactagcaggctttgccgcacaagccatgtcccagtttaagacgctatttgttttcttccatgggcttatagattatataaggacctaatgacctgtttattaattatcataatctaaatatctagattatacaacctaataataatttatgttgtttgtttatctcttaacttatttaagctatattatataatgtagagcctaagtaaacatggcctaactgttcttcgtcacgaaaggcatcagaacacgtctcattatttgcatggttccagacgaaatatagttataaatacactataataaatcttaactttatttagacgagccttaaatacaaaagtaatgaacccaacttaagcatttaagttctactccctccgtcccagtttataagactttttattcttgtctcataatacaagacatgctcctctaagtatacatacatcgatgcagtagtatataaaaaattaatttaggatatattgaagatagagtactgctgcagcgaatcacctaaaactggacctctatttctttatttcttcaggactggaaaaatggtcgtctcctttattttggagagatgatacttctattagaagatctcttaataaaaaatatagatatatagatgacatagaagatcacctgcaacttctctatctcctaaaacactatttttaaacactaattttaggtacagttgatgagataggctgatggagatgctctaggagatagaagatctgatggagagctgaggtaaaacctggggttccatacagaatagtgaaagtatcaattacaggtttatcaaggtagtatatacacacaactctaggttttcatgattcttccaaacttacaacggatcacatttatgacgacgacgaaagcactactggataaaaacttgcgatgcttctatgcaattattttctagggtgaccgatatctcacaagacctcgtcttcttgcacgtacatgccaccatcggtctcgacgggcattgaaggtggggttccaggtggaatgcaggaagccccattttctcctgcaatagtacacaatgcctccgcgtcctggatagcccggtcaagattgatctgaccactgagctcattgatgaacttaaggagggtatcgaagtccatctgctccccaattatccgctgacgatattttttcaagattgctacgcacaagtacaagtggaaatgttctgacaaataatgggaccacagaacttcccataaaagcatgatctggtcgaaactgaactcccttttgaattgtataagaaatcaatccatcttagagttaaaaaaaagacctgatggctgatctgtaaggcacattttcttcaattacgtaattgctcaactgcgggataaaatagacctgttgtacgattagcttagttaaaataagccatcccaaccactccacccccaccccccaaaaaaagacctgccacgtggttagatcaagtctgaactcggactaatttcagaggtacacaggcaaaaccagtgtttttttaaacgaatgaaaataggtaatacaaatttactaacgtcatgattgatggtccatggccaatgctctgtcagataagaccgttaaaagactggaagagtagttgaaaggaaattctttatagttctaccaagataagtgaaagggtctctaggtgagttggttaggtggcctagcctgtgtagcattgctcatatcctgagtttgactcttcgtggaagcacatttcaggctgttgttaaaaatatccccgcttctgtcccacaccaaaacacaagtcttaaggtctggtcccagttgcggtcgttctcatggactatggtgccattatgtatgggtgaggtgggggtaggtgttcatgagttttctcgacttgtgtgaggtcttcttaaatgaaatgacgtggggcggtcttacccccgcaagtgagtttttttttgttctaccagataatcaggttgtaatggagcacatatgagatagtgtaagcccccacctcccaagctcatatgaattatgaagagtaatgatgctggattgtctggtgaaatatgatcctagttcttagaagcagagtaatagcataatcataatgattgtgtcgtcccctatagcaaacagtgattagagagattgccggtgcagcggcggtgaaatctgacaagtttgagcagaggagattttgttctttgaaatacaactggcacttggtttctttaagtggctgatacttcttttacttctcttttctgggacatggactgtttttttttgtatatttaatacaaggacatgcagctctccagcattgcttgtgaaaaagcataggaaaatcagtctgtgacactactggttcatgaatttggttgtaggaaactgataaaataaaagggaaattagtgtgagggtaggtggctaggtgccagcgtgcatataaccatgcaaaacagtgttttgcactgtaggcttcactgtttatagagtagatagtagagttcgaaatagggagtgagatagacagtgggatagagaggctgatggagatagcccgagtgagatagacagtgggatagggaggctgctggagatagcccgagtgagatagacagtgggatagggagaccgttggagatgtccccggggcaaagcgacccctcggtatttcgttaagaagaccttatcatgtagatcgagaaaaaacctctaaaccctagcccaacctatacataccagtgacagaacgagggcacatttcaaggaagttatggttcagggatgaaatacaaactgataggtcatatgcatattcaaacacttgaaacttaaaagagaagaatatattaccttttgaattgtataagaacccagcggaaacagaagaaatagttcaagcagtcattttgcctaaaatagttgtgcaatgaaggatcaagaagctccacaagctgaggcacaaaagaaaaaaaatagcccactaagctgataggctttaatcaaagtaacaacggtataat

SEQ ID NO: 23092 - DNA, 1372 bp, Zea mays
cggcctcccaaggcataagatggctccgtcccgtgcgctccaccgcccatctctcctcgctacggcggcggcgctgctgctgctcattctccctccatcagcagcagcagcagtgccggcgcctgctctcttcatcttcggagactccctcgtggatgcgggcaacaacgactacctcgtgaccctttccaaggccaacggaccaccgtacggcatcgacttcgaatcctccggcggcaacggcaagccgacgggaaggttcacgaacgggatgaccatcgcagatatcatgggtgagtccctggggcagaaatctctcgctccacccttcctggctccgaactcgagtgctgcgatcaccagcagcgggatcaactatggctctggttcttctggcatatttgacgataccggttccttctatatcggaaggattccgctagggcagcaagtcagctacttcgcaaacaccaggtcacagatgctggagaccatggacgaggaagccgtagccgatttcttcagcaaggctctctttgttatagtagcagggtccaacgacatcttggagtttctttcaccgtcagtaccgttcctcggacgagagaagcctgatgacccatcgcacttccaggacgcactggtttccaacctgactttctatctcaaggagctgagtgagctgggggctaggaagttcgtcgtgtccgacgtcgggcctctcggctgtataccctacgtccgtgctctggagttcatgcccgcggggcagtgctcggcgtcggcgaatcgagtcaccgaaggctacaacaggaagctgaggaggatggtggagaagatgaaccgggagatgggtccggagagcaaattcgtgtacacggacacgtacaggatcgttatggcgatcattcagaacccccgccagtatggtttcgacgacgcgatggacccgtgctgcggcggcagcttccctttgcctccgttcctctgcattggagctgtcgccaaccgctccagctcgacgctgtgcagcgaccgctccaagtacgtgttctgggatgcgttccacccgaccgaagccgccaacctcatcgtcgccggcaaactcctcgacggcgacgcggctgccgcctggcctatcaatgtccgcgaactgtcccagtacgagtacaaatgatcgatatcgacgacgcgcgcgatgtgcaggccggctcaacgattcattggttttgtgtcattgatgtagtttcgtcttccttgttggggttttctaggctaggcttttatttgcttcaatttcgtatggttgactaggactgcgtgcaaattggtcaatttattccatgttgacgggacaaaaaaaaaaaaaaaa

SEQ ID NO: 23093 - DNA, 5055 bp, Zea mays
cgtgggtacattatagaatggttatctcctggggcgttagtaaagagacggggttaggcgacatctccagctgagagctagagccttttgattcgctaagctcgtcggctactagagacaggtcccatcgtcgcgacggggcgacatcgggcctatcggccgagtcggcgttgcgacaaggacgagcgaggcaggggtatgagcgcatcgggaagggggaggctgcgaaaacgggacattcgggcatactggcttgagcggtgtcagaaaaaatgtggtccgatggaagttgtgaggattgggctgagaaagaggaccggattcgagaggactgcgtcgtccgacagaagaggcctaagacaaagatgtattagcccaaccaaaactttaattttatatttaaccgtaaaaaatattagatataagaggttataaaaattgtcgggtgccatggctcacttctgacgaaagtgtctggggaagtagcatgtggtttctacggaacgaacgaaagctattacactaaactcaggctctgtggctccgagctgcatacctcaaaacttagtgatcccttgatattgtaatcttgctgatatcctgtaacattgtacaacaactatcagtaaattgttgtattataaatgcatctctttttttagtaggcatgtcttcacaagtgaatgataaaaaaaaaagatacgaattcatggctgcgttgcgttcctggactactgagactgctaggtggtcctcagttgcatctgaaactctggagtccgaaccgccgtgttgcttggtctcttctgctgaagcagtcaggccaacgaccatgtgagagtgtacatcagcctgtgcagggcaacgtacgcacacgcagaaagcatgccagtgccccaagcgcgcgcatgtgaatatatgcaacatcagacatgtctccggccggcctcccaaggcataagatggctccgtcccgtgcgctccaccgcccatctctcctcgctacggcggcggcgctgctgctgctcattctccctccatcagcagcagcagcagtgccggcgcctgctctcttcatcttcggagactccctcgtggatgcgggcaacaacgactacctcgtgaccctttccaaggccaacggaccaccgtacggcatcgacttcgaatcctccggcggcaacggcaagccgacgggaaggttcacgaacgggatgaccatcgcagatatcatgggtaattaacgtcaagtgtgagttccatgagtacgtaagtgtgtgattgctgcaatatacttggattatttaacgtttcagggcgctaatataattaagctgtcgatcaggtgagtccctggggcagaaatctctcgctccacccttcctggctccgaactcgagtgctgcgatcaccagcagcgggatcaactatggctctggttcttctggcatatttgacgataccggttccttctatgtacgcggccgacggccacttagctgctacttccattttttccagtgttttcttatgtataaaacatggttgtagatcggaaggattccgctagggcagcaagtcagctacttcgcaaacaccaggtcacagatgctggagaccatggacgaggaagccgtagccgatttcttcagcaaggctctctttgttatagtagcagggtccaacgacatcttggagtttctttcgccgtcagtaccgttcctcggacgagagaagcctgatgacccatcgcacttccaggacgcgctggtttccaacctgacattctatctcaaggtcctacgtactaccactaccagcattaccaacctctcagtctcagtcgcagctaaacgcgtctgctgaaaactttcagtccactgctcttacttattccgaaactgacatgcattattattccttttcctctcgatgaaggagctgagtgagctgggggccaggaagttcgtcgtgtccgacgtcgggccgctcggctgtataccctacgtccgtgctctggagttcatgcccgcggggcagtgctcggcgtcggcgaatcgagtcaccgaaggctacaacaggaagctgaggaggatggtggagaagatgaaccgggagatgggtccggagagcaaattcgtgtacacggacacgtacaggatcgttatggcgatcattcagaaccaccgccaatatggtacgtacgctacgacttcccttcgttgctgtttcttcttcctgcaaacagcacacaccttcctgctgttacttactgagcatacagaggggatggatgatgcatatatatgtggtaaacgaaatctcgctggctcttggacacccggcaggtttcgacgacgcgctggacccgtgctgcggcggcagcttccctttgcctccgttcctctgcattggagccgtcgccaaccgctccagctcgacgctgtgcagcgaccgctccaagtacgtgttctgggatgcgttccacccgaccgaagccgccaacctcatcgtcgccggcaaactcctcgacggcgacgcggctgccgcctggcctatcaatgtccgcgaactgtcccagtacgagcacaaatgattgatgtcgacgacgcgcgcgatgtgaaggccggctgaacgattcattggttttgtgtccttgctgtagtttcgtctgccttgttggggttttctaggctaggcttttatttgcttcaatttcgtatggttgactaggactgcgtgcaaattggtcaatttattccatgttgacgggaagaacgcgagtgcaatttcttctttctctactttttctagggtttggatcagtttcttcttgctctattttttctggggtttggaaagactggaagaaagaaacagccgccttctggtgtgtagactactgctactacgatagtgcgatcccatgtgcgccttggagttaggatatgatcctacacctacacggctacacgtcttgcagttgcagcgcatggccatggctgctgcctgctggtgctggctcagttctcccaataatggacaagcacctcggaactcacagtcacagctaacccctcctctatccgcaggaaaaaaaaagggaaccatctcggatcacggccattcgagcaaacaattccgcttcagagatcagctcagggaccgtatcgatgattgttgcttcaagccttcaacatgcggcgtgcgagacgagagtggttcccgtgtatctatcaaacaatcgcggccaaggatacgtggctcgtggcctgaggacagatcgaagcgacggcggaccggccgattcagttctatacagtgtttgcttcagttctattgttcgcaaatacatacagacatacagttgtttcgacgtctgaaaaacaatgtcccacactggctgtagagctttcatatttgaaatgaaactgcaaaaggacatatttgtaaaaaaaactgaaaaaaactaaattgcaaaaaaaagttggcaaatactaccagcggtcaaattccgaaggtctgcgtctgaaccagcttagcccacctgcatcgtcgtcgcttttatattaatcagctcacgagtactacgagacaaacgacccagagtacaaggtccccgccagccgttgcccaccgtccgtccaagactcatgtgagccgcgagcccgcgagtgatgagcgccgccgccgccggtgccaagaagcgtctcagcgtcggcgccatcgccggcggagggttcgcgctcgggtgcggctgcagtggacgccaaggccgtggcggtggcggtggcgtcgtcggcggcggcgtccacgtcgccctactccgcggccggcacggagacgacgacgaccacggcgacgaccgcgacgtggcgcagggccaggacgccgccgcaccgcccgtcgtcgtcggcgtccgggtccacgggcacgctcaccgtgccctccgcgtcgtcgtcgtcgtcctttccgtgggagcgagcggacgccgagggtgacggcgatgccggcgacgaggtggactgcaagggggacgccacgaccacgacgagcttctccggcctgctgcgccagctcaacgagctcgagcagagcgtcgtgtcgtgggggcggaagagcgccagcaaggatcacttgtcgccacctccacggccgttaccagcgctaccagtgaagcaacgacttgcgcacagctgtgatggcgaccgcaaagaaggccacggcaacttctctccgccgccgccgcctcctcatttccagtttcagattacgcagcagcgccagaaggcaaagagcatggataaaggagacagacaggtcgaagtggcccactccaagtccatgcaaccgccaccgccaccgccgccgccgcctccaccattaccactgcagccggagcggcagttcaaggcgcagagcacggacgacgacaaaggcggcaaaaaagaagacgccagcatgttcccgacaccgccgcaggctccgtaccacctgaaatccaagagctcggttctcgacgggagcgtgggcgtggcggtggtgaagcagtccgacgacccgctgggcgacttccggcgctccatggtgaacatgatcgtggagaaccggatcgtgacgggcgaggagctccgcgagctcctccgccacttcctcgcgctgaacgcgccgcgccaccacgaagccatcctcgcggccttcaccgagatctgggacgaggcgttctccgccaggacgacgacgacgatggcgactccgccgcggccgcggcccagcgcaccgacgccaccgcgccgccggcacgccccgcctacgcggtcgtggcgttaactcgtactacatggtcaccctcacccgtcagagaatagttttagcaggtcaacttctcgaaaaaacaactacgccaaactatttttaactcgtactacatggtcacccgtcatagtagttagcatgcatgggtttcgtgcaatgtcatctgtgcagtcacgcagatgctctccggatctgtttgataatgcttacgaatctgttcgactaaaaaaaaaaaaaaaa

SEQ ID NO: 23094 - DNA, 7287 bp, Zea mays
gggattttgaacccgacgtgaatcgaacacgcaaccttctgatctggagtcagacgcgctaccattgcgccacggatccggttgtttatcttacacaaactttactttataagcaaatacatcttcccttcgcaaaagagagagacattttttctaaggcgatttgtagtgacaacgcgtgttaatatgtgcctagacattcaatattatgcactgtgcaacagcctcaaatgaaaaaaaatacaaaacgaaaacgatcgtgtaaagagtctccctttgtcatttttttacacagcaatttgtgctatggaaaccggaccaaaaaaaaaacgagtggaattgtcaatatcacaagagtgtgcagatggttaggtaccagagcagaaagccaaatagaatcatcttaatatgaggaatgaagtcatcccatcaaatcttaggaatgcaccaccttaatttggatgatatgatttctcaaaccaaacactctggtaatcaccgactgaattctaatcctgtggcaaggcctgctagctccatgaccaccgattctggcccattgcatggacgaatgccctgacatgacatctgaacccagttgggtggtctctggtctttctagttcgcggtgaaagtgaaacactgatgaaactagtgcagcactgcagctggaatggaatctcaccatcttgtcgtctccctattggtgcggtggtgccacctgacgccaacgttcgcggctgttcgtccccctcggcacgctcgtgaacccgatacaccacgcgccatgaaaccccgagccctctcgctcccgttcgcggccgtttccgtatcgtggaacgagcagtcacggcgacccaccgaatacgtccaagatctctatgcccaaaggcgaggaggaaaagggccttgtcgcctcccacctcgcccccatccgcttggacctctcctcctgtcgtccatggcgtccctttccactttcacatcgccgacgagtcctcaccattgacatgcacgacggcactggtacccagctttccgttttggaccccagtgtctgtcgccgttccacggctctacctgtgtgcttttcaaaaaattctacttgcccgcgctgccgcgcagataattgtcacccctgcgccccgcgctataaaaaagctcacctcgccgatttctcggtcaaacccaaacgcagccgaaaatcagaacaactacaaaaaccaaaatgcctcatctccaccactactcacccgtgctactgctcctcgccgtcttcgtctacctatcgacacgctacgtgcacggtgaccatgccgacggcggccaccaggaccttcccgccctgctctccttcaaggcgtacaacccgaacgccacggccctggcgtcctgggtcggccccagcccgtgcaccggcacgtggttcggggtcaggtgctacaggggcagggtggcgggggtcttcctggacagcgcctcgctggccggcaccgtggcgccgctgctcgggctcggccgaatcagggtgctcgccgtcaggaacaactccctgtccggcaccctccccccgctggacaactccacggcctccccgtggctgaggcacctgctcgtctcccacaacaagctcagcggaagcctcagcatctcgctggccgctctacgcaccctgagagcagagcacaacggcttccgtggaggcctggaagcgctgcgcgtcccgatgctcaggagcttcaacgtgtcagggaacaggctcgccggggagatctccggcgacctgtccaggttcccgagctccgctttcggtgacaatcttgctctctgtggtccgcctctgccacaatgtgtccatgcgtacgatgctctaggccggtcatcaggtaactcgagcactagtgctactgccgctgaatctccaggcgatagtgtgggtgtttcttctagcaacgggggattcagtaagattagcctgactgcgctcatggccacgggcattggcaacgcggtgctcgtcacggtctcgctggccatcacggtggccatgttcgtctacatgaggagaaagctccggtccgcgagtgatgctcccgacgcggggctgtgcttcgaggaggaagacaagagagcccaggggggagacaggtgccacaagaccggcgggctcgtctgcttcgagggcggcgacgagctgcggctggacagcctcctcaaggcatccgcagaggtgcttggcaagggcgtgtccgggagcacgtacaaggcggtgctagaggacggcgtcttggtggccgtcaagcgcctcagcgcgctgcagttccccgccggccggagcaaggcgttcgaccgccacatgcggctcgtcggccggctccggcaccggcacgtcgtcagcctcagggcgtactgcaactccaacggggagcggctgctcgtctacgacttcctcccaaacgggagcctccagtcccttctgcaagccaacggtgcgctatggaaatattatccaatctgcatgcagttgctgcaagagagtgagtgtctgttcttgacggactgttgctgctgctgctggctcgttgcaggaggaggcgcgaggaatctggactggacggcgaggaagagcatcttgttcggcgcggcgcagggcctgaactacatccacacgttcccggcgcgcccggcgctggtgcacgcgaacgtgaagccgtccaacatcctcctgggcgagcgcggcggcgcgtgcgtgtccgagtgcgggctcatgcgctacgccaccaacatccagcagtccatcgccccgcaggccacccggacgcggtgcccgcccgagctgttcctggagcgggacacgggcacgacgacgtcggcgcccgcgtcgagcgggtggcacgggtacgcggccccggagctggcttccggcgcggccgcgcgggcgacgcaggaatcggacgtgtacagctttggaatggtgcttcttgaggtggtggctggcgagggtagcgatgagacgatggggatggtgaagatcggcatgctgtgcaccgccgaggcgccggaggagcggcccacgatggcgcaggtgctcgccatgatgagcgagttcgtgtgaagcagttgcccttagcgagactggtagattgccaagtgtattgaggcaagatatttgttcgtcggcagataaatgttgtgatctcgtggcggttcggtacaattattccaattccaacatcattacgaacgtgtcttcttcattttattccttctctccattctacgcttggagcgattcatccgtggtcgtggactcgtagtcacgcctaggaatagcaaggaatctaattcgggcctgatattaatattcgttcataatatatctatagttgaaataatatctatccgggcccatactcgtggatagaaatttgtgtccatatccacggatttcaaatatgcctcgtatgtgacataaaattcttctcaattcatcatcatacgtagctaaaaataataatagaataattataaaactacacatatcttttaacaagcaatattctcaatatgaccatgaaaggggcctagactaaaaggagtgggaagtggggaaccagcgctagactaatagtgtgtttggtttgaggaatgaagtgatccatcttcttctcacttctcacttttttttatttggtgtgtggaatagaatgcgttgatccatcatcacatcatccctcataagccaataattagtatatacatgaggagtgggttgattctaccaaaaatgatggagtgaacttatgatgcatcacctcgtgaagcataaagtgactctacaaaccaaacacacaatataaaagtgtgaaatgacgatgaaaacatgtactgaagagcccagagcgggtaggcaggtgaccgccacatgattgagatgcaagcaagaaagaccagccatcggccagccgccagcggtgttgcggcctacacaacttggaaagggcacgggcgcaacgaagcaagccagtaaggctaaaaggggtggtcaccggtggagaatcgggagtgtttggcgtggggtttagtcgttcatggagctagatttactctttgttatgttatatgaccaaaaaaactataacccgattttggatattcaatggataacccgcgggtgggatataatatcctaatctggatccacccgatcttggttcggatacaggtctaactcataagtcaaaaaatatatcgatatctagctctattggaatcgaattgcgacgaatatctgatttcaggatcaaattgccatcctattcacggcttaagtctattaagttttctttcgaaaactattttttataagagaaagagttgaaaataaatttatttttttttcaaaaaggaaacttgtggacgtgcggattgttcgctccattgcatcctttgccatggcccaaagtcagcggcacattgagcccagttagaactagcgagcttaggtcaatggctcgatcaatgggccaggcccgaagcacaacgagcctattttgcacgttctctacgtgacagcggaaataggcccgaagctggactggcccgtcggcccgaagaaaaaatagcgttccattaaaaattctttcaatgcagaaatgacagcggtgcagtgtgatattacgaacccctgcagattaaaataaaaaaaactgcagcgaatacagctttagattgaactaaaaaaacgtagcggttgcggtgctttaacacgaagcgaacactccctagagtgcacgtcacgtagattatttactatatattatttgtttactttgagctccttgtatctcagtgcgtggatggcgatggcacgccattttgtttcagcttccagcgcgccatctttctttcagcatgccaattgccagccatgttgatgcagtcggtaggggcgctgggcagattccgccgaagactgccagccatgctgatgcagtgggtacgaagacaagtagacaactcatctgtggaccagtttgaaagagcgagccgcacatatacggacataccacatggcgcatggctgtcaacaccaatcatttcgatctttggatctctcaacagccctcaaaaccaaccaacggcctaatatcggactcggtgccacagcatccgtttgcagactataaaaattaacgctctgttgattctgaacattttctttgacggctttctgccagtgttcaatccagatgattcttcgccggaccaaatttctcaattgtattaccgtatttttatttctttattgtccccactgaacttggatgcacgaattgaaggcatgcagcaaatgccatataatctatcagattatcactagcgttttttctttgcagaaggcaaagaaccacttgaaattgccgagacaaattcgttggtcgcaaatacctcatactgcacgctagataaccttcgttggccgcagtcccgcagatagagaatcttatacctcagattgaacgctagatgggcacacgatattccgctccccttttcgatgtgttctttttttttttttttttaagaatcaaataaatcatctcattgataaccagaaaacggggcaggcacatgatcgccgccacaaacaatggagcgtcgacgcacgtaccaccacgcgcacacctcctcctccgccgccgactccatacatacagacacacgcccgccgaaacaactcacacagacacgcgcacgacacggactccactcgcgccagacgaatcacaaatcaagcacaaaccacgcgtccagcgcggatctagcagaagaggtagccgaaggcggcggcggcgagggaggccgcggcgaggggcacggcggccgcggcgtcggaggcgggggccggggcgggggcctcggcggctgcggcggacgccacgagcgcggcggccatggcggcgacggcgacgaacttcatcctgaggccggccatctgcgagtgtgtagtgcagctagcgagtcgggtttttattgggccgcgcgggatctctctacgagagtatgaagcagtagaagtgtagagagatgcgcgcaggcgacgggctggctcgagctggatggaggtgtcggcccgcccggcgctggctcgagggttttatagaggcgggcaggggcgcaggccggagagggccccccgcgcttggcgcggccaggtaggttgcgtgaggcggtggggggctggctggctggggacgaccgggaagggccccgcacgacgcgcggctggctggccatttgtcgggttccgccgcgtttggtgaagcggccgggcagcctggcatcgccttgcggttgggcgggcgccgcggggccgttgcccgttggggccctctctgccctgccgattgctgtgctgactgctgaccatgcgcgcgtctgagcgcgtcgccgcccgcccgcggtgcgcgtcctcaagacggcacgacccgcgccgaggaaacttcgttcgtgcgcgtattgcttggtgctacaagcaggcagaggcagcacagcactacagatgcaagcaagcgattctggctaacttgacaaaaaatagttacttgaaaacgttagaaaaaagtccacattaccctcctcaagcttaggctacgtataaataaccttataaattaatatttagttcagtttactctatccaacggtttcatttggtctagtttatatcttaaaaagattcttatttttatctcactatgtgcaaattatgttttaattccaatttttattacgtcacagaagacatcatggttgtgttaaaatatattgcaaattttaacattatgctatacacggtattgtacctctagttttatttattaataaatctctaagccattaaaaataatgacagaatataagatatgtctttctaacataatatatgatatcctctgtcaccacaacctacgcatgaagaaacaaaaataacaaatcttattatggtgtaaattagatcaacgtaaatacttgaagaaagtaaattgaacaaaatatagactttaaagaataatctaaacacatttgaaatttgaaggaggtaatttagatttttttttcctagcgcgcttcatggtatagcgtatggtcttattgagattctcgtgttttctccaaaagatgcgtccaaacttcaataggatccttcatctatcttatgcatggaaataagcttcaccatggatcaaaagtagggatggcaacgggtacatatctattgga

SEQ ID NO: 23095 - DNA, 2135 bp, Zea mays
ttttttttttttttttaagcagacagatcattttcttctactgctagtatttaatttaatctattagactgcaaggtagcatagcaaccaacaaaccagtcactgatacatatatggtgaccgcagctctgttcttatagatcatacagcacacctgcactacctgcatgactgcatgatgtgaagtaggcagccttctgctagccctcgactaatcagactacattctcctctccccggttcacaaaccttgcccgatggttgtgacctgtgactgaggaaccaccacgaaagcagccaaatagaacagtatctttgcaccgacggagacatcagtaaacttcagatgcctccctcaggggtacgttcatgctgctttccattgtttgccacccaagcccagagctgacgctctgcatcattgtgacgaactcgccatagttgttggtctggccgtcattgttctgatcgacctgataaatggtgttctcaaggaaagcatctttcatctcgtgttccactgaagccttttgaagctcgtcgacagtgatgtaatcacctccatctttgtcgaaatatgttaaggccgccatcaagtgttctttgtgttctgttttatttaggggcactgttacagcaataaactcttcccagttgatattggtgttgccgtcataatcatccgcttccacgatatcactaatctcaatgtttttaaacactgagccgcatttgctcaaaccttctttaagctcagacaaagtaatcacaacactgtttccattgtccattgccttgaacattcctcttaacctagcaatctcctcttctgaaagatgcttagcaataacctgtagagccaatttctttgatttattcactgcaggtaatttgttgataccagaaagaacagttggatccagagtttgatgagtaaccactccattatcacatatccatggatgctttagaacttcatgggctttcaatctctccgatggacaagggcagagcatttttcttataagatcctttgcgctgtccgaaatcatgtgccactggtctgattcaaaatcaaaatgcccatcccgcactttgtcaagtactccttcatgtgtatctgcccaaaatggtggcacgccacttagcagtacatagagtatcactccagctgtccacacatcagcctctggtccataatgtttctgcaatacttctggagcaatataatacgggcttccgactgtttcagtgaagacctcacctggtttgaagaacacagagagaccaaagtcgattacttttatcgacaaatcatcgtctttatcctgtaagaggaagttttctggcttaagatcccggtgcatgacaccaagtgaatggaagttctctatgacgccaacaatagtccttataagatgtgcagccttctgctcgctgtagttccccttcttaatccggtcatacagctcgccgccttcgcagagctccatgacaatgtgcacggcctcctcgtcctcgtacgcttccttgatggcgactacatccttttgccctgaaaggtagcgcattatctggacctcacggcgcacgtcttcaacatcttgcatgttccggaaccttgtcttcaggatggacttgcatgcgaactgacacccagtgctggtctcggtgcagaggtaggtggtcccagtgagaccctctccaagctgccggccaatggtataatgctctgtgacattaggagtctctcgaccaagaacagagatggacgttaaagtctgcctcagtccttgccgcataaggtctgctatgctcggtctagatggccctgtgtagcaatcctcagtatcgtccccatcacagtgcctagaagccagaggctccttctgaaagtggttgtagctgttgtaattgctcccgtacccgtaggttccattttggcattggtttcccattaatgcaactgcactgacgctgcggcctcgatcggagccgcgaggcgggagagctggggggagggaccgtcgccggaatccctgcttccccaggggcctaaacgcaaaaacgagaggagaagaaaaatggagctagagcactttttgattaggatgttctaggtaatggtctcgtgc

SEQ ID NO: 23096 - DNA, 2461 bp, Zea mays
tttttttttttttttttcctttttttttttttttttttttttttttctccaacaacataaatatgacacttgaaagaaagaagaaaaaacatggagatgcatcattgtttagatatcacccaagctttctgccttatgggttcaatcagatatgtaataaacttatacagacatcgaccacatgccatgcagaaaagtatatatggattgtccaacaaaaagaaaacaggtaacgggcatgtacatatcaatgtcaacatgggcgggtgtcagtgttaccacttagcatcaggtaaagggcagacacaacataacagaacaacaacaacaacaacaacctactcgcttggggtagtcagaagaattccaggaaggaaataacaggacagggaaccaacatcagcagctccatccacagagacaaaagtgcgtgtccactcggatgccaccatctccgtcttcacaagccaacaggtcttctccccacgtatacacagcccatcctccgattactcgattcagtctgtcagagtaatgcatacaccttcagaggaacaagaatcctttcatttctttttgtaccctcgcatccacagcgccgctgcttattttcctggagcagcagctgctgcctgcaccttgggccctttggcatcaggaacacgcttgacgctctgcaggatcgacttctcatacctctgcatcccgttcgccgacctccatgcactacacggcgtgcagaaccatttacctctcgggacagaactgcgcggtggatccatgcagtaagtgtggtaagcttcgtcacagccatcacacaacactattttctcgtcgtccttgttcttgaagcagcgtctgcacaggcaagacgggcagtaccagcattttagattcctctgcttctcgcttgcaatctggctttctttcaggcacagggcatgatagaacttgaaagaacagtagccatgcccgcataccacgaacttcttgttctcatcttcacacgtgccacaaagcttgcacaagtttgctagagcggttatcgagaggtctggttcactgtcttcgacaatgcttgacactgagctctcctgtgttttgacggccaattcaggttcttcggcaggttcttctggcttctccacctcaagccactcgcatacatcgcagccttcatgtgctctgccatggttgttgctctttaaaggtacgtctggttcgacgcaggtgggacagtaccattttgctggggcctcttcatcaatggcaagcttgagacatgaaacatggtacgcggcttcacacctgtcacagataattcttcctttgctgtctgcctttctaccacaatccttgcaaattccatccgatccagatgtcccagttcgtcttggtatggtagaatagccagaatcgcatgggggagtgaacttccttagggctttgcgggtgacaccaaccagacttgtttcctaataaatggtgcagtcagtgatgaatgggatttaacaaatcctaatgacgaaacaatggccagcagacatgttcatagcatgccactcacctctatcttgtgttcagccacatcaatttctgaaatgtcagaagcctacaaagaatatttctataagcaatggccacataagtggaacgatttcaaaaatacattgccatgaatcaaaatatgtggctatcaccataaattatgccaatgaagcaccaacagaaaatcatgttacctgcttttgattagaagcttgtgaaatcagtaagagactgcttgccagaccagccatttcttggccaacgtgttcaaacttcttccatatctagataataaaccaatatgtatacatattaaaaaaacagcattgaccgtatgttttcaactgcatgtttatggtaatttttgggggtgttccgtacatgaatagcagcaaacaaaagaatttacatatgagagaaaaatggaaaaacaaatatcagaggaccactttggccattgagatatataggaggtactaacaaaaaaaaaactaatttcttatcccgtggcccctaaaatattaatataactttcctgttttaaaataattaccttctttcattcaaggacagctcacagcagtgaacaaggtaaataaatgcttcctcacaatacatggattgcaacatacttattgaatagttgtgtatggaagcgtgatgcaacccatgtctgatttatatgcattcatgactgccatcgccttgtgattcacttaaagagagaagcccaagggatttggcaaggtgaggtcaagtgcagcggatgacacaggcagagaggaacaaagcacagattcatgaagaccaagacagcagatcccttcccagtaaaaacagctattagatgtcctttattggaaaaggaggcattaccctgcaggtcgactcggtaggacccccgaggaccgag

SEQ ID NO: 23097 - DNA, 949 bp, Zea mays
ttttttttttttttttcatagggtgggccctctagcctctttctcatctatattccatatgagtagctaatatattctacacgagacgatacatttgtatatgttctatatatatatatatatatgtatatatatatatatagacgtgatatcctttagaaatatattcggtatttaccacgtaatccttcattagtgtttctcaacatgtacaacccaattggcgccacctccgtggattccggcttcctacggtgctgcactgcagcgactccccgctcgccgagctactccgacgacgtgtacgcgggccgccgagggggaagctggtggtacgccgtccgctgcagcttgggcttgaggggctcggctgcgggcaccgtcgtcgggctgttgctgctcacgccttgctgctgcagacacccaccagggggggtggggttagctctgacatgtgagtatatcgcccgcggttactcacgcgcggtctttgggctgcgaccagttgagttgacgagtaatttgctaccttgccgagcacccaatctgcggagtcgaagtaggcgcgctcgtggtccttgttgatgagcgccttcttcggagaaatgcctccgtacttgccctgtagaggtgcctcctccctctgtgtgcctgctctgctctcttggttgaagcttgccatctgcaacagcgctcccctctccccagcaagcagcaacacgcaacgtatacgacaacctgtaccagacagagatctgcagctactgacggaagagacgaaggcagtacgatgatatagccggtggagactggagagagatgagaggagaggacaggagacccgtatcacgttcgttgatccatcagcatagttgatgtccaggcgaccgtttcaggaaaggaactaggaagcggggcggcgcgggcggggagtttggtctcacaaaca

SEQ ID NO: 23098 - DNA, 1274 bp, Zea mays
accaaccaacgccctttcccttgccatttttggtgagtgcgccctttcccttcctccccagatccccgtccccgttttccacttttgcctccgccccaattcggataacaaacccctccgcctcgtcgcgtctcctcccagccgagccgatccggtagagagagggagagggagggactgagggaggaggagctgggttccggtcccggccgcccggccggctgcgcgattcgattgcagctctcgtccccgggcggcgtccaggatggtgcggggcaagacgcagatgaagcggatagagaacccgaccagccgccaggtcaccttctccaagcgccgcaacggcctgctcaagaaggcgttcgagctctccgtcctctgcgacgccgaggtcgccctcgtcgtcttctccccgcgcggcaagctctacgaattcgccagcggaagtgcgcagaaaacgattgaacgttatagaacatacacaaaggataatgtcagcaacaagacagtgcagcaggatattgagcgagtaaaagctgatgcggatggcctgtcaaagagactcgaagcacttgaagcttacaaaaggaaacttttgggtgagaggttggaagactgctccattgaagagctgcacagtttggaagtcaagcttgagaagagcctgcattgcatcaggggaagaaagactgagctgctggaggagcaagtccgtaagctgaagcagaaggagatgagtctgcgcaagagcaacgaagatttgcgtgaaaagtgcaagaagcagccgcctgtgccgatggcttcggcgccgcctcgtgcgccggcagtcgacaacgtggaggacggtcaccgggagccgaaggacgacgggatggacgtggagacggagctgtacataggattgcccggcagagactaccgctcaagcaaagacaaggctgcagtggcggtcaggtcaggctagcagctacctcagccacgcacaggcccaatcaacgcaagctagctagctgagaataatcttttagatctctggtagtgtggagatcgagatgcaagccaagcaatgtgatatcgcgttgtgtgttaccaacctgtcagtctgtgtatcatcccgtcccgtccgtcagagtctcagagaacgaacacttcttctccctgtagctagctgctcctgcttgtgtccagatcttctgttcgatcgggtttgggactaaaaaaaaaaaaaaaaaagcggccaaaaaaaaaaaaaaaaaaaaaaaaaaaaaaaaaaa

SEQ ID NO: 23099 - DNA, 1420 bp, Zea mays
atataccctttcgtctccgcccagcagcaacggcacccaccgaatccgcccctccctctttccgttccgcctcgtcgcgctcgctctcgctgcgccgcccgccccacctcacggagctcacggcaacaccggcagggacggaaaaggaaagccgaggaggcgaggagagagagatacaaggcaggcagccaggcacaggcagcccgcggctggctacggggccaaaacccttacgcgcgacgcggccccctcctcttcttctctctcccaccaccgccctccccttgccatttttgccgcaggagccgccgccatccgatccggaagagggaggaggggggagggaggaggatctgtgtcccgattcgattggagctctcgtccccggcggtccaggatggtgcggggcaagacgcagatgaagcggatagagaacccggccagtcgccaggtcaccttctccaagcgccgcaacggcctgctcaagaaggcgttcgagctctccgtcctctgcgacgccgaggtcgcgctcgtcgtcttctccccgcgcggcaagctctacgaattcgccagcggaagtgcccagaaaacaattgaacgttatagaacgtacacaaaggataatgtcagcaacaagacagcacatcaggacattgagcaagtaaaagctgatgctgagggcctggcaaagaaactggaagcacttgaagcttacaaaagaaaacttttgggtgagaggttggaagaatgctcctttgaagaactgcacagtttggaagtgaaactcgaaaagagccttcattgcatcaggggaagaaagactcagctgctggaggagcaactccataagctgaaggagaaggagatgaatctgcgcaagagcaacgaagatttacgtgaaaagtgcaagaagcagccgccgccgccgccgcctatgctgatggctcctccgccgcctccagcgccggcagccatcgatcacacggggccgaaggatgtcgggatggacgtggagacggagctgtacataggattgcccggcagagattaccgctcaaacaacaaagacatgactgcacagtagctgtcaggtcaggtcaggtcaggctagccagcagtgcagagaataatcttagatctgtggtgcggagaactggagatgcaagccaagcccaagccaatcaacatgataaggatcatgagtgtcgcgtcgtgttttacaaacctgtccaccgtccgtcaaaggcacatgcgccagaacgtccgtcagagaacacttaccccctcatctccctctattagctagctgctccggcctgctcatgtcgaaaccttctgttcaagtatgttctcctcctgatgtaaaaaaaaaaaaaaaaaaaaaaaaaaaaagtcaaacaaaaactaaaaaaactcaaaa

SEQ ID NO: 23100 - DNA, 1339 bp, Zea mays
ccacgcgtccggccaaaacccttacgcgcgacgcggccccctccgcacgagaccattacctccaccgccctccccgtgcaatttttggtgagtgccccctttcccttccctagaccagatcctcgccccgttttccacttttgcctccaccgccggcccaattcggataacaagctccctccgcctcgccgcgtctcctcccagccgcaggagccgccgccatccgatccggaagagggaggaggggggagggaggaggatctgtgtcccgattcgattggagctctcgtccccggcggtccaggatggtgcggggcaagacgcagatgaagcggatagagaacccggccagtcgccaggtcaccttctccaagcgccgcaacggcctgctcaagaaggcgttcgagctctccgtcctctgcgacgccgaggtcgcgctcgtcgtcttctccccgcgcggcaagctctacgaattcgccagcggaagtgcccagaaaacaattgaacgttatagaacgtacacaaaggataatgtcagcaacaagacagcacatcaggacattgagcaagtaaaagctgatgctgagggcctggcaaagaaactggaagcacttgaagcttacaaaagaaaacttttgggtgagaggttggaagaatgctcctttgaagaactgcacagtttggaagtgaaactcgaaaagagccttcattgcatcaggggaagaaagactcagctgctggaggagcaactccataagctgaaggagaaggagatgaatctgcgcaagagcaacgaagatttacgtgaaaagtgcaagaagcagccgccgccgccgccgcctatgctgatggctcctccgccgcctccagcgccggcagccatcgatcacacggggccgaaggatgtcgggatggacgtggagacggagctgtacataggattgcccggcagagattaccgctcaaacaacaaagacatgactgcacagtagctgtcaggtcaggtcaggtcaggctagccagcagtgcagagaataatcttagatctgtggtgcggagaactggagatgcaagccaagcccaagccaatcaacatgataaggatcatgagtgtcgcgtcgtgttttacaaacctgtccaccgtccgtcaaaggcacatgcgccagaacgtccgtcagagaacacttaccccctcatctccctctattagctagctgctccggcctgctcatgtcgaaaccttctgttcaagtatgttctcctcctgatgaattccctgcccggcatgcattggtgagcttcttctcgagaagaagtgggtggggtggggacactgtcg

SEQ ID NO: 23101 - DNA, 1346 bp, Zea mays
  misc_feature (8)..(8): n is a, c, g, or t
ggccgggnaaaaaaaaaaaaaaaaaaaaaaaaaatgggtacccccccccccgaagccccccacgcctccccacgaaaaccctaaaccctcgctacccggcggcggctacaagctcttcgtcggttcagcaccatgaggccaccggctagaggaggacgtggtgggaggggtggcaggttcgatggcggcggccgtgggggcggcggcggcggccgtgggtttggcggtggtagaggcgggagaggggacaggggagggagaggtggcaggacccccagaggcggccgtggcggcggtggcaggggtggccgcggcggtggcatgaagggcgggagcaaggccgtcgtggtggcgcacaagcacgccggtgtcttcatctccaagtccaaggaggatgcgctctgcaccaagaacatggtcccgggagagtccgtgtacggagagaagcgtgtctccgttcagaatgaggatggaacaaaagtcgaatacagggtgtggaaccccttccgttccaagctggctgctgctgtgcttggtggtgttgacaacatctggattgctcctggtacccgtgtgctgtatcttggtgctgcttctggcacaactgtatctcatgtgtctgatattgtagggccggatggtctggtctacgctgttgagttctctcacaggagtggaagagaccttgtcaacatggcaaagaagaggaccaatgtgatccccattattgaggatgccaggcatccggcaaggtaccggatgttggttggcatggttgatgttatcttctctgatgttgcacagccagaccaggctaggatcttagcacttaatgcttcatacttcttgaagaacggtggccactttgtcatttcaatcaaggctaactgcatcgactccaccctgcctgctgaggccgtgtttgcagcggaagtggagaagctcaaggcggatcagttcaagcccgcggagcaggtgacgttggagccctacgagcgtgaccatgcatgtgttgtgggtgggtacagggtgcccaagaagcagaaggccacctcttaggatcggaatccgtgctcgtcttgcctaccaaagatgcttcgttgtattgtggtttattaagaaactttgaaggattagtcaaagtatgtgaaccttctgcagtgaaggctggtttagcagcgacagctgttagggtctgatgcagtgtttgctggtttaacagcattattattattattgttgatgaaacatgggtttggtttcgttgatctcactaaaagtgtcaatcttttggataaaaaaaaaaaaaaaaaaaaaaaaaaagagaagaaaaaaaaacggtggag

SEQ ID NO: 23102 - DNA, 1427 bp, Zea mays
ccaagctacggtatagggtatacgcacctccatcaccagttcagtccaccgttccgccggcccgcccgtacccgcctgcgcctacacatcgctgctccaggtccccatggcgaagactacgcaacccaccgcggggatgcgggatcccctgctccccacctccaccgccgcctcaccgccgccctacctcgacccgcatcccgccgactcctacacctacacggtcttccttgtccccgttcgcctccgccgcggcctctgtcgcggcggccgttgcatcgtcccctgcctcaccgttctcttcctcctcgcgctcgcgggcttcctcctctggcccgcggacccggacatctccctggcccgcctccacctagcgcacgtctccgtcgtggcacgccctgccgtcgccgtcactatatccgccacgctcaaggttcgcgttcgcaatcctgacctcttcgcgctcgactacacccgcctcgacgtcgctatcggctaccgcggtgcggggcttggccgggtaacatccggcggcggacgggtccgggcgcgcgctgtctcgtacgtcgacgccaacctgcagctcgacggcatacgcgtcgtcgaggacgcgatgtacctgctcgaggacctcgcgcaaggatccgtgcccttcgacaccatcgccgaggtcgagggccacctccacttccttttcctcagcatcccggtcaaggtgaatggttcgtttcttgttttttatattgttatatatgcagatctcatgaattgaattataaactgtatcagttttcggacttagacgcgtcttgtctttttccatggtattgcgaaagcccatatgactacgtctctacgacgttaaatttggtagggtattgacgtgaggtgaagcatttttggaattttcactgccgacaagagtttactattacccgcataatttatctgatatgattgttaaggtgtaaggtccatacaatggctagtgcattataaagaaaaacaacacagaacaatgcagaaaaaaagagaggagagaagacctactcaatcttcttgcattgatctagatatctttcatctgtcagacatggtatggccatcatattcagaacattcatggtgtaatgttagcaggatacatgctcgaattctctcattcatgattcactaaatgatatatttggttttttatatctgcaaaaggacataatgagacatgtcttaaatacttagcatttagcttccattttgattcattgttacttctaccatgatcagtgacaagttacctcctgtatgcagatatcatttttctataaaactttgattcaagatgtaacagtgatttagtatgttgcctctctaagaatgcattgtatcaaacatatcctttgtttgacttctttttacgaatttgaaac

SEQ ID NO: 23103 - DNA, 977 bp, Zea mays
cctgccgggacctccccccggcagtccaccgttccgccggcccgcccgtacccgcctgcgcctacacatcgctgctccaggtccccatggcgaagactacgcaacccaccgcggggatgcgggatcccctgctccccacctccaccgccgcctcaccgccgccctacctcgacccgcatcccgccgactcctacacctacacggtcttccttgtccccgttcgcctccgccgcggcctctgtcgcggcggccgttgcatcgtcccctgcctcaccgttctcttcctcctcgcgctcgcgggcttcctcctctggcccgcggacccggacatctccctggcccgcctccacctagcgcacgtctccgtcgtggcacgccctgccgtcgccgtcactatatccgccacgctcaaggttcgcgttcgcaatcctgacctcttcgcgctcgactacacccgcctcgacgtcgctatcggctaccgcggtgcggggcttggccgggtaacatccggcggcggacgggtccgggcgcgcgctgtctcgtacgtcgacgccaacctgcagctcgacggcatacgcgtcgtcgaggacgcgatgtacctgctcgaggacctcgcgcaaggatccgtgcccttcgacaccatcgccgaggtcgagggccacctccacttccttttcctcagcatcccggtcaaggggagaatatcttgcgtaatgcatattaatccacacaaccaaaccatagtacatcaggactgctatcctgagtgaattgcttatggcgtggaaatgtggaagggtgtaagctatgttgccttgcgaatggatcgtttgatttgtttctaacctttgcttccagtcgtggttgtaaaagtaagaaccaactaaggggtgtttgaatgtaattgagctaatagttagttcgcaaaaaaaaaaaaaaaaagaattagctaactaacaaataacaatctaaccatt

SEQ ID NO: 23104 - DNA, 1245 bp, Zea mays
gcttatctcttctccctcttctctcacctttcacaaaatctctctgtctcacgcctctcccgcgcgcccttctcccacgcacggccggctccgccgccggtcgcgccgccccgaccgcgccccgccctcgaggagcccaccccggccgccaccgcggccgcctctcccgcccccgatcgcgccccgccccgcccccgtggcggcggtggcaggggtggccgcggcggtggcatgaagggcgggagcaaggccgtcgtggtggcgcacaagcacgccggtgtcttcatctccaagtccaaggaggatgcgctctgcaccaagaacatggtcccgggagagtccgtgtacggagagaagcgtgtctccgttcagaatgaggatggaacaaaagtcgaatacagggtgtggaaccccttccgttccaagctggctgctgctgtgcttggtggtgttgacaacatctggattgctcctggtacccgtgtgctgtatcttggtgctgcttctggcacaaccgtatctcatgtgtctgatattgtagggccggatggtctggtctacgctgttgagttctctcacaggagtggaagagaccttgtcaacatggcaaagaagaggaccaatgtgatccccattattgaggatgccaggcatccggcaaggtaccggatgttggtaggcatggttgatgttatcttctctgatgttgcacagccagaccaggctaggatcttagcacttaatgcttcatacttcttgaagaatggtggccactttgtcatttcaatcaaggctaactgcatcgactccaccctgcctgctgaggccgtgtttgctgcggaagtggagaaactcaaggcggatcagttcaagcccgcggagcaggtgacgttggagccctacgagcgtgaccatgcatgtgttgtgggtgggtacagggtgcccaagaagcagaaggccacctcttagatccgaatccgtgctcgtcttgcctaccaaagatgcttcgttgtattgtggtttattaagaaactttgaaggattagtctaagtatgtgaaccttctgcagtgaaggctggtttagcagcgacagctgttagggtctgatgcagtgtttgctggtttaacaacattattattattgttgttgatgaaacatgggtttggtttcgttgatctcaaaaaaaaaaaaaaaaaaaaaaaaaaaccccgggcactctgcgttgttaccactgcttaaggaa

SEQ ID NO: 23105 - DNA, 1280 bp, Zea mays
tgcaggtttatagctgtgtttaggtctagtttagaaactctatttttcggagagatttatatttttataaagaaaaaataaattatttttttaagaaaataaaaatatcttattaaaaatatggttttctaaactagccttaaatattcgtcctgttaattgcttcgcggggctgcgttccaccagagatcgctatccagtatcccaaaacagagacagaactagaaacgctacaaaacaacatcattcggcacgcgccaatcgcgagctcccttcggccactccaccatcatcagcaattcagggagcccgccggcccgccccgccccgcctcgttacccgcccacccaccgctgcttctgcccgactgctccatggaggggaccacgcaacccaccgcgggggcgcgggaaaagctgctccccacctccgccgccgcctctctgccgccctacctcgacccgcaccccgccgactcctcctcctacgcggtcctcctcgtccccgtccgccgccgcctgcgccgcggcggccgctgcatcgccccctgcctcaccgccctcctcctcgcgctcgcgggcttcctcctctggccggccgacccggacatctccctcgcccgcttccacctggggcacgtctccgtcgtggcgcgccccgccgtcgccgtcaccatatccgccgcgctcaaggtccgcgtccgcaacccggacctcttcgcgctcgactacacccgcctcgacgtcgccatcggctaccgcggcaagccgcttggcctggtaacgtccggcggcggacgggtccaggcgcgcgctgtctcgtacgtcgacgccaacctgcagctcgacggcatacgcgtcgtcgaggacgcgatctacctgctcaaggacctcgcgcggggatccgtgccctttgacgccctcgccgaggtcgagggtcaccttcacttcttcttcctcagtatcccggtcaaggggagaatatcttgcgtggtgcatgttaatccacacaaccaaactatagtacatcaggactgctaccccgagtgaaatgcttacggcgtggaaggctgtgtgctatcttgccttgcgaatgggttgtttggttcgtttctaagcttcgcttggagccgttgtaaaagtaagaaacaactaaactctactgggtaatgtgcctattgtaaagccgttaacacgtcatgttaatatcaatcagtttccctactatgagaaaaatgaaaaaacgaatttttcttccgtccggtgatggttgagttcacc

SEQ ID NO: 23106 - DNA, 5114 bp, Zea mays
  misc_feature (5085)..(5085): n is a, c, g, or t
  misc_feature (5089)..(5089): n is a, c, g, or t
cacatgaaccctaaaccaaaagagattaactcacttgttttgcttggtgcttgggccttatggaaccgccgcaaccaatgttttggtacctaacccgatgagtgtagatacgagtgaagattttgaccctcggcccacacccaaccttaagttttgcgggtatggatgcgagtttttatttctacccacaggtgacccacactcgactcgaagtttggttcgtttttatttttacgtaaaaatgattgagatacaatattatatattttgaataagtaacttaactaatgattcatgaaatgttttattgttgctcaacgtgagaagacttagctaatgatggttgacaggttcgatcacgggcagatgttagctaatgacggttttaaaacaggtttagaattgcaccgacaggtacgatagggggcaagtttatgtagagctcacaaatgccatcgtggacagatttttcacggattcaatcgtagatagatttttgatgcagctgactcattgcctgggagttttaaaccctgatgttttaagtgtgtatggcatgggttgtacaagcttgtgcccaactcttctctttgtaatataatgatacatattttcctgcgtatgcatacgtattccagaaaaatcgatcccgatcaaattgaaatcaattgtactgttatttaataactattactccttccggtctagattataaaatattttaccttttctggattcaaagatttttttatgcacttagatatacactacacaataaaagcagtactacctttggtgtccattagttatagttttagatgactcaaacttataaaattttgacaatatataactattttattatttagttttgaaacctatgcacagatttatctacttttataaaagtattaatgaagtaagaatttatttatattgtaacaaaaaacatgaaagttataatatggagacacgttataatatggagaccgtgtcactattctaaacgacaactaatagaaaatcggaggcagtatatcttaaaaaggtcaaactgtcttataattttaatttagaacagatggatcaatatctaacatagaatgccaaattgacaccatccaggcaagtacgtactgaaggacctggaagtgtatcactgaaattacaaaacaccgtgtaattgtcaacaacaaagacttgtacactctacgtcataatatacagcagggcaagtaccctcaacagctcaaggcctcctagcaccaacagcaactggagaacggaaagatcgactaaaatgccggctattcgactgtataaagtcatctaacgggaagtactggcttatctactaaagacaattgttcggtggggtcatctctgcacaactttatatgtatccggggaaaagcagggaaagatgagaagccgccccccgatcatacttggagtctcatgaactagctcaccagctccacgaaaaacctgagcaacatgccccggcacgctttatttcaggacagcaattttagcccttgcttggcagctcattgctcaaatttctatcatgcctagttataaatttttacaggtctctcaaatgaatgccgattctgattaattgtgtgtgccttcctaggagctgtgtctggatgttccagtccaagatactgctcccaagctccatacatgtttctctgaaattttaaagctacagtatctgaatcttcaaaatagtctggacgaccaagtgaaatgtatgcaaacttccactttgagaaatcctcatctggaatcttaagctttctctgtatacgctctttgatagaagatagggtctcatcctcacgaataaccataaaaaaaggttctccaaagttctgaacttgcgtttggttttgagtatcttttgtaaaatgatatacatgaatcaatcgatcaaagggaccaaggtttttctcctcatctggaacctcctccgcacgcagtgtccagtactgatcattaatgttttcaatcttttcatttggtgcaaacaccttgtatatcttgtgataaaagacctcaagtaatctcagttcagcattgggatgagataactcaacctttgttttgatatcgtttagcacatcgccaacagtgctgttttttggcaatcttatactgtgaactgacacctcatcttttgtggcatgatggtatgtaacttttaatgtcttcagcgcttgtaattctggaagtggtatgtccaatacttcatagtacagaatatcagaagtctggttataatgaatcagcatgtccagtagacgttcaacgcctctgtactttattggctgaggcttaggctgctgcgaataacaattatgtgatgtaagccgaattttcgatgggtcatccacgccaagtttttcagctactttttccacgacttgatcatatgtgaaaatctttgacatctcgaggaaaaaatcgtcctccttgggcttctccagtgaacgaaagtggaccacctgtcggttacgtatatacgtcaaaaaggatgggacgtcaggaaatcgatatcggtcagcactatctgcctttgaagatttttgaaaacaaattatgtccccatcttcaagctggcaagatcggaacagaagcctgttatcaatgtattcacacatcacattgggttcgaacttaatttcctcataaagttcaatatcatcatcttgtgaaaaacctgccaacatctttagcttcggcagaatgtcctgtggtcttcctgaagcctttacaaagagcctaccaacataccgtagctgttccttttcaggttcatagagtttgaagagaagaaatatatcttctctagtcttgtctggaagaggaagaggtttaaggtccagtccaagttcaacttccaagaacaatttcaattcagcgttgtgggccttgttcaccaattcctttagctgtccaacagtatgcgcttcgtcttgaggacacaatggcctgttaggtcggtaagtatggttttgtcgcttggcccacagccaaaatcgttggaactgtgtgggaataccaaactcttttgctacctcctccttgaattgagcaaaggccatctgcttttggatacggaagcttgggactttatcatggtcaacaagatcaaaatatatgtctttccctatctgagtttttaagtcatcatcccttgcaaccttgattatggtatagaggtgtgcctcagctttttccttcttccgacgttccttctcttcacggtccttttccaatctaatccgaagatgctctgctatatctttcgcttccacattacagataattttgtccttgtcgctttcacgaatgtacacaagcatgtatgcatttgaatatttagtaaccttgaagggcgtgttgttcacgccaggatttgtctgaggtagctcctcctcaccaccatattgttcttccagtgccctctttgcatcttcttttgtcacacgctcatcatcaaacttgaaccattgatcagaaagggtaggtcgtatgaaagcataataatgtccaccatgaacaccaccgctatggacaagaacgctgtgaagggtataaaggttacgcacattcctgtcagcatcaggagataaatattttccatcatctctgtcaaggtccaattgaagtgggaattcatagcgatcatttatcttcaccatcgtgtcacgcatgaaatcatattcaaaacgttttagctgaagctgcagaacaggagggaagtcgataaaaagaactcctttctttgcatcctgcagaccatgcttatcggcatgatacttgttgtcaccttccaattgctccacttctacgtacttgtcaaatgaagcgtagacatcctgacaacctttgacatcaagctggagatcatagaaggattcctttcttgttgatttgaaatctacattgatgcactcaatgtagttcatgtggtgcccttcaaacaattgttgtattgtgccctctacaacagttcccttcatcttatcttccaacttctcagaaagaactctgttcaattcttgaacatcatgttgcataaatgaatcatgcatgtcccacccgaatgattttgtgagctcctttgtagagacactgctgtcattatactgcaacttatagaagagtgactgtagagctagtgggatgcttcctgagggcatatcgttctcggtggtgggcatgtgataaacagcctttctgaaatacgggatgtggtagagtgtctgaagaagagaattcatatagcaggtagcaccctgatttttaagaccaacatagccagtttcctttttagagtcataactccaatactcaacaactttacacacagcaacttcagcttccactatacaagtatcatttacaagataacccctacttgggttgtagagttcacccagcggcataaatgaagtgaaaccccaatcactttctcgagcagagaactgatgttgtgtttcttttcttattgtgaacttgttgtgaatctgattaaccacagagaggctgaattgtgcgtatctagtccatccatatggcaagactccagaatcagctacatccaaatacatagataagaattcaacattattcccccgagggaaaatcaaaattcgccacttgtagcctccaacaacaaaaatttcagagtagagcttctttgtgctaactcttgataaattctcaatggtccaagtaaatctcgagattggtggatcctctatctgttggttctccacggtagcagctggctcagcaggcacaacttccattggctgcgctccattgggcagctcctggtgcgggccatgcggcaccagcacctcctcttcctcctgctgttcctgctcggcgggcggcggcgaggtcgtcatgaccgggggcgtggacgtggtggtcggtagcgggggaggcagggagggaggtgcgtgtcaccggcggcgatgtggggggcccacctggaagtgggttacggaggtgggggtgggggaggaggtggaaatcgcgaggggatggggggcgagatgngaanaggcccggccggcctcgaggtaccc

SEQ ID NO: 23107 - DNA, 3011 bp, Zea mays
  misc_feature (1335)..(1335): n is a, c, g, or t
ttttttttttttttgcaagaaatgtatcattggaattacaaacatccgccgcgtcaataatatacagaaagagtcgaaagacaagtaccctcaacagctcaaggccacctagcaccaccaccaactgcagaacagagtgatcgactaaaacatcggccactcgactgtaaaaagttatcttatctactaaagacaattgtctggtggggtcatctctgtacaactttatatatccggggcagcaaaacaaacaggaaagatgacaagtcgcccgatcagtctcctctgaactagttccacagctccatcgaaaaacctgagcaacatgctctctatttcaagccagcaacttcagcctggcttggtattgagcggcagctcatcgctcaatttctaacatgcctagttataaatttttacaggtctctcgaatgaatgccggttctgattagccgtgtgtgccttcctaggagccgtgtccggatgttccagtccaagatactgctcccaagctccatacatgtttctctggaattttagggctacagtatctgaatcttcaaaatagtcaggacgaccgagtgaaatgtatgcaaacttccactttgagaaatcctcatctggaaccttaagctttttctgtatacgttctttgatagaagatagggtctcatcctcacgaataaccataaaaaaaggttctccaaagttctgaacttgcgtttggttttgagtgtcttttgtaaaatgatatacatgaatcaaacgatcgaaggggccaagatttttctcctcctctggaacctcctctgcacgcagtgtccagtactgatcattgatgttttcaatcttttcatttggtgcaaataccttgtatatcttgtgataaaagacctcaagtaatcttagctcagcattggtatgagacaactcaaccttcgttttgatatcattcagcacatcgccaacagtgctgttttttggtaatcttatactgtgaactgacacctcatcttttgtggcatgatggtaggtaacttttaatgccttcagcgcttgtaattctggaagtggtatgtccaatacttcatagtacagaatatcagaagtctggttataatgaatcagcatatccagtagacgttcaacgcctctgtactttattggttgaggcttaggctgctgcgaataacaattatgtgatgtaagacgaattttcgatgggtcatccacgccaagtttttcagctactttttccacgacttgatcatatgtgaaaatctttgacatctcaaggcaaaattcgtcgtccttgggcttctcccaatgaacggnaagtgcaccacctgccggttacgtcccggccccgccggcctcggggcgtcaggaaatcgatatcggtctgcactatctggttttgaaggcttttgaaaacaaattatatccccgtcttcaagctggcaagatcgaaacagaagcctgttgtcaatgtattcacacatcacattgggctcgaacttaatttcctcataaagttcaatatcatcatcctgtgaaaaacctgccaacatccttaacttcagcagaatgtcctgtggtcttcctgaagcctttacaaagagcctaccaacataccgcagctgttccttttcaggttcatagagtttgaagaaaagaaatatatcttctctagtcttgtcgggaagaggaagaggtttaaggtccagtccaagttcaacttccaagaacagtttcagttctgcgttgtgggccttgttcaccagttcctttagctgcccaacagtatgtgcttcgtcttgaggacacaatggcctgttaggtcggtaggtatcgttttgtcgcttggcccacagccaaaatcgttgaaactgtgtaggaataccaaactcttttgctacctcctccttgaattgagcaaaggtcatctgtttctggatacggaagcttgggactttattcatgatcaacaagatcaaaatatatgtctttccctatctgagcttttaagtcatcatcccttgcaaccttgattatagtatagaggtgtgcctccgctttttccttcttccgacgttccttctcttcacggtcattttctaatctaatccgaagatgctccgctatatctttctcatccacattacatataattttgtccttgtcactttcacgaatgtacacaagcatgtatgcatttgaatatttagtaaacttgaatggggtgttgtttaagccaggatttgtctgaggtagctcctcctcaccaccatattgctcttctagtgccctctttgcatcttcttttgtcacacgctcatcatcaaacttgaaccattgatcagaaagtgtaggtcgtatgaaagcatagtaatgtccaccatgaacaccaccactatggacaagaacactgtgaagggtataaagattacgcacattcctgtcagcatcaggagataaatattttccattatctctatcaagatccaattggagtggaaattcataacgatcgtttatcttcaccatcgtgtcacgcatgaaatcatactcaaaacgttttagctgaagttgcaaaacaggagggaagtcgataaaaagaactcctttttttgcatcctgcaggccatgtttgtcggcatgatacttgttgtcaccttccagacgctccacttctacgtacttatcaaatgaagcatagacatcctgacaacctttgacatcaagctggagatcatagaaggattcctttcttgttgatttgaaatccacattgatacactcaatgtagttcatgtggtgcccttcaaacaattgttgtatcgttccctccacaacagttccagatgtcaaaccttcatcttatcttccaacttctcggaaagaactctgttcaattcttgtacatcatgttgcataaatgaatcatgcatatcccacccaaacgattttgtgagctcctttgtagagacactgctgtcattatactgcaa

SEQ ID NO: 23108 - DNA, 2299 bp, Zea mays
  misc_feature (13)..(20): n is a, c, g, or t
ttttttttttttnnnnnnnncgttataaatatataaaccaaacgaacaccgcaccctttttttttttttttttaacaaactatattagttcaattattaattatgtttccatacaatcaccaaaatcacatatggctcaactagatgctttttaatttccttgcagatatatgttggttgagcctcttgggttgtttatataagaataaatggactggagagcaataaacctctctccttaactactctagtaaataaacaaaatgcgacatacactcttcgttttgcaatataaggaagtagccactctagtagataattaattaagaatccctcgatcgatcatcgttggattgaagtgtgcattagtcgtcgtcgtcgtcgtcggagttcgcccaggccatgcactctctctgaatctgccccagcgtcttggggccaccgccgccgccatgacgatacagctgctgcggcgtcgcactggtaatggcggtaccagcagcagcttggtgctgctgtgccgccgcatttctactggcaccagcagcagctgcttggtgctgcggctgttgtgctgctgcggtgccatactcgccatgatggtgatgtgctggcggtggcggctgcgatgaagcggcgcctgtgagttgctgtacgactgcacggaactggtcgggccggacgacgtggaccgccgtgtccgcggggtcccggcgtctccagtgcggcctggcggcgggcttgctgcaggaagctgcgtccacggcctgctgctgctgcttgttcttgctgctgttctccattaactactcgaccaggaggagctggtggcacgtggagcttatagtatatatatagctgttcagagctgatgagagatcgtctggtgggatgcggcgtagcgcgcggctatttatagttaagcaacggcggcggcgaagagaagtcatgccagcttggtgctgacatcactgcttttgctcggagcctcggacgagagtccagtgcacccacctccagcagcaacaggcaaccccaaaacggagtcaaaccaaaagcgtgggtggtcaaataaataatcctgcagcttcaggtaggtccggaccaggggcgtgctgcactccgtttgattccgaatcgatagagaccagggtcatgaatgaccaaccggtgacccatggccatgggccgagtggacgtcacgttgaaggcgtgggatatattgtggcgctatatatgctgcttttacctgcagagaaagatggttgtgctcacatgcatgcgacgactgcccaattcaattaagctctgagtacacatcgcaagtaccgaaatacattcaaattaaatcatgcatggcgatgcgcgcaaatgctcaaagttaactcaactttgtttatagaatttgatatttgaggaaatttcgagcggtttagcttatggattttgaacaagatgtaactttatagaaagtgtaaacttgattagccaagtgccagcttatttatgagttacatcgagttttcgtatttttaatccaaaatcaatcatgatataattgaattgcatatgagtgtaacttggctcgtgtcactagtagaaaactgctctatgcctacggtgaggtctaatttttaccaacggtttcggttatcgcacgctagtctggtggctccgatttcataaccaccagcagaaacatatttgtacttgtggttcacttaattaataaaaccgctagtgccaaccgtgcatttccactggcggttcacttaaaaatatagccaatgagaatgcactatttttagaggcggtttttaagtgaatcgacagcgcaaatgcgtttgcattgacagatccttacgaaaagtgcttatgatggttgtataaaaaccccttctttcgccccaattaatactgttcctcgcagccaccttccattgtcggttattttggaggtccagaggttttgatcttcattttttagaagaaggttgctaagaaaggttggtttatgtttatcttgccattttttgttcattcttccacaattttagccatattttgggtctaaggtttcaccatgtgttagagagaagagtaactaggttttttctctatttcatcaaataaggctgcttaagatggttagatattgtctctcttctctcccttttcatatttaattctcaatttagtttatccaagatatatttagttgtttaatgaatggtgcatgtgtttatatggagagagaggaagatagttttggtaattatgattttttgtgttcttgtgt

SEQ ID NO: 23109 - DNA, 2603 bp, Zea mays
  misc_feature (843)..(843): n is a, c, g, or t
ggcttacacggccagtattccatatggatcttggttcgccgatgcaagtggcccaagtcaccttcagcactgtggttgagcacatcggcacccgggacttggtgcaggaatttcttgccaacaaagtgttcccaacactgtctgggtggggaatgccgaagctgaaagagagtgtagataagtgaaaccttggacgattaccgtaccattttaaatttcaggatgtattcaaggagccatgtatcgaatggctggaaatgaatgaaacaatgtgtaatgaaagcttgggtaattttgcaaagaaggaagatcaattaatggttgtagccttcggtaatcgagagaaacgaaggttgaatagcattatggatgccctatagtttgattatccagactacccgaagatttctgaagaagctactagcgtaaaaaggaaaagaatcgttagtattatgaagagacaagtagtgagatctgtaaggaatagaagaagacggaaatgggtacgaagcaaaaaaataaaagaggctaagaaggggagtcctcacacacgaggccaaaatcccctccccaaagaagcagagaatgatgaagcctgaccgtgctagcaagaaaccttaggagttaccaaagaagattatcgagaccccctcgacttcatctatataacaaattttaagttctcctttattatttactgtatctttatcaatatatcaaatgttaagttctaaattcatcccatattcatcatatgttagaagatatatctagatagaattttcttttgttatatcttataatataaaatgagtttagagcttaaaatttaatatattggtnaatacaatggcgtaataaataatgaggtacatatattttgtaagaaaaaacttaaattttagtagtttgactggacgacaattgcacggaatattttattgcgcaacaattttcattctcagggccgtttagaaactctgttttcgaaaccacgttttataatgtcatagtttattgtatgccatgatataattatggtatcttttatataaatcaatctaacacttgtttagaaacacactatgtagttacagtgtatgacacttgtttagaaatacactatttagttacagtgtaggaaaataggaaaatgtagctacgtgcaagaaaaaaaaactttgtcaaaaaatagcatggtattggtgaaataatgtatgtgctgccaaacaccttttagggctttttaggactagtttagaaactctattttcctaaatgatttctatttttccaataaaaataaagtaatttctaagaaaatagaaaacccttaaaaaaataggatttcaaaaccaacccttagtatagaatatcatggtatacataaattagattacgatccaactacagatacaaccatagtttgttaaaggttttttataaagattattgagctggtggtggaagagtttaagtgttaaatatgacctacggttaatcacaatctaatagattagatggtttgcttgcacgcttgcatagaaagactgcttgtatagcagtcgttgccatcacggtattatcttgatactaaaaaaattatgtttccaaacatgcccttaacgttctaccgcaaagaaaaacgtctggagcaacgtcaagacaccccgggttccggccattacgcttctacttacagtgatcagcatactgctcaagggcatggtggtggcactacaaaaccaactgtgtacagcacccaaaggttccttcatgccgttagatcatcagatgaaaaaagattatcatttcctagaacgctgcttgacgtcaaactggtagtcatcatcgaggtcatcaacatcatcttcgatttcgtcaagaatcgattggttaatcttctttctagacaccctcctgtgcttcttgagttcaagacgaggctctgcttgcttcacccccatgacacctgttttgtacctgacatcaccttctctttttgttccaaatgtccgtagctggatttcttctctaattttgatctcatcaagcatctggagatagtatggatacctttcccagtcccccttcacagcacatccatgctcacccaggtgaacacaatcattaaataagcattttttgggctcgttctctttcagcgcttttcttatctcaggaaatgtttctgcaagactcttttttgtcactttcatcaaactaggctggttaaatccaggagtatcagcaaggaagcctccgctagctataggaagcaacgagacatggcgcgttgtgtgctttcctttaccacttttcttggacacagttccaacacgctgttcaccaaaccatttactattctgttcaactagtttatgtattggatcttcttctgatatgtcctggttacacctcagtgcattgatcaggctggacttcccaacgccgcttggaccaacaactacagttgtttgtccttccaacatctcttcaagagcagtaaatcctgattgcttatcaacacttagaaacagtggatcatagccccaactcctcaacctatcttcccagtatgctattgtctgctcgtcgacgag

SEQ ID NO: 23110 - DNA, 606 bp, Zea mays
  misc_feature (1)..(1): n is a, c, g, or t
nctccgaatgctggatgtcctcggcgaaggtgctcttgtccacgtacagcggaagagatgctgaggtcgccgtagaccaccccccagggctctggtacgccagcagcaaggtggtcttccacgagtctctctttggggacctcaggcccctaccgaactcgagatccatcgctcggcgaggcgagagccagcctacctgctagccttcactacttcacacataacactggcctttctttccgcacaattgaacgaacacaccagcttcgaaccacggcctttgttccaaatccccgagcagtgaagaatcttttttagcagcatcaacgcgtaccaaacgagcagctccccaagaacacgcggattgccgcgcctgccaagtctcctcgcggacgtcgcgatgcagggtgccgcggcaaggaggagggagccagggagggggactcggctcgccccggacgaagacgagaagccgggcgtacgtccactccagccgcgctacgctccatcactcgtcgaagtcacagctactactgggttggtggtatccattgatgatcggacaagactgctgcgaacgccaccaacactgtagcatacccgtct

SEQ ID NO: 23111 - DNA, 4090 bp, Zea mays
  misc_feature (615)..(615): n is a, c, g, or t
  misc_feature (3361)..(3361): n is a, c, g, or t
agctgaacgagacccatagtctaatcgatatgtaattctttctcctcccttgtctataaaaggggtgagtagagcaacatgaaagtggtttgacttggaactagatttcatatttcaagattctcaattttctaaagggcaagcataaagatgaactaaggatcattaggctagaacactcaccataaccaaatggaaaggaagaactaggaggtcatgacacttagttggtacttgagtttgtaatcttctttactacacacactgcggctcgagcctctctaagctaccttgtgttggtaaccagatacttccaagttcaacgtacaaccagcctacaccccccgcgcgctctatcagttacacttttcagcttttgggtgcatttcatactccaatgtcataacgcgatgatattttgcaccctaggtagggcagctctattttcttcttagatttggcatgttttgctatgcagtgcaaccatgacatcactagcatgcttgacagggggaccgggcacctccaacacctgctctaacaacttaggatgtgagccacgacataaataacattggagtctcatgcagtcttgcccatcactgcctatggtgngaggacacgctagtaaggacacacggtgttgtccccactggccttgctttggtttgtgtctcttgtagagcgcatgatgccctggagctgtcacaccatatgcctctatgaccacttggtgtgtcactccctaaaccttgtgtcaggatcatgacgaggcaacctaaagccctctttgtttgagttacaacttttggagtttttataaaaagttgttgcatgggtttttgattctgagaagccaatgataacttttcaatgatattattagctttttaaactcaaaaagctacgaaaagtctttaaaatcagattctttttacctttacgtataactcagtttttgtgagcttctagttttcgaaagctaaataaaaaaactatttgttttgtttcagtttttagctttttcagactgatgctgtccaaaagcaaaaccaaactgggcctaaaacgcacagactgatgctgtccaaaagcaaaaccaaactgggcctgaaacgcacacgctcacgcacagacgtgcacacagagttcgttaccgactcctactaattctacagtattttgactctatatattgcagctgtagaagtacgaacaattctctccctcgctatacagaacggcctcattatgttactgggaaaactgacaacagtcgtgattactatatcagatgttcataagaaaaagtcgcatcgtctcagcctcaatcaaagcacgtacaccatgccgacctccagcagtgacgccggcggcacgcgcagcgcgacgtccgggccgcggcagttgcgccgcaggaagttgtacccgacgtccaccgccaaccgcttgagcaccgacgacccgggcttgcactgcacgtgcgagtgccccaggatgaacgcagtgccggcctcccgggccgccgccagcgcctccagctcatccgcaacctgcttgttctccgcggcctccgggctcaccacgtggctgtcgatgaagaaccgcacctgcttcggccccgccgccgagctgatctccgcgtccctggggctcatgctgtcggcggccgtggcgcgcacctccacggtggacgctgccgaatgctgcacgctgtcctggaggtcgtagctggcgcggcgccgcagcgggttgctcgcgatcacggtcagccgccgctcctgctccccgggatctagctccagctcccgctcgctggcctcgctgcagcggtacgaggcgtccagcgttatgaacgtggccagggtctccacgagctccgtctcgaacgagtccacgtcctggtgcacgtcgcggtagccgtagcgcacgatgcaccggtacgagcggtggcccggcgggccgacacgcccgatgaggtaccgctccgccgggaatacgtacggcactggcaccgacttgacgcacacgaacaccagcacctggtggaacgccgggaggttggtcacgaaccgggagaagttggccgggacgcccgacgtcaggtctgtgtacacgaggccgatgccggggacgcggaccatgcccagcctgtccccgagggcgaggagccactccagggtcaccttgttgtgcaggtcgaactcgtacttcttgatggtcgtgtagtgccagatgagcatgacggccatcaggatgagcgccaggaggatggggagccacgcgccttccaggaacttgatcagggacgcggagaagtaaagcgcctcgatggatccaaagaacaggaggaaagccaacgccagcagcggtggcctgtgccagcagagaacgatgaccaaggatgtcaggaacgtggtcaccagcatcactgtgatcacagccaaacctgcggacagcatgcaactcgatcgtcagcaaggataatctgacgctgagtaacatagcaaaattaatcaagaagccaatcagagcggacactgtggtcaccagcatcaactagtgatcacagccaaaccagatgcatttcccatgtgttttgtatctctaaacccaacggtcacagcaatgcagaggatcataagcaaccaattgatctcggggatgtatatttggccatgaattttctcagatgtgtgtacaactttcactcgagggaagcagctcagggacaggctctggttgatgattgagaatgttccgctgatgattgcttggcttccgaccaccgaagccaaaattgccaatataagcactggccatctgatcttatctggaactgcgatgtaaaatccaacttgtgagctagagtaaaagtcatgatgttttgataagtaagcagcttgacccatgtatgccaaaatcagtgcggggtaaactagacaagtgaaagcaagctggattgcactgtatgagaaatgtccaagatctgcaaacattgcttctgatcctgtcatgcagagcaagattccaccaagtgacatccatccatattttctagtcttttttaagaacttgaacatgtaagacggatttagagcttggtagatctgaggattccagtggatgatattataaaggccaagagcactcatgcagaacagccaggcttagaactatcggggcggacagaaatccaaacccggtgcgtaccatagtgctggagggcaaataggaatgctaatatgacacaggttattggaatgacagcatattcacggtgatcccccggccgcgagaactcgaggcctgaaactgccgagaacacggatatagctggcgtgagaacaccgtccccgantaaccatgcatgtcccgatcataacccatgaccagcagagcgacgcgcagcttcctgtgccgctcaagccacacccttgatgcgggacttgtcggtgatttcaggagggcattccagcttgtaggtggaaagctcctcatcgccgatctgccggttcgggaggaggctcacattggcgtgcctgcaaatcagagagtagagggcaaacgttcctccctcgccattgtcgtcagctcgcaggacaacggagacgtacttgacgagagggatgagggtgagcgtccagaagacgaaggagagcacgccgaagatctcttcgttcgtctccgagtgctggatgtcctcggcgaaggtgctcttgtacacgtacagcggagagatgctgaggtcgccgtagaccacccccaggctctggtacgccagcagcaaggtggtcttccacgagtctctctttggggacctcaggccccttccgaactcgagatccatcgctcggcgagagccaggccagcctacctagccttcactgcttcacacataacactggcctttctttccgcacaattcaacgaacacaccagcttcgaaccacggcctttgttccaaatccccgagcagtgaagaataggctgctcaagggggatgggatagagcagagggaccagccgaccagacgaggcaaaagcgacaggccaggttaaagccggtttccggacggcccgagggacc

SEQ ID NO: 23112 - DNA, 3159 bp, Zea mays
aattctacagtattttgactctatatattgcagctgtaacagtccgaacagctgaaaaacggctaagctatacagaacggcctcattatgttactgggaagactgaaaacagtcgtgattactgtatcagatgttcataaaagaaagtcgcatcgtctcagcctcgtcaaagcacgtacaccatgccgacctccagcagcgacgccggcggcacgcgcagcgcgacgtccgggccgcggcagttgcgccgcaggaagttgtacccgacgtccaccgccaaccgcttgagcaccgacgacccgggcttgcactgcacgtgcgagtgccccaggatgaacgcagtgccggcctcccgggccgccgccagcgcctccagctcatccgccacctgcttgttctccgcggcctccgggctcaccacgtggctgtcgatgaagaaccgcacctgcttcggccccgccgccgagctgatctccgcgtccctggggctcaggctgtcggcggccgtggcgcgcacctccacggtggacgctgccgaatgttgcacgctgtcctggaggtcgtagctggcgcggcgccgcagcgggttgctcgcgatcacggtcagccgccgctcctgctccccgggatccagctccagctcccgctcactggcctcgctgcagcggtacgaggcgtccagcgttatgaacgtggccagggtctccacgagctccgtctcgaacgagtccacgtcctggtgcacgtcgcggtagccgtagcgcacgatgcaccggtacgagcggtggcccggcgggccgacacgcccgatgaggtaccgctccgccgggaatacgtacggcactggcaccgacttgacgcacacgaacaccagcacctggtggaacgccgggaggttggtcacgaaccgggagaagttggccgggacgcccgacgtcaggtctgtgtacacgaggccgatgccggggacgcggaccatgcccagcctgtccccgagggcgaggagccactccagggtcaccttgttgtgcaggtcgaactcgtacttcttgatggtcgtgtagtgccagatgagcatgacggccatcaggatgagcgccaggaggatggggagccacgcgccttccaggaacttgatcagggacgcggagaagtaaagcgcctcgatggatccaaagaacaggaggaaagccaacgccagcagcggtggcctgtgccagcagagaacgatgaccaaggatgtcaggaacgtggtcaccagcatcactgtgatcacagccaaaccagatgcatttcccatgtgttttgtatctctaaacccaacggtcacagcaatgcagaggatcataagcaaccaattgatctcggggatgtatatttggccatgaattttctcagaatgtgtgtacaactttcactcgagggaagcagctcagggacaggctctggttgatgattgagaatgggccgccctcgagggccccgctgccgaccaccgaagccaaaattgccaatataagcactggccatctgatcttatctggaactgcgatgtaaaatccaacttgtgagctagagtaaaagtcatgatgttttgataagtaagcagcttgacccatgtatgccaaaatcagtgcggggtaaactagacaagtgaaagcaagctgcaccagaagtgtagagctaggtgatctgcacaataatttgacatagaaatattatatgaactctcatgcaggtcaagaagttacctggattgcactgtatgagaaatgtccaagatctgcaaacattgcttctgatcctgtcatgcagagcaagattccgccaagtgacatccatccattttttctagtcttttttaagaccttgaacatgtaagacggatttagagcttggtagatctgaggattccagtggatgatattataaaggccaagagcactcatgcagaccagcccaggctagaactatcggggcgaccagaaatcccaacccggtgcgtaccatagtgctggagggcaaataggaatgctaatatgacacaggttattggaatgacagcatattcacggtgatccttggacagcgagaactcgaggcctgaaactgccgagaacacggtgacagctggcgtgagaacaccgtccccgataaccatgcatgtcccgatcataaccatgaccagcagagcgacgcgcagcttcctgtgccgctcaagccacaccttgatgcgggacttgtcggtgatttcaggagggcattccagcttgtaggtggaaagctcctcatcggcgatctgccggttcgggaggaggctcacattggcgcgcctgcaaatcagagagtagagggcaaacgttcctccctcgccattgtcgtcagctcgcaggacaacggagacgtacttgacgagagggatgagggtgagcgtccagaagacgaaggagagcacgccgaagcgccccgcggccgcctcccgatgctggatgtcctcggcgaaggtgctcttgtacacgtacagcggagagatgctgaggtcgccgtagaccacccccaggctctggtacgccagcagcaaggtggtcttcccacgagtctctctttggggacctcaggcccctaccgaactcgagatccatcgctcggcgaggccagacccagcctacctgctagccctcgccttcttctacttcacacataacactggcctttctttcccgcacaattgaacgaacacaccagcttcgaaccacggcctttgttccaaatccccgagcagtgaagaatctactgggagggagggaagaaagaaagggggcccgctcgcgtacctcggaaactagacgagaaaaaaaaacgccggacggaagaaatcgaggttcgtatgagttcagcttgctcaacagcctgctcaagggggatgggatagagcagagggaccagccgaccagacgaggcaaaagcgacaggccatggttaaagccggtggcgccctccccctgcgttaccgaataccgatagggagaggcaaggaaaggacggccacgtgttcttggagctgtggactggactactcattgctactgctgctgctactaccagcacagcacagcatggctctacacaggagagagatccgatccgagtcgcggtcgc

SEQ ID NO: 23113 - DNA, 911 bp, Zea mays
  misc_feature (32)..(32): n is a, c, g, or t
  misc_feature (41)..(41): n is a, c, g, or t
gttttctttgttatctttcgatgcgttcccanctagttctnagtataaatacgttagtcatgttgccaatcgtgttgtcatgtatgaaacaaccttattctgaaaatcaatattctgaaaataaacaatgttgaaaaaccaagctactgttctcaaacaattgccttcttccttgatgctttcgtggagtcccgtcctaattgttgtatcagatgatcgaacctttggttctattttatccaaccttgaatttttttagcatgtatgaaggcagattatggcgctgcaatgcttcatgaaattgtgatcccatgtgcttgtacatttcctccatgagcgtgatgaggagctggcgcgcggcgttgcggacgggctgcttgctgtcgccgaggcgctcgacggcggcggggacgagggagttgaggtggatcttgaagtggtcgccggcgacgacagcgacgacggagagcgcctggaggccgccctgggcgatgcggaagttggcatcccgcgtcagatccatgcagtggtccaccagcgcggtgacctcggccgccgtcagcccgcgacgcgccgcgacgtcaagcacctcgtgcagccgctcgaccccggccagacgctccttggtgtccttggcgcgcgccgcctccattctctccgcgcgcccgaggactccggcggtcccgccgcggggagagctctagggctccggggcgcgggaccggcagcgaggcgagcaggaagtggccggatcgtcgccctcctcgagcaccctcctcggagtattccgagcgcgcgggcgtgtgggcgaagaagcggctgcgggggaggaatgcggcgtagcgtgcccatccatttagcgtgagagagaaagaatagggaagggagaggaggaggaggaggaggccggt

SEQ ID NO: 23114 - DNA, 1836 bp, Zea mays
gtattatgtgggtcagcaatgttgttatatttcatttatgaactaagtactagtagttgtagcaatggaagtcatgtatcgtgggcgtcagtgaagaattcatggtacctgtcctctgtaatgcatctgctacaaataatttgcatatgttgccacacgttgagtgatgtatgacacctacgttattatgaatatcaatgttcagacaactcgaaattgtataaagtgcaaacacacatgacaagggtacgccaatacacaggtgagcaacaccttatgaaataaataagtactcttcagataggattgttgatgaaaaaatcaattaacccttttctcctcgccatgtatacagctctcaactcttcctggtaaagcatccatatccatggcataaagtttgttgagctcttcatccttttgcttcctgtcttccatcatcaattttttttttcccgcacttctatttccttggactgaacctccaacttcttcagttcaacttccttcatgaactcaatgttctgttgtttcaggtctgatttttcttcactctgcttcaatcttgctatttgaatgtcatggattctggagaggtagtcagtagactgggatgaactggacattgacttcttcctggatgctttcgtcgagtcacgtcctaatggtctcttgcctttcgaaccaccttcatcagattccacttcattcacagaacctgtaggtgttaaactacgaacaggctcggtgcccgcattgcctctccatgggctgccatgaaccatggcatcccatttgggttcgtctttcaggcgcgtccagcagtgcatgaaatgaaatggctttttctgtgatgttgcatacaaagttgctgcttttgaagtctacacaatatgtataaccacttgtaagtgcatgaataatactaagttcacataaaccatgaccaaacatacagtattacaaattaatctaagtgtaccttgtcgttatctgtgaggccactctggttttcccttaacactctagcgtagaatccagcaaatttgcctgtttcagctctgattttgtcccacctgctgctcagggccctattaagtctcattggaaactcacctctaagttcattataccttttctcaattctagcccataacccctcctttctctggcctgtgctaattactgggtcactacttatctctagccatgttttgcaaagcaacaggtcttcagcaggtttgaagttctgttcctttgtccttctaaatgtggtaggtgtgtctgaaggtttggttgggctgttaacttcctggacactatgttctgcttcggattcaaaagtaattgggtcagtctggttgggaacttgggcggaaccctgtggacttggaatgggaggtgcaaactggggttgaccgaatgatggttgctgtggaggacccccaggattgatcataccaaaaaatgggttccatggactacgaaaggtatatgtagatgggtcattagctccctgggaccaggtaggattggtcatatggtttgtaggagtagaaaatgtagaaggatgggttgggtcgaaaccttggccctgccacatctgaggatcccacatgggtggggggaaacactggttacctgaattggggctggcaccagtaggtcgaataggtgtgtttgagttgttgtcagccattctggaatgaaacataggaatacattaatttggacaacataaaacagacttgtactgtaaagtatgaactgtaatgcatacgaaaccacgcattgcacataaaggttcatacgaaaccaacataatgattaagcatt

SEQ ID NO: 23115 - DNA, 1685 bp, Zea mays
  misc_feature (9)..(12): n is a, c, g, or t
ccagctggnnnncttagtctttccttctcttttttttttttttttttcatgtatgaataatattattctgaaaataatattctgaaaataaacaatgttcacaatacgaagcaagtcttgtcaaacaatgaagcaaatgttcaacaaactgaaatcacagatggccgaacacacccgaccacgatacgccgaaaattggttcgcaacatattatgaaatacaataatactcatcacactggattcttgatgaaatagtcgattaaaccttttctcctcgcgatgtatacagctctcaactcttctggtaaagcatccatatccatagcatacattttattcagctcttcgtcctttcggatcctgtcttccatcatcaatttagtttgctgcatttctattttcttggattgaaactccaactttttgagttcaacttccttcatgaactcaatattctgttgtttcagctctgatttttcttcactttgcttcagtcttgctatttgaatgtcatgaattcttgaaaggtagttagtagactgggaggaactagacattgccttcttccttgatgctttcgtggagtcccgtcctaatggccttttaccttttgaacctgattcctcattttccatatcattaacagaacctgaaggtgtcccactgccaacaggctccatcccagcattgcctctagactctacagccttatactgcattgttgtatcagatgatcgaacctttggttctattttatccaaccttgaatttatttcttttagcatgtatgaaggcagattatggcgctgcaactcttcatgaaattgtgatcccatgtgcttgtacatctcctcaatacaagagatagcagcatctcgaacactttggttcgaatcattcattagttgcaggacaggtgaaagcaaaactcgttgcaaggaaatctccgtagaagcaaatagcccaactgcagatgccaccgtacgtacaaactcgtccctcaccctccaactcttatgagtccatgcataactaccagctctttcaactggggggggggcccaaggagcccccacgcgcgtgatgaggagctggcgcgcggcgtcgtggacgggctgcttgtcgtcgccgaggcgctcgacggcggcggggacgagggcgttgaggtggatcttgaagtggtcgccggcgacgacggcggcgacggagagcgcctggaggccgccctgggcgatgcggaagttggcgtcccgcgtcagatccatgcaggtgtccaccagcgcggtgacctcggccgccgtcagcccgcgccgcgccgcggcgtcaagcgcctcgtgcagccgctcgaccccggccagacgctccttggtgtccttggcgcgcgccgcctccagcgccgcctccattctctccgcgcgcccggggactccggcggccccgtcgcggggagagctctagggctccggggcgcgggaccggcggcgaggcgagcaggaagtggccggatctgatgaggagagagagggggagtgacagagagtgcacgcagcgagacgaaccgtcgcccttgttcgcctcagactctcttcaacgcgtccccctcccctgtatttggcggctacaggcctccgcttcccactacaacgttgccccctagcgctggtacagtgctagcggcgggtg

SEQ ID NO: 23116 - DNA, 1156 bp, Zea mays
  misc_feature (1050)..(1050): n is a, c, g, or t
ggccgcttttttttttttgttgctgaatcaaactgctaataccatcataatttcaccaaacataacatatggttaaattgttaagtagttgaattataccatcagacacctcttctgtaaggatacacactgaaaataccgacttcgaagtaaactgacttgagtgttccagaatcaaactgtaaataccctaaagcactgaataagcaccctacgtttgaagttccaccttgtaaaaataacgcacactaccctctcaaattctgatggttcgttacctagtattctctcttgatctctgatttcgaaaacccacggagcagtgttgcagctgttactctctagtcgatcttgaccgaagagtagatgagcctggtgaaccagaagcaggcgtagaagccaatggtgccggtgagcacaaagaaggcgtaggaggcaatgagcatgtagccaaagtataggacgccggagacggtcttcgttatttccagcttggtgaagaagtagaacgtggcgtagaggaagaggtacagcgctgacgagccagacgtcaggtaggatctccaccaccactggtagtcctcgccgcagagctggaagtagcagagcacgatggcgatctccgcacaggtcaggataaggatgacaaagaccaggaacagaaacccaaagatgtagtagaactggtgcagccagatcgatgtcaggatgaagaagagctcgatgaacactgcgccgaagggcaggatgcctccgatcagcaccgagacgaccgggttcatgtaccatggctgctccggtattggccgtgctatcttgtttgtcctcactgggtcctccatggcaggtttcttgaagccgaggtagctgccgataaagaccaacggcacggagatgccgaaccagaggagtaccagagcaaacatggtggtgaacggcacggcgcctgaggatttctcgccccagatgagtgcattcaggaccaagaaaattgcaaacacgatgccagggaacatcagcgcggtcttgatggtgacattcttccactgncgagcccttgaacatcctgtaaagccgcgaggaggcgtaccctgcaaacagccccatgaagacccagaggaggagcattgctgtcatgagccctccgcggttcgca

SEQ ID NO: 23117 - DNA, 1002 bp, Zea mays
  misc_feature (848)..(848): n is a, c, g, or t
  misc_feature (878)..(878): n is a, c, g, or t
  misc_feature (884)..(884): n is a, c, g, or t
  misc_feature (903)..(903): n is a, c, g, or t
  misc_feature (909)..(909): n is a, c, g, or t
  misc_feature (918)..(918): n is a, c, g, or t
  misc_feature (921)..(921): n is a, c, g, or t
  misc_feature (928)..(928): n is a, c, g, or t
  misc_feature (947)..(947): n is a, c, g, or t
  misc_feature (951)..(951): n is a, c, g, or t
  misc_feature (968)..(968): n is a, c, g, or t
  misc_feature (996)..(996): n is a, c, g, or t
aaaaacaatttaccagcccacgagactgcgcggctttccctctcgtcgctgacatgccgaagcggcaccgcgacagcgagggccggcagcggtcgtcgtcgtcgcggcggcggcgcagcccgtccccgtccgactcggacgccgcctcctccgattacagcggctccccccgacggagccgtggacgccaccgccataggagccgccgccggagggacactccgtccacctccagcgacgcgagcggcagcgggagcgaggattcgaggtcggactccggacgccgagggaggagcggcggccggaggcgccggaatgtcaccgaggagcagatcattgagtacatggcgaagaaggcgcagaagaaggcagagaaggtggcgaagaagctgaaagcgaattcggtttcaggctactccaacgattcaaacccctttggtgatcccaacctgacagagaagtttgtgtggcgaaagaagatagagcatgatgtatctcagggacagaaggtggacttttctgtcaaatccgagaagaagaaacagctagaaagaatggctgaaatagagaaggttaagaaaagaagggaagaaagagctattgaaaaggcacagcacgaagaggaaatggcgttaatagctagagaaagagcacgtgcagagtttcaagactgggagaagaaggaggaagagtttcattttgaccaaagcaaggtcaggtctgagatcaggttgcgggaggggcgtacaaagcctattgatgttctccttaagaatcttagtttctcagatgaatttgacattgagttaaatgagccttatctggtgttcaaggtgagcatcctttgntcatccttattcaattgtaattcaactganaaaaanagctgtcccagcagcatgnacctgngtaattttntgnacgtttnttgaagtcagctattgtanattntgacatcattgaacagnacattcaaatgcattttataactttgcncttcct

SEQ ID NO: 23118 - DNA, 1272 bp, Zea mays
gcaccaggaaccaccacctgaggtccttgcagaagagagaggtttgcatgcaagtattgagggggatgtaaaaagtctcctgggtgcttcgccggccgcacagcttgaagatatgcaaagtcaaattgagtcccaaatgcgctctggaactgcgaaagttgttgaatactgggaggctattctgaaacggcttcatatttacaaagcaaaggcttgcctgagggagatacatgcttctatcctaaggaagcatttacatcgtctggagcatcctggtgctgctgaacaggatgtggattctgagaaagaagttgataataaactggaggatgaaatgcatgaggacgaagatgataaacgatattcacctgagcctatgcctcagcagacagataacgaatttgaagaggcagatggatccttttctccacagctaatgcatggcaatgaagatgaagatgcaattgatcctgaagaggacaaagctgagctggaccgaaaacgtgaagctgtagttttggagcatcaaagaaaagttcaggaagccatgaaaacaaaggcaagagtacctgatgagatggagatgaaggccataaaaacaatgggagctatggaggaaggagatgcagtatttggtgccggtgctgaagtgaaccttgattcacaggtgtactggtggcacgacaagtatcgaccaagaaagcccaagtacttcaatcgggtgcacactggatatgaatggaataaatacaaccagactcattatgaccatgataacccaccaccgaaaattgtccaaggctacaagttcaatatattttaccctgatcttgtggacaaatcgaaagcaccaacatacagtatagagaaagatggaagcgccggagagacttgcttcataagatttcacgctggacctccatacgaggatattgctttccgtattgtgaacaaggagtgggaatactcacacaagaaggggttcaagtgtacttttgagcgtgggattctccatctctatttcaacttcaagcgttaccgttacaggcgctgaaatggctcaagaggcaggggaaaactggatcgattggactggtgcgtcatgattctgctgtatgctgtggcatggataccagtcgagtatgtatcttcagtataattagatactatgctaaatgggaacgcactttttggttttactgactgattccccccttttggaggttgtactggaggtcggcctagcatacagcatagcaagctgatagtttt

SEQ ID NO: 23119 - DNA, 2307 bp, Zea mays
  misc_feature (36)..(38): n is a, c, g, or t
attgttactggagcatcccatcaatcacatcttggnnnaatcacatcttgcatgcctcagtcgcttcaaacgttagtgtaaaagcaaagcaaatctgcaattgaatgcaatccagtccaaaattgcaagtcatccagaagataaacgaacatattcttttgtacggtaatgtaacataaaattctcatctaatgcctggacttcttcttcctagatttgttgctagtttttggctgttcagcatttaccgccggtgtctttgatgaattggtggtttggcttccttttgaggaagcaccgacattggtggccgatgtttccctagacacagctccttgagcacctctgacctgagccctcttatccttcctctttggacggtaactggaccgctctctccttggcagccatctctcgggatctggtggcggccccgggtttgctggatcgaagcctttcgggtatctaggcttccgcttcctcttctttgccttttgcttcttcacttcctcgggaacatctaccttcatgtcttggggcccttccacatgccttgcaccagatgtcttctccaagctctcaacattaactcctttgaggcctggcaatggcttcagtttcttctcgtattgttctgccttctccaagttagtgcgcgctgaagtcattactaacccagccaaagcttctatgcttccatggctcttcacaagttcctcatacaacaaacaagcctcttcatcacgtccatggctgagcttaaatgcagcagcctcccgtgttaatatatctaatttgttatcctcggtcatggaattcttccaccagttgatagcagaatcaagtacagaagctgcagcattggagtcacctaggcgctctttaagggccactaatgtagcaactgttgcaggcatgtgctgaatgtcaggtattctggatagtgagtcagcagcaagctgaaaatggttggcattagcagcaatctgggcaagtgcaaggaggagccctttagaattctcaggacgcttctcagcgtactggctaagaacatcttcagctttgtgaatcttcttttctttaacatgaacagcggcttgaagtaaaacagggaatacactatctggaaacataccaagcagccccctgaccaactcatgtgcctgttcagttttatttgcatggagcagtaaaagaacacgtgcagaatacagagcttctttctgccatggggataacttgtagtcaaggttttcaacaagatgcaactggtttggagctgtagttgttccaataagccgatcgagcttcttcaagctatctgcggtatcttttgtaccttttattgaaataagatttgttgttgccacagcaagtgatgataaatcagctgactgcccatttatcatattaacatatgtttgcatagcttcttgagattgtccttgtagctgctgcacataagcaagctgagcagacacaggagctaattcatattcaatatccgcctcgccgtagtcttccaccataagctcttctttcccaattcttttagccaagtccaattgctccttggcttcagagtacttcttgttttctatcaaggagcaagcagaattgtatgcgagctcaaaactacgagtatccctgagtgctctcgtggtaagatcaaccttaagcgccttcatagctgcctgtacctcagaagcccttccagcagcaactagagcagcaatgatatttatcttcagatccattgagtcaattttaaattttttaagcttctcatagctactcatgcaatcattcattcttcctagtcggtaaaagatctgggattccagctggagaacagctgaagtttcttcttggcctcttaaaagctcaagagcctcatgcagtttgttttgcctgtagcagcagtaggccctgtagtagctgagatcgatcgggaggcgctcggcggcgcggatcgcggcgagcgccttgtcgatctcgtcggccttgatgtatgccaccaccttgcatcgcaccgcgtcctcatctcccggcgctgccttgagaacttggtcggcgaccttggcggcctgtttgaaagcacctgcctcgatgtggcggtggagcgaggcgaagaggtcctcgacggccaccggctccgcggcggcggacgccttcgatttcggcggcatcacgagacgcaggcgtgggacttgggtcagcagggagagagaagagagtaccagagcagcacccagcacgcgctgcaagaaaataggttcgcctgctcgcccgcccaatcaaggattc

SEQ ID NO: 23120 - DNA, 1876 bp, Zea mays
gcacgagaccattacctagaacataaattataatttaggagggtcattctaacgtcgtcttatatcagataaaatggttttcgcgtacccattagttcatgagcgctcttagttcattaccatatgtactcgtgttggtgcgttcgccccgtagcagccgtcgggcttctctgccttgtacttgcgatcgagtccagacctgcggagatagatctactagtcgaccgatccggatccttcccttccgtctcacgctgcttgctcgggacgggaaccggaggtggggttgcgatggcgctgcagtacgtggaggcgcagcggcagttgcgcccggacctctccgactggtacgcctccctcgccgacctctaccagcggaagctatggcaccagctcaccctcaagctcgaccaattcttacagctccaggtcgcacagaccggagacactatcattcagctctacaacaatttcattgtcgactttgagaccaagattaatctgctcaaacttgcccattttgcggtgataacttctcgccagtaccctgataaggatgctgcaattactttcttagagggggtgatcacaaagctgcgtgagacaagggagtcacggatcaatgaaccaattctctatgtgaagatgcaaattgcagctattaatcttgagaaaggaaacaaaaaagagtgcaagaatttgttggaagatgggaaaaccactctggatagtatgactgatgtcgatcccacagttcatgctagcttttactggatatcatctcaataccacaaggcctgccaagaatttgcagagttctataagaatgctcttctctatctggcctacacaactgtggagtctctatctgagtcattcaagctagacttggcttttgatctatctctagcagccttgctgggtgataacatttacaactttggggagttgttagctcacccgattatcaatagtcttattggaactaaggtggagtgggtttatcatatgttacaagcattcaacagcggcaaccttgccctctaccaagaactttgcagggttcacaatgctgctcttactgcacaaccagctttggtgcagaatgagcggaagctgcttgagaaaatcaatattctttgtctgatggagataatctttagtcggccatctgaagatagaactattccattaagtgttattgctgagcggactaagctttcaatcagtgacgtggaatgtcttcttatgaagagcctctcggttcatcttattgagggaataattgatgaagtggacagtacagttcacgtatcatgggtccagcctagagtgcttggaattccacaggttaaggctttgcgcgaccgcctggatgcctgggttggaaaggtgcataccacattgctttcagttgaggcggaaacacctgatcttgttgctgtgtaatttcacagctgttacacttccgcgagaggcttggtcagcaaggtcccatttgcaaaatgtgagatgctttgtgtgacacgtagtcattttctggataatgagatctgctgctgccctgagcgtttgtcttcctgcgcctactgatcaggacatgtaatttcttttttggtgccctcaggacatggatggttagaactgcacgcagtgtcacggagacgggaccaatggattgaaaatttcatactagtagggtgttactagtagaacacgatgcaggagaatcttgctggaacatgagttgtgcctgatgtttgcatgttgcactgcgataagacgtggatcatcattaacatattagctgtttttcagtggaaaaaaaaaaaaaaaaaaaaaaaaaaaaaaagtactctgcgttgttaccactgct

SEQ ID NO: 23121 - DNA, 3100 bp, Zea mays
tgctttctaccagaactttgcagggttcacaatgctgctcttactgcacaaccagctttggtgcaggatgagaggaagctgcttgagaaaatcaatattctttgtctgatggagataatctttaggtaacatttgtggaatcttcttttctaatgtcacctccattttctttttctttgacatgttatttgtctttattttcagtcggccatctgaagatagaactattccattaagtgttattgctgagcagactaagctttcaatcagtgatgtggagtatctccttatgaagagcctctcggtaacttgattggcattctttttagcacaagatattatcgtcatggcctccctttttcacttgttcttttccttgtttgtcatcatgttttcaatggaaactttgttattttaattatctcatttcttgggaaattgacttgtcttgtggatgacacattttattccgcatttatgaatgttttatggggatgtttgtctatctccgcacacatgtttgttgccttgttttactactttattagtatttgtgtccctttggtcaactatgtcttcttggtaccaaggtggagtcggtttatcatatgttacaagcattcaacacgggcaaccttgctttctaccaagaactttgcagggttcacaatgctgctcttactgcacaaccagctttggtgcaggatgagaggaagctgcttgagaaaatcaatattctttgtctgatggagataatctttagtcggccatctgaagatagaactattccattaagtgttattgctgagcagactaagctttcaatcagtgatgtggagtatctccttatgaagagcctctcggttcatcttattgagggaataattgatgaagtggacagtacagttcatgtttcgtgggtccagcccagagtgcttggaatcccacaggttaaggctttgcgcgaccgcctggatgcctgggttggaaaggtgcatactacattgctttcagttgaggcagaaacacctgatcttgttgctgcctaatttagcacctgttacacttccgcgagaggcttggtcagcaaggtgatgagatgcattgtgacacttgtagtcattttctggataatgaacctgctgccctgagcgtttgtcagcctgcgtcctgatcggggcctgtaatttcttttttgatgtcctctggacatggatgggtacaacttcacgcagtgtcacggaaacgggaccaaatgattgaaatttttatactagtagggtgttactgtagttttcccagttgaatttaatttgtaactgagtttgtactctgctggacatggatgcaggagaatcttgctggaaatttagttgtgcttgatgtttgcatgttgcattgcgataagacgtggatcatcattaatgtattcttattctcagaaaaaaaaaaaaaaaaacgcggccaattgtgcttagtttgggacgtttttatggctatgcttggttcagcgtctggggtgcttatagtcgccagaagatggaagccaaaccaaacacctggcttctggtggatgcgctttcgctcgcagcccctttagcactggccgtgagaatcggcctgaagcccgcgtcgtccgacttaagtcggacgtccgacttctctagtcttttactatgcacgagtgattcctttgtcttcaaccttatggttttgtcgtcccttagtacacacttatcgccgaggcttatggttttgtcgtcccttagtacacacttatcgccgaggcgaacaatgatgtcgcctaattatgtagcctgactgagctattgcctctcgtgtccgtccctcctcgcggtaagatcctctccccatctggccatctctcgagtcgtgcccttccttctacctcatcgacatccgcatccctcttggttcttcctttttgcgatagtttgatggacgaccgaggcggaccactgccatttcaccagcatccacaccacccctactttctccattacgtcgacaacctagcacactgtattcgtttgattccaccccataatggtttctcggattcgtttctcacaattggtttcctgccttgttcatttgttcttggtttaccttacttccgtggtacacaaattagacaagtcctcgatgatctataacatctatgcatcaattttatcaacttcatgttagttgtttaggtgttccgacgtcagccacatcttagttgtagggcttccttcaagtgtccttgacaaccttgcattcatttgtttacatggaatgatgttttgttctacattttacttttgtctgcattagctgaactactacttcctgttgttttacaaatttatcctaacctcttcgaatccggtatgccagtagccaaataattgatgtacccatgtactcattaatccatgtgacgacgttacccacatatctgctctaggacttactcccaggatcctcgccaaccttgaagtgttaggttgtactgtagtggttagtcgagtgtgttcattaaagtccatactaaccaaataactcacaatcagatggattcgtcaaacttcgtagctaaaaggacattggcatgatgcaagacacatcgaagaagctattttctgtcctcttttgaggtcacccaactccgaattgaattggaataaatagctgaattcctggaccaggactcttggtagtgtcaacacgccttggataagatgaacaacgaaaacaaatatgtagacaacgacgactacgtgccctcagacatctcctaagcatcgtcgcctatggaaccactcattggtgaattgttcgactttgcttagcatttcaaacaaatgtgggtgtcgaatacgattctgaccagatgtcgtcgtttagtgacaatgagctatgagtgatgtctagtatggctacaattaggtcatttattaaggtgtaaggtgctccctaggtcgtagtttaaggtgttcctagtttacttccaacgggtatgttctacgatctatcaacttgtaatgggtttgcctactgaactgatctttcgtctgttatgtagtgtgttata

SEQ ID NO: 23122 - DNA, 1813 bp, Zea mays
gcacgagaccattacctagaacatcctacccgccggcccttccgtctgacggcaagtatcacccccttcccctcttctcctgccacacctccgccagcgctagggttttatttttgcattgctgttgctggtggtggttaccttcttctctctctcagtcgtctccctcgcagctgcagtcgtcgtagcagatcttatctcaaaccctaccgaccaacagctgcttgctcgggacgggaaccggagttggattgcgatggcgctgcagtacgtggaggcgcagcggcaggcgcgcccggacctcgccgactggtatgcttccctcgccgacctctaccagcagaagctatggcaccagctcaccctcaagctcgaccaattcctacagctccaggccgcacagaccggagacactatcattcagctctacaacaatttcatcactgattttgagaccaagattaatctgctcaagcttgcccattttgcggtgatagcttctcgccagtaccctgataaggatgctgcaattaccttcttagagggggtgatcacaaagctgcgtgatacaagagagtcacggattaatgaaccgattctctatgtgaagatgcaaattgcagctattaatcttgagaaaggaaaccaaaaagagtgcaagaattcgttggaggatgggaaaaccaccctggatagtatgactgatgtcgatcccacagttcatgctagcttttactggatatcatctcaataccacaagtcatgccaagaatttgcagagttctataagaacgctcttctctatctggcctacacaactgtggagtctctatctgagtcattcaagctagacttggcttttgatctttctctagcagccttgctgggtgataacatttataattttggagagttattagctcacccgattatcaatagtcttattggaaccaaggtggagtgggtttatcatatgttacaagcattcaacacgggcaaccttgctttctaccaagaactttgcagggttcacaatgctgctcttactgcacaaccagctttggtgcaggatgagaggaagctgcttgagaaaatcaatattctttgtctgatggagataatctttagtcggccatctgaagatagaactattccattaagtgttattgctgagcagactaagctttcaatcagtgatgtggagtatctccttatgaagagcctctcggttcatcttattgagggaataattgatgaagtggacagtacagttcatgtttcgtgggtccagcccagagtgcttggaatcccacaggttaaggctttgcgcgaccgcctggatgcctgggttggaaaggtgcatactacattgctttcagttgaggcagaaacacctgatcttgttgctgcctaatttagcacctgttacacttccgcgagaggcttggtcagcaaggtgatgagatgcattgtgacacttgtagtcattttctggataatgaacctgctgccctgagcgtttgtcagcctgcgtcctgatcggggcctgtaatttcttttttgatgtcctctggacatggatgggtacaacttcacgcagtgtcacggaaacgggaccaaatgattgaaatttttatactagtagggtgttactgtagttttcccagttgaatttaatttgtaactgagtttgtactctgctggacatggatgcaggagaatcttgctggaaatttagttgtgcttgatgtttgcatgttgcattgcgataagacgtggatcatcattaatgtattcttattctcagtcgtgc

SEQ ID NO: 23123 - DNA, 1762 bp, Zea mays
agatctactagtgtcgaccgcgacggaaacttcccttccgtctcacggcaagtatcttccctcttcccctctgctcctgccaggctgccacacctccgccagcgctagggttttcattttcactcgctgttgctggtggttgttacccttcctctctctctcagccgtcaccctcggagccgcagtcgccgtagcagatcttctctctaatcctatcggtcaacagctgcttgctcgggacgggaaccggaggtggggttgcgatggcgctgcagtacgtggaggcgcagcggcagttgcgcccggacctctccgactggtacgcctccctcgccgacctctaccagcggaagctatggcaccagctcaccctcaagctcgaccaattcttacagctccaggtcgcacagaccggagacactatcattcagctctacaacaatttcattgtcgactttgagaccaagattaatctgctcaaacttgcccattttgcggtgataacttctcgccagtaccctgataaggatgctgcaattactttcttagagggggtgatcacaaagctgcgtgagacaagggagtcacggatcaatgaaccaattctctatgtgaagatgcaaattgcagctattaatcttgagaaaggaaacaaaaaagagtgcaagaatttgttggaagatgggaaaaccactctggatagtatgactgatgtcgatcccacagttcatgctagcttttactggatatcatctcaataccacaaggcctgccaagaatttgcagagttctataagaatgctcttctctatctggcctacacaactgtggagtctctatctgagtcattcaagctagacttggcttttgatctatctctagcagccttgctgggtgataacatttacaactttggggagttgttagctcacccgattatcaatagtcttattggaactaaggtggagtgggtttatcatatgttacaagcattcaacagcggcaaccttgccctctaccaagaactttgcagggttcacaatgctgctcttactgcacaaccagctttggtgcagaatgagcggaagctgcttgagaaaatcaatattctttgtctgatggagataatctttagtcggccatctgaagatagaactattccattaagtgttattgctgagcggactaagctttcaatcagtgacgtggaatgtcttcttatgaagagcctctcggttcatcttattgagggaataattgatgaagtggacagtacagttcacgtatcatgggtccagcctagagtgcttggaattccacaggttaaggctttgcgcgaccgcctggatgcctgggttggaaaggtgcataccacattgctttcagttgaggcggaaacacctgatcttgttgctgtgtaatttcacagctgttacacttccgcgagaggcttggtcagcaaggtcccatttgcaaaatgtgagatgctttgtgtgacacgtagtcattttctggataatgagatctgctgctgccctgagcgtttgtcttcctgcgcctactgatcaggacatgtaatttcttttttggtgccctcaggacatggatggttagaactgcacgcagtgtcacggagacgggaccaatggattgaaaatttcatactagtagggtgttactagtagaacacgatgcaggagaatcttgctggaaaaaaaaaaaaaaaagatgtttgcatggcgccctgcgataagacgtggat

SEQ ID NO: 23124 - DNA, 1768 bp, Zea mays
gttcgccccgtagcagccgtcgggcttctctgccttgtacttgcgatcgagtccagacctgcggagatagatctactagtcgaccgatccggatccttcccttccgtctcacgccgtcaccctcggagccgcagtcgccgtagcagatcttctctctaatcctatcggtcaacagctgcttgctcgggacgggaaccggaggtggggttgcgatggcgctgcagtacgtggaggcgcagcggcagttgcgcccggacctctccgactggtacgcctccctcgccgacctctaccagcggaagctatggcaccagctcaccctcaagctcgaccaattcttacagctccaggtcgcacagaccggagacactatcattcagctctacaacaatttcattgtcgactttgagaccaagattaatctgctcaaacttgcccattttgcggtgataacttctcgccagtaccctgataaggatgctgcaattactttcttagagggggtgatcacaaagctgcgtgagacaagggagtcacggatcaatgaaccaattctctatgtgaagatgcaaattgcagctattaatcttgagaaaggaaacaaaaaagagtgcaagaatttgttggaagatgggaaaaccactctggatagtatgactgatgtcgatcccacagttcatgctagcttttactggatatcatctcaataccacaaggcctgccaagaatttgcagagttctataagaatgctcttctctatctggcctacacaactgtggagtctctatctgagtcattcaagctagacttggcttttgatctatctctagcagccttgctgggtgataacatttacaactttggggagttgttagctcacccgattatcaatagtcttattggaactaaggtggagtgggtttatcatatgttacaagcattcaacagcggcaaccttgccctctaccaagaactttgcagggttcacaatgctgctcttactgcacaaccagctttggtgcagaatgagcggaagctgcttgagaaaatcaatattctttgtctgatggagataatctttagtcggccatctgaagatagaactattccattaagtgttattgctgagcggactaagctttcaatcagtgacgtggaatgtcttcttatgaagagcctctcggttcatcttattgagggaataattgatgaagtggacagtacagttcacgtatcatgggtccagcctagagtgcttggaattccacaggttaaggctttgcgcgaccgcctggatgcctgggttggaaaggtgcataccacattgctttcagttgaggcggaaacacctgatcttgttgctgtgtaatttcacagctgttacacttccgcgagaggcttggtcagcaaggtcccatttgcaaaatgtgagatgctttgtgtgacacgtagtcattttctggataatgagatctgctgctgccctgagcgtttgtcttcctgcgcctactgatcaggacatgtaatttcttttttggtgccctcaggacatggatggttagaactgcacgcagtgtcacggagacgggaccaatggattgaaaatttcatactagtagggtgttactagtagaacacgatgcaggagaatcttgctggaacatgagttgtgcctgatgtttgcatgttgcactgcgataagacgtggatcatcattaacatattagctgtttttcagtacaaaaaaaaaaaaaaaaaaggccccta

SEQ ID NO: 23125 - DNA, 1754 bp, Zea mays
atttgcattgggctgtccgcagtatggcgtcgcctccgactcgtcttgtgttctcccccgcggcccgccggggccgtcgtcgggcttctcctctttcttgcactttcagtcgagtccagacctgcggaatatagatctaccaatcgaccgacccggatccttcccttccgtctgacgtcgtcgtagcagatcttatctcaaaccctaccgaccaacagctgcttgctcgggacgggaaccggagttggattgcgatggcgctgcagtacgtggaggcgcagcggcaggcgcgcccggacctcgccgactggtatgcttccctcgccgacctctaccagcagaagctatggcaccagctcaccctcaagctcgaccaattcctacagctccaggccgcacagaccggagacactatcattcagctctacaacaatttcatcactgattttgagaccaagattaatctgctcaagcttgcccattttgcggtgatagcttctcgccagtaccctgataaggatgctgcaattaccttcttagagggggtgatcacaaagctgcgtgatacaagagagtcacggattaatgaaccgattctctatgtgaagatgcaaattgcagctattaatcttgagaaaggaaaccaaaaagagtgcaagaattcgttggaggatgggaaaaccaccctggatagtatgactgatgtcgatcccacagttcatgctagcttttactggatatcatctcaataccacaagtcatgccaagaatttgcagagttctataagaacgctcttctctatctggcctacacaactgtggagtctctatctgagtcattcaagctagacttggtcttttgatctttctctagcagccttgctgggtgataacatttataattttggagagttattagctcacccgattatcaatagtcttattggaaccaaggtggagtgggtttatcatatgttacaagcattcaacacgggcaaccttgctttctaccaagaactttgcagggttcacaatgctgctcttactgcacaaccagctttggtgcaggatgagaggaagctgcttgagaaaatcaatattctttgtctgatggagataatctttagtcggccatctgaagatagaactattccattaagtgttattgctgagcagactaagctttcaatcagtgatgtggagtatctccttatgaagagcctctcggttcatcttattgagggaataattgatgaagtggacagtacagttcatgtttcgtgggtccagcccagagtgcttggaatcccacaggttaaggctttgcgcgaccgcctggatgcctgggttggaaaggtgcatactacattgctttcagttgaggcagaaacacctgatcttgttgctgcctaatttagcacctgttacacttccgcgagaggcttggtcagcaaggtgatgagatgcattgtgacacttgtagtcattttctggataatgaacctgctgccctgagcgtttgtcagcctgcgtcctgatcggggcctgtaatttcttttttgatgtcctctggacatggatgggtacaacttcacgcagtgtcacggaaacgggaccaaatgattgaaatttttatactagtagggtgttactgtagttttcccagttgaatttaatttgtaactgagtttgtactctgctggacatggatgcaggagaatcttgctggaaatttagttgtgcttgatgtttgc

SEQ ID NO: 23126 - DNA, 3230 bp, Zea mays
  misc_feature (2691)..(2691): n is a, c, g, or t
  misc_feature (3130)..(3130): n is a, c, g, or t
tgcatgcctgcagattgatcatttgtagtatcagccatactataattttggaaacaacagaccattatgtgccacaaagatagcgaaaacgaacttgctttgtattaaaattagtgggggcatacctcatcacaaccctttatgtataccttaccaaatatacgcaaatgacaatcatacatagtcaaacatgatcccgcaacgtagttaattacaaactaaacatggtgctcatgtaaggaaaaaaaccttcaacattcccagtgccgttggcatcctcagtgctcaagctggaggcaacgaccttaagcggctgttgtaattgtagtcaacagaggttccaggtattccttgaacttgtcttttatcattgccccttctcgtcggctgcctggcacctcttggccatccttgaagagaatcaaagtcgggagaccataaaccttgtactcttcaatcagctgtggattggcatcatgatcaatcttgacaatttttaatcgcccagcatattcctgagtcgccagattagactttatcaaagctgacaaatctgatttcaggcaagcatagtgtttccttacgcatatgtctaaagcatcacattctgctaataggtgttgtcgaccaggtcatattagaacatctgcaaagagttttttttagccacttgaaacactcattggcttaccaattgattttttgggaactcctggagatgctcttgttaaccaatggcttctacacaaaactattaaaatgcaatgcagttcttagatttagggggaaaaaaaccaaatgctgttacagtgttcctaatagcctccacacctgatggacactgtgatgtgtacttcctttatgaaagcgttttggtcactggatttcatgaaaacaaaaactggattctggacttttatactgatgtcaactcaaatcccaaatatgggagtaaggataactgcagtgctttgatttttcttagttgtctcaagccccacttaaaaaagaggctgttcactaccttatcttgataactttagcttctatagcgtcgtcgatgttaccaaattacttacattgcagtcgctctcttaatccgtcatcatccagagtacgacacaacaccagcacagacgaataaaaaacacggataaccatccaccaagcagcagcagaataacctatacctcggaggcccaatcgacgacgggcgcgatgaggcggcacggcccgcaccagtcggcgacgaagtccacgagcacgggcagctccgactccagcacctccgcggggaactcgccctgcccaatgaacctggccgccgcgccgcaccgaacgcgcgcgcgagggcgagcgaggcgacctggcgccgcgcggcatccggccgaccggagctgagcgagcgagaggcggagcgcggccggaaggcgggccccgcggggacccgaggagaacggcgtgtggatagaggctgcgatggtggacgccgtggtgctcggcgcggacgacatgagcggagcggaggcagcgcgcggggaggagaggagaggaatcttctcgaaggtgttgccagtggacagtacgccaccagttctgttccgcggccgagatttgtgggcgaggggctgatttttgttttgtttttctcccgtaacataactcgtctgaggcgcgggaattcggcccggcccagaaaaatgaaattgccaaggaaacgggacgcgagcagcccattcgacctattcgtttggaagcaacggtctttccggaattcaggctttggaatgagccggcggtggacttttcgtccaacgaaatcttctcgatatgagatttttctctgagaaacaatcacaaatgattctcgacagagaaaatgacatctttggtgtgcatcttgttaacttgtttctttctgcggatgaaagggcagctcagtgcttgctaattgctgtgtttgagctgttctaaattttctgaaccatgatgtatgaacttccaaaatgaccatactacattatatcatatcatatattattttaaaaatgaaatcactgggataaaaaaatagagaaaaaaaagaaaggttagtttgaaatatgccactctaattttaaaaagttgaaaactaatttattttcatatcctgctttgtcatagagtaaaacctcaaatagcagtcaaaattaaatcatggttacagttgatttccctgtaatttgaatatttacacttgtacatatccacactaaaaaaactataggaactccctacagtaactgcttcaaaaaaataaattttatatcactcaattgcatcaaaataaactaaccatctatttttttttaaaaaaaattgcaattaatccaaaagaagagatgctggctgcatgtcacagtcaacacctgaactgtctcgtccagcataaactaccatgccacgtgtacaaagcgcgcatggaccaagtccacggagagagcaagatccatcggtccgcaacccctccctccggcgtccggcttcgccatcacgacgcctcctccctccctcctctcctcttcactgacgctttctccctcccgtccttgctttattccacccccgcaaaaacccccgacaccccgaaaagctcaccccgcacatggagagctccgtctagggttggttcccgggagcgcgtccatggtnatgccgactgtggcctccgcggccgcagcggcgcttcacccggcgatctcgacgcggcgcgcgggggtcgtcgggaacggcattgcgtccgccgcggcggcgggtggacgcctggccggcggcgggcgaggggcggtcgtgcgtgccagggtggcggaggccgcgccggtggcggccgagggcggcaggttggaggcgcctcccgctgcacccatggtggagatccccgtcacctgctatcaggtgaatggttggagtcgcctggtctgttttatcgactgcaatttcgaaaacggcgctcaccttctgttgtctgatcgccgccgcttgatctcggcggcgccatgtcaattaattacctgggttgcagattgaatcggcgttttcatataacgaatcgaattcaatgtgcgcatccgtaattgtatgcgcttccctnccattttgagtaaaaaatatgtgtgaccgcgtctgatttttcgtctgatcagttcacaatcgattggaccatttgtcctttttaaaaacttgttggttga

SEQ ID NO: 23127 - DNA, 960 bp, Zea mays
caaaacttacactgttttattgatcattcgtagtatcagccatactataattttggaaacaacagaccattatgtgccacaaagatagcgaaaacgaacttgctttgtattaaaattagtgggggcatacctcatcacaaccctttatgtataccttaccaaatatacgcaaatgacaatcatacatagtcaaacatgatcccgcaacgtagttaattacaaactaaacatggtgctcatgtaaggaaaaaaaccttcaacattcccagtgccgttggcatcctcagtgctcaagctggaggcaacgaccttaagcggctgttgtaattgtagtcaacagaggttccaggtattccttgaacttgtcttttatcattgccccttctcgtcggctgcctggcacctcttggccatccttgaagagaatcaaagtcgggagaccataaaccttgtactcttcaatcagctgtggattggcatcatgatcaatcttgacaatttttaatcgcccagcatattcctcggaggcccaatcgacgacgggcgcgatgaggcggcacggcccgcaccagtcggcgacgaagtccacgagcacgggcagctccgactccagcacctccgcggggaactcgccttgcccaatgaacctggccgccgcgccgcaccgaacgcgcgcgcgagggcgagcgaggcgacctggcgccgcgcggcatccggccgaccggagctgagcgagcgagaggcggagcgcggccggaaggcgggccccgcggggacccgaggagaacggcgtgtggatagaggctgcgatggtggacgccgtggtgctcggcgcggacgacatgagcggagcggaggcagcgcgcggggaggagaggagaggaatcttctcgaaggtgttgccagtggacagtacgccgccagttcggtcccgcggcccccggccgtgggcgaggggct

SEQ ID NO: 23128 - DNA, 1458 bp, Zea mays
ggccgcttttttttttttttttttgatttttctgtttttgattagctaacaccagaatttattaatcatttaaccccacagtatacacaagcctataatcagatgggaacaaggggaaaacgttggttgggattgtacgtgtacacaatagaaataaagaaaaaaaccatgatcagctgattttagcaccttgtccgcatccccagagtgttgattgggtaatcatgtacagggggccatattggacagtcaacagctcaaaaggctggattagttggtgcgaacgcctgattgcggaggcgccgactgctgaatgtccatgcatcaatggacgacagtgctttgcatgctgttctagttgcttcgccctggtttggttatcattgcatctcaatgcttgagccaataattcctaagctgagacatgtgcaggagtatctcgtcgcggccctggttggtcacgctgctcgtcatgatccaaggaggcgcggcctcgaagtattcgcggattaggccctggaaagtttccacgttttcttcaggtttcctgccgccgttcttcttcttcttgcgcttgtcacattttgtgaacacaagggtcatgggaaccttgttttggccaagccaactagcatagtcaagatcaatcttcttggcaggtatacttgcatctataagaagaaaaacagataccaaattctcccgactgagaaagtaatttctagtaaattcatcccaattggtacgagcttcctgtggtgcagaagcatatccataaccaggcaagtcaacaagataccagctgtcatttactttgaaatgattgatacattgggtcttcccaggcttcttggaggtaagggcaaggcgcttgcggcggacaagcgagttgagcagcgacgatttgccgacgttggaccggccaacgagtgcaaactccggaaggccgtcccgagggcagtcatcgggacgcacgctgctctttacaaaatctgcgttgaccacctgtgcgtcgccgcgcgcgtatgggcccagcacgatgttggagcccttaagcacccgtgcgctcacggcctcctggtcccccgcatccattgttgccccgggcggcacgaagagatggtcgagcgggagcttgatctgcccctccccctggggtgccccctcatcgtcggagtggtcgacggtctggggtgccgcgaggtggggcagcgcgtagaagcgtggcgagagggagaggcggcgcggcaaacgggaggggcagaggagtgtggaggtatgtgtggaaggaacaagaagtaggcgagggaggaggcggtggtggagaagcatggccgccgccggcggtcagggttttctgagtttttggaggcagggggaagaagtgtgcggcggggcttgcgaagtggattgggttttaccagaagggagattgctccccggcctcgagggtcccaa

SEQ ID NO: 23129 - DNA, 608 bp, Zea mays
  misc_feature (577)..(577): n is a, c, g, or t
  misc_feature (608)..(608): n is a, c, g, or t
gcacgaggcggccgccctttttttttggttttctagcaaaggtccagcaaaacaatttattctctaacattcgcagcatatgtagagttcccacgatccagaagcaatatggtgccaataatataaatattatacaccagactattttcccccctatcataaccatcattcagactatgacgatgacaacataagtacataactagccacccatgcgaagaactgtggtggtaatgaaccaaagaaagaaacagccacaagtggcgtgctccactggtagtaattagcatggccagtcctctcctaagtaccaaaactgctctagcacccacttcaaatgatctcagaatataccctcccctaaccaaatcgacagtacattctactcccttttgttttcctcatcatcgccttcaaaatctgcaactgtattcacgtcctttgttgctttggcctctggcgcagaagataaactccagccgttcttggaagcactcgttgctggcctaattaatgacagattgtcctttcgatcaaagaattcgcttgcgtcctaggaaaatctcattgagtttcngtgaaggtgcccacaggtagcaaatgacacn

SEQ ID NO: 23130 - DNA, 1691 bp, Zea mays
ttctttcagccctctttacaattacaatacaccaccgctcctccatatccgtgccctcacacatctctccgagcccgcgggcggcccccgttttttttttttttttttgccccagtacgtccgtccacctaattcacttccttcctcatgtgttcaggaacgatccggtggacaagctcggcggggagcccttcgagttcggctgctgtgaagtcgaacaacggtggcattggccgtccgttcggcaggcaagccttggggtcccgcagctcatcgaagaacggatgggcacaggcgtcgacagcagtgcagcgcaggttcggtgagtactggagcagccttgacacgagatcgacagcctcgggtggcatgcgcttaccaaaaagcttgtgccatggatgggcttttatctgagggaacttgaattcggaataatttggattcatgcacctgatctcctctcttgttggagtacccaaaatctttattatttccaccagttggtcaacaccactttcaccaggaaacaaaggctgaccaatcagaagctcagccactacacagccaacagaccagatatcgatcgcagtggtatactccgtagctccaaatattagttcaggagccctataataccgcgagcaaatgtacgatatgttaggctcaccagggaccaattttttagcgctcccaaaatcacaaatcttaagttgatgtgtatgaggattgaccagtagattttgaggtttaatatcacgatgacacacaccgacaactcgatggatgtaagcaagcgcacggcacatctgatatgcatacagcttaacatatattatgggtacacgctggttcatccggttgtagtatttggcaacacgataaactgtctcggatacaaattcaagtacaaggttgaggtaaacttctcccttttgagttgttgaaaagaagtgatgcttcagctgaactacattcgggtggtcatgtaactgcatagtctggagctctctattcttgtagcgcttatcttgtaacaccttttttatcgccaccgtctcgtcagtttccaagcatttcgcctggaaaacaataccaaacgaaccagtaccaacaaccaattctgccatgtatgagaccttctgctttggcttcccattgtgacctcctattgttgtcacaattatctgccctgtctctgttccagtcccatcaagtgtaacaccctcaccttccttatcattatgaccatcagctttgtcgtcgctaattgtcataatattcatctctttgggaagaagatctgctcctgcttcttcagttttaacaggtttcatgctagtagatgtgcttgcctcagcatccctattagatgatgacgatgattcttggtctatccgcacaggtttatccttggttaagtgtggctccataacaatatctcctgctccatcctgctcaaactttggtcttttggagccagagtcaccacccggatcggagaccgacgagcggccggaggcgatgctcttgagccgccgcatcatatgcatcctcctccctcagacgcagcccaccagcagcgaccccgaaccctagcctcgtcttccccgccttcgtcgaccccgtcgcccggctcctccgccgccctcgcgatgcagcctcgccgctgccggaggcggcgatctagggag

SEQ ID NO: 23131 - DNA, 1347 bp, Zea mays
ttgggtacctcgaggccggcccgcgaggccggccgggccggaatgctttacacgctctccctcccacttcgtgcgagcgtcccgaactaagttgctcgtggtggaggtggtttgtggcgatggccttcaagctggtcaccaagcccgcggcggcgtcgcccgctgctgctcactggggagatctcgcccgggggccgcaggtacgagccgcgttgccttcggaccagcgcccaggaacaaggggctccgcacggccaacaactccgcaacgcccatggctaaggaagagagggttgatcgaagtgaaatattgacattggatagcatcagacaagttttgattagactagaagacagcatcatatttggacttttggagagagcacagttttgttacaacgctgacacatatgatagcaatgctttccacatggatggttttggagggtctttggttgaatatatggttagagaaactgaaaagctccatgcacaggttgggaggtacaagagcccagatgagcaccctttcttttccaaggatctgcctgagccccagttgccacctatgcaatacccaagggttttgcatcccattgctgattctatcaatatcaacaaagagatttggacaatgtattttgatgaacttcttccaagattggtgaaagaaggaagtgatggtaatgctggatccaatgctctttgtgacacaacctgcttgcaggcactctccaaaaggatccactatgggaagtttgtggcagaggccaagtttcaagagtcccctgaagcttacacgccagccataatagcccaagaccgtgatcaactcatgcgccttctcacatatgaaacggtggagcgtgctgtcgaacacagggtggaagccaaagccaagatcttcgggcaagaggtgaacattggtgctaaggacaacggcagccaaccagtctacaaaatcaggccgagcttggtcgccgagctgtacagctacagaatcatgccgctaaccaaggaggttgaggtcgcgtacttgcttaggaggctggattgagtgtgtttacgtagctgtaaaactgccagatccgaaactcgtgcaattaaaccattacatcggtaagtactcatttctgtggagaggatgatccgaactcctggcattaaaccagaacgtcagtaagtacccagttttggggagaagatgggaactgtggcaataaacatgcagaatatcatgtggagttgtcgctttctttggctgtatggaatgctacgtcactttctttggctgggtgcccagtgcccttttgaatcggagtaaattctctcattgtcgttggattt

SEQ ID NO: 23132 - DNA, 1679 bp, Zea mays
tttaagtcacgataatgataaatttattatcgagatagtataatttaataatagttaataatctaagaattaggaactgttgaaggctaaagttgtttttgtttttaatatatatttagcaacttgtagaatccgagtttaaggagtagggggttaatggagatggtcttactatgtgtgatgtataacgtgcgcaaataaagaaaaaaaaatgaaaatggcgatgcccccgatatgggagactgggacgctcgcactcgcacgcaagccgatcaccatgcgggcatgccaccgtggctggcgccatggccaccacggcccaactggcgggcacggggacagcgcgaagcgcccaaggcccaccgaatcagaagcgatcggaccctcggtccctcgctaagccatccagctctcgttccgttccccacgggccacggtcctgggccccttccccatcaagcctaccacacctgctctctccgtccggcccacgcggccaccgacttccaaattcccaataaatacccggcattttgcttgcataacatgctttacacgctctccctcccacttcgtgcgagcgtcccgaactaagttgctcgtggtggaggtggtttgtggcgatggccttcaagctggtcaccaagcccgcggcggcgtcgcccgctgctgctcactggggagatctcgcccgggggccgcagggtacgagccgcgttgccttcggaccagcgcccaggaacaaggggctccgctcggccaacaactccgcaacgcccatggctaagtacgaacgctccttctcctgggttagaaattgtttggtttaataaacgactatggcccttgattgttggttccgtgtaagggatgcggggttggtcctagatccatgagttcgtgtttgtgtgtggtcgtggtgtggtaactcttatctagagagatttgcgattgtgttggttctctgttggggatttgtggtttggtgtgcttgggccctcttaagcccacgagttcgtgtttgtgcgtggtcgtggtgcggtaactcttgtctagagagatttgcgattgtgttggtcgatggttctcacttctcggttggggatttgtggtttggtgagccctcttacgtctacaacttcgtgtttgtgcgtggtcgtggtgcggtaactcttatctagagagatttgcgattgtgttggttctcagttggggatttgtggtttggtgtgcttgagccctcttgaacctgatcatccatgttttaggtccatgacttcgtgtttgtgccaggtcgtagtgtggactgtggtaactcttatcgagagagatttgcgattatgttggttctcagttttggatttgagccctcttgaacctgatcatccatgttttaggtacttgaggcatccaatatgtagcatgtactactgttctaattctacaattgggtgaagtactgaagtccttgccgaatttgttgtgttaacaaatatgacgcgatgttgattattctgcgtcttttgcttaataccctgcgaagtttaattgtttggtggacttgaccttggaagtcatgacttgatcccaaaagcatggtgtagcctgtatggactatgtatctacattgttgtaacttgtaactaacccgtggtaatttgcacacctctgacggctca

SEQ ID NO: 23133 - DNA, 3140 bp, Zea mays
caaataaacccccggcatttcctggcctaacacgctctcagtctcactcccacggtcccactcctcaggagcgtccagagtttaggtgctcgtggagtcgtggtggaggtggtaggtgtcgatggccttcaagctggccaccaaggccgcggcggcgtcgcccgctgctgctcaccgcgggggtctcgcccgggggccggagggtacgagccgcgttgccttcggaccagcgcctagaaacaaggggctccgcgcggccaacaactccgcgacgcccgtggctaaggaagagagggttgatcgaagtgaaatattgacattggatagcattagacaagttttgattagactagaagacagcatcatatttggccttttggagagagcacagttttgttacaatgctgatacatatgatagcaatgctttccacatggatggttttggcggctctttggttgaatatatggttagagaaactgaaaagctccatgcacaggttgggagatacaagagcccagatgagcaccctttctttcctgaggatctgcctgagccccggttgccacctatgcagtacccaagggttttgcatcccattgctgattctatcaatatcaacaaagagatttggaaaatgtattttgatgaacttcttccaagattggtgaaaaaaggaagtgatggtaatgctggatccagtgctctttgtgacacgacctgcttgcaggcgctctccaaaaggatccactatgggaagtttgtggcagaggctaagtttcaggagtccccggaagcttacatgccagccataatagctcaggaccgtgatcaactcatgcaccttctcacatatgaaacggtggagcgtgctatcgaacatagggtggaagccaaagccaagatcttcgggcaagaggtgaacatcggtgtggaggacaacggcagcccaccggtgtacaagatcgttccgagcttggtcgccgagctgtacagctacagaatcatgccgctaaccaaagaggttcaaatcgcgtatttgcttaggaggctggattgagtatgtttatgtagatgtaaattgccagatcagaactcctggcgttaagccagaacattggtaaataccggttttggtgtcaggatgcaaaatgtaccatgtgtggaattgtgccaacaaacaagcataatatcatgtggagttgtcgagtagtcgcgcctcgtgcgtactgccaatggacaatgtttgtagactgtatggaatgatgggtcacttcctttggcgggtgcccttttgaaagggagtaaaattctctcattgtcgttgaaatttatacagatccgctcaagtgccatcgaaattttcaacttactttgattgccacgattctaagtttgcattttctttgttgcaattcatgttaaaatcggttaagttgtacttgtaccaccgatatgatagcctgcccttccgttatccttggacatgtttggatctacccccgtttcttaaaaacgggtttctagaaactggcttttaggaaaaaaatggataggagatccactagtttttaaaaattggtctctgattcttccttagacaatgacaatcgtaccactgggcggaataacgcgtggagttgttcggatgaatgagacgatgtcattgtttagtaattccttttcattccattaagggtagtaccagtggcggaggacaaaataataataaggtatgactgaagaagaataaaaaagagaaaaacatgatgcaacacatatgactcaaacttggaacctaacgattgcaaacagtatatacttaccactacacaaaacatgtttttttggtatggttctagccatagttcgtcataacgggtgctccgccaccgggtagtacctaattagcgatccaaaaactgggtttagcaggggtaagcagattcttggtttttaagaaaccagaaaactagtttttagaaactaaataaaaatttgacttgattggaggccttataggttttaaaaaccagtttctaagaaaccgggtggatccaaatggggcctagccgcacatcgcacctgttgtagcgtggatgcccaaccacacggccacgcctgtcagtcgccagtagctcacgtgggcgcccaggcctagcttagcatgactgggacgtggctaagcaaagggctcgcatctttcagacttccataggaacgggaacgactacgagtcccttcttgtgttgatggatctccaagagttgtagccgaagacgacaagatagctgagaagagacagtccatctgttttataaatatagaagtctatatctatttagtaattcttttattttagaagtatttgtcacgactgaaggtgactgtatctgcttaaagagtattatctcaggtgtttgttgcaatattaaggttaattcatgattagtggactattagcttggggaattagccccggtcaaatatcagggctatgaatacttgtaataggcggattgaagaatggagtgattgaggagcctatgagagccttttctcaaaaacaagtgtggtgtctaaaacctaaccatcttagaaacccaattgacaccctgccagatgcctctagtgttcccattcctagagcaccatagccacccaaaaagatcaaatcccacaaacagactccacctaagagagaggcaaaattttattgcgattattgtgatatgaagggtcatttggttgccttttgctttaggaagaagagagacgagatgcggaatcctgagttaagtggagggaacatgaatcaccctctcacggtattcatgattttcctgcttagagtcgtcctgccaggcctagaggtgctttgcctcttgttgctaggcctcagggagtgagaccacgtgctggtcatgcctgacggggtgctggtcgtgtgccatatgaccaaggacccacggtagtgtctttggttcccatttcccaagaggaccacaatttccctctcatgatgattgctaccccccttcaggaccggggatgtttggtgtgtttcctaacatttttcaggggcaaatgccacaacacttttattactaaccccaaatgatgtggcatttggccacccc

SEQ ID NO: 23134 - DNA, 1507 bp, Zea mays
aagtgggatgttttacaccctacctgggacgtctcgtctcgttctgttgcccgcggtcgtggcctcctgggcccctctccacctaccctaccaaacctgctctcccctccgcccccacgcgatcacccgcttccaaataaatcgcagcattccctgcctaaacgtgctcgctctccctcccatttcatcccggcattttccttgcccaacgtgctctccctcccatttcctgcgaggtggttggtggcgatggccttcaagctgatcaccaagcccgcggcggcgtcgcccgctgctgcttactggggagatctcgcccgggggccgcagggtacgagccgcgttgccttcggaccagcgcccaggaacaaggggctccgcgcggccaacaactccgcaacgcccatagctaaggtagagagggttgatcgaagtgacatattgacattggatagcatcagacaagttttgattagactagaagacagcatcatatttggccttttggagagagcacagttttgttacaatgctgatacatatgatagcaatgctttccacatggatggttttggaggatctttggttgaatatatagttagagaaactgaaaagctccatgcacaggttgggagatacaagagcccagatgagcaccctttcttttccaaggatctgcctgagccccggttgccacctatgcaatacccaagggttttgcatcccattgctgattctatcaatatcaacaaagagatttggaaaatgtattttgatgaacttcttccaagattggtgaaagaaggaagtgatggtaatgctggatccagtgctctttgtgacacaacctgcttgcaggcactctccagaaggatccactatgggaagtttgtggcagaggccaagtttcaagagtcccctgaagcttacacgccagccataatagcccaagaccgtgatcaactcatgaaccttctcacatatgaaacggtggagcgtgctatcgaacacagggtggaggccaaagccaagatcttcgggcaagaggtgaacattggtgctaaggacaacggcagcccaccggtctacaaaatcaggccgagcttggtcgccgagctgtacagctacagaatcatgccgctaaccaaggaggttgaggtcgcgtacttgcttaagaggctggattgagtgtgtttacgtagctgtaaaactgccagatccgaactcctggtattaaaccataacatcggtaagtacccatttctgtgaagaggatgatccgaactcctgtcattaaaccagaacatcagtaagtacccagttttggggagaggatggaaaatataccatgtgtggcaagcaacatgcataatatcatctggagttgcgcttactcgcccctcgtgcgtaatgctaatggttgtagcctgtatggaatgctgggtcactttctttggctgggtgcccttttgaatcagagtaaattcgctcattgtcgctggaactt

SEQ ID NO: 23135 - DNA, 3783 bp, Zea mays
gtcgacctgcacaaagcaggcagcaccagccatagcgctccagcaaaaacttgagatcctttattctgaaaaggaggaaacacttaaaagttaagcaagcagtcaaagtgcattcagtcccaataacgaccaatgtgtggagcgccaggaaaagtttcagcacagaaacgactcatggttcacaaatcttgtccgtgttgttcatgtcctccaaacacccaaggttttgtttggatactctagtattcacttaatccacctcaatatacgtggattaggtgaataatagagtatccaaataaaggtccaatgtgttgctcactgacaacttatagagaaaattcttttacacacaaaagatgaagacactgatatgaatagcaagcaaatgacgccagtttgatgaaaataatctttctacacctcgctgagtcagatttacacgtttaagatgtccaagaaaactgacaaaagctcccagtgatggtcccatgtagtggtgaggagactgccacagccacagcttggaagggaggaaacgcctacggctgggtagagtatgccagatcattccaactctgtagacagtggctagagtcctaattgaatgggatagtgagacaggacagaggagtcccttattgggccgaaaaacaactggcccaagttgccaacatacctgatgccagcccatgacgaaattttcattcgcctaatcaggcgaccactcgtttatgcccatattggatgttatgttactcttaattagtcgacgcctaatcagacgacttgatttctagttgctccagtcaagccggatatcataatcgtcgccgacttgctgatgcttatttcgataattttgtagtgttctcaacgaagtttctcctaatcaagctgaagtgacttcactctctacagagacagaggagatgaagtactgctgctgtctggtgaaggcaaagctgttatgtcctgggaatattgtgggtgtgttgtaaattaagttttcttttaacaatatgacacacatctcaacttccatgattcaaaatattaccttacttcaggaaaaaatatatatatagcacgagaagtcaaagttaaaacgtaaaaagggtacctgctataaaatacaaaccccagatgcagcagctacttttttgtctacaaaatagcttcacaggttgccttgttgtggcctgcttgcttgcacctgctgcagagccgtattaccgtggggatcttgttggggttaaaccgcttccttcttggtttatccgacgtccgtggcttgggaggcgggattagatttgcaccggcactaaaatcaacagtgtccatatcaggtattgggaagatcgttcctgagtaagtcatatggtagctctctattctgaaaaacttggagcagtagtcgtagaaagatcgcccgatccggttgaacacagcgacagcatgcaggcacgggaggccagaaagctgccacctccggcaggtgcattcccaatttgcgagattaacgacaaagatcgcattgcctcgcacttcaaacacggtttcggaagagcacagaacagtcattttaccagccttcgtcacctcctcctgtgctttgaattccatggaaggcgtcaaaggtcctgaccacgccttgcaagcctcacgccttgtttctattatctccattatttttgttctcagtgagtcaaccatcagcacaattgaaccctccttcttggttggtatccagttattgaaggcatcaacaatgtttgaggagaaatggtcgtatcgacagcctctgaaaatggcgtcggaccaatgctcaggcttgcttgctatgatccactcagcagcttcagtggatatgttcctaatgctctcgattgacgtgttaaaatcctcaatactacatgcttgagcggcgcgagtaaaatcctcaatcatcccctctcttatttgttgtgaccatggtccctttctcagctctcctttgaattcctccatgatatgatgcaaacagaaggcatgatggctatcttcaaaaacttgagaaacggcagcatccagacccttctgtccactggacaagaatgtcatggcattgtaagcgtagctgtgattttggacagggaatttcagctgcattaagaaccaaacccaactttcatagttttcatcctcgaccacgctaaatgccactggaaagacagcatcgtcagcatcgactgcagcggccaccagcaacttgtactcatttgttgctttcagtggaaccttgtcaagaaacaataggggcctgcacccatttgcaaaaccatgcaaagaagcatgaaatgcaacaaaaaagcgacggaattttgtatccaccattggagataacaaagcaatactccctgggttggactctgtaagcctctcacaataccaaggcaaatggctgtaagtctccctgatagcatgatacagttccttctgtgctacttctttacctcgccagacctgtgaataggtcagtgtaactccatattgttcatatatttccttgacaaggtcctttggtttcaacatcggattatcatgcagcttctccttaataacagtggtcagccattgtcttgtcgctcgacgctgaccttctccatttcctcctccacatgtatgctcatctgtcattttcttgatcacaaatttcttgttacgagatgactcggatgcatgcattcgccacgtgcagccctctgcaacacattttaccgtgacacgagtagttcccggccggccgcgccggtacgcaaatcctttcccaatggcatatttgcacaattgagcacggaaatccttcacattatcaaattcttgaccaacacctttaattatgtcatcccaaaacataacagggttgtcgagtccatgctgaggatctacagtgatctcagaaccaacatatgagtcacctgaatcattgaaatggccaattggttcccgatgtgcagtgtcaacaagagcaaggttttgctgatccagaatgtctggcgcagtagaagcacctccagctggggtggcaaaggcaacatcacttccaaattccagttggaataccctgttgtcgttggtttcgatagctattggtcttggctgtttcacattattagcactaggttggactgaagtgccaggagcactgggagttggagtcttcttgttacttttggataccttgtttttggaaggtggccttttccttttatcaccaggagcattagatccaggcttacttgcagaagctccagagtaagtaacaatactcctgttttctactctactaatcaagaaaacttccacttgtgtggcactggtagtaaaatcaaccatcctttgtaaatctcgatcacatgatatcgtgattagcgttctgtaattattcggaaggaagtacttcaatgacatgtcagtgacgtcaacatggaacaccttggacacctcatccttgaagttctccagtggcatgtcacgagtaacatcaacagcatgcgcctcgcctcctttgtatgtcaaattaccattggggccagaagtgaattctccaccatattggcaaatggctaccacaatacccccatccgccatgcttcccacgagagagcacgaggaggaatcagctcaggcttccccgagagtagagacaagcgagtagttgcctccggacggaaggaggcgggcgcgcaccgcggcggccgggaagggaggggacgaagggaagggccccgccccggccgg

SEQ ID NO: 23136 - DNA, 1058 bp, Zea mays
gcttttttttttttttttgaaaactcaaatccagagatcagtcatcgtaatttccctctcaaaagatccaacagttccagttacaagattgaaacagattcatttcaggaaagtggatcccagaaacaagaaaatgtaagcaactagtgaggtaagtagctctagagaccatgaaggtgggatgatgaatgttgggaccagtggaaccagtagagaaccaatgatccaaccgccaacaagtattccaaacccagtggttgatgcccttagaaggttcttcatcttttcgttgaggaaatatatgcatgagaatagcgatatcgcgagctgaaatgcaggtccattctctgcagaagttgctatgctccatccagcaatgaaagcaaagaaaaacaatcttctggagataatatccatcgatggcacctcaaagcaaccaagaagtgctttgacccatgaaggggattcctctactctcttctttaacttggttttcaagttaatttttgtcttcttccgctgctggtagctcttcataattatcttctcataagcaccttcaatagcttcttcactcggttcatgcccagcatactgttgaataaggaaattcctcgcacctcggatctcttcttcagatgcatcacgatcaacaccaagaagcttgtagggatctcgtattcggtatctagggaacaccggaacatgctcgtagctgaactcgtggtcagcttcggcgccagcgccggcgccggcgccgatggagaggctaatggagcaccgcggcccccgcagccgcagagggagcgcgataacgccctcacgcaccaccgccgcatccgctccccagctgccaatgcggcgaagccgcgggagtgggcgggcgaggaaggaggcggcagtcgcctgcatctccagcacctgcggcggggagagggaggcagggagcggcgaggtcgtcttgccgcgacgcgggggagggagggaggagaagattggatagggagcgacgcggagacggagacaggaaccccggcccggccggcctcgaggtaccc

SEQ ID NO: 23137 - DNA, 2511 bp, Zea mays
  misc_feature (547)..(547): n is a, c, g, or t
  misc_feature (639)..(639): n is a, c, g, or t
tacacacctttacttgcttcagtaatcttgcttgtttttttgttcattgttcctgtccttctttcctatcagtaatctccaatctttgaagcttaagctacataagcagccattcctagcaaccatgccaaggaattttcctaagactcctgcctcctctccaataggttggccgagctcgttacagttaactacaattcgttttcctttttgaaggttccaaacatgtttaagtttgttcggaccacgacttattgcttcattagtttgacctatgcagttttatgttagaaacaattaaagaatggttgaaattttaaaataaattacaatttatgaagtgtaagaaccttcaacagaatcctctatatccgcatcatcaggagaagggtacactccagaagtagtctcaaaagatgttgtatcttttttatgatgatctgaaaacatataataatggagagatttcagttgctgtccctaaacatataataaaatttgaaaagtaggacatagtattcactatttattagctgaaaaattgaantcactgttttatgttttaattcccaattaattttatatcttggtacatacctaggtcattgaactcattaccattgtcgctttctttttggngttctctagcagaaggatggtggtcatatgctgcatctcgtggccgatgacttgtttccccaataggctcctctaccaaatactcttcttggcttggaatgatgcactttctcatacccctagccatgtccgctggcataccaaaataaaaacttatcatgtgtaattagttggtctagaaatgtaaatggagttcagtaaaacatagcattaatccatacaatggccaacatagaaaagaatttatcaactgacttgatttaataaaacacttggagtctgaaacagagcccaactcaatgaggaaaaattgttttactaacatctctaaaacttcaaacaaagtacaatgtgtctgcaagtatttagacatcgtataaaaacaagtcatgtaaaagttgacattactaccactacctccaagtatcccacaactatggacaatgtgtctgcaatgcagtttctgaaaaacacctaacaggatgctatgtaaaataatgtatatggaaactgctatgaatatctagttacaaaaatcagaggaactatacatctgctaactacagaaacaataagaactagtacaaggttacttgaactaaagtataaggaaactgctatgaaatgcagcagtactcagacaagtgaaaacatggcccagatttggtgcagccttacaaccgacggcaaggaaacacacgtcgtgtgtcctctgtgagctgcagccgattccccgaactggcgcgcaccagccaccgccaattcctgccttggtgcgcaccagcctccgccaatccccgaattggagcgctcaccaattcctgccttcaccagcctccgccgtcgccagcgaagccaaaggacggattgggggaggctgttggacgtggcctagggcaggggtagtagcgtgagtagtgggagaagttgcgtgaggaaagagtgcgaggattagggatcacattgccgctatgtacagccagcagatgggtttgtagggtctgtacggtgggtccacaacaaaattggtgggaaaacttgaaaaattagggaaagaacaaatatggaattaccaaatttcagatcaaatgccaaatttcacaatttgagctatatttttaacttttgtttatgtctctattttggaccatttactaatttctatgcttcaaatgccttttcaagccgaaataaataaataaataccaaatgtgcttaaacaatagcgaaacttggcatggagtcataacatgttcctggttggttgagataaaaagtttagattactatacagaagtatgaatacaggtgcttcaaaaatggacacatctccactacgtttcataccattgatctatacagtttgagctatatttgtaacttttgtttatgtttttgccaaaaagggtgcaccaaatgttcttctaactgttataaacttaattcatgtaaagatgtccctattttggaccatttactaatttctatgcttcaaatgccttttcaagccgaaataaataaataccaaatttgctcaaacaatagttaaacttggtatggagtcataacatggtcctggttggtcgagataaaaagtttagatgattataaagaagtatgaatataggtgcttcaaaaatggacacttctcactgtacgtttcatatcattgaactacaacttcacatcttgagctatatttgtaactttttttatgttttttgcctcaaaagtgcaccaagtgttcatctaactgttatagacttaattcatgtaaagatgtccctattttggaccatttactaatttatatgcttcaaatgcctttccaagcgaaataaataaataaatgccaaatgtgctcaaaaatag

SEQ ID NO: 23138 - DNA, 2497 bp, Zea mays
ctttttttttttttttttaatctggaatcagtctatattaaaaatagtagtgtcgttataaaatatcatccacaacttaatccattacacaatgtatgaattaacattttttctatgatagtatgaaacaaacaaaggttgactcataaactggactcagtagactcatcgctctcatcactaataacgccaatttaaagaagaatcaaagtcatagccctcatgtagatctgttgttgttcaatggttgacattaaagagctgccttttctatacaacttgaaggccatgctatagggtcgttgtctatgtctcctagaaccacgaaattgttgtagggccgtattagtggttcatcacgcacaagtacaagaccgagacgaaccttccaaaattctttgcccaatggatctcctccaacttgttgctttggatcacaaccaattattgtacctaatgcaaccttcttattttgattcctccaactcttcaagaaaatatgagaaccaaccttcagtcctgttgaaatcctactaggttgtaatgtgtctcctcgtagtggcttgatcgtctcatgattttcgtcaagtgtccaaaattcctcactttgaaattgaccatatactcgttttcgttttgatgtagactgatcgtctttagtacttggcaaataattttctagagatcccttgttcttgtatggttcatgattagaggaatttcgagcagtgtcctggttcatcaccttggctgcattacttctattttttacatttaacgatgtagaaactctaccaccttggagtcctcctcgtggcattggtggcttgcccttttcttgaattttagattttttgcactgggcctgcagctcctcgtacccatcatgtttgatttcatccgccattgtgctattcagttcatcaagaagattaattttttgattcatagtcggctgaagattttttgatgccgacaaaggttcatctagacattcatggtgacttttatgcagttccaaggtattttgcaaatttagtatagtatcatcttgcttctggacacgatctataagtttttccacttgaagtcgaagagatactacatcttcacttgatgttgcatccaaagaggttaaattaagatgttttagatgccttgaagttgatccaccaaacacttgatctggattcggaacaaggccaagaccatggatatggccaggcttctcttctcctaaaatttggctaagcgcatctcctttccatgcaacctttccatgactagtgtcagctaaacttggttcttgcactaatagttccttcaacgcaaccacatgtgggtttgtgttctttgtgatgttactcttgtgtgtattgatatacaatacagccctatgggggtatttcttttctggatcttgttccctcatatcttccctgttccgagcaaaactctttgttcctgatgtatgggtcgccttcctttttgcgcagtttatcctatttgcctcactgatatcctgtgattttgttgtaaaccaattattcacaagagcgacccattgatcatctaagacgccttttggaacattttttagattattttccttgctcctatgcgcatcaaaatgtaaggattttagattggacttgtgttgtctccatctctcaccaatagttcgaagtatccacttttccatgcgggcagggtataggaatctcatctttacttgcttcagtacatcttgcttgtttttttgttcattgttcctgtccttctttcctatcagtaatctccaatctttgaagcttaagctacataagcagccattcctagcaaccatgccaaggaattttcctaagactcctgcctcctctccaataggttggccgagctcgttacagttaactacaattcgttttcctttttgaaggttccaaacatgtttaagtttgttcggaccacgacttattgcttcattagtttgaccttcaacagaatcctctatatccgcatcatcaggagaagggtacactccagaagtagtctcaaaagatgttgtatcttttttatgatgatcattgtcgctttctttttggcgttctctagcagaaggatggtggtcatatgctgcatctcgtggccgatgacttgtttccccaataggctcctctaccaaatactcttcttggctttgaatgatgcactttctcatacccctagccatgtccgcgagggcaaggaaacacacgccgtgcgtcctctgtgagctgcagccgattcctcgaactggagcgcaccagccgccgccaattcctgccgtggcgcgcaccagcctccgccaatccccgaattggagcgctcaccaattcctgccttcaccagcctccgccgtcgccagcgaagccaaaggacggattgggggaggctgttggacgtggcctagggcaggggtagtagcgtgagtagtgggagaagttgcgtgaggaaagag

SEQ ID NO: 23139 - DNA, 2412 bp, Zea mays
gggtacccgggccccccccctcgagtttctccccccccctccccccccccccccccccgttacgcaaacggacgaggatttttcattctttccaaaacagtcgagaatgcacatatacattatcatcattggaaataaatacgaatccaaacatcagatttttcattaacaccatacgaagatttgaaatgttcaattggcagggaataaatgagtacttctactacatctttagaaagccaaactttttcataggggttgagcgaacgacaaggcccttagtccaggtcccgagttgatgacctccgaacagacagcagcgagcatgcatagaactgatgcatcatgtacgcaatttaatcgcagtccaccaatcatattctaggatggtttggacggtcgaacaacctgtataagtgcaagtcttcgtgtgtagctcggaaataagatactgttatacgttgtagtagcacattacttgcgcctgaagaaaataggaatccttatattttctgccactcccgatgtggacaccatttttaatccaatcttctctatgaatccacgcatccttaccaatatcaaggacgcccaaaatcactccacctttccatggaacaaataatggataagtcctagattgcaacacctcaactttctcaatagattggtttgctgaaattttagtgcgaaccctttgctccagcacttgtgcaaggccagctgtagaagctgcaccaccaaccaactgaatgctaccaaacagcttcttttgaaggtcaacacgtcctgttgaaagtacactactaataatggcctctacgaggccaatgttatcaaatttctttaatctagtgggaaacatcggataactgtcccacatgccaaacccaccattcccactagggtaaagaccatcacttgtttgccaggtatcctccagcatgtcatcgtagtcttggaaccaagatcgaggaggtggagggtactcttctggaacaagaacccttgggtaaagaagacccataggaggaacattaatagctgatagtcttgtcttctgatgtccaccagacctttcattatcatatgaatgaacaaggacagctgcatcaatgctcccagtctttatttggctatatgactctttgattttgttgagcattagcatatctataggattgctcattggatcagtttggaagtttggccacgtgccatggcgacgttgaacccaaagcaagcatctggagatgtcatctccaccatatggaagcgccagagctgtgtggggcaaagctactccatcctcaacacaaactacttgtgtaacttgagccccaatgttgacaacacaagttgtagataaaccatttccaaacgctgcagatagagcttcctgatgtacaactgcagtgctgaaccccaaatcatgaaggacaatagacagcatctcttttatttctcggttgtcaaatgtctccccaagaacaagaattgcagaatatagacctctgtctcttgggttgatatgcaacttttctgtcagtatccagttccaaatagtgcgtaaatcttctaaaacctgatgcactgaataattatgggacacattaaaatggcctctcctaattgggcgactcagacagtatgactctgaaggagggattttcagagcatcttctccaaatatcatttctttatacttattctctttaaagtcctgtccattatcatcatcagatgtgcttggcagagtatcttcctcagcatccttgtatactgacctatcgaatggtgtggatggcttaataattctctctgacacatctgtccaagtgaatttattatcgtctctgttttgctgcgaagagaagccatcaacacgtcccatctttggaggaaggggttggttcggtgaaggcatttcttcatcgtccaaaaatgggattttcatcagtgctgcaataatatcatatgcactctcccgctctgcattctgcgatgaagtagcatggcagttgagcatctgatcgcgcacagagaatcttggttcttcgccctcttgtggattgatgtgtcgggcaatgcaatgtggtatattgaatggcacatcctgactagcaaaccccattcgcacatttcccgatcctgggttgatgacgacaagattggagccgcgctctgccaagagttgtgacggaaccaccgtcctgaggtagtccatctcgtcggctgctggcttggccaccggcacgggaacgcctggacgtgagcgctcaagcctcgccgtcgctagagaagacaacgataactttggcaacacaacgttttcatggttccgatacaatctcgcagcccgtcctgggcgtcccccatttttaagtttatatttttatttttttttttttt

SEQ ID NO: 23140 - DNA, 2435 bp, Zea mays
gtacccctgcacatagctgaccccccccccccccctccccttaagccatcttcctggtagttgtatgatggttgactgaagaacaatgatgtgaaggattcatgatgtcaacttgtcaaggtaatgtggtcaaaaaaatcatccatcttccatgccaaggtgtcatgctgtctgccaaactctgaaacacagccatcttgctgctcttcagccttttgtttcggattgtatccagagccactttttatgccatacaaaaattacggagacttcatttgagaaggacttggatttgtatcgattccgttctacggccagctcatctaccaatacgtttcatttcaccgagttgtcttgtctcttgcccgcagaagacactattttccatttgattctacctgcgtctcaagtttaactaagtttaaaggaaaatatttattacatttatgacttcaaatagatagattattaaaacatatcttatgaataatctaatgatattcgtattataaacagcattattatttttataaatttggttgaactaaaaccatttgtttataaactgcttgtcttactgctgctttattcatgagttttttctctctcccccttttgcgggttctcaatatcattgatatatctacttctctattcatacactaatcgactttttttagatagaatagaggaagtatactgtataccatagcaacaaatgccccgataattattcgctcgttcatgctaaggtactttttcatagtccagttcatgttgcttgttagtcatcttgcagctgcaaaagcagccaaagccctcagctcattaggattactgaaaccatttctgaggcgcaaccgagtgaggagcttgaaaaggataaagccctcagctcacagcttctgtatggatgggggcccctggttgcttcttggctggcggaaagaacgagagcaaaagcatatataattaattactggctaagaggtagcactactagtatagaagaaaccaaacaacacttatcaaatccctaaacatagatgaactgcaaaaagaagtttcagagttcagtacaccaagctccggatacagagtacagactatgatggatgatggctgtccccctcttcttaagttttaaaatcatcatggacgatgatagctactactgacctgccctgcataacctcccttctaattagcaaaccaacaaattcccctttcatttgcttaaaagcactctccatgctttcttctaattgattgactgactgactgactagctgcaaagtttcctctctagatctgtctccctctgctgctggtttagctctccttctcacctagtacctaacctgcaagcaactgcaactgcaatgcagcaaccactctgattcatctatttctcctgcctctcctctcaccctcctctctctttctctctctatacaaacaaaaaaacattcagggggaaccaattaaccaatagacagaaaagaagaaaggtaaaataacactagcccccgatgagaaagaagacctaatgaactaaacgcgccgggatgcccggcgatggattgggattggatcgcgggccgcagaaaccaatgcatgtgatgaggggtgggatccatgccatggcggtgaccggtgaagtggtgatgatgaccatgatggacgacgacgacgacgaccgacgactgctgaagcaaccatgcatgcatacatactagcatgtatacatatactatatagctagctataagggggacgagaccgaccgacagtccggcgacgccgtgccgggacgtcaatcccggcggcggatgaactgcaggaggtcgcacgacgggtcaccgctccggacagccttctggcgcatctccaccaccttcttgtgcgagttggagtggatggacggcacgaaggtggggctcgccgcgggacggtactccgggaacaggcggccggacttgtagcgcacgccacaggcgttgcacagcgtcttgggccccagcggccccgcgcgccactgcggcgtcttctcgatctggcagtgcgtgcacctcctgacggcgccgccctgcggctccgcgcgctcgccgccttcctcgtagtcggcgtcgccgtcgttgtcgtcggaagaggcgggcgcgggcggcgccggcggcttcttggccttcttctttttcttcatgggcggcgccgggtgcgggctggactcagcgatgctctcggggtccgagtgggacggcccggacgagtacatgggcgtcggcacgaggatggtgggcgcctccgccccggcgcgcgtgaacgcggacgggcgggagcgcttgctccgcgcgcgcgccggtatgacgagcacgggcggcggcgacacgggcgccgaccacgcgtggccttcgccgctcccgctcccgctgccg

SEQ ID NO: 23141 - DNA, 2201 bp, Zea mays
aatatgaaaataataatgattttagtattttccgaccatttccgaccgattccatccctaataagcacaagcatggaggctgccggctggcagtggctgggcaacgccacctcaccaccatgcgtccacgcagcactacggcaggcacgtcgtgaacccatgacacacagggaagactgttgttcgtcaaaagggagcagggacgtcgctgcaacctagattggatcttggttcttgcataaggattgatgaatgacgatgagtcacgaacgctagaacgcagtaataggcaacaaccggcacgcgtgctcactgctcagcgcctcggccagccgcgggcagctagcggactcatgtagatggtatagccgtatagggttttaagtgggcaagttttaatgggccaagaaggcctgggccaaaatcatctcccgcttaatgtataacatgataaaacggaaatttttcggtaaaatacgggatactataaatatgggcgagaaacacctctaattattttcgttcccgttcccgagcagaccgacctgattctcgtactgtttttatattttcccagaaaaacaaaaacatatggtttcgaacgagaatgtggaacgggacatgttgataattttcctcattgttttcatccctagtcatgggggcgtcttttttgcctttttaccctttttacgaaagattttcacaattacgctctttctggtttggatttataaatagatatttacctcggcgttattattattgacgccgaaattacatgtctcggcgtcaatataaatggtgccaagatcttgcttcggtgtgtcgagctgacgcccacgtgacaacatgtcggctccgtgatcattggcgtcaacctcctttcctaggaacggtcgctcgtgcctcatgcctttgttgagtgggtggcgtgcctggtatgtatatatagcattagaatttctatatatttatattagtataaaatataatttattaatattataatatttatttatataaaatataaatttatatacttatatatatttactaggtgagtgcccgtgcgttgcaacgggaccactacattgcaacctttaagtacaaggattttccgcttgcaacggggccagaacctccaatgtctaggaacaattcagaagaggcagaaatcagaaagtgtatcgagtccttcggaagggcaacagattattggttaggttgcttcttgcttgtgaaattgatcgaaaagcaaagaaggacattgacttgagacaatagggaggcgaggcagagcggcctcgcgaatgcctgctttagagctcagtggacgttcttctcgtgccacaactttttcctcagcttgtccacctgtaaaacaaaatcgaaaacgttggacgtcctcaacagaaatgcaagaggcttacaactaaacaccaagtagaacaatacacacacgtcttgttgcagtgcagttttcctgtcacttcgaaaatggcttctgttcttcatgccttgaagcgtcgcatttgcggaggacgccttcatggacactggcgctatcttcgagctaggtggcctcctttgctcctccatggccatggatagaggaaacaacacaaaaaaattactcaccccaaacacattcctctaatcttcataagaacagataagagtacaataagacaagctcaaataatagtataatatcaagtatgcaatatatatttggtctcaaagtacaagttcaaccaccttctgcaataggctaaccaactataaggataacaaaatgtagcatgtcgtaagtataaaactctcacttgcaacttaatattacagactgaggttcaacacaatatgaagctcttcattgccccatatattttaaaagaattgctcaaaagaaaatgcatatcttgttttatacaggtgatcgaacattgagtgtcgctaaccgtaaaaggcagtgcttcagcaaaagaagcacaacaacaccaacgtttgtgtaacaaaacatacacactttagctccacattttcaatacaagaaataagtagccacatatggcatcgtcagttcatcattgctcatgtgactacattttgaatgcaggaaataagtagccacatgtgaccatatattctagtggaatgctaacctctatttttttaaaaggtatttgaatccaaca

SEQ ID NO: 23142 - DNA, 1262 bp, Zea mays
ttttttttttttttttcgactccacaaaacaaacacaccattaataatttataatttcaatcgccctggtacattacatgcatggacaatgggcgggaaagcatctgcaaattaacttggccttcctccatttcgttcccagtctccaactccgccgtgaaggccgcgcgcacgccaccaccatctaccagtaataatcgactgaggcacctcgcacagtgctcatcagtcccatgctgcatatgcagcaatacaatagcactaccaaactaatcaagcacaaggacgcagagctatcgtggtgcgcggcggccgccgagagctagtactggatgatggaacggtagtaggtgttgggaacccagttggccgggatgacctggttggccaccagcgtcttgccggactcgttggtgatgcgcagggagaagggcgcggcgaggcggtggccggagtccagccgccagatggacccccacgactcgcgcatcggcgtccacgacccggagttggcctccatgaggtccacctgcaccacgtcgccgtcgccgtcctcgaactcgacgagcaccgccaggtacaccgggttggacccctcctcgatgtggaacgtcaccttctgcccggggtagttgcagggcaccctcttgaactggatgtcgatgatgccggcgtggcggagctcgtcggtgcggccgggcttggccatggcgccgaacgccgtgccgctgaggtcgaagtggtacttggccacggggtagtagttcatgtcggtgatgatcaccgtctccggattgccggagcaggctgggtggttttggcatcgtatctggtagcaggagccgcagcccttgccgtccttgaagaggggctcgttgccgcacgatgtcatcgccgagaacggcggcaggttcacgttcttgaatccacaggcaccaccgtcgtcatcagggccggcgccggtgggcgcaccgtaccaggtggcccgggcagcctcccagttggggtcggcggtaaagtcggaggcgttaaagctcgccggtctcgcgcacgagccacacgttacaaggagcaagaagagaagcgccgcaagtgcaactaccgtggaggaggaggaggaggaggtggcggccatcgtagtgcagtaccttgcgagcgagggctgctatgtattagagctagctactggtaggcagacgacaggagaagttcgatctgtgtgtcgatttccgactgggatgttctaggtaatggtctcgtgc

SEQ ID NO: 23143 - DNA, 816 bp, Zea mays
cgtcttgccggactcgttggtgatgcgcatggagaagggcgcctggaggcggtggccggagtccagccgccagatggatccccacgactcgcgcatcggcgtccacgtcccggagttggcctccatgaggtccacctgcaccacgtcgccgtcgccgtcctcgtactccaccagcaccgcgaagtacaccgggttcgacccctgctccacgtggaacgtcaccttgagaccggggaactcgcacggcactctcttgaactggatgtcgatgatgcccgagtggcggagcttctcgctgaggccgggcttggccatggcgccgaacgcggtgccgctcaggtcgaagtggtacttggcaaccgggtagtagttcatgtcggtgatgaccaccgtctccgggttgccggagcaggactggtcgttggtgcaccgtatctggtagcaggagccgcaccccttgccgtccttgaagatgggctcgttgccgcacgatgtcatggaggagaaggggtactggttggtgttcttgaacccgcacgcaccgccgtcgtcgtcggggccggcgccggtgggcgcgccgtaccaggtggccctggcgtcctcccagttggggtcggcggtgaaggcggagtcgttgaagttcccggcgccggcggcgtaggtgacgaggagggaggacagtgcaacgagtgcaacggccttggacgaaagaggagccatgtcaaagtaccactgcttcttcgagcttgtgggggtagtgtaccagcgcactgagcgggtcgggctggggggctgagctatgtatcttggttttcg

SEQ ID NO: 23144 - DNA, 2976 bp, Zea mays
  misc_feature (2930)..(2930): n is a, c, g, or t
  misc_feature (2938)..(2938): n is a, c, g, or t
  misc_feature (2942)..(2942): n is a, c, g, or t
  misc_feature (2973)..(2973): n is a, c, g, or t
ccaacaacgttttttcggctgtttgtaccgcaaaatggctgcaattgtactagcacccaactcaaatgatgaatcttcacaggtcacagcatgtttaccgtacacgcatccagctcaataatgaatctttacaacgtgtttctttacaagtttcatcagattattcccaactttgaactccataaaatggtaggacttggcacatccctgtcagagttcaatggataattcgaactcttcatcacccaccgttagaacatgggcacccaacagaagtacccttttgccttcaggattggctgcgctcatttgcttgcaggggtcaacagtaatctccacattggatgcactgccagccgccgtgtggacactctcaaagccaaccagctgttttataggaaagcccgggacgcttgatttcgatctcgcgaacagaagaacagcatgactcccatccatgctaccatgattcgaaacagcgacgtgaacagagaaaaccagagcttcacatgaagcgatatcttcagttttcacagagcctagtccatccctccttgtgtatgcaggctttctgctgataatgcccaaatcggatgaacgcgacacggtgatcttcttcggagccgaggagatgctatatgaatatttggagtaacttaaaccatatccaaagccatacactacatctccagtgtaaaatcgatatgttctcccagggtagcctcgtgaaggatcagctctcatgttcatatcagtcatgggaatagcagtaaaggattcaggataccaagttataggcagctttcctcctgggttgtactctccgaaaagaatttctggaaggacttgtccaccaacctcgccaggatatccgagccaaagaatgcttgcgattcgtggatcttgctttgcaaacgaaacatcaacaggaccaccacccaggagaaccaacacaaggggcttcttcgctacactagcaatggcatgtatgaggcccatctgcttgcctggaaggagaaggctcactctgtcgaagtcctcacgctcttctgtcaggttcaagccagcaattacgacaacaatatcggctcttttagctgcttcaacagcttcgccaaacaaatctgttgagttacaggaagcatccttgcatccaggggcaaagcttgtttgtgtagcatatgcttgaatgcccttaaggaaggtcgtaggattgcagggaacacctgtatagtctccgcccatcgcatacgcgtcatttgcagatggtccaatgatggcaacatgtctaacttcgcttctcttcagaggcaaaaaattatggtcattcttcagaaggacagcaccctgccttacagcttctgctgcaagctctctatgctctttcgtgcacacactgttgggccctagttgagagaaccattggttgttgctgggcttatcaaatattccaagacgcaactgaaccgagaatagattaaaaagggcacggtcgatatcttcttcttgaatttttcccttctcaattgctgacttagtatgccgaactaggaaagaaccacagttgatatccattcctgccttaagaacaattgctattgaatcttcgcctgatttagtgtatgtctggttttcatgaataattgccacagcatcacaatcagatgtaatgtacccctggaagccccattcatccctggtcttctgcagaagatctttgtgagcacacataggcacaccattgacctggttatatgcacacatcaagcagctagcacgagcctcctggatgcaggtcttgaaaggcggctggtacgtgtcttccaaatcttgtgcatttaccttggcattgaaggtgtaccgcgagaagccttcccatttctccatgtcatacgctgtatagtgcttgcagcacgcagagagcctgattctgccttcctctccttcctctccctggaaacccttgacatactcgagggagtacgcggcagcgacagcggggtcctccccggacgtctcctggccgcggccccaccttgggtctcggaagatgttgatgttaggcgcccaatacgtgaggccggcccggccggcgttgtgcatgccgagggcctccgtggcgacggcctcggcgaccgcgcgccacagcgagcggttgaaggcggcggtggacaggatgacctgcgggaagtcggtggcggcgcggacggggcccgaggagaagttgaccccgggcccgttgtcggcgaggccgtggagcgactcggaccaccactggtagggcgggatgcccaggcgcgggacgccgcccgccgtgttggacagctgcgcgatcttctcgtccagggtgagcagcgagacgagcgcgcgcgcgcgggccgggatggagagcgacgcgtcgcagaacgggtaggcgctggccgagtagggcgacgcgcacgggcgcgcgttcggcgcggcggcgcctgctgcgccggcgccggcgcagcaggcgaggaggcagaggagggcgacgagcatggcggatgcgtagccgttcggtggggaggaaccggatttcggtccaacaatttggccgtgcgctcgagtcgagtggctcgccggcgaccactgaaactgagctactacctgcagtgttgtgattgttacgggacggcgcggagactgggacgacgaacggagaccggcgccggatggttgcgtcgtggagtggaatgctcgctgcctgctgcccagtgtatgactaggatcagttgcttgctagcacagtagcacggcctatgcgaatttgtatttcattttggataagtgtggacacttgaaaaaactcacgctttggcttatcgcggggaatcaggactcgtgaaccgtgtttggacccgcaacagggtattctttatggttctttagtaaaaaaataggaactattnttggtttntttnctcgtttgttaatgcttgctggcttgctgtnctg

SEQ ID NO: 23145 - DNA, 1960 bp, Zea mays
cccgtccctcgccaccgccatggccgacgtcggcgagcctcctccctcgctctgccccttatgcggccaccccgctgccttctccgtttcaccgtcgacgtctgcggcggccagcgtgtcccccgcaaggccgctgctgaagcgaaggaccccacccgaggcgccacctgcggtcgtgagggtggagatcggggatgaggccgcggcgctgcgcgaggcattggcgcggcagcaagcggcgctcgccgacgtccaggcggagctcgacgcggagcgcggggccgcggccggcgccgccagcgaggccatgaccatgatcctccgcttgcagcgcgagaaggctgaggccatgatggaggcacgccagttccgccgctacgccgaagagaagatggcccacgacgccgccgagctcgcggccctcgaggaggctctctcgaagcgtgaggccgggatgcgggcgctccagggccagacgccccgtcacgcctgcgccgtgccgtcggggggctccaccccacgacgcccctctgtggccacgccgcgccacccaccctcctcgctgtcccccgcggcgtcgtccggaggagggtactacccgcctctgcggtgcagcatcgaccacccgcccaccgcgtccgaagcagacgcgctcgagacaccgcgcgaccagctcaaccacctcgcccaccgcgtccacctcctcgagcgcggcgcgaccccgatggccgccaccaacaccacgcccatcatccgtgtcgcgccggggtctgccttcccgcaccatgcacgggcctactcggacgacagccttgacttgtacgatggtggcgactgcttcccggatgacgattgcggcgccagcgaccgggtatacaccgtggacgccattcatggggcacccctggcggttcctgagggctcctacgccggtagcacgcccatggggagcgactgctacggcggcgctccgtgggcagaagacgaggaggtgcgccgcctcagcgtgcggatgcaggcgttggaggcagaccgtgagtccatgaggcaagccatcatgtccatgggagccgagaaggcgcaggtgatgctgctcaaggagatcgcgcagaagctctgcaaggacacgacaccaccggttccagcggcagcagtggctcagcacagcttttacaaagggggcaacacacagccggccatgaccatcactgtgcgaccaccacggcacccggctttgcttatgcaaaggaaactggtgaagaagaagccatcactccttgctgcagtggtcaagtgggttacatcaatcatgtggtggcgaaggaaatcatcccgcgtcaagttccctattgggcagtgcggcaacaacgtggggctgcttctgctgctcgacaaggctcccagggcaggccacgggcaccagaggcctcccaagaggatctaaccaccaaatgagtcatctgtttgtgaagcaaacacatgactgggcttccgcattgttgttctcgcgttcttctattcaccgtgtctggtgatgtagctttcacatatggaaaccatttttttctcatgtaggatataccacctgagcattgtacgttgtgtgttcatgggacttcaatcaccagaagttgactcagatcttagaatcgatcatatggaattgacgttcatggcaattcgccgctgaatactgttgttgggtgtcatttgagcaccatattcaacttgtcagtaaatacatggtttacggtttcatgatggttttttttgggtggggtgggggattttgaataggcaattaccagggtagttcttggtttcatgattgtttgggggatgctgattttgaataggcaattaccagggtagtggaacttaggctatccgcaacggtgtcctctaaattttccctctatatgctacaatgcagtcacatcaacaagatttcttccccttt

SEQ ID NO: 23146 - DNA, 1857 bp, Zea mays
gcccattaccatctcctagtctcatcatctcatggtgtgaggtttcagcaattgtcatcccacggttgcccagcctgagtcttaatgtaaccctattgcaattgacatgcaatttagaattagcttgccctcagttcatcactttagttaccactcacgccccattttccaagtacagagaaagaagagcctctcatatcccgtaatcgaattcgaagccttacaacgatcgaccgacccaatggcacaacaagcatcgcgacactcagtcgagcgcgtcgcagcggcgcctgacgacgccctggcgccccgtcttgacgccgacggcgccgagcctctgcatcgcggcggcgaagtcctcgaagaaggcggtgcggttggcggcgtagcgctgggcgaagaccctggtgggcgggtactcccagatggcggcgtcggaggcgagcaggccgaggccgtggggcaggttcttgtagtaggtctcgtcgaagtcccggggcgtgacgatgtcgttgaagatggagacggtggggtcggtgcggtatcccgcgcaggagcgctgcagcgcgcgcgcgaactccgggttgagccgcgggtcgtggctggcgccccggtagccgtagatgcggggcgcgaactcggcgcagtgggagaagccgacggtgtgggcgccggccagcgccaccatctcccggggcgcgaggcccttgcgggcgaagaggcgcaccatggctcgcgccgacatgttggtgcggggcaggttgccctcgacgtcgcgcgcgtcggagcggcgggagtcgcggcggcccagcgcgacggggaaccggggcccgcccagggcggccacgaggtcgcgcgccgctagcgccagcgcgtcggcgcaggagacgacgcccgggcacgcggcctccagcgccgccttggcgcgggccacggcgtcgaaggcgtccccgggcagggagaggttgatctccgcggcgcgctccggcgcggcgtcggtggaggagagcggcgagaccagcaccgaggcgtcgcagccgttgacgaagcagtcgtggaagaagagccgcagcgtgcccgccgccgtggacgggttggcgcgctgcttggcggcgacggcgtccgacacgatccgctccacgcgcgggcagctgcggcggtagtagttgggcgacagcctgggcgccgcccccgccgcgcagcaggcggccgcggtggcgagcagcgcgagagacagcaggagttggcggcggcgcggcggtgggcccatgggcggaaggtagattggtttgggagtgagagagagtgaagtcgacggcggcggtgaagtgatggtggcggtgcccctggctggcctcgatttggggaggggagtggaagggaaaggaaaggtggtggagactggagactggagagtggattaggtgggttgtagtgctcgtatcgagatcctcctctgccggagcgacggacggatgttttgcgtttgtttgcatttgttttccttagctgccctgcggtagattaggtagtagtacagtgtcgcttggcgcaatggtccctagcgccaggtttaagatgcgctcatggcatcagttgtgatttgagttgagcaaaccacagttctgtcctatcgctctcgctctacgcaggtgtagtaatttcagatggagttattcccattccaggagaaacaaagggcacgggacagggcggcagcagcactgaattttgccttgtactagtgcacaaccaaatttcagagatagattcggatattaaatttttagacttttttcgattacaaacaaataacaaatataatctgctatgtaaatttatattcttatttttaac

SEQ ID NO: 23147 - DNA, 640 bp, Zea mays
ttttttttttttttttatacagaatgacttagattctttcatgagtgaacatatattctatataaagctgacacttagttctagatatttctatgcccaaaatacacaaaaaaacacagtaggggttcccctgctgaattctcaaaaagaaaacgtagctgcaccaccaaagatcacccgaataactgaaaaatctccatgccagctaacgtatctccatctcaacggacaagcacaaataattctgacattcgacctcacacattatattgttgtcatctctgcccaacttattccaccggatcgacaggtgtccacacgatcgatatatagttttgtctccctgtccattttcggaaagttcttgagcgccttttcacccccagagaagactcgcgactcggttgctcgatggtcgctgccctctgctcgctgcttggctgctcggtgctcgacggtcctcagtgcttgctgctcgctgctcggcagccctgcaccgtattctgaggacgcctggtggatggcggaaactgggtcagcgcctgatggaggtggatgcctgcagccctgcaccgcagacgggcagtttgggactttggacttgggagggagcttgaccttggcagctagggttagaaac

SEQ ID NO: 23148 - DNA, 1533 bp, Zea mays
gacattagtatcgttttgtgttatcaaccaatactaatatactacatccgttctctaatatttatcgtccgctaattcattttttttactaaaacgcgacaaataaaaaagaacggagagagtacctgtttcaacggagatgagccccgttcatgacgccataagcttcaacggaagtggctgtacagtttttttttaacgcaacagctgtgcatacaccaccacaacaggaccgctatgcgaccaccagtggacggggaaaaaaaaccctccatgacattaaggattcagttacttgcactgcggtgctgcaaatacctgacatgctctgtccgcagcatgttgagcacgtcctcatcgagctgctccaaccgaccggagtctcgcagcctggggtacagatgcgccacgctgctgatggcggcctccaccagctcccactggcccaagttcgccgcgaagccgatgaaggcgagggaggcgtccgtgctggaggaattcaggcacgaggtcaacacttgaaggctctcttccttcatcccgtccacgaaccagaagtccgccagggacgacagctccgcgtacgatttcaggatagatagcttctcttctgtactcgtagccttccatcggcagtcaggtggaactctaggcagctcgcctgagtagaaccactgaactagttttctcagtgcttcccatccgaccggaactctgatagtctccgcaaagctacctctcatgcatcccagactggaacaaagcacggaggtattcgcagctcacgctcagaatgaccttatggctatgaatatgaggagtcgataactggcacgaaccatggtgacactccattttgtcatttgattgggcctccaaaatgatgtccgagaacgaatgtttagctggttcgagtgctgtagtaagatcatatatgggacatgagtgccatctaggttgctctttctgaagcatcaagtgcagcgatctcaaatggcaatactttgcaagtgtttttacaggcttaacagtggcatcatctacagtgaccaacccagtgtatgcatactccaaaattttcttcagagcgtgactatctacacgatcagacattcgaacatgatagcatgaccttctgccccattcataagttactgacccatcacggacaaaagttttttcagatggtaataatttaggacatcttgctgataggatagccgcatgagcacttagagattcgccatctgcaagcaacagttccagatcaactaactcactgtcacacaaaacatttctcatatttcctcctagcttgcttggaaaaccacagaggccaaacatactcagtatatgtgcaatataagacttgggccctgggctcatgttctgacacaaggcttgtttaaggactccaaccaaaccttcgttgtaatgatctctgcattcatggcacacaatccccgcatctaactttctcagagaaaatgaattggctaggagagagaagcatcataagaactgccctcaaag

SEQ ID NO: 23149 - DNA, 2342 bp, Zea mays
cggatttggttttgtgatacctgagccaaggatttcatggagagatccaattttgcttgcaaatactgaacaattttgtcgtgctccctttgtcggttttcaatctcctcgagtttgctagtcagcgctccgagcccatccatcttccttgagatgtcgttgagagttgacgcggaagaatccaaggcctgctggaacctctcggtgatacgcttctccacatcctccatcgccgcgaccagatgacgcgcttgcgtggatggtctgttaggagccgtgatgaagtcggtgatcaaacgaactctggatgttacgacgaccgcctagacgtcgtcaaccgatgagcgcttgaaccttggagtcaacaacagaagaatccctaggatagaagaatctgataccaatttgtcataaccagcgatcgtggagatcgtcgtcgggaacttccagagaagaaggagacgaggaagaagaagattcagagcagaagaatttgggtgtaagtatttctgttcttcgctgccctcttctgtcagagttacatccttttatactctacactagagcctagtgtgttcaacaaacggcccatacaacctattacaagatgaaatgaccaacacggcccatactaaccatcagaatacaagaataatactcccaccacctacttctcattgtcaccctccgtgacaaagattaggcgacgaagacccgccaccaccatccatgcaagaacttttggatacttaccatggtggcggcggtaagacgaagagggaaggaggaaggggcggtggctagtgtttggtgccgtctaccacctcataagagacaatcgcgggattggaattgtgatttctgctcaacatataaaatgcttttatgcgggttacatagtagaccgattgaaatcaggctttcccctctcaaggctctaaaaaaaatgaccgtaaatgagaaacatgagcgtataaacccacaggtacccgcagtgatcttctcgggcgcgggccccgcccgcctctctgcagaatattgtaagactgtcataatatccaacaatgaacagagtaccatgtcgagattaataaccgtacagaaatattgactcaagtacaacttgacgagaaatcatgccataagcaataagcatagcagacaaccaatcttgcgatctgcacaattatacttcggcagtatcgactaaaatctcgataaaccacagtgaacagtttttctatgtgcactatcccctcttcaatctccagaaaacaaacctgtatactaaattcgtgtctcgaactctcgatggtggaaatcactggctttcagatttaccggtttgttcagggccgttaccatttgatccagagctgccatcagccccttgagattcattatgctcggcattggtggatgtgctagtttcaatcttgggatccacctgctcacccttgttatacgtttctgtagctccatcacccttgttagatgtctcttctgaagaaccattcactccgctggaagaatccccttgggagttctctgcctcagctgagacactgctgttctcagagttctgttgtatggaatatgacgcttcagtggttgtacctgttcccatgcccttctcatcatcaccagatacagtctcagtattttcttctgcagaggcgctatcagatgagttaccgttgtcatcaccagatccagtcccagatgatgctgttgcactttcatcttccaatccagtttcaatatggacagcctcaacaatgccatgctcagacgaatccgaggtagtgtaagttgcatcaccttggttttcactggcatcattttgcgaattatcagtatgaactgatggtatattcccggtttcatcaggaagactgacagtagcacggtcatcagttgcttcagccttggcatcatcaggaagggattcagaaccacttttaatatcaactgcctcatttttctcaccatctccatccgatccgttcccgcttccacttgcactggtcgattgttcaccttgcaccacttcatgagacgttccacttgcctccccagtgttttcctcttgtgcataattgtttcgggacatatcatctccagttgaattgacttcacttttactctcagcagcagagttggattcagtatcatgcttgccttcttctgcatgaccggtagtttccccccccttccgattattattaacttctgtattaccatctgcactgttgacttgtccttccgcttctgacctctcagtgtttctcttgtcatcttcattcacgttagtactgtctttatcgaacacagttctccag

SEQ ID NO: 23150 - DNA, 2004 bp, Zea mays
atccccctgcccacttccaacacagttgagcgagaacatctagatgacataatcatttaattggtgccaatatgtatttagagaccaaatttagcagggagactgctgactattagcaagtaacatgcattaactgattccaacctcccagtgacatgttcaccaaatagcccaataacaattagctattagtatcactagtgaatcctggagcaaccacggagggggtatatattatacataatttctgaacaaaatcacagaatacgagcacttgtcacttagctagctaccattagcattatgattcaaacaggccaacacccacgaatatttatgaataaagatcacagaataattcaccacaatagcactggtcactggagtatttagaactacagttcccatgataaaattggaccattacactacaggtgaagttattggatccaactattcggctacacctgttcaatcaccaacatagcatcgcgtctgcgattgtatacagtgtcaccgggaacttggtgaccatcagtcctacacatctgacgttaagtaaaactgttaatgcttcagacagctttcccaaacgatactgacagacgatgaacgagcagaatttttcagattcatttgtgaagaacacttcttttctgcagtttgattttcttctgtggttgggtctttcccttctccaaagcttctaagtctatcctgttcttccatgtgctcttccgtaatttgattggccgatttcctacatatttaccattcatatctttcaaggcagaagtaagatcagacgcatcagcaaaactaacaaaaccatatcctttagttttaccagtccacttgtcccgtataaccctggccatattgaaggatggatattttgagaatgcctttgcaagaacatcatcattcacttcatttccaagatcaccgcagaacaaacggaaatcatctaaatcacgtgtggcaatctgttgggctcatcacatccttgagcactttcaggccaatcagccaaggtagggtcctcccaactttgcccagctgcctttcgaggcactgccttttttgttgcatcaaccttcttgtctttctcactatttgcaatagcagccttaacagtagctagagcttcaggagtaattatcttcgagtccttttggaacaactgttgggcctgctggacttggggcatgggatagatggcgttgtacacaggcaccgccggcgcggctgcggtccatgcggtgtattgcgcgttctggaggtggaagggcacggggaagtaagacggggccgctgccgccgggtaggtgaactgcgcggacgcagaggccggcgaaatggactgcgtcgacatgtggcggcgtcggggtggtggaccgagaggggcggagacgcgtctggaatgacaggatcgccggagaacggggctggaggacggtggcgtgagccgtgaggtttgaggtgttcacgggttctgcttcggccgtgtgaggctgaggctgaggctcccgccgcggccgggagttggaactcggaagagctgttccgccgggtgaggcttgtgctgtgtgatcgtgcctcgtggtcagtcgtgagcgaatggtgtggaaagctctggaagcgtctggcgcgtcgtgcttgggaaagaagaaggccgacattcgcgggatgcgaggaccgggcatctgggctggcccattcgtcgtgtccgtgggccgaagcagaagtgagttgcgcacccgttgggcctgtgggaaaccgcgcagtgtcgcagggcgtttctggacgcaagatccgtgcaaatccaggcgaaaggtttttttttgttcctagacaaaggatcttattatgtgcactgtgcattcattcgcaactcgtcaaccatcgcgcgcacgcagtcgttgcaagctgtaaggctaacagatcgtgtaaatgtcgagatgaccgcatgcagcacggtaaatgtcgttacaaagggtaccg

SEQ ID NO: 23151 - DNA, 2006 bp, Zea mays
gttcgctgttatatttcgcgtcacttcttctatcctccccaagtatgccccggccataggccatgtccctccctggctcagacaaacctcccctaatagtaataggttttgtcgtctccgtttctttacgtacaaattaaattttaagtttatattttttaaggtgaccgatgatatcgtaacttatgttagaaaaatatattaaaatctgatctctaacctattaaaatgattctaaaaaaatataatatatttttctacgataaagtatgacattaactactaaacaacaaaaattatactgaaaactcaacttatacattaaaaaataaaaaaaacaaattttgttaaggatattaaactaactcaagtagttggacttattcctttcaaatatacatcagccagcgactagcgagcaagaaaacataatgcatataggattccattacattaaccgtgaatagcagaggacaaaggcttccactgccaccaatcatgaaagagtggaagatgcatacaccacaaaaaaaatgctaaacggtttgcagacttcgcccggaccaatgagaagatagaattatctaaatattctacgtaatatgataaaaggattccagaacacagttggttacaaatggcaaatgatacaagaatcatttgatccaagtagataatctaaagactcgcaagcctaaccgttaaatgtagtaatgaacatgccttccccctattgattcaaggctttcactcagtcactgatcacctgagcattgaactgacatataggaggaaattgtgtttatgacaacaccaacacgtacgcgcccaatacaactaggtgaagtttatagagcaaaaaagggggagaaggatatagatgccctagttgtcaatacctaatggccttatgatgctaaagtagtttcaggttttctatacagaacacatcatctaaagttctagatgagagaatcagttgagcaaactacgtcgatatcaacagaaactgacaggaacgcaaggttcgataagctggtttactcacttgcacctgcctgcttgtacatctgatgcctcaaccgaggtatcctctatagtcttctccactgctagagcatcctcatctagtgctttaactgtggcacccagagcagtttcttcggcgttggtggtatttgtacctggtggcgcaaccattgcatccttcagagtattctcaactgttgttgaatcctcatttgtcgcgactgtggcattctctacaggtttcccatctgctgtagacttatcatctagcaccttaacatcctctaccgtttcctcagttgttgtagcttcttcatctggttctccagctgcagtttgatcttcagttatctccctgattattggttcaacaatacctttgtttgctattttctcatctggtgcctctactgtaatttcacattctttggtctcaccagctggtgtgtcagcatctgctttaatttctgttttctcatctggtgcctcaactgtaatttcacctgccctggtctctccagctaatttgtcagcatcttcattattttctattttccccttctcgtctggtgcttcctccttagtttcaccttcagctgtctcctcaactactcctatggtagcagcattattctctgtactctcctcgagtggtactacttttgcctccacagtttcatcaaccatgaccatagagtgctcaatatttgcatcagccatagattcatcttctgaaattcgtcttcccacctcaagttgtccacctgatgcttcaattacagcttccatgttaacagtctgctcaatactatagccttgttcgcatgacacttcaacagtagttttggattccagttcaatttctacttgctcgactgcaccttgtacgacaggttcaacagtcaaattttcagcttgtgactttggatcttcaggtcccactttttgttcagtttcagattgccccactagcttct

SEQ ID NO: 23152 - DNA, 2609 bp, Zea mays
atgctctttcgccggcctgcagactagaatattttgaccgatattggatttggattagtaatagtttgcctcaaagaaaacaggtgtatgtcatggggctggcagctatttgctgggcaatttggggaaccagaaactctgtgtttcgataacaagagtgaaatcttctactgagattgtttgatattgtttgcgtaacgtgttgctttctcgcttattggataggcctttgtaaacgagtttatcctcgacttcacatctttcactcggatgatgacctgcttctgtcttccttcaacaaagacgttactatgttcacaaagactttatctcttgaggataaacttgtttacaagaattaaaaaaattcactgccaccaagcatgaaagagtgaaacacgcatacaccgcgaaataaattgctaaatggttactaagcttcgaagatcaatgagatagagggctagtttggaaacttaaatcccctatgggatcccggagattaagggggaaatagcttaattttctcctcaatccccgagaatcctgaaggggatttaaacttccaaactagccctaaaataatctaggtaatatggtagaaggattcgagaacacagttggttacagacgacaaatggtaccagaatcatttgatccaagtagatagcccaaagacttccactcagtcactgatcgcctgagcactgaactgacatataggagaaaattgtgtttatgacaaactcacacgtgcgcatcgaatacaactagatgaagtttatataggaaaaataaggggcaaaatatagatgcccaagttatttaaaacctaacagccttatgatgctaaagtggttccaggttttctatacagaacacatcatctagacaagagaatcagttgagcaaactacgtcgatatcaacagaaactgacaggaatgcaaaggatcgctaagctggtttactcacttgcacctgcttgtacatctggtgcctcaaccgaggtatcctctatagtcctctccgctggagcgtcctcattttgtgtttcaattgtggcaccaatagcagttttttcggcgttggtggtatttgcatctggtggcgcgacaatcgcatccttcagagtattctcaactgtagtcgaattctcatgtgccacaactgtggcattctctacaggtttctcagctgctgtagatttatcatctagcaccttaacatcttctaccatgtcctcagctgttctagcttcttcaactggttctccagctgcagtttgaccttcagttgtctccccgattacaggttcagcagtaactttagattctattttctcatctgtttcctctactgtaatttcaccttctttggtctccccagctggtgtgtcagcatctgctttattttctgttttctcatctggtgcgtcaattataatttcattattttctattttccccttcccggctggtgctaatttgtcagcatcttcattattttctatttttcccttctcgtctgatgcttcctccttagtttcaccttcagcagtctcctcgactactcctatgacagcagcattattctctatactctcatcgagtagtaccacttttgcctccacagtttcatcgacaaccatagagtgctcagtagttgcacaagcaatagattcatcttctggaatttgccttcccacctcaagttgtccacctgacgcttcaattagagcttccacttgaacagtctgctcaatactatagccttgttcgcctgacacttcaacagtagttttggattccagttcaatttctacttgcccgactgcacccagcacaacaggttcagcaacaaaattttcggcttgcggctttggatcttcagatcccaccatctgttcagttgcagattgccccactagtttctcaccaggggtttgaccttgtaactcaggagataccatgtgctcttctggaacttcattcccagtatcatcctcagtatgaccttgtgcagttcgcggtgcttcagtgactgcttcaaatacggcattatctcctgaattgtgactctgttttggatcctcggctatatcagtttgcatattatctggagcattctgaggcaacttttttaatatagcatcagaatgtaaggtttctgtctctgtgggtagatcaccaggggtttgactttgtaactcaggagataccatgggctcttctggaactgcattcccagtatcctcctctgtatgatcttgtgcagtactcggtgcttcaatgcccgctgcttctacggctgcttcaaatacggcatgactctgttttggatcttcgactatatcagtttccacattatctggagcattctgaggcaactcttttgttatagcatcagaatttaagatttctgtctctgtgggtagatcactgactgacacttccttttgagtgtaaacttgctcaacatctcgcgactcttcagatacagatgcagcttgtgcagctttcccaatttgattaacatggtcaattagctcagcgtcaatatttccagcttcatcaaacctgtcttgactgacaaatgtactgtctgcag

SEQ ID NO: 23153 - DNA, 1987 bp, Zea mays
  misc_feature (1526)..(1526): n is a, c, g, or t
  misc_feature (1632)..(1632): n is a, c, g, or t
ccaactataaataatctaatatggcccaaggcaagtgcatgaagaaaatacatgaaggcaagggattcctccatgtaatgcattttttaaatgcactacccgcttaggcaaagggtattttctataaaatgtcctcgataaaccaagcctatctctcattaagggatgcaagtgggctagcccatgaacccacatataggcttaattttgcgggttgctgcaagtgtacaatgccaaaacttaaagacagagatggctttactctttgcctcatctcatttggtagaaggaaaaaaatacttctcgttaactgaacacaggctataggggttctatcaatcttttctatttttttctctagttcatcttatgcttgtaataaatatctagttgtaccttttcgttataggctagtttggaaactcaaatccccttcaggattgggagtgatttgagtttccaacctaaatttaagggaaaagactcattttctgctataaaaaaccatcttatttttagttacaacaaaattagcttcatagcattaatgcagttgccagcttccaacggtaccaggtaagactaattaactgaaatcctgcattgttgaaagaagatgaaccaaggtcctatattactaacaaatgtaccattatttcaaaatttcatcagatgcattccaaaggcatggtatgagtcagtcgttagtggtcaactgcgctgcaggagaaacttgtctgaaaaaacaaagaatggtccgtgagccacgggttcaaataactaggagcataggtaccgcagaaaagattaacatagtggaagcagctgcatcaagaaaatggagatgaacgggagtacggatggaaggaattggacttccctctcggcgaaggtttcgttgaaggagatgcggtggccatccttctcggtgtccaccagcacaccatcgcaatcgaacaacagcgccgccggaagggcaccggccggcgcggccctgtcgccagccgctgccgcgcgcacgaccgatgctctccgcccactgacggcgcggatgcagcaggcaacgccgcttgggacggggcgcgcaatagagaagttgcttgcccgcagcagcgtggatgatgccgcggcgggggcggcggctgccgccattgacatggcttttttgagcggggatatcgcgcgcctgtggctgaagatgtggcgtgaggattttacaggtggcgtttggtgttgtgggtctggagggtgggaaactgggaatagaaatgaggacaagaggaggaatcttatccgacgattgcttcctctgaagccgaaaaaaagtagactacccctcaacttgtattgttgtatttggttcctaaacttttgaagtatatatctagatccttgaaattgtaatatctagatttttaaacttttaaagttgtatcatttcgatcccagaatatttatttaacatgtacatttcagttcttatagtatgattgtgtcatttgagtctctaaacttgtttgtttatnttatcaaaggtccaaattatttggacctgtgatgacacaaaaaacaagtatatggatccagatgatataatcatacaagtatgacaactagaatgtgcacgttganagtttaggaatcgagatgatacaacttcataagtttagaaacctaggccgagatgatacaacattgtaagtttaggaaccggtagtgtatttgttgagaaccatttgtggcaccggtcacggtcgaacggtccggccctaaggactggatggtccggtccgcccataggcgcagatggtccgcgaatagatcgaatcaggcgtaactaatctctttttcgcgcgagtgtatccctctaaaccagcggttactgttgggagacgcctaggaatgggtccagaccactccctatatataatacagggcacggccgattacaatcaccaacaatcgatcaaacaatcaatatatcttc

SEQ ID NO: 23154 - DNA, 1350 bp, Zea mays
caaacacccacttatggccgcgggttttttttttttttttttcgactcgtaacctcaattgctattgctttgactgaagagtttggacttggtgatcccttattcgagtggtttccagtttgttgaatgactaacacatttacaactgccaactgggtgggcagtagtgaatgtcattctataagttactattgggtagaacgtggacttccaagtcctagtatcaggtcatggcttgaagaaccaacattggcatgccatggactctttctccatattcaggaacctcgtacttggtatatcacttgcactagccccctttcagctcacatattgtttcttgagcaacttggcgcagaaatccaaatcgaagcgcacttctggcgggtcaccaatgcaatcgaacactgcatctgctgtctcgaagtcctcttctgcagtgtagccgctttttgttacgatacacttcatgccggcagcttttgccgctgcgagccctatagtactgtcttcaataacaacacagctttgtggatcaactccaagtgtagttgctgctaatatgtagattgctgggtcaggttttttgtgaggaaccacatctccagcaaatatggtaatcttatcagctctatcaggccccaataagtacgacactattgctgaaacagctttctcatttgatgtactgcacactgcaactttaactgcctttcctaaagcttcatcgattaacctttgaacacctggacggagaggaagcaactttttctcaattagggccatgaataattctgttttcctcttgtgaagagaagctatgaactcctttcttttgtcatctgtctttggtgctttagccggccatcctgtctggttgaagtaagctgtcatcctttcctttccaccacctatcctgagcaattctccatacagttcaacatcccagctgacacctaattccctctcggcgaaggtttcgttgaaggagatgcggtggccatccttctcagtgtccaccagcacaccatcgcaatcgaacaacagcgccgccggaagggcaccggccggcgcggccctgtcgccagccgctgccgcgcgcactaccgatgctctccgcccactgacggcgcggatgcagcaggcaacgccgcttgggacggggcgcgcaatagagaagttgcttgcccgcagcagcgtggatgatgccgcggcgggggcggcggctgccgccattgacatggcttttttgagcggggatatcgcgcgcctgtggctgaagatgtggcgtgaggattttacaggtggcgtttggtgttgtgggtctggagggtggcatcccggccggcc

SEQ ID NO: 23155 - DNA, 6538 bp, Zea mays
  misc_feature (1500)..(1500): n is a, c, g, or t
  misc_feature (1995)..(1995): n is a, c, g, or t
cggttcttgttgagtgtttggcgctccaaaaaggcgtcaacaagtacatagacttgcatggacactactaggtgtaagtgtagtatggtgtttacaagatacaatgatgtctctcaagatgaccatattctacaaacttcgatgtacgacacactctgtcacttagaccattgaacttagaaaaacatgaaaacaaatcattaaactttaccgacttgtaaaacaacattcaaaaccggatctactcgaaacgtatttgcaaatttataaatttcagttaactgttttctatctcagagcatgacggcggctggagccattgaatacaaatatacaatccatttataggttatgaaaagcattcaagagttcagttgtaaggggaaactaattggctagtatgttattgatcgccggtaggatatgaaatgcatacatgcttctggacccctgttgtttagcctaagcaaggatagctgttgttctggtgtacgcaatgaaagatgatcgtataaaggagtctcttctctcgtgtatgtcaatatagacgattaatggatttgaaatattgctacagcttaactttatttcatgcctttgtgctggtactctcctgtttttttatcagagatatgcttgtgttggaggaatgcaactaaacctaacctagaccgggaaatactgagctgcatgcataaagcaggaactcttgactagcttgatacttagaaaaatagcgagacggtgatgcaataaaactacatgattagcgagacggtgatgcaataaaactacatgaagttttacaagtccgacaagtaactcgagcttctgggatcgtcccttcattggttggtgattacctctcgataaacgctcggcccacatgtcagctgtgtatgtgctagtgcacagggcgacgggccgcacgagcagcgtgggctgcaaccttcgtaacgggccgcgcgaaaacatcttaccggacggccgagccacagcgctgcgctgcgcagctccacgccgcttacggtaccccgcagatagcaccaactcgctcgctgaaagaagacgaggcaatagaagcaggctacaaaagaaggcgcagggcatcgttccaactcatacctttctcggccttttggctaagatcaagtgtagtatctgttcttattagtttaatatctgatatgtggaccatgtgtccactttgatattaaatttattttttgtgggagaggaatcacaacagtggcttgccactgggttcctcaagcgtcgtccggccgttgcactattggctggacgaggcgcaccccaaccaataccaattcaaaaattgattgtattacttaattaataagggaactttaaatcttttggcggaagaataatattgtcgtttcttgatgcgtacatggtcaaaaataataatatttttgtttcttgatttggtgggatatacatgggcgttgtttctggttccaactctactgtaccagnacaacggtttggacatgggttctgaatgctgggctttaatatgtcaatgagttgtatccacccaatccataaaggacgagggagctatatctgtgttgtcaatccattttctttatttgtttaaacatttaatggttattgtcagaattttcaagtactttgctaacacctatttccttctcttttttttttctgcagattgatgtactaaaggcgaataggcaatccgcaacgttgatgctgaattaagcatagagtatcacgtgaaatgaattgtggtgaggagtgtcaaaatcaacagaatatctgtttttgaaaatcaattggatgacctagaaccagaagaagctgtggcttatgcactcgtcttccaacaccaggatatcaagatgtgcatgcctaaagcaagaagtcttaacttagcttgaaaaagtagtgtgacggcgatgcaataaaatgctataaagtcttacaggtcaagcaagtagctaagancttacgattacgaaccatcgttaagacgaagtcaggccagtaacccgagcttttagtctagccttttattattagggtcgtggcttcctcggttcatgattttaacctgttgatgaacgcccgccccacatgccagctgtgttacttctcttcggacagaagcaagagcaaagccaaagagcatgtccttgtcgtcctagtccataaggccaattgctgggctgggctgcgcgaacagcgtgcgctgcaaccttcgtaacgggccgggagaaaacgtccgggcagccgaggcgccgagccacaacgctccgccccgcttccgcttccggtttcataggatagtaccagctcggcagcccttggtgggtgaggcaaccgaagcagactacaaaagaaggtgcagggcaccgtcacaattcatacctttctcggccttttggctaagatcaagtgtagtatctgttcttatcagtttaatatctgatatgtggaccatgtgttcacttcgatattaaatgtattttttgtggggagggaccacaacagtggcttgccactgggttcttcgagcgtcgctcggccgttgcactacaggctgagccaggcgcgccccaaccaaagcgaaattaaattattggagttcacagtctacaagatcagaaatgccaacaaagctcacaggccattactactccatcacaggccaccaacttaacttataggcacgaaaaagggcaggctacacaacagtttaacaggccaccaactgaacttaccaaaatgaccagccatcagacacttaatatatcaccccctaaacaagtttacatactgcccttaagacagcaaatccttgaggcttcttctaaccactttagccttgttctttcttaggtgccttggtcttcttaggtgccagcacgtattagatggaccagcagtgtcaactccagcactagttggctttattgtcatgttagcatctgcctaactctgcatcaggaggaagcaaccacacagagaggctccagtccagtgcatcacattcagcatcatcatccatatccatgcaaattgccttatcaatcacttcaattattacaatataaacacgcacgcacatccctgtacgtgtccgctgctgacagttggctcatccaggcagaaaatggtactagtgtaaataaaggagagataaagatacaatgatagatttctaaataggcaaactatcgtattttaaaatctagaaaattataatggcatggattcaaataaataaataaataaccctgtcagcatggggggcctttgcgaccccgactagaaaaaggcagccacgctcgctcaggcgaagaacgagggaggaggacgcgcaggcgcagcagagtccaaaaccgagagccggagaaaagcactgcacgaccgacggcgatgacgacgaccaacgaggcgaacaaaacaagcagctgccggttcccaacgcgacgcgacaatgggcgcccgtcgttgccaccgccgcccgtttgcggcctccgcctcccagtagatggttccgatgctacctactaatttatagatgtatataatgtacaagtaagcaccggcgacgagagctaacgcttcaggccgcacatgcaccgtagccgtcgtccacagaacctcgcatggtgagcacgtcgtcacgtggtttctcgctgcatttcgtgcctagctagctagctagctaagctagtctgctaacgcggtcgtcggcgctgttgcgtgcacgcagggcctcctgccgctgttcctccgggctgtcgcgaggctggctgcgtgcctggcgagccggccgctgcccgagacggcggcgaccgtactgttccacgccggggcgctgccgcgggaccccgcgctggagcgcctggtctgcgacgacgtgctcgacggcggcggcggcggcgaaggcgactgcgacatcctgcgtttcgtcgtcggcgtcatgaggtccttgggctagccgtcagccacacctgcactgcacctgcacggctgcacggccagagttcttcaagacatgcgctgctgaccgctggagtgctgactttgccctccgttctttttttttctctctctcttttgattggcaaactagtatgacctagctaccagtttggcctcagtgtcaatggtctgaatcaaaggtacaaatgacacccccaaaaaaaagcacttcacgatttctttcatctatctataacaatattggaacaagactagcagttgtttcggttgaaactatgacctagtacatatataaaattgattcgaagaacccgatccccccgtacatatataaaaaaagatcgattgggcaatccaagaaagaagaataccgcacaatgcaagaacgtgcccccgaatgattttgcagcagaagctgtcggtcggcaccgccagatgcaacaaccgtcacatgcccttctcctctcccaggagagactaaaaaaaaaacaaggaaccagcaagcaatgcctgccgccaggctgcctgattttcgctgaagaaaacggcatttgctccggtccgcggcagctaatgtgcggcgtttccctataataaaagaaggaatttctttatcatcgtagcagcatcaatggacatcttacacaccaacagtatctgttctatgagtacaacaaacaaccacatccagatcgctgtagctggctatcggtatggtagtatggtatccctatgaattgccacatcttaacaactcttcctgatgacaatactctaccaccaagacacactcagagcaacacgagaacaagtataccaccaagacaaaaaaacaattgctgcgaaaacaggccacagttgtatctcctcgagtgtcctcttatccccagtgaggccgtgactcgcaggcaccaccaggtttcagattccatggtagaggtttgttcctgaaacaacagaagcgtcgctgaagggcagtcagtcttggggcacagctcacgcgttcctcagagcactgatgcgcgcggcgagttcgtcgaaatccggcatgctcggatgcacgttccccctcgacatctctggctgcatggacatggaccgagcagggggcttcgccttcgccttcgccttggggcttgcggattctgaaggcaaggatgcggctctttcagggcggtgtgcagatgctcctcctcctttgctagacagttctccggctccgtcgccgcgctggtcgtctcgtgggaacagggtccgggacttgttggctctctccttgcgctcctccctgtccagccctttcttgctgtagtgcatcagaagcttgtccatcatcctctcctcgtcgtcgccgcggcctcctgccttgcgaggatcggcgctccggctcctgtgtttcctgtgcgaactgggggctcggggcaggaggttgccgaaatcgatcgatgtgttcacatcgtcgccatcagactcgtggccttcgctggcccaattgtagtcactgccgctcgtcgatccgttctgcctgcttttgtgctttcttcgctcgctaggaactcgatgaaaaggcctcgcgttgttgatatcgtcatcgacccccatgccttctaagggtggtacaacatgggcaactctctggtcatgattgtcatgggcaccattcctcttgcttgagtgtcttcttcggccatcaggtgcttggtttgccatcttttcctccattccagcatattcatcagcatgtgcaggtggtcttggaaccctacttctcacggagacaggatcatagattggttcacgcttctggtaaattgtttcttcggtgccactctgcttgtggccatttgcgccttgatttgcatgtttttcaaaatttggcttaacataaggaggacgcatattggttgccttctctggcacaggctgcctgtcttcagcaaccttctcgcccattggtgctctgtagggcttagaataaggaggaggcttgttcactgctttaccattcaaggtggaaattggatcaatttcttgtttttctatgcccagagttttaagccccaggtcagcatgtccccaactacgatcggggccaccggaaggtttcatcgcaccaacatcctgttttttcaagccattgatgtctaacacctccacatccatcagttccctccgacggtcactatcctgtttgccagatttcttcattcctctctcgcccttccttccgcccgcctccaggggaggcaaaggattatccacgtgccttctctcactaggtttatcagagtagttctttctgtttttttcacctaactggccaatgccatcaggaacgacatggatatctctgggttttacgttcatttcctgcttctgttcatagccttcaggcatagcttttgatttcctttcatgaacagcatgcctatcaaccttgtgtcaatctcgttccatatcatacttaactgaactcttctttggaagatcatgtttattttgagagccacaacgcccacgcgtgccgccacggtcc

SEQ ID NO: 23156 - DNA, 1555 bp, Zea mays
ttttttttttttttttctacagacgcatcatcctgccgtagacaagtgcagttcgtttacatctcaagctctcaaccctccaaggacaggttatactggtacggttacaccaagcttccggtcgtaaccgtctgtagaacatggagcgttgccgcccaaacccaaccaccgccaacgtttgtgaaaaacaagtggaaacatattaagctttcatcctaacaaaaacatacaaaaatagttaacgggcgactgttttgggagcaaaagtccacgtcactgaaaaccatatgcgtaatcgttaacagctctgctcaatgattgggcttggatcctcgtcttcccagcaatctggtgggatcagcggtaaactccaggaaaaaatagcctcgttttctgttagaaaaatgcaccagataatccaagacttgattgacagacacgtcactcagcttctcaggatgttttcaaagtctggtcataatttttcctgccttcattttggcatattcatgaactatagtagccgtgctttctctgtgtcgcagatagaactcagcaagcaatatcctattttcttcaggcaagagatcaccgtgatggcccaggcgggaaactctatcacaaacagcatggtgcatgaggattccagctgcaacagatacattaaacgaatccaccatgcctttcattggaatgctgcagtgcaaatctgacaattctagagcatcatcacttatacccctaagctcattgcccacaacaatagctgttggttgagaccaatccatatcatacacacaaaccgaatcagttcccaaataagtggtcgcaatgcgataaccgcgtttttttaatgcactgaaacattctgcaggtgagttccatatctcaatgtcaagccatttctcagcacccatgctcacatgcctgttgtctctatacctctgcaccttttgctgctatcaaggaaatgacgtgcacggactgcacgccgagcgcgtccgcggagcggaacgcggccgagacgttgccgaagtcggagaggccttccaccacgaggcaaacggcgtagctccggttgccaacggcttgtcgaatccggtcccgccgcgcctctaggatgtgcggctccagcacctctatgacctccccgctggacagctccgcgcccccggccgcgggccggaacgcgtccaggtaagggaaccacctcctccggcccccgggcacggcgtcgccgtcggcgcggcgctggagcttcatgaggcggtcgatccggccgcgggatccggcgggggctgaggtctcaggcgggcgtgggtggaggagctgctccacggtgtcgacgccgtcctcgtcgccgggagcggcggcggagagagtggaggcgcgggggcgagggccgagaaggcggaggaggggaggcgaaggtgaaggcctgcggggccgcggcaaggaaaaggaggcaaaggccgtggaggtgagcgaggagacggatagcgccttggtcgccattactggggtcgcttgcgaggtttttggtcggggggcttcc

SEQ ID NO: 23157 - DNA, 1586 bp, Zea mays
tctatagtcgacctgcaggggccggagacaggtgtgaaggggctctaggcgcgcctccgctcaatggtctattctgatgttggaaatgctgtccatagtgaattagtactgatggcagcgttcagtactctaattgttggtcaatgtcgaatgcgataatgcaaggtgacccgtgaccgaacagcaccaatgaacctaagcagacctgagtacctgactgattagcaaccaactctgtcagctgaaaaggcgtcacaattagtaatttaccaataggcaccacaacgtaaattatcgcataaaaaatgacaattcgataaacaaactacagacctactcacctacatataattaatatagcagaccagatactgatgatcagcacacgacaccaaaccaaattgacattcgaaagatgctacggtcattcctccaagtctgcaaatgtactttcgtctttttgctgtctaaaatgacaccacggagctggtttttgttattttcgtactacacagagacgttctggttgaaacgacaagtttatctccttcgaagtcagagatttccgtgtttgggagatgaatatgtgtttgtaagatacaacccacacaattttccgcatgtaactgtaaaacgctgcttggatcaacgctgttgcctgttttccctagctggtatccacatgcttacgttcttcactgcctcaactcaatccgtgaagacaaatactggagctggtgaacctccaggctccagccccatcaatttaactgtgaaccgtggaaaacagacataagcgacatatttgtcacctctgcagtttcacaaaaattaattttggtggtgcgctctgcgatagtcgcttctccccataattagataagagaaaagaatcatcgcttccattttttttcaaccctcagcaatcactacgtctacccaagaaaaccgactcctcttgtataccagtagtctacgtaaatgctctacctaggccacccaagcctttgaatcttacaatcaatcatcaccgcctccatcgtcagcatccatatcagcatcatcgtcgtcccctgcgtctgcatggtcggcggcatcatcgacattcatgagctcctgccttacaacttcttggttgatctcttccagtactcgagcattcagctctggcggaggacgcctttccaccttcatagtcttcaggttatcctctgcaaagaatgcggtcaatggcttggggaccttgaataagcagtttcgctccttggcactctcaacaaggttgttccagtgtttatcttgcttcaatgttgaagcagaacctacaaccagtacagcagattttgctcttgtgatggcaacattcattcgtcgaaaatcagaaacaaagccaatcttttgttccttattgcatcttacacatgaaaaaatgactatttctttttcacgtccctggaatccatcaactgtgcttacatctatcaattcctttgattgatccccaaaggttgatcgaaaactgtccttcaatagttttacttgatgcctgtatggtgatataacacccactcaggactagatttgag

SEQ ID NO: 23158 - DNA, 1412 bp, Zea mays
gctcgaattccgttgctgtcgagctgaccggctccatcccgagtgacctctcgcgcctggtgaatggaggagctggacctcagttacaatcagttttcaggcaagataccaccagagatcgccttcggcccaccactcacccttctcaagtttgatgacaaccgtattggcggagacataccagcctctattgccaacctctcaaagctgcagacgcttgacctgtcgtccaacaatcttaccggcaacatacctgcatcgttggctcagattcctggccttgtgtcattcaatgtgtcacacaacgagctttctggtgagataccggcaatgctcggctcccgctttggctctgcttcagcgtatgcttcaaacccagatttgtgcgggccgccattggagagtgagtgcggagagtaccggcggcggcagagacggcagaaggtgcagcgcctggctctgctaattggtgtggtggctgctgccgtgctcctccttgcgctgttgtgctgttgctgcgtgtttagcttgctgcgatggaggcgtcggttcattgagagccgtgatggtgtgaagaagaggagacgcagcccgggacgcggcagtgggtcgagtggcacaagcacggagaacggtgtcagccagccgaagctgattatgttcaactcaaggatcacttatgccgacactgttgaggcaacccgccagtttgacgaggagaacgtgctcagccgaggccgccatggcctcgtgttcaaggcttgttacagtgacggcaccgtgctagcgattctgcggcttccgtccacgtctgctgatggtgccgtggtgattgatgaagggtcgttcaggaaagaggctgaatctctcgggaaagtgaagcacaggaacctcactgtgctccgtggctactacgccggtcctccgccggatgtccggctgctggtctacgactacatgcccaacggcaacctcgccacgttgctgcaggaagcgtcacaccaggacgggcacatcctcaactggccaatgaggcacctcatcgcgctgggcgtctcgcgcggccttgcgttcctgcatcagtccggcgtcgtgcacggcgacgtgaagccgcagaacatcctcttcgacgccgacttcgagccgcacctgtccgacttcggcctggagccgatggtggtgaccgcgggtgccgccgcggcagccgccgccgccgcgtcgacatcagctgcgacacccgtgggctcgctcggctacgtcgcccccgacgcggccgcggccgggcaggccacgagggaaggcgacgtgtacagcttcggcatcgtgctgctggagctcctgatgtcccgtcggcccacggccggcactgccgcctgtcagatcctcgcggtgggggtgaagcggcagctgca

SEQ ID NO: 23159 - DNA, 1064 bp, Zea mays
gggtacctcgaagccggccgggccaagcctctagctctttgtcttggccatctcaagttcacaacagcagggctagtagtagtagttttgacggccgggctgggccgctggggccgtggttgggtaattgtttttttgagccaaggttgcttcggccggccggggaacttgtgccggagctgtgagtcatcgccagtctggtgacagctctgtccctctttgaaaaaaaaatactccctccgtcttcttgacttgtagccgtctgggtcgtctcctatgtccttgtcgcattcctgagagttgctaccaccggcgctaggggggaagaggctgccggaagatccgccatgagcagcgatcagcagaacgatgctcctggaagctacttcgtaggccgtccaaccaacccgggcgacaagacggaagaaccgcacgcccgcggggaccagaacccggcgaccgcgcaaactcccggcgagtacttcgttgggcgtccggcgagccatccccagcaggaacaggaagcagcacagcagcaaaccactaggcagagcacaccaagcttcttggccaaatgctgtccctgcctcgccggaggtggagctgcggaatagatcaagaactgcctcctgcagccctgctaagggcacccaacgaattgtgcgcatgagaaatggagttaatctgggatggtgatctatctttctgtatctgaattgaaacttgtgctctggaaactcctcttttttttttttcctcagtgttccacttttaatcgtttcttctgcatccttgtgcatccataccactgtcgcgtagtgcgaattggtccaaccagctgatttttgtttgtttgcccccacccccaaaaaaacgatatgtttcatttcaaaaatgtcaatgtgtatttatgtattattatttactttgcttgaggttattgtgaacttgtattaatcatgaattgtcataccgtttacaaatatatacatgcgtcaagttaaccttgaagctttttcaggtcactcaaaaaaaaaaaaaaaaggaaataaaaaaaaaaaaaa

SEQ ID NO: 23160 - DNA, 2672 bp, Zea mays
gtccttcctcgccaacctcaccagcctcgacaccttcgacgtgtccggcaacctcctgtcaggccccgtccccgtctcgcttcctcccagcttgaagtacctcgacctatcctccaacgccttctccggaaccatcccgtcgaacattagcgcctccaccgccagcctccagttcttgaacctgtccttcaaccgactccggggcaccgtcccggcgtcgctgggaaacttgcaggacctgcactacctctggctggacgggaaccttctcgaggggaccatcccggccgcgctggcaaactgctcggcgctgctccacctgagccttcaggggaactcgctccgcggcatcttgccgtctgcggtcgccgcgatacccacgctgcagattctctcggtgtcgcggaaccagctcaccggtaccatcccggccgaggcgttcggcggccaggggaactcgtctctgcgcatcgtgcagctcggccgcaacgagttctctcaggtggacgtgccgggaggtctcgccgcggatcttcgggtggtggaccttggcggcaacaagctcgctggtccgttcccgacttggattgctggggcgggagggctgacgctgctcgacctctcgggcaatgcgttcacaggcgagttgccgccagcggtcgggcagctcagtgcgctgcttgagctgcgcctcggcggcaatgctttcgctggcgccgtgcctgcggagattggcagatgcagcgcactccaggtgcttgatctcgaggacaaccacttcaccggcgaggtgccatcagctctaggtggtctcccgaggctcagggaggtctatcttggtgggaacactttctccggccagattccggcgaccttggggaatctggcgtggctagaggcattgtccatacccaggaacagactcactggtcgcctttctcgtgagctcttccagctgggaaacctgacgttcctggacctatccgagaacaacctcaccggagagatccctccggccgtcggcaatttgttggctctccacagtttaaatttgagcggcaatgccctttttggccgcattccaacgaccattggcaacctccagaacctgcgagttcttgatctctccgggcagaagaacctctctggcaatgtcccggcggagcttttcggcctaccgcagctgcagtacgtgtcgttctcggacaactccttctctggcgatgttcctgaaggtttcagcagtctctggagtctgcgcagtctcaatctctccggcaattctttcactgggtcaataccggcgacgtatgggtacttgccgtcacttcaagtgctgtcggccgcacacaaccatatttctggcgagctaccagccgagctcgccaattgttccaacctcactgtgcttgagctcagtggcaaccagctgaccggctccatcccgagggacctctcacgccttggtgaattggaggagcttgacctcagctacaatcagctttcaggcaagataccaccagagatctccaactgctcatcactcacccttctcaagcttgacgacaatcattttggcggagacataccagcctctgttgccagcctctcgaagctacagacgcttgacctgtcgtccaacaatcttaccggcagcatccctgcttcattggctcagattcctggccttttatcattcaacgtgtcacacaacaagctttccggcgagataccggcgatgctcggctcccgctttggctcttcgtcagcatatgcttcgaactcagacttgtgcggtccgccgtcggagagcgagtgcggcgtgtaccggcgacggcggaggcggcagagggtgcagcgcctggctctgcttatcggtgtggtggctgctgcggcgctgctcgttgcgctgttctgctgttgctgcgtggtcagcttgatgggatggaggcgtcggttcgttgagagccgtgacggtgtcaagaagagaagacgcagcccaggacgcggcagtgggtcgagcggcacgagcacggagaacggcgtcagccagccgaagctgatcatgttcaattcaaggatcacttacgctgacacggttgaggcgacccaccagttcgacgaggagaacgtgctcagccgaggccgccacggcctcgtgttcaaggcttgttacagtgacggcaccgtgctggcgattctgcggctcccgtccaggtctgccgatggcgccgtggtgatcgacgagggatcgttcaggaaggaggccgagtctctcgggaaggtgaagcacaggaacctcacggtgctccgtggctactatgccgggcctccgccggacgtccggctgctggtctatgactacatgcccaacggcaacctcgccacgctgctgcaggaagcgtcacaccgggacggccacattctcaactggccgatgaggcacctcatcgcgctcggcgtctcgcgcggtcttgcgttcctgcaccagtccggggtggtgcacggcgacgtcaagccgcagaacattctcttcgacgccgacttcgagccgcacctgtctgatttcggcctcgagccgatggtggtgactgcggccgccgccgccgcggcggcccccctccagtgagctcgtcgacccgggaattaattccggaccggtacctgcaggc

SEQ ID NO: 23161 - DNA, 4336 bp, Zea mays
ctgcatagcatctcacacatggagcaaaaatgaaaggaacgtgtgtgagttgacgtgtatgaggatattttccttttttcttctgtcgtgaaacaagtttctttctttttttttctatggtcgtccaatgttttggaggtttttttttttgtacaaatacagaacgtgctgaagcgtgaagtcgctattggcaccggtataccatggacgtcgttgctagctgttcttgttattgtacgcgagtatatgcgtctccatccctgctgcgccaccgtgtcgagcaggaggaggaagtttgtacgccgtgctcggtagtatctctttcgaacacaggatggtgagattcgaacatgaggcccaggcgttacgtgcgtgctagctagggtaccgggaggggcgggagctagaccgagagcaacacccatcgttcgcatctacagccacaggcgtctttccatgcttgcactcttccgctttgtctttgttccgttgctgctgcctgctagctagcttcgttctccgactcggatcctcacatctggcgatcgagactgcaacggcgtccttgcagcgctcacagcttgttcgctgcggcttgctgcggctttaatccggctgcgactgcggcttctacagtatttttctctctatggattgcagctgcagcagtccaaacagctgcaacagtgtcggcttgcagccaaccgaacacgccctgaggtacgtcgttgggcggcgggtacggtggtggtagcaagaaattagctcccgcgcgcgtgcattttaaattgatgggagataatgctgtgctggtcccaaatctcgcgtagttcccgcggtcggattttggcatcatgatgagtgtgctccggtctctcggtcgactcctggagatcacgaccaagacaagcatggatatagttacagtacgaaagtactagttttttttcttggcatcatgacgacacccttgtaccaatctatcatctctaggaaattacccttgtttagagaggacgaggattcatcgtgcccacgaaaaaccatctcttgtcctataagaaacctcaaggcactctagagatgaagtcaaatcgtgtctggtataattattcggcttctctttttgcacttgagagcttacttgatacactttgcgcaacgtcacgccgagatggtgagacgcggacacgagggtccacacgcaacgcaaaggaacactcgtccagtacgtacgtcctccggctccggggtccggaaatacgggtggatgaaaatcctgggagcaagaacgatcgagagaagacgacgaccacgacgacgagagcgatggcaggaaaaagataaaggcgtcagcagcagggccacgacaggcagaggatctagcgctggctggcagcggcagtctggatgcggagcgaagacaaagggagctggcaggcattggctctgctcacgtgtactgccatgcctacccggactgtagggcgccgtccgtgctgcgcggcgcggcgcggcgcagttggttcgtccgttcgttctgggcactgggcttctggctctggctctctgccggtgctggcccggcgaccggcgcccgtcaaaggaactgtccggcggcagcaaacaggccaacgaacgacgaggcaagcaaatccttgcgcctccaagacgcactcggaaccggaacgaccggcgccccggacccacgtgtcggcgaaggacagcgcctccgcccaaacggccgaggaatgtccgtcctctctcctcgctcagagaagtcgatgcaagcgttctgttattaattcctacagaagctctaacacgtgctgtggctctgtactacgcacagaagcatatcaatggatgacaggatgagcgggtacgaaagcaccgaagcagagggcacagggcagagagagagacgtacgagtactcaggacggaccaccatccacatgctagctgtgcatcgctgctctcacaggcagaggctggggtcatggcggcggcggcacgcagcatcaatgccagcgagtagcagtggttcatggtagctttcattgcagctgcatcgtttcagtgatccgtccgtccatccaccaaaaaaaaaaagacttgattgccaaccgctgagtgcgagagctccgccttcggccttccgctcctgcctgccccccgaagcagacagagccacagaggagaccacttgtgccgctcgatcgtcgctgtcctccgtgcgccgcccgggtacgtgaactcccgtaccaacgctgcgcctgcgctgcacaagtggtggtccaagacaagatgaactgaaacacgggcgccgctaccatgacctgccgactgccgtccggctacaagacacgtctggtccgctccttctctcgatgctgggccggacgaatcaacactgacggcccactatctcggtgtcacgggggcctgttaaaacatcgcctcggccaccccggccggccgcgactcgtcgtcaaaacttctgatcggggatgcgatggtggtggcttcattcgtggtctcaagcttaccagagtggcctctttttttatcaagagcgacgcctgttcggaggcgaacatgctgccgtcctcgacaatagattttggccgtctttgaagatcgattccgtgataatgaactagtgatatctacctcgttatcattgtcatgagcagagcagtagtgccgcaacccagcaattcgcctcaagttatcaaatcggtgagtacaatgtgcacgtgctgccgcgcttgtttgaactcgaaatatgcacatttacaatcattattacagccagcggggcagcgatagaaacaacaaaccccataggatacaccgatacaccaagaagaagcatagaacggcagaagcccccgtcacaccttggcccttgcatataacaacggcatatgcacctgtccagctgaagcacacgtcgaactcatcggcaggcaatggaagaaggcaccaacgaatcagccgagctcccccctggcacaaccgccagtgtccacaacaaggcgctgtcggggaccagggaggaggtggagcgagcccgcgaggcggcggtgcaggcgtggctggcgtccatgccgctcggcgaggagctggagcggctccgcgccgagctagccgcggccaagacccgcctcgccgcgacggcggccgagataccgctgctcaagtcgcggatcgaggccacgaacgccgcggtcgccacgaggcaggaggcggcggcgagaaagaaggccgccgcggaggacctccgcctgcgcgtcgacggggcgcgcgccgagctccggcggctgcgcgcggaggtcgcggcgtcgaggggcgccaaggacgcgctggagcggcgggtgctcgtccggcgccaggccgcgcgggcgcttcagcgggcggagcgcgccatcgcggcggaggcccacgcgctggcgtggtccgcggccgcggccgccgagctggccgcgcgcgcgcgcggcgacggggaggaggacccccaccacgacgtcgtggcgctgccggcgcggaagctccaggagctgcgcaggctcgtggacgccgaggagcggaaggccgaggcgcgcgtcgaggaggccgaagcagcgcggcacgcggcgaaggcgcgaagagcggcggccttggcgaggctgaacgcagcgcgcgccaagaggcgagtggctgctgaagctgaagctgagcttcgtcgccgcgcggacggggacgacgcccgcggcacgcgggcaagcgcgctggcccggaggagccggagccggagcgggaggtcgtgcttcgcggtgaagaagctgcggaggttcctgggcaacctaaccaaggcttgagcgttgaggtggctgcgggcgttcagaagagttcttcctgagccgaattgtggttggaggtgagcgtttcaatgggcttttgacaaataactagtagcgtcgtggttcaaaaaacatttacaagagatctttgtgtgcaattatattacgcaaggtttttgcataaagggaggcgatccatacagaaagatgttctggtacagactacagaatgcttgctttgccttggttggcctattatacaaaaagcgagctagatcggcagtttgtttagttgacgaagcaatgcttgatttgcccagggtgacatacgatacaggagggcaaatgttgaatttgtgatctaaattttaaaaaagacggttagtttgataaacgaagtggaggcacgtcgtcgaaaaacttggtgtagataagaagatagacatgaggtggttcctatctcttctcggtagaccgagtatagtgtcg

SEQ ID NO: 23162 - DNA, 867 bp, Zea mays
gaaatacagatgaaggatgagtaacgctgaaaaggtattactggcaacacatgtcctggaagcctgagttcagctaccgatcaaccatggagggcacatcacttccacttcttgaacttgccgccgccgaacatgccgtgcccatgcttgccatgcttgaacttgccgtgcccgtgcttgaacttgccgtggtggccgtgaccatgcttgaacttgccgtggccaccatacccgtggccgtaaccaccgtgaccatagcctccaaaggccccatgtccaccgtgtccgctatggccatgagaaagcttgtgtgctccataagcggcagcggccgcggcagcacctcccgctagcattgcccccgtccccatgtggcccccgtggcccccgccgtggctgctcccataaccctggtgagatgagccggggtagcctgcaggaggatatccaccttgaggtgggtagccacctggctgagggtacccatattgtggtgggtatgccccaggtggaggaggatatgcccctggaggaggaggatacgcccctgggggaggcgggtatgctcctggttgcggtgggtagccctgcggagggtatccctggtgggggtacccatgaccaccggcaacgccgtgcatcatgttcgagaagagccccttgtcgctctcgtcatgcttgtctttccctcctcccattgaccccgcaagttaccgaacgacgacgcgaactccggcgccctgaagcagcacagatgtgcagccgatctcggccggcgatgttccctgtcgccgggggggcggcgggtgctggtttttccgcggccctcgccggcccccagcgggatattcccggccggcctcgagg

SEQ ID NO: 23163 - DNA, 1352 bp, Zea mays
  misc_feature (37)..(37): n is a, c, g, or t
taggggcccttaatactaagtaatatttccgtcagtncatggtgtggggtgtggggttttcgtcctctttggtggctcgtttcttcgtgggattgttttgtttaccagcaaatggttatttatgtcacttattagcaatatgtcacttgccacaatctagattactgcagacatagatactgaaaaggcattcctggcaacacatgtcctagaagcctgaattcagctaccattagggatggtaatgtgccataaattttacactataaaatttaaagatcaaatctgattaggatcgagctatatttctattcatttttaaattaaaattatttacggtctctaacatattgtgaagaaacatttaaatcgtgatccattaccaccgctagctacgatcaacacatcacttccacttcttgaacttgccgccgaacatgccgtgtccatgcttgccatgcttgaacttgccgtggtggccacgaccacggccataaccaccacgaccacgaccatggcctccaaagggcccatgtccaccgtgtccgctatggccatgagaaagcttgtgtgctccgtaagcagcagcggcggcggcggcacctccagctagcattgcccccgtccccatgtggcccccggcgtggctgctcccataaccctggtgagatgagccggggtagcctgcaggaggatatccaccttgaggtgggtagccacccggctgagggtacccatattgtggtgggtatgcgccgggtggaggaggatacgcccctgggggaggtgggtatgctcctggttgcggtgggtagccctgcggagggtatccctgcggggggtacccatggccaccggcaacgccgtgcatcaagtttgagaagagccccttgtcgctctcgtcatgcttgtctttccctcctcccattgctcccccaagttaccgaacgacgagccgacgatgcgaactccggcgcccagaagcagaacaggtatgcagccgatctcgggcggcgatgttcctgtgggcggcgggtgcggctggtgccggctggccccttcgccttcccccaggctggcggctatatagccgaggagacggcgacaaggaaggagccaggatggtggccggaggagcaaacgcgtggcgccgagtcaggccgccatgcgggctcgcggcgcgttacggttgctgcgacctgcgacttgcgcgtcgcgagcgcgtgccggcgaccggcgtgcgtgggaggggaaggggaggaaaggaggaaagcaacgcgacgaagaaccgaaccgagccccacatcaccagccgggcctaccgcgcagtgacccggatcgaaacatgtaat

SEQ ID NO: 23164 - DNA, 854 bp, Zea mays
tttttttttttttttcccgctcttgaaggatccaatctgatttcaagctcactttattatgtgatatatacagactcatggaataaaagcaaactccatacttatgactggtataagatagtctagcactagtctaaaacctaacctgaccacaataatctaagatgccagtttaggagctggcagacaaaactcatactactatgggcttgacatagataagctatacactaaagatgaaagcgatgcactttttggatcttcagagaagcttgttctgtgccaccgcttcgcaaagctcctcctcgtaccgtaaaactctgggcgatgaagcagctttacacgcatgtcttggcagccacggtggcacccagcgtcggagacgcttcgaaggaaaaggtgtcgaagactccgggaagagaacagccgtgattggcttcacgtcgaccagcttgaggcgtgaaaggcgagcagcgtgttttggagccctcggtgtccttggggtggaaacgtgcacgtccttgccgttgattcttaagaaaggccaatgctccgttggaagaggggttctattcaggagcaactcctgtctgcttctgtctggagtagtgtagttgaaatgaaactccctggcaagttgaactgcttttcgaatcctttttgaaacatggaaaacaactttcagttcgtcatggtgcaagcaacacatgatcttgatcagcaaatcaagaggaagtgattcaagccctgaatcaccacaggacacagatgcatttggagtccttggagtctttggcaatacctgccctgtattactaccaaatggctcaaaattgagtcttgcaggggacaaa

SEQ ID NO: 23165 - DNA, 1573 bp, Zea mays
ttttttttttttttttggggttaccgacaatgaaattgatttgcaggtgcagatatattacaaacatatactgctactgtatacttatagctatgaaattctaactatctgttactagtatatatataacctttaatttgttgatgatggaatcaaaagaatggatcttttactaccaaggaggcgagaggccggctgagaaagaatggatatcagtggatgcagatgcccggtagcttccactggaactttcccgcgcgtcgctcctcgggtgtgccggcggtgtagttcctccagacgtcgaggaccccgcggaggtcgtggagcttggcgccgaggccgacgcagcagttggcgtggagcgtgcagatcctgttgaggtccttgctgagctggcagaagccgctgatgtaggctgtgtcgaggaactggatggcgaggtccagcctgggcgcctcctcgtgcttgatgaggttgaacacgtcctgctcgtgcttccccaggaagcgccaccgcccctgctgccacgcccggtagaaggcgaccgtcttgtccgacgcccgcacgaagaggaagccgccgttggggaagttgcgcaggctgtaggggtcgcccatgtacacgtcgctggagatggcgatgtccgccgccatggagatgtggcggaacgggtcgcggaaccacatcacgtcaacgtccgtgaataggaagttgtatcccagctccagcaccgtctgctggaagcggttgcgtccccacatcatctccaggtagtccttgctcatgaacaccttctctgatcggtagtcgacggcgttgcccgtgcggaggaagtagcagtggctgtgcacggccctgcagccctcgtaggcggccgggtccatggtgacgatgaccaggtggtccaggaggcgcgccacgccgccttcccccgtgcggaagctctcgaagaagaggtccagcagcgagcccgggcgcgtccacgccgcgttgatctgcgtcatgatcaccgtgcggtccttggtcgccgcgcgcgccagcacctcctccaggtcgccccacggagacggcggggcctgcaatgcaatgcagcgcaatgttagttgatagagtatgcatgctaatgcaggtggtgtctggtgaccaaaaactgcttgtacgttgacagacgggcggcagtagtagccattaggtgaaacggttccatccatccgcatgttccaaggaaggagagtagaaagaaagaaggatgggccgtcgatcacggggagatttcgtgtggacgtgtcagggattcagtcagttgaggggagggggttgtggggaggatggctgtgatctggtggaggtgttgacgacgacgagcagtgatgtgcatttacatgcggcgaataatcacctggacacgtggagaaggcaacaaacgacggggtggattcctgaaggtaccaccagctcatccactgtaggagttttagttcatgggggaacgggaaagcgatacgtaataacaaaaaaaacaagcaaaggagcatcgagacgtgagctgggctctgtattatttaatataact

SEQ ID NO: 23166 - DNA, 1338 bp, Zea mays
ggattgccaaattaaaactttcggaacgaaacgagggaaaggcaacaacacacatttggcgcgccctctgcggtgtatcaaaacaagcacgagaccattacctagaacatcctaatcgaaaactctttccgttttccttcctcgtcgcggtcgtgggtcacttgccgccgcgccggcaacgtccccttcccatccccagccacgcataaatcaatcgatgcattggtccttggcacgacttgattcctgattccctctgctgttctccacccgctctctctctttcgcgtggcatttcttcctgccagcgacgaattggcgcgcgccgccgccgccgtctgcccaggcccttcgcccacccaccagggccatgaaggaaggtataccatatatattcatgcctcaagggagaagcctgaacatgtcagtcccatatttgttggtcgagagatatacagtgaaaaggtaacttggggtaaaatttctatggttgatgctgagaggaggttgatggcaaatgctctacaagatattgacaatcagcattttgttttgctatctgatagctgtgtacctttgcacagttttgattatgtatatgactacctgatgggtgcaaatctcagttttattgactgcttttatgatcctggaccacatggaaattttagatattcacaaaatatgttgcctgaggtcacagagactgattttagaaagggttcacagtggttctcagtcaaacgccaacatgcgttgatgattattgcagatagtctttactatactaagttcaagcttcattgcaggcctgggatggaagatggtcgcaactgctacgctgacgaacattatttgccaacagtattccgtatgatggacccagatggaattgctaattggtctgtaacccatgttgactggtctgaagggaagtggcatccaaaagcttaccgggcaaagcacgttaatttggagcttctgaagaatatagcatcaatcgacgtgagccaccatgtcactagtgatggcaagaaagtggtcacagagaacccctgcctatggaatggagcaaagaggccatgctacctgtttgcgaggaagttctaccctgaatccataaacaatctcttgaccttgttcgcgaattacacacttatttgagcttctaggtgacgcttagaggctacagggaatattttgttatagaaatccttgtacattggttaggaacataataggagattaattaacaggatagcagttggtgaggagaaggctttcggctttcgctgcagcaacacagtggcttcggatataccacaaaaaaaaaaaaaa

SEQ ID NO: 23167 - DNA, 7102 bp, Zea mays
  misc_feature (1990)..(1990): n is a, c, g, or t
  misc_feature (2050)..(2050): n is a, c, g, or t
  misc_feature (2056)..(2056): n is a, c, g, or t
  misc_feature (2239)..(2239): n is a, c, g, or t
tgcagctgaggttctgtaaaagcgaatgacacacctgaacattcttcttttactgagatcaagcgtgtcataagatttattagttcctcttgtattgtgaaaatttccaaagaacacaggaagtgaaatatcttttattatgaacattcccaaggaactcaggaagtttgataaaaaaaatgagcataatccctccgtcccagaataacaatcgttctagacttcaaaatttgtgctgattagagattttttaaatctaattatgatgtaatacttcagagcgtatcactatccttcgaacaattgtttctctgttcttcgtgctgaacgcttgtttgcacacttatattgagctgattcaacgacgagagtaactgaagaatactgacaaaatcaaccgagaaaaataataattggtgtatctcactctgacattatttttctgctctgctagtactcttaagtataaagggagcatccttcttgacgcgactcacattattcaaggtttcagccccgaaaaaacgttcacatccttcatgtttcagacatcttacaacaggggctgattctgtattcaggtgtaggcatcccatatttcagaaactcaaatcatagctcatttgatggggtgccaggctactctttacatgtgagctgcaagtattgctggaagtatgataggattggttcaataagtctttgaacttgaaacaatataaacagaaagctttgagcagcttcatataattacttcccctatgtcaccataaccaaatcactgcacatagcttattccacagtgacaagatgaggcctagtcattgtgctgaaaaccaggaagaagcgatgcaacaaaccctacaacaaccagctggatctctttcaagacaccttccagccaattacgccgattgccttctacctctgcctcttgtggattctcgttaccagctgcagcatcttgttcacggttctctgcagcttggtcagggtttgcagggtcattgggctgctcattgccatcattctgggcaggcagagcagcacggttctcggcccgagcaggagcctgtggtggatgagcagctgcacctcccgcccgctgaagccatctaacaaaaggtataatagctccggtttgatataagtaaatcaatgaggcaaacagtatgagaagaaatagcctttgttttgagccttcctggctaaagagaaacaccactgcagctagtttgatgatcagggtcaagtcaagctgaaaagcgaagtgaaacctcctcacaacaacttgtctttgaggtacattttgctgcctagcatcctgtacattctcttcaccagcaggagcaccaatgctttctgttgggatattgtaagggaggggaaggcgtgcggttggacagttcaaaacttcataatgcttcgcactggtcccaagtatccccatcccccaatgaccaaatcaccaaaccagaataaaaaggaatgtcatagcccatagtagcaattcttgcaacaaaagttttcttttttcaactgctcaaagtctgtaaccaagttttacaagttagctgtagttccattctatcttcaagcatggcagcatcagaaacagcgcttgggctccattcaaaaagttaaaggtgtttgtgttgtggtattctcaatcaaattagtcattacaaactagtcagttatagcaagtccctgctgtcataacgatgaaaattgtattatttcaggactgagtaaacatcattatatgttatgttctgccttactcctgttctacaagttacaatatccctagataaataagagagatggctgaagttattcatcttgattttgacccccacactacaacagtgtgataaggccagtcaatcggttttttcggtgtaatcagtttactggtgtaatcggtttgtttgttcagttttagagaacttcggtgttgcagaatgaagagtcgatcaatgtttgnaacaaaaaccaacattttcgtttatctgttttttggctcggtgttcgctttttgccaaantacatngaacactagcacagcaccctgaacggaggacagagacagcaatttagctatgtgaatgattaaaaaacggggataacagcaagctgttcaacacaaccacatgccgttcaacatcaatcaaagcacgggattcaggaagaccaaaaaatcaagaaaggaagtggagaactgaatttgaacagnagagacagacacatcccacaaggaacccactgacctgcaccgtcgcatcggctttcaaggtgctgatgcgccggcgcgccacgctcgtcgtggtatgcgtcatcgctaactcgcagcaccactgagcaggatgcaccatagctaagccctgcggcgggtgctgatgcgccgatgcgccacgcttgccgtgggatgcgccatcactaactcgcagcaccactgggcaggatgcaccatagctaagccacgctgcgggtgctgccatcgatttggtcactagggatagagtcagggcctcaagggtgcggtgcgggaatgctggctgggcgtcttggctggctgtgggccaccttggtgtgggcttcatgggctgactgttgatggaaagttggtttagctgctctagtgcttatggcagatacacttcggtatatacggtgagtcagtttggtcaggcctaagcactgacaccgaagccgatcactgaggtatcaagaaatcaaaaccgatcccatgccgaacaactaatagtttgggttagttcggtttcaggtcggtaattggtgtctgggaaaaatatgcccagccctaagtgggactgtgggagtttttttctgtacatatctaattgctgagttaattagtaatgaatgttgcttcaagaacaaatgaggtgcatgtcaaataattcatggaaacagatacaatagtgaaagttgactcactgttttttcggttacccaagattgtcgccacctcataacagatcctaaacgaggtacgtataaagtataattcaaatgaagatctaaggatctcataatccttaaagtaagattatattgtatactgctgctgctgagcatgcttttaatcataaaatttctaccaagggccaacggaaaaagtacctaaatctcaacatatctactatgaacccctcatcacactagttcgatacagccacccaaatgtgtccaaggttttcaacagtacaattttatgactgcatatattacttgcataagctgacttacaatgactactgcaatggcacgcgagcagatctcaccaattcattgattgtacaaaataggcagacgtagcatattgttcagtaccaaagggtaacaacttacgttgggatattgtaagtgaggggaatgagtgtggttggagcatagcaacccattcccatcgccgctgctaactggttctgttgtatggcatatatccctggaccttgagcctgatcatccccgccttgctggggaaataccccagaaaggtagacagggtacaccatcggagaagcagaaggaccgttcggtgtggccatctggattatcatcaccagcaacaacagcacatagcagtattatcatcaccatcaggaggaaacacatattagagaagatttttagaagaaacaaaatatgctagcggcctggatcaggaacgtgccccgtaaggcagatcggtgtacaacccaataatttttgcaaaaaaaatgtacatgcataggcttgtaatttgatcagatccggatacaaatagctaagttagggttcgggttctcggtttcgcacagcaggaatggaaaagtaaggatccgcataccttgtgggtgcgggtgctaatccccgagaccccgacgatggcttggcgaagggaccgacgatggcctgggcacctagctagggcgccggcggtttgcctagcttccgcacgcgagaggcacagggcgagcgcacgcgagagggaggcagccggcactgcaactgctgaagtccgtgtgtttttcttatttttcagtttggcccttctgtacgtttaatgcagcccgtatctccgcctcccgcggcccccgtctcgacacttccatcaccgcccatcgaaatccttctaccgccccgctccgtcatccatggctcgtctgctcgcggcgcgagcccttgcgctggcccgcccctcggggacgccatccgccctacgcttctgcccctcccgtgcgctgtcggacgaggtggagttcgtcgagatcgacctatccgaggagtcccctgcctcttcatccggaggggaaggcgagggcgactcagccacggttcaggcgcagatggggtcgcggcgcctggaggacgccatctatggggtgctcgtgcgccgggcggcgcccgaatggctccccttcgtgcccggggcatcctactgggtcccgccgttgccgcggccgctcggggtggcgagtctcctcggcgcggctgtgtacaccgcgaggggcgccacggcgatgacggaggaggaggcgttcagcttcactaccgtacgggggtgtccatccgcggcgtactttgtgggaggtgaggtggattaagcaagcatttcattggggttgcgaaatgatgatgtgttagggctgcatagttttgatttgtcactgaatcatagtaagtttcggtactcttgggggtggggggtttgcaagttgtgcaagaaatttttggggtgcacttttatttttatacatggttagctaaatgattgtttatattggattgatgcgtgctaacttcaggtccacgttggacgcataattggttcgttttagttttgggtggatggttatcggtgtttcagagatggggcctctccaatgcaatgcaagtgttgttcccaacatttttgttcctttatgagttttgatgcgatgaaataggtctagaacttattggtgcattgtttgcacggatgaagttgaaatgtttcaaaacttaagttgatgtaaaggagtaggcctgttcatggtcctgtttgtgcaggtttgagcgggttcgcaaaccaagccgtgtgcatgtactctggtctgggttgggtagctctgcacaggttagtagctggtttcataacatatatggttgggtcagtccagtctgggttgatggtttttcacggtttctcagttgataagtcccatcgctagaaggaaaaacaaaaaaggaaggttcctagaatcccatccccttcaaaggtaaaacctgaaaccaacccagaatctcaacaaacacaggtttcaccatcagggctataaaggagtatgttttctgtcttaacttcacctgatggtgaaacttgtgtttgttgataacttaatgtgagtccaatgtactgcaatgtgcccttgcacaatctagctcttgtagttgtagctatgaaggttggagggttatgtgttccataacaggttcttagaattttgatatattattttgtgaatgatgactcgcaaccatgtgagcacaacttcataggctcagtgtatacaaatacaagtgaatgctttcatgaattgtcatgatcgtagttggcgtataagtttgtcaaaaaaatggtgatccttaatggcattggaactcaaatggtaggattgcaaaccataggatcataaaaaatagaattgcaaaaaccatgctgcttggcatatcaatcctgaagaaatctgcatggagattggttatgtatctatttcacatagaatatatgacgttccccaaggtatttggtaatgacatttagttctaatagattgaaaagccattattttttcctgtttatggcctagtttctgagatatagcaaggcagaaacagctgctacttataaagggaggggggtttaagtcagccccggggcattatattaagaaaaagacctcacgcaggtcaagaaatcagatggacttgcatttttataaccatgccgcttgtcatatcaatcctgaagaaatctgcatggagattggttatgtatctatacacttagaatacatgacattccccaaggtatttggtaatgacatttagttctaatagattgaaaagcccttattttttctgttgtctatggcctagtttctgagatatagcaaggcagaagcgactacgtataaaaaactcgacctgcaggggtaagtcagccccgagcattatattaagaaaaatactttctcacgcaggtcgagaaaaccccggaacccctgccaaacccatacacagtgtcaccgtagcccatgtgagaacacgacatcgaccgggaccaggccttagacatgtgctttggcgtgggacgaggacatttttttaaccacagcctaaaattcgctcccacgcggagtcgaactcaggacctgagaagtgctactcaaaccacctaagcaactcagctagaggccctttcgcaacaacagctacttatcacttaccatgttggcatggtgtggttggcatgttattccctttcttatgtgtcatcctttaattattccctcccctatccctgttaagctgaaaacttctttgctatatatgtataaatgataccatgactatgtagttggctgtgctttccgtacggaatcagtttatgtatgccctcagttccactcaaatttatgtgaagcaaaacaattatgcagtatagtattcctttaggtgtgctattaaagcagaatcatttcatgaattcaaaggattgtaaataaggcacataccattccttccagcacttgttgattcagtaaaaattctggtcatactgtgctaaactgctagcataaactttcatcttcgtatttggtttgccatgttactggtaacaaggtttaaatctctttgtttggagaattttgctggttgctgtgtttaaatgagtatttaacaagcttgatggtggattttttataaacgaagtttagcaattttgttgattcttttgtggctggtcaagttttcacaaaagtatgtaactatgtacaggtggtcagagtttttggtctccttaggctccaaagtgtccagggccaga

SEQ ID NO: 23168 - DNA, 1241 bp, Zea mays
agcagtggtaacaacgcagagtacttttttttttttttttttttttttttttggtttttttttttttatttcagaaactcaaatcatagctcatttgatggggtgccaggctactctttacatgtgagctgcaagtattgctggaagtatgataggattggttcaataagtctttgaacttgaaacaatataaacagaaagctttgagcagcttcatataattacttcccctatgtcaccataaccaaatcactgcacatagcttattccacagtgacaagatgaggcctagtcattgtgctgaaaaccaggaagaagcgatgcaacaaaccctacaacaaccagctggatctctttcaagacaccttccagccaattacgccgattgccttctacctctgcctcttgtggattctcgttaccagctgcagcatcttgttcacggttctctgcagcttggtcagggtttgcagggtcattgggctgctcattgccatcattctgggcaggcagagcagcacggttctcggcccgagcaggagcctgtggtggatgagcagctgcacctcccgcccgctgaagccatctaacaaaaggtataatagctccggtttgatataagtaaatcaatgaggcaaacagtatgagaagaaatagcctttgttttgagccttcctggctaaagagaaacaccactgcagctagtttgatgatcagggtcaagtcaagctgaaaagcgaagtgaaacctcctcacaacaacttgtctttgaggtacattttgctgcctagcatcctgtacattctcttcaccagcaggagcaccaatgctttctgttgggatattgtaagtgaggggaatgagtgtggttggagcatagcaacccattcccatcgccgctgctaactggttctgttgtatggcatatatccctggaccttgagcctgatcatccccgccttgctggggaaataccccagaaaggtagacagggtacaccatcggagaagcagaaggaccgttcggtgtggccatcttgtgggtgcgggtgctaatccccgagaccccgacgatggcttggcgaagggaccgacgatggcctgggcacctagctagggcgccggcggtttgcctagcttccgcacgcgagaggcacagggcgagcgcacgcgagagggaggcagccggcactgcaactgctgaagtccgtgtgtttttcttcggccggcctcgaggtaccc

SEQ ID NO: 23169 - DNA, 722 bp, Zea mays
ctgcaggatacagaagcatgaggttatctagcagcaccatatataggctatacaagtaatgaagaataaactgtgaaatagcattaagtattttggagacgatttgagcaaagtacttacaagtaaatcaatgatgcaaacagtatgagaagaaatagcctttgttttgagccttcctggctaaagagaaacaccactgcagctagtttgatgatcagggtcaagtcaagctgaaaagcgaagtgaaacctcctcacaacaacttgtctttgaggtacattttgctgcctagcatcctgtacattctcttcaccagcaggagcaccaatgctttctgttgggatattgtaagtgaggggaatgagtgtggttggagcatagcaacccattcccatcgccgctgctaactggttctgttgtatggcatatatccctggaccttgagcctgatcatccccgccttgctggggaaataccccagaaaggtagacagggtacaccatcggagaagcagaaggaccgttcggtgtggccatcttgtgggtgcgggtgctaatccccgagaccccgacgatggcttggcgaagggaccgacgatggcctgggcacctagctagggcgccggcggtttgcctagcttccgcacgcgagaggcacagggcgagcgcacgcgagagggaggcagccggcactgcaactgctgaagtccgtgtgtttttctt

SEQ ID NO: 23170 - DNA, 2322 bp, Zea mays
tttgttaaaaaaatcccttgtacattggttaggaccataataggagtttaattaccaggatagcagttggtgaggaaaaggctttcggccttccctgcagcaacacagtggcttcggatataccccaactggtcattgctactcctttagcctcgtgttgctttcatagtttcttctacccacatttttagctgcggcgttttaccatgtacatcaagctttgtttttacaaggaatggtcattcaataggaaaatctgagatcatggtcccgtatttgccctcaagttctcggttctgactgccaaagcacggttcaaagggatacatggaaaattttactttataggaaacaaatcctacgagttcctgcacgagtcctttgctgcgaagagatccaagactgaccacacgatgcttcaagtagatgatagagaagcgtcatgagctgcctggtctcgatgttcaggtcccactgccccagcccttccactgtcttcccagcacactgctatttggtttatttaggaccagcttggaaactcaaatccttctggaattcgaaattggagattgagggaaaagttttctgtgctgagtatgctcgcacacttatactgagttgattcatttatgagggcaactgggtaagatcgaaaaaatcaaccgagaaaaataacaattgatgtatttctctcttgccatgatttttctagtactcttatatgtttggtttgaggtcaaagtagtatgagacgggagacaccgcccccttaattttttgggatcacaccgctgccaaaaaattactccgttgtttacctcgactacacgtgactctcatccaaagttccaaacgctatagaaactgtgaccgccttgttccattccttcttatacatctaaccaaacacacccttagtacaaaggagaatccttctggatgtgaatcacattataaatcaagtttggagccctgaaaaatcttccacatcacatttcagacattttacaacaggttctgaatactgatactgtattcaggtgcaagcatcaaatatttctgcaacgaaacaatagttcaattgatgggggtgtcaggctagtctttacatttacatgtgagctgcaagtattgctggaagaaggacaggattggttcaaaaagtatttgaacatgaaacaaaacaatattaacagcaaagatgcataatagaaacctttcagctgcttcatataattatttcccctatgtcagtatgtcaccataactatttcactgctggtagcttattccacggtgacgacacgagggctagtcattgtgctgaaaaccaggaagaagcgatgcgacaaaccctacaacaaccagctggacctctttcaagacacctccaagccagttgcgccgattgccttctacctctgcctcttgcggattctcgttaccagctgcagcatcttgttcgtggttctccgcagcttggtcagggtttgcagggccattgggctgctcattgccatcattctgggcaggcagaggagcacggttctcgacccgagcaggagcctgtggtggatgagcagctgcacctcctgcccgctgaagccgtcttagaaaaggtgtaatagctccggtttgatataagtaaatcaatgaggcaaacagtatcagaagaaacagcctttgttttgagccttcctggctaaagagaaacaccacagcggctagtttgatgatcagggccaagtcaagctgaaaagcaaagtgaaacctcctcacaacaacttgtctttgaggtccattttgctgcctagcatcctgtacattctcttcaccagcagaagctccgacgctttccgttgggatattgtaagcgagtggaatgagtgtggttggagcatagcaccccattcccatcgcagccgctaactggttctgttgtatggcatatatccccggaccttgagcctggtcatcccctgcttgctgggggaatgtcccggtaaggtagacagggtacaccatcggagaagcagctggaccgttcggcgcagacatctagtgggtgcgtgtgctagtccccgatgaaggcctggcgaagggacagaggcctggctagctagggcgccggcggtttgcctggctgacgcacgccgagagagagcgataggactcgcgatagggagagcgcacgcgagagccggcggccccagacgcggggcccacagacacggtgcccacagacacagggagaccgcacgcagaggcaggagaaaaaaactgccaagtctgcaattgatgaacccggccggcctcgag

SEQ ID NO: 23171 - DNA, 1534 bp, Zea mays
taaagacagctgtggctttgtattggcctctattcattttgttttgttttaaactaatatacatattactgtttatggattcagtttacacttttcttctttgttttaccatattggacttaagagtattctctactgcataacatgtgtccatgtttgttttccttgcagcctgggatggaagatggtcgcaactgctatgctgatgaacattatttgccaacagtattccatgtcagtacacaatgacctttcagttgcaggaattaatttgtcatctgtctaatgcttttacagccctgttgacactgcaaatttgcatatctgtatcaactagatgatggacccagatggaattgctaattggtctgtaacccatgttgactggtctgaagggaagtggcacccgaaagcttacagggcaaaggatgtcactttcgagcttctgaagaatataacagtacgtgttctcctgctcatcctatgtctattttccaggtggttatttgaccgtagcatcattttctaacctcaaacccttttgatctgtgctgcagtcaattgacataagtcaccatgtcactagtgatagcaaggtaccaccctcggtcccttgtttccctcccagttggtggataaaaattcacaagttcagctacgtaggccccccccccagtgatagcaagaaagtggttacagagaaggcctgcctatggaatggagcaaagagaccatgctacctgtttgcgagaaagttctaccctgagtccataaacaatctcttgacctcgttcgcgaattatacacttatttgagcttctaggtggcgcttagaggctacacaggaaacattttgttatacaaaaccttgtacattggatagcaacagagtaggacattaattaacagaatagcaatagctattggtgaggagaaggctttcgctgcagcaacacagtggcttcagatttatcacgacaggccattggtactcctttagcctcgttactttcatagtttatcctctccacatatctttagctgtggttttaccatgtacatcaagcttatttggacaagaaatggtcattaaatggaaaatcagagatcatggtcttaaaaaaaaaaaaaaaaactcgagaacggaaaaaaaaaagttcaaagggatacataggaattttttgtatatagaatagggaatagattttagagttcatggattatctatcttcttcaaaaagcttaaaattttcggttgaactggttagtacgtctatatcagagttagagttcttgagttcggatcttttgatttctatgtttacatttttctctatgcgagtgacggtgttgaagtgtataaatactctcttcactcttaacactttgttagcgttgggtggatgacgaaggctgattctcgacggcggtaacgagcacgagatgagagggaactcggccgggtagcaaagctgataagctggcgctgcaggttgaccatggacttagtcaaagtcttcgtcacttgatgttg

SEQ ID NO: 23172 - DNA, 1566 bp, Zea mays
  misc_feature (48)..(48): n is a, c, g, or t
aaaacagccgcatccctctctccctactacctctccctagcagcgganagcttctctcccagccgcagctcctccctctgtcccctctcccaaaacccctctctctccacgcttctccctcactctcccagccgctgcagccgcgctgccctccgccccggcgcccgtcgcgctgccctcccatctccctccggtgttgtgttgtcatttgtcaggtagccgcctcccccccccccccccccctcttcagcttgttctccgcggcggcggcggcggcggcttggatcggagcggagggagaagatggtggcatcaatcagggtgcccaagacccaacgcgccaggagggagcttctcaagcacgcgcccaagcttgttgagaccagcaagaagacactgatcctccatggtaccaagactagtgctgtgttgaactctgtgctgtcagatatttaccacctaaagcgtgataatgctgtgaaatataccaagaagaatgacaacattaggccttttgaaagtggtggagaatcttctctggaatttttctccctcaaggcagactgtagccttatagtgtatggttctcattcaaagaagaggcccaacaatctgattttggctagaacgtatgaccaccacatatatgaccttgttgaagtaggagttgagaactacaagtcaatggaatcttatgtttatgataagaagctagcaccattacttggatcgaagcctttctttgctttcataggggaacactttgagagttctgaagagctgaaacatttgaaagaagtgctgcttgatcttttcagaggagaggtcgtagagaatctgaaccttgccggtgtggatcggatctatgtgtgcactgcaatctctcccaccactgtctacatgatgcactgtgctctccgtctaaaaaggtcaggtacatctattcctaggatggagctggtcgaagttggaccttcaatggatctggttgtaaggaggcacagacttccagctgaaagtttgaagaaagaagctatgaagaccgctgaacatgctaagaagatgaaaaatgtcaccaaggatccagtgcagggcaagctgggcaaggtctacatgccagaccagcaggttggaaagttgaccttatcaaacgacgtaaagggactaaagagggagcgccgcgaagccaagaaaaatcaggactcaaagaagcaaaaggtcaaccctgagtaaagagcactgaagtttacctttgtattggatacaggtcaggttaagaaaccctggcttgtatctgtttccaactgctgtgttatccaagtagaagttgctcgctgtcagattagtgccatcttgttaggctaaagatctctgtacgactttcacatcagtattgtgtaccaatccatgttatgacataagcatggaattttgagaatgtgttatcctatcaaatatcaaacgtcttctgaggtctcaagccctgttaaaggaggattgtggtaggcttggcgaaaaaaaaaaaaaaaaagccattctaatggagatcgacaaccagaatgccta

SEQ ID NO: 23173 - DNA, 1505 bp, Zea mays
  misc_feature (1361)..(1361): n is a, c, g, or t
  misc_feature (1383)..(1383): n is a, c, g, or t
  misc_feature (1442)..(1442): n is a, c, g, or t
  misc_feature (1455)..(1455): n is a, c, g, or t
  misc_feature (1467)..(1467): n is a, c, g, or t
  misc_feature (1480)..(1480): n is a, c, g, or t
  misc_feature (1502)..(1502): n is a, c, g, or t
gggcaccgcgaggtaccgcccgggactctccgcaatatggcgcggggttttctagggtttaggggtcaggccgcccggtgttgtgtcgtcaggtagccgcctccccacctcttctgcttgttctccgcggcggcggcttggatcggagcggaggaagaagatggtggcatcgatcagggtgcccaagacccaacgcgccaggcgggagcttctcaagcacgcgcccaagcttgttgagaccagcaagaagacactgatcctccatggtaccaagactagtgctgtgttgaactctgtgctgtcagatatttaccacctaaagcgtgataatgctgtgaaatataccaagaagaatgacaacattaggccttttgaaagtggtggagaatcttctctggaatttttctcccttaaggcagactgtagccttatagtgtatggttctcattcaaagaagaggcccaacaatctgattttgggtagaacgtatgaccaccacatatatgaccttgttgaagtaggagttgagaactacaagtcaatggaatcttatgtttatgataagaagctagcaccattacttggatcgaagcctttctttgctttcataggggaacactttgagagtgctgaagagctgaaacatttgaaagaagtgctgcttgatcttttcagaggagaggtcgtagagaatctgaaccttgctggtgtggatcggatctatgtgtgcactgcaatctctcccactaccgtctacatgatgcactgtgctctccgtctaaaaaggtcaggtacatctattcctaggatggaactggtcgaagttggaccttcgatggatctggttgtaaggaggcacagacttccagctgaaagtttaaagaaagaagctatgaagaccgctgaacatgctaagaagatgaaaaacgtcactaaggatccagtgcagggcaagctgggcaaggtctacatgccagaccagcaggttggaaagttgaccttatcaaacgacataaagggactaaagagggagcgccgtgaagccaagaaaaaccaggactcaaagaagcaaaaggtcaaccccgagtaaagatcactgaagtttacctttgcattggatacaggtcaggttaagaaaccctggtttgtatctgttcccatctgctgtgttatccaattagaagttgctcgttgtcagattgtgttaaatagtttagggccatcttgttaggctaaagacatgtgtacgactttcacaacaatattgcgtaccaattcatgttaagactgtaaccaggaacaaatttgagagtgttatcctatcaaacagccaacgtcttcctgaagtcccccaacccccngtttaaaaggaaagaattgttnggttaggcctttgggtgaaaccccaccgtttttaaaacctaaccccattcccccaaatnggaaaaatttccnaaacaaaccccnaaaaatgcccctnaaaagggtttttaacccccttnaat

SEQ ID NO: 23174 - DNA, 1496 bp, Zea mays
ccggacacaacttgattagttttctgaccgtttttaggtttggtttaaaatttaaaaattcagaaaaaatataaaaacagaaatgtatgataaaacttaatatttttctaagtattattatgtattttatatttttatgtttttaaaaatgttattataatttcttggtaataaataacgtatttcactgagaaatcatggtttgccgatgtattgtcgctgaatttcgtatttttaaatttaaaacatgtacatcatttttttatcgaaaaacacaaaaccgcctgaaaacaccgaaaaccgctcgggatttgaagaaaaccacccgggacccctgagattcggtgttttaaatttgaaaattctaaaccgttcaagatttagcggaaatcgacgaaaactgctcggttttccgttctcgagaggtagctgaactggagggaaaaaaaacaaacggtgaactctcagtccagtacactattatattatatcaaaatcatatccgtccatcgaccatggggcatggtgcacccagagttgtgagatcgacgcccctagatctcgatttcttaaaataaaatcatacagcgcagcagccaacacgggcagcccacagacaaagttgacaaagggcgcccaacccacggcggaaagcgacgcgcgccagataaatggcgggggagccagcagcaacctacttcctgcttcctccagaatcggtcagccgcaatccttccaccccgtaccacgcctccccctacccccaccaccaacaagcatgatttccccacgccccgcgctctcccccagcttcctcgccttccggtccggctccccggccgcgtcgccgccgtcctccccgcgcctccacgcgccgccgcccctctccgcctccttctccaccgtcgccaccgcggcaccgggccacgcagctgccagctccttctacgacgtcctcggcctccgccccggggccagcgcgcgggaaatcaaggccgcgtaccgccgcctggcgctcgccgtccacccggacgccgccccgcaccccacatcgtccgccgaggacttcatccgcgtccacgcggcctactccacgctctccgatcccgacaagcgcgccgactacgaccgccgcctcctcctttccggcgccacagtacggcgcaccgtcgctctaggacgctcgccctcgttcccagcgcaccgttcccgccggacatgggagactgaccagtgctggtgatatgtcagaaagatcttcgacttcgacgtctacgactggtgcggcctccgcagtctccgtcgggccgcagaaccttccaatgaatgggaacgcgaagatccccgcaaacctctggactcacacaaagcgtagcgcagccttgcatgcttcgttgcgggcttgcggcctgtaatgtaagaatgttaaaataaaggaacaattagatctataccattaaaagatccaaactttagatatataccatagatcatac

SEQ ID NO: 23175 - DNA, 1851 bp, Zea mays
caattgttcttttgcttcctggctccttccttctcttttcttttcgtttttttttttttttttttaaacgaagccaaccacctctatattagggtatggaatcacacatacaacacatatataaccgccctttgatgctctacattttctcattgtgtacagaaaaaaaatatatcctcctcaaatatatctcctctatgtcatctagcatctataatttatatgaccgaatattaacgttgctactcttggcgcaacatgcccaatataacacgagaatcatgtaaacctagtccagatgccgtctggaaacatagatgccatgcgtctgatcttcggaatgttctagctagcaggggccaatactacagtcctgctctgctctgcttccaaagctgtagaggctggtgccaacctaatgtaaagctccttcatgaacacttcccgctttctgggcctcctggagttcaggaaaaatcatgcgcgtagcagtttattagtcgcgagccggcttgtttctccaagcagcaatgggctttggaatgttgtcaaaacgagggatcgggagaggaagagcaaaagcatctgtatttatgctccacttgctcgctgaccatatggatgaactggtgttggtctctggctcctggaactccggagtgctggatgatttccttacagtttgcaaaccattgccaaacaaaggctccgccattgcaaaaagattctgctggctcttgttcatgtctggtcgattgctagactttggcctcagagccaagccttttccaacgcttgccagaaagtcaccaccattttcctccctcggtaacagctcaccatcagctttctggcgccgtcttatgaacctttcactgtcaccgttctcatcagtaccaccatcaagaaaagaacctatcatcaagcttctgtttttcctattctgaagagggaaggggtcggaatttggtggctccagccacggctcaacatccaaaaaagcagatttgcctttactgtgaactgccatctcagtgccctcacttgtttgatctctctttggaggtggttcaaggccatagtatccctgcagaagactcatagctggcgaaactttggaatttggtgttttcaatattgattccaagatatcatcatgaatgcgacgtggagtacattccctgtcgtcactctcatatgaaccattctgctggtaagacgacggagggtgcctccctgggagtggaatccgcagtgtcttgtgtgcaaacatctggagatcagttgagaggccgttcagcctcttaatgtcggctacctcgacaccatacttgatggcgacgcccgctagggtgtccagcttgcgcacccggtgtagcatgtactgcccgcacgatgacatcgccgccgccggcgacgacgccgacggggacgaggactgcgagggggactgttcgacggctacggtggccgcagcgcccacctcctcgatctcgccgaggccgcgggccccgccgtccaaggacccattggtgcgcgggaaggccgggtccttgggcaaatgggggcggatcatgacatccggaagcgcggaggggggagatctaagcgcggagggcgcagattcgggggcggcgccccgtggaatcgccgtcggtgccggcggctgggggtgcagaataggagatagtgcgaggaatcgacgaggagagaggaagggaagggtgggaggggaggggaggggagaggggagctctcacaggtttggttcctttgacgcggctcggggaagaaggaagaaggggacgctagaaacgtcgcgcaccccggccggcgtgcgcacgggaagta

SEQ ID NO: 23176 - DNA, 1514 bp, Zea mays
aatttaaggtgatcagggatttcctgtgtttggtagtatgattaacatgaaagaacttcggtaaactgtctactggttaattaaacagggagagttttttttttttgagcttcatgttattgtttttatatagttaagagatatagctagtcaagtattctcattgcatctaaaaaaacggctcattctattatcaaacacacaacttgaatggccatatctctgaaacatggatgcatcctagccaaccttgccatcaatccaaacacacaacacaccataatcatggggaaaacacaacattgaccaatcaatcttcgagacaccgaggtctgatcaaatagataagatgacggtatcatattgtcccttaactctggtcctccattgttattcttgagcatcatgattcgttccaattccatcaaggcagaacaaatgcatgcatccatccatccagccatggagtcaaatcaaggccgcaaacaagtcagtcagttccattgtattttcctgtggattgtccactccgacgggttcacggtggcgtcaccgctggaggagacaagatcgaagggggagtcctcggcgaactccgtcggcattgccttccagtgcagggatggttcccactctgcctctttcaacaccttcaggatctcttccaccacaatgttgctcccttcttcagacagatgcagcccatccctacaacacgacatcaattattgtcttcttgctcaggccggcgacaagcataagcagcaaacaactcacgtgaagcacgcagtcttccagtcctccctcttctgcatggcatgccagagatcaaccaccttcaggtgcatctccttgcacagagctacgcacacgtcagagtacagacggcaggtttcgttggtccggacgatctcactcagtatagtactgctgcacacataatatgctcagttccatgtattatattacattgcaaaaagaaagtttgtgttcaccatacaattgatctctctcacctggttgagtttcgaagcatctcctcgttcagaggtgggcagctcaggaaaaggacccgtgtcttctcggagaggctctgaccacaaaggcaaaacaaactgtcaaacaactagctactgctgcaccagcaccatgccagtaacaccttggtaatcgacgctctacctttaggtgttctgcaatctttctcatgttccctatgtactcatctagcggcacatgaggcccgagaccggaacaatgagcatcaattgagtcgtttccaccaaagtaaactattaccagagacggctgcactgctgaatcctaatgacaaatgaagagtagaaaaccagttaaaatttggacaactgccagctattttttttagtatcatcaaagattatttcgtaaactgtattaggatcattgattacattacagtattggtcctcgagagcatacacgtgtgtcatcatatagataagtaactgaaaactgctgaaattttcattatg

SEQ ID NO: 23177 - DNA, 1072 bp, Zea mays
  misc_feature (1050)..(1050): n is a, c, g, or t
  misc_feature (1054)..(1054): n is a, c, g, or t
  misc_feature (1060)..(1060): n is a, c, g, or t
ggccgcttttttttttttttttttcagcttcatgttattgtttttatatagttaagagatatagctagtcaagtattctcattgcatctaaaaaaacggctcattctattatcaaaacacacaacttgaatggccatatctctgaaacatggatgcatcctagccaaccttgccatcaatccaaacacacaacacaccataatcatggggaaaacacaacattgaccaatcaatcttcgagacaccgaggtctgatcaaatagataagatgacggtatcatattgtcccttaactctggtcctccattgttattcttgagcatcatgattcgttccaattccatcaaggcagaacaaatgcatgcatccatccatccagccatggagtcaaatcaaggccgcaaacaagtcagtcagctccattgtattttcctgtggattgtccactccgacgggttcacggtggcgtcaccgctggaggagacaagatcgaagggggagtcctcggcgaactccgtcggcattgccttccagtgcagggatggttcccactctgcctctttcaacaccttcaggatctcttccaccacaatgttgctcccttcttcagacagatgcagcccatccgtgaagcacgcagtcttccagtcctccctcttctgcatggcatgccagagatcaaccaccttcaggtgcatctccttgcacagagctacgcaggcgtcagagtacagacggcaggtttcgttggtccggacgatctcactcagtatagtactgctggttgagtttcgaagcatctcctcgttcagaggtgggcagctcaggaaaaggacccgtgtcttctcggagaggctctttaggtgttctgcaatctttctcatgttccctatgtactcatctagcggcacatgaggcccgagaccggaacaatgagcatcaattgagtcgtttccaccaaagtaaactattaccagagaaggctgcactgctgaatccttagggaacactttgtccatcacttgaacagcccgccttgtgttccagccnatanatcctnttagcaggcagt

SEQ ID NO: 23178 - DNA, 607 bp, Zea mays
  misc_feature (539)..(539): n is a, c, g, or t
ggtagctcggcacccttcttcaaggattgctcgcactccttcaggaacgcacgcacttcatcatcctcagcgacatgtagagctgtctggccacctttggtctttgctgtgacgtcaacacctttcttcacaaggtacttcacaagatccaggtgagaattctgagcagcaaagtgcagcgccgtgaagcctttccggttcttggctttcacagaggccccagatgccagcagctcacgagccacttctacatggcctttctgggaagcaaaatggggggcggcgggggcggccattgctgcagctcccacatcagctttgtgcttgcaaaggcatctcacaaacatcaacatgcccagcccatgcagccaggtggagtggtgtgcgtgagaggcgatcccttgaattgacggcgagagggttggactcgctcaccgactccactgctgccgcatcaccagaccttgcagccttgtgcagaggaagatcttcttcctcatctcgcccacgccctcgccctcgccctcttcctcttccgnccgccgcggccgccgccgccgctgtgacgccgtcccatcagtctcgcgaatcggtcaggtaattaatt

SEQ ID NO: 23179 - DNA, 2085 bp, Zea mays
ttacataaaaaatatattaattgaattagtgttgtctaatttataattattagaatgtaattcaattccaacgaaacaacggggccttaggtttaatatcttccttacactgcgaaaatgttgttacacttgccaaaaaaaatcaatcgcatatttaccttacaaggacatattttagcaaaatgctatagacatgaatccaacgtaatcaatagagtgagatttactggtaaactaccaattgctcatctgctcggtaccaaccagcctttcctattaccatgcacatgttgcctctcaactgcagcatctttcaagccgtgagcagacatgttgcagatcgaagtaaggtatatatgtgcatagtctcctaattcttcatcttcaacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgtaaccatgattattaatgccctccatagtctccattccattttggtctgtagggttcacttcatccactctgatgagtaataataagttctttaaacttattgctggcggtgaactgatccaggcaagacgacgaccgtgaggactcggtacgtggtgatgtcggatgagatcctcaagaactacccggagctggcccaggaggggctgccgacgatgaaccagcgtctggacatctcgaacgcggcggtgacgcagatggcgacggaggcgtccctgtcgtgcgtccgctcgtggggcggcgcgctctcgtccattacccacctggtgtacgtctcgtcgagcgaggcgcgcttcccgggcggcgacctgcacctggcgcccgcgctggggctgagcccggacgtccgccgcgtcatgctggccttcaccggctgctcgggcggcgtggcggggctccgcgtggccaagggcctggccgagagctgcccgggcgcgcgcgtgctgctggccacctccgagaccaccatcgtggggttccgcccgcccagccccgaccgcccctacgacctcgtgggcgtggcgctcttcggcgacggcgctggcgccgccgtcatcggcaccgaccccgcccccgccgagcgcccgctcttcgagctccactccgcgctccagcgcttcctcccggacacggagaggaccatcgagggccggctgacggaggaaggcatcaagttccagctggggcgggagctgccccacatcatcgaggcgcacgtggaggacttctgccagaagctgatgaaggagcggcagagcggcgaggacgcggacggtggcggccccgagccgatgagctacggggacatgttctgggcggtccaccccggcgggccggccatcctaaccaagatggaggggcgcctgggcctcggcgccgacaagctccgcgccagccggtgcgcgctccgggacttcggcaacgccagcagcaacaccatcgtgtacgtgctggagaacatggtggaggacacccggcggaggaggctgctggctgccgacgacggtggagaggactgcgagtggggtctcatcctcgcgttcgggccggggatcacgttcgagggcatcctcgccaggaacttgcaggcaaccgcgcgcgcctcagcccagccttgatcacctcttgttgggttgcttttctgcttgctctgcacctctgcttccgtgtgattgctgctttgagggagaatgctgagcatcaacattgctcatgagcatcaatgaaataaggggccccgaaattcactgctcatggtttccgcaattgaattgaatcaaccttgagatctaaaaagaaaaaaaaaaaaaaaaggacatggaggtctccaagaagatggtgggataatacgacaa

SEQ ID NO: 23180 - DNA, 1552 bp, Zea mays
gcacgagaccattacctagaacatcctaatcgaaaaatcttcaacctctagctgattgatctctggtatttaccactctttccttccttccttccttcaattctaaataccacaaatcaaagttgctttgcgatggtgagcagcagcatggacacgacgagtgacaagcgtgcgtcatccatgctggcccctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcccaggaggggctgccgacgatgaaccagcgtctggacatctcgaacgcggcggtgacgcagatggcgacggaggcgtccctgtcgtgcgtccgctcgtggggcggcgcgctctcgtccattacccacctggtgtacgtctcgtcgagcgaggcgcgcttcccgggcggcgacctgcacctggcgcgcgcgctggggctgagcccggacgtccgccgcgtcatgctggccttcaccggctgctcgggcggcgtggcggggctccgcgtggccaagggcctggccgagagctgcccgggcgcgcgcgtgctgctggccacctccgagaccaccatcgtggggttccgcccgcccagccccgaccgcccctacgacctcgtgggcgtggcgctcttcggcgacggcgcgggcgccgccgtcatcggcaccgaccccgcccccgccgagcgcccgctcttcgagctccactcggcgctccagcgcttcctcccggacacggagaggaccatcgagggccggctgacggaggaaggcatcaagttccagctggggcgggagctgccccacatcatcgaggcgcacgtggaggacttctgccagaagctgatgaaggagcggcagagcggcgaggacgccgacggtggcggccccgagccgatgagctacggggacatgttctgggcggtccaccccggcgggccggccatcctaaccaagatggaggggcgcctgggcctcggcgccgacaagctccgcgccagccggtgcgcgctccgggacttcggcaacgccagcagcaacaccatcgtgtacgtgctggagaacatggtggaggacacccggcggaggaggctgctggctgctgacgacggtggagaggactgcgagtggggtctcatcctcgcgttcgggccggggatcacgttcgagggcatcctagccaggaacttgcaggcaaccgcgcgcgcctcagcccagctctgatcacctcttgctgtgttgcttttctgcttgctctgcacctctgcttccgtgtgattgctgctttgagggagaatgctgagcatcaacattgctcatgagcatcaatgaaataaggggccccgaaattcactgctcatggatggtttccgcaaaaaaaaaaaaaaaa

SEQ ID NO: 23181 - DNA, 977 bp, Zea mays
accaaacaagcccttagaattttcattcatgcaccacatggagaactgagattcaactttgtacttgtctttacattcaagcatcgccgtacagactaagactagcataacacaacacacaggtgcaggtggaactatctaagtgcacttctattgcatcctcaaggtcaaggctgctcgaaatcactcctcttcctcgtccatgtcattttcacaaactagatgaccaagagaaactttggctttttttactcctgacaaactcgacgcaccaaccaattcgcttttcctcttctcgccctgctctgcatcctcctcatctttcataacctcacctgaagacttgctatcgccctctttctcggcagaatcatccttctccgatggtagctcggcacccttcttcaaggattgctcgcactccttcaggaacgcacgcacttcatcatcctcagcgacatgtagagctgtctggccacctttggtctttgctgtgacgtcaacacctttcttcacaaggtacttcacaagatccaggtgagaattctgagcagcaaagtgcagcgccgtgaagcctttccggttcttggctttcacagaggccccagatgccagcagctcacgggccacttctacatggcctttctgggaagcaaaatgaagtgctgcagtgtcgtccattgctgcagctcccacatcagctttgtgcttgcaaaggcatctcacaacatcaacatgcccagcccatgcagccaggtggagtggtgtgcgtgagaggcgatcccttgaattgacggcgagagggttggactcgcacaccgactccactgctgccgcatcaccagaccttgcggccttgtgcagaggaagatcttcttcctcatctcgcccacgccctcgccctcttcctcttccgccgccgccgccgccgctgtgacgccgtcccatcagtctcgccaatcggttaggtaatggat

SEQ ID NO: 23182 - DNA, 1130 bp, Zea mays
aagaaactgatttatagaaattgaggtggctcatgtggaggagctacaaatgagacagagctacaggggtttttaaagggagccagagtcctaccaaacaagcccttagaattttcattcatgcaacacatgagaactgacattcaactttgtacttgtctttacattcaagatcgccgtacagactaagactagcataacaaaacacacaggtgcaggtggaagtggaaccatctaagtgcacttctattgcatccctcaaggtcaaaggctgctcgaaatcactcctcttcctcgtccatgtcattttcacaaactagatgaccaagagaaactttggctttttttactcctgacaaactcgacgcaccaaccaattcgcttttcctcttctcgccctgctctgcatcctcctcatctttcataacctcacctgaagacttgctatcgccctctttctcagcagaatcatccttctccgatggtagctctgcacccttcttcaaggattgctcgcactccttcaggaacgcacgcacttcatcatcctcagcgacatgtagagctgtctgaccacctttggtctttgctgtgacgtcaacacctttcttcacaaggtacttcacaagatccaggtgagaattctgagcagcaaagtgcagcgccgtgaagcctttccggttcttggctttcacagaggccccagatgccagcagctcacgggccacttctacatggcctttctgggaagcaaaatgaagtgctgcagtgtcgtccattgctgcagctcccacatcagctttgtgcttgcaaagacatctcacaacatcaacatgcccagcccatgcagccaggtggagtggtgtgcgtgagaggcgatcccttgaattgacggcgagagggttggactcgcacaccgactccactgctgccgcatcaccagaccttgcggccttgtgcagaggaagatcttcttcctcatctcgcccacgccctcgccctcgccctcttcctcttccgccgccgccgccgctgtgacgccgtcccatcagtctcgccaatcggtcaggtaattgcttccatgacttgggctcttgctggcagggaggagcctccccgtcccgtcgtgc

SEQ ID NO: 23183 - DNA, 1841 bp, Zea mays
gcatccacatgcatgcaccagccatggggactataaagaatcagaccttgcccatgtgactttgctcatgccagcaacaattccaaggagttgaattgtcgttgatgcaaatccaccaagtctgaacgctatatcaaggtccacaacactttgatctacagaaactctgttcaaaatccgaccagatggtgtggtgtcaaagaatgacattggagctcgaaagacacacctaagcatttttataaaaagcttctgggcagctgctaaaccaaacgtagccacaagaaggcttctcatgaacacaaatagtgaacttccaaaggcaagggacatataaacaaccagaaggaccacactatctgtcttgggagcatctccttctgtttgtgggtttgcccatgccatccaccagttgctcgcaatctgaagaacttggaacatggtttgagccaagataattagtggtatcagtgtacctttgtaagcttcccccatgtatgacaaataaaccttggagctcacttttccacgttccctttcctcctcttgaacagtacgcttcttcttacgctcttctttcttctttttttccttaattccccgtgtattagatggttgtccattttcacacatcttatttttcaggttatcaatattgctgatacttggtgtcaatcttttgttgggaatagaagaaactgtatcactatcggaatcttcaaatatatccatggtttcaatagcttccttatgagcagaaaccagagcattgaaatcagttccagcttgcagaagatcatcatactttccagcttgtgtgatatggccatccttaagaaccaatatcagatcagcagctggtagaaattcaacttgatgtgttacatagattactgttttggttgctagtgcagtcaatatatactccttaaacagttcgctcccagtatgagcatcaacagcactgaagggatcatcaagcaaataaatatcagcatcttggtagagtgctctagcaagctgaactctttgtttctgacctccactcaaattaatgcctctatcaccaataacagtctgatctccgtactggagcagctcaagatctttcttaagacagcaagctgcaatgactctcttgtaacgttgtctatccatttgactgccaaacagaatattctcctcaatatttccagactgtatccatgcagtctgaggaacatacgctgctgtgccacttatcctgacctggaatatgaggcaggagaaaggtcaatgtaacagaacaagcaaaatcaatgtcgatttttttttgcatttatacttacatggccacataatttgggtatctccccgagtatagacgatagtagacttgatttaccagaaccaatgacaccacagactgctactctcatgcctctcactacactaaggtgtatatcagaaagtgtaggggtcagagtgtatgggttccaagagaatgcgccatccttaatatcgactgccttatctgtactactttgtggaacatttatagttgcgtcatctggcagttcttcttgctgcagaaaatgagacaaacggtccaaagacacccttgtctgtgccatcatagagatgagatccgggaagttcctcagaggctcttggaggatccgaaacgttgctaaagcggatagaacccctcctgcagtgagctggccaccgagtaatatgcaagtcccaaaagttatgactgcgacaaagattggcgagctccagaaaacaaatgtaactgcagcctgtgagtacagagcccaccgaagccatctgcattccacgttcctcatctcttccaa

SEQ ID NO: 23184 - DNA, 2182 bp, Zea mays
taccagcatatgtaaaggatactttttgggctggtatctccactgttcgccgtagtgaacgattggaggccttttttgatggatatattacaccagaaaccacaataaagacgttcattgaacaattcgatactgctatgaagctcaggtctgatcgagaagcctatgatgatttccgttcatttcaacaaaggccacaagtcctgtctggtcttctgtttgaggagcaatttgcaaatgtttatacaataaatatgttccagaaattccaggatcagttgaagcagctgatgaatgtgaattgcactgaagtcagtaggaatggttcaatagtgacatacacggtgacagtaatcggaaaggagaggaagtttgactacagagtgatgtataacagtgctgagaaagaagtgtggtgcatctgcaggtcattccagtttaaaggtattttatgtagccatgctcttgctgtcttgaagcaagagcttgtgatgctaatacctcccaaatatattcttgatcgatggcgaaaggactacaaatgccctgaggaacctaaggaaacccccatttcacagaaagctgctaaagatacagggaagggctcaaaaccagaaaacattcgggaagatcaagtggacaatctctacaagcatggacaccagtactttgctgacattgtggaaatgggagctactgaccctgatgcgatggaatacgtcctttctgtgatgaaagaagctaaagagaaagtgcgcaagtttgaggagtctcgaaaagagaagaggcctggagagggtccagtttctgctggtaaaaaaggggcgaagttttcgaagccatccacacaagaagttggcaatacagcatcagtttcgactccgactgaagcagtggcttcggtcacagtggtgtcatctcctccaatggcggcagccccaacaatgatggctatggcgccaccttcagcagctgtggccggaggaatgtttttagtaccaatgcacccgcatcccttggtgttcccacccttcccccctgcagtcccaccagcggtagctcctgtagcaccacctgctgcaccagcaaccaatgttgtctccaacacctcaaagaagcgaaagaaaagaaaggggaataattgatcttctgatgctgatgaaatgatgagtaagctgcgttttgcatattgctccaattgtatttcgttaagattaatgtttcctgaaatttgttgtttttacacttagatgttttccagatctaaaacaagatcagatcggcgaagtagaaaatgagtttgatctcacactacgcatcaggcctcgacatgagagtgagctatcgatttatctcttctgcgcgggttggtctttcgagaaaaatctcttctgcgcgggttggtctttcgagaaaaatctcttctgctggctgtgctactgctacctatgagactacctactgcagtctgcatattcctggggtgttggcttcactgcttcagctagatgctctgctgtggctgacccagttcagtctaaggagagatgcattttgggctcagcacactgatcttgattactgtagattactagattagattgcctgtagtgtacattatcgtccccagggccggaagtaatctaacatgtagtccagcttatgaatgtaaagatctgtttctgattatggattgcatttatggggaaggatctggatcttattaagaaattctgatttacaagcatttgccgtcatttgagtttattggactatactctttccatttggcaatgtttgtctatcgtcttgggacttgagaggatgtctctcaataccctatgtccaatgaagatattattagaggagtacttagcctatctctagcagattttatattatataaacagcgcagtttacagctctgctgagcgcggtcttattgggcgtgtttgtgacccagattttatattatataaacagcgcagtttacagctctgctgagcgcggtcttattgggcgtgtttgtgaccctgtccttggccagctcggcccgttcaactggtccaggctgaggctagccactcccggctactgcaactcactttgtttgcgcacttgtaccatatgagtctgactcagatgagctgatgttgtcacccaatatgcagccaggctagaa

SEQ ID NO: 23185 - DNA, 2230 bp, Zea mays
atatttgggatagtgcgaggactatcaagataattagtagtttggtattctgttgtatccggctggttgcatatgtaaagattttagctaatcctttcacatgttcgagagcaggacaggacgttgaacggtttgttggcattcacgtgctacacggtgctggaacaataatacagagtaatacagagcagcagagcagaccggtaatcgttcagtgccgcacgctcgaatcggggagagttcaacgggcaaccagctgatggaagccctaaagaaagcagaggacaccaacgtctcgccgcgatgcttggccataccgaacatagcatgccacccatcttggcttcgcagtatatatgtgtgttcgagcgcaccaccacaaccacgacaccggcaccaatctgccatcctctccatcacgaagatggcgttcatcagcaatgtcgcagtgaaggcggcgggcgtggccgcgctgcttgtggtcgcagtggtgtcgcctgccgcgcgcgcggcggcggtggcggtggcgggaggggcgccgtcggttccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgacgggcgggctggagctgaagggcccctgcaagtcctccatcatcatccgtctcgacggcaacctgctcggcaccggcgacctcagcgcgtaccaaaggaactggatcgagatcgagaacgtcgagaacctgtccatcaacggccacggcaccatcgacgggcagggagccctggtgtggagcaagaaccagtgccagcattcttacaattgcaagatcctcccgaatagctgggtgctggatttgtgtccttcgtctctgtctcctcttctcgataatattgataattgattgaaattgcatgcacccgccgccggcgcgatcctcccgaatagcttggtgctggattttgtgacgaacgtccagatccgcggcatcacgctgctcaacagcaagttcttccacctcaacatcttcgagtgcaagaacgtgctgatcgacaaagtgacggtcaaggcccccggcgacagccccaacacggacggcatccacatcggcgactccagcaacgtgaccatcagcagcaccaccatcggcgtcggcgacgactgcatctccatcggccccgggagcaagatgatccgcatccatggcgtcaagtgcggcccaggccacggcatcagcgtcggcagcctggggcgctacaaggacgagaaggacgtggaagacgtgcaggtgacggggtgcacgatcgccggcaccacgaacggcctgcgcatcaagtcgtacgaggactccaagtcgtcgctcaaggccagcaagttcctgtacgagggcatcaccatggacaatgtctcctaccccatcatcatcgaccagaagtactgccccaacaacatctgcgtcaagtccggcgcctccaaggtggccgtcaacgacgtcgtcttcaagaacatccacggcacctccaacacgccggaggccatcacgctcaactgcgccaacaacctgccatgccagggcgtgcagctcgtcaacgtcgacatcaagtacaatggatccggcaacaagaccatggccgtctgcaagaacgccatcggcaagtccatcggcttggcaaaggagctcgcctgcatctgaaccaattgactaacatgcatatattatatatataatcactcttcgtaacctctctctttctcacgtactctcaagtctccaccgaatatataatccgctggtttgtattttctttcttctttggatcatcacaaaaccaaccgatgtaattattattagaccgacgcctcacaatcttggaacttattcattatgctagtgtatattctgtaatcccattccataatgttaatgttgatttgtggtcacgtttcaaaaaaaaaaaaaaaaaaaacagaaaaaaaaaaaatcgattgaagtaagaacataacaaatcgatgaaacgaacggaaggattagttaaacctatattgagcctctacttcaagtgaaagactcctaaacgcttcgtagtaaaacccgcaaggaagagtatttacatgttgtttagactttgtttgggtactctattattgacca

SEQ ID NO: 23186 - DNA, 2553 bp, Zea mays
  misc_feature (1936)..(1936): n is a, c, g, or t
ctcctatgggcgattgggttcctcgaggccggccgggacggcaccgacacgaatctgccatcctctccaacacgaagatggcgttcatcagcaatgtcgcagtgaaggcggcggccgtggccgcgctgctgctggtcgcagcggtgtcgcctgccgcgcgcgcggcggcggtggcggtggcgggaggggcgccgtcggtgccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgacgggcgggctggagctgaagggcccctgcaagtcctccatcatcatccgtctcgacggcaacctgctcggcaccggcgacctcagcgcgtaccaaaggaactggatcgagatcgagaacgtcgagaacctgtccatcaacggccacggcaccatcgacgggcagggagccctggtgtggagcaagaaccagtgccagcattcttacaattgcaagatcctcccgaatagcttggtgctggattttgtgacgaacgtccagatccgcggcatcacgctgctcaacagcaagttcttccacctcaacatcttcgagtgcaagaacgtgctgatcgacaaagtgacggtcaaggcccccggcgacagccccaacacggacggcatccacatcggcgactccagcaacgtgaccatcagcagcaccaccatcggcgtcggcgacgactgcatctccatcggccccgggagcaagatgatccgcatccatggcgtcaagtgcggcccaggccacggcatcagcgtcggcagcctggggcgctacaaggacgagaaggacgtggaagacgtgcaggtgacggggtgcacgatcgccggcaccacgaacggcctgcgcatcaagtcgtacgaggactccaagtcgtcgctcaaggccagcaagttcctgtacgagggcatcaccatggacaatgtctcctaccccatcatcatcgaccagaagtactgccccaacaacatctgcgtcaagtccggcgcctccaaggtggccgtcaacgacgtcgtcttcaagaacatccacggcacctccaacacgccggaggccatcacgctcaactgcgccaacaacctgccatgccagggcgtgcagctcgtcaacgtcgacatcaagtacaatggatccggcaacaagaccatggccgtctgcaagaatgccatcggcaagtccatcggcttggcaaaggagctggcgtgcatttgaaccaattgactaacatgcatatattatgtactaggtttgtgcccgtgcgttgacacggaagttaaaaattagtataaaacaaagatacataacgataaatatcactatgacattcaaaatccatgtggcaaaatatcactgtaaccatctatgattgtgcattgcgacgccacacaaattattcgataaaatattagcaattgggaataaacctagtgcacaaataacccgcggcccaataacttccgttaatagcaattgagaacaaacctggtggcataactaacagcaatgacaggaaagttcaggaggatacaccaacaggccgaactaactatccagtaacattccataacgaccataagaaagcaaaaagacaaataaaatcctactgtccaaagaaaacattgccagttgcagttaaacgtctaaccagggagatcatcaaagaacttcatggactcatcaagcttctcttcatgactgatcttaacgatcgaaccaattgactaacattgcatatattatatactaggtttgtgcacgtgcgttgccacggaagttaaaaattagtataaaacaaagatacagaacgacaaatatctaagaaaacattngttggcaataggcataaggggtatttgaaacacataaaatgtgcatgttgtcaagctcttttacatgatccccttcgccttcttgacttccatgttctacgacctcaagccttgccaggcttggtttctttaagctcctctaagccgccaacagtaggctcttcaaaaaaacaccctctcctaatttgtcttgcttggccatccttctcagcaacaatgattaatacatggcttcataagaaaagaaccaagttcctgccatggacaagtgttctgcaacattgtgcgggatacaaaggggacaccgcacaagtacgcacatcgataggcatctaggtaaaggccaggagcgacagggtgcaagctgtgcagcatgatgtggaataaaggagagatggtgtgcaggggatttcaacccaagtttgagcatctctagctcaaactctatatttgaggcctcaggcaaaaacaaaaggtagcttcaacaggccccgatgaagccatcaaactggagagggaccaacaagcaattgccctcagccccatttcccacaggtcaagtaggggtagagcgatagcatgtaaggaagcatggtaacagtgtagggtcatgactc

SEQ ID NO: 23187 - DNA, 1543 bp, Zea mays
gggcgattgggatcctcgaggccggccggggcgcggcacgcacccgaccgcacgagccatatcgatggcgttcatcagcagtgcggcgatgaaggcagccgtggccgctctgctggtgttcgccgcggtgtcgcctgccgcgcgcgcggtggcggcggaggcggaggcgaaggcgaaggctgtgggaggcgcgccgtcggtgcccgctggctcgctggacatcgcgcagctgggcgccaagggcgacggcaagtcggacagcaccccgatggtgctcaaggcgtggaagcacgcgtgcgaggcgacggggcagcagaagatcgtcatccccaagggcaactacctgacgggcgcgctggacctggtgggcccctgcaagtcctccatcatcatccgcctcgacggcaacctgctcggcaccggcgacctcaacgcgtacaagaggaactggatcgagatccagaacgtcgacaacctgtccatcaacggccacggcaccatcgacgggcagggagccctggtgtggaacaagaacgagtgccagcgttcctacaactgcaaaatcctccccaacagcctggtgctggacttcgtgacgaacgcccagatccgcggcatcacgctgctgaacagcaagttcttccacatgaacatcttcgggagcaagaacgtggtgatcgacaaggtgacgatcaaggcccccggcaacagccccaacacggacggcatccacatcggcgactcgagcaacgtgaccatcagcggcaccaccatcgccgtcggcgacgactgcgtctccatcggccccgggagcaagaccatccgcgtgaagggcgtcaagtgcggcccgggccacggcatcagcgtcggcagcctggggcggtacaaggacgagaaggacgtggaggacgtgaaggtgacggggtgcacgctcgccggcaccaccaacggcctgcgcatcaagtcgtacgaggactccaagtcgtcgctcaaggccaccaagttcctgtaccaggacgtcaccatggacaacgtctcctaccccatcatcatagaccagaagtactgccccaacaacatctgcgtcaagtccggcgcctccaaggtggccgtcaacgacgtcgtcttcaagaacatccacggcacctccaacacgccggaggccatcacgctcaactgcgccaacaacctgccctgccagggcgtgcagctcatcaacgtcgacatcaagtacaacaggtccgacaacaagaccatgtccgtctgcaagaacgccatcggcaagtccattggcatggcgaaggagctcgcctgcgtctgaacctacttgcatccatcactcactcttcgtcacctctctctttctcactctcgccagtctttttttaggcctctggcaatctgcgaactttcttattcattctactagtgtggatctataattccattcaaaatatatacatgatctaaatttcatgccacagaggacattgcaatgtacaagtttacgaaccccccccaactcttaaaaaaatttgcggcc

SEQ ID NO: 23188 - DNA, 2074 bp, Zea mays
ggccgcttttttttttttttttttctgaggttctaatagcaatgaacacatcgtctatagatcaaaatccaaccacagcaattggcagtccatgtgttacatagcgctaaaaatacacagattttatcctcaaacaaagctcaaaatacaagaatctaaacttgcatgataaaaagttaacacgagatgaacactgagtattacagtgaatggctgatatagacacaagaggggcaaggattattagtcaagcattctctgaaccgctaacctaattttctgcagacgtggcttggttaccagcagggaatgctggcagggttgcactattatcttgggccggagcatctgcacttgcatgccgcatgaactcctccggagacatgtgagtgccatggcaagcacatactatctttacctcatttctaccaaacttgtatgtcacacctgatatggttctgccatttggtccggcgccgatggtagaaacccagggaagatccggatatgatccagaccctccaaatttgacatttggtgcgatgcctggccttatggcagaacccataagagagagtcctctatcagcctttttctcatcttcagcatgagcagacgaggaagcacctgcctcctggggcttcttgccatcgtcaacttgcttggttcctgtttgatcagctttgtcttttgcagtaaaagaagacagagcctgaggtggagcaccaaatgcccatgaagagcccgtttcaagtgttggtagctggactgctgggtaaccaaaagcaacttgagaggcactacccattgtctggacagctagtccaccatttgtgggcggcctcaactgcacagtacataccgggtgaaaatttggtgcattagttaagacaggaggtccagaaacttgacctgggacttgatatggcaaagccactacatttgatgcctgcatcgatataagatttccaggtgtcaactttccagagctggactcacttcctgagaaacttggttgtctctttcctttaaaaccatctgcagcagcatcggcggaccttttcctatcagatcctttgttaacaacagagcccttagcactgtcttcacgctgtgcaaccaaccaagaatttgagccttctgcttctgactctgcaacatcctcattttcaccagttgaaccatcatccgtactaatcgagataggtgcattctttgcacctccgtcagagctcttactgaatgcatcaggctggtcactagctgtctgatgtttcttctgaaagttcatctcttcagaaggcaacttgtggttaccagaaactggcttctgctcctcagaattatttccactgttaattggcatccttccatcttgataactggaaagctgaggctgatgactcaccggttcaacagaaccatctaccactggaccggaggaattccctggttgtccccagaagttcccaaattgtggtgcaacagggctgtgcctctgtttactattttgttcatggttatcagcgctcttttgataaaatttcccagaaggagcatcaggagtttgtaaaccacctttgctactgctttcttccacttggggttctgcttttggttctagaggtgcatctctagccttggccttccctgatgacccgcccaaagataggcccaaactaagctcaagcccattatcatcgtccatttccagttcttggtaattgcaatgaaaggtatgtgtagttacagactatttcttcacacatactgaggatgatatagagaacattcttgtcattcagtctgtaactcctggtgggcgctcctcgccggcgaagatcggctaaggactcggcacctggcacggcggcggcgatagcccaattagaatccgatctgggaaaagagaggctcgatccgggaagggggactgtcagcggtgcgagccttgcggcgtcgccgtactgacgagaggaacgcgaggaggaagacgtgaacgaaggaggagggcggaccgtggacggttgggttgacacttgaccaggcccggccggcctcgagggtcccaatg

SEQ ID NO: 23189 - DNA, 1271 bp, Zea mays
gccggcccggccgggcttgaggcttgagcccagtgcccagacggcttgcgcttggcctcgcctcctcttctcgtcgagcggataacagaaccgatgtgcaagctccggccggagcgtcaggataagaaccgcgcggcggcaggcagctcctcctgcgactgcgagcgcccgtccaatggcgtccctctccccttccctccacctcccttgcaattcaagaactggcttccttggaaagacacgtgggattcgtccttgtgttttccctgctggaagagttggatttgtcagaacagtagtggaatgcaaggaatctagaattggaaagcagcccatcgaagttccatcaaatgttactctcacattagaagagcagtttgtcaaagctaagggtccgctgggggagttatctctgagctttccaggtgacttgaagatcgtgaaagaagaatccggtaacctgagagtttataagactgcagagaccaagagggcgaaccagatgcacggacttttcagaacgttgacagacaacatcatcgtcggtgtgtcaaaaggattcgacaagaagcttcagttagtaggtgtcgggtaccgtgcggcggtggagggcaacgatctcgtgatgaacctgggattctcccaccctgttcggatggccattcccgaaggcctggcggtcaaggtggaagagaacacaaggatcatcgtgagcggctacgacaagagcgcgatcggtcagttcgctgctaccataaagaagtggaggccacctgagccatacaaggggaagggtatcagatacatggatgaagttgtcagaaggaaggaaggaaaagctgggaagaagaaatagaagtgtttgttttttgtttgtcctttccatgcttcatttcattttcccgctgtaacggtcctcgtctgctatgaccgaacccgagaaaaaaagtattgttctgtggctgtgctgatcatgccatatttatgtgcaccttgagcatcccagtatcccactgtaatggtttccatgtacaccaagcggagccgtttgacccccgtttggttggtgaagacgcaaaactgctcgatgagcgctaccgccaaaaaaaaaaaaaaaaagcattcaatctctgtgacagtttaacaggttgcgattattcatcgccgaaggccaaagcctcgtttgatcaggatgttctggcacaaagcttcgtttcgattaggatgcgtacgggtctgttccagattttgctagccgggatgatgttcgc

SEQ ID NO: 23190 - DNA, 1003 bp, Zea mays
tccccgggccccgccggggggcgcgagaatagaaccgctgtgtgcaagctccggaccgtcaggataagaaaacagcgcggcggcaggcagctcctcctgcgactgcgagcgcccgtccatggcgtccatctccccttccctccatcacccttgcaattctagaactggcttccttggaaagacacacgggactcgtcctcgtcttttctctgctggaagagttggatttgtcagaacactagtggagtgcaaggaatctagaattggaaagcagcccattgaagtcccaccgaatgttactctcacattagaagagcagtttgtcaaagctaagggcccactaggggaattatctctcagcttcccaggtgatgtgaagattgtgaaagaagaatccggtaacctgagagtttataagactgcagagaccaagcgggcgaaccagatgcacggtcttttcagaacattgacagacaacatcatcgttggtgtgtcgaaaggattcgataagaagcttcagctagtgggcgtcgggtatcgtgcggcggtggagggcaacgatctcgtgatgaacctgggattctcccaccctgttcggatggccattcctgaaggcctggcggtcaaggtggaggagaacacaaggatcaccgtgagcggctatgacaagagcgcgatcggtcagtttgctgctaccataaagaagtggaggccacctgagccatacaagggaaagggtatcagatatatggatgaagttgtccgaaggaaggaaggaaaagccggaaagaagaaatagaaagtgtttttttgccctctccttacttcatttcatttttcccactgtaatgatcttcgtttgctaaggctgaacctaagaaatatattgttctgtgctgatcatggcatatagatgtatactttgagcaccccatatgtttcataatttcattgtttttcaagaaaaaaaaaaaaaaaagggcggcggctcgcgatctagaac

SEQ ID NO: 23191 - DNA, 557 bp, Zea mays
aaggaaagcataggaatagatgtgtattcgacagtgagcaactagaggtccatgaagttccccaggaggttgtagacaagggtagtgtttgggtgagggctgatactgtagctttggggcagctaacacatcagtagacagtagtctcaggactcaggaggttaggctgctcaatcttcacaatggtgatgtgcagctctcttgcatattcgagaaaaaaatcaagaggagtttgaaaagaaaaacaagtatggagctgtttcatcttcacgggggctttgatcgataaggattcaggagtgctggaagaagatttggagcaagagctgtcgctgtccggcgtctggcggtctgggggagaccagtgattttcctacgcacgcctgccaaaagtgggatggagttgaacgcaaaatgtgttgtttgtcattgggtagatggaggaggacacctcgtttatacgcgcggaggaggtgtagtgcgactgtgcgagttgaatttgtaagaaactcagccgcatgcttgcttggagatacttgagatggaacggaaaactc

SEQ ID NO: 23192 - DNA, 564 bp, Zea mays
actatggagtcttttcatgatcaaatcagcctatatttagtccgggaggagttggccactatggaaagcataggaatagatgtgtattcgacagtgagcaactagaggtccatgaagttccccaggaggttgtagacaagggtagtgtttgggtgagggctgatactgtagctttggggcagctaacacatcagtagacagtagtctcaggactcaggaggttaggctgctcaatcttcacaatgggtgcgaatgtaacaaaaaaactaatctgagccatgtatctggatcgttctatcttttaatatagtgtttttaaatatagtgatgtgcagctctcttgcatattcgagaaaaaaatcaagaggagtttgaaaagaaaaacaagtatggagctgtttcatcttcacgggggctttgatcgataaggattcaggagtgctggaagaagatttggagcaagagctgtcgctgtccggcgtctggcggtctgggggagaccagtgattttcctacgcacgcctgccaaaagtgggatggagttgaacgcaaaatgtgttgttt

SEQ ID NO: 23193 - DNA, 657 bp, Zea mays
ggtcgggaggtcatccaacgtagcattcaattcattagagtcaaaaattatctaccatattagcatttataagcacaaaaaaatgaaatatgccttggttcctaactgtttgtatgatctaatactaccaccaacctgctggcatctttacatcaggaaagacatcagttacaaagaataagcaccctaggcagcttaaattacctagagcacaaagaaaattggtctaaggaatagttaaagaaaaaacggtaaattaagcatgcaccactatttgctgttcacgggtttatattgcactcttgtagaaacacttggtcgtaattgacgtgtgctgaccagtacttgcggtatttgggcaatccaatctcaagccaggagcttcaagtttccgttgaagtggatgactgtcgctcgccttatatccttttcgttgacatttgggttgtacccaagccctagttgatgccacgaacgatcaagagggaacgtatgcggttccagaaggttacaaggccagcagggagggtacctagcttccacaatagcctgttttcattcaacttctgccaggtatggtagacctcggtgatgttttgctttctccacccgcccaaatcaaacatgttcatgccatatgcccaaccacaagcatgg

SEQ ID NO: 23194 - DNA, 5570 bp, Zea mays
  misc_feature (2838)..(2838): n is a, c, g, or t
gggacctggcgcccatctagccgaaccctagcgcagggatcagatctgtaccaaccctaatcctagggttcctcacacttgcgggccgagtaatttctcgtcttgtttcggctagggagcggggtggcttctccggccaaggctttcacagttttgtgtttgttgaatgtgtttgcaatggagattgaagaacacacagattcactttcaatagaggaacccatcacaaggctcccaccagatattattgaggggatacttctcaggcttccggtaaactctctaatgaggctgcgtcaagtctgcaagcaatggtggaacatggtcagcgtgccccgctttatcaaagaacatgcctatcatgcacccaagcacctcctcctttacttgcctaagttgaatatatctgcatcgctccatccaaagactgccaaaccatgtcttgcaacaatcattaatgaaaagtggtctccattgacatgggcctcatcgcatatggaccctgatgatcacctctttgcatcatgcaacggtttgctttgcttctacaagacatacacactaaagatatctaaccctgcaacaggtcaatgcctgcatctcttgaaacctgacggcatattgttgtacgacttccactatctatacagctttggatttcacccgattactggagaatacaagctcgtgcactttctccgtgagcctcagcgctacaaatcaggacagcctttccatttcgacaccattcaagtgtacacccttggtgaagacaaatggagagctatcagagctcctataccatgctgcatggtgcatcttggagtagtaaatgtggatggagtgatgtattggctaacagaagataaaggaacaagctgtggcatggcagttgtatcgtttgatctcagggaagaaatgtttgccttgattcatcttccagcattggaggtgaaagagacagcctcttgtgccaccatcaaagttgcttactatatgactgagatagatgacaaagtgtgcgtagtgactatgccataccaaagccatgcaccaaggtggcgccgaaacaacgcagagctttcaggcaggactgacatttgggctcttgaaagtgacaagtggttcctgaaatatagcatccagtcaccatctctatctcggtatgttcctcagccatgcttcatccacagggagaagatcatactgcaggacagtgaaagtaatgtgtggtaccatgatttgcgaggcaagaacgtgcagattgagcatgcagatggggcgaagcttttgcaccttggtgacaacagattctatgagacacagtcctatttctacaaggagacacttgctcccttgagcatttatgccagagcagccattgttcgtgcaccgcctgagcctcttgctcgttcagttgctttacattagtttctgagaggctcttgcactctgaaggtttggcagcaagtactgacgaatattttaatatggagagtgggtaatggggacggcacacgtatggaatgatccctggttttggagagagtggactagccatccatgccaaggggtgtaaatcctatgaaccaagtgaatcattgagatgattgacacatgcataggcaattggaacgaggcactaaagatgtgaatgaatcttagtaagcccagttcatatggagatggatgatgtctcagtcttgcactatggagtcttttcatgatcaaatcagcctatatttagtccgggaggagttggccactatggaaagcataggaatagatgtgtattcgacagtgagcaactagaggtccatgaagttccccaggaggttgtagacaagggtagtgtttgggtgagggctgatactgtagctttggggcagctaacacatcagtagacagtagtctcaggactcaggaggttaggctgctcaatcttcacaatgggtgcgaatgtaacaaaaaaactaatctgagccatgtatctggatcgttctatcttttaatatagtgtttttaaacaaaaaaaaaaaaaaaactcttgcatattcgagaaaaaaatcaagaggagtttgaaaagaaaaacaagtatggagctgtttcatcttcacgggggctttgatcgataaggattcaggagtgctggaagaagatttggagcaagagctgtcgctgtccggcgtctggcggtctgggggagaccagtgattttcctacgcacgcctgccaaaagtgggatggagttgaacgcaaaatgtgttgtttgtcattgggtagatggaggaggacacctcgtttatacgcgcggaggaggtgtagtgcgactgtgcgagttgaatttgtaagaaactcagccgcatgcttgcttggagatacttgagatggaacggaaaactcaggtctcaacagctgtagagaaggtgaggggagggaagcaaacaacctagcttacattgtgatgaaacaaggcagatgagttctggacctctctctctctctctctctctctctctctcaaaaatggtttgccagtatagtctgtgacttaggaagattgtcatgcctgaatcccgatatagaatttctggtgtaattttcacagtaatattgttcacacatgtcgatggttcagctgttttcggtgctactgcattttttttctatttctgaacacaaaatgctacaatgttttttgttaaggtttctggattgagcaacaaaaaagttattccggaatacgtggtggcagtcatgtagggtataatgcagaagctcgcagccaaaacgcaattcgaaatgaacggatgaaattatggaaaaccctgtctgttngctttgaattaaaactagttgtttgaactgctacagctttaatctagagacaaacacagtagaaaccggtatggattaaaatcaaaactatgaatttttgacagggttatatatatacggatctataaaaattatgaagattatcgttgtctttatttttttctctttttgttgtgttacgaggtggaaaaactaaggtataaatttaaatagcccaagaagaaatggaatcttcgtatcttcacgcctcaacttctatccatcaaaagccgaaaggctgcggcgaggccttcgctcttcgggacgacaaattttaatcctcacggtgacaaagatgaaaagccatcctcaatagaaaatttcctattgattgccctcgtgtattcagccaaatgcatattgcggccgaaccggggtgccaatccacccgaatacctttgcagccaaacaagtcggtgtcacgcctcaacttctatccatcaaacagatgaatgatttttttagaagttgaacgcaccagcacaaaatcgtacaatggccgtataacaaggatcccacactgtcgtgcatgaaattaacagacaacagatcacaggatgcagtagtggaaatgggtcgtcgcaaactgtactgtttgcgagggcatctaacatagcattcaattcatacatacagtcaaaaattatctaccatattagcatttataagcacaaaacgggatatgcctttggctactaactgtttgtatgatccaagcctaccgccaacctgctggcacctttacatcaggaaagacatcagttacaaagaataagcactctaggcaatttaaattacctagagcacaaagaattggtctaagaaatcattgaaaagaaaaggatataaaccatgcaccactatttgctgttcaggggtttatgttgcactcccgtagaaacacttgatcgtaattgacgtgtgctgaccagtacttgcggtatttcggcaatccaatctcaagccagggcttcaggtttccgttgtagtggatgacagccgctcgcctgatatccttaacgttgacatttgggttgtacccaagtcctaattgatgccacgaacgatcgagagggaacgtgcggttccaaaaggttacaaggccagcagggagggtacctagcttccacaatagcctgttttcattctgcacaaaggagccgagtgagtgaaccatacaagataaagagtatgacaataaacaatgctcaaatcctacatgagtgtatttttgtatcgaaatatagctgcaaccctactaagataccagcctgcacagctgttcttgaagtgcctgataggaaattctatatgcattaggtcactattgacattttctgctcaagcactcgagtacatactctagtgtggcaacaggaactagcatcacaatttcacatgtaaagctcatactcaccaacttctgccaggtatggtagacctcagtgatgttttgctttctccagtcggacaaatcaaacatgttcatgccatatgcccaaccacaagcatgtggatcaaaattcttggcaataagagggtttgagaagttgaggtacttatcaaacctatggaagtcctgtctacaggtctcgacagcaccattaaccttgcctttgagatctaccaaccaaagcgcacttaggtctcgctgcactacagtatcatcatccagaaataacaccttgttaagtcttgggaagatctcagggagatagaacctcagatggttgagaattgacaagtacttggggttccgaaacttgggattttcatcgtgcctagcatgcccagttctgaagtagtaatcaatcataaaccgcgtttccaactgcttcagcactggactgtagcttgagtttaaccatgtaaactcttcaatgttctgaacctgaatagcggctttaccaaagggattagccaggaaccacattttcattgcagcatagttaagactatctgtcacaatgtggaatacatgttttcctggtttctgcattaaatatagcatcagaaggttagttgtgaaaaatgattaaatcaattagaatattcagcataaaaaaagttgattcttgattcacaatagttaactggatgcctaattggcaacttaatatatttccgaggccaagtggtataccttagcatggacaagagttgagttaacaaccactgcagcagccaatacattgtctgaaaacaaggcataatgatagagtttggggtcttccagcttctccacgtagggaaagtctttattctttgagttagtggaatagtactcatttgtaagccgcagtgtaaggcaatggagacccttgggtagagattttgcagccacttgtgctagatagttagcttgtcttctgtttgatccgagctgctgctctgttcactcaaggacagtatggagcctattcacagcgcttgagcagccatcatgaattttcctgaccttcaccagtgtctgctccattgctctagttttgctgtggacattatgaggtaattgccgatcactccttgcatcgcctagtgctcgttgtatatccctcatccgtgcacggagctcccttgtgaagccatgattacccctagaagcaaacaatccaaggtacatctttgctgtcgtaagctggttcttgatgatgcgaattgtagcatctggcaaagctgtgcggacgcgtggg

SEQ ID NO: 23195 - DNA, 5970 bp, Zea mays
  misc_feature (2398)..(2398): n is a, c, g, or t
  misc_feature (2544)..(2544): n is a, c, g, or t
gctcactagtccccccccccccggcggcgcaggagggatggcaagtccatcacatggacgtcaagacagcgttcttgaacggtgacctccaggaggaggtgtatgtgcagcaagcgcctgggtttgctcaacctggacaggaacacaaggtatatcgactgcacaaagctctttatggtttgcatcaagctccccgtgcatggaataaaaaactggatgaacaactgggtgttctgggatttgtgagatgtccatctgaggctgctatctactgccgtggaagagatgcggagagactggttgtaggtgtctatgttgacgatctggtgatcacaggcactagcagcagcagcatcaggaagttcaagacagaaatgactaagatttttaagatgagtgaccttgggttgctatcttattacctgggtattgaagtgaggcaggaagaagctgggatcaggttgtctcaaggaagctatgcaagaaaaattctggagaagtgtggtctagaggactgcaatccctgcaccgtgccgatgcagcctaagctgaagttgagtagggaaagtgatagttcaaaaatcaatgtgactgaatacagaagcttggtagggagcctgagataccttgtgaatactcgacctgacttggcatattcagttggatatgtgagtagatttatggaggagccccatatggatcatcttgcagctgtgaagcagatcctgaggtacatagcagggacaagagattggggcctgttctattcaaggagaaatggagggagtgatgagctcttgggctatagtgacagtgatatggctggcgacttggatggcagaaagagcacatctgggatccttttctttcttgggaggagtccaatcagctggcaatcaactaagcaaaaggtggtggcgctatcaagttgtgaggcggagtacatcgctgctgctactgctgcatgtcaagctgtttggctggcacgactgcttgctgaaatcaggaactcagagacaagcagacctttgctaagggtggacaacaagtccactatctcgctgattaagaatccagtgcatcacgaccggtcaaagcatattgataccagatttcatttgattcgggagtatgaaaattcagggcaaatcaaggtgaagttcatcagtactgaagaacagctgggggatattctgaccaagccactcggcaaagtcaagttccaggaactctgcaccaagattggcctaagcctagtgtaagtagatgcacaagtcttaggaggagaattgttaaaataatccttgtgcttttagctggtgtttgttttattttctgttagctgaagtcagtcgcacggtctgttgttggctgtgcgtgtagtgggctcggacgtgcgcgttttgttcgcatggagagcgcgtactgcgccatgtatccaccaggcaaggcagttgggatggcagctgcccatgatggttatggggcgtcaggcagggtgttagtgccccgtttctaggaagtagtaggtcacgttctctattgagtcttttatattccagtgaatagagtctgaaaaagctgttcgttgttcacagcaccaaatcagagtgtctccacttgtgtttgtgtgtgtgcgcgattttctctgcaacctgcagggtgagctcgccggcaacaggaggttgtttctccggcgaggtctgacagtggtgttctgggtggccgacatgatagaggaggaggaagtggaggaagaagaatgcatattagggatttaggaaaatagccttggctctggtggcccagagcacggcagaggctctcttggggctgtattccaatatttatagatagaagattacatggatgcatgtgctacaatcacggaggcacagcctaaacaggaatcaaggtttccatctatctatagatagataaccctttctatgtttaacacacacgccatagccctccgcgcgcgtcaagcgcggaggagccagcaagctggtggaggttttaataatagagaatcccctgaactacctacctgatgcatctctttcctctcaaagaagaaagaaagaaagaaagaaagtagcagatcgcttgttgctgcgtttttcaggagctcacgacattaatgcgctgtaatgtagggtgctcctcctggccaaatgggagcaagctatcctcgcatgtttctggtcctcctgctgcttcatggagccagtgctgctttgaatcctccaacagcagggccaaaatggcagactctgagcggtaacctatcaaattccaagtgttgtttttgtacaattgcagtgccgggcgggccatgtggtttggctgctaattaataatgctgatgttgctgtgtcatcctacactacaggtngtccccctcaagtcgtagctcgaggaggattctctggtttgtttcctgactcgagccagatggcctaccagcttgccttgtctaccagcttgcctgacgtcgttctgttatgtgatctacaattctcaagcgaccgcataggcttntgtaagacagggctgacccttgataactcgacgactgtcgctgagatcttccccaagatggacaggacgtacaagctgcagggagaggatgtccatggctggttctccctagatttcaccgcggagcagctggttcagaacgtcacttgtaagcagcgaaactaagaactgaagcacagttttcccctgtcagaattgcactggcttgaccttgacatccttgctttcctctcagtgatccagaacatcttttctcgcccgagcacattcgatgcctcctttgggatgtacacgctcgatgatgtcgttgaactccacccccctcaaatatggctgaatgtagaggtaaaaatgcgctgactccagtcagcctccccctcttctcatctctcaaccatctaaataaactgtgatgcgaccttttaatttgttcacttttgcagtacaattcattctttatggagcacaagttaagcagcgaggactacatactagagctaccaaaagattttagcctcacgtacatctcctcgccggagattgggttcctgaaaagcttgagtgggaagctcaggaacgccaagacaaagctcatcttccggttcctcaacgaagacgtcgaggagccttcgaccaagaaaacgtacggggagctcctgaaagatctgaagtccatcaaggagtttgcagctggcgtccttgtgcccaagacgtacatctggccactgaaaaaggaccagtacttggcgccatccaccagcttggtcaaggatgctcatgccctcggcctggaagtgtacgcctccgggtttgccaacgatatcatcttgagctacaactacagctacgatcccactgccgagtacttgcagttcatcgacaatccagacttctctgtcgacggtgtgatcacggacttcccgcccaccgcatcaggagctgttggtaagaactatccaatgttggaaggaactgaaaggagctgaaaccacactccctcttttgtaaaatctcaagtttttttttctctctcttttttccccccagcttgcttggctcattccaagggcaatcctctaccacctcctggaagtaagctcaagctatgaattgtttctactgttatcaccatcgtcgtcgttgagtacttacttactcccgtgcacaaatctagaggacaccaggccgttgatcatcacccacaacggcgcgagcggcatgttcgccggcagcaccgaccttgcctaccagcaggcgatcaaagatgccgccgacgtcatagactgcacggttcagatgtcaaaagacgggacggccttctgcatgcagtccgctgacatgtccagctccacgaccgcgtccaccgctttcgcgtccaaggcctccactgtccatgagatccagaacaagtccggcatcttctcgttcgacctgtcatggagtgagatcgcgaccttgaagcgtacgtgaagaacatgtgtttgcttaccccccgcacaatgtcatgccagatttgctcatgcactcacaaccgtttatttcttcccccctcttgatctgagcagccgacctcatctccccgtttgctcaggcaggcatgaaaagaaatcctcaagcgaagaatgccggcaagctgatgactgtgccccaattcttggacttggccaaggccagcaacatcaccggtatactgatcgaaatagaggtaatagataagtgagcattcagttagggttgcttctgtcggtctgtctgttcatcgggaaaaaacggttctttaaggtgaataccgtaccggtcaagcgttcttgtgcgtgcctgatgccctgatgcacacatgcagcatgcttcgtacctggccaagagagggatcggcgtggtggaggcggtgtccagcgcgctgaccaaggcgggctacgacaaggagaccaagcagcaggtgttcatccagtccgacgactcgtcggtgctcgcggcgttcaagaagttcacgacgttcaggagggtgctcaacatcgaggccaagatcagcggcgcctccaagccgtcggtggatgacatcaagaagttcgcggacacggtgaggatcaaccggaactcggtggcgcaggtcaccgggtacttcatgacgcacttcaccgacacggtcagtagcctgcaggccgccaacctcaccgtcttcctcggcgtgctcaagaacgagttcatgaacctcggcttcgacttcttcgctgacccgacgatcgagatcgttacctactcgtgggcggtgctggccgacgggctcgtcacggactaccctgccaccgcggcttcgtcccgcgatgcggccttgttggtccccggatcgttacctactcgtgggcggtgctggccgacgggctcgtcacggactaccctgccaccgcggcttcgtacttcagaagtccatgcagtgacatgaacctgaacctgagctactcgatcctgcctgcacaacctggcgctctggtgaacctggcagcccccgggacgctggctccggcgggagcaccggcaccattgctccaaccctccgacgttgtggacccgccgctgcctccagttaaagctgtgatcaccgccgacgcgccggcgccagaggcggctgacaatacctcctcggcgtccagctccaacgcggggaatggcctcttgtgggctgccatcgttgccctcttgtccctgagctttctgcgctgatccttcctcgatgatggcttccattgtactcccgcatgtccccctcccccctacatcctcgaatgtgctgtaacataatgttccttaaatagatataacctgtcattaacctgcacataaatacaggtcagaaaaagtttaccctgcaccaagtcatgattggatagtggatactacagacagccgttttttaaagtgcaaattactatcctaaacctaaggtttggtctatgcccaggtaatgttggttcggtttagttcacacaactatttcaatttgttcaatttatcatttaataagtttttcatttttttctatattcaagttgattcttaaattcaaaaccaatattttaaaatcgtttagttgaacctaacaactactgcccaatcgactagtcacgattagtcgtcgcgagcctaatgcaagaaaagcccatcttaagatgagctcatctttttggtgcttgatgcaagcggatgcataagagctagacctggacgacgaaccttgcagatggcgggcgtcgcttggaactagatcttgcgggtggcggcgacattgtggcagcaccagcggtcgcctagaacttgtggacgacactacagctgtgcggtagtagcgcgatcgcctggaactagatcttgtggttgtgggcggcagagcggcattgcagtagcatgggaggtgcctagaacttgtgg

SEQ ID NO: 23196 - DNA, 2207 bp, Zea mays
atgcaatgctcccatatattccaaaagatcggctggtgcccggggaaagcttttttttttttttttttggtgaacagaatggtaccccatcgtacgtatatataccaacacgagcatacaatggaattcccgatgaactgcggaggaacccgatcatttgctacagaaagtaaaggaaattccttctgaaattggccccgatcgaagatattaataatcggctggccatcttcttcggataatcaggtgtacacgtacgtactactaggtacagtatcttcgtcgtcgtgtgatcttggcgatcgaacaggggcagctagtgcatgctgcatgcgtcagtcgtcctgcagaatcctccgcttgagcatctcggcgcgcaggtcggcggcgtccacctccttcgtgccggtgaccggacggtagtatccggtctcggggtcaggttcccagaacgccgtcttctcctccgtcgtggtggccatggcgctggcgatgtccttggccaccgtgcccagcttcaccgccttctcctccaccttcttcacggactcctccgccaccgtcatcgctgcggagagccccctcctggatacatagctggacgcggcacgcgccatccggtcgtgatgctgacgacgtacgacttgatcggttccctgttctcgatcggtgcccgacggactgcacgtctcgccttcttctcctctcgaccttctaggagaaatgaaggcccacgacgacgacgacgacccaagagcacaccccggccgtataatcctggcccgatcgccctttggaggcaacaaaaaaaaaaggggatagaacctaataatgagcaatggcaatgggaggttgtcagaacttgccggaaggcacgttttgtcacatgcatagcggggtttcttctgtttttaggaaggaaagagcatgatgatggaacatatcccttcaccgccgtctactatttcgtgggaataggccttctccttagatgggccttccagatatcaacggcccaaagagtttttttatttcatttcgtgaaagctgaatgatttagggtttttttgtttgtgtgacaaattaggcagcgaaccaaacagctccttactatttcactggtgtgctctgcgctgaggcaacaccactgaaatattattagagagaataaaaccctcaatcgggaaatcttgagacgagtgaagctcgaacctaggacctgtcgttctgccaccggagaacggaccaaccgagctaaggctctgtgctcatcttataggagaagttaggtcaaagcaactcgatttttaagaaactggtttttatctcttatttagaagaggtcagttttttagtttttaagaaactgtaaatctaatttctataaactaaagcataaactattatatttagaaccacctcaattttcataaactagtttcttgaaaaccggacgctttcaaacaagtccttagttgaacatttagctagctaaaaattgaatcgaggaggatacaaactatctgtgttgggcttcagactcatacatgagccacgcttgtcttccggtccagaaaagtaagagagagagaggtgttgcaacaagggattgaggtccaatgtagctgctatggtttactgctactgccaatttaatcagttcatccttttcagtcatccaaactccaaagagtatccaacaaccccaaagcaatttctttaatcttcatctctcctttggtcctcctaacttgctcagctagctaagcatggcgtttgtggttagagaaggaaccgatagtagaaaaatcttcgtgctcgcacccctcctacgcgcccagggaagaagctacgactgaatcaaactctagtcgatcagcttagagaggagaagggaacaaagcgatcctctgctgattcatgttatacaaaagtttacctatatataatatataaaaaagcgtagcaatatgcggccacctaactagtacacataatatgtttactaagggagggtcaaaagggattttcagtgtcgattaaaacacactattattctatcgactataatgatattaagattatagtgtcaagcatttaagagcatcttcattagttccctaaaaaaaatgctcagatttagcaagttgctaaatatatattacttattacttgcacctttaaatttggtttcatttgtgtaataa

SEQ ID NO: 23197 - DNA, 813 bp, Zea mays
ggccgcgggtttgccccccccccgggtttttttttttttttttttttttttttttttttttttttttttggtgaccagaatggtaccccatcgtacgtatatataccaacacgagcatacaatggaattcctgatgaactgtgcaggaacccgatcatttgctacagaaagtaaaggaaattccttctgaaattggccccgatcgaagatagccaatggttaataatcggctggccatcttcttcggataatcaggtgtacacgtacgtacgtactactaggtacagtatcttcgtcgtggtgtgatcttggcgatcgaacaggggcagctagtgcatgctgcatgcatcagtcgtcctgcagaatcctccgcttgagcatctcggcgcgcaggtcggcggcgtccacctccttcgtgccggtgaccggacggtagtatccggtctcggggtcaggttcccagaacgccgtcttctcctccgtcgtggtggccatggcgctggcgatgtccttggccaccgtgcccagcttcaccgccttctcctccaccttcttcacggactccgccgccaccgtcatcgctgcggagagccccctcctggatacatagctggacgcggcacgcgccatccggtcgtgatgctgacgacgtacgacttgatcggttgatccctgttctcgatcggtgcccgacggactgcacgtctcgccttcttctcctctcgaccttctaggagaaatgaaggcccacgacgacgacccgagagcccccgcccccggccggcctcgatgaacccaatcgcccataggagt

SEQ ID NO: 23198 - DNA, 756 bp, Zea mays
gaccagaatggtaccccatcgtacgtatatataccaacacgagcatacaatggaattcctgatgaactgtgcaggaacccgatcatttgctacagaaagtaaaggaaattccttctgaaattggccccgatcgaagatagccaatggttaataatcggctggccatcttcttcggataatcaggtgtacacgtacgtacgtactactaggtacaggatcttcgtcgtggtgtgatcttggcgatcgaacaggggcagctagtgcatgctgcatgcatcagtcgtcctgcagaatcctccgcttgagcatctcggcgcgcaggtcggcggcgtccacctccttcgtgccggtgaccggacggtagtatccggtctcggggtcaggttcccagaacgccgtcttctcctccgtcgtggtggccatggcgctggcgatgtccttggccacagttcccagcttcaccgccttgtcctccaccttcttcacggactcctccgccaccgtcatcgctgcggagagccccctcctggatacatagctggacgcggcacgcgccatccggtcgtgatgctgacgacgtacgacttggttggttgatgagctcgatctctagcagcctcttgcttccctgttctcgatcggtgcccgacggactgcacgtctcgccttcttctcctctcgaccttctaccttctaggagaaatgaaggcccacgacgacgacgataacgaccgcacgccccaccggacgcgtggg

SEQ ID NO: 23199 - DNA, 3476 bp, Zea mays
actgaaaaactatatcttctatattaaatataatgtggtaattttggatatcgtgacaagaaaatctctttagaaatgactaaatctcctttttttgataaacagaattggcaaactccagaaacatacaaactggataaccggtatattaaaaagaaaagaaaactacattcttactgtcagctacaacaatgaaactgactaaagctatatattgtacattgctcactattgcaggaagcatcaatcctcatttgttggatatttttttctcctaaaaggaactaatggttgacgatgtcaggctattctaccagattgggcaaggcaagcagactttacaaaaggcgcttgaggtaacaccagcatcatatatgccagcgggtaccagcaatcacatgtagcaacttaaatgctacataatcttatgctacatcaccgactgaattaccatggccgcctaccatataccggaaattagtaagcgccaagcagttttgttttggtgctgcgacacaggcgccaaccttctgtttcatatgtagataggtttcacatcattaacaccgaagcttagtccacaagatggacacctcttctgacggctcccaagtggcttctgtatgcactgactgcagaagagatggtagcatttggcaatcacaacctctttctgcctatcatgacaaataccacacttcaatattcccctgtactccttggcctcatggagaagtttctgaagaactgctgaattatctgtcttctctcttagagaattagctttacttgacattagatcaagatcatcctctagtctctttttaccaaacctctcattctctagttctataagcagctcagcaatttccagccgattgctcccagccttcgcttgtagaacatccattgactgcctgagctttggagcttctccatgcataccagacagctttttttgataattgcccaatgaaatagactgctgcattccatcctctgacagtctcctcaaccgctctgaccaacctcttagctggtcctctaggcggatagttttctggttgcacaaatccatcaaagtacttgcatgctgcaaatttctttgcaacgagcgcacctccaaatgcaaagcatcgtgtgactgttttgatttaacaccctccatgaaaagcttggtattatgatcatctctttcaataatctgctgtagcaattgttgattttgtgacattatatcttcataggcatggccaatgctctcgatctccacaacatacgcttcacattcttcatgtttagacttcagtatatcagattgtttcactagatctctcctagaagtttctagcttctgccctaattcagcaatctcagcttcagcagttgccaacctctgctgagagattgcttcagcttcattggctgaaattacacgttgctctaatttactttcactaagagaatatttgagaatgtgaactcgagcccattcagcgagttccctatctctcgattccatcagctgtctggaatcagtggactcatgcttatacaactccacaaatagcttaagctcctgtgtattttccctcagctcacggaccagagattgaagttggcttatatcagatccagcatgggcagatctaaatgacatttcttcaatttcttgttcctttctggtttggatactagaaagtgaatgaacttctgctcgcaaagaatgcaactgtaaggaagcatccttgtgtttggacagttcactttgcacggcacccatttccctcggtagtgcggcctccagagctttaaactctgagataacctggttccgaccaggttctctcgaagcctcttcaagtttcagcacaagcatattcttttcattacacagtttctggacatccttttcaaggtcagcaattctagacacacagtatgcagaaaccttctgggggatttcagccaaatcaactttttgattaaattgcctttctcgccaaacaaaggtatccatctcaacctgtaatttctctaacaacgtttggtgatcatccagttctgcttgtgacttctgaagttggtcattgacaagttgaaaagctttggaagagtgaatgcttttgaaatccgttagtatattctgaaaagttgctaacttgttcaaaatttcaattctctctgtatgcagccttctaatttcctccagacgctttgaaatcaattccattaactccttgtgagtagcttcaagatcttgcagttctgtttgtttatctctcaccttttctgcagtcatatttttgtttcccagcgtaggaaccaggatcggtgttgcttgtttattgtctccctgtgctttcagtactgccagtttttgtttgcttccttccaacttggcaacaacactagtcaactcctctttcagacgtttctgttcagctctgttccaggcactcgaatctctttgtttttgatagttcgctgctaactgcctgtgtttcaagtgaagattatctactgtacgcatcaccacatgaagcttggataacacatcgctggtagcattgtgcaattgcctgctgtgttcattttctggcaacttcatgagagcagcagaaacaaactcgttattcacatgccatggaccacttgatggaaggaatagcttctgcagaatatcaattgttgttgattgttctgaagagacgtcatttcctagttggcaattgggagaacctgaactttctgtggcaccagcctccaaaagtccatttaaaaagtcctttcgtatattgttgttccctgtactgcagcttgaacgtgaagattcatttttgcaaacagaaactatacccagatctgctatgagtcgctcccaataacttttgactagaacaagtgtcttattatgtgtcctttgtttctcttttagatcattaaatctactctcaagagcacagaactcaaatttgtggacttccagttgttccgcaagcttttggtttttgtatttaagcacagcaaaatcaagcggacgagacatagcaatgtttctgggatcttgcacgtggaggcaagttgacattcagctaagcttgaactgcctaagatttgttatgatttgagaaaggaaagtacataagtatgaactcttggagcgccaacaaaatctgtttccaaccagtgcctatcttcaagaggcgtgccacgtgcctccgtttgggcaccacaattcatcatccacctggacagcactgtctaaaccatgtggtcataggatgctgggacgtagagtggcaatatctagagtttgatctggtgtggtgggtgctcgtcgccggcaaagggtccgcccaagacctgggcagctggcgtagggcggcggcggtggtcgccctaggcgaggtaaactgggctacgggagagagaaacagcgaaaacagttgtgaactccagtctccgcccgaatt

SEQ ID NO: 23200 - DNA, 1443 bp, Zea mays
ttttttttttttttttcaattttttccaatcccatctaatccatatgtattgggaataaccgaacaagtccttattgtagcagtacataggctaggatctaaacaggcacggctgcggctgagtaaacgaacccgccgaatcctgacggcacgggcactcgcttccatgcaccgctgctcgcttccatgacccacgcagagtagttgacgccctccgccgccgcgtctgccactgtgccgaacacgagcacggccccgccgttgccaacgccaaccgccttcaagcaggccttcatgcccggcggcccgtcggccacgtccttccacgcgcgcgcggcgccgtcccattcccgcacgccgccgttcccggccccgacggcccacaccgtcccgcgcaccgacgccaggcacgtcccagccgtgtcgccgtcgggtaccacgtcgcactcgctggtccacgcgccgccgccggcgttgtaccactcggcggtatccttgaacgcgccctgggcttcggtcgggtagccgctggcggcgaggacgcggcccggggtcgccacgacgagctgcggctcgtcacgctcctccaacatgtccgggagtgcgcgccaggcgtcggccgcgacgctgtacgcgaaggcggagcggagagcgttcttgcactcgtcgtgtccgccggcgacgtagacgttgccgccgcccccagcgcatccgaagaagctccggctgtccggcatcttcgggccgcgcctccacgtgccggcggggacgtccagcaaccggacgtcgctggtcgggcggagcgtgtccgggtcccagccccccaccactgcgacatgccgcccgtcgcccgcggccgcgcactgcgcgaagagcgggacgggtctccaggtctcggccggcccctccacgcgccgccactcgccggtggtcaggttcgccgccacaagcgcgcattccgacgtcgatcccttcccgtcgccgcgcgcgggcgcggtctggacgaggaacaccatgtcctccgacgccccggcggccatccggcgccgccggaattccgccgacccgacggtcccgcgccatctgcggcacacgcggcgcatgcgccggtgcgaccggctcggcactcgcgccaggcactccatggccacgtcgtcgggcagccccgggatgagctccccttctatcccacctccgtcttcctctgcttccatcgccatggcacgttcttgcctcttgtccttggaaccgtagcggtagcgtgctaccgcagttgcagcgtacacatcctcaacctcttgcttgacggcagtgctgtgctgtgctgtgctgttctgcgttccttgtgatgtgtgatttttcgattaggatgttctaggtaatggtctcgtgcgggtgagattgaggacaaatttggtttaggatttgatgagtgctaggtac

SEQ ID NO: 23201 - DNA, 1987 bp, Zea mays
gggcactcggtccacactccgaccctcagtcctcactcaaccactgcccgccagctagctccagcagctagatcaggtcgaccgtcctcccgatccacccccgtgctccgatccaccacacgagctggctagctagccagagcggcggcacgcaggagatgatgagcgggaggctgaacgcggccacgcccgcctcgccgggggacgacttctcgttcgcgcccatgcagatgccgccgccgccgccctacgtcgggttcgagcacggcggaggcggccagcgcggcgccggagcgatgcaggcgcagcagcaccacctctacgacggcctggacttcgcgtcggcgctccagttccagcaggaggcgtcgtcccactcccaccaccaccagctgctcacgttgccgtccagcctgggcccgatggcgccgccgatgccgatgccgatgccgatgccgctgccgatgcagatgcccgtgcccggcgaccacgtgtaccacccggcgctcgggacgatggtgaagcgcgagggcggcggcgcggacggcgggaggatcggcctcaacctcggccgccgcacctacttctcccccggggacatgctggccgtggaccgcctcctgatgcggtcccgcctcggtggcgtgttcgggctcggcttcggcggcgcgcaccagcaccaggtcccgcgctgccaggccgagggctgcaaggccgacctctccggcgccaagcactaccaccgccgccacaaggtctgcgagtaccacgccaaggcatccgtcgtcgccgccaacggcaagcagcagcgcttctgccagcaatgcagcaggtttcacgtgctgtcggagttcgacgaggtcaagaggagctgcaggaagcggctggccgagcacaaccgccgccgccggaagccggccaccaccgcctcatccaaggacgccgcgtcgccgcctgctgccaacaagaagaccaacggcggctccatcacatgctcttactccactgaaaacaagaacgacgacctgagctgcagggccaagtcgaccatgtcgtccaacacgagcagcgtgatcagctgccagctggaccagcccggcaacaagcaccagctggcgaggccgacgctgactctcggcgcctcgcaggacaacaaggaccaccagcaacagctgagcaccatgctccatgtccaagcggccggcggctaccaccaccaggagcagcagcacttcataacctctctgcaggttcacaacaacggcggtagcggcaacaacaacaacaacaacataatactgtcgtgctcctcggtgtgctccagcttgccgccgcccccgtcggcgcccaacggagaggtctcggaccagaacaccgccgccaacaatggcaacgggaacatgcataacctgttcgaggtggacttcatgtagaccgtggagatcgatccaaagcaagctaagcaagcacacaggagtacgttcttctggcaagctaggtgtccttggtgtgtaaaaggaataggagagagagagcaaaaaaggtatgaagtgcgcggggaaacaaggagagaaagagagagagaagggtgcaagtgcaaggattccacccatccatcacactccatatcagtagcagcaagctgcagcctgcaggtctagcaaaggtagctacgtaccctcttgtttgcaaggttccatggctatagcaaagccatgcatccgggccggatggatggaaggcccccattacagtggctagctgcctctctcaaccagtctacctcgatctactgcgctgctgctgcagctgcatccatcgcaagcctttctacctttccatttcaagcgggggggaatagttaacagtggctgtgtttcacttgtttttctccactagtttttcttttcttgttgcaaggtgcacgagggtgcagtgtgtgtcgtactaataccaaactacctgttcaaaaaaaaaaaaaaaaaaa

SEQ ID NO: 23202 - DNA, 2401 bp, Zea mays
tgcagccgagagcagctacagcccgaacagctgggcctgctcgcctgcctgcctactgcctagcttcgtgtgttttcgctgcgcgccggtcgaagcagaaaaaagcctaggcacccaaccctcccggccacccgggctcgcgcgccgtcgtactcgtactcgtaccccagccccatcacctttctgatctgatccgcagtctggctggctgggggcagtaacatgacaaaaacccgcctgccctgcccatgccatgcatcaaggattcaccatgtggccacgtacgacgaatagctagctcgtagtactactagcagcacagcacgcaacatttgcgccggctgcatgcatgcagcgcatgcagagggttttcaccaaaaggatcgagatagagagagagagtgcgtttcactagaagggactgagagagaaagatagatggagaaagggtgcacaacatacgccgcactcctactctctgttacagtaccagtagtatatgccggtagatctcctgccggtggctttaccaaaatgaaataaataaaaaaaattcatcatgcggcgcaccaacaagtgagtaacgcctagggctctctgtctctatctccccttcaatgcagagagtaatgtcgtctctttccctgtctttcccactgccttcaactcagccctttttaaccacccacaaaggccaccactgcttcacactcacacgcacacgtatagctcgatcgctctctgtgtccgctcctcctgcctcctgcacacacatacactcagagagcatagtagcagtagccagtaggatgatgatgaacaccaacgcgatgtcgccgacagcaagtaccgacgccgacttctcgttcggccccttgcagccctacgtcggcttcgacgtcgccggcatgggcatgcccagcgtcgtcgtcgagaggtcgtcgtcgctactgcagcacaacaccagcagcagcagccacaacaacaacctagggctatacgacagtttcgacttcgcggccgccgcagggttaccgttccaagaatctggtctcctgcccccggcgagcctgccgctggcgccgtcgccgcaaagcatggcggccatggcaatgccaccgtcgtcgctgctgctgacgctcccaggcgtgcctgcggcggcggatgtcgtctataacccctttggtggcggcggcgcgggagggttcctgaagcgggaggacggcggccccctcgtggacgctgctggaggcggcgggaggatcgggctgaacctcgggcgccgcacctacttctcccccgcggacgtactcgccgtggaccggctgctgacgcggtcgcggctggcgggtggcggcgtgggcgtgggcctgggtatgggcctcggcatgggcgtgctggggctcggcgccgcccaccaccagcagccgccgccgcggtgccaggccgagggctgcaaggccgacctctccgccgccaagcactaccaccgccgccacaaggtctgcgagtaccacgccaaggccagcgccgtcgccgccgccggcaagcagcagcgtttctgccagcagtgcagcaggtttcatgtgcttgctgagtttgatgaggccaagaggagctgccggaagcggctcaccgagcacaaccgccgccgccggaagccgagcagcgcacaggacgaggactcgtcaccgccaccacccaagaaactggatacttgcataactaatactgcctcttacaatgatgatctcaagacaggcgcgagcaacacggcagctgcggccatctcgccgaacggcagcggcgtcagctgcctagacgtcatggacaacggccagacgagcagcgcagcggcgccgacggctctgtctttggccgccccgccgccgccgccgctgcacgagaaggacggcagtctcgactcgatgctgatgcagcgggtcctgcagggccgacgggaggacgacgacgacgaacagcgtcgccacttcatcacctcgcttgtgatgcagacgacccagcagcagcacagcggcggcggcggcgccggcaacatcttgtcgtgctcgtcggtatcagatcagcacaacggcggcggctgcaacggtttctttgaggtggacttcatctagtgtataatcagatgcatgacgtgaggaaagcaagcaaaaacaaagctgggttggtttcactgtagagcggctagtagccttttcttttttactgttgttcttagtacgacttgagctagctagctagtggttggacttcttttaccagatggaaatgcttgtgtacgtagtatgtgtattcctttttcctattgcgaaaaatgtaaattattattacgtgtatgtgtctgagttatactacttattaagcaaaaaaaaaaaaaaaa

SEQ ID NO: 23203 - DNA, 845 bp, Zea mays
tttttttttttttttctttttttttttttttttttttttttttttttttttcggcatgtgagcagacaaaatcaaatgattacttttatgtattgtctcatggcattggtgtcttaactttgttacttctcacatttatactgtaattatcagtgctatattcccgctacttcaccttttgcatagccctgtttaagatttgttgaatgcaatttttgtggagctgttggagcaggagatatccagagccacctttcggtgagtgctctgcggatggaggtcgattgctggcagcggatgaccggttggaggagtttcgagctcgagcgcttggagatttgagctggcggagcgatgttcgaggacgccgcgcacagccgtcgtcgcgctgggtcgatctggcctagtcgcgctggccgcagcaccggaggtagccacgacgctcccgaaatgatgaccagcccgtagggaaagcccggtcgccacagcacaccaaatttcttggaaccctttcggtgagtgctctgcggatggaggtcgattgctggcagcggatgaccggttggaggagtttcgagctcgagcgcttggagatttgagctggcggagcgatgttcgaggacgccgcgcacagccgtcgtcgcgctgggtcgatctggcctagtcgcgctggccgcagcaccggaggtagccagacgctcccgaaatgatgaccagcccgtagggaaagcccggtcgccacagcacaccaaatttcttggaaccaggttgtttgggctgatttcagtataggagatgggcccaagattgatattggctgaaaacatggccgataggtgtcatcg

SEQ ID NO: 23204 - DNA, 673 bp, Zea mays
taggggccttttttttttttttttttgagatcaaaagcgaatgcctgcatgagtctcgatcaccaggctacgctgaagaatcacaccaaacaaaacaagtgtcacatagttatcattacataaccgttttagtcaatgaaaaaacattaaaaaagggggggggggggtcagagcatcattcgaagatctagtttattaagtcgtatctcagttcacatgaacaaaaagaaaaacacatcccattttttctttttccaatcaactcttcctgtttcctccaggcacacaagaactcgaagcacaattgatgtcctggttcctaaaggcacccacagggggcgttatactccgtcagtttcagcttgggtgagccagccgaggccttggccaggagcggcgagcatggacgtcatgcgtgcaccggcggtggcggtgtgcagaggcagaagcgactccacgcagaagctcgactcgacgggcgaccggaggaggcgaggaggagcagccaatgcgcgccgaagagacggacgcgtggtagccgaggatctcgcgagggcgggggcggcgcgaagaagggaggccgacgagcggagcagcgaccttacggcggccatcgggcgtggtggggcggcggggggagatggggttttccggtctccgcgacccggccggc

SEQ ID NO: 23205 - DNA, 1143 bp, Zea mays
actcctacccgcccgtggggttccttgggcccggcggggaaagggcgaagcaatgtttcgatacctcgctgctctgattctcgtcgtcgccttggcgacgtgtacaaacaagtctgttgatgcccgcgtggtccaccccatcgtcaccctcgaggccgatggctcatctcccacctctggcgatggtcgtcgcctgatcagctccaccaaccaagatgaacttggagcgttatgccaacagatgcactacaagacgttgtgctccacgatgacgacactgcctggggtgactacgccagagcaactcttagatgcatccctgcggattacagcggtgaaggcagcgatggcggagatgaagctagacaatgcaataaaatcaggcagtgctcagggtaacccgatgatgtcgtcgctaaagacatgcaaggagagctacgcgtcgctggtagactccatcaataccacgcggaacacgctcaaaagcggcggcagcaatgcagacctcatgtcggagctatccgcggcggacaccttcgccaccgactgcggggacaccttcgacgagcgaccagacctcaactcacccatacccggtgcgcagcgccacgtcaaccgcctcatcagcaactgccttgacctagcagccaccattaaggaacaaccctagatgcctatgatgtggacactgaaaaaatttatctacaactggctgaagaagaaacagtcccacaacctacttcaaatttacgacatgtctgcacataccaatgattgtgtggcttatcgattttggctctttttatatcctttgatattgctggggcataaaaagcaatcatcggttattagtaggtggatacgtgtcgcaaatccaaagaaggttgtatgactgtttctctgtagccaactatagaactagaccgcttgcatgcatgtattgacgaggacacacagtgttagcatggtacattatatacatctagtgtacattgctctgttgtccgtttgccttggggagcttgagcgcgtctataataggcttatgtgtgtatgtgttgttcgtttttatgtggtcattgtgctctaacattttatcgaataatttgtgtcgtcgcaatcgcaacgcacatgtgccagcca

SEQ ID NO: 23206 - DNA, 912 bp, Zea mays
  misc_feature (849)..(849): n is a, c, g, or t
gcgtatcgactcctatgggcgattgggtccctcgaggccggccgggatccatttatagccttttcactcgctcggcccgcttatttacctgtccgtcattcccaattccaaaggaccaagcaatgtttcgatacctcgctgctctgattctcgtcgtcgccttggcgacgtgtacaaacaagtctgttgatgcccgcgtggtccaccccatcgtcaccctcgaggccgacggctcatctcccacctctggcgatggtcgtcgcctgatcagctccaccaaccaagatgaacttggagcgttatgccaacagatgcactacaagacgttgtgctccacgatgacgacactgcctggggtgactacgccagagcaactcttagatgcatccctgcggattacagcggtgaaggcagcgatggcggagatgaagctagacaatgcaataaaagcaggcagtgctcagggtaacccgatgatgtcgtcgctaaagacatgcaaggagagctacgcgtcgctggtagactccatcaataccacgcggaacacgctcaaaagcggcggcagcaatgcagacctcatgtcggagctatccgcggcggacaccttcgccaccgactgcggggacaccttcgacgagcgaccagacctcaactcacccatacccggtgcgcagcgccacgtcaaccgcctcatcagcaactgccttgacctagcagccaccattaaggaacaaccctagatgcctatgatgtggacactgaaaaaatttatctacaactggctgaagaagaacagtcccacaacctacttcaaatttacgacatgtctgcacataccaataattgtgntggcttatcgattttggctctttttatatcctttgatattgctggggcataaaaagcaatcat

SEQ ID NO: 23207 - DNA, 1746 bp, Zea mays
  misc_feature (3)..(3): n is a, c, g, or t
  misc_feature (27)..(27): n is a, c, g, or t
  misc_feature (49)..(49): n is a, c, g, or t
  misc_feature (1382)..(1382): n is a, c, g, or t
  misc_feature (1473)..(1473): n is a, c, g, or t
ccnggccgggagtcaataagccgaccntctttcgcaacaacacaatttnttgggacatgaatgacatccatttatagtcttttcatgccatcccggccggggtttatctcaaggtcattcgaaattcgaaaggaccaagcaatgttccgatacattgttgctctgattcttgtcgccattttggtggtgtctatgaacaagtctgttgatgcccgcatggtccaccccattgtcacccctgaggccatcagcccctctcccgcctccaacgatggtcgtcgcctgatcggcaccaccggccacgatgaactcgtagcgttatgccaacagatgcactacaagacattatgcaccacgatgacgacgctgcccggggtgatgacaccagagcagttattggacgcatccctgcggattacagcggtgaaggcggcgatgacggagatgaagctagaccgggcaataaagtcgagcggtgcccagggtaacgcgatgatgtcatcgcttgagacgtgcaaggagagctatgcgtcgctggtggactccatcaataccacgcggaacacgctcaagagcggcggtagcaatgcagacatcatgtcggagctatccgcggcggccaccttctccactgactgcgaggacaccttcgatgagcggccagagctcaaatcgcccatacccggggcgcagcgccacgttagccgcctcgtcagcaactgcctcgacctagcagccaccatcatggaccagccctagacgcctatgcgtgcattgacgcggtgcaaacatggtacatacatgtatgtttaattaatttatgtttatctttgctgggttcattgctctattgtacatttgccattgggggtctacaatgcgtttataataggcttatattttatgtttactataatcactttcaacatgtttggtgtttttaggtctaaaatgcaattgtagctgaagatcatctaggtatgtatagttaacccagagagaataggatttttataagaattaaagtatcttcaagattatttcttacttcattctctaaattattatttaaatagtcatttaaataaaaattgatctctatatttttgcttttgaatagattttatatggctcctctttggttggacttttcaacatgctttggtttctaaaaagtcaaaagccaataaaaggaatttgttctcactcaaagccagagccaaaatccatttttgagtggttcaaatttcataacagcctcctcctgctttcacatgatgtggagttaggaaagtctacaaaatcagtcacctatcactagttatgaaagataccaattcattttttccaccgagcgactcaacttcatcctccatcttatnaatgagaacatcactagcgggaggtccatgcatggacctgccccagcatgggcataaccccaatgcatagccctgccctggtataggtgtngctcaggtagtggccctggtgcggtcgtggcacatggcccttacctaacctcacaaccctatgcaacccctcgggcgagtagctttgacacaagtgatagaatccagatctacagaggatacaaatagaccataaacattcatttcaatgtcatgaaataactagagcaatgttaattagtataagaggtgatgtagaatcagataccttctctagctctatttcacaacaagcaatccccttaaataattctagtaactctcaagcacaagg

SEQ ID NO: 23208 - DNA, 1056 bp, Zea mays
cgatgtgtagtaataacataacaagtccattatcatcgaccaacattacaatgttcaagcatgacatactggaaaatatcaagtttgcaatcttcttggaacaagaacaaaaatatggttcagaaacatgcagtttttctcgaaaacaaataacatgacttactcaaccactaacacaaattaacttcgttcactcctcacttgcttgacgacgagtttccaataacccttgccaatatctcttgttgcttagcctcgtagtattgtcgaagtagggggttacatttactcagatccatgctcaatatcatgacctcctcttccttgtcctccttcaatttctgccgatccatcctaagtttctccaggtttagcttcttcctctccaagatgagtttttgcctctcgttttttttcatagactccaacttcctctcctcaattgaagctactaatttgaacacagacaaccgttccaaagatatttcacccatccgcctgaggtactcagacctgaggtactcagaaacagtggacgatgtgtcaacagacctttgcttctttgccttttccttggacgaatcatgacctagcggcctcttcgaagtaaagcttgatggaacagaatcttcagcatctaagtctacagtatttggttggataccgattgggttgggtggtggattttggtgactcatgtgttgctccatccattttggttgatccttcaatattgctgcagaagggtcactctcacagaaggcctcaaggcaaatgttgcatgcatcctgaatgccaccctccacaaaggctgcagcagatgtcaaactctccatcttagctttctcatcagtttcagatgccattgcaatggaatcacagcccaagcaccgccggcgattcgcagcaaccccgacccggctcggattcgatgcgtgaggcgtggtgggggtgggggcacaaaaccctagccccctcactctcctcttgcgttctgtgattgcggaggaaaggcagagaagacagaagctcgagccgaattccgagcggccggac

SEQ ID NO: 23209 - DNA, 1577 bp, Zea mays
  misc_feature (84)..(89): n is a, c, g, or t
  misc_feature (111)..(118): n is a, c, g, or t
  misc_feature (172)..(176): n is a, c, g, or t
  misc_feature (380)..(384): n is a, c, g, or t
cccttttatttgtaactgatttgcgcaccacgaagatgccatatccgttatttgtaccggtaaacatcttttctcacaagttcnnnnnnacagaagacataaacagaagannnnnnnngagatcggacttcccctaagccacacgcatgcagtttatgcagtgcttgagatnnnnntggcagcatcgtgttactgcacttctgctctaccgccaggttgtcaacttggaactggagcatcgtgttactgcacttctgctccacctgttagttttagtttgatccatccgaggctctaagatgaggacgaagctggggaactacctttcaagatgaagaataggcacgtgtaagccttctttctcggacccttacatgatnnnnncagtatctgaatatagacacagcacctgttaaaaaaaaacaacctaggactagatacagtagtgctatttccagaagaaacgacagcgtcctgttcaccttcctcgtcggttagcatcgaccaacattacaatgttcaagcatgacatactgaaaaatgtcaagtttgcaaacaacttggaacaacaagaacaaaaatatggttcagaaacatgcagtttttctcgaaaacaaataacatgacttactcaaccactaacaaaaattaacttcgttcactcctcacttgcttgacgacgagtttccaataacccttgccaatatctcctgttgcttagcctcgtagcattgtcgaagtagggggttacatttactcagatccatgctcaatatcatgacctcctcttccttgtcctccttcaatttctgccgatccatcctaagtttctccaggtttagcttcttcctctccaagatgagtttttgcctctcgtttttgttcatagactccaacttcctctcctcaattgaagctactaatttgaacacagacaaccgttccaaagatatttcacccatccgcctgaggtactcagaaaaagtggacgatgtgtcaacagacctttgcttctttgccttttccttggacgaatcatgacctagcggcctcttcgaagtaaagcttgatggaacagagtcttcagcatctaagtctacagtatttgattggataccgattgggttgggtggtggattttggtgactcatgtgttgatccatccattttggttgatctgcagaagggtcactctcacagaaggcctcaaggcaaatgttgcatgcatcctgaatgccaccctccacaaaggctgcagcagatgtcaaactctccatcttagctttctcatcagtttcagatgccattgcaatggaatcacagcccaagcaccgccggcgattcgcagcaaccccgacccggctcggattcgatgcgtgaggcgtggggggcacaaaaccctagccctctctctcccccctcactctctctctctctcctcttgcgctctgtgattgcggaggaaaggcagagaagagacgaaaaggggtgtgagccgagcgaggcaagcacctcgtcttcactcccccgcccggccgcgacctcgaggtgagtccatcccccccccctctttcttt

SEQ ID NO: 23210 - DNA, 679 bp, Zea mays
ttttttttttagaactctttcttggagttgctcttgcaatgtggaaaatagggattacatagtacttggtacagacctcaagcatcataaaccaacacatgccagactccttacaaccaaagggaccaccagttcacaactaaaaagtttgcaaataggcatgttccagttcgcaaaaaaagtcggtcatttcattccaatcttccttctgtgacagccactcaaccaagcagcacagattatgtactgaacaaccaagcaacacgatccatagggtcagcaggtcaggccgccaccactttctgaaattctgtcacctactacggttgctcctgcgtggagatggcaaggccttcttttcctcgacgtattcggtgaatctaacccttggtttagggattctgcagtgggaatttagatccacgaacatctgctggcaactgtttctggccacctcctccacccgagaagcatgtctgcaagctgcttgcgttgattcttggccagcaggcttctccagcagactcctaagactggccacctccttcagtaagttagttattatatcatctgcttctttcatctgcttcctagagaactcaaaagctcggtcagcaggtagtcggaatgtggccgtgctagccagcgaaccgacccctgatcctggatctctgagagt

SEQ ID NO: 23211 - DNA, 566 bp, Zea mays
ggaagaccggagggagtatttcattaggaaataggacatgaaagttcattacaagacataggactgcaaaaacaccacaatatgccaacaaactacccgtactattggcaacacacttgacatcataccaaaccaggcactctcacaagcacagagaggcacaacctactggaagaacgcacagcgcacatataccacttattacaacatctctccagacaggaaacgagaaaaaccacacacaacacaaaggagtacaagcatcattacaaccataaagcaaatgcgaagcagccaaaaggaacaccaccaggtagaccagacaagcgaaaccagaacacacgaatcaaccggcaatacgtctagccactggtctccatccataagcgcgactcatcgcctcacttgtcgtccttctgatgaacttccttcctagctccaccgtccttctttccatctctgagccagcttcaacgggccgacgcgatgatggaagcttgtcgtgtgaggacgagtaagaagagcatccatggcagttgacatcgagaaagcaagggaaggggccc

SEQ ID NO: 23212 - DNA, 1694 bp, Zea mays
ttttttttttttttttgcagtcaagtaaatatatgttgaattgatgatttagtaatgtatacaagcctacaatgtcagagtatcagtaatacggattactgtgctactgatgtatcagtggcaatcaggctggctttattaggttgttagaaagaacatagaagaaatcagagctgggatctccaaataacatctctgtaataatacaacaacaatgtactccctctttttttgtcgtgttttagttcaaaaataaacttgcagacgacaaatattcgaaaacggcggtgataataatttagtgcttcaggcgatattcaggtgaggcagatacagtcactttgcaggacgattagctggaagatccgatgctcggaaagacttctcgagcagctgaggaacagttagtttcagctcaaaggtcaatttctgaagcacgtaagagagggttgtcacatcctgcatggcacgatgcgcgctccctgtgagtgggattttgtagcgttccctcaggaacttcaatgacacagaactgagttttgacccattagaatcgaccaattgttttgcgataggaagagtatccacaaagagccaatcaccaggcatttctactttacaccgtcgaaactcaaacatgagaaagggtacgtcaaaggaacgcccattatgagcaacccagagaactggtttaccgtccatttgacgactccacacatattgtagcagaatgggaataatctctccaaatcttggaacatcaggcctgcagagcatactgttgttaataccatgaacatatgtatttttcacatctttctcaggatttatgagtgtctgaaaagtgctattctttccccccataagatcacggacagcaaactcaataattctgtcatcacgacgtgagaagccagtagtttcaatatcaaaaacaaggatagttgcaggccattcggtcttgacttcagaaaactcttcctcaacattgtagcaatgaagtgatttaagctgctcaagctctgactgcttgaacacttcaattgatgattcaaccgatttactgtgcaaatggcggccattgctaaatgactgcttacttccttttcttgtgcttcttgctagcactgttgtactaggaggcctactttgatgtattctgcttgagaggaaagtttcatatatcaatctgctatggtatttaagccatctgacactgcaagtgtctcctatagagttccttagtagatggaacttcgcacagcaaatagaagacaaagacattgcagaaactaatgaatggggttatggggcatcaaaggtattgctactcctattcttcagtagctagttttcactgaatattggataacccttcaatgctaatcctatgaaccggatgaggcaaccaagatccaaggcggcgaaagagcccaaagaaaccggaaaataaagcggcagagaacgcactaatacaggatggggtggggaagaagcaagggacgctacggaagggacattccttgcggggatgccaagacgagcgagggagggacgaccggacgagggggcgagcgagcgagggaggcgtggaggagaggagcgacgggagtggcgagcggagagggaggaggagtgggggttcgggaaccggagaccgggcggggggcggggcgggcgcccgttgttggcgg

SEQ ID NO: 23213 - DNA, 1162 bp, Zea mays
gaggcctactttgatgtatctgctgagagggaaagtttcatatatcaatctgctatggtatttaagccatctgacactgcaagtgtctcctatagagttccttagtagatggaccttcgcacagcaaatagaagacaagaccattgcagaaactaatgaatggggcatcaaaggtattgctactcctattcttcagtagctagttttcactgaatattggataacccttcaatgctactccagcgagacgtcgttcaccgacgagcaacgacggcggcccgggcgggacggcgggtggcggacacgcacgcgtggagctttgctgcggcgccgcgccacgcgcagacctggggaaggccgacgagaggctagttctctggtgagctgctacgggcgggcggggccgaaccggcgaggggcagttcgcgccaccgtggacagcctgtcggggccgaagtggacgagacacggggcgaccgccgcgctgctacttaggccacaccgcctcagcttaagggccgtcggatgattcggccggtgcggcaggcgggcgggcgccgcgcggcagtggccgaggggcgaggttgagtggatgacggaggcggcgggcgcaggcaggtgcgccacgggctgcggctggtcggtctgtgtgcgggagcgcgatgcgaagacactagggcttttttttactttgatttctggaccatactgggccctccgcccctgtgttcgacgaaatgctccaccgaaaaacaaccaaagagtgcatcaatggagtcccagcaaaggttaaagaaggtacctacgaaccggacgaggcaaccaagatccaaggcggcgaaagagcccaaagaaaccggaaaataaagcggcagagaacgcactaatacaggatggggtggggaagaagcaagggacgctacggaagggacattccttgcggggataatacaggatggggtggggaagaagcaagggacgctacggaagggacattcccggcgggcatgccaagacgagcgagggagggacgaccggacgagggggcgagcgagcgagggaggcgtggaggagaggagcgacgggagtggcgagcggagagggaggaggagtgggggttcgggaacacggagaccgggcggggggcggggcgggcgcccgt

SEQ ID NO: 23214 - DNA, 1072 bp, Zea mays
tttttttggacagcagatttaacacattctgtgtacctaatccatttttttttttttttttaagcttcaaactttggggcctttcaacaccaaggcctccccccctctaaatgcaaacagggagctacaactctatcctcgttacacgtggacatggacgacaaaatccagttctccaatcaccctgaggtcaatcaaaacaacaaaactagctagctagctagatctatctttcaccagcaccatctgttcctcttgagctgtagaactgaaacaacgggactatacccctaaaagtatctccacccttttgctttcattttttttcccttacatttttccttctctcgtttttcatctctttttacttctgccttctctcttgtcgcaagaaagcacaggctgcgttgcagtggtggtgcttaatggcaactagagaaaagggaaggaaaaaaaaaaacaggatgtacatcatggcgtatgcttctgccaaagaactcggcgccattacacgatgtcccattcgtgtcgggagcacaccactcatcattatcctgctgcctctcatacacacggaatcgacatcaactggacagtggcgggaagtcaccactgtccttgagacggtatggctgaacattcctcattccattggaacccattccagtatttttggccacagacatggggctcacaggcccagaagcttgattgttggagacagaacctgatctgttggcatggtctttagaggcaacttccgaaggcaatgcccccaaggtcccaaactcaagtttactgtcttgcgggagcataaaaccattgccatgaaaattatcctttcggacatgggaagatggggaatgcattggtacattcaaaggatcccttggagactgggaagatggggatgatattggtatattcattggagatgggattccatgaccatttgcattaggagcatatgtctgcagtggcagctcatgccgcaattcctccaaaggtatcatatctacggccatatccggtcgggtgtggtggtgaaacttgtgataattacctcgtgcaa

SEQ ID NO: 23215 - DNA, 957 bp, Zea mays
cttacagggcagtgcaagtttttttttcccctttttacctgaaacaatggttacagattatgcataaacggaaacacacagcaagcgcgcattttcgtttggacagcagatttaacacattctgtgtacctaatccattttcaagcagctaaagtagcttcaaactttggggcctttcaacaccaaggcctccccccctctaaatgcaaacagggagctacaactctatcctcgttacacgtggacatggacgacaaaatccagttctccaatcaccctgaggtcaatcaaaacaacaaaactagctagctagctagatctatctttcaccagcaccatctgttcctcttgagctgtagaactgaaacaacgggactatacccctaaaagtatctccacccttttgctttcatttttttcccttacatttttccttctctcgtttttcatctctttttacttctgccttctctcttgtcgcaagaaagcacaggctgcgttgcagtggtggtgcttaatggcaactagagaaaagggaaggaaaaaaaaaaacaggatgtacatcatggcgtatgcttctgccaaagaactcggcgccattacacgatgtcccattcgtgtcggaagcacaccactcatcattatcctgctgcctctcatacacacggaatcgacatcaactggacagtggcgggaagtcaccactgtccttgagacggtatggctgaacattcctgcaaattgtacagtgtgggttcagccattgtaaactctggagattgagtggaaaatcttcaaggtgaaactcaaaaaggccgcagtttcaagctgagctagcatgctttcaacagaggaaacaggcatggttagagttaaccagaagtatgtctttattccaactagcacaacagccataggtttgacaactgtgcctatatacccccccaaacatggtct

SEQ ID NO: 23216 - DNA, 1096 bp, Zea mays
ttttttttttttttttcttttttttttttttttttttttttttttttttttttttttttgactgccaaatatatagaccagtgcacatgatagtcgttgcgggattcatgtccatcctccaacagtccaacgccaacaaaatatatgtacatgtaccctgtcgagctgcccgtggaaatagcaagccaacaaaacgttcttgtactctgcaccgacgatcgtcctaggcaacaacaggccggccctattcattcatccgccaacactcggcccacgtaaaacgatgcaatctgctctctggccactgaaaagcttgaacatcattatcattggcaaaccaataacactagatgctctctgttacaactgcaacgaaaggaaggtgcaccgacagtatccaaagttctacatctacgactacaacccaacagagcaagccttcaaggaagcttcagatgatacgcactcttcagctactgaatcaaattggcttacaccttgtcttgcaggtaagcagagtaaaagacgcccaaggcaccaagagaaagggctagaagaaggccagatggcaccagcttccggctgttatacaacctgataccaaacacgcaggcaaatagaaaggcagatccaaatccaacagcatcacctgctgccatcgtctcaggcgactgcatcagataataggcagcgcccatgagcgcagctccagccagacccccgtagatggagcctttactccccgacctcgcatatgcgaaggcgccgccgcccaggaggaggacgccgtaggtggctgaggcggccggggcaatctcggacaccgcgtcgcagcggaacagagcgtgacggcgggggtggaggcgcagacggataacggggaggcgaggcggcggccggaacgaaaggagaggggcggagaaggcggacgaggtggtcatcagcgccagcatgcggattccggtggtcgctgtcagtggcctgagtggctgagtcagggacgaccggacgagtggtgtgtggtgcggtggtgcctggcggtctgtctatcgctatccggtatcccacggtagtcttccggccgcgccaacacaat

SEQ ID NO: 23217 - DNA, 2747 bp, Zea mays
ggcaagaaaatattttctgcaatatttttttttttttttttgcctctggaaatgctaatctttttattttaaaggacaacacaaccatacatcggtacatatgatgatatgacaatactaacagaagtatatacctatgaattgtgtaaacctgagattctcaactgagctccttttggatacaataagtcaataactagtacctcctcaataccagcaacttaaagtggtataggagccacaaagaccaatgtaacaggccaacaagcgcttaggaattctcctccacactgactgaagtcttcctagccttcttgtcactgacatataattgatatccatatgaaacgaatccccagatggccatcaacatagcaataatcttcactccatccatcttgtcgtggaagaaaatcacagcaaaaatcggaatgatgggtagagccagtgtgcttatcacatttgaaaagagtgatgacacaacaaagatcaaacccaccactcctacggaagctatctgccaagatacagcagtccatagaagtgtcatcacataggacactctccctgagctgaaggcatgcatctctccctctaaagtcttccactcgccgcttgcaaataaaccgataagagaagctactgttgccactagtgctgtatatatctgcatattcaacacgactgagaaagtttccttcttaataaccttctcgaatgcgacttgcattagagagagaattagtgagtatgtggccgaggctcctagggtcaatgcgaaacccaatatgtacttcccacgcgataaaccattggtaccctgagaatcttcgtcaactccaagaagcgcagcggaaaacgtaaggaggattactgagttgaaaatgaatggggtgaacttttgagcatttaggacatatgagaagacagcattgaaggccagctgactagcgcaaatgagcgaatatgttgatacaggaaggtacaacaggccataggaatacatcaagtcatcggcagcaatgatgaggcccaagacaacatatataagagtaattttggtgacagaagtctcagggttactggtggttgtttgtgtagaaggcgattttgaacggaacagatatagggcgacgaacagcactggaaagccagcggtttggacaaatgtggacatccacttgctatttccaccttggttgtagtagaacctgccaaggagtgtcgatgctgtctgaccagcaacgaggaagaaaatgttcagagctaccatcagccaccaatgccaatgcttggtatgagagttttgaggagctgtttcgttggtagatgaggtttcaggtttggatgatcctgcaaacaacatacagaaggcattatgaacaggtcatccggaactataaatgctaagcactcagggtaacaggagacccccaaactgaaacgctggtttcttagaccaagtgaaatccagcttgggtacttttcctgacgaacagggcacaaacccacagtgctctaaaattaccgcacacaagaaattgtccacggtatatctatgactttttctggagaaaaaaaaaagaagaagcagcgctgctcccctaaagctcacatcattattcccaaacaagaaaaagataatacaggcctggcctggccattgaagtgcataaagtaaggttccctacacatcctcatgaaatgtttcagatacttggagtcgtaattaacagctgaaccaaccctatcggacgaccaaccgaacattcactcagtgtcaatggccagtaactgaaaacgcacgcacgagcacatggcacagatgcagcaatcacaagacagccgtgactcgtgagcgcgcgcactgaagaagggagatgaccccaaccccaatcccgtacacgaaccaaaaacccactgacccaccggtacgccacacaccagaaggtaattcatcgaacacctctcgcgcttgagcgttccaacgacgtaccgccgctgacataacccgagaaaaaagaacatgtgtcggggactcggggctccccccgccctgcagagcaaatccaatctacgacagtccttcccgcgctcctctcatcgcatcctcaacgacgacccgacatagttcacactgtccgtcggagagagagagaacgagcggaggactgacactgacctgcgatctgcacgtggacctcgtcctccctgttgccgcctccgctcccgccgctgccgtcgtcgccggccatgccgctccccgcgcgcgatccgatgcgagtgggctgtgctgcggaggacgcggcgagtgaggaggaggcgaagagaggcgcgagcggtcagcgactcagcgtgggagcgccgcacggggggggtggaaggttggaaaagctgcgcacctgcctggcttccttcgcgtaggaagtaggaacacgagggagaagtccagggcaccgctctttttggatggacgtggacccttgtagatggcaccgcgggcgcagcctttccgcgtcgctgtcgtgtctgaccaaggccggacgccctttctgattcgcccgctcgcggtcgcaacttatttttcctgcgtgcggccagcggtgcggggccttgacggtgacggattggtttgttttcggcagtatgccggagttgaccatccaaacccgactccggccttctccaaaaaaaaaacaccgaaaaaaaggtgcttgtcgatgatgtgtggaggagagctgctagcg

SEQ ID NO: 23218 - DNA, 1088 bp, Zea mays
tttttttttttttttgaactcaattactgatgtgtaaaccatttttcataataggaacaagtgcaggactttttacatgctacgtactgtattttcttctatatgacgagggtagcaactttacaaaggcatgataacccagaatcgatcatgatctacctacacatcctgtctacatactgggcatgaaccatggtcaatgaaccatctgtccacacaaggctgatggaaggtgtgagagcactttggcaacttcctcgctgtctctccgctaataacatcctgcaggcaaatagcgcaagacaagctttcaccaattggtgcaggaaccacatgatgtggcaacttctttagagtatcttgtgagagcccttcggataaaacatcttcaaggacatcaaacatatcatcattgtcggcaatgccaacctgccaacgataggccatatatgccgatggctcatactggtcttgcacaaatcgagcatgaaggagctgttctatgaaatcccccatggaggacgtgctctgcgggctcgatcggtccgcgctccagtaggcgcgcgaagcctcgagaacctcgatggatagtaccgcccccgcaaaggcccccaggccggctccccggaggacgccgctgtcggaagctcggccggccaatgcgccggtgaacgcccccgtcaggcctccagcaacggcgaagatgccggtgagggcccccgagaggacgccggagaccagcctggggaggcacgaccccgtcgctacgcttcggcgctccccttccgacgccgttggcagtggcggcacttccatgactcagcctcacggcgcaaactaacccgaagccgatcgagcgtcacggtagatagggttgggttgggtctaacgcaggggccggtctacctgatggcgcccgcgcgcttggtggactggtggttggttggtacacccgtggtagaggagctcgccgggaggagggagggccgaagggggcgaggagacaggcgtgagcgcgtgacgccgcctgataacgatctgccgcttggctcgggatgcgttgctggtttgcagtttcggacgcgggg

SEQ ID NO: 23219 - DNA, 4561 bp, Zea mays
ccaccgagccacctcacaagagcgagcattgaaagtgtggtttctcactcggcttataaaatgaatttatacagattatatgttaggtgtgttgatatcggacacagcgactaatttaaatgaagcacaaatcattgcaaaggtttgaaatgtgtttgaataactatctcatttaaataagatttatctatgtagtatatagaaaccgtagcaatgcacgagtaactaaccagttttactataaaaataacgaaggcatgtaaaaacatatggatcatgctccgagccacggcctgggtgcctgggattgtatgcgccactgggtgtgaatgtctgtttgaaactaataacccctgttcaaaccccccactttgtgtgaaatttaagcttatttttaccatttaacatcgagcccgtggaaacgctgggagtgcattataggagcagagacttatgaattatatactagcaattgtttttatacatcgaggtagaaaaatcagtcaaaattaagcgtgtccttgttcaaaatgataagatggacggagagtgcgtagcatgctagccgcgcgatcacacgggccacttcatacgttgatagttcatctgattattatggagtggcattccatgatatgattcgagggtctcctcccaaaataggaattcaagaggcaaacctgaaaactcgggaccgggccacgccatggataaaggagcagccggtggctaaatttttggttggccccgcgggcgcacgtcgtttccgctcgcccccctgcgatgccgggaccggccgtggaggcagcggccaggagcggcggcgaccaccacggcggctgctgcgggaaggcggccggcaagtgggagaagacgtacctggatgtcctgggcatctgctgcaccgccgaggtggcgctcgtcgagcggctcctgacgcccatccaaggcgtgagggcggtcaccgtcgtcgtcccgtcccggaccgtcatcgtcgaccacgacaccgccgccgtctcccagttccacattggtaacgaaaaaaaaaaactccttcgacccccccggcctacatatatattacgatgaaatcggaatcaatctctgttgcacatttccggaccagtgaaggttctgaacaaggcgggcctcgaggcctccgtccgagcctatggcagcagcgccggcgccggcgggcggtggcccagcccgttcaccgtcgcctgcggcgccctgctcgccctgtccctgctcgcgccgctgctccccccgctgcggtggctggcggtggcggcggcctgcgtgggctcccagcccatgctgctccgggcgttcgccgcggcgggcaagctgacgctggacatcaacatcctgatgctcatcgcggtcgccggctccgtggcgctcgggagcttcacggaggccggcgccatcgtgttcctcttcaccgtcgccgagtggctggagacgctggcgtgcagcaaggccagcgccgggatgctgtccctcatgtccacggtgcccaagaccgtcgtgctggccgagacggggcaggtcgtcggcatgggcgacgtcgcggtcggcaccgtcgtcgcggtcagggccggcgacgtggtccccgtggacggcgtggtcgtcggcgggcacagcgaggtcgacgagagcagcctcaccggcgagtccttccccgtgccgaagcagccgcagtcggaggtctgggccggcaccatcaacttagacggtaatcctcggatctgttcatttccgagctttattcagcaacaatgtcgatccatccatgtggtggtgtcgcaggctacatctccgtgaggacgacggccctcgccgagaactcgacggtggcgaagatggagaggctggtggaggaggcccagaacagccggtctcggacgcagcggctcatcgactcgtgcgccaagcactacacccctggtacgcgggcacggtgaccaccggaaacgaccgcggtgtcaaaaacgcatagaatcggcatagcagttcagcagaagcagtgtggttgtgtcttttgcatgtgcagccgtggtcgtcctcgcggcgggggtggtcctcgtgcccgccctgctgggagctcgcgacctggagctggagcattggttccggctgtccctggtgctgctggtgagcgcgtgcccgtgcgcgctggtgctgtccacgcccgtcgccaccttctgcgcgctcctgcgggcggccaggatggggctcctcgtcaagggaggcaacgtcctcgagtcgctgggcgaagtcagggtcgccgcgttcgacaagaccggcaccatcaccagaggggagttcagcatcaaggacttccatgtggttggggacaaggttgaaatgaaccagctactctactggtaagtatacaccagcagatgattaaactgttgttaacatactgcttcagcaataatttgctactaatgaatctcctgctcctgctctcgctctcgcagggtatctagcatcgagagcaaatcaagccatccaatggccgctgcacttgtcgagtacgctcagtccaaatctgtacagccgaagccggagaacgtgaccgagacctgcatctatcatggcgagggcatctacggggtgatggatgggaaacagatctacattggaaacgaaaggatcatagcaaggtcctcgtgtcgtcatcatcaacatggtaagcaaacacattccagacctttttgttcacgcattcttgaccaacagctgaactaacggcttcctgggttgcgattgcgacatggcgacgaaactttcatcatgtacacaagctggccaccaagaaacagacggtctcaaaggcgtgtccatcggccacgtgatctgcgacggcgatctggtggggaagttctcgctgtccgacacctgcaggacaggggcggccgaggcgatcctgcagctgaggtcgatggggatcaagtcggtgatgctgaccggggacagcgcggcggcggccaagcacgcgcaggagcagctcgggggcgtcctggacgagctccacgccgggctcctgccggaggacaaggtccggctcgtccggggcctgcaggcgcggcacggggcgacgctgatggtgggcgacggcatgaacgacgccccggcgctggccgcggcggacgtgggcgtgtccatgggcctgtccgggtcggccgcggccatcgagacgagccacgccgcgctcatgtccggcgacatcctcagggtgcccaaggccgtccggctcgggcgccgcgcccggcgcaccatcgccgtgaacgtggcctcctccgtcggcgccaaggccgccgtgctggcgctcgccgtcgcgtggcgccccgtgctgtgggtggccgtgctcgccgacgtcggcacgtgcctgctcgtcgtcctccacagcatgctgctgctcagggacggcgccgcccgccgcccgaggtgctgcgctagcgctacggcgtgcaagagcaagcaggcgtccaagccgtgctgcgcgacggtgaagccggtggcgacgacgaggcacaggcacgggcacgggcacgggcacgggcacgcaggcgcggggaagcccgggacgctaggaggcgacaagcagggtaaggactgccatggttgctgccagaaggagagcaagccgcccgaggacgccgtcgtgatcgccattccgggacgggccgtggagcaccggaaggaggccttccctcacgagaacgcgggagccggggggtgctgcgctgcagcgcacggtgccgaagacgaggtatgcattgtcatcagcgccaggtcgccctgctgcagcaccgcgaggagtcggtctggttctcccaaggacgcattgtgctgccacggctccggtggtaaagacggcggcgccatctcagccctcgtgtgctgacctcacctaccagcactaccattcgtggaatacggtcgtcttgtatataaaaaaattactcatatcctatgccgtagacaggaagttgtttctattacgagtactaatattcttgtaatctatgttcccctgagatcattagaaaaaaaattatatataatactctattaaaaaaaaaaaaaaaaaaaaaaaaaaaaaaaaccctctaccataccacgtaaaaaatagtgtatagtgagcactcgaattcacgtctcctgctttaaaaacttgagactaaccatcaaaccaaatataccttagtgtttaaaaataaacaattatatttaaataaatatttcaatacatatttatataatatataataaccgtagcaaagcatgggtcactgattagttattaacttatgagtcagcgacttggttagctcgtcgttagcttttttcccctttgcatcaccgtcgtcagcttgtgcattgcatgtgttctaaaaataaaaaattaagccatgtaaagtcttaaaagcctaattaattgagggtttgcttcctagagttcctgagggaggtattatcagtttacagtacgcggatgatactcttcttttcttgaaaaacaatttagagaaagccaggaatc

SEQ ID NO: 23220 - DNA, 5029 bp, Zea mays
  misc_feature (1069)..(1069): n is a, c, g, or t
agctgtgacgtccgagcgccagcgataacctgtataaagtaggggtaaactcgcagtggctacctccacgccgccccccaccggcagtctgcgatcaaaccgcacgcaagcgaaccacagcgtgctcgccatctcactgactgtgacgacggcaacaagccagtgagcagctcgccatggcagcagtgtccaccgcgccggcgctcgaaggccgcatcgcgctcgtcaccggcggctcccggggcatcggccgcgaggtgtcgtcccacctcgccgcgctcggcgcgcgtgtcgtggtcaactacgccaccaacccggccaaggccgaggagctcgtcgcggagctcgcctcgcgcggcctccgcgccgtggccgtgcgcgcggacgtctccgatccggacgccgtgcgcgcgctcttcgaccgcgccgaggaggccttcgggtccccgccccacgtagtggtcgcctgcgcgggcatcatggacgccaagtaccccgcgctggccgacactgccgtcgaggacttcgacgccacgttcgcggtgaacacgcgcggcaagttcctggtgtgccgggaggccgcccggcgcatcccccccaacagcggtgggcgcatcatgacgttctcgtccacgacggttgccgtgctgccgccgggctacgcggcgtacgctgcgtccaacgccgctgtggaggcgatgacgagggtcctggccaaggaggtggcggcgaaggggatcacggccaacgtggtggcgccgggccctgtgcgcacggagctcttccttgccgggaaggatgaggcgttcctagagaggataaagaactccatgggtatagccgagacgacagacatagcgcccgtggtggcgttcctggcgagcgaggcctcgggctgggtgaacgggcaggttatcagggtcaatgggggcgtcgcatgagtgcggcgttgttattattacctcattatctgccatggctttccaaggatgttgttttcctaaaaaaaaaaaaaacgtgactgaatgaaaaaggttgtacatctcgggctccatagaagtagttttcnagttgtacatttctacggttctttgggagaaatatcgtagcaaagtattatgctcacaattttcaggcagtcaccttcgcctattatcatcatccgcgccttcatcgaacacaccagatgagccaacacggaagtcgagctgcttctgatgtttctgcctccgccgctggtcgaactcttcccacccctccacctgttagggaattggaacatgtcaaaaaaaatgaccacggaacatgtcaatttgagaatgccactggaaaatgcctctaacagagcccaaagacaacttgcgcggtcaaattaatcagctgtacttgtctcaaaaaatggatgaatacataaaaaaactgcatctctactaggccactgctaacaaatgatgatattagacacataaatatagagtgtaaccatacaaagcagatcgcaatataatacggcaatgaaggtaagaaagtagtatcaatactaacaaagtgcgaagggaaaatatgaacatgcaagcgcaggcatgaagactccaaggaaatggtacctgtcgaagaacatcatttgtgatttctgtgccatggagatccagtgtagtaagctgcgagcactttttgaaaaacgctgctggcaaggacgtaaggccattgttgcttataagcaaattctgttgaacaaatttgtttcatataaagaatgttacacactggtagatatcttatatgcaaagcctgctgaataaatttgcttcatataaagaatgttacacaatggtcgttaggagtaaagtgcaactgcaaatgaaaaataagaacaaatctgtaccaaaaaagagacaaataaacattaccctcaacaaatatcgtagaagagccagaaacagcatgatacaaaagtttcgtcaagttaaactgaactggtccactaatatgtgctaatgaaataatagaattcgagaacaagcgactctttctggctgtccaggtcataaacccaaagttccatgcatgatatactgagaagcaaaaagaaaataactctgcagtcctaagaccataaaactgcacgcacaagttttgttccacaatagatattgaaatatcatacatcttgtagtttcgcagctatccacgggactaactctgtattcatttatacaccttctatgtgaccattgttgcaattggacaataaatattctgtggtttcatccatattgtgaaaatcattgctatctcacaatgagaaaactggaattttaacaaattaagataacagaatatgctaattcagcacttcatttcctgtaagcgatgatatatcaatataccatcttagtaattttatcttattttctaacaaatgcacctttcatgcatctaaaggcacacacaccttaagattacgaaggttcgcaaaggtctctggcagttcagttaagagatttgatgacaggggaacctgaaaaattcaaaaatcaggttcaatacagagtactcttcaagaatatatgaggcacaagcaggccaatatgtgagagacaacacaccacagtgagagattcacaatctcctattgatgaaggcaatgaagttatcctgccaacaagtgtaaacaagtcaaatgtgacatacaacataacatttaagttttattccttaacagaacagtactagtatagtttccataagaagtaacaagaaaaacatttcttctcccaataatttttcttctatgatagaatagaactagtaacaacccactagtgttagcacattactaacaataaagtgcgctagaaacagaaactgaggctgtccccctatatcccaatatcttgctacctcagcaagattcctccccttatatcagctcccccacaacgattacccctaaatcatccctctaaatcccaatatccacatataaaattatttcctttccaactaccataccttcctccaaatgtttttttatctctttgctaattatttcatcaaagctttgaacggccagcatcaccaaatgaaacccacagggatggctagcgaaaaaagcaggcgtcaatgtataacaacgatgatagatttttttgtttcctagtaagatttgatttgggagcggggagcggccggccggccggacgaacgccggcaagctccgatgcgcgcaacaccgtggccctgatctactcatccagtcgcccgagaaatcatggaagaggctagagggaaggtaaggaagatgggggttaatttaacctcaaataatgtcaaatgaggaatgaacagaacgaggctttgtaatccacaccaccacaggaacacaagcaagcaaatagcatcccagccagcagaaacgctcgacggatggtttatcatggatggtgggcaggcgggcagtgccgtcgatggcggacgtggtagtgatgtggagcgtgacaacgcggttcccggcatcggcgaccttggcaagcgcccaggtgagcagctcacggttggctcggttcgagactatgccatacacgcctcgtcgtaacagagcctcctccactccgacgagccgttctggataagcgcgtctagctacagctgggtgggcaccatcaggtggtcggcgtggagccatggagcgctgccgcaatgatggtgaggagcgccgcacacgcgctctcccatacggtgtcgtcgttgcgctggttgatggacgcgacggcggcgtcttgagctttgcctcggcgtcccagcttggcgaggtcccgcgcaggggccgacgaggcgacgagcagcgctccatctgctccagcccgagtcaagtggcggccggcggtacgatgaaaggcggcgaacaggagcggaggtcttcactgcgtgcgcgggaacacgaagtagcgtctccctagatctagggggagagagaaggtttctataggatagagggactcaaagagagcaccgttgcatcttttagggggctcctgttgcccctaacgagggaagggggaaggggagcggcaagcgatgcagatagtctgactaaggcctttcactttttctgggctgtaaatgtactctttgggatacataaatataataaattgtactaaaatagaatcagcaccgtatagttataactgtcagcacacaagtcttaatgtcaactcttgagacattgatctactgaaccatctagacatggtccttttcaaccccctcaacctgattgacaaacagtcaatctcaaatgggaacacatcaataacatcgcatcactcttgatttgaagcattcctttaccagtatgtaaaataaacaaaagtacagtgtcaaaattcagttataaacacataaaagtatgacagaacaaataaggtactgcaagccaaaaatagtgagttctggcacaaacctgttgttatttgctatgaggacctggaggtgcttcagcagtcctatttctacaggcaagttatcaagcctgttctttgcaacacacagttcacgaagagaagtcagtgaacccaaagttggtggcaagctaaccagtctgcaagataaagaagaaagtgggtgatcacgtcatcttattttcatgtataacaaaaacatacttatcagtcatcatgctcaatagcactaagaagataagagatattgtattctaaatatctaattagaactacaaaatatcccctttttgtaccaaactaccaatgtgatacttcatgcatcttggtggcaggagtcaattgcaaaaaaaattattcaacatgttgacagaaacataggtaacaaacaatgaggtgatgaggtttagtttctcaataggataattcaactatcccatttaaccaaaaaaatcatgaacacgtatagacatcttcagagaactaatgtggatgtttagcgcaatagtttgcaccgcgattaaccactcagatatatctcccacctggaggattccaccaca

SEQ ID NO: 23221 - DNA, 1488 bp, Zea mays
cgttgctgtcggtgaacgggcaggttttttttttttttttacagggtcaatgggggcgtcgcatgagtgcggcgttgttattattacctcattatctgccatggctttccaaggatgttgttttcctgacgtgtctatctacgtgactgaatgaaaaaggttgtacatctcgggctccatagaagtagttttcagttgtacatttctacggttctttgggagaaatatcgtagcaaagtattatgctcacaattttcaggcagtcaccttcgcctattatcatcatccgcgccttcatcgaacacaccagatgagccaacacggaagtcgagctgcttctgatgtttctgcctccgccgctggtcgaactcttcccacccctccacctgtcgaagaacatcatttgtgatttctgtgccatggagatccagtgtagtaagctgcgagcactttttgaaaaacgctgctggcaaggacgtaaggccattgttgcttataagcaaattcttaagattacgaaggttcgcaaaggtctctggcagttcagttaagagatttgatgacaggtgaaccacagtgagagattcacaatctcctattgatgaaggcaatgaagttatcctgttgttatttgctatgaggacctggaggtgcttcagcagtcctatttctacaggcaagttatcaagcctgttctttgcaacacacagttcacgaagagaagtcagtgaacccaaagttggtggcaagctaaccagtcggttttcgcttaaagataaattcaatagcttttgaagacatgatagaccttcccagcagatgctatcatcaactatatcattttcagttaggagcaatttatttagagatttaagagcagagattttgtgtggaatttccttgatacagttgtagctaatgtctagtattcgtatcgaggtgccacaatcccagacttcttcaggtattaccttcaagtcacagtcttgcagcgcaacaacacctgttaacttccagcgctcagatcggcttttggtgacaactacctctggcttttgtgtttgattctccttaacatttgaaggccttctcacagttgttgctgagctactgctattatttgtgataggaccatccccctgatggagcccctgcgacgcgatgagcatcaccttggatccgcccactacttgcatcgagctcaggcttgcggcatcctggagcactttgcctttgcagatgagcctctggccgcgcgggaggacattggtcagcggctggaggaggcgcttcagctccgcgccggaagccgctgccgggacctccacggggatcgtccgcccggcgaacttgacctggacggtgatggtggtaggcgcggcctccattacctctgtgccgtcagtccgtcacaggcacagcccacaagacaagactcgaagtcaggattctgtttcgactctactctgttgagacccgccggccggc

SEQ ID NO: 23222 - DNA, 769 bp, Zea mays
  misc_feature (2)..(3): n is a, c, g, or t
  misc_feature (5)..(5): n is a, c, g, or t
  misc_feature (7)..(7): n is a, c, g, or t
  misc_feature (9)..(9): n is a, c, g, or t
  misc_feature (11)..(11): n is a, c, g, or t
  misc_feature (37)..(37): n is a, c, g, or t
  misc_feature (110)..(110): n is a, c, g, or t
  misc_feature (120)..(121): n is a, c, g, or t
anntntnangnagcatgcacgcgtacgtaagctcggnattcggctcgagctcgagccgctcgagccgaatcggctcgaggttcgcataccatgcgacaatgatgtcaaanacccttcganncatcaatagtggttttcactaggacgggatttatggctatactgcttagtcactaccgtccatctggcactatttttgcctttacagatgaggagagggttaggcaacgattggctttgtaccaaggtgtatgtccggttcaaatggaattttctgatgatgctgagaagacatttggcaatgctttgtcttatttgctgaaacatggtatggttaaggacggtgaggaggttgcgctcgttcaaagtggtaaacatcccatctggagatcacaatcaacacacaacattcaggtgaggaagatctgatgcggaacgcacatagtattctgattgttggaggacatcgtttcttctagcaaaccgcaaggtcttgttacaatgataccacactggtagtaagtactggtattggtgagatagttggtgctgagctagtgttgtgattctttttcttacttgtgcactagtgctgttttccttccgtgtaaaaaggccaatccaattgccgcttggttttagctgtagctttgggaactgtaggcttgttgtaatacagttcgttctgtcaatgttaaggacttttgcctcgagagctaggcataactcgaagctcaccaaacagcaatctacctgcaaattgcaacgc

SEQ ID NO: 23223 - DNA, 2274 bp, Zea mays
gccggccgggcctgcgcacgagcctcgcgacctgcattcgatacaaacaaggccggtgcatcggcattcctccttccttaaacccaccccggcatcgggcacgccgcacgccacgcctcaccgagtcaccttcccagccagctacccttccccctaccaattccaaatctctcacccggcttgaggatggcggcgcaggtggtcgcagcggcgggcaccccggtggccaggccgctgggcggcggatctggggccgacgcgctccggccagcggcaacgatgccaagggagagaaggaccggtgctgtggccgcgagaggacgccgcgagtctcaggtggtatccgtcataagccgcgccccacgccccgatgccggggtgctgccggtgtcgcccgacgacgacgcggccgtaaaggaagaagcaaacttccagcaccttaaggctatccagcaacttgcaactgcagcaaatggcgtgtggtctaaaccaaatgtaaggcgcaagacaaagattgtgtgtacaatcggtccttcaaccaacacaagggacatgatatggaaactcgctgagactggcatgaatgtggctcggcttaatatgtcacatggagaccatgcatcacaccagaaagttattgatctggtaaaggagtacaatgcatcacatgctgacaatgtgattgctatcatgcttgacacaaagggaccagaagttcgaagtggagatttgcctcaaccgatatttctggaaagcggacaagaatttacttttacaatcaaaaggggagttgggactgatacgtgtgttagcgttaactatgacgactttgttaatgatgttgaagtgggcgacatgctccttgtagatggaggaatgatgtcattcttggtcaaatcaaaaactgaagattctgtgaaatgtgaagttattgacggtggtgaattgaaatctaggcgccatctgaatgttcgtggaaagagtgcaaccttgccatcaataactgacaaggactgggacgacattaagtttggtgtggataatcaagttgattactatgctgtttcttttgtgaaagatgctcaagttgtccacgaactcaaggattatctaaaaagttgcaatgctgacatacatgttatcgtaaaaatagaaagtgcagactccatccccaacttacattcaatcatcacagcatctgatggggctatggttgccaggggtgaccttggagctgagctgcccattgaggaggtgccgctgttgcaggaagaaattattagaatgtgcaggagcatggtgaaggctgttattgttgctacaaatatgctcgaaagtatgattgttcatccaactccaacccgagcagaagtttcagacattgctatagctgtccgagagggtgctgatgcagttatgctttcaggagaaactgcacatgggaaatttcccttgaaagctgttaaggtcatgcacactgttgccctgagaaccgaggcaactattcctggtggggaaacacctgcagaccttggtcaggctttcaagaaccacatgagcgaaatgttcgcataccatgcgacaatgatgtcaaatacccttcgaacatcaatagtggttttcactaggacgggatttatggctatactgcttagtcactaccgtccatctggcactatttttgccttcacagacgaggagagagttaggcaacgattggctttgtaccaaggtgtatgtccggttcaaatggaattttctgatgatgctgagaagacatttggcaatgctttgtcttatttgctgaaacatggtatggttaaggacggtgaggaggttgcacttgttcaaagtggtaaacatcccatctggagatcacaatcaacacacaacattcaggtgaggaagatctgatgcggaacgcacatagtattctgattgttggaggacatcgtttcttctagcaaaccgcaaggtcttgttacaatgaaactacactggtagtaagtactggtattggtgagatagttggtgctgagctagtgttgtgattctttttcttacttgtgcactagtgctgttttccttccgtgtaaaaaggccaatccaattgccgcttggttttagctgtagctttggaacactgtaggcttgttgttgtaatacagttcgttccatttgtcaatgttaaggacttttgcctcgagagctaggcataactacaaaaaaaacaaaaaaaaatctacctgcaaattgcaacgcttttgcgttttt

SEQ ID NO: 23224 - DNA, 1334 bp, Zea mays
gggacctcgagccggccgggaaaattgtggcctatcctcttcaccagtgtgctgcttgcttatctcgttctgtcgttcactcgacgcgttctccgctactcctcgtcctcctgccgaggaaaattttgcagcgggagctactactagctagagctagcatgggaggtacaagcgccgcagtcccgagccacggcctcgcctgcgcgcccccggcagccgtcactctgaatccgcgggcgcggcggcggcgcgcttcctcgggcagcggcggccacaggagcagcccccagcagccactgaggagcgacctgctacccccggctaccgtcgcctgccgagctcgctctcagtctgcttcctcgtctaatgtgaactttgggagaggggatgacgcggacaagttgctcgaggatttgctcaaacagcatggcgaggtggtgtacagctccggtggacctccggatcccaccgttgaggccgacgacgatgccgagtgcttgtcctttgccgtctcgttggctaaagctgcaagtgagataaaggctactgatatccgtgtactttgtgtgaggcggcttgtctactggactaggttcttcatcatcctcactgccttctcaaatgctcagatagatgctatcagttccaaaatgagggatattggtgagaagcagtttagcaaagttgcatctggtgatacaaaaccgaattcttggacattactggattttggtgatgttgtggtccatatattccttccgcagcagcgagcattctacaacctggaagagttctacggcaacgctacacccatcgaactcccttttgacacccaacggcagtgatcgttgatcgttacatccgagccagcgctaggaagcatcccagtgaaaagtgagattttttcgtgaagccagccagaagacattgttaccggcatctcactagtcatcagatgtggtgagctgcccagagaaaagaaacctgcggtgcgaggtcgcaactgacaaaacgcttcctacaaccgaagcggcgcgctgctcgcagcctccgatgcagtgctgaaacggcaacttgatgcgaaaattctaggtttctgttgtgtcatgtcatgctctgcataccctgtgtgaactatcgaataatgttggcaaccgcaccgcaccgcacttggcttcccatgaccgggaggatcagtgtgtcgatccagaaattgttcactggctcctggctcgctaatattaaccccatctgactgatctgacagcttgtaaaatttcactgctggtttacgcaaggctgcactgaaccacgcttgctacaagaggcaagtt

SEQ ID NO: 23225 - DNA, 714 bp, Zea mays
  misc_feature (394)..(394): n is a, c, g, or t
  misc_feature (414)..(414): n is a, c, g, or t
  misc_feature (420)..(420): n is a, c, g, or t
  misc_feature (447)..(447): n is a, c, g, or t
  misc_feature (453)..(453): n is a, c, g, or t
  misc_feature (465)..(465): n is a, c, g, or t
  misc_feature (474)..(475): n is a, c, g, or t
  misc_feature (490)..(490): n is a, c, g, or t
  misc_feature (495)..(495): n is a, c, g, or t
  misc_feature (499)..(499): n is a, c, g, or t
  misc_feature (503)..(503): n is a, c, g, or t
  misc_feature (506)..(508): n is a, c, g, or t
  misc_feature (520)..(521): n is a, c, g, or t
  misc_feature (523)..(524): n is a, c, g, or t
  misc_feature (526)..(527): n is a, c, g, or t
  misc_feature (542)..(542): n is a, c, g, or t
  misc_feature (547)..(547): n is a, c, g, or t
  misc_feature (551)..(551): n is a, c, g, or t
  misc_feature (554)..(554): n is a, c, g, or t
  misc_feature (561)..(562): n is a, c, g, or t
  misc_feature (576)..(576): n is a, c, g, or t
  misc_feature (587)..(587): n is a, c, g, or t
  misc_feature (614)..(614): n is a, c, g, or t
  misc_feature (625)..(625): n is a, c, g, or t
  misc_feature (632)..(632): n is a, c, g, or t
  misc_feature (642)..(642): n is a, c, g, or t
  misc_feature (652)..(652): n is a, c, g, or t
  misc_feature (663)..(663): n is a, c, g, or t
  misc_feature (666)..(666): n is a, c, g, or t
  misc_feature (668)..(668): n is a, c, g, or t
  misc_feature (694)..(694): n is a, c, g, or t
  misc_feature (697)..(697): n is a, c, g, or t
  misc_feature (706)..(706): n is a, c, g, or t
tacaaagccagagtagtttccattcacacaggagaaatgactgagatggattggtttgacatggaactccctaaggctgaagttttgatactacacttctcttctgacaagtatgtattgcctcctttcattgctaagatgggcaagcttagggcgctcgtgatcatcaacaatggtatgtctcctgcgcgtctacatgacttctccatctttaccaatttggccaaactcaagagtctctggcttcagagggttcatgtccctgaactctctagcagtacagtgcccttgcaaaacctccacaagctgtctctcatattctgcaagatcatgccagagagaactagtctcgagggggggcccggtaccccaattcgccctttagggagtcganttacaattccctgggcggcngttttnaaaaacgcgtgactggggaaacccctngcggtncccaacttattngccttgaannaaattccccttttgnccagntggngtantannnaaaaaggcccgnncnnanngccctttccaaacanttggnccanctngattggnnaatgggcaaattgnaaccgttaatntttggtaaaattccggtaaaattttgntaaaaaagctnatttttnaccaataggncaaaattggnaaaatcctttnaantnaaaaaaataacccgaaatggggtganggnggtcccatnggaaaaaa

SEQ ID NO: 23226 - DNA, 703 bp, Zea mays
  misc_feature (578)..(578): n is a, c, g, or t
  misc_feature (649)..(649): n is a, c, g, or t
  misc_feature (681)..(681): n is a, c, g, or t
  misc_feature (696)..(696): n is a, c, g, or t
gactgacctatctcactctaaaatctctctctgccaatctcatcttcaacctctctctaactctcgttttcgattctacaatggctgacaagaagattaggatcggaatcaacggattcggaagaattggtcgtttggttgctagagttgttctccagagggacgatgttgagctcgtcgctgtcaacgaccccttcatcactactgagtacatgacctacatgttcaagtacgacagtgttcacggtcaatggaaacacaatgaactcaagatcaaggatgagaagacccttctcttcggtgagaagccagtcactgttttcggcatcaggaaccctgaggatatcccatgggccgaggctggagctgactacgttgttgagtctactggtgtcttcactgacaaagacaaggctgcagctcacttgaagggtggtgccaagaaggttgttatctctgcccccagcaaagacgctccaatgtttgttgttggtgtcaacgagcacgaatacaagtccgaccttgacattgtctccaacgctagctgcaccactaactgccttgctccccttgccaangttatcaatgacagatttggaattgttgagggtcttatgactacagtccactcaatcactgctattaaaanactgttgatggggccttcatgaaggactgganaggtggaaaaactgnttattct

SEQ ID NO: 23227 - DNA, 1202 bp, Zea mays
ttttggttttttttttagggcatttaaaaaaatatattaagcatggcaaagcaaaacattgaggaatctaaataacctgtcttaaaacgtactcaaagaatacgctgcaggttccattcatatatgtcatacatgaccattttcatgctcgtacatcaaacaaaagttctcgcactggtaaggcaacaactaacaagtcaaatggggggcaaccacggcacatagaccgctgtgtatagaaagatgacagctctcaaccccggtttttccccagcaatctcagcttgttggctctctcttcttcctcctccattttctttctgcgcaacgcttcctctctttgcctttgtatcctttccagctccaaatatcgttccaactctttctgctgctgctcaagagcttcctttctttgtgcttcctccactttacgcctgttctcttcgagcattctatccaactcctccctctctcttctttcttgttctgctttctgcctggcctcataaagggccacttctttctctttttgtagctgagcgtcaacctcatcaaataactttctaataccctcctcaattcggtgttctatgtcacgtttcacctcttcagatttcagacgttcctcgacatttttccttatagcttcttcgacccttctagcaagctcctcttccagtaacttaaattcagcttccttttgacgccttttcttttcttcttccagcctttgttttacagaggaatttattttctctgatgcgtgacttggactggatgggttattctctaatgaacttgtagtgctccgacttctctgtcttctgtgtctccttggagatagtgggcttctatgccttcttggacttggtgagttgctcctatcccatagtggagaaggagaacgagtttttcgccgagaggcgtaaggggagcggctccgatctcgtctgtttctccggctagcgtaccgcagaggaggggagcctcgccggcggaatggcggaggcgaccgggaaatctctctaggcatccgaccttgtgcctctactccgcactcgccttgacttgttggcctcggttgagtaggcgcgcccgtgtctgcgaggaatttctcacgaacgggaaacagggtgccttttgttttgagagagagtttctaagatctagggtaaggtcatgtttacaaaatattgtttttt

SEQ ID NO: 23228 - DNA, 3954 bp, Zea mays
  misc_feature (1448)..(1448): n is a, c, g, or t
  misc_feature (1791)..(1791): n is a, c, g, or t
  misc_feature (1841)..(1841): n is a, c, g, or t
  misc_feature (1867)..(1867): n is a, c, g, or t
tttttttttttttttttagcaggcacatgaaacttaaaaaaacattattttatagcacactgacgaagattatgaacacatgctacagcaaccaaaggaactgtatgattcagatctgagcgaattatttttttaaaaaaaacacgcaggagaactgcgcatttgaatatattaggaggatagaaatagaggtctattaatagaccgaacatccagagtgagcgcattatttaaggatcgagatttatggggcacatcacagaaaggctgctagcaaaaaatgcttctgagatgccaaaacatgcaaggggcaatacttaggtatctaaagttcacatttatcttggtaggtccctacacttgaacaatttgccacctgagacaatttagtagtttagggacaaaaatggcaacactgtgtaagtatagcaactttcgttgcaagtttcttcatgtcgtgttcatcagttcatgcaactacatctgttagccattagttctctgtctatcatcattatcaagatttgaccttgttagaagaatataatcaactaaggatacagagaagcaactatcaccatattttgcagccacaggggcaattttgctgagataaaccagaggatcctcaaactcctgggttgatggagaaaatacagggcaatctggaatctcatcaatccaatctaggctagatagatcaaatttctttactctgtgtttcaagaatgggtctctcatggaccctgcctctctcagtgatgcatcacaactcctgcgcagccttgccccgtatgacacagatttcagagtaactccgtccttccccgccattatcctggaggcattggtcccttggtctaaaaatccagagcacaatgactgaagccacgtatcctttgcagtccccagctcaagagaaccggtctccttgatctaagcacataagaagaagcaatcactgattttgttagagcactgtatacacattgcactactaaattatagctagaaatggcatattgtaatggaagatgccaaactaaagtgaaatggacatagcttaaagagtttgtctcagggggtgtaaacagaatatcgcaacccaaaaaggaagagtctaatcgaacaaatgtaaataagcaattcatgaacatgtgtcaattgtgcttacttttccacaccactctatatgcccaaaggtcagagctgaattctacaaaaggcgagcagtcactaaatttgttcccataataaaagccactgtagccacgcgggtggcaatacctaggactaggatacacgtagtacgatgctgaaaaagtcaaactctcctgtttatacagaggagaatccaacagttgtgcaccacaatcacaaaatataggaatgcatccatttagttcaaaattccttctcagatcacccacagttcacgtgaataaaanagctcatattcagaacactagagctatagcccgcgaatcacatcatatcaaacctatcgacgtagaatagcagaaatgcaggcaaaaatagcaactgaagtggtcaaaccctttccagaaattggtcaaatctatggaacagttcgaatttataaacacctcaaaactaaccgtgaaagtaaatgtttgccacattaggctcagttctacaataaattgtctgaagcaaattcgtcgcccggaaaggaacaggcgcgccaatagtaagaggactagcggcaccacgcgaaactacgggttaagcgagctgctacagaacacatagaatcaggcgagcgcgggnagtcgcgaaattataccccgcatatgcaggcactgcaacccatctctacnaaacatccggcaaatcacaatttganggggaaacacaaaattaaaaaaaacgattgggacggatttcgacaacgaaccgccagaattgcagggttagttgatcaccaaaacggcactcccggttcgaggcgaatagaatcgtatgactcgaaacaaacaaaataatgatactaacatgagcggagtccacaaggccaagtcaattctgacgaatcaaacagttcccgagttttttctgcgcaaattccatagaaaacaaactcccgcatcctctcaaacaaacccaaccacccagagcgctggtgcacatgctcgccaattcccgactagcaacccacaaacccgcagatcgctcaccgtatcatctcggcgcggcctcccggcccgaggcctcctcaaacggggacccacattcccctgaggcggccgctaccggcgtccccagcgcgctccgatccgcgcccgcccctgctccggtaacgccgcgctcccgagcgcacggaggtggctccagaactccggaacggcgcagactacggatcccgcgtaggcgtcggaaccaaaccaaggcgaaggagggagcgcccgcggcggtgctccggcgagcggcaggaggaggaaaaagaggcggaggatgaaaggagaggaagggaaaaaagtgcgggtgatatttaataagcgataactacctgtactgccggacgcggatggcgttcgggcctcgctgatccaaccgccgcgccacagctaatgtgcggattattagaatgtgggttcggactgcacttttttttttcttttcttttccggtggatgggggtagttgtggttgcaggtcgtcgtcacgggccgtcttcttcctcttccccccggcggcaccaattactgctctgccctccgtcaggtaatgtatggtgtacaagtagttggactgtccggctactaggagcaggggctctagcctgccccctgggacctctctagaaacattaggtttgccggggtggggcggagcaccgcagattagcacggagagccatgttaacgtcatctgttcagtagcgtagaggggattaataacgagaccgtgttacaagcatgcgacttttcagaccccggattaaaaggaagaagcgaagcatctcgttgcctcccccagcacgttgttgtctcccttttttttttccccacatgctggttatctgagcttgagaagctcttggttgtgttcttttctcgttgtgcgccgtgccgattatgccttttaatttatcacacatttcgatttcggcggagcagcatcgcggcggccgccccctcgccgtcgccgaaatcaggcttgtcggcagcgaatccgcgcgtccattgccatcacgttttgggaattcgcgatggaggatcggtgcggtattctctctcggtctcggtcacagaaagccgcccgttttggatggaccaacatttccgcggccgtggccaggtgcacaacgccgcaagcagagcgtggatccaaaaccacatccctccggcctccgctgtaaagtttgaggcgtcggacgcaaagcgtaggcgtgtatagctagctgccagataggtaaagaggaatcgctctctgagaaaaatatatgtaaataccaagtactactagcaaaaaaaaataattgtataaaaaaggtacttgtctgccattgaactgtaccagcaaattctaaaaggacgacggccttgattagagggaaagtaccgcaccacagagcagttaggctttatacgattgcttggagtagggatcgtgttcgtgtccctgtgaaataaggaaaggctggatggatggctctgagtctgagtaaggggaggggggatgacgtggaagaagcaaataattgaagtgaagtggagagcaaagtggcatctctgcccccgcttgagatgttggatccttttattttattttatttttcgtttcactctactttcggccagctcctgctctgtcaagttggccaccccatccacggaagaaaaacgagtagtactccaaaaggccgcttttgatgttaatggcatacgctgactttgagtagaatataaccttgccccccccccccccccc

SEQ ID NO: 23229 - DNA, 3348 bp, Zea mays
ctgcatagactacctaaagcattatggagaattataatggacgaattcattctacaaatagaagctacttaggggacaaatcaaattgcctactttgctaaccaaccagacatatgatcaaattaaaataattgtctaaccaaatattatatcctgaacttaaaagagaaagtaaatcttatgtgacagatttcagtagaccaggatctaacagcaagaagttgctcctttattccttctgttgtatccactttctatagaacatgattgattcgagcatttgcatgcgcttcaacattatcacaaagcatctactttgttgcatatgcaacatgacagtcagtggaagtgaattcctgtcagcatcaaacgatttattaacatatcaaagttatcaacacatctgaggacaaatgtaccggtgccaacaactgaacaagaataagaattgcaaatggttccagattataatgagcaaaagactgacttgttaaaaaaatgtacaatgtccatttcgtatgaggatctattaaagcattctaggtacaggtgtatctgtggtggaaaaagaatgaaccaaattgttaaaagtagtagactaacctattcacagtggaaaatctacaaagaaaggaaataagtgatgtgcagctacggatcatcagaaaaatcgcctatgacctggcaatagaatcataaaatccagccataacagtgcctccattggagaccagtagatagaatcagttctgaaccatccaatgaaaaaagagctttcatcttccagaagttacgattgatgttagcagttagcaccaagagcagcatacttcattgagtatgctgactagccaagtcaatgtcctcctggaacctataagatatttccacttcagaaacagtgcttgggaaggatgggccacgaattttcaagcgttttggcccaagatctacagatggagataggtaactgcaaccgatagatttctggccgaaagcaacttcatcttccacattttttgcatctagctgatctaccttcattttttgtttgcttcgattgatgaaattatctgtatttccagaaatgaagtcaaggcaatgcgattcagttgcgttctcttgtctgtcatctgaacaggctttctttaaccgtcttaaagcctgattctcagttaaagttattgttagatcttctgaacatcttttctccataactatgctagatcgtctcttaactctaaatacctcacagtcagaatcatcagtatcctgagcagccaatttgtcagttgagaatgcttgatcagatgtacataaaggataaacactaagcgttccattctctggacatgagctagagtatgttctttgcttagaactagtacactcatcactttgtgtagaatactcatggggtccatgtgcagaagttattgttgataatgtagggtatggcttattcagatcatatccaagaacatctacctctgaaaaggtacgaagttcaggggatgtatcaattaggatcttgcagtatggaaagtatttagcattgtggtcaatgccattggacaagtaaggatgcgtgctatagccatcactttgagacatttgttttcctacttcatccagtattccaatttcctcaaacttctttgatatttcctccaattcaaagatgtctttcctcacaaaaacaacacggtcgcagttgcaagaacacttactaatctcttcctcatgacaaaggcaaattgcatctgctctgcagttacacataatgtgagctacatagcagtcacgtttgcatatcccacagagaactgtggcatcaatgtctgctttatagcatgtacgggcacccattttcacaagcaaccaacgaacacggtgttggaaccgcatcaactgcacaaagggacccttcatatagctctgtatatgtgtgcctccagttaatgttacatttccgtgttcaaacaaggaaaactcattagcacaaaatgttgcttctttacaaagaagctcctcataaggtaatactggtatcctcttaagaagtgcataatgttgactagcaactgctcctagaggaaaccattcgcccgtagcaaaatttactgcctcaccacaattgaaaccatggctgaaaccagaatgataagctcggggaaacgttacaacaaactctccaggtttctgtacggctctatagactggaacatgatgatccagtaaaatattaggtgggaagattgtagtctttcccaacagaacatcaaatgctgcactttccccttcacctgataaaatttcgtgatcatatacatgctcacgtaccactttctcaaaatcagaagcagcacttcctggaataccataccatgttttggggggtccacagtggtgatagttaatactgtacaggtaatgatcttccacatgccaggcaaacatactaaagagcatcccaatatacagcattggatctgttattcctggaactgcagctctgagaagacgcagcgtagagttcggcaaccgtgagaatctcttcaagttccatttgcttctcccaagttggtcattggaagaagaagaaaatgcgctaccatcgatatcacatgcatactcaacagactccatcttgccaaaagctatttcatgccaaaactcctcttccatataccttgatggaagacaagcagcactagagtatctccgtacaaattctttatttgccatcttctcgaactcacgaaatgtgtactttcttccactcataaagaaggcgaacttgtcatccttggtccattcagcaagacggagaggctgaactctggtcgtaaacttaatcccacctagttccttcattagtacagtgcccgcaggtactgaagcagagacaggtgaaatgatcttgcatataccatattttgcagccacaggggcaattttgctgagataaaccagaggatcctcaaactccggggttgatggagaaaatacagggcaatctggaatctcatcaatccaatctaggctagatagatcaaatttctttactctgtgtttcaagaatgggtctctcatggaccctgcctctctcagtgatgcatcacaactcctgcgcagccttgccccgtatgacacagatttcagagtaactccgtccttccccgccattatcctggaggcattggtcccttggtctaaaaatccagagcacaatgactgaagccacgtatcctttgcagtccccagctcaagagaaccggtctccttgatctgtactgccggacgcggatggcgttcgggcctcgctgcccgaggcctcctcaaacg

SEQ ID NO: 23230 - DNA, 2466 bp, Zea mays
ttttgcattcctatgaacttcaccttataagcacatggtggtttattgatccaaggaacatttttcatacacttgggaacaaaccatggccatgaggctcaaggccaagttcagtgtttgtaggcttaagaaatcgaactggttccctatagtggaaaatggtagcgtttgacagctatcaatggcatcaaccatcactccatcagcacaaactagctgatgatacttcaactcaattcatctgctcctataacttgtctccagatttgttggaataactaaattcttttcgcatttactcagtaaaaattaacacagacgaatgcttttgaaataatcagtaaaaattaacacagatgaatgcttttgaaatcaagtggcatcttaaaatcctactgctatgctctgtgcttcttaaaattcttagtcatggacaacaaaaggatgaatataggtaaatgcaaaattacagatactgacatatatggatatctatttatattctcaattcaaagaaactctcttacgaaaatatataacaggccacaagggcatatcaatagcatattaaatatgaaaaacttacaacagctgcgatttaaggatatcaaaatgcaaactacgagcctttaatttacctaaaagaagttgcaaaagaattagatgaactttaacaaaatcagacgaccattcttgtgtagcagtagcacgacaagtcgacaatccactccatgcacgcacagacacagaaggcatggtaatcatcatttgcatgtgacagtacggaggctgttctgatggcaccacaggactatttagcagttgacacacaagaattgaatgattgactgaatagtaacagcctaacaggactgaataattaacatatcggcatgaaggtgatagtatgggaaggaaattcataaacgagtttaacaggaaaagaaaaagaaaaaaaagagctagagtaatgagttcatataccagcagtctacccacatataatctttataatgactatatccaggggatatgagagctaatttccagattcgtctacagctttgaaagtttagtagcagaacaactttcaccattaattccatcataacaccttggcacactaagagattttcggcatacatatattgaaactaagggggtgtttgaaaacactagagctaatagttagttagctaaaaacatactagtagaattagttagctaacaaatagttagttaactagtagctaatttactaaaaaaatagataatagttgaactattagctagggtgtttggatgtctctagctaattttagccactaactattatctctagtgcattcaaacaccccctaagctaatttaaatctcaggaagcatatatttatctatgtcaacatggcttgagcaaaacagaagcaattttagcacaaatcaagcagcagtagctaattctactatagtagacatgaatctgagatctgttctggcaactattgcagtaagtagccagtgcccacatcatgccaaactacatatagatgttccttctgagttccaactcaagtagttgctccaatgcatccttgattattttaagacctactaagtctaagccgatgtgaatactgttcttgtgcagcactcaagaaacatgtaaacgaatccattcagaagcaaaaaaaaatggatatcaactcacattgggccggggtcgcctgggtctggaccggcgcagcgcctgcagctggccagcgttggccactccgagcacagctgactcgtaggtgccgatgttcccgacgatcctcttggtcgactgcaggctcacgtacgcctccacggtggccggcgcggacgggggctcccactgcctggagtggaacaggaagccgagctcggcggggacagagtcgaacccgcaggcggagatgatgagggagccgctcctggcggcgggctcgtggagctcggactcgacgcgctccatgaactcgggctccccggagatgtcgaggcagtcggcgcccgcggccgcgcaggccgccgccacggcgtggccgtggaggcggaagggtcccgcgcaggagagcacgacgcgggcgcgagaggcgagcgccgcgagggaggccgggtcagaggtgtcggcgacgaggatgggcacgtcctcgggcggcggggccggggccgcggcccagcggagcgcggctgcgatgcggtccctgctgcggccggcgaccgcgagggagcggagcggggaggcggatgaggaggcgttgaggaacttgagggcctcgcggatgacgtacttgccggtgaagcccgaggccccgaatatgacgacgtcgaacatctccggctccggcggcgccatggcgggcggcacggggcgggcgcgacgacggtttggagaaaggtcggtgagcgctggggttctcggctactcgcggagtggttcgt

SEQ ID NO: 23231 - DNA, 2301 bp, Zea mays
ttttttttttttttttttacgagaagttgccagcattgttcaatgcattaaaagcaaaaaactcatgcatgcattacgagtacatccctaaacctaacaaatggaggaatgacagagagatgttctttcgtgctttctggtgtttcttgcagtgcgtagagaccttcagacattgtcgtctcgggctctctattaatgatacttttctgttttctaagtataaaggcacattgttagttgtaatttcatgtgacacaagcaacacattggttcctttggcatttgctttggtggagagagagaacggagatagttggtcttggttcttgggagatagttggtcttggttcttgggacttgttcgaatccatgtcgtggacgttcttgcgatttgttcggatccatgtcgtgggccctggtcggtatttgaactgcaggattacgtttgtgtggcacgaatagcatctttccttccacagcacgccgagtctggcattgcgcattgcaacccatatgatcctctctgcagcacacgatcacaacgttttcctattgtcacctcttttttttttttttttcagaataaggaactaggtaaattcagaaggtacagcggtagtaactagtaagactccataggactgttggtacgacacacacagttatggcttttggaagcaattatacccgacgggatttaaggagctaaaatccccttatattcaaaattgaatagcaaggggtttcagctcctctccggcggtatccttacttccaaacaagccgtttaagttgctaattggcgcttcttattgctcaagttgcatccttctgccaagtttttccacaggatgcactgagtggagccagtgaacttcaatgcatggctctagtggtgttaacctcgaaagacagcccgttatcctggaggcgctgctggagatcagtagggccaaagacggtgccaggcgtgtataccccgcccttgggcaggttggcacgctggctcagcaggacgagggcgcactgcaccagcacgatcggagttgtgacgtaaccgacctcgggtcccgaaaccttggtgatcacctccttgtccggcttgcttcttccgagctccaacgagctatccacgttgctgtagccgtgaccgacaaaccacatcttgaacgaggcgctcttcacctcttcctcggtcgggccggctctgctgaacagcccagcggagaaaaactcagggtacttcagcaggagggacctgccgaaggagaagttggcgagcaggccgatgaagattccggtgaagatgaagcgcacaaggatcagcagggatctggaggcgatcttcacgccaaaatgggcaggtttgacagaagaccagaatttcttcctatgatcagcgtactctggggtttcttctgcgccaggaaggccctcaggatgctcagtcaaggttgatagagttctcttcacgaccactgtgtcagcggaaggcagtttcatagcccacattcccagaggattgtgaccttcaatcagcgaccctttgggaggtggagggcctggaatattgggccggggtcgcctgggtctggaccggcgcagcgcctgcagctggccagcgttggccactccgagcacagctgactcgtaggtgccgatgttcccgacgatcctcttggtcgactgaaggctcacgtacgcctccacggtggccggcgcggacgggggctcccactgcctggagtggaacaggaagccgagctcggcggggacagagtcgaacccgcaggcggagatgatgagggagccgctcctggcggcgggctcgtggagctcggactcgacgcgctccatgaactcgggctccccggagatgtcgaggcagtcggcgcccacggccgcgcaggccgccgccacggcgtggccgtggaggcggaagggtcccgcgcaggagagcacgacgcgggcgtgagaggcgagcgccgcgagggaggccgggtcagaggtgtcggcgacgaggatgggcacgtcctcgggcggcggggccggggccgcggcccagcggagcgcggctgcgatgcggtccctgctgcggccggcgaccgcgagggagcggagcggggaggcggatgaggaggcgttgaggaacttgagggcctcgcggatgacgtacttgccggtgaagcccgaggccccgaatatgacgacgtcgaacatctccggctccggcggcgccatggcgggcggcacggggcgggcgcgacgacggtttggagaaaggtcggtgagcgctggggt

SEQ ID NO: 23232 - DNA, 1436 bp, Zea mays
accattaatccgccggtatcagcaaccaggaaattcacattggcccaagaaacagagcttttttttttttttttttcacagcaatgcactcatctaccacttcgatttgttcttcacctcttcattgttggttcagttcgacggccccagatttacaaatataagtacttaattaatttgccctcaatcccgcaggcacaaatgatggatagtatccaaattcatttttagcatcagcatcttccatgatccacttctctagttcctataccagcgtattctgaatttctgattcactgtttacatgaagaagaaagaagctgaaaagtagcagcagcagcagcagccaaagcccaaagctgaagggaagctcagttcaggatgcccatagctctgtagcattcgatgctgtctcggagggtgtcctccatgggcctagaggtccaccctagcttccgaagcttctccgtgttgtatgtgttgctaccttccgcttcaacgaatttttgagggtaagtgtatgttggatattcggtcttcagtatgtttacaatatcagagactcttattgctggtgaactgcagaggtatcgtccagatgcctgcagattttcgtaagccaacagaagggcaccagcgacatcacgaacatccacaagatttttgggtccatctttaactatctcctgatctcctttgatataactgaggaagactttaacacttgtatttactgcaggttgcaacaaaggtccaattaccaatgatgggcaaatagttacaatgtctagcccagttttggctgcataagcaaaagcctcatgttctgccaatgttttagaaaggaaataccattcctcattttttctgcaatattccccatctgaccagctatcctcagtaaaggcctcgcccttaggccagtcaggattattgaacacagcagccactgaagataccacaacaactctcttcgctttggcctcatagcaagctttcaacacattcagtgtgccagttacagcaggagcaatgacatcttcctcagggttggaggatttgccggaggggacagggctcgcgacatggaagacaccctgacagccggcgaccgcggacgcaacgctgccatagtccagcatgtcagccttgaccaactgcagcctctccccggcatcttccagtgtcttaagatgggcattcttgccatcaccgagatgacgcacggtaccccggacggtgtagcggccggtggagaggaggagcttgacgagccacgatgccacaaagccccccgcgccggtcacgcacacggtggtgcccctctccgccgtctccatgctgctctcgcgtccttctccctgctcggctcagctcaacggttcttccacagtgggtgcgtccgccgatcggagcgggcggttggtcccggacgg

SEQ ID NO: 23233 - DNA, 1132 bp, Zea mays
  misc_feature (383)..(383): n is a, c, g, or t
ttgggtccctcgaggccggccgggccgggatcagaacgacgtgccggttagctaggccagccatacgcgtacaggccgcgcgcgcccttatcctccgttcctccggcccgcccccgatataactcgatgctagacagaagagcgcgaggcagcactagcagtaagaaacttgtcgaagtcgtcgtagttttacgtgctccgcccgtcccgtgcgccatgtcacgcagcaacgccttgctgtggttgttgcttctcgcgctctcgtgctggtcgtggtgcggcgccgtcacggcgcggccgaccccgagcgccagcaccagcaccaccacggccggcggcggcttcatcaggtcgtggtgcgcggggacggactacccggcccntgtgcaacgcgacgctggccccgtacgcggcgaaggtcggggcccagcccggcgcgcctgtcgctggcggcgctgacggtcacgctggacggcgcgcggagggcgacggccgcgatgaaggcgatggcggcgggcggcgcgagcagccaccacctcgtgcccgtggcggccgaggcggcggcggactgcgtgggcatgctcgaggacgccgtggacctgctgcggcagtcggtggaggcaatggagcgcctcggcaaagagccggccagcgccagcgccagcgccagcgggcaggccgggcggagcgtcaggttccaggtgaacagcgtgcagacgtgggcgagcgccgcgctgacgaacgacggcatgtgcatggaggggttcaagggccagcccgccgtcgtgagggaggccgtgcggaggaacgtcgccggcgccatgcacctcacggccatcgcgctcgctatcatcaacgccatggccaagcaaatgtagtaggggtacggtatggtgttaccacggacgtgtatagatagcatcgtgtgtggatgccttgtgcatatgtacagtacgtatacgtctctctgtgtgctgtttcttgtctgatgaaatgatcacatcagatcctgatttgtttacagctgtaacggaataatcatgggttgactgtctgctgaacccgtgccaggatactgcaatggaagaatcatgtgatttgttatcagaaaaaaaaaaaaaaaaaagcggcc

SEQ ID NO: 23234 - DNA, 805 bp, Zea mays
cgaaataaaaccaccttgcttccggaacctttagcttgcaaagctcgccaacgatttcgattttccagatccagaaaagaggggccgtttttttttttttttttttgtaacaagtaaaccacgatttcctgacagttgtacaccagtagcatcttcggtacaagactatcgcacttggccaatatttttaactcgaagtttgtatcccttactacttgatacaaagctaaaatgtcatagcattcatgaagctctcttgggaggagacatattctgcaggagtctggtagttgtagctataaccaccatttgcagcaggataccaagagcaacacgaaccgcatcaagcatttcgtagcttgtgatggcctctgtgttttgcttcataaccttcaagaacaactctgaccggataatgcacgtcacagagaatgcaaccgcaattgatgacaagcttgtgtagagccgaagcagcactgccatggtccgcattcgccctaattcccccaccactatagccaggaatcccgcggccatggacagcacggcgaacttgttcaccgccgcccccttggacaacgacagcaatagaagcaagcctccggccactaggtgcagcgcctgcacgaggatgaggcgcgcgaggcgggatctgccctcggcgaccctctggtaccgggattcgacgaccatgcggtaagaaaagtcggagccgtccgtgcccgacggccggcctcgaggttcccactgccacaaggcagatctcccaatatccaaacagcagtactacactgaactcaatcat

SEQ ID NO: 23235 - DNA, 4548 bp, Zea mays
ctgcagccgctgttcgacgagccgtatcagatagcagacatgcacgcttcagataccggcatgctacatacgccctcacacgtttgaaatcaagaagacaagaaggaaggtgtgatgaacgttgaacggtttaaatttttcgcgaattagcgacggtggtgtttgtgtacgtgctaaaatgtctgtccggcaagaatatatatatacgtcctggcactagtacccacgcgtctttgggtttagtggcgtaatctagaacagcaacacggtttaaattgagtttctcgtcgatatctcaacgtgtcttattccatttggtgatcacttgactgatgtgatgactaagcctctgctattggcgtcactcagtaggattcggaacaatctgaacttagtatgtcttagtgaatgggattcaacgtgtcttattggcagccagctcgtctacgccacgtttcgtgggaagcagcatggaggattggggggggtgaaacacatgcagacccagaatatttgtctcctgctcaaactggttcacaagatgatgcgtcctgctcgatcttcatgggtcacatggggtccaatcagatggtggtgtcaaaccgaccggagatcactggaatcaactccaaaagctacttcctctgtactctgccataaccactgtgaagctagggaataatgggaagactaccaggttctggtccgatgtctggcttgattttggacctatcacagatcacctatagctacctgccctcacaagccatgcaaaacaccgggccgtctctatccatcaggttctctccgaggggattactaggcaccttgccccgcgcctgagctcggctgcaaggcaggatctggagctccttcaagctgctctccgtaatagcaatcccacattcccacggaccttccggaccaacgcctgagccctctcattgatgaaattgcctcttggtgtgattccttttctattttcatgtagccatctgtgcgatgtgtctctggcagctaagcttatgtccctcccccttgtaaacctggaacatgtgcccttataattatcaagttctaatcaggccgggggacctttcgtcccccgttggctttgtcaacaaaaacaggtgtaggtccatggagttcaccacatgcataaatacgtgtgtatcacaccgtgcatgaatactagtgaaaggaaatatcttctagcttctcccgtctccatgtccactaggtggaaatatcttctagcttctcccgtctccatgtccactaagttgcctttagtgaatagtataaaatagaggacgctacattgtaaatgacattgtttatcaagtgaagtttaaaattaagagataagatagaagaaccgccggagactagataccgatttcgcccgtcaaacaattagggatggtaatagattacaatctaaatgtttcttcataatttattagggtctttaattaattttagctaaaaattaatataaatagagtcgaatcctaatatgattcaatcattaaattttatagcgtataatttagagtttacgctaccctacagacgatacagcccaatcaagattcgcgctgcagagagagaagagggaaaccagtggctgagaaagcccgcgcagcactgcggccacatgggcttgcgggccagcctttcccggaccgatggcgatctgaaacagaaacgcccagcgctattgattcggtcccccgtgccctgaggctgaagctgaaagcaacgtcacgtcatcgcacctgacgatgtccccaccaaccttggcacgtcccagtgcggcaccgtcaatgtattctcgtagcggactagctagccgccccagccgtgttcccgggccgggatgggcagcagaaccccgcacgtcgccgtcgccgtcgccgtcgccgtacgtctcgcgatcgcttgaagacggctagctagacgccacgcaagatctccgccaaactcacgttgcattggctcgacctgttcgtacgtatgcgcatgcagcggcgtcgatcggcaaatcaaaggcaagcagccgagcaccctcgatctcttatggtcctcctgggcacgctctcctggccagacagacacgacgtgccggttaggccagtcatacgcgtacaggccgcgcgcgcccttatcctccattaattcgtcctgccccctatataactcgatgcgggaccggccggcccggcagcactagcagtaataagaaacacgtcgaagtcgtcgtagttttacgtgctcccgtccgtcccgtgcgccatggcacgcagcaacgccttgatgtggttgttgcttctcgcgctctcgtgctggtcgtggtgcggcgccgtcacggcgcggccgaccccgagcaccagcaccagcaccaccacagccggcggcggcttcatcaggtcgtggtgtgcggggacggactacccggccctgtgcaacgcgacgctggccccgtacgcggcggaggtcggggccagccccgcgcgcctgtcgctggcggcgctgacggtcacgctggacggcgcgcggagggcgacggccgcgatgaaggcgatggcggcgggcggcgcgagcagccaccacctcgtgcccgtggcggccgaggcggcggcggactgcgtgggcatgctcgaggacgccgtggacctgctgcggcagtcggtggaggcaatggagcgcctcggcaaagagccggccagcgccagcgccagcgccagcgggcaggccgggcggagcgtcaggttccaggtgaacagcgtgcagacgtgggcgagcgccgcgctgacgaacgacggcatgtgcatggaggggttcaagggccagcccgccgtcgtgagggaggccgtgcggaggaacgtcgccggcgccatgcacctcacggccatcgcgctcgccatcatcaacgccatggccaagcaaatgtagtagggtttacggcatggtgttacgcacgtacgtgtatagcagtgtgtgttgtggatgccttgtgcttgtgcatatatgttacgtctctctgtgtgctgttcttgtgtgatgaaatgatcacatctgatcctgatttgtttagagctgtaacggaataatcatggatgtctgctcaccagtgtcaggatactgcaatggaagaatcatgattcgttgtcacgaatgcgctggactaattggcggccagtggtactcgatcagatccgtttctaccaccagtcagtcagatcaccaggaatacattctgctctgctgtcagtaaattggtgatcaaagatgtccattttactggctcgagtcctacagctactacacaatgacatcgagtagactttacacacaccgatgattatccaacggcaaagcgctcgtcagtaccagcagtgtccggagatccagattttagaaataggatccaaaaggcatgaacacaggaaacgctgagtagctacaggtcatattcagagtcttatttccaaagcagacatggcaatcaaagataccgacagaattattggcattcttttgtggttatcttgggctttcagcaagatgcaatcgcgccgaagaggtcccagttgccccccgagttgaattcaggacatgaaagaaatagcctgagtagcaacttccagcgcagcagaaacatggacacaaacatgaagacggaattaaaaacacatatgctccgttagcctttagcttgcaaagctcgccaacgactacgaattttccagatccagaaaagggaagaagtaaaacaaaaacaaaagaggaaacaagtaaaccacgatttcctgacagttgtacaccagtagcatcttcggtacaagactatcgcacttggccaatatttttaactcgaagtttgtatcccttactacttgaaacaaagctaaaatgtcatagcattcatgaagctctcttgggaggagacatattctgcaggagtctggtagttgtagctataaccaccatttgcagcaggataccaagagcaacacgaaccgcatcaagcatttcgtagcttgtgatggcctctgtgttttgcttcataaccttcaagaacaactctgaccggataatgcacgtcacagagaatgcaaccgcaattgatgacaagcttgtgtagagccgaagcagcactgccatggtccgcattcgccctaattcccccaccactatagccaggaatcccgcggccatggacagcacggcgaacttgttcaccgccgcccccttggacaacgacagcaatagaagcaagcctccggccactaggtgcagcgcctgcacgaggatgaggcgcgcgaggcgggatctgccctcggcgaccctctggtaccgggattcgacgaccatgcggtaagaaaagtcggagccgtccgtgcccgacggccggccggaggcgacgtgccgctgcatcgccgggtgcgacggtgagaaggctgcctcttccttcgtcaagggtagagacagttcgcagaaggctggcgcctagtctgcgtgtcaaggcgaataccgaaagac

SEQ ID NO: 23236 - DNA, 1713 bp, Zea mays
gcacgagaccatttcccacacccccctactccaaaaacaccccagcccacatcctctgattcataccacaaagctagaacctgaaagcagccagccacaccactccgctccactccacctttgccatctccaagaaagaacccagcctcttctgcttcaagaagccttttttgatcctgagttatcgccatccatcaccatgatccaagaactgctcggcggggccgccatggaccagctcaagagcgtgaatgagtccctgcccctgttgctgcactcggtcatctccaacccatcgcccacgtcgtcgtcgtcgacgtcgtcgcgctcgtctgcgcagcagcatcagcagcagcggtcgacgtcggcaacgtcgtcgccgcaagcagggcagcagcagcagcagcagggccaggggcaaggagcggagcagacgcctctgcggtgccccaggtgtaactcctccaacaccaagttctgctactacaacaactacaacctcacccagccgcgccacttctgcaagacgtgccgccggtactggaccaagggcggcgcgctccgcaacgtgcccatcggcggcggctgccgcaagccgcgccccatgcccacgcccgtcacgaagccggcggtctcatgcaaggccgtgggcggcgcgcagtcgctgggcctcggcgtcggcttgggcatgggcgccggccccggaccctgggcgtcctcgcagcaggcggccgccgcgcagctcatggcgctgctcaacagcgccaggagcgtgcagggaggcggcggcggcaacatgcacaggctcctcggcctcgacgccgtggcccacctgcccctccatgtcctgccgggcgcgggcaataatgccggtggcacggcgccgtcgttctggccgcaggccgcgccgcgtgtcatccccgcaccgccgcacatggactcccagctcggcatggggccgctgggccagcacgacgtgctgtcgagcctcgggctaaagctgcccccgccatcgccgtcgcccgcggcaagctactacagcgaccagctgcacgcggtggtgagcagcgccgccggacgcggacacgagtacgaaacagccgcctgcgccacgtcactgccctgcaccacggcgctgacctccctcccgccggccgcgtcgagcgtgtccgctgcactggccagcgccgccacggtcgggctagacctcccgctggtctccctctccgcgccggagatgcagtactgggccgggccggcggcgatgtccgtggcgtggccggacttgcccacccccaacggcgcgttcccgtgagagacaaacatggacctcatctgctgtacggatgacgcagctgtttacccacccacatgacacactagctagtacgtaatcagtagctcgatcacttcagccttcagtgtagctttatcttgccgttaatttgactgtgttattatgagtgagaactccactcggggggaggttattaatcaatggtgtttctatcactcttgtttttgttcactagtgggagcatgggagtaacttttcttactgttattaatcagagtttttattactcttgttggtaatatctttttctatttatcttctctatatctgcatgcttgtgagctgtatgtagggtagtagcaatagtagaagggatccataactttgtatctgttgttataaaaaaaaaaaaaaaa

SEQ ID NO: 23237 - DNA, 620 bp, Zea mays
ttttccttggcttgaagatcatgttgatactcagccacagaagcacaagaaatcaggacccaaactgctatatcttgtcttggcggcgtcacaaagttcaccctgacttttttctgtacaagtcaccgactgtgatcacttgtagatttttatctatgtcatcaactggagcatcaataatatcctcctgcaaactacataagccaactggcagaatctggaagacagtgtttcctggagctgcaaaagtcgccaatagtgtgcgcttggagatgtcccacaaacaaaaaccgccttcgccatcatggccaataatgagagatgtgttttttggcatccttgtaagctccagtataggacccatgttacccaaactaggaatcatatactgctcagatatctcactccacccatcaaccatttcccagatatgcaggtttctgctgtcttcaatagctacaatgtaatttggttcaaatatcagaatgcacgacactgtcccataaggcatcaaattggttacaagtgaagcatagcccgagttaacagatacaatttttaaagaattatcttcacattgacacaagttgcagactgggcacaagcaatcaatgttttgc

SEQ ID NO: 23238 - DNA, 1255 bp, Zea mays
atggggcgcggcaaggtgcagctgaagcggatagagaacaagataaaccggcaggtgaccttctccaagcgccggaacggcctgctcaagaaggcgcacgagatctccgtcctctgcgacgccgaggtcgccgtcatcgtcttctcccccaagggcaagctctacgagtacgccaccgactcccgcatggacaaaattcttgaacgctacgagcgatattcctatgctgaaaaggctcttatttcagctgaatctgaaagtgagggaaattggtgccacgaatacaggaaactgaaggccaaaattgagaccatacaaaaatgccacaagcacctgatgggagaggatctagagtctttgaatcccaaagagctccagcaactagagcagcagctggagagctcactgaagcacatcagatcaaggaagagccaccttatggccgagtctatttctgagctacagaagaaggagaggtcactgcaggaggagaacaaggctctgcagaaggaacttgcggagaggcagaaggccgtcgcgagccggcagcagcaggtgcagtgggaccagcagacacatgcccaggcccagacaagctcatcatcgtcctccttcatgatgaggcaggatcagcagggattgccgcctccacacaacatctgcttcccgccgttgacaatgggagatagaggtgaagagctggctgcggcggcgcagcagcagccactgccggggcaggcgcaaccgcagctccgcatcgcaggtctgccaccatggatgctgagccacctcaatgcataaggagagggtcgatggatcatgacgtacgcgtaccatatggttgctgtgcctgcccccatcgatcgcgagcaatggcacgctcatgcaagtgatcattgctccctgttggttaaaccctagcctatgttcatggcgtcagcaactaagctaaactattgttatgtttgcaagaaagggtaaacccgctagctgtgtaatcttgtccagctaccatgtatgcttgttactgcccagttacccttgaatctaggggcgcttttggtgagagggtgcagtttactttaaacatggttcgtgacttgctgtaaatagtagtattaatcgatttgggcatctagtaagtaaattaagggtgtgtttgatttggcttttactctctaaaagttaaaagctaaattaaagagctggatctagaaaatagacttttctaaaaaaaaaaaaaaaaaaaccgatt

SEQ ID NO: 23239 - DNA, 1413 bp, Zea mays
cgattcacacccactgtgtctctcgcgtcgcgcccggccgtcgcctcccctccctccctgcaccgaccgatccctcccctgatcccctcttcacatcctaccacctctttaaagctacccagctacctgcctgcctcgcctcaacctcgccggcggccgcagccgcatagaccggaagagaaaggaagcagagatcggaggcaggcgaagatggggcgcggcaaggtgcagctgaagcggatagagaacaagataaaccggcaggtgaccttctccaagcgccggaacgggctgctgaagaaggcgcacgagatctccgtcctctgcgacgccgaggtcgccgtcatcgtcttctcccccaagggcaagctctacgagtacgcctccgactcccgcatggacaaaattctagaacgttatgagcgatattcctatgctgaaaaggctcttatttcagctgaatctgaaagtgagggaaattggtgccacgaatacaggaaactgaaggccaaaattgagaccatacaaagatgccacaagcacctgatgggagaggatctggagtctttgaatccaaaagagctccaacaactagagcagcagctggagagctcactgaagcacatcagatcaagaaagagccaccttatggccgagtcaatttctgagctacagaagaaggagaggtcactgcaggaggagaacaaggctctacagaaggaactttcagagaggcagaaggcggtcgctagccggcagcagcagcagcagcaggtgcagtgggaccagcagacacaggtccaggtccagacaagctcatcgtcttcttccttcatgatgaggcaggatcaacagggactgccacctccacaaaacatctgcttcccgccgttgagcatcggagagagaggcgaagaggtggctgcggcggcgcagcagcagctgcctcctcctccggggcaggcgcaaccacagctccgcatcgcaggtctgccgccatggatgctgagccacctcaacgcataaggagggcgagcaaatggcgtgcgaagtgattgattgctcaccgttgattgaacgatagcctaagttcatggcggcagcaaactaagctaaaactattgttatgtttgcaaggaagggtagggtaacccgctgtgtaatctttgtccagctagcatgtaccaactgagatgcatgcatgcttattattgtccaattacccgtgaatctagcggtgcttttggtgagaggccggccggtcgggtgcagtttacttcaaatatggtttgtgattttgtgtaaatagtattaactaggagtcctatggtaagtaaattaattaatgggaggatgcatgaataaaacctctcttgtgctgcaaaaaaaaaaaaaaaaaaaaaaaaaaaaaaa

SEQ ID NO: 23240 - DNA, 1676 bp, Zea mays
  misc_feature (11)..(11): n is a, c, g, or t
ggtacccccgnggttcggccggggcaggcgcagcagcagcagcgtcagcgcccgaggcgcgcacgagagaaacagaggctgacgaggtggggcccgtgcgggccttgaccaatcggagtacctcgaggcaacggccgggccacccacaaaccacactccttcgcctcgcgccggccgtcgtcgcctccctccaccgaacgatccctcctcctcctcctcctcctcgcatcccaccccaccccaccttctccttaaagctacctgcctacccggcggttgccgccgccgcaatcgatcgaccggaagagaaagagcagctagctagctagcagatcggagcacggcaacaaggcgatggggcgcggcaaggtacagctgaagcggatagagaacaagataaaccggcaggtgaccttctccaagcgccggaacggcctgctcaagaaggcgcacgagatctccgtcctctgcgatgccgaggtcgccgtcatcgtcttctcccccaagggcaagctctacgagtacgccaccgactcccgcatggacaaaattcttgaacgctatgagcgatattcctatgctgaaaaggctcttatttcagctgaatctgaaagtgagggaaattggtgccacgaatacaggaaactgaaggccaaaattgagaccatacaaaaatgccacaagcacctgatgggagaggatctagagtctttgaatcccaaagagctccagcaactagagcagcagctggatagctcactgaagcacatcagatcaaggaagagccaccttatggccgagtctatttctgagctacagaagaaggagaggtcactgcaggaggagaacaaggctctgcagaaggaacttgcggagaggcagaaggccgtcgcgagccggcagcagcagcaacagcagcaggtgcagtgggaccagcagacacatgcccaggcccagacaagctcatcatcgtcctccttcatgatgaggcaggatcagcagggactgccgcctccacacaacatctgcttcccgccgttgacaatgggagatagaggtgaagagctggctgcggcggcggcggcgcagcagcagcagccactgccggggcaggcgcaaccgcagctccgcatcgcaggtctgccaccatggatgctgagccacctcaatgcataaggagagggtcgatgaacacatcgacctcctctctctctctctctcgtcatggatcatgacgtacgcgtaccatatggttgctgtgcctgcccccatcgatcgcgagcaatggcacgctcatgcaagtgatcattgctccccgttggttaaaccctagcctatgttcatggcgtcagcaactaagctaaactattgttatgtttgcaagaaagggtaaacccgctagctgtgtaatcttgtccagctatcatgtatgcttgttactgcccagttacccttgaatctagcggcgcttttggtgagagggtgcagtttactttaaacatggttcgtgacttgctgtaaatagtagtattaatcgatttgggcatctagtaactaaattaagggtgtgtttggtttggcttttgatttctaaaagacaaaagccaaactaaagagctggatccataaaatagcattttctaaaaaaaaaaaaaaaaaacgcgacagtcttctag

SEQ ID NO: 23241 - DNA, 1125 bp, Zea mays
aatgaaattgaaataagttataactaacggaaggaatatacaaaacctaacctctagctgtgtggctcttggctaggtttactatacatttccaaaaacaaaatttacagcatattcttatttacagcttggccttataaaaaccttccagattcatctaccgtgcatcctattgtgcattcaaacaagaacttcaagttctcgaaaaagaatgtgcatccttatttgtcaaatccaacaggccaccaatctcagctactttgtcgacaagaagcctgagcaaaggtattgttgaaagcgttccacgtgatcccaccatgatgagcttcttctttgcacgtgtcaacagaacattgatcctgtgccaatcaccaagcagagaagaaccactagcccttgagtttgcagtggagcgcacgaaagatactattatacactccttatctctaccctggtatttatcgatcgtatgaacctcaaccaaacaatcagtgtattgctgaatgatattcacttgagcgttatatggggttatgataccaatagcatcttgagctacaccccttcttagtaattctttgatgatccatgaaataatgtgtgcttctgtaggattgttcacagttctgtgttcctttgcctcaagtgcaggtatttgatctgtgttggcaaagatcacagccctatcgggattcaagatctcttttaacttcaactgcattggttctctaccagaaaacttgagtttggcatttgcaatttccaatgaaccacagcacaacctattaccgtaaatcaacgaatttgagagctccatgataccagatgacatacggtactggcatcgcagtgctgaaattgcctgggaatgtgcttctgacaatctccaaaataagctgatgcccatcccattttctcgcgcttcagagctctgaaccagtggaggaagttgataatggtctcctactagaacaaactttgttgcaagcatcaaaggtcccagtgaaaccggcaatgtaatttgtccagcttcatccatgatacatgtgtcaaacttcttatgtgctaataaaggatgatacattcccaagcaagtaactccaacaacctgtacttgctccatcc

SEQ ID NO: 23242 - DNA, 2095 bp, Zea mays
  misc_feature (5)..(51): n is a, c, g, or t
cgggnnnnnnnnnnnnnnnnnnnnnnnnnnnnnnnnnnnnnnnnnnnnnnngagaaatccacttcaatagctgatggagatctagtcaatagaaaaaaaaaagaatgccctcaaccagggaaaaaatattttttttttttttttcataaattatttttttttgtcgcttcagaaggcagtagaagttacaaaatcgcctcacaaattctcttgcccatgtccggagctcaaaatcatctgtaggctatagcaccctccaaattcgcattgcttgcagatatccatttagcttctcgaaacggattttcctctgtggcgtggctgcaaaagtgcaggctggatggatgaacgctctccactgtaatgcctgtgtgatcttcataaacatctacggggcaagacaccaatcatctactctacaagtcctctttctcgtcttttagtcggatcgggtgaattgcaactccattttgagcagatcggactcgtccccatcttccaaggcgaggctcctggccaacaccagcaacaataaaacgtccagattttgctatggcgagagaattaacaaatccatccagtttcaaatcaaataatggctcgactcccttggaatcaggtttgatagcccagagacgaactaaaccatttcctgctcctgatgcagcaaggtcagaacctcttctagcagcaacagtaccaacccatgactgggctgcggacgacacgctttcaggtttatgtattccattttctttaggtgactcatcatcgttgtcaactgaattaaggtcagtacatgatactggatgagcattttttactatgaggataggctttttcctcattatgctccaaagctcaatgcttccatcatcagatccagacaaaaactccttgtcatcaataaagcagcagcactctaaagatgtggcaacaggagcacggaacactaactgtgactcttctggaatcttccaaaggtgcattgtacggtcccgtgctacagtaagaatcctctctttactaaatgcatccattgtcaagatttcattctgatgcccatataaacagttcatgtatgttctatcctctgcattccactgcattattgaacgatcaaaagaaccagagaatagctctgaagagtctggcgcaaaagcaagacatgatattggtccccgatggccgctaaatgcctgtatgtgctcctgtgacctaatatcccataaatgaatgtgacggtccaagccaccgctcgccaagtaacgaccatcagaactggcagctaaagccagcacttgcttgcttcttttagctgatactggcggtttagcgtgatgtgaaaccaacacatcttcacttggccatatatacttctcacatttcccagtttcaacatcccaatgcataatgattccatcttttgatcctgaaaaccccttatcactatccttggataaagcaacagcagtaacaggttgccggtgcttcacaagaaccttaaagccatcctgagggcctggtggtaataccctcgcggcaatctcccgccgcttcctgccgctctcctcgagctgctttctctgcaggatctccgccacccgtctccctcccgacacgttctcatcctcatcgtcatcctcctgccccctcttagcgacttcagtgaccttcttcagccactccttcgctatccgcatcttcttctcccccaccgtttcctcgtcctcatcctccttaccgccctcgtccccatcctcatcaaatccgcggccaagcgcagccacgccgtcgtcgtcgctgtcctcgctctctatgtcctcgtcacggtccccgcggcggcgcttgggcgcggactcgaagaaggggtcgtcgtcccctccgccgccaccacgtcgggagcctgggcggggcttggggcgcgaagcccgcttgcgggagcgcggcgccatggtgactggtggggagcgggcgctcacgcttgggctgggatttcggtagagggcgacaaggtgtttcgccgccgccgtcggtggtgaacacgatagtttgggggaagcgacgggcggcggaaaggcgagggtttaacagg

SEQ ID NO: 23243 - DNA, 778 bp, Zea mays
ttttttttttttttttgctggccccaaccgataaatattgcataaagagggcaggatatacagcaaattattagctcataatttctcgtccaccgagatgattcaagattcaatactggttccgaatagcaagaggttgcatcaacaacaccgattccataatattcgtcggcaaatgtggattaatgtggttgcccatgctagatagaggtaaggcaggcattcaggcttcagacatggtagcccgtgacggtaaaacctctaccgacgatctcaccgaggcagaaccacgcatacaactcgatgccaaacatcgccgcaacaccagcatcctcacccttcagactgcttctgttcttccacagaagcttcgcaccatcaacctctttccagaacgactcgtaacgaccgggaaggctagcgagtcgggtgtagaagagctgcttggagaggtccttgcacttgtcaatggtgggagggtcgacgacatagtgtttgttcttctccatgagcgtcttgtggtacgagcatccgtgcttggccacgatcctcgtcgcctcgcatgccttggactgcagctgcgccagctttgaccccagcggcgccatggaatgcgccgccgccaacgcttctgattgtggtcggtggtttggacgaaagggatggagagatccgaggtgagagcacgagttggaacttgggggaggcggctgcctcgctgagaagggacgggaaggggacgtcacgcccgcgggccgcacgcggggcggacgcgggg

SEQ ID NO: 23244 - DNA, 1164 bp, Zea mays
gggcaattccgcttcggcactagaccaccgctcgccgacgccgctcctccgtcttctgcttctcccagcgccgcccgcccccgctgttccctcacacgccggccgccgcgcaagagccgtggccccgtcgacgtccgcccgcacaggactctccgagtgtgggattgagccgtagttttttttttttggtggctcgggccgatatccggtactgtatgagggttgccaactactagactttaagatcgctgattcaatggaggcctccgaggcagcacctgcagcggcggccaccgtcatggaagcagaggatgtgagcggcgggaagggcgaatggtacgtgcttggggagcgggcgctgatggtgccgtacacgcgggagcacgtgccgcggtaccacgactggatgcaggacccggcgctgctggaggccaccgcgtcggagcccctctccctctcgcaggagttcgaggtccaccgctcatggaccctcgaccctctaaagcacaccttcatagtgttggataaggagctcatagagggagagttcgtgccgggcaacccgcacattgaagctatggttggtgatgtgaacatatatatgaatgactctgatgatgtgcagatcgcggagatagagattatgatagctgaacataagagccgtgggaagggtattggtcaagaagcaatcttactgatgatggcatttgcagtagagaaatatggaattcacacgttcagggcaaaaattagcgaatcaaatatggcatcgcttaagctcttcaggaagttgggcttcaaggatgcttcatacagtgtggtgttcaaggaggtgactctggaggcacccgctgactcactcccgttgagatttcctctgaccattggagactggtgacgtttgacatgccccaagttaattccatgcagacgacacaagaagctaatgctgtttgtctgtactatctgaccaaaatttactcgggctgatattgtatgaaaaaaatgaataaaacagttgcacagttgtgattcaattgcattagaccagtcgggtttttcatgtcactattttgaagaccccatatcttataaacaaatgtagacaagttttatctcataatttttttatagtatctcccgtcaaaaaaaaaaaaaaaa

SEQ ID NO: 23245 - DNA, 1983 bp, Zea mays
cccccctcggattttttttttttttcccttaactaaacaatggaaaattagccatgtattaaatctcagctgtaattgaaacacacatggtttaagtgacatgggatggattcactcaatcccaccatgtattggatcccaatatgtattaaatactagagtgccgaacaaggccttatatggattgaggtgaatactcgtcacccaaacaaggctccagtgggtttacctgaccaaaactgaaaatcaacgcagctccaataagcatacacactcaatatgaggagtatgaggaaacatatccacaggaattacactcttcagttcatagaatcctctcaaatctttctcctccacgccatgacataggtagtccaaatcccgagcacaagtagctggattacatgagacatacactattcgaggagctttaacttctaacagccacttgattaacttcatgtgcatcccagggcgattaggatctgagatgattatgtcaggctttggaaattccttcccgaatgattcattgattttattgaggtccccttgaacaaatgttgcattgttgataccgttcaacttggcattctttcgcgcatcttcaatggcttcagggacaacttcatatccataaatgtgctttgcccttcgggcaagggtcaaaccaatggttccagttccacaaaacagatcaagaacaatttcagagccatctcctttaagcccagcagaatcttcaataagcttgtaaagaacatcagcctgttttgtattagtctgaaaaaaggagttggcagatatctggaacgcaagtcctctcaacatttctgtaatgtttggcttcccgtacaaagtatattcttgttcacccacagatgaattaccaacagacgagttcacattatttatgacactaaccacttcaggtatttttgtgattttatcaacaagaggcatcaatacatctggcttataacatgacgtcacaaaattgaccattacttctggagttccagtgctgatgtttcttccagttcttatcatcagatgcttgagaaacccaacatgcttatggacatcataaggtgtgaggcctatggcaggatccatccaggtttcttgaacaactgcaagaaccttatctgctggctcactctgcagaaaacatttctgcacatgtagcaccttgtcgaagaaccctggtgcgtgcagtccaagcgcatatccatcagtttcattcgtttcctgcttcacctccacctcctcacccttgtccttcaactctttttgcacccatctcttcgtcccaaacgagaactccattttgttcctgtaccggaatatctcgtcacactgcacggtgggtttgaggatatcatccggctccgagctctccaggcgcttgggatcaaacttgccaaagttcacgagcaagtcgcgaacctggtgatgcttgtggcggatctgcgcggcgtacgcgagagactgggtcttgcagccgccgcagtcagcggcgagggggcagggcgcctcgatggcgtcgtggtgtggctcgagggtcctgagcttggcggcctcggcaaaggcgccacggcggaggcggcggacgcgggcgatgaggcgctcgccagggagcgcaccatcgcagagcaggacgaacgtggagcccgcgaccttgcagacgcccttgcccttgaaggcgagcgcctcgcaggtgagctcgactgtctcgccacgcttcgggaagtagcccttgcgaggaggaaccgggggaagcggcaactgggatggcgcgggggtaggcgcgggcgattctggcgctgcggcggctacggcgaggaggcggcggctgtggttgaggggaacgccgcggcggaggcagcagatggtgagcggggtgacggcgtgggcagccatgagggggctgcctcttcccggccggcctcgagggtcccaatggggtgtggaactgcggat

SEQ ID NO: 23246 - DNA, 2569 bp, Zea mays
gaattcttggcgaccagtggacgactgcaaaacggtttggtcttgaaggcgctgagactctgatccctggcatgaaggagatgtttgacagagcagctgatcttggtgtagagagtattgtcattgggatgccacacagaggcaggttaaatgtcttgggaaatgttgtgaggaagcccttgcgacagatatttagtgagtttagtggtggtaccaagcctgtcaatgaaggggaggggttgtatacaggtactggtgatgtcaaataccatcttggaacttcatatgacaggcctaccaggggcgggaaacaaatccatctgtcattggttgcgaacccaagtcatttggaagcagtcgatcctgttgttgctgggaagacaagagcgaaacagtactattccaatgaccgtgacaggaccaagaatttgggcgtgttgctgcatggtgatggtagtttctcagggcagggcgttgtgtatgagacactgcatctcagtgcccttgaaaactacaccactggtgggacaatacatatcgtggtcaacaaccaggttgctttcactactgatccaaggtcagggagatcctctcagtattgcacagatgtagcgaaagcattggatgcgccgatttttcatgttaatggtgatgatttggaggccgtggttcatgtctgtgagctcgctgcagaatggcgacagacatttcattcagatgtagtggtggacattgtatgctaccggcgatttggccataatgaaattgatgagccgtccttcacccaacctaagatgtacaaggtgattaggaaccatccaagtgcgcttgagatttatcaaagaaagttgttagagtctggaaagatctcaaaggtagatattgataagttaaacaagaaggtcagcactatacttaatgaggaatttcagaacagcaaggactatgttcccaacaagagggactggctttcagcttactggactgggttcaagtcaccagagcagatttcgcgtatccgaaacactggagtcaagccagagattctaaaacgcgttggggaagccatgactactctgccagaaaatttcaatcctcacagggctgtgaagaagatttttgatcagaggcgtcagatgatcgagactggagaaggcattgattgggcagttggtgaagcacttgcttttgctactcttatcattgaggggaaccatgtcaggttaagtggtcaggatgttgagaggggtacatttagccaccgtcattctgtcctccatgaccaagaaactggagaccagtactgcccactggatcatcttgttatgaaccaagatgaggagctttttactgtgagcaacagttccctgtcagaatttgctgttttgggctttgaattgggttactctatggagaacccaaactcattggtcatatgggaagctcagtttggtgatttttccaatggagctcaagtgatatttgatcagttcctgagtagcggggagtcaaaatggctccgccagactggccttgtggtttgtcttcctcatggatatgatggccaggggcctgaacattctagtgcaagattggagcgctttcttcagatgagtgatgacaacccttatgttatacctgagatggatccaacactgcggaagcaaatccagcagtgcaattggcaggtcgttaatgtaacaactcctgcaaattatttccatgttctgcgtcgccagatacaccgggactttaggaaacctttgattgtgatgtccccaaagaacctccttcgccacaaggactgcaagtcgaacttatctgaatttgatgatcttgcgggccaccctggattcgacaagcaagggacacgctttaagcggctcattaaagaccagaataatcacaaggacctcgaggagggaattaaccgtctagttctttgctctggaaaggtgtactacgaactggatgaagaaagaaggaagacggagcgcactgatgttgctatatgtagagttgagcagctctgcccattcccctatgacctcatccagcgcgagttgaagagatatccaaatgctgagatcgtgtggtgccaggaggagccgatgaacatgggagcgtacagctacatcaacccccggctgctgacggcaatgaaggctctgggccgtggtggcatcgaggacatcaagtacgtcggcagggccccgtcggctgctactgctacgggcttctactcggtgcacgtgcaggagcagacggagctggtgcaaaaggccctgcagcgcgaccccatcaactacccgttctgaaagaaacgagacccctgtaaattcttggaaaattgggcaccttttgattttgatatacctctatagagagagcaggccttaaggtatgcctgtgctgctgtgcagccatttgttgaaataatcgtttcggactctacagtaccgcattatatagtatataatttcatgataaatattgtataagtaattattgattaattaatattatttactccctccgtccaaaaaaaaaaaaaaaaaaaaaagcggcc

SEQ ID NO: 23247 - DNA, 861 bp, Zea mays
ctagtagccgcacgctccctggcttctcttccagccgccgccgcctctatctctcccttccctcttctctctacgctcaccactctcctcccttccctcgcctcgctcctctctgtctcgaccgagcagcagcagccgaccgcgcctgcaacgaccgcgactcagctcggcgcccaggcggaccgacgccggccacccggccaggcccgcggagccgcagccacgcgcgcccagcaagtcgagcttatctgaatttgatgatcttgcgggccaccctggattcgacaagcaagggacacgcttcaagcggctcattaaagaccagaataatcataaggacctcgaggagggaattaaccgtctagttctttgctctggaaaggtgtactacgaactggatgaagaaagaaggaagacagagcgcactgatgttgctatatgtagagttgagcagctctgcccattcccctatgacctcatccagcgtgagttgaagagatatccaaggacactgaaaggcggacgtgcggattggcttatagagaaatgtattgaacttggagcttctagtgttacccctgtcctgatagaacaatgtcacacaatagcggaaaatcgggtggacaggctgcaacgccttgtgctggatgcagttaaacaatgtatggagtttgggtatcacctccgttcttggcctgttaaacaatgtacggagtttggggttaaatgattttgtaaagtgtttgcaaatatgtgcaaaacataataatgtgtaggttttgtgaatgaaaaaaaaaagtcgacgcggccgcgtttatgtgatgtggatctatcattatgcaatactaattaaatttgtat

SEQ ID NO: 23248 - DNA, 3905 bp, Zea mays
ggcacccctgacctcgcccactgtaagccccgcccgctcgttgcgccctccgtgccggattccgtcacgcggttttctgtcgtgatccgatcggttgtttgctgcggaatcagcttagtgattgttcttaattctctagggttgtggggagagatcgcgttcatcagtgccctgtacggagtgaccgatctcggatgaggaccgatatgccagttttgctgtgattattgatctgtgcggtgcgtaatcgatcgagatttagtttgatttgggaagcccagaagcagtacgtgcgaaattcagttcccttccacgagcccccttccactggaatttcggtgcctaatttgttgttgttcctgccgctctctatatagagatcttaatcaaatctcctgttctggtgcagagggggacgtgcgatcgatcacgtgcgcggcgactgatggcaggctagattccggcaatccacagtcagacacatacattttgcgatcgatttttggtgaagcgaccttgatctgaaaatggggctgttccgggcggcgtccggtctggctcgtttggcgctgcggcggaacctctcgcgcgccgcagcgagccccttcgccggcagcggtggcgccgtcccgggtgcaatgccggcgcggtacttccactccacacgcccccgcacgtgcgccgcgcccgcgccccgtgcggtgccgctctcgcgcctcaccgacagcttcctcgacgggaccagcagcgtctacctcgaggagctgcagcgagcatgggaggccgaccccaactccgtcgacgagtcctgggacaactttttccgcaacttcgtcggccaggctgccgccacctcgcctggcctctccgggcagaccatccaggagagcatgaggctgctgctgctcgtaagggcgtaccaggtgagcggccacctgaaggccaagctcgacccactggggcttgaggagcgcccagtcccggatgtgctggacccggggttctatgggttctctgaggcagacttggaccgtgagttcttccttggggtgtggatgatggctgggttcttgtccgagaaccggccagtgcagacactgcgttccgtgctggagcggctcgagcaggcttactgcggcaccattgggtatgagtacatgcacatacctgacagggagaagtgcaactggctcagggataggatcgaaacagttaacccaagggagtacacttatgatcgtcgtcaggtcatgctggataggcttatctggagtacacagtttgagagtttcttggcgaccaagtggacgactgcaaaacggttcggtcttgaaggtgctgagactctgatccctggcatgaaggagatgtttgacagggcagctcatcttggtgtagagagtattgtcattgggatgccacacagaggcaggttaaatgtcttgggaaatgttgtgaggaagcccttgcgacagatatttagcgagttcagtggtggcaccaagcctgtcaatgaaggcgaggggttgtatacagggactggtgatgtcaagtaccatcttggaacttcatatgataggcctaccaggggtgggaaacatatccatctgtcactggttgcaaacccgagtcatttggaagcagttgatcctgttgttgctgggaaaacaagagcgaagcagtactattctaatgaccgtgacaggaccaagaatttgggagtgttgctgcatggtgatggtagtttctcagggcagggcgttgtgtatgagacgctgcatctcagtgcccttgaaaactacaccactggtgggacaatacatatcgtggtcaataatcaggttgctttcactactgatccaaggtcagggagatcctcacaatattgcacagatgtagcaaaagcattggatgctcctattttccatgttaacggtgatgatttggaggctgttgttcatgtctgtgagctcgccgcagaatggcgtcagacatttcattcagatgtagtggtggacattgtatgctaccggcgatttggccataatgaaattgatgagccgtccttcacccaacctaagatgtacaaggtacacactcttctttgtttcactttgttgtcaagatttggcacaaacttatacgcccttttgtctccacatattcatttctatcctgattctttctgtaccatttgagcagtgatgtcttcagtactccatctagttaaattctgaacggcagaaaaaatatgagcacattttgtatcttttgatatcataataataataagaattcttaaaagtctgaaatcaacattgattctgaacaatcaaatttggtgtagtttccgtattatttgtcactgtcagatgtgtaattgtgcccatcatatttggaaagttgatttctgttgccctcaggtgattaggaaccatccaagtgcgctagagatttatcaaaggaagttgttagagtctgggaagatctcaaaggaagatattgataggttaaacaaaaaggtcagcactatacttaatgaggaatttcagaacagcaaagactatgttcccaacaagagggactggctttcagcttactggactgggttcaagtcaccagagcagatttcgcgtatccgaaacaccgggtaaatagatcttcccatctagtttagttgtttctgcgtttcttcacattttaagtgatcttgatctgaaaaaaatcagttgcgctttgccgctttatttaatgcattttcaaccatgcagtgtcaagccagagattctaaaacgtgttggagaagccatgactactctgccagaaaatttcaagcctcacagggctgtgaagaagatttttgatctacggcgtcagatgatcgagactggagaaggcattgattgggcagttggtgaagcacttgcttttgctactcttataattgaggggaaccatgtcaggttaagtggtcaggatgttgagaggggtacatttagccatcgacactctgtcatccatgaccaagaaactggagagcagtactgcccgctggatcatcttgttatgaaccaagatgcggagctttttactgtgagcaacaggtatgaactaagatatactaactacttgttcctgttagtgatgtgcatgggttagcagcttaagttcactcacttttttaggaaacatgcaacattacaataaccagatagattcaaaacaggaaccggtacttttgtcagctgcactagttgattcttgtttccacataatgagcaccaataaaataaataaaaaggcattgcatatccatatgtcaaacaacgtcaggtaaaataatgttgttgtactatcagtagtctgtattattgttgtactgcctacttactattgatgcgtgggtattgtggtatctttaattattcaaacttctgagataatgctacatggtttgtactggtgaattgagaagcacgtttaaggcgcagcagaaagccagaaacacatgccaggaataggattcctgactaatgatccagattccagactgaccacttggatgtagataataacaaactgttaaacaagcataaagggtattgatattgactagtaatcagattaaaacagcctagatacaggactgaaggataaaaaattttcagtggtcgttggattttatggctgatatccacatgctcttatatcatctttaactgtatgaatcttcatatgcaaaatataagaaaaaatatggctcagtgtctgggatgtttcttctagtcgggttatttaacaaggcttgctgttctcttcctgtcttaatgaaatgacacagctctccttgtggtagttcaagggaaaaaaacagaactgaacacttttcacccccattactggcc

SEQ ID NO: 23249 - DNA, 3897 bp, Zea mays
aattcggcacgaggcttatcatcatcaacatcaccacgggcgggggagacggccctcgaagcgtacccgtccccatccaccttttcctctcaccccatcccatctccggatctatcgccctcgccatcggcaatcggcatcgccaccggtagtgggagggagcaagggggggacccaggccaacgccgcgcacctttgccctcttatcatcatcaacatcaccacgggcgggggagacggccctcgaagcgtacccgtccccatcctccttttccgaaccaccggagcgcggcggcgcggcgcgagacccttcccggcttctactcctccgatcctccgcaccggctgacgagtagcccactcactgggggacgtgggatcgatcggcggctgatgggaggctagattccgcaatcccacagactagacacatccccttcgcggttgactttggcgaatcgaccttgatctgaaaatggggctgttccgggcggcgtccggcctggcccgtttggctctgcgaaggaacctcttgcgcgccgcggcaagcccctttgccgccggcggtggcgccgtcccaggtgccgcgccggcgcgctacttccactccacctgcccgcgccggttcgctgcgcccacgccccgtgctgtgccgctctcgcgcctcaccgacagcttccttgatgggaccagcagcgtctacctcgaggagctgcagcgggcctgggaggccgaccccagctctgtcgatgagtcctgggacaactttttccgcaacttcgtcggccaggctgccaccacctcacccggcctctctgggcagaccatccaggagagcatgaggctgctgctgctcgtcagggcatacccggtgagcggccacctgaaagccaagctcgacccgctcgggcttgaggagcgtccggtcccggatgtgttggacccggcgttctatgggttctccgaggcggacttagaccgcgagttctttcttggggtgtggatgatggctgggttcttgtctgaaaaccggccagtgcagacgctgcgctcggtgctggagcggctcgagcaggcctattgcggtaccattgggtatgagtacatgcacatacctgacagggagaagtgcaactggctcagggataggattgagacagttaacccaatggattacacttatgaccgtcgtcaggtcatgcttgataggcttatctggagcacacagtttgagagtttcttggcgaccaagtggacaactgcaaaacggttcggtcttgaaggtgctgagactctgatccctggcatgaaggagatgtttgacagggcagctcatcttggtgtagagagtattgtcattgggatgccacacagaggcaggttaaatgtcttgggaaatgttgtgaggaagcccttgcgacagatatttagcgagttcagtggtggctcccaggccccccccccccccccccccttgtatacagggactggtgatgtcaagtaccatcttggaacttcatatgataggcctaccaggggtgggaaacatatccatctgtcactggttgcaaacccgagtcatttggaagcagttgatcctgttgttgctgggaaaacaagagcgaagcagtactattctaatgaccgtgacaggaccaagaatttgggagtgttgctgcatggtgatggtagtttctcagggcagggcgttgtgtatgagacgctgcatctcagtgcccttgaaaactacaccactggtgggacaatacatatcgtggtcaataatcaggttgctttcactactgatccaaggtcagggagatcctcacaatattgcacagatgtagcaaaagcattggatgctcctattttccatgttaacggtgatgatttggaggctgttgttcatgtctgtgagctcgccgcagaatggcgtcagacatttcattcagatgtagtggtggacattgtatgctaccggcgatttggccataatgaaattgatgagccgtccttcacccaacctaagatgtacaaggtgattaggaaccatccaagtgcgctagagatttatcaaaggaagttgttagagtctgggaagatctcaaaggaagatattgataggttaaacaaaaaggtcagcactatacttaatgaggaatttcagaacagcaaagactatgttcccaacaagagggactggctttcagcttactggactgggttcaagtcaccagagcagatttcgcgtatccgaaacaccggtgtcaagccagagattctaaaacgtgttggagaagccatgactactctgccagaaaatttcaagcctcacagggctgtgaagaagatttttgatctacggcgtcagatgatcgagactggagaaggcattgattgggcagttggtgaagcacttgcttttgctactcttataattgaggggaaccatgtcaggttaagtggtcaggatgttgagaggggtacatttagccatcgacactctgtcatccatgaccaagaaactggagagcagtactgcccgctggatcatcttgttatgaaccaagatgcggagctttttactgtgagcaacagttccctgtcagaatttgctgttttgggctttgaattgggttactccatggagaacccaaactcattggtcttatgggaagctcagtttggtgatttttcaaatggagctcaagtgatatttgatcagttcctgagtagtggggagtcaaaatggctccgccagactggccttgtcgtttgccttcctcatggatatgatggtcaggggcctgaacattctagtgcaagattggaacgctttcttcagatgagtgatgacaacccttatgttatacccgagatggatccaacactgcggaagcaaatccagcagtgcaattggcaggtcgttaatgtaacaactcctgcaaattatttccatgttctgcgtcgccagatacaccgggacttcaggaagcctttgattgtgatgtccccaaagaacctccttcgccacaaggactgcaagtcgaacctatctgaatttgatgatcttgcgggccaccctggattcgacaaacaggggacacgcttcaagcgtctcattaaggaccagaataatcacaaggacctcgaggagggaatcaaccgcctagttctttgctctggaaaggtgtactatgaactggatgaagaaagaaggaagtcggagcgcactgatgttgctatatgtagagttgagcagctctgcccgttcccctatgacctcatccagcgcgagttgaagagatatccaaatgccgagatcgtgtggtgccaagaggagccgatgaacatgggagcatacagctacatcaacccgcggttgctgacggcgatgaaggttctgggccggggtggcatcgaggacatcaagtacgtcggcagggccccgtcggctgctaccgcgacgggcttctactcggtgcacgtgcaggagcagacggagctggtgcagaaggcgctgcagcgcgaccccctcaactaccctttctgaaagaaacgaggcccctgtagattcttggaattggggaccttttgaatttgatataataccaatatagagagaacatgccttaaattttatctgtgcagccatttggtgaaataattgtttcgactctgcagtaccgcatgaaacaaaccgttgtaagtttggaaaaactccatctcgcagcgttgattttgtgttcctaaatgctggaaagtttgtatggctgaaagcctgaaacaccgcctgccgcaattttcttgcgttgaattgcaaagtctataaaagcaatgaactgatatgtcattcaaccggcaacttgaaaaaatccgaggaagggtcgcggtacc

SEQ ID NO: 23250 - DNA, 1558 bp, Zea mays
acacgaactaacatttcattgatatttcattcctacacatatgtctagtcagtgaggaaatatggtgaggaaaagtgtcgccaccaccggagtctcaccacctatagcgtccttcgtaaggtgactccctctaccctctcatttttctttggttctacgttttggggtatacgaagatcctacacgtctaacacccacctcggcgagtgcaccagatcatagctctgactaaaaaataacatatatcagcacccgcaaatgcaagacagtctacagttgatattgtttcagccaagaaccatacatggttaagataatatccagcaaatcaaaattgtttgtcgcgagtgaccatcctttggccatctttaagatttgagcagaattagtaaggcttgaatttcctctgggccctaagttcctgtatccttttcttatcctgctcgaacttgctctgcaacattgccagttcactgaggtgggcttctcttttctgaaatctgtagaagttcatatcaacttccttgggtttcattttagccattttatgttgcattgcaccaagagatacagagccaacagctgttccagtttcagtatctgtggtctttttcctccctttgtgatgaaccacaactgtccatccatcttctgctgcacgggcctctctctctttcttctccttctcttgttgttcctcatgagcaacaataaattcatctattgcttcctgcaaggctttcaagccaggtctcttctgtttgtactccaagatccattttttcattcctctagagcagtcttcatcaactaatggaatctcatcagcgtttgcagtactaacatcaacatgtctctccaagttgttattatctttacgcgatgcatgcttgtctttcttcttggccttcccagattttttaacttccattttctttcccctctttaatttctgaggctcttcattatccacatcttcactcagtgctgcaagttggttgacatcagcactagtttcttcattttgattttcatgcagaatttcttctgcgtcagtaatcccagcagaggccttccctccctttaccttccttttctttttcttcagcttaggtgctccagcatcttcagtaacaactgaactttcatatacgactgcaggactgctactttccatttgcttctttttgctcttcttctttagcttcagtggagcatcatatttactgtctgacagtgattccaccacagcatctgccgtatcatgattactcttaacattggcatgcttatttttcttcttctgcttcaccaatggaattttctttctccttggcaattctttttcttctttaacgccatgcccggcagcgggttcgctatcgacggcacattccaacactctgtccttcttcctcttcagctgcttcctcttcaccccaagcgccaatttcttgtcctccttcgcttcccgcgaacccttcttgtctttggatttccccatagcaacagactagtaaccaatcggacgcggggcggacgctgggcggacgcgggg

SEQ ID NO: 23251 - DNA, 3174 bp, Zea mays
aaaataataataataataataataataataaccatcctttttttttttttaataataataataataataataataataataataataataataataatatactggttcttttgctagcattacttaatttgtttctcaaaaaaaatgtagtaaacacattaattactacatacaatggactcaaggtacgagtaggttctcatctcatctgagacccggctgcatgagcagctcgtcgaaagatgctcctccattctgctccacgctacctgaacccatcctgttgctgcaattggacacgagcacccgctccatggcaatggcgtcctggatctccttgagcacttccgagatgggaggcctctgggcgcccttgggcttcacacacattatggccacctccgcgatcttccacaccgactgcaggtcatagcagcctctgtccaacgactcatcaatgatggcgtggatgttcccgctctcgatgtgcgatcgggcccacgcaacaatgttccggcagttgagcccaaagttgtcattcgagatgggttcatgcccagagatgagctccagcaaaatcacgccgaagctgtagatgtcgctcttctccgtcagctgctgcgagatgtagtactctgggtccaggtatccaactgtccctcgaactatacttgacacatgagacccatccactgcaggtttcgaaagcccaaagtctgccacttttgctctcatgttcttgtctaggagaatgttactgctcttcaggtctctatggatgattgttggggagcatcccgtgtggagatactctatacctttcgcagaatcttctgcaatctcgagacgcttcagccagctagttatcttttcattatcagctccacgaaggtgctcttttagtgtcccattatgcatgaactcatacactagtatgtttttgccatcttgctgactgtaaccaaggaatgtaaccaggtgtctatgatgtattctggaaagcaatgtcacctcattcaagaattctctgattccctgatacgagtcattcgtgagaagtttgactgcaatctctctcccatcagccaactttccatagtatactatgccaaagcctccagacccaattcttctctcaaatttgtcagtagcattttcaatttcagataaagaaaatctgtgtgctgattctgtagccacttcactaaaatatgaaccaagttttttagctggtgctgctgcaatgacaacagtgtcttcatgagatttattctttctcctacatgtaatgaaatagcacccaatagcaacacccagtaagacaacggctccaatcaccacacatataataattatggtgtggctaatgccattgcttactatgtgaaggccactgttgcctgagaagttcaaaataatgcttctcttgaaaagtgcttttggaacctgcccagacagcttgttattttgaacatacaactctttcaggttaggtaggtcacccaaagaagatggcaattcaccagttaactgattgttctcaaggtgaatatactgcaaattcccacattctctgaaatcaggaatttggccagaaaatgaattaccatcaagccttagctcaaccagccctgatagctttgtcagttccaccgggatacttccggtaatgttcttcccagacaatgtgattgagaatatccttggagaagtttctgaactgcattgcacccaggaccatgatgctggtaagcacggatcaccaccctcttgtgcccaactttcctgtggatatcgtgataccatgctggccatgatatttgcatcctgtgatcccatagtaatttggacatatttgtaaatctccagggcattcaaaataggcccctttgaagaatcattcgtcttcctgaacccaaaggagaaaacaaacggaagtgacaaattcgtgtagcctggttcatacaaacggtatttcccttgagcattctcctccacatcaacagttggtttactgagtgctggcatgccagggacctctaacttaaatttcctcgtttcatttggtgccaaatcttcaatttctgcaaaatacgagactccccaagcatttgctgggaaaccttccaaatcaaggcggtagttcaatgacccatcctggccaactactgctgtttgcatgaccttttcaggtggttcttcgttggtaccgacaaatatgggttttgtagttgatattctttcagtccctggagcaacatcaacaaggtaatttgctctcctcacagaatcagattcccagattctatcaaatggatcatcaggatatctcactgaatcattgcttcctgcgccaaaatttatcctcgcagacagtccaagaaagaagcgtgtctcgtcagtggtgtagtagagcgaaccgttaaactgtcgaagctccagagtagagatgaagggctgtcccgtgctggcattggagagacatacactgagcgtgggagcagcagccaagatgatggcttcctcaacgacgggggtggtggcgtcgtcgacgacgatggtggaccagggagacgctccgagggagatatcgaacttcgggtagacgttgctgttatcgaagttgccgtagaggaaagtggccctgacaaggtagcgcgtcctgttcctgacgttcatggtgtagcagtgcttcctgttgtccgcggggaagtagcgcacggtggtcagctgctgctgggtctgctgcaggccattctggaccagcagctgcgcggcctggccgccagagacgaagctggcatcagaggtccactggatcccaatggcatccgtgtgatcacgagctcccccgcagtccaagctaatgaaaccaggctgcgcagcggaaggcgagaagaggagcagcagcaggtggaagaggatagcggcggagaaggcggcagccatggaagtcggcttgcaagttcctcctctctcgcagcctccgccaccgcaaagcacagtgcgccacttctgctgctgttgctgttacaagcaggcaggcaggcaggatcgatctggtagtagtcctagtactagatcagtgtgttggtggacatggttggagaaaacctgaagcaaggcgatggacatccagctttttcggccgctccgtctgcacgcggcgctcgt

SEQ ID NO: 23252 - DNA, 771 bp, Zea mays
ctgcaggcatgtaacaaattagaacatatgggagtcatgctaccattctctaaagaacagcatagctatttggtctacataaaaaaagagcagacccagtgccggagcctcccacatgagtgaggtatgggtaaggaataaaccgaaacaagccttccccttgcaaatgcggagaggctgtttcgaactcataacctggtgattcagtgagacaggcagacagcttctcacgcaggtcaagaaacccgccaaatctctgccccactgatgtgggacagacgaaggattttttaaccctagtctgaaattcgcctgaaattcgctctcacggggagttgaactcaggactaaagtgctactctagtcatctaaccaacccagctagaggccgtttcactcaaaagcatgatctgaaattaataatctgctttaaggacagggtactaacttcaaaataatgcttctcttgaaaagtgcttttggaacctgcccagacagcttgttattttgaacatacctgcaaattttttcattcataataagagaggtcttttttccataaagatcctcacatagatgtaatcatatgaaaaagcctaaatcactgacatcaatttgccttttggtttcttgagcagaaaaaaaaagaaaggaatacaaaaaaaaaaaaaaaagaagaaaaataaattgaaggaatattatactatggcctccaaaatgtggagattaagaacaaggtgtacacgtggatgtttaacttacaactctttc

SEQ ID NO: 23253 - DNA, 1723 bp, Zea mays
acgcctgcaggtaccggtccggaattaattcccgggtcgacgagctcggttggacatgcccaccacacaacagaaaatttccataaattttctactaattgtttccccagaatgtttgaatttattctaatagataagtttggtaaggtaaaaacaaaaaatgacacgataaatgcataacaaagtagctctaactagcccttcttgttcattgtcatccattcatacttcattgataaccactgaaagcgctcctcgggtgtatccaaagtcaagaacatttctctttcatttttttttggtaaagacttgagttgcaatgaagtgctctttgctgccagctatagcaccacatgccttcaccaattgcataacatcttttatggaagatccaggtgtctcttgtgttcttgccaggaacatagactcacaagatgttgtctgcttattcaattcaacaagtttagacatttggtcttgcatccattgtcctcccgtagtcttcggttttttacctttatctaattgcataacatcttttatagaagatccaggtgtctcttgtgttcttgccaggaccatagactcacaagatgttgttgtctgcttattcaattcaaaaagtttagacatctggtcttgcatccattgtcctcccgtagtcttcggttttttacctttatctgtcacaaccacacgacgtctcttggatgtggaactagatggtgtgtcttccccacaatcactagcattttcatcttcaatgttgatggcatcgtgtatttgtgcttcagtgtcttggggtagctcaccactggttgggacccagtgatcatcaccggtgtttcgaagatcttcaaacatgacactcaattcttctgcattttgaagtgacttgtctttaaacttgctaatgcctttgaattgtatgtttgccttctcccaccaccaatctggagcaacatacaacttcttgttagggtcccaaccacatcctgtctcttttcccaattgtttccaattactataatcttttttcagcttgtcccatttatttttgaactgtagctcgctgtaagttttccctgtcctctctttgaacttgaccattacattgttgtacccaagcttgtttaagtgagaacctgatctgttctttgctcttacttcctcagcaaatatttcacaagctatcttaacattttcatcgcaccagtctgcattatcctcctccatggttctgatctgcttgatgacgatcttgcggagcatgagctcctgggaacggacacgctgcataagctccttaagcgcgagcaagcggttctccgagtccttgatgtcgagaagggtgtgcgcccggatgaggcgctccgtgccgctggaccgcatcttgcgctccatgatcgacagcgccggctccagattcccgtccctcacctgcaccacgatgccccgagcttgctgcacctgcccgctgtgccctgcctccatcaccgacggccgcgcagccgcagccgcagccgcgagcccacgcgccgcccgtgccaccgccgcagccgcgagcccacgcgccgcccgtgccaccgcctgcatatttctctttcgtctcctcccgccgccaccgcacacactcgatggagcgtcggattcggtatgttgggtccagccgtccaggtactatcgtttttcgattaggatgttctaggtaatggtctcgtgc

SEQ ID NO: 23254 - DNA, 2328 bp, Zea mays
ttgaataagagtctgacaccatttctagaaaataatggtggataagcaagcgaacatgatttagcttattttcccttaaataatgggggcatgaataagtagacaagaaaccaatgaactgcaatttatgcatgtttctgggtataactaccaatttagatacatggatttcactcaacagttacataagcaactgcaactatgtatactatcaaatataataaacatacaacacgatcttcccccatcagccacatggattgaaaattcaagccatcatttaaagcatggtaaaaatttcaggacaatttagccctcactgtgaacaaaagttatttatttggtccgtattaagttggttaaccaatgaatcatcaaatcataatactgagagcaaaagttgccaacacacacacacacacacacacacacaaacagaataacaaacagttatcagaactcctaaagataggagaatcacctttgtaccaaattctgattgtccaactggtcgaacagaaacgttcacatcacaacgaagggaaccttcttgcatattaccattactcactcccaggtacctaacaatcctttgcagttcagcaccatactcagcagcttctatccctgttctcatgtctggctctgagacaatttcgagcaaaggtacgccagccctgtttaggtcaacctaaccagccaaagtagcaaccactgatcaataactgaagctgctgtacttttatgtgatgagacgctgtgtaattcttttcattccctctggatttcccctgtcaatattagagcagtgtttatggtttattatctgtatcattgtattgtgttccatatgtcatacttacacaaaaaaacatactttcttgtgtgagcctatcacatgcatttatagccagatgattcaaactttcaaatagttactttcaccaggaagatgggactgctgagattatacctagctcccccatctgttctacaaccagcaatagaaaaggattaatgtttggccataattctgaatagcagttgccagacttttttttcactgcagcgctacttttcttttggtgccaaactgatttggctctcttcacagagcaagcttttgctcgtgattgcagattatattgccccaaaataagtcttttgaattttgatgtcctataaaacttcaatcctttcgctgtaaagctaggatcccccttgcctcagatccaaatgcccacttaaggtccctgatatacaatctttaatatttttctagggttctattcactaatctataagttttctaatgcaccgtggtaaatgtcaaaactgatcttgtggttacgaaactgttatgccagaaagacatgacaagcagatccgaatatcacaatatcttacagtagtacacagaaattaagcaatcaggtacgccagccctgtttaggtcagacctgagagtagctgctggattcagaatgaagcagcttgccagcatcttcttccatgtgaacccttgtgaccccaaatttcctatgcccaccaccaaactccactggaaggtccaaatcgacacaacccttcttggcaatggggatgtcaaactgggaaatctggtaccccttggggaggtccgggtagaaatactgcttgcgatcaaacttggacgtcattgagatctcgcagttgagggcgagccccagcttcacggcgcactcgaccaccttctcattcagaaccggcagcgtccccgggtggcccatgcaggtggggcagatagtgctgttgggctgggaaccatagctgtaagggcaggagcagaacgccttcgtgacggtcgagagctggacatgggtctcaatcccgatgatggcttcgaagccttgtgttttctgctcagccgcctccttggtcgccagctgaattgacctgggcgccgctttgggttctgtggcctgcgcactctccgccctagtcgtgaagcgggacaaccgaggccgtaggacagtggagaagaagccggagttcgatctgaatggtatcggcgttctcatccctcgaagtagggttacagccatcctcggcgaatgtgcctcccacaaatttacaatcgctggtggaaaattatggtggtgggacgggcgagcagcaagtacggagaagccgagggcgtggccgccggaagtggttgtgggagaggactggggtgcagaggaagagcggcggagggcgtgtccgcgttgctggcgagtggcgggggtgagagaaacggattgggtgcgggcggcggagcggcgggattggctgcgagagagttgtgcc

SEQ ID NO: 23255 - DNA, 2067 bp, Zea mays
tttttttttttttttttggttttttttttttttttttttagggcaagctatcgcataaaatataatgaacacgcccttttaaagtatcagcttagtacaatgatatctgtattgtggacaaaacttctacgtcgttcacattaatctcattctatgaatttgaagtcccattcttcatggacgcctgagattcagtatgggggtaaaaataattatttggcatttagcttctctccaagaattttattcaacaaaactgggttggccttccccttcgatgctttcatcacctggccagcaaaaaatccttgtagcttagtttttccagcacggtactgctcaagttgctttggattatcagcaattactttatctaccattgcctcaattgctgctggatctgctatctgaaccaaatctttctcttctatcacagccttaactgttccgcctttggcaatgagctcggccagtatctccttgccgatcttcccacttatagttccattcttaattgatgctatcagttcagaaagctctagaggtgttaatttaatttcatcaatggatactttttcatctttgagataagcagcgatgtcacccatgatccagttggcagccagctttgcatcagcaccatgctcaagagtagaatcaaagaaatgaccaatattatcatcattagcaaggaacagaacatcttgcatgctgagtcccatattctcataacgcctacgctttgcttctggaagctccggcattgacttgctgatttcattaatatagtcactagtgataactacttcaggaagatcaggttctggaaaatatctatagtcggcaagtccctccttttttcgcattgtaaaagttttctgagaagattcatcccacaggcgggtttcttgtacaatttgatcagcctggccttctttatggagcagaatctgccgggagatctcataatcgattgccctatttatcgcagaaaatgagttcatattctttatttccacctttgtaccaaattctgattgtccaactggtcgaacagaaacgttcacatcacaacgaagggaaccttcttgcatattaccattactcactcccaggtacctaacaatcctttgcagttcagcaccatactcagcagcttctatccctgttctcatgtctggctctgagacaatttcgagcaaaggtacgccagccctgtttaggtcaacctgagagtagctgctggattcagaatgaagcagcttgccagcatcttcttccatgtgaacccttgtgaccccaaatttcctatgcccaccaccaaactccactggaaggtccaaatcgacacaacccttcttggcaatggggatgtcaaactgggaaatctggtaccccttggggaggtccgggtagaaatactgcttgcgatcacacttggacgtcattgagttctcgccgttgacgctggcgagccccagcttcacggcgcactcgaccaccttctcattcagaaccggcagcgtccccggggtggcccatgcaggtggggcagatagtgctgttgggctgggaaccatagctgtaagggcaggagcagaacgccttcgtgacggtcgagagctggacatgggtctcaatcccgatgatggcttcgaagccttgtgttttctgctcagccgcctccttggtcgccagctgaattgacctgggcgccgctttgggttctgtggcctgcgcactctccgccctagtcgtgaagcgggacaaccgaggccgtaggacagtggagaagaagccggagttcgatctgaatggtatcggcgttctcatccctcgaagtagggttacagccatcctcggcgaatgtgcctcccacaaatttacaatcgctggtggaaaattatggtggtggggcgggcgagcagcaagtaccccggccccccgcgcggggccgccggaagtggttgtgggagaggactggggtgcccgcacgagcggcggagggcgtgtccgcgaaatgaaaagtggcgggggtgagagaaacgctcgagccgaattcgagct

SEQ ID NO: 23256 - DNA, 4019 bp, Zea mays
ccactcccctccctcctcttccgtcgtcctgcagcgtaatgtaagaagatggttagccgccttctttgactgtatgccatacaaactgaatgaatccggacgtggcaaatgtaatccaggccagcactttaggtggccataccctttaaaaaaagggtggccattatttccatatgaaacttgctctttcgtctacaactcattttaaggaattaagtctcttcttctaaaatgactaaatatatacaaagaagtactaatatttatagcgtatattaggtatcactagattgatcatggaatatacttccataataaaattgctcagcaatgaaaatattgatactattttctatatatctagtcagatttttttaaacaaaagaatcgcccgcgtgggtcgccccggggtgccctggccgtgggatggagggagggagtataagaaaccaagaaatcatattaaggccctgtttgggaacacagttttttcaaaatgcagtttttcaaatactaaagtatactttagtcatgacattactacagtttacaatgcttcagttttcgaatacaacagtatccaatacatcaaggtgtttgaaaaaaactttggttaagaccaatcagccagagcgggacccagctgacgctctctttacagagaaaaactttggccgagactaaagttttcaaaactgcaaaacaagtgcagtatttacaatactacagtttagtatacagagatttcagatgagttgtcaaacacctcaaagtatataataccataatattgctcaatactacagtattgcttcgatactgcagaaaaactttgttcccaaacgcccccttaggtttacagcaagtttcccgtgttctcttctaagattatataatccagcttatagaagcacttgcttacggattattataatctagacatctagattatataatccatctaataacctgtgatgtttgtttatcatttaacttatttaaattggattatataatctaaagaataaacaaacaatgactgtgatgtttgtttatcatttaacttatttaaattggattatataatctaaagaataaacaaacaatgactaaggggtgtttgtttaggattatggtgtgtccaaattatataatccaattcaaaatttgttggattatataatctagacaaattatgatcctaaacaaacactcctaagtccttgtttatttgtccagaaatagatcagaaatcgttccagctaatcaaaacttatataaattagagaagcaaaggctaggaattgtctcatatctcaattccaggaaaaaggaacggtccctaagtgtgcttgtctttcattctctatacacgatatcttgaccacggagttctccacataagttattcgtctctcctagacatcaggccattgcataccggtgatagaaactagaaccgtcatagaaacaccttgtacctttctttgcgaatgcaatctcctcccaccaagtgctcaactgaagagagccttgcgtgaactgtatcatctgcgcaccaaagtgttcccaggctagaattcgaccctgtttgttttcgcttatttgacagcagcaggggtgagaatcgtataatcccaataaacaccctgcaataaacttgcttctcccaatcgcgccatcgtccaaaatcgaaaactgaactactaatcaagaataacgtcgattacaagaatcatgtcctagaaaacgacgattacaagaatcatgtccaagaaaaacagagccgatgtgtacagtggtggtgatccaactctttagagctgatttggtgacgaggattagaagagatctatgggggaggaaatctcttgccattcttttttatatatagcaagagatttcttctctatgggtgcatttttgtgaatggctgcgtattcatcagttcttgaaagacggttattgctggcagcacttcgaacctagtgagcgtccaatgcaccagcaaagcaaggtttacatgctgcacataattctttactgcacgatggagatgaacaaacaccattgtgattctgcagatgcacgattgtagatgctgcgtggaggaaacggcatgtcatcaaggctctgtatttctgatactcttgtacttttgtgataacatgagcaacgatgagaactgtgtaccagcaattatggtgtgactgagtggatgggctgcacaggaaagcaccctttgggataaaggaacaaacttgtttcctgcaggttgattttccccggagactcttgtttcctctttgtagtccacatggcatgcagagctggtatctggatgaaagtctagtagatagattccatcatatgaggaagatccaactgcatagattgaagatgtcagcagccaggttggctttcttaattgcttttgcagcaccaagtctgtgccctccaaccaagcaggaggagggcagtgaagatgagtcacattgagattgttaacattcaggactccagaccagccatcatcaagatggaaggccaattgatatgaacaactagggttgaagtctatcgacagaatcggacttgaaacaatgtttgattgttcctttagcgatgcaattttgcccaataacgttgataatttcactgacatcaattgctgaacctcgttgtggctttgaaaagcagctgatgccctccctccacggagatcccaaacatgaattgtgccatttttagttgcaccaaacacagtccgattatccacagttaacttgacagtgttgaactgagcttctggagatgccacaagctcaagacagtgtgtcttacttgatcgcctgtcccacatgtacactgccccatcaaggccagatgcaaatatccgtgacttatcatctgaagtaaaagttatatcagtcaaactcttgcaggattcagagtagagcgaggggaatttcgattttcctttatgcaaaacttcagttggtgtagatgagacatagccaatatcaaagaggaaaacgttatcactttgacttgatgtgcaagcaatctcgtcttggtttcctggattccatcggacagcatttaggggaattcggttagatatatggagcacataatttgatgattcatctggcatactgcatggtgggccatatttagagcagtacaaagtctcaaagtcatgcaccgtcagacaccctgagagtgtcactgatgcaatgtatattccctttctatcgaattctattgctgaaacaccctcccttactggatgaaaatttatagttgaagcactaatcattcgatccacgtatgtccgacacctttcctcgccatgaatgtaatacttgtgatcgaaggccccaacctcggtgaaggaatcaagaaggaggcgcgaatctctgtgctggaacctggagtctatgcggccgtccagctccgcgatgatgcgcctccaccggtgtctcctaggaggcggcgcgggctcctcgccacaatgaggcggcgccggcacgaggaacttgtccatagccgacggctagggaaggcaccactcgattagggttagaatgcctgtttggtaggactcccaaccagctcacacgggctcccgctccagctaagctccatgtttggtagcggtagcgctcccgaactcgctcactctcgacggcgcgggaggccgcagcggtgcaggatgacgaggaaggcgagctgtgagagatcgccgcggctcgggaagccctccaggaagccgtgaagtaagaggaggctcgcagagaccgccgccgccgtcgaatcctgccggagaagggcggcgggagcagcggagaaggaagcgacgggaaaaaaagcgatttcccgccgcgcccggccgggtgccgccggaatgccggatgagcgcttctcacgcgagcaggatgccgaatcgcggcggcgtttggaagcgcgctcccgaatctcgccgagggagccgagtacccccggcccggccggcc

SEQ ID NO: 23257 - DNA, 1617 bp, Zea mays
caaattatcatacttatttattttcttctgtttcaatcttccacatacattttacatgaatgatacaaatatctatccaacatagtctttggtccctacgtgaatcatactggctattgtgtaacctacagttgacatctccaaagcagaggcgagctctatagcttgtcgaccttgttttactgtttatgcggataataaatggctttttgggaacatatactaacgcttgcgatgcccgtagttcatcttgatgactttgatggtagtttcttaaccagactagtgttaccagttaccaatagtcgagcacccttcaccagctcctccttaatcataaaaagcaaagcagaagcaaaaacactttgcacaatttttgtgcccattcctttgtacatccctgacagaccctcatatcgtaccatctttgtgaacgcatcaagtgtacctttgtagcgatgcctcttgtcatcgttaatcatgtgctttgcctgaagtcttgccttaacaactagaaggggatacgtaacgacggttgcaccaagtttcgcaacagcaccaagaagaaaaatttcaagagcagtcaatccatcagctcccttgaaattagaggctcgtctcttcttcaatttcttcagaagagtctcatatagcatgaactgaattgcgggattgctaaccatgataagagccggaattacccctttccagaagccaagaactccagattctttgtagagttcctgaaaaacatcaattgttttatatggagcgttttcagctgtagcagcttcaagggacttatcaagagcacaattcaaaccctgaggtctttgctgtttgattgcctttctgtgagtttgcattcgtgtaacaacaacccaaatcgggtttgtgaggtgcgtgagcagtacattgacacagccagacagggcagcgacagtgagagactggagcatcccgacagacccatcgccaagccctctcctggatcgctcaagggcccttgcctcggccctgttccggaatatttggtagaagtagtagtagacaccctgggaggcagcggtgccgacgagagagggcataagcccgccatacaggcgctcccacccctcgttcttcacaaccagatacaactggcgagcggcgccgtccttgaacgccggcttggaggggtcgcgctccgtctgttgccgcgcgttcacggtctggagcgggtaggtaaggagctgggcgatgatcccgccgccggcgccggcgaggccgttgatcagcgcgtctgacatcttcccctgcttgtactctccaatctccgctcctcttcccttccccgcttcgccggccggcggatcccagcgacgagccgagcaaaactggactccacgccgcccccacagcgggttgcttccgccgcctgctgctcggtgtccttggattgtgggagacggaagcgaggacggggcgtgggcgtggcgggcggagtggagagtggacgactcgctcggctcggcgcggcccggcgcgcccagcggtcccgtcccgtctcccgtgcttttcttttcgttaaactttactttatgtacggtacataaatagtaccggtgaactcaagtc

SEQ ID NO: 23258 - DNA, 1683 bp, Zea mays
ttttttttttttttttgtttttttttttttttttggccgaagttcaaattatcatacttatttattttcttctgtttcgatcttccacgatacattttacatgaatgatacaaatatctatccaacatagtctttggtccctacgtgaatcatactggctattgtgtaacctacagttgacatatccaaagcagaggcgagctctatagcttgtcgaccttgtttacggtttatgcggataataaatggctttttaggatgatatactaacgcttgcgatgcccgtagttcatcttgatgactttgatggtagtttcttaaccagactagtgttaccagttaccaatagtcgagcacccttcaccagctcctccttaatcataaaaagcaaagcagaagcaaaaacactttgcacaatttttgtgcccattcctttgtacatccctgacagaccctcatatcgtaccatctttgtgaacgcatcaagtgtacctttgtagcgatgcctcttgtcatcgttaatcatgtgctttgcctgaagtcttgccttaacaactagaaggggatacgtaacgacggttgcaccaagtttcgcaacagcaccaagaagaaaaatttcaagagcagtcaatccatcagctcccttaaaattagaggctcgtctcttcttcaatttcttcagaagagtctcatatagcatgaactgaattgcgggattgctaaccatgataagagccggaattacccctttccagaagccaagaactccagattctttgtagagttcctgaaaaacatcaattgttttgtatggagcgttttcagctgtagcagcttcaaggggcttatcaagagcacaattcaaaccctgaggtctttgctgtttgtttgcctttctgtgagtttgcatccgtgtaacaacaacccaaatcgggtttgtgagcagtacattgacacagccagacagggcagcgacagtgagagactggagcatcccgacagacccatcgccaagccctctcctggatcgctcaagggcccttgcctcggccctgttccggaatatttggtagaagtagtagtagacaccctgggaggcagcggtgccgacgagagagggcataagcccgccatacaggcgctcccacccctcgttcttcacaaccagatacaactggcgagcggcgccgtccttgaacgccggcttggaggggtcgcgctccgtctgttgccgcgcgttcacggtctggagcgggtaggtaaggagctgggcgatgatcccgccgccggcgccggcgaggccgttgatcagcgcgtctgacatcttcccctgcttgtactctccaatctccgctcctcttcccttccccgcttcgccggccggcggatcccagcgacgagccgagcaaaactggactccacgccgcccccacagcgggttgcttccgccgcctgctgctcggtgtccttggattgtgggggaccgaggacggggcgtgggcgtggcgggcggagtggagagtggacgactcgctcggctcggcgcggcccggcgcgcccagcggtcccgtcccgtctcccgtgcttttcttttcgttaaactttactttatgtacggtacataaatagtaccggtgaactcaagtctttttgattaggatgttctaggtaatggtctcgtgc

SEQ ID NO: 23259 - DNA, 1733 bp, Zea mays
tttttctttcttcggacggacgaaataatatttcaaacaccgatactgcttacaaacagaacatgttcttagtttgcaacactacatggtatacatcagtaccaaacctaatgcagaatcgatgcaacaaatggcatccaacaccatcacagacgtgagattccaagcatgaacaggtacaattgaactttttgatagcttttacaatgcatgaagatacatttgaactttatgagagttcccgtgaccatgaccatactggaagtgtgcagttgtctctagaaggcatcaccctaatagttgccaggccgtggaacttctcggaggaaggaaccatcccctattctgaaatctgacacagggacgctacgcccaccagcagtgggcatggatagcaacatggaattatgaggatcatagtatggatttagtgacaacccagaaccatactgagacaaggatagagctggcataatatgatcagcatggtagcttggcgacacgtagggtggactcaccgaggtcaaactgaaccatgaaccatagccatcccttgtggccatctcatctctgggaaatgaatctattggcaaacgaaacaaaccagcaggacctattggtaccttcacatcatcatgcggtaataccttgttaaggtagtctgttggtgttggtagtgcgagtatttcctgactgacatgggctgtcctgcagagtgaaagttccatgccattgactggcaaatcatccggtgcttcaagtgccaatatgttcttgctggctggacttggccagctcaactttgctctgagagacatcttggcacgtcgaagggcctctagcacccctcctacatctttgtttgatgattgatgaagttgtgtatcaagctggttatcggtatggttatgaaagcaagaggagctccattctgagacttcgcttttaggggtatcacttagctggctcccaactgatgatgtgtttatgtattgctcagaagatcgagcattcacatggtagcttgaaccactgtctgaattttcatctccttgaccatttctatgtcctgcatttagtctgctaccacagcttccttgtggtggcagagctgatttcccaagattattgccacttccttcaggatagcttttagttgtcagcacatccttcctaacctgcagttctccgtggcttgaaattactgctgcagcagtcactacacaatcatgaccaaacccatcaaatttccggtgttcagtaacactatctttggctacattttggggcaattctgaaacagggccatttggtagacattcagaggggtcgttgatgcaatggaaattattgtcacttgatcttgcctgttcacaaaccacttctttatctacaacccgagcagtttccctcctcccacaagcattttcagcctgatttagcttgttgtttaataagttaacattgtccataactgaatcccggctcaggctgaatttctcctcccactccctctgagcattttcttgagcctcgaactgtccaattagctcagcctgcttctcgagtaccctctccatctccccatcctcctcatataccatggcaagatcatcacgatcctccactcttccattactagaagagccatgcccatcttggttcacctcgccatcaacatcagccggctgatcagtgcaaacagtacaatctgatctctcctgttacaaaaa

SEQ ID NO: 23260 - DNA, 1707 bp, Zea mays
ccggccggtccctggtggagtcgaccgatcgagctagatctccaggactcacctccccaaccgtttgcctccgtctcgcgtgacttcattcccagcggccggcggcgacctccacgtggtgccattcgccggcaacgagcacccgcccaccaggatccaggtttgtgctgcgagagcgcctatccattcaccatgattaatttcgtgctcctgatcagccgccagggcaaggtgaggctcaccaagtggtattctccttacacccagaaagagaggaccaaggtcagtaccccacactgctctgtgtgataactcgtgtaattcagttccggggttgctttattcatcactggcagagtggcagtgggtgctaatttctgcaggagttaaggctatgcatgctagtttgtgtcaggactttgcagtcatgacttttgttcccaacaaatcgatgaacattagaagtgaatgaatagttgccatgttgtaacaagtttgacgtacaatatgcatgtcggttgccaacttccaaagctatatcttgatccagcatacatgtttctgtatagattatgatgaatgtttttttgctatgtaaacttgaatatgtgttaattcttgttgtttttcctcttgttgtatttggtatacattcatctgaacaatttcccgtttctcctactcgctgccctcttccttgtttattcctctaatgtgttgctgccttgctgggtaacaagtgagtgcggccccatgtattttctcaccaatttgatgaattcgtacagaacttactttagtacagtaatctgttggaagggagttcctgtcttccatcaaatattctgctttttaccagggtacctggtttcatgtacccatggatgttttgtttctttcaaactttaatagcttcatataattcccaaaaaacaagttttctagcggtatctattaaataacatttctttgtgaggcgtattgctgcatgcttgtttattaagtttgctactcatgttcaaaaaggtcattcgcgaactcagtggactcattcttacacgagggcccaaactctgcaattttgttgagtggagaggttacaaggtcgtataccggaggtatgctagcctgtatttctgcatgtgcattgatgccgaggacaatgagcttgaagtccttgagatcatccatcatttcgtcgagatactggaccgctattttggcagtgtatgtgagttggatttgatattcaattttcataaggcctactacatactggatgagattctcatcgctggtgaacttcaagaatctagcaagaagaatgttgcaagacttattgctgcacaggattcattggtcgaagctgctaaagaggaagccagctccataagtaacattattgctcaggctacaaaatgaagttcttcatgcctgccccccttccctctatcttgttattgttgtacaagcaactgtaatgcactggactgcgagttcatttgctctgctcatgtttatggatttcaagactccaggttatttagaatgagcgtgatgtgtaactacattgcatgtgttcccgttgcaagtaaaatcatgatttccaggattgctcaggcatacatgtaaattcctaatgttataagtggatattttgtcaacctcgttgattgttaaaaaaaaaaaaaaaaccctagggccaaa

SEQ ID NO: 23261 - DNA, 1021 bp, Zea mays
  misc_feature (1021)..(1021): n is a, c, g, or t
ccacgtatagttttaaatttcgaattttttaagcgggtcaaaaaagcccctctcctccctggtggagtcgaccgatcgagctagatctccaggactcacctccccaaccgtttgcctccgtctcgcgtgacttcattcccagcggccggcggcgacctccacgtggtgccattcgccggcaacgagcacccgcccaccaggatccaggtttgtgctgcgagagcgcctatccattcaccatgattaatttcgtgctcctgatcagccgccagggcaaggtgaggctcaccaagtggtattctccttacacccagaaagagaggaccaaggtcattcgcgaactcagtggactcattcttacacgagggcccaaactctgcaattttgttgagtggagaggttacaaggtcgtataccggaggtatgctagcctgtatttctgcatgtgcattgatgccgaggacaatgagcttgaagtccttgagatcatccatcatttcgtcgagatactggaccgctattttggcagtgtatgtgagttggatttgatattcaattttcataaggcctactacatactggatgagattctcatcgctggtgaacttcaagaatctagcaagaagaatgttgcaagacttattgctgcacaggattcattggtcgaggctgctaaagaggaagccagctccataagtaacatcattgctcaggctacaaaatgaagttcttcatgcctgccccccttccctctatcttgttattgttgtacaagcaactgtaatgcactggactgcgagtccatttgctctgctcatgtttatggatttcaagactccaggttatttagaatgagcgtgatgtgtaactacattgcatgtgttcccgttgcaagtaaaatcatgatttccaggattgctcaggcatacatgtaaattcctaatgttataagtggatattttgtcaacctcgttgattgtctgttgtgttctccaaaaaaaaaaaaaaaaaagcgccctan

SEQ ID NO: 23262 - DNA, 649 bp, Zea mays
ccccctcgagtttttttttttttttttttatacaaacatgaagctattattatatatatagaaagagcagtccttgatacatcacagtaatacctgagattaaactggctagaagaacggcctcatctagacaggaaaccaaaaatctagtacataggcttcttcatcaggatactaaactcagttacaaaggggattcatcctaaaggacaccaccacctcttccaacgcgcaggggtgcgagaacaaaaaggctacggctctgttcttgatttcgaacgaacacaaccacagaacgggacccgcttcttctttcccttctgcccgcctccacggtccttccttccatacaggtagtccctcaaaagcacacgagtgcgcttatcagagactttgagccttctgtactcgggctcctcctcaagcttcagcaagacgtactggatcttctggagctccagttccaaccttgccacgttttccgaccctctctgcacctgctccgagatcttcctcctgctggaataccctcctcgctcggtgctcgtattatctgacaatgcgggatagttctcaaccttcctggtcaacttggtggtggaattgatctggtccaagacaagactttggtactcatgcgcgctacact

SEQ ID NO: 23263 - DNA, 1126 bp, Zea mays
ggggggggggggggaaccactaaaaaatttttgattttttcggggaggcatcctcacaggtatcagaaggtgtgctccttgcagctccagaaggggtggtcgatgtggtaattgaaacaggggtagcaacaccaaagcttgtaatggttgctggaggtgttgtagtcttagtctctggatccatgattttgtcaatgtttacatccaagccagccaagaactggtccagcattgcctctgtctgtatgcccttggcactgcctgagcttttccttgaccatggagttgaaggagaagagacatgcttctgcaatggtgtggagggtgacattggcaatgccatgatcagtctctcaccaccagggctcaaatggctggaaccaatcctagattgccccgaaggccgagatggtgtatagctgaacgaagacctcctgataggcacaattggttccgatggtgttgatggcttggtcttgggaggccttttgatttgctcacctttcccacctccttctgaacctgccatctttaacccaagaagccccagttggcgatcagacaagacaaccttgtcggccttggccagtgccttctgcccattgtataacatcagtgccctgaagaaccccagcagtgtgaaaagtgcaacaagaccgagtgctgcttccaccaacctaatgacaaaaacagcagcaaggacagagatacccgctcgtccggcgagcttggtgagctgctcctcccgggaggtgagggcgaggaaggaggatgcggaggcgacggatatgaccgcgaggacgaggaggactgtgacggaggggcgggcgctgcgggagtctagggcgcgggtgagggacgggttctggtacaccgagaacttgtcccgcgccttcccgtcgccgccgtgatgggattccatcactgctctgcgtgaagcgatgcacggcggcgtcgcagtatggcggaggcgtgcagtgcagtgctgcactgcaggcaccgcgggccagctatttcccggcccggcccgcctcgcggggcccgaattcaagggacaaggccacagggggtggcaaacgaccaagcacacagtccgagagacccagcccggcccggccggcctcga

SEQ ID NO: 23264 - DNA, 1497 bp, Zea mays
cggccgcccttttttttttttttaaagagtttgttccggttttttaatgaaggattcaaagaacaataataatatagtcacaaatccaaggtaccacagggcatattacagctagataaagctatgtcaattccaaacatgctagtgtaaattacaacattaacaccagtaaactagcttgacataattcatcccctcaagactaccaaactaactttcagctttctgaatctgaatctataactgacaggagattcaaggcagacgaaccgatatggattcctctaaccacaccgccatacccaacgtttatttggtgacataaaagtagaatggcatcccacagagctgttcttccctgaagagaaaattgctgcttcttgtcccagtatagagcaaaaattggaggattctgcttgctcacagccagtataagagcccctgggtgaataattgctggaacacctgatatcagagcaacatacttttctgggaacctctcttttggtggaagaactcccagaaataagggatttttgctggactgggaaccagagtacgaggtagggtcaacatgaagcatccattttggatgttcaaggaaagcagcaaacagatacagaagaaggtgtgagtcagtaggtagctcggtggtccatttcttttctgatttaccatagtcatttccatgacccatgtaatcataattcttcaagcatgttccttcagcgagttcttgaactctctggacagtgtaatcagcacggacactactctgtggcaacaagccttttatcagctctcccttcatcagagtgttgagcctctgatgctctgtgattgcatcaatacatgcttgaatagctggaaggtgggggttccgttgtggctgttgtagactgccaaaagtttgcgcaacaggggcatctcgagaatgtaggagtgcagagtgtaattggttaaggatcccatcctcatctaccgtgacagtcggttgccaatctttagtcccaccaagaggagacaaggcaactggtggtgttgtgcttggcagatcacttccaacttggctaacagtaactgaagccccaacagtagctgttgtttgcttaacctgagtatggcttgttttgattttttgtacaagtgggttcatcacaactgaagaaaaccactgcctgagactatctcgccactgctcaatctcaggatatacacccaagttctcaaaggcctccactgcttgctctaaggacattggagttggaagttcaccctcacccttttttggtggcgtgctgtatttctgatgggagccaggagacatcctcacaggtctcagaggtgtgctccttgcagcaccagaaggggtggtcgatgtggtaattgaaacaggggtagcaacaccaaagcttgtaatggttgctggaggtgttgtagtcttagtctctggatccatgattttgccgacgcgtgcggtcgtgccgaattcgatct

SEQ ID NO: 23265 - DNA, 5747 bp, Zea mays
tggcgcagactcctcgcgagagcgatcccactcgcccccgcctcctctggcttccccaaaccgctaagccccctcctccacatcggtggaccgcgcctaaccacctcttccggggaccccgtcgcggacggtggcatcggcggcgaagatgaccctttctgcttcccggaccactactacgagcagctcccgcccgatgtcgcccggggagtggacgccgtcgtagcagctgccgaggccaccggctccaatgccacggacgccgcgcgggccctcgacgggtgcggcgccgaggcgtccgagccgctcgtggtggcctcgctggcgcgcctccggaacagctgcgccgccgcccatgccgcgttccggtgggccgccgcgcagcccgggtacgcgccgggccggcgcgcgtgccactccatgctcgacatcctcgccaagcaccgccgcttcgacgccgcgcgcgccctgctcgacgaaatgcgccgcgcgtccacggcgtctccggccgcggtactgctcctcgtccggcgccactgcgccgcgagggacgtcgcgggcgccgtcgccgccttccgagcgctcccgagcttcgggttccacaccggcgccgccgagttccatggcctcctgagcgcgctttgccggtacaagaacgtgcaggacgcggagaatttgctgatatcctggcagaaggagttccccttcgagaccaagagcttcaacatcgtcctcaacggatggtgcaacattgtctgcagcgtgcgggaggcgaagaggttctggagctccatggagagaaagggcattgccagggatgttctgtcctatgggagcatgatctcctgcttctcaaaggccgggagcctcgactcagtcatgaaactcttcaaccgcatgaacgaggctggcgttgctccagatcggaaagtgtacaatgctattgtgttcgccctggccaagggacggtgcgtgaaggaggcgaagatgcttgtcaggagtatggaggagaagcaggttgccccagacacggccacttttaactctctcatcggccctctgtgcaaggctcgtcagtttcaggaggcaatggaaatgttcgatgctatgttacagagaaagctgtctccttcagtaaggactttccatgcactgcttaatgtggctaggaactccaccgaagtttttgatctcttggataagatgaaacagttgcgatgtgagccagagatggacacttacatcatgttgatcagaaagttctgccggtggagagagcacgagagtgtggaaaagctgtggagtgcaatgcctgcaaatggcctgagccctgaccggagcgcgtacattgtattgatacatggtttattcctaaacggaagactagaggaggcagcaaggtattatgaagagatgaaaagtaagggctttttaccagagaaaaagactgaagaaatggtaatggcttggcttgaaggcagagagcttgccaaggcatcagttattagctccaagggtggtcgtggtccagtgtctctcaaacttcccaagaagtgacaagtttaaggtttagggtttagggtacgataaagttcaagaatgaaatgaaacgaaacgatatatgacggcgcttattgttattcctgtagaactgctaaagttcaagagatattttgctacacagaaaacgggggttatccctaaacctaatcttttggttgtcaaatcgtggctatcctctaatcttttggttgtcacctcgtggctatcctgtggcttgagtagtaaatcaatgatgcctaagagccgttggcttatatttatcagattactgataacatggtctaagtcaacgagcttatccttgtacggtctgaccattgtaccatatccttagatatgccgatgctgattgcaagtggctcaagtattcatgtcattttcatggtacggatccaatccaccatcaagtgtcagtgcaataactcagatggatcatgacgtggcggctaccgatgaggctagcgtttttcatttgaggaacgcaacaacagtcgaatggacactttgacagtcccggtttgagaaatagatttggttggttcaatatcacttcatcccactatataatcatgcgattttatccatccactcaatgaaggtttttttttctttctaaaacgcgcatcagagctgcgtgtcgtttcgttgatagatagaaaaatatctgaattcatagaaagacagggaaaaaaagtcaagccgattccattcactgaatgctactcctaccatttcatcatcttgaaacaactgtacgaatatataccagaataaagatgaaatgtcctagaccaatctcggttcaggccgaccatttgaaatatgagaactgtaattctgtactagtttcttcaagtagtgcaaagggagatggattttccttttggtatattaccaagcacacaatttaacaaatgaataacccttacaagactaccagcaacagttgcagaattcagaccctccaaattttaaacctgctgttcctagccagtctaaccactcctacgcccaagatcatctcttcccccttccatcacagcaactctcagaacggaggcaggatcgtctgccacatcttcgtcgacggcgagctcatagactgcaagtagccatggccttgcccagccgccagattcatcgtctggaccgggttcggattcaacacatgggtcacgttgtagggcgcctgcagatcatccagattcaggtccgtgaaccaatagttgtcctccttcaccgtcctcgccacgctgccaatgccgttcctcatggtcatggtctgcccgtgcaccatgttaccgaagccgttctgcatgccgaaggcattgttgtcgatgtccgagtcgtgcgtctggaagctgtcagacatggaatcctccgctgcgccctgctggtgacggaacggcgccgccgcctccggctcctcagccttcaccttctcccaattgtttttcttgttgtacagccggcacagcacccactcatccaactgcaagaacaacgcaaagacgtaagcgcactgaacgcagcggctgcagcgccatggctcgccacggaatgcaactggcgggatgaaacggccacacacgcaccttccgtgagcccttcttgcccggcgcacggtccgcgtccgcgaggcggtactcatgcatgatccagtcggtcttgaatcccctgggcgccttgccggagtagaagacgagagccttcttgattcctgccgccccgccaccgcccttgggcgcgatcggcttgtccgcgcccgttgccttccaataccccctcccggcggcgcggttggggcgcgagccgtttgggtacttgcggtcccgcggcgtgaagaagtaccactccttgcggccaaacagcgccttctctggagggaaaggaaccagagcggcacagagccaagttagaaattccgtccggggtttggatgaatggatcgacgagaagattgttcttttagtaaaacaagaaaatgttttgtttgcaacagcatgagtgagcaggggaagaaagaagagcacgcacctggaagatcccacgggtcgaatttgtaaaggtcgacctcggcgatgatgggcacgggcagctgctgtctcgccgcaacggcttcctgcagaggtagtgcaccaccagctcctcatcggtgggatggaaccggaaccccggcggcaggttgagctccgcctcggcgtccctccggccgcctccctgcgccgccaccattgccataccccctcctcctcctcctcctcgtcacagaaattcccggcgggcggctggatagatgggtcgctcgctcgctcgaaccaggttccagagaccaccacgtcggctccctcgtgctcggtttcgaaaggcggctggctggcactggcagccgccagataactaaatagaatcgcgttgtccgtggagagctgcctgtttccgctgcctgtttcttgcctccttggccaccaaggcgaatggagggtctcggagcgcgtttatatgggctgcgctgcgtagcccagctcgtgccgcctcgcgcggtccaggcgtggcgtggccccgtgccctcctccggatgaggatgggggcgacgctgccgcgaaggttcccgcgtggaaaaggctctgaccctgtcctgtccactccaccgccgttggtggcctgcctggccgacgacggctgcagcccacgcgcgacgcccaactcccgcaagggtcaaaagcttgtcgaggggatctcgccagtttccatccgggaaatgtactaaaatccgagcgagcgatctcggcgaatgggacgccccggtcgtcatcgtgaaagctctccgtggttttgactgcgtagcagtgggcgatgggctcggcgcgcgccaagggccggtggcggcgccgccacgtgcgcattgtgccgccgccgccgccgccgccgccgctgttccgggcatgaaggccctggctttctcgtcctccaaggactgttttgatctgcaggtttggtgctcggcattactgcgtccagttccagttccagtctatggaaaaattagggaaagtgccttgatttgaattgacaaaatcgcaccacgtcttccgatcgatgaacagctaagattcaaaacgtgctgtgagcagtgagcgacgtgtgtgtttcagtcggtatcaatgcgatcacgacagatgctactgtttcgcctgtcaactgctggctttcacacgcatctcaggcgcaggatcctctgcctgtcgacaacaaaggatatgcttggaatatattttttttttaaaaaaagttcagaagccaagccagcatatatatatgtacacactgctttccaatctatagcttgccccgttcgttcgttcatacgaggatggatgatggtctcatgcgtccacttttatttattattaataaacagcttagataaagagaagtcggcattcagcaggtggtgccgatgaaccagcttggtgcttgcctcctgcactggttggtcctggtcctggatgcatgctatcctgttcctgtccaggtgcgttcaaccttgcccgggtccgggtgcggtgcgccggcgggggcccgctcccgctctagctcgtcgtcgtcaacatccgatgcgttttccttaaattcctcctgccatggactaccactatacatgctatatgctatgaactacgtgtgtctccatatctagttgaaaaaaaagacactggaaaaacggggtccgtcagaaagcggtttctccactatgtttgtctgttcctttaagtaaaaaggagaacattgtgtttgcctgtagttagtttttacttaactatgatcaattatatagtttaaaagtgccccgcatgcaactgagcttttcccgaccagaacgtgtgcgcggtctgaagaaattagcttgttttggctgtagtttattgtgaagttgaagtgtactttagttttatcgccaatcaaattagagaatgtaatggaattaatttgacgacgtcccatatgttaatgctttttgtatacactttggtgaattagagaaattcgacttataacaaatctaaagcgaagaacggtaagagtagttattatatggcaatctaatttagatttgagtgtacattatattgtcggaaagaatgtacaaatttcatggtttattgatttaaaacgaattaatt

SEQ ID NO: 23266 - DNA, 1569 bp, Zea mays
  misc_feature (1523)..(1525): n is a, c, g, or t
  misc_feature (1534)..(1534): n is a, c, g, or t
  misc_feature (1541)..(1542): n is a, c, g, or t
  misc_feature (1546)..(1550): n is a, c, g, or t
agggaaaaaagggagtcgattccattcactgaatgttactcctaccatttaatcattttgaaacaactggccgaatttatacccgaataaagaggaaagtgtcctaaaccaatctcggctcaaaccgaccatatgaaatatgagaactgtaattttgtactggtttcttcaagtagtgcaaagggagatggattttccttttggtatattaccaagcacataatttaacaaatgaataacccttacaagactaccagcaacagttgcagaattcaaaccctccaaattttaaacctgctgttcctagccagtctaaccactcctacgcccaagatcatctcttcccccttccatcacagcaactctcagaacggaggcaggatcgtctgccacatcttcgtcgacggcgagctcatagactgcaagtagccatggccttgcccagccgccagattcatcgtctggaccgggttcggattcaacacatgggtcacgttgtagggcgcctgcagatcatccagattcaggtccgtgaaccaatagctatcctccttcaccgtcctcgccacgctgccaatgccgttcctcatggtcatggcctgcccgtgcaccatgttaccgaagccgttctgcatgccgaaggcattgttgtcgttgtccgagtcgtgcgtctggaagctgtcagacatggaatccgtccgctgcgccctgctggtgacggagcggcgccgccgcctccagctcctcggccttcaccttctcccagttgtttttcttgttgtacagccggcacagcacccactcatccaactgcaagaaccttccgtgagcccttcttgcccggcgcacggtccgcgcccgcgaggcggtactcatgcatgatccagtcggtcttgaatcccctgggcgccttgcccgagtagaagacgagagccttcttgattcctgccgccccgccaccgcccttgggcgcgatcggcttgtctgcgcccgttgccttccaataccccctcccggcggcgcggttggggcgcgagccgtttgggtacttgcggtcccgcggcgtgaagaagtaccactccttgcggccaaacagcgccttctctggaagatcccacgggtcgaatttgtaaaggtcgacctcggcgatgatgggcacgggcagctgctgacacgccaccttcctgcagaggtagtgcaccaccagctcctcatcggtgggatggaaccggaaccccggcggcaggttgagctccgcctcggcgtccctccggccgcctccctgcgacgccaccattgccataccccctcctcctcctcctcctcgtcacagaaattcccggcgggcggctggatagatggatcgctcgctcgctcgaaccaggttccagagaccaccacgtcggctccctcgtgctcggtttcgaaaggcggctggctggcactggcagccgccagataactaaatagaatcgcgttgtccgtggagagctgctgtttccccgcgccaaaaaaaaaaaaannnaaaaaaaanaaaaaannaaannnnnaccaaaaaaaaaaaaaaaa

SEQ ID NO: 23267 - DNA, 645 bp, Zea mays
ccaagttagatgcctgccacttgcatagtgcaagtgtgttaatggtctcaacttgactgccatttgatttttaggtggctacaatccatgaatgtttccactctgctcaaagctgcttctcgatgttgcaacactgacttcatgctaagctcagttcttttccgtgcaatttttcgggagacgatcttccatttcgattcaaactcacaggcttcacttctgttggcaaatccttcaacaaggcatgcgagattccaaggcctgccggcagaggaagcttttgcaccaccttttaactcaccattatgttgccgcagccggcgagggaaatcggtggtgacgccgacgtacgtgcggcggatccgggatgaggctataaggtacacgcaccacggcggcgccgccttagtactcttcgcggcccccggcggcggatccccggacgccgaggccgaggaggaggaggcaggctcaccgcactttggaggaagagcgcgcgggattttggtggcacggaaggccgccgtgaggctcatctctcacctggccggcggggcggaatcgttcgtggcattcacatccatccattccaataaccatgcccatggacgaaatttacctcgagccgaataggaaatcggtgac

SEQ ID NO: 23268 - DNA, 957 bp, Zea mays
tagctcactagtctcgtgccgttcttttttttttttttttgtttgagaagaaatataggtgattacaatacataagtataatttacatttacaaacgggtgtcgcatgatccatattattgttcggaaacaattgttcatagaaaaaaaaatcaaacatagaatttcactggggctactcttggtttttcatgttaagaaagcatagcagcagccatcttgattgttcagcagaagattataagttatctttgctacgagctgctagaagacaggaggattcttaagtggttatgtttctccaagttagatgcctgccacctgcatagtgcaagtgattaaatggtctcaacttgactgccatttgatttttaggtggctacaatccatgaatgtttccactctgctcaaagctgcttctcgatgttgcaacactgacttcatgctaagctcagttcttttccgtgcaatttttcgggagacgatcttccatttcgattcaaactcacaggcttcacttctgttggcaaatccttcaacaaggcatgcgagattccaaggcctgccggcagaggaagcttttgcaccaccttttaactcaccattatgttgccgcagccggcgagggaaatcggtggtgacgccgacgtacgtgcggcggatccgggatgaggctataaggtacacgcaccacggcggcggcgccttagtactcttcgcggcccccggcggcggatccccggacgccgaggccgaggaggaggcggcaggctcaccgcactttggaggaagagcgcgcgggattttggtggcacggaaggccgccgtgaggctcatctctcacctggccggcggggcggaatcgttcgtggcattcacatccatccattccatgcccatgcctgatcgacgaaatttacctcgagccgaatgaattgaatgggaggaaatcggtgac

SEQ ID NO: 23269 - DNA, 2325 bp, Zea mays
  misc_feature (133)..(140): n is a, c, g, or t
  misc_feature (151)..(153): n is a, c, g, or t
  misc_feature (156)..(158): n is a, c, g, or t
  misc_feature (161)..(162): n is a, c, g, or t
  misc_feature (2167)..(2167): n is a, c, g, or t
ggcggatttaaattgggtaaccccacaggttttccccagtcccggccgtttgtaaaacggacggccagtggaatgttaatccgcccccccataaggcggaattgggtaccgggcccccccctggaggtttttnnnnnnnnttttttttttnnnccnnnttnnttttttttttttttttttgacacttcaatccacaatccatatgaaattaaaataactgaacaaggctttagtgtagtgtaatcaaaggccattctgccagctgcaccctgcagacagcgacgacccatcaaagattcttcccagacctgtcagtttacatttgctgacgcagaagttgggggaaggccaggtcagcgcccaaaaccagtgaatgtctacgacgctggcccggtggccccaggattctagaatcaaagcagctaaacctaaaattaactcaacgttacaaaactacaaccttctgccctataattctggaatcaaagcaggtaaacctaaaattcctgtggtaccatcgatcctgaaaattgcaaggttccaataccacgacgtcaagagcagcccaaggtatgctcaattcacccatagcattatagctgatctcgtaagactccagcttctacaggtttagcaatatgtccaaccaaggagtgcaggcacaatttccgaacccaactgatcacgcgcttatgtcttgggaactgtaacattcaagatttttacatcttgatatggtttgtcattcttgtcagtcttgaccttctcaatttgctggacaacatccatccctttcacaactctaccaaacactgtgtgtttgttatctagccatggagttgctacagtggtgaagaagaattgagaaccattggtgttaggtcccgcattggccatggaaagtgtaaaaggcctatcatgcctcaagctcttgtgaaattcatcttcaaattctgtgccccagattgattgtccaccagtaccatcccccaaaggatctccagtctgaatcatgaatcctttaatcacacgatgaaatataagattgtcataataaccattccgacaatgggtagtgaagttttcaccagtttttggacactcttctggatatagtctcaagtgaatgtcacccatagaagtatgtagcaccaaattatcaggcaatgatgttgtagcagtttttcctaggtctgatgcagacaaaagctcttctggcggtggtttttcattgaaaacatctctacccttagttgcatcttcaggctcttctggttccctacgactaaagagatatatccgatgcttcttgaaagcacaacacagcagcgttgggtctgataatggttccttgctatcattgacattggcagctactgaaggaatttttctaaccttcttgttgcctttgtctccttggtatagtgcaattctcagaaacctctcattgttctctaccttccccaggatacgggaaaccttatttgtgtgcaaattcacaatctttacacccaaaagggtagcataaataagtaaattggcaactctcatcaaagacagcattaggttgtggaacattttctgttttctctatttccttctccacagccattcgtcgaccaaaatcaatagcatcaaggtgatacaatggaacatcacttctttgaagatcttgcgccacatctagggactcgtcatatacacgtcttaattttccagttttgaaccaaaatacacgtatcctgcgatcaggggatgtgacagcaaattgagtgccatcattgcttacctcaatagcagacacagtagtcttgcatttcgcaatttcaaatagatttgtatctgatttcaggcgaaacctcacctcattttctggaaacatgagggtagatggagaccaatattccaacagtcctttggcatcagcagatataacaacatcatgaatgtggttatatttcataactttgacagggccaccatgaatctctttggacatgattgggtcatttgaaccagaatgggtatcaaatatgtgaacgaaaggtgtatttcggtcactaacggcaagttttggtttgacatctccttctcgatgaacccactcaatagccccaggaacaaatgagagacggggggggggggggggaacaagggagtttttttnccccctccccttttcccccccctgaacccgggggacccctattttaaaagggccccccccgggggagcccccttttttccttttaggggggtatttcaagttggggaaactgggcaaatgttcccgggggaaatgttcccgtcaatttccaaaaaaaa

SEQ ID NO: 23270 - DNA, 1231 bp, Zea mays
  misc_feature (51)..(52): n is a, c, g, or t
  misc_feature (118)..(118): n is a, c, g, or t
  misc_feature (130)..(130): n is a, c, g, or t
  misc_feature (133)..(134): n is a, c, g, or t
  misc_feature (147)..(147): n is a, c, g, or t
tttaccttcccccagaatacggaaccctttattgtgtgcgaattcccatcnnttacaccccaaaaggggtagcataataaagaaaattgcaactctcatcaaagacagcattaggtgntggaccatttcngtnntctctattcctcntccacagccattcgtcgaccaaaatcaatagcatcaaggtgatacaatggaacatcacttctttgaagatcttgcgccacatctagggactcgtcatatacacgtcttaattttccagttttgaaccaaaatacacgtatcctgcgatcaggggatgtgacagcaaattgagtgccatcattgcttacctcaatagcagacacagtagtcttgcattccgcaatttcaaatagatttgtatctgatttcaggcgaaacctcacctcattttctggaaacatgagggtagatggagaccaatattccaacagtcctttggcatcagcagatataacaacatcatgaatgtggttatatttcataactttgacagggccaccatgaatctctttggacatgattgggtcatttgaaccagaatgggtatcaaatatgtgaacgaaaggtgtatttcggtcactaacggcaagttttggtttaacatctccttctcgatgaacccactcaatagccccaggaacaaatgagagacgtatcatgaacatcatgtcatagtttacaacatcatatatcttcacagaccgatcgtttgatatcgtgcagcaaagcaatccatcaacactcacagctagaccttcgatgggactgagatgagaccgaaaatgtttagcaaattcaaccccaacaggtttcttcttccaaaacttcagatgcccatctgcgctcccagtgatgaagaagtcagcaggagatacggcgacgtgcgtgacgacatcccgatgcatatagctcttctcgtacatggcggcggaggggagggcgtcgaggaacgcctgctcgaactggagagggcgcttccgccgctgcttcgccggcgctgggcccggcccgattatctcttcctcctgcccaaccgtgggggtgcccaccgcgccattgaggtgttcctgcttgctctcgtgcgcaccaccgtcctccactgtcgtgctcgttacgctccgcgaccctgtccggcgccatcgcgggctcgtgctcgagacctctgctagggttctggggttttttttttccggacccggccggc

SEQ ID NO: 23271 - DNA, 974 bp, Zea mays
  misc_feature (969)..(969): n is a, c, g, or t
cattgggtccctcggggccggccggggccccccaccccactattcctttctgctgagctcaggaaatcccctctggtctccccgtcccccattccacccgccgccgccgacgcgccgcgcctgttcaagatgaatgtggagaagctcaagaagatggcgggtgctgtgcgcactggaggaaagggcagcatgcgcaggaagaagaaggcagtccacaagaccgcaaccaccgatgacaagcggcttcagagcacgttgaaaagaattggagtgaacactattcctggtattgaggaggtcaacatcttcaaggatgatattgttatccaattccagaaccctaaagtgcaagcatccattcctgcaaatacatgggtagtcagtggagtaccccagacaaaaagtctacaagaccttctgccaacaattatcaaccaactgggccctgataacctggagaacctcaagaggcttgctgagcatttccagaagcaggtacctggtgccgaagccagcgccagtgcagctgcccaggatgaggacgatgtccctgagcttgtcccaggagagacatttgaggaggctgccgaggtgaaggaggtgcctgaagcggaaccggaagagaagaaagactcgtaattttgttgcgtgtcatatccattgtttgtgaagggtcgttgtgtgtttaccatacaccatgggagagacctggtcatctatgaacccctgatgttcctcattcgtttacatgtgctccagtttttcagtttcttatttacctgggttttggtccaaacctgacaagtcagcatttggtttggcgtcaattgtgcttcaggttccaaaaaaatacattactgcagtatgattatgttgagggtgtaggccagaccggcacatattttcaaaaaaaaaaaaaaaaaactcgagggggggggcccggtacccattcgcccctatagtgagcgnataac

SEQ ID NO: 23272 - DNA, 1101 bp, Zea mays
tccaggccgtccgggacagacacaaaaaggatctgacacgcaaaaaagcccctacgggctacggcctacctgggcacagtgactggcctcccgactcgactctcctccccctatctctatctgcttcctgctgagctcaaaccccttccgcctccccatcaaccattccatccgccgccgccgccgcctgcgcaagatgaatgtggagaagctcaagaagatggctggcgctgtacgcaccggagggaattttcttatgcgcaggaagaagaaggcagttcacaagaccacgaccaccgatgacaagcggcttcagagcaccttgaaaaggatcggggggaacaccattcctggtatcgaggaggtcaacatcttcaaggacgatgttgttatccagtttcagaaccctaaagtgcaagcatccattcctgcaaatacatgggtggttagtggagtaccccagacaaaaagtctacaagaccttctgccatcaattatcaaccaactgggccctgataacctggacaaccttaagaagctggctgagattttccagaggcaggtacctggtgctgaagcagctgcacaggatgatgacgacgtccctgagcttgtccaaggagagacatttgaggaggctgcagagaaggagcctcaactggagcaggatgagaagaaagaatcgtgattttgttgtgaagggtcgtcggtttaattgttggcatcagccttgcgagagaccctacctgctcatctggcgtgcctctttacatgtgctccagctttgtgtcaagtgtgcttcgggttcgaaaagcattactgcattatgttttctgaagacagtgtaggcatatattttcctcgagccatagtgagtttccgcatatgtcttgctttctcggcgtccagcagcagttccatatacagaccaaatttgcaacaaaaaaatagaagatttttggccagaaaatgcatctccctgatcgaatagaaagaaactggcgacgcggtttggttaatgctggatcatgtgtagccgtgcatcactatgacacctagcaacatctgaatggaatgacaaaccaaaaaagcaattgggcc

SEQ ID NO: 23273 - DNA, 942 bp, Zea mays
cccccgaggttcccccccgtttcgcccctaaatgttccagtgactggcctcccgactcgactctcctccccctatctctatctgcttcctgctgagctcaaaccccttccgcctccccatccaccactccatccgccgccgccgccgccgcctgtgcaagatgaatgtggagaagctcaagaagatggctggcgctgtacgcaccggagggaagggcagcatgcgcaggaagaagaaggcagttcacaagaccacgaccacagatgacaagcggcttcagagcaccttgaaaaggatcggggggaacaccattcctggtatcgaggaggtcaacatcttcaaggacgatgttgttatccagtttcagaaccctaaagtgcaagcatccattcctgcaaatacatgggtggttagtggagtaccccagacaaaaagtctgcaagaccttctgccatcaattatcaaccaactgggtcctgataacctggacaaccttaagaagctggctgagattttccagaggcaggtacctggtgctgaagcagctgcacaggatgatgacgacgtccctgagcttgtccaaggagagacatttgaggaggctgcagagaaggagcctcaactggagcaggatgagaagaaagaatcgtaattttgttgtgaagggtcgtcggtttaattgttggcatcagccttgcgagggacctacctgctcatctggcttttgtgtctagtgtgcttcgggttcgaaaagcattactgcattatgttttctgaagacagtgtaggcatatatcttcctcgagccatagtgagtttccgcatatgttttgctttctcggcgtccagcagcagttccatatacagaccaaatttgcaacgaaaaaaaatggaagatttttgccagaaaaaaaaaaaaaaaaaaaaaaaaaaaacaaaacc

SEQ ID NO: 23274 - DNA, 959 bp, Zea mays
tagcttcggttgcccccagggcccgccggactccccaccccactattcctttctgctgagctcaggaaatcccctctggtctccccgtcccccattccacccgccgccgccgacgcgccgcgcctgttcaagatgaatgtggagaagctcaagaagatggcgggtgctgtgcgcactggaggaaagggcagcatgcgcaggaagaagaaggcagtccacaagaccgcaaccaccgatgacaagcggcttcagagcacgttgaaaagaattggagtgaacactattcctggtattgaggaggtcaacatcttcaaggatgatattgttatccaattccagaaccctaaagtgcaagcatccattcctgcaaatacatgggtagtcagtggagtaccccagacaaaaagtctacaagaccttctgccaacaattatcaaccaactgggccctgataacctggagaacctcaagaggcttgctgagcatttccagaagcaggtacctggtgccgaagccagcgccagtgcagctgcacaggatgatgacgatgtccctgagcttgtcccaggagagacatttgaggaggctgcggaggtgaaggaggtgcctgaagcggaaccggaagagaagaaagagtcgtaattttgttgcgtgtcatatccattgtttgtgaagggtcgttatgtgttaccatacaccatgggagagacctggtcatctatgaaccccctgatgttcctcattcgtttacatgtcctccagtttttcagtttcttatttacctgggttttggtccaaacctgacaactcagcatttggtttggcgtcaattgtgcttcaggttccaaaaaaaacattactgcagtatgattatgttgagggtgtaggccagaccggcacatattttcatcgagccagagtttcagccaatgttgttttaaaaaaaaaaaaaaaaaaaa

SEQ ID NO: 23275 - DNA, 926 bp, Zea mays
  misc_feature (905)..(905): n is a, c, g, or t
  misc_feature (913)..(914): n is a, c, g, or t
gtgcgaccccgagcgggccgggaagagcgccatggaggacatgcccctacctgttcacagtgactggcctcccgactcgactctcctccccctatctctatctgcttcctgctgagctcaaaccccttccgcctccccatccaccattccatccgccgccgccgccgccgcctgtgcaagatgaatgtggagaagctcaagaagatggctggcgctgtacgcaccggagggaagggcagcatgcgcaggaagaagaaggcagttcacaagaccacgaccaccgatgacaagcggcttcagagcaccttgaaaaggatcggggggaacaccattcctggtatcgaggaggtcaacatcttcaaggacgatgttgttatccagtttcagaaccctaaagtgcaagcatccattcctgcaaatacatgggtggttagtggagtaccccagacaaaaagtctgcaagaccttctgccatcaattatcaaccaactgggccctgataacctggacaaccttaagaagctggctgagattttccagaggcaggtacctggtgctgaagcagctgcacaggatgatgacgacgtccctgagcttgtccaaggagagacatttgaggaggctgcagagaaggagcctcaactggagcaggatgagaacaaagaatcgtgattttgttgtgaagggtcgtcggtttaattgttggcatcagccttgcgagagaccctacctgctcatctggcgtgcctctttacatgtgctccagctttgtgtcaagtgtgctttgggttcgaaaagcattactgcattatgttttctgaagacagtgtaggcatatattttcctcgagccatagtgagtttccgcaaaaaaaaaaaaaaaaaagccgtcccgcagcaggttcnatatacanngaccaaatttgc

SEQ ID NO: 23276 - DNA, 808 bp, Zea mays
  misc_feature (19)..(19): n is a, c, g, or t
ggatggttgttgggctaancgccttccagatgatatctcacagatattcgtagcaatgaacagagagataccagatcccaaacccatagcctttctgtaggagttcatctagacagatgacaatgataccagcaaagaaaagctgaagtataatgaggatagcattcccagttccaagttggctcacactgccatacattccagagagaacatacgccacggcttctccaatggcaataaggataccaagcaacttctgcgcaccatttagcagagcacgatcctccctcacactgttgtcaacttcaataatctttgatcccactagaagttgcatcaccattccagatgttacaattggagtgatacccagttccataacagtaccacggtttgatgcaagaataacacgcatccagtagaaagggtcagcgccagtagttgaatgaatgccatagagtgggagctggctgcagaccagaaaaatgaagagagaaatgaccgtgtagatcactttctctctgaatggtattttcctatcagcactctgtacttctggcaagaaagccagaaatggcctcacaagatgcagtactcgaaaaccaccagccatctctctgttaggtgctcgtcgccggcgaagtgccaagtggcagacctgagcacctggcttaaggcggcggcgatcgcccagtcgtcgccgctagggacacagagcacgggagaaccacgagagagagggtgaaacggaagaacccccggccggtccgaggcccacaattcccggccggcctcgaggtacccaatg

SEQ ID NO: 23277 - DNA, 1090 bp, Zea mays
aagtaaacgaattttcttttgggactccttttccatcacaaagaggaacacccttatctggttctggtctgtatgtgattcgaagttggcaactccgtttcaggccgccttgctttgtctcctcttctgcttgcttttttaatggcaactgggttgtcatttgcaaggatgtgtggatgcatgaagagaattctcctgtctcgcacttcagtatttatgtaaacaaaaaaaaggtctgataggaccctaagacgtcaaaaaatgagagaagccaagacaatggacatggagcaaacaagagctgaaagaaacgtgatgctagatacaaatcctatgtgggcctcgtctccacagggtatgcgccatgcagctttctccaggggtgcagctttgagattattgatcacccaaagacaggaaccagaatggatgtccttttttctgtagcggaggaatagatctgcgctaccaaactccactgtggcatagccactggcatcaagaggcgggtatctagcatggagaggcatctctattacaaggttacagttgattgaaatgattcgcctgagatcaaaatggatctcaacagatgacccattggatagagctgtgggcagttcaaggttggcgtctccaaaaacagcaacatcaacgaaaactttgcgctcaacaaaatgctgtagctcaaatgggtcggcaaacactccatcaggaagtttttcaaatatcaccagatgggcatcgtagtgatcaaggaaattaaccatagcaccttcatgggcaccaaaatccacagaatagactaaacggcggtgagaacctttaccaaccagttgccggcgtagttttgaaagcataggaacttcgacatcatcagcaagtcctttgcacaattcaccgcggtcgcgcgggcccacgcgggcgcgacgctgagcaagctggcccgtcaaggtgtccagatgtgcaccaccaatgtacgttctagagcagggcatgcatttgacgggtgtgcggcttccgccttcagcttacaggtacggtaaaattcagcatgagctaaaaacgaacgctttccgtagccctttcc

SEQ ID NO: 23278 - DNA, 1451 bp, Zea mays
gcagggttgtggggttgcttgaaaagaattctcctgtctcgcacttaagtttttatgtaaacaaaaaaaaaggtctggtaggaccctaaaacgtcaaaaaatgagagaagttaaaacattggacatggagcaaacaagagctgaaagaaacgtgatgctagatacaaatcctatgtgggcctcgtctccacatggtatgcgccatgcagctttctccaggggtgcagctttgagattattgatcacccaaagacaggaaccagaatggatgtccttttttctgtagcggaggaatagatctgggctaccaaactccactgtggcatagccactggcatcaagaggcgggtatctagcatggagaggcatctctattacaaggttacagttgtttgaaatgattcgcctgagatcaaaatggatctcaacagatgacccattggatagagctgtgggcagttcaaggttggcgtctccaaaaacagcaacatcaacgaaaactttgcgctcaacaaaatgctgtagctcaaatgggtcggcaaacactccatcaggaagtttttcaaatatcaccagatgggcatcgtagtgatcaaggaaattaaccatagcaccttcatgggcaccaaaatccacagaatagactaaacggcggtgagaacctttaccaaccagttgccggcgtagttttgaaagcataggaacttcgacatcatcagcaagtcctttgcacaattcaccagaatcagacatttccactatgtcacgacgctgagcaagctggcccgtcaaggtgtcgagatgtgcaccaccaatgtacgttctagagcagggcatgcatttgacgggtttgcggcttccgccttcctgctcacccgacgatgaggcggcgaccaccgcgccggagatccaagcggcggcgagcgccaaggcgagcaagcaccgcccgccccccgcagccatctgtcacagtggcggagccaacaagaaaacgaagcctgggatagcgggcggctgccggctcgctgggtggcggcgggcgcgtctggcggcgaggaggtgaaggcgagccgtcgcgtcgcgtggaggtggaagcgggcgacgggacgtgcggagctggaggcgagggcgaggtgccaaggtgtgtggaggcggagctcaggatgcggacccgtcgggttatttgggctgggccgccgaagcccggccaggccgggcctcagctctgcctctgctctgtcaggagggggaggcggcggaaggatcttgtggtagatagaagagagaagtaggttgtcaggttgtgtgcagcagggacgccggacgcacctcgccggcgtccgggaggcggaggcgtggagcgtccacgctcggggacgcggatctcgtcatggcagacggcggagggccagcctagtcgaccccggccccggccggcctcgaggtaccca

SEQ ID NO: 23279 - DNA, 1599 bp, Zea mays
  misc_feature (174)..(174): n is a, c, g, or t
  misc_feature (186)..(186): n is a, c, g, or t
cagacgggggcatggtgggcactgtggtggtggtgacgaatggtagactggcgcgggggctgggaatggtgaaggtggggaatacggcagtggtggtggtggcggtggtgacaacaacggtggaggcggggaatgtggttgtggtggtggcggtgacggcagcagtggaggtgncggtggtgacgncggtggcggtgatggcggcggaggagacgtaagtgggggaggtggagacggcggcggtggtgatggtggaggtggcgaaggcggcggcggtgatgggagccgcggcgggggcggtgacgggagcatcggcgtgggcggtgatgggagcatcggcgggggcggtgatgggagcatcggcgggggcggtgatgggagtcgcggcggcggcatgggcgggacgaacggcttgcagtggaatgcagcgcagttgacaggtggacgggcgtagaacgcggcgcactgctgcggcgtccgctgggcggggcggttgggcaggcagttgctgcggtcgctgtcccgcggcacgacgcgcgcgcacgccggcggctcgcccgtgaagaagttgtaggcgaatgtgaagttgttgaggcgcggcaggtcgcatatccccggcggtatcgcgccggtgagcaggttgtgggcgacgtccagctgctccagcttcctcatgagggcgagctccggtggcagcgggccggcgagctcgttgaagctgacgtcgagcacggtgagctcccgcagcaggccgatctccggcgggaagcaggatgagaggccgttgttgatgagcaggatctcgttgagcgtgccggacatgttgccgacgctcgcggggaggcagccgccgaaggcgttgtgcgcgaggacgaggactgaggccggcgagttgccgaggttgtccgggagctggaagcggaggcggttgtggttgaggaagatggcgtcgagcgggcggtcgaagaggcggggcgggacggtgccctcgaagtcgttgaagcggaggtcgaggaagcggagcgcggggaggtcgagcacgacgtccgggaacgggccgacgaagcggttgttgctgaggtcgagctcgtggaggaggcggaggcggcggagcgcgcgcgggaggacgccgcagaagcggttggagttgaggtggagcagggcgaggtcggcgaggaggccgagctcgggcgggaggaagcccgcgatgtcgccgtggttgaggtcgaccccggcgacggcgagcgcgccgcggtcggggcccgaggggagcggcgcgcagtacacgcccgtgtagttgcagacccccgggccgacccagtcggcggtgaggttgctcgggtcggagaagatggcctgccgcttccacgtctgcagcgcgacgtacgcgtcccgcaggcgccggctcgggaaccgccgcgtcgggtccccctccaccgccgccgttggcagcccctcggaagccgccggaaagacgtctcctctcatctcatatcccgcgcggcggcgatccccctcggtggtgtgcggcgcagtgacgcgtcacttgttgcgcgcagagagagagagagagacgaacgcgtacagagccgacccggc

SEQ ID NO: 23280 - DNA, 2326 bp, Zea mays
tttgggtctgtttggtttgatgtctaacttgccacattttgcctaacttttctgactaaggttagttcttcaattcgaacgactaaccttagacaaagtgtggcacatttagccacgaaccaaacagcctctaaatgtgcgatgtagccaatcggaagcaacgagaacttacgtttcaaatgaaatgaagcacgaacatagcgatatgaatctgaactgaaatgtgcagggtttaaacgatcgatgagctgcttgtcggctctactgggtgttcttctgttctggcgttacagttcacgagcttgctagtgttgcgtggtggcagctgacgagcgtcggagtccccgcgtcgttttgtgcagtgtactctcgcgcttgcccggcctcccctatccccttcggtttttcccaacttcgccagacaggtaaccgaaaagctgcagtggttcgggagccgagagccacacggcagtcggcaggcccacaacgtccagccttgttcgttccaatcttgttcaacttgggttaaactttttaaaaaataataggtctaaaaactgatgtattaaagtaagaaccatacggataaaatggtaatgaagggagaaaaccgataaatgcaaagcatggggaagttatagaaaaatgtgctgtttggaatatggagatagaaagtcataattcataaaatagaaaaaatggttaacaacactagtgtaaaataagaacattttttaacccattcactgctcacccgtgtgttcctattctcacctatccctatcgtttatccattcactgctcaccctcccactgccgttcttcaagaactccatcgcggcacgctctctccctccgcgggtgtttcgagggctggctgcatcgtggatcgtcaagctgtgggcacggcaggtggaagtgctccatcccaaggccacggacgggcgtgttcatggcgccctgcggagcaggggacgatcgcggcggatgcacctgcttcatgcgttgatgaatcgatcggaatagcactgcacaattcacagaaaaatagttgcgatgtgacagattgttcaagccatgtgatgtttttgaataaacattgcaatcaactgtaatacattgacaatagtactgcctcttcgtaatgctttcaccatcgagccgcaatggtcaatgacaacatgaaactagcctcgaatgacaacaagtcaacaatacgatccatgtgggctactgaatactgatagtaccgcacataaaaattatcaaggtaatcccttagacgaacgacaatacaaccaatccatcagctcccgcctctcggtaatgacaaaaataaagccataaccatatgtacaacgatgtttaacataatgactcccggatcaaagacgaaacatatccccaggtcacaggcctaaaatcaatagccatataggccgataacctagctaaattaagcaacctaccctctatcgaatccggaccgtatcatacacatcttcaggcttgatggtagtgaacaagtcagcttgcgctcccacctgaacgatgagccaaccatagctgcatcttcattcctcagacactgtttctgcctgggcagcagccaataatcttccgttactctcaggtacaggtgacccatgagcctgagcatccttcactccagaatgattgcctgcagcatctagctcacattctgaactgagctcttcggactggctagatggagatgaatatattaggttcagcatggcgtcaccacatccacccagctcaatcgaagggcaagtaatactgccatcctcatggacagactcttgttgaatcaaccgattcttgaatttatcttcaggggtgttgtccgacatgtttccttcacgtatcttctgacagcaacttaggcacagcttaaacgggcatgttgggcagcaccttaataatcggctcatcgagagcttacagttattactgctgtctgactccctctgacacggtcgttggttaaatgagaaattgcaacagaaaacagcagtagacaaatacatcaaaaggcagcataagcactaccacaatgcatattagattagctaagaaaaaggctaaactataagatgaaaagaaaacggaactttctagggtgaccaacacagatgcagtgttttcaagtcgtccggctaatcgcgagtcggactaatcggtggactggtaacgactagtgtcaccgaggcgactaggcaggcggactagaatgctggtcgtcctatttagtatagaaccactagtttagccactgtatttgttcatggcctgttgcaggggg

SEQ ID NO: 23281 - DNA, 2481 bp, Zea mays
  misc_feature (114)..(114): n is a, c, g, or t
  misc_feature (127)..(128): n is a, c, g, or t
acattgacaatagtactgcctcttcgtaatgctttcaccatcgagccgcaatggtcaatgacaacatgaaactagcctcgaatgacaacaagtcaacaatacgatccatgtggnggctactgaatannctgatagtaccgcgcgatgggaaattatcaaggtaatcccttagacgaacgacaagacaaccaatccatcagctcccgcctctcggttaatgacaaaaataaagccataaccatatgtacaacgatgtttaacataacgactcccggatcaaagacgaaacatatccccaggtcacaggcctaaaatcaatagccatataggccgataacctagctaaattaagcaacctaccctctatcgaatccggaccgtatcatacacatcttcaggcttgatggtagtgaacaagtcagcttgcgctcccacctgaacgatgagccaaccatagccgcatcttcattcctcagacactgtttctgcctgggcagcagccaataatcttccgttactctcaggtacaggtgacccatgagcctgagcatccttcactccagaatgattgcctgcagcatctagctcacattctgaactgagctcttcggactggctagatggagatgaatatattaggttcagcatggcgtcaccacatccacccagctcaatcgaagggcaagtaatactgccatcctcatggacagactcttgttgaatcaaccgattcttgaatttatcttcaggggtgttgtccgacatgtttccttcacgtatcttctgacagcaacttaggcacagcttaaacgggcatgttgggcagcaccttaataatcggctcatcgagagcttacagttattacagtagagtgactcactctgaccagtttcagcaacctggacgcagacattagatatttttgttccttgtattttagcttccagttccaactcatctagctgttcctggtcaagtcttacaggtaaaagcttgtaaaattgatggttggaaatttttatgctaagtatcttcctttcaacttttggcggttccttaggcgtagaacccttggaattaccaaggctgcatggtttacaattgcagagaccacggcaagctggacaacgagcctttatatctttcctggacaacttagaataccatttattaatgcagctgttacagaagttcttatcacagttcttgcaattggccacacgtgcagccttcttcattccacagcagtgacatgttcttgctgtttgtgtcacactcatcgcacgaggaacaaccttcacaggaccaacaggcaatggctcagcattcttggaacgatagcaccgctgtatgggtgcaggaatttctacaccaatcttcacaggagttgacaatgccgcaggtccactgctacctggcgagatcgtcatcagtccatttgggagatccctggtctgggggtcactcgtggctgcctgaggggacgtcggaggattgatgctcctcctgcccttcctcttgttcttctgcctctgaagaacaacagcaaggacctcctcatccgctggtaacttcttacccttgttagccctcgcgtagtggtactcgcaaaagctaacggttgggagtgcacggcccgagcagcgccacttcttcccgtcgctgcgacggcagcggaggtggtcaggaagtggcggcggggagtcaccacgctcccctgacttccgacggcgccggcgacgcgacggcgtaggggtctcctctgcttcgtcatcgggagtggccgctcgcttacggcggcgactgcggcgaggaggggatggaggagattcctcggcatcaccttcggtgtcggagtcgccaccatcctcttcgctctcgccgcccgtctcagcggcttcctcttcactatcgccgtcggtcacggcggtggctccctcctcatcctcgccgtcggactcctccgctttcgccttcggatcagcacccttgccatctgcttcgcggtctgagccagtctcaccagcttcttcatccgaggcgtcaggtttcgcctccgcctccgtggccaccgtttcagccttggcctcgacggctttggcttcaggctctgcatccatctcctccgttccgttctcgccagcttcttcgctggcctctgcatccatggactcggtgtcgctctccgattcgtcttccttcgagtcctcgctctcggcgctggactcctccccagcctccgcgtcccccgcctcgatttcggacttggcggcttcgtctagttccccggcgggcccgggcgcgcgctcggtgggcttcgctcttggctttgccctacccttaccctttcccctaccgcgtcgcggcggcatggcggcggctggctagggttcaggcgagtcggcggagtcggattatgctagatcgaagtgggggaagtggtgcgtgcaccggctcccggccggcctcgaggtacccaa

SEQ ID NO: 23282 - DNA, 599 bp, Zea mays
  misc_feature (387)..(387): n is a, c, g, or t
ttttttttttttttttctttttttttttttttttttttttttacaaccaatccatcagctcccgcctctcggttaatgacaaaaataaagccataaccatatgtacaacgatgtttaacatgactcccggatcaaagacaaaacatatccccaggtcacaggcctaaaatcaatagccatataggccaataacctagctaaattaagcaacctaccctctatcgaatccggaccgtatcatacacatcttcaggcttgatggtagtgaacaagtcagcttgcgctcccacctgaacgatgagccaaccatagccgcatcttcattcctcagacactgtttctgcctgggcagcagccaataatcttccgttactctcaggtacaggngacccatgagcctgagcatccttcactccaaaatgattgcctgcagcatctagctcacattctgaactgagctcttcggactggctagatggagatgaatatattaggttcagcatggcgtcaccacatccacccagctcaatcgaagggcaagtaatactgccatcctcatggacagacttttgttgaatcaaccgattcttgaatttatc

SEQ ID NO: 23283 - DNA, 1152 bp, Zea mays
ggccgctttttttttttttttttttttttttttttttttttttttttttcgtttactcgcgttgtttatttgcaattatgcatgacaaaaccagaagaacaatgtgtactacatctcccgcaaaaaacgttcaacacttaaatttgagacattatcttctctgctggagggcgactgccatctatatttaccaaactggaacatataaacacaaaacaatcagatgattcctatggctgataggtacatctcttctgagtccgcaactttgtcctcaaattagacgtgatgttacatctttgacatatactaccaaagatggcaataaaaccttcatcaatcgtcatccttgaactccctgcggtcaagatagcgtggttggattccggtgccttggcatgtagtgcatgtcaaagagccgatgccctcgcagttgacacactgcgattcttcagtctcgcctgcaccaagtactacagtaacaatgccctttccactgcaaaacctgcatacctgcgcgccagaaccactgcaggggaagcatggctgtgtattatccctcttggcggcattgtcgatttgagtctcgtagaacacagggacacctattcccacggcgatgctgacgacgcccaccgaaatggccacaatcgtgttctggtcgaggtcaatggcccggatgcgagggtaccgcgctccggcccttcgccgtcggggcagcgccgccatgtagggcgaggaaggggtgggagagaggaagcgggagtggagcgttgtgagcgacgaggaggaagtggccatggctgcgtgtcctccctacgtcacgcgttggctgcggaccgggtctccggcgggcgggcgggcgcggcggtggcctgaccggcaacctcctccgcgtcgtttcgcgaggaggaagagcgagggaggactggaggaggaggagagggaggtcgcgacagcccgggggtggtgcaccatgtggatgtggtattgtgcggagacgtggcgcgaccaggtgccagcgttcggatgggtgctcgtgatcgggcggggcaccgggggccgcccgggcctcgggacgaagaaaagagtggatgtggaagaacgccggaattttttttgattaggatgttctaggtaatggtctcgtgc

SEQ ID NO: 23284 - DNA, 2217 bp, Zea mays
  misc_feature (1008)..(1008): n is a, c, g, or t
  misc_feature (1022)..(1022): n is a, c, g, or t
tgcagcgtggaggagcaggagaagggaagcgtcgcgtgcaccgccatggctggctcctcgccgctgcggcggcagcggcgccgcttccgagagagtaggggaggggaggggaggggaggggagggtgcggataggcgtggcgaggcctggccagatagacggttcgtctggtgtagtggtgtgtgtgagactgtggaatgcgtcttcctccggtctaaaggcccccgctaatcaactgtgaaggcgtagtttacgatcctctaagagagagtttacgtaaacgaatttgcgaggcggatccacggatactgcgacgtttgtcttgctgacctccaggctccagcccaatgctttcactgatcaaaacgaatttgccgagggatttttaccacgtcactgctgaaaatgatgtccaggagtcagaacagctcctcaaaacgactccgccgcctcatttgttcttgatactgaacactaataccgccgtcagtctcgagtttctttgtagaatccgaagcagatgctggtagaattggcagtggctccatccatcagtttaggtccggatttcaatttcaggcagacgtgcattgctgcagcggagtcttgcgcattccagtatttttacttatcccttctttctttttattaaattaagaaaaaggtgtgcgttccagctgggagatacttcatgatcatggccaattggccaccaagcttcactccaaaggcatttcccgctggagttccatgttcctcgtccagacatctagcatccaactttgggcagtatgtgtcattccttccgatcatgccacgataagatgttgtcaacgaagcatccatcaagcagaagcatcaaaatgatgtcctcgtctctcagtaactggctcagatatagcagcctgaatggctttctgtcgatcgttgtgcgtcagtataggtttgggagcatctcatgatggcatgtatatatgcggagatgcagcctgtaggtaaaagaaatgnacaagcaagagaanaagaatatttaacagacctcttagatcccaaaaggctgaagcagtggcttggttaatgaagcaaagtgtaaaacaaacttttcttgtgccaaatgctagaggcgacgaatttatctcccaaagagaacagcaaggccatacctagctgattttgtctagctcaggactaaaaaaatggaaacattgtattcattagtcagaaggaaacaacaaggaacttagtcaatcaattttccttcatccttcctttattcagacatctgtaccatacaagttgcctgtgttattcactatgtttacagataaatagaaaagattctgcagttaaactgtgcagtaaaatatttgcatcaaagaagttctacggctatgggaggaacaaaacttaatttgtggcctttaaactatattttgctttccctttgtacaaaaagaaaaggattataaacaggttatatgttatctcttcatggtagcaacagttgttagagtttctgtgaagagatataaagctgaaaatttcatcctgaagattctccgcccatcataattggttgttcaccttcaaactccgatatcacaatgagcgaatcattcatttcaagggacagcggctccgatttgttgataggattaatatgctgcttgccgtccttgatgtaaccaatcgcaacttcacggcgtaaaactgctctttcagagagctccaagaatgatattttctctccttccttcatgtacagcccaatttccttaatatagatctcatcgccttcagcgttcaggatatccttccatacttcattcagctcactactttccgcaacttgtgctgtcacacgactcattatttcctctgctccaataaatgaaagggatggtcttattttagatatttgttttcctagtcccatgtcaacgatttctgatacaagattctcaaccataacgccatgtttctggcaaatgttttcagcaagaagaagggtgtatgccaactgtttatcagcctgtgcagcatctccaacaaaccagtctctgtcagatatcacaactattgacagtggaacctctttatctgacttggcagattctcgtacgttaactattgtttccttcagagtatcgtagttcaaaggacaccccacccggtgagtaactttaacattttaagcccggcgacaccgagggtacc

SEQ ID NO: 23285 - DNA, 1411 bp, Zea mays
ctgcagtttgctcattgcagtaagttctagagatcattcgtttagctcatgtgtacgtcttaagaccatttttttgtgtgaattcaaccatatctgtttatttctatttattttctttattcaatggtttgttcatcaatacaaaatgatgttgctaccgattttagatactccagtccattgcttgtggaaatctgtgcagtatttattactctattaaatgttggttaccgtatatatgttgtatatctctactctactcaatatgtattcgatgattgtcgatttgacatctacaaattggtctttgtactacttgcattttcatccagttaacctgcacccctgacccttggtaagaaggcgtgcttgcttgaagctttttttttttttttttggtgccacacaatgggagtctaaccgatgatcctctttctctcatggtgtccagacttttggaagtgatacaacagacatcagtcatagtaaattggtaactgtatagatttgatttcatacatggaagcaggtgacgatggtaaacagaatgccacttatgaagtaagcctaaaaaccggaacaacagttcatgacttcagacaagagatgagctggtatggccctatatatgccttaacagccatgcccttaccttacctctgtattatatttgtaaatccattggtctcgtgccttataaaccatatggcatcaagcagcaggaaccttccttccatcttcaatgaagaaaatggccgactcaggtacatcaggccatgtatctgtaatgaactccacaatatcatatgagatgtccccttgtacgtcgatttgctccttctccgtagggcccttaacaacagaagctccggttgcaaacttcttcccaagcttcttcgaagcatcactaagctttacaccaaacaattcaagccccttcaccacagtaacacatttgcgcttgttacggacaatcttctcaatgaccacttcttgcttctcctttttcttgagcttaccaccaggcaggcgtttcgcctcttggggcttagacgcggaagcatcccctgcggcgcttgtggagccgtcggagattccgacgccctggaggcgatccccgaccctgtcgacgtccttgtcgccggggtagacgcacaaggtcgtcggggtagacgccgggcgcgtgcgcgcgcagccagggcttgcagcgctcgaagtcggggccgaactcgcagtactcggccgggaggccgcagacgccgcagtagagcacgcgcacgggagccggcttctccgccgacatcgccgctgcttcggttcggtgcggagagcggtggcgattattttggttttggggaataaagcctggagccggcacccgtcgctttcttcgaagccggccggcctcgag

SEQ ID NO: 23286 - DNA, 965 bp, Zea mays
agcctaaccgatgatcttatttttcacgcaccgtgtccagacttttggatgtgatacaacagacatcagtcatagtaaattggtaactgtatagatttgatttcatacatggaagcaggtgacggtggtaaaaaaaaatgccacttgtgaagtaggcctaaaaaccggaacaacagttcatgacttcggacaagagacgagctggtatggccctatatgcctggtctcgtgccttataaaccatatggcatcaagcagcaggaaccttccttccatcttcaatgaagaaaatggccgactcaggtacatcaggccatgtatctgtaatgaactccacaatatcatatgagatgtccccttgtacgtcgatttgctccttctccgtagggcccttaacaacagaagctccggttgcaaacttcttcccaagcttcttcgaagcatcactaagctttacaccaaacaattcaagccctttcaccacagtaacacatttgcgcttgttacggacaatcttctcaatgaccacttcttgcttctcctttttcttgagcttaccaccaggcaggcgtttcgcctcttggggcttagacgcggaagcatcccctgcggcgccggtggagccgtcggagatcccgacgccctggaggcgatccccgaccttgtcgacgtccttgtcgccgccgccgggtgaggaggaggcggcgacaaggtcgtcggggtagacgccgggcgcgtgcgcgcgcagccagggcttgcagcgctcgaagtcggggccgaactcgcagtactcggccgggaggccgcagacgccgcagtagagcacgcgcacgggagccggcttctccgccgacatcgccgctgcttcggttcggtgcggagagcggtggcgattattttggttttggggaatagacccccgggcccgcccgggggcctgggccccgacccggccggcctcgagg

SEQ ID NO: 23287 - DNA, 1172 bp, Zea mays
ccaatattaacatcgaggtattattgttcgaactaaacaagtcatcatgtgtcttttacacaccagagcagtgttggattggatgtcgcagaccacctgcacgcgcttcccgtgttcctctcctttcttcgtctcctcttcccttctcctccacgctattgctaacacaggccacggaccgcggtatgtatatttgacgaaacatggtgacacaacagttatcgcacatataacaaactggtaactgtatagatttgatctcatacatggaagcaggtgacggtggtaaacaaaacgccactcctgataaaacttggaagaacagtccatgacttcggacagagagacgaactggtatggccgctacatgccttgacagccacgcctttgctttatctctgtgttataattgtaaatccattggtcctgcgcctcatagtgacatcaagcggcaggaaccttccttccatcttcaatgaagaaaatggccgactcaggtacatcaggccatgtatctgtaatgaactccacaatatcatatgatatgtccccttgcacgtcaatctgttccttctcggtcgggcccttaacaacagaagctccggttgcaaacttcttcccaagcttctttgaagcatcactcagctttacaccaaacaattcaagtcccttcaccacagtaacacatttgcgcttgttgcggacaatcttctcgatgacaacctcttgcttttcctttttcttgagcttaccaccaggcaggcgtttgacctcttcgggcttagacgcggaagcatcccctgcggcgctgctggagccgtcggagatcccgacgccctggaggcgctccccgaccttgtcgacgtccctgtcgccacccgcaccgccggacgaggagggaccggcgacgaggtcgtcggggtagacgccgggcgcgtgcgcccgcagccagggcttgcagcgctggaagtcggggccgaactcgcagtactcggccgggaggccgcagacgccgcagtacagcacgcgcaccggagccggcttctccgctgccatcgccgctttcttcgattcggtgcggagagcggtggcgattatttggattcggttttgcgggtgccggccgggcgcgagccaacgggtgacgattgtgtgagggaatccccggccgg

SEQ ID NO: 23288 - DNA, 977 bp, Zea mays
agtaaattgcgtaactgtatagatttgatttcatacatggaagcaggtgacgatggtacacagaatgccacttatgaagtaagcctaaaaaccggaacaccagttcatgacttcagacaagagatgagctggtatggccctatatatgccttaacagccatgcccttaccttacctctgtattatatttgtaaatccattggtctcgtgccttataaaccatatggcatcaagcagcaggaaccttccttccatcttcaatgaagaaaatggccgactcaggtacatcaggccatgtatctgtaatgaactccacaatatcatatgagatgtccccttgtacgtcgatttgctccttctccgtagggcccttaacaacagaagctccggttgcaaacttcttcccaagcttcttcgaagcatcactaagctttacaccaaacaattcaagccccttcaccacagtaacacatttgcgcttgttacggacaatcttctcaatgaccacttcttgcttctcctttttcttgagcttaccaccaggcaggcgtttcgcctcttggggcttagacgcggaagcatcccctgcggcgcttgtggagccgtcggagattccgacgccctggaggcgatccccgaccttgtcgacgtccttgtcgccgcctccgggtgaggaggaggcggcgacaaggtcgtcggggtagacgccgggcgcgtgcgcgcgcagccagggcttgcagcgctcgaagtcggggccgaactcgcagtactcggccgggaggccgcagacgccgcagtagagcacgcgcacgggagccggcttctccgccgccatcgccgctgcttcggttcggtgcggagagcggtggcgattattttggtttttggggaataaagtctggatccggcacccgtcgctttcttcgaagacgtaaattgatctacactagtctctttttatcacccgaaccggccggc

SEQ ID NO: 23289 - DNA, 633 bp, Zea mays
cctcgaggccggccgggccgggagcaacagccgaaacagcaacagcctacctcttcgtgaatcgtgtcccttcccttgcttggctgcaggatccaagcaacacggaaggagggaggtgagcaccatgtcggcgctgttcaacttcaactccttcctgaccgtggtgttgctggtgatctgcacctgctcctacatcaagatgcagttcccggcaatcctcaacgaccgcaccggattccgtggtttcttttggaaagctgccaggataggtgagcgattgagcccttgggtatcagtcgggtgcttggctatgggaatatccactattttcttctaaggccgaagtgttaatctccacaaatttagtctaggacgcagcaccttgtttcacttgtagagaaaaaaaaactattgtaagcattttgcttcagtttttaatggaatgggcactgtaagatctgtatctgcactgagatttctgagattaacaaaaatgttttctcataagatttctgagaaaaaaaaaactttgtagaccttgtagctgtttgaagagtggtaattgatgaactgctgagagaaaaaaaaaaaattccaacgcccctagggccaaaaaaggcccctcgggcccgg

SEQ ID NO: 23290 - DNA, 1913 bp, Zea mays
  misc_feature (10)..(10): n is a, c, g, or t
ggtaccggcncccttccctcggttttttttttttttttttttttttttttttttttttttacttgcatcaacaagacaacaacgtaacatacaaataatttgtatgatactttcaattgaacttattccgtcccagatgattatgcagcaccaggcacaagccgtgcatcaattacaggtacagctaggagtacatgaccaaagaatactaatttatacagatctatttcatgatcatctttatgccttttgaaactgaaaaaaaaatagcacaagagcgcagcagttcttgttacaagctgcaaacctgccatcaattcttcagaaaaaatttcgagtatatcctcttgcagtacggactggtcctaagtagttcctcatgtggtaggattgcatttatcagtgcggaatgaagtgagccctttgagttcttgagagcagagtagacgacatagtttgcatagcagtgcggaagcagctgctccaggtgtggcgtggcaaggagttccagtatgatcttggccttgtcaacctccttgaacactttcaggcatttctccacaacattgctgctgaacttctgcatggacaggtggatatacttgcctccaaactgttgcgcaaggcttgaattcgcagttggtatcttcaagtccagtacaacctggacaacgtagttcccatatgcatcttgggcaagcttaaacccattgtgagcaatggcggcaaccagcttgtccctgtgctcaccacgcgaccgcgcaatgcaccgctgtaggacacagcaaccgtggatttgcatcccgatatcgacgcagtggagtgcagcagcagcaaagatcgccttattatcgtttgaagcaaacgaatgcaaacacttttgcacgacatggttgccattggtatccttgatgagctccaagaagccagggcgcagagcatccatgacaagaccaatctcttcccttgcactgagtctctcaatcagcttctgcaccgcccgtgtcccatggacgttgagggatatcctgacgagggcgaaggggtcggcggtgagggtgagcacaagcgtcatcctctgcccgtcgtcgcagacggcgagcagcttctgcatgaggtagttcccgaatgggtccaccatcagctgcgcggcatggcgcgagacgccggcgaagatatagtcgacctcgcgcttgccgtcgtcgagcctctgctgcagcaggcggcacccgtgctggtcgcgcgccatgtggtacatgaccccgcgcaggccggccaggctctcgccgtgccacttggccgccgcggcggctccgcacttcttggggctcgtcgtcatcaccgagccgttcttcctcctcacgctcttgcaccgggccctcggcgtggcgggagaaggcagaggcacataaggcggcggggagcaccggatgtcccagccgtcggcagcggcggcgtcgtcgaaggtgacgggaacaaacagagagcgcatgtgcgcgtagtggctggccatggagaacgagtgcatggcgacaaggttctcgcctttcgtggggaagccgtagccggtggcagcgcccggcgccggcagctcgtcgtcgccgtcgacgaggcccatcgcggcgagctcgtggatgaggaaggagaggtcggcgtcgtcgtccgcgccggcctcgctgccgccgaggaggccgacgtggtggaggagggggatctcgttcagcagaatctccatctccctgtcgaccttcatctttccccggtgaattagctgccggactccgatcggatctttcgatatggggaaactgcgtggggagtgatcggattgggttctattggtccgcggagaaggattgggattggagcgaggggggaaggtggtttcttggagacgggttgttgagacatgc

SEQ ID NO: 23291 - DNA, 1353 bp, Zea mays
aaaaaccgcttgcaccacggagagacccgtccgggccgacaatactagttgttcccaccgcaagcaaagcattttcgcccgccccaccgcagcagcagagaagaggccgccgccgcgaccaagagtcgatggatccgaagatgacagaggtgacccagatgttcgcccgcttcaaggcggcctacacccgcaacgacctcgacgcctgcgtcaccctcctctcacagctcaaggtccatctcaccaaattccccagccttccgccctcatttgagcagacacctaacgctgtcgaggagctcaaacttgcaagggacatttatgagcatgctgttgttttgagtgtgaaacttgaggaccaagatgcatttgaacgtgatttctgccagctcaagccttattacatggatacatgtggcataattcccccctcaccagaggagtacccaattttgggactcaatcttctgaggctgttggttcagaatagaattgctgagttccatactgagctggagcttttacctgtcaaggcacttgagcatccttgcatcaagcatgctgtagagcttgagcaatccttcatggagggtgcctacaaccgagtgttaagcgctcggcaggctgtgccacatgagacctatgtttacttcatggaccttctcgccaagacagttagagatgagatcgctgggtgcagcgaaaaggggtatgattccctatctgtaagtgatgcaaaacaaatgcttatgttcagttctgaccaagatctgcacgagtacatcacagaggagcacccggaatgggagtttaagaatggcgccgtcttcttccagaaggcaaaggaatcacagccctacaaggagatcccatccttgcagctcatcaaccagacgctcagctatgcgagggagctggagcgtattgtatgatttaatttcacagtaatccctggtggatgtttatttctgtggccacttggcatggcatgtactgtcctttacatttgagatcagctctgatcgcagctcatgtcagctctgatcaatctctgaagggcttgatctctgcggcattgtttcaccacattaactgcattgcttgaaagatgcctgtcattcattgctgctgttaacttttgatgggcttgcggccaaaaaaaaaaaaaaaaaaaaaaaaaaaaaaaaaaaaaaaaaaaaaaaaaaaaaaaaaaaaaaaaaaaaaaaaaaaaaaatgtcctgctaaggactgaaaactgtagcaaacaggctaaaccagattgagggaaacagggccttctataagaggacaagattggatcagataataacgggtaaatcgccactgaccatg

SEQ ID NO: 23292 - DNA, 2291 bp, Zea mays
accaaagacttatttgagttgtttatctagtctaaagtcctgtttggaagaaacctagtttttaagaatccagtttttatgtctagtttttaaaaactggtttatggtgtttggaaccatatcagttttcataaactggttttagttagggaacgctagcttcttgttttttaagaaactgagaatccagtttctataaactgtatgtttggaaccaccctagttttcataaaccagtttctttaaaaactaggtgcttccaaacaggccctaagcgacaaggaaacccgatacccgacatttcagtcagatccatcagactatcaagtagttttaactattatttgagtgagcgtttattagttttttgttgcaatgaagttgctaaaacgaattcaaactggacttgctaaaacaagttcaaactggacttgctaaaacgagtttaaactggaaattgtgtgtagtcttgcctttctgggacccgaaacatatccataagtaactatgaataggatcaaaacattacctccagggtattttttttcaggagcatgccagaattgtattatgctaaacaatgtaaatttgataccaaatggtatttatttatgcagtggcataattcccccctcaccagaggagtacccaattttgggactcaatcttctgaggctgttggttcagaatagaattgctgagttccatactgagctggagcttttacctgtcaaggcacttgagcacccttgcatcaagcatgctgtagagcttgagcaatccttcatggagggtgcctacaaccgagtgttaagcgctcggcaagctgtgccacatgagacctatgtttacttcatggaccttctcgccaagacagttaggtgagtgggattctgttactcctgtttatttgattgtttgattttatctcattgtgttttcctgctctcacagagatgagatcgctgggtgcagcgaaaaggggtatgattccctatctgtaagtgatgcaaaacaaatgcttatgttcagttctgaccaagatctgcacgagtacatcacagaggtagctttagtcttttaaacccccctcctttttctgagtgtatgtctatgcgaaatccgtatgttcagttctgaccaagatctgcacgagtacatcacagaggagcacccggaatgggagcttaagaacggtgccgtcttcttccagaaggcaaaggagtcacagccctacaaggagatcccatccttgcagctcatcaaccagacgctcagctatgcgagggagctggagcgtattgtatgatttaatttcacagtaatccctggttgatgtttatttctgtggtcacttggcatggcatgtactgtcctttacatttgagatcagctctgatcgcagctcatgtcagctctgatcaatctctgaagggcttgatctctgcggcattgtttcaccacattaactgcattgcttgaaagatgcctgtcatccattgctgctgttaacttttgatgggcttaatattgaattattacatcgaaaaaaaaaaaaaaaaaagcgacagcaacgccaaagacaaattatgttgacaagattagtcatactggaaaacagagattgctcattcaagtatgcttgagcgaaacatgagcatacatctgtgcttaactgaagggaagtcttattttggtttggtgttgtggttaaaaacacaattttaccggtttatgttctgcaaagaggaagtttactaatgagacgatgaacgggatcaaagtcatgcagatccatttaagaaaatgtcatggtcaccgtcctttcatgtgccgagtaactgacaataaattgactgtctcgtctgaaaatatcatttctgaattactggtgtaaataaaatagatcttatggtctaataaatttggattttgctgtctgataaataatattgtaatttaaactaatattgtttgtcgatatataaggttgatacaatctaaactatggtaaaatgatactggacaacgtgttagccatagaaagtatggttatgaaagtgattctggttccacagtttaggcttgggtacctatggcgattctgtaaagaactgtaacaactgcacggaaaagaactataacaagcaacacaatttaggtgaaatttttctttctcttctctatatctcttttctctctaacagtgtcctttatatgtcgtcctctatatctaaataactatattagagatatattttatctatatctaaatacctatattagagaca

SEQ ID NO: 23293 - DNA, 821 bp, Zea mays
tttatgaagctaaaagggtgctttacgaataggtgttttcaactctcttatgaagttgaggtgaaattacccaccttgggttacacacttctctcacgaaacattttttttcttttctctgatacccaccgcgccccttttgctcccgtttttacaaagctaaagctggtctgcaagccaaacacttcaaaagctatgcaactttaaagatgagctattttactttgaagttcgtgaaggtgaagctaagctagtttttgtgaatcagagcagtgccaaaccccactcctttttctgagtgtatttcaatgcgaaaccatatgatagtcatggtaagtcttcttgtgaacatcgttaacaggagcacccggaatgggagattaagaacggtgctgtcttcttccagaaggcgaaggaatcacagccctgcaaggagatcccatccttgcagcttatcaaccagacgctcagctacgccagggagctggagcgtattgtatgatttaaaccaatccctggtggttctttccccccctgtggccgcttggcatggcttgtactgtcctttgcatttgggatgatctttgatcgcagctctcatctgactgaaacatcatgtgaatctctgaagggctcagtctctccggcattggtctgttaactccatttgtatttcaccacattaactgcattgcttgaaaaatgccggcattcactgctgctgtgaacttttgatgggcttgatattgaattactgcctcggaattccactgacctctgcaggccgacgacgtcgcgttttcttctgcatctgatgcagg

SEQ ID NO: 23294 - DNA, 1347 bp, Zea mays
  misc_feature (1275)..(1276): n is a, c, g, or t
  misc_feature (1284)..(1284): n is a, c, g, or t
gcacgagcctttgtgtgaaccgccgtcccgcccgcccggctccgcccctacgcgcagtcgccacgggagctcgtatcgctcgatttcctctccggcggcagcaccctccacccctcataacccaacccgcaagaaaaaacccgcagcagagaagaggagtcgccgcgaccgagagctccagagcacgcccccgccacagcctccgacgatggatccaaagatgacagaggtgacccagatgttcgcccgcttcaaggcggcctacgcccgcaacgacctcaacacctgcgtcaccctcctctcgcagctcaaggtccatctcacccaattccccagccttccgcccttgtttcagcagacaccgaacattgtggaggagctcaaacttgcaagggacatttatgagcatgctgttgttttgagtgtgaaacttgaggaccaagatgcgtttgaacgcgatttctgccagctgaagccttattacatggatacatgtggcataattcccgcctcgccagaggagtacccaattttgggactcaatcttctgaggctgttggttcagaatagaattgccgaattccacactgagctggagcttttacctgccaaggcactcgagcatccttgcatcaagcatgctgtagagcttgagcaatccttcatggagggtgcctacaaccgagtgttaagcgctcggcaggctgtgccacatgagacctacgtttacttcatcgaccttctcgccaaaacagttagagatgagatcgctgggtgcagcgaaaaggggtatgattctctatctgtgagtgatgcaaagcaaatgcttatgttcagttctgaccaagatctgcacgagtacatcactgaggagcacccggaatgggagattaagaacggtgctgtcttcttccagaaggcgaaggagtcacagccctgcaaggagatcccatccttgcagcttatcaaccagacgctcagctacgccagggagctggagcgtattgtatgatttaaaccaatccctggtggttctttttcccccctgtggccgcttggcatggcttgtactgtcctttgcatttgggatgatctttgatcgcagctctcatctgactgaaacatcatgtgaatctctgaagggctcagtttctccggcattattctgttaacttcatttgtatttcaccacattaactgcattgcttgaaaaatgcccggcattcactgctgctgtgaacttttgattgaaccccccccccccccccccccccnncccccccncccccccccccccccccccccccccccaaaacaaaacgggcgccccccccccccccccccccc

SEQ ID NO: 23295 - DNA, 891 bp, Zea mays
  misc_feature (828)..(828): n is a, c, g, or t
  misc_feature (858)..(859): n is a, c, g, or t
ttgggtacctcgaggccggccgggtctctccctttctcactcgtctctctctgtctcttgtagccgccagccgcccccaccgctcaccccatgccacggccgcccctgccgcacccggccacccccggccccggccgcccttgccgcggacgcccctgtgtgagccgtcgtcgcgcactcgccgctccgcccctacatgcagtcaccacgggagctcgtatcgctcgatttcctctccagcggcagcaccctccacccctcatcaacccaacccgcaagaaaaacccgcagcagagaagaggagtcgccgtgaccgagagctccagagcatgcccccgccacagcctccgacgatggatccaaagatgacagaggtgacccagatgttcgcccgcttcaagacggcctacgcccgcaacgacctcaacacctgcgtcaccctcctctcgcagctcaaggtccatctcacccaattccccagccttccggccttgtttcagcagacaccgaacattgtggaggagctcaaacttgcaagggacatttatgagcatgctgttgttttgagtgtgaaatttgaggaccaagatgcgtttgaacgcgatttctgccagttgaagccttattacatggatacatggttagttctttgccacccaatttggcgattttattttcctttattattttggtttctatttttttaggctgaattcatgtgatgcttcaggcaataaaatgtttaaagctgattgcgaaaggcatatttttcttatgcacaagcattattaaattggttgtggctgcatttgtaaattgagatactanactagtggaagcaagggacttttattgagnntgttaactagtctaagtgaaactaaacccgac

SEQ ID NO: 23296 - DNA, 1301 bp, Zea mays
acatcaattatagtccacgtaatgaagtccacccggcccaactagccctctgtgtgagccgccgtcgcgcactcgccgctccgcccctacgcgcagtcgccacgggagctcgtttcgctcgatttcctctccggcggcagcaccctcacccctcatcaacccaagccgcaagcaaaacccgcagcagagaagaggagaggagtcgccgcgaccgagagctccagagcacgcccccggcacagcctccgacgatggatccgaagatgacagaggtgacccagatgttcgcccgcttcaaggcggcctacgcccgcaacgacctcaacacctgcgtcaccctcctctcgcagctcaaggtccatctcacccaattccccagccttccgcccttgtttcagcagacaccgaacattgtggaggagctcaaacttgcaagggacatttatgagcatgctgttgttttgagtgtgaaacttgaggaccaagatgcgtttgaacgcgatttctgccagctgaagccttattacatggatacatgtggcataattcccgcctcgccagaggagtacccaattttgggactcaatcttctgaggctgttggttcagaatagaattgccgaattccacactgagctggagcttttacctgtcaaggcactcgagcatccttgcatcaagcatgctgtagagcttgagcaatccttcatggagggtgcctacaaccgagtgttaagcgctcggcaggctgtgccacatgagacctacgtttacttcatcgaccttctcgccaaaacagttagagatgagatcgctgggtgcagcgaaaaggggtatgattctctatccgtgagtgatgcaaagcaaatgcttatgttcagttctgaccaagatctgcacgagtacatcactgaggagcacccggaatgggagattaagaacggtgctgtcttcttccagaaggcgaaggagtcacagccctgcaaggagatcccatccttgcagcttatcaaccagaccctcagctacgccagggagctggagcgtattgtatgatttaaaccaatccctggtggttctttttcccccctgtggccgcttggcatggcttgtactgtcctttgcatttgggatcagctctcatctgactgaaacatcatgtgaatctctgaagggctcagtctctccggcattggtctgttaactccatttgtatttcaccacattatctgcattgcttgaaaaatgcccggcattcactgctgctgtgaacttttgatgggcttaaaaaaaaaaaaaaaa

SEQ ID NO: 23297 - DNA, 1240 bp, Zea mays
cattgggtacctcgaggccggccgggacaatactagttgttcgttcccaccgcaagcaaagcattttcagccgccccaccgcagcagcagagaagaggccgccgccgccgcgaccaagagccgatggatccgaagatgacagaggtgacccagatgttcgcccgcttcaaggcggcctacacccgcaacgacctcgacgcctgcgtcaccctcctctcacagctcaaggtccatctcaccaaattccccagccttccgccctcatttgagcagacacctaaagccgtggaggagctcaaacttgcaagggacatttatgagcatgctgttgttttgagtgtgaaacttgaggaccaagatgcatttgaacgtgatttctgtcagctaaagccttattacatggatacatgtggcataattcccccctcaccagaggagtacccaattttgggactcaatcttctgaggctgttggttcagaatagaattgctgagttccatactgagctggagcttttacctgtcaaggcacttgagcacccttgcatcaagcatgctgtagagcttgagcaatccttcatggagggtgcctacaaccgagtgttaagcgctcggcaagctgtgccacatgagacctatgtttacttcatggaccttctcgccaagacagttagagatgagatcgctgggtgcagcgaaaaggggtatgattccctatctgtaagtgatgcaaaacaaatgcttatgttcagttctgaccaagatctgcacgagtacatcacagaggagcacccggaatgggagcttaagaacggtgccgtcttcttccagaaggcaaaggagtcacagccctacaaggagatcccatccttgcagctcatcaaccagacgctcagctatgcgagggagctggagcgtattgtatgatttaatttcacagtaatccctggttgatgtttatttctgtggtcacttggcatggcatgtactgtcctttacatttgagatcagctctgatcgcagctcatgtcagctctgatcaatctctgaagggcttgatctctgcggcattgtttcaccacattaactgcattgcttgaaagatgcctgtcatccattgctgctgttaacttttgatgggcttaatattgaattattacatcgaaaaaaaaaaaaaaaaaaaaaaaaaaaaaaaaaaaaaaaaaaaaaaaaaaaaaaaaaaaaaaaaaaaaaaaaaaaa

SEQ ID NO: 23298 - DNA, 1114 bp, Zea mays
actcctatgggcgattgggttcctcgaggccggccggggaagttcgcctagcgtgtttccactattgagcttggagcagccaagtcaagcaaggaaggaggaggaggaggaggaggtgttccccacgagctcaaagaacagattgcttgcctcagggcagcagcacgagggaaagatggagatcatgagagcatacgaagcactcaatcgagcccagacatatatagaatgggaacgggtaatgcatcacctgcgtccaggcacccaatagaagatgggatcatagagaacgactcagcattgggagatttggctgaacactcacagttcgggagcagcaattccctaccagagttgggacctgatgccacacaagatctagccttctaccaaagaagcaactccgaacagcaatggagctggtctgggtctgttgcaacggaggattccgatgatttcgaggttgcaactaattgctcgttagagctggactgcgtgaggccatctagtgccccaaaagcttcaggtttatcaaatggagggggcacagctgtaaaaaagatccaagtcaagggttcaaaaggttcagacgttaggggagtgaatcctggaaaaaggtcatcgccattacagaagaagccgagtggaccctcaccgacgctaatcaagaagggcggaggtgaaggaaggaagactccaaatggtaaaacaggaaccaagaagtaagcaacccagatgaaacttggttttgctgtgaccaacttcaccttggttagggacagataaacatgttgatactatcgggtgatacattgatatttgccacacgaatacgtcagtcctcttaagggaggaggtcgctagatcttcgggcatctgctgtaaatcactcgttgatttgttgtagtacgaacagaaaacggaccacaaaaaactcgaggatgggaggaagatcatcatcacaaggacgtttttgttagatgtatatgttgcttagcttatttttctcgctgtgtgtaagggcttctatgccctgcccatgtacatgtttggcttcttgccccatggaatatacaaagctcatttcgctctaaaaaaaaaaaaaaaaaaaaaa

SEQ ID NO: 23299 - DNA, 1991 bp, Zea mays
  misc_feature (1972)..(1972): n is a, c, g, or t
  misc_feature (1979)..(1979): n is a, c, g, or t
tttgcaaggaagctcccaccaccaacttggccgcttcttttcttgcttttttgacagatcaagctaacactatattcatatatgtaaagtcacagatcgaagaaccctaaaatgacccttgaaaagatcacagaaaagccgctacacttatttccactcgaccagatgactaatttacaaagcaattcccaaaggtaaacagcagtaggccaggacgacctggaccaccgttcttgaggggctcacttgccccctccaggccctcccagggtgagcacaacatcgtgcaggtcgctgccgcctcgctccggctcggacttgactgcctttgccgggaacccttgccgcgcgcggtggacacagttcggcagcacgaaccccgtcgcctgcggcaccggccgggcgtggacagggatggcgtgcgcgagcagtggccgctgctggggaggcatggccgagctcgtcaggatctgatggtgcaccgtcggtctcggagccgtaaccccaggtcccggagcaaacagaacgcctctgaagagctgcccattcacgacggccgtcatgaggtacccggaatcgaaagctccatcgatcgtcccatggacctctgcgccaataaggggtggtccaggagccggccggggctgaggcttcttatggtcggaggaaaggaactgcacttcctgccgatgatgctgtggcgcgacggtgcggaggaactggtccgtcttcagagccggcctcgaagacacgcagcccccgccgccgcctccgcgcccaggagcactcggagcgccgtcgttagccttgaggcgagcgaacggttgcagcgctgagaccgacgcgttgggcgagggcgagagcttgtgagctccgccgccgttctgctcttggtctgactgcgacggcgaggagtgctgggagagagtcagcgagtgctcctcctgctgctctgactcggccgcctcgctcgggcgagcttcatcggttttccttcgtttcgcacggctgttctctaggccacgcaggaacggattcctctgctcaatttctgcctctcgacgtttctgcaccgtttctccgttgctcgcacctgtatctttagtctctgattggagaaacttcctcctctcttggctccattggttgctcagaaccttgcacgtcgaaatgttgtaacggccgttcggatgctcggagcccaattgcagaatgagaagctcgttcaggggacgctcgtcttcgccgcatcctccatagattgcaatgtcattgttcatgactactgcggtgtgggaaaaccttccctgcggtcgctgcccgctcacctcgagctgactccacgaacggttggcgacatcgagaacccagacgtcgctgtagtattgcttgtcaccaactcctccgataatatagatcttggacccaacactcaaagccgcatgacctgctctgacgccaggcgacgcgcccttgacaggaaaccttgaccacgccatggtgtcgacgtcgagcacgtccaccccgccgtggtagcggtcgccgcagtccccgccgaagacgaagagcctggcgccgacggcgacggcgctgtggctgtccctgggcgcgggggcgccgcccctgatggcctccggcgtggaccacgtcatggtgggcacgtccagcacgtgcacgtcgctgaggtagttgccctccccctccccgctcccgccgaagaccacgaggcggtcgcccccgacgacggtgacgctgtggctctcccgcggcgacggcgccgcccccctgcactgcgggcggctccactccctggtgcgcaggtccagcacgtgcagctcgttcaccttcttgccgccgttggtgcccccgaacacgagcatccggtggcccaccagcgcggcgccgtggctgtcccgcgtgcccggccgctgccccgtcgtggccagcgcgctccacgccatcgtctccacgnccagcgnccggacgctggg

SEQ ID NO: 23300 - DNA, 787 bp, Zea mays
cagaacaaaactagctgcatcaagctaacactatatttatatatgtaaagtcacatattagaaccctaaaatcacccgggaaagattatagaaaagctgctagtcttattttttttcctcaaccagactaatttacaaagcaatccaagaggccaacagcagcaggccaggacctcgacagttcttgaggccttccatgggggggctcacttgccccctccaggccctcccagcgtgagcacaacatcgtgcaggtcgctgctgcctcgctccggctcggacttgacggccttcgccgggaacccttgccgcgcgtggtgggcacagtccggcagcacgaagcccgtggcctgcggcagcggcactggccgggcgtggacggggatggcgtgcgccagcagcggccgttgctggggaggcacggcggagctcgtcaggatctggtgatgcaccgccggcctcggagctgtgaccccaggtcccggagcaaacagaacgcctctgaagagctgcccgttcacgacggcggtcacgaggtacccagaatcaaaggctccatcgactgtcccatgaacctctgcgccaataaggtgtggtgggccgggaggcccccggggctgcggctgatggtcggaggaaaggaactgcacctcccgccgatgctgtggcgcgatggtgcggagaagctggtccgccttgagaggcctcgaggagacgcctccgggtccggcggccttcgtgccgaagccattgccgttgagacgagcgaacggctgcagggctgccc

SEQ ID NO: 23301 - DNA, 2701 bp, Zea mays
cgaccttacctacccccgccttcgcgtctcgatggtctcgtactcttgtcacgttccttcctgactgcccccacttctcctccggcggcgcggcggcgggttacctcccaacagcccgaccatggaagccgacatcgctttcaggtatgagatcccccggaccgcccagttcctccgcgacggcgcctacaccagggtcgcgctccagttccccgacgagatgctgaaggatgctgctgcggtggcgagggcgttgcggcgggagcttgcctccggcggcgccgacagtggggttagggtgttcgtgatggccgacacggcgtacaactcctgctgcgtggacgaggtgggcgcgtcccacatcgatgcgcagtgcgtcgtccactacggccacgcctgcatgagcccaacatcaaatttgccagctttctttgtatttgggaaggcaccgttggatgtccacgcatgtgccggcacattgctggagtgctcaaggaaaagcaataagcgcattctggttttatatggactagagtacgcatatgcattggatgaccttagacagactttcatggagtcatgtaaatcaaattctggcaatcatgaagtccagtatgcagaagttctatgttcagttatgagtccatcatcaagtactacagaagaaaacaaaattcctcagtcgagtggcccctcttgtaatggggatatctccagaaacagcgagtcggcaacattcctgaataatcgtaatggcatggaatgttccagttccacacaaaagtacagccttgctggcatgacatggaatatttcagttgaggagaaaatggaggactatttcatattttggattggacaagatagctcagcatttgccaacatagtgcttaccttcaataaatgtgaaatagttagatatgatgcaatagaaaatcaactcacagcggacgtctctcatctgatgaaaattcttaggcgaagatattacctcgtggagaaggcgaaggatgcaaatattattggcattttggtgggaactctgggtgtagctggttatcttcatataatcgaacaaatgaaagatctgatcaaggccgctggaaagaaatcctatacattggtcatgggtaggcctaattctgccaagcttgcgaattttccagagtgcgaagtttttatttatgtttcttgtgcccaaaccgctctgctggatagcaaggattttttagctccagttattacaccttttgaagctgtactagcttttggcaggggaagagagtggaccggagagtatcttttggatttcaaggatttgatcacttcagagaaacaagaagctgcgagcacaacaggagaagcacgcttttcttttatgaaaggtgtctatgtggaagataattgccctcaagaaaatgaggaacaatcggaaacgtcgctcgctctggctgaggtaactgaaaaggcactgagcatccaaaaccagcacaacgacgctgtcctttaccaaggaagagcaatgtcctcaatcgactacctcaaggcacgttcctaccgtggtctaactggagaatacgaaggcccagttcctgattcagtcttggtaggcagaatgggcagggcagctggttacagtgacgagaaaactgagagcgcacagtgaaggtagcattatgcgagttgatcagttgctacaggctccccttttttggcggtgaaaaaccaggagggtgcacaatgattcaatcatgcagcctggatggtttaccaacctgtgtacttttgtttaggtgggctaacaggtttatagacaattgtcaacatttttttattgttgagaatacctgtttctagtcccagggaacaatactttggatgctgttcaatcaggtggcttttttgctattaggaactactagtgtgtgcctaatcagtttgtatgcaatagtgagagctatctcactgatgtggggaagcctttttttttttctttctaacaactgtggcatgtgttcagaagatgagatgtacactattcacaacatgcactgtactcatccattatgtttgtacaagacaccaaatttactctgcacattcttatttattggtaccggtagtagttccccaagcacaatatggtaaatcttccgatcttaaattgtctccgaaagtaagtttctgtaagggctagtttggaagtctaaaaaccgaaagggattagaggggataaaatcatctttttattcaaaattgaataaggaggagattttagcttctccaatcccctctgtttttgttttttttccaaactaactctaaaacatctcattcatatggagaagattctctttctatatgaagcatcctctaaacatagaagccgttctttcatcgtcatctatgtatagaccctcccttctttcacctattcatttttatatttcaagtaatagattaagtaaaattaaaaaatatataaaatatttgaggatataacaaatatgtatgtactatgagtatttaaggagaaatttgtatttttgtcattggaaagattctcttttgagtatgacttgtgggtccatttgagtataaaatgtgggtctgatagcaattttgtagaactcattctttgcaaaaaatacaaatctctagtacgtatgtagattaatatatagagaacactgttgaagag

SEQ ID NO: 23302 - DNA, 1557 bp, Zea mays
cgagggcccgcggtcgttctagagaccccccgagtttttttttttttttttttttttttttttttttttttttttttttttttgtttacaaagggatgcaatttgtctcaacgttgctgcttgtttgtgtctgtattatacatcatgctagatctcaccatagcctaccagatccgaccataacaccaaaactaaagtaagatacagaagcagcaaaggctccggaatccggacagctcaccaaggccatccctgttttttttctctctagcccttgacccttgttgtacatgcattacaggttactctaaaacaggagagaaaaatgaagcatctaggtactccttgacattattccttggattaaaatctaggtttacaatatttcgtcctctggttctggcctgcactagatcttctgcttgaggacctggcggagctggatcttctggctctccatccgtgcctccatgagctttgccttcaaactgtgcttctgggacgtccgtgggtactctatacagcccttgaagccccggttgaattggatattcatcgagtccggcgagctccactgctcgacgctcggtggactgagtccagtttcttggatgccactttcaacagtggaataagtccccactgagtgccgtgcattagacggtcttgcattcaccgtttcaacgactgcatctttcttgcatacctcactgttctttgggcgggacgacttccagagctttgaaatggccgattctttcttcttgggttggttcatgcttgccaggtaggcatcagctaagtcatcttccagcttctcgttctccctgtactcgaaaccatttctgctgttccaagaaatgcttatcttattgctgactgaaggttcgcttccatcaggcgaaccgctcgaaccccgcatgtcttcatggcttattgtctcccagctgctgccatcttcggcgtcgctttcatctttagggcttttgtttgagtaaactttggctttcgtttcgaggaatatatcggtcattgggctaacctgttgaatttccgattcacatttggcagagctattcgtgtagcatggctcaatctccttaatgacaggctcctcacttggacgcagctcttcaaagatggaaaatatgtcttccgatgccgccggtggctcatatctgaattcagcgccttgggctctgactgacttgattgcctgaatgatgttctctgcttcctctactactgttttgtctccgtttgcagtactgcgtgcggcaataaacgcctcaacatcctcgtgccggtctgctcagctgtgtgtatttggcgtcaagagtaagttttgcatcgacgagcttcatctgcacccgttcttcacgccacacctcagccatctggagcatcttccgttcctcgtctagctcctctcgcaacctcagggagtcccgtttcaaggcctcaatctcagctttgtcttcccccacctctcttgctagctcgttgcatacctcctcggtgagctcacgcgccttcctctctgtctcataatcttgt

SEQ ID NO: 23303 - DNA, 1620 bp, Zea mays
gtgttatttgtcattgtattaccatgttttgtctgatggttaaagaaccgcctttatgctatgctgaatttatttaaccttgcatcgtcttaatcagttgatctctagacaatgttttttatccgccttcatctatatgacccatttgccatagagtcatttgcaggagtgttaaaacagctcgctgttttgggatttgccgcctcaagtttcatctagctacctccaacaaacccttcaatctccatggctacatcggtacttctcctattccaccttgtgctcctactagtagtgtttttattcttgagtagagcattttgctttcaactagcatgtctaattgcatataaattacgtgttctagatatcaactcaatatactaacgaggaggaaattaaaaggaagagaaagaagcgaaagagagttgttgtattagctgtgtctattatggctattattgcaaaccggtatcaacggaggagacctagacacatcgtagatgctaacgaagttcaagagagaaatgtcgagtgcagaaaacaaatgctacgtaatatgtaccagggttcaaatgtctattgctatgacagtttgcgcctaactaagagatcttttagtgacttgagtgccatcttacgggaaaagagtggcctacaggataccctaaatctgtcggtagaagaaaaacttgcaatttttctgcttatagtaggtcataacaccaaaatgaggctgatccgtagcacttatgggtgatcccttgaaccaatcagtcgacacttcaacgaagtgcttagagggattctatctttaagtcatgagttcatcaagcttcctaatccagaaaccactctacctgaggatccaaagtgaaaatggtttgaggactgtctaggtgcactagatggcacacatatcgatgtgaatgttccattgactgacctaggtaggtatagaaataggaagcaacgaatcaccactaatgtattaggggtttgtgatcgacaaatgaagtttctgtatgtcttggctggatgggaagggtcggcttcggattcacgcatactacgtgatgccatgtcacgggaggactcatttgttgttcctagtggtaaatactatctagtggatgctggatatacaaatggtccgggatttcttgccccgtaccgatctacacggtaccacttgaatgaatgggctattcaaggcaacaatccatctactgtgagagagttattcaacctacgccatgcaacaactaggaatgtgatagagagaacttttgggctattgaagatgagatgggcaatcttgaggaccagctcatattttgatttagaaaaccaggtataacatagtaggtattcaattaaaattcaattgttagttttaaaattgtgtattgacttagccaaattattctgtgcagattaggatcatccatgtttgttgcatattgcataattttttaagggatagacaaagagatgtggacgatattctaatacatgaagttgatagtctcatctctactactcctactgaaaatcaaggagaaatgagtctgattacgcatgttcaatcaactaatgagtggggtaattgtagagaca

SEQ ID NO: 23304 - DNA, 1110 bp, Zea mays
ttttttttttttttttgacaagaagaaaaataaggcacaaattaagaacagcacgcggcaagcactcggcgtggatcagttgtaaggtgggcatcggtctttcaggacagtcacataataaacgccttcgtgtccacggccaccagtgtcttattaaccgggcaaaattgcagggcctgttaagaattaagatcctaccctcccctcctgccccggccacggccaccacgccagccgcctcggccacggcctcctcccctacccccgccgccgccaccgccacccttgtggtggccaccagacttcttgccgttgccgaccttcatgtcctcagggagaggcagtatgttgtccacacacttgcggaagctgaagtcatccgaggatccgtcgatcctgcggataaagaagcagcggctttgccacaccgggtggttgcgtatctcgaatgcttcgactcctgccccgatcttcttagcaggttccgcgtggcctttcttcagcaaatcctccagcaccatttgttcatacttattgaactcaatctgcggcgtccagtagtgaagcagaccgaagaagtagtcgaacatctcgacggatgaggagaactcttttggccccagcttcactggcttgcgctccgcctccactgtcttctcattcgcctcctctgtcttcccctccgccgtctcctctgtattctcctccgccgtctcctctgccttctcctccgacgacgcctcctctacctccttagtctcctcctccaacttcggcttcttagccgccgccgcttcctccaccgccgcctcgcctccttcagcagcaggatcaactacttcctcccgttccctcttctgaccggctgcttcaggagcttcggtttccatcgctgtgtctgcggccacccctacctcgggttcagccatgggcggagaagtgcgcaaggtcgaacacgagctgtcggcgctggcggtggaggctgctctggtttggttcgagtagggttttgggctccggccgccctccgaggctacaggttaagaggacgcggtcctggggccgaatgactttccgaaaggccaacagtcccggcccggccggcctcga

SEQ ID NO: 23305 - DNA, 769 bp, Zea mays
cttgcatgcctgcagtaaactgatgtttaagagcaaccttatatagtacaagtaaatgcatccccgaactcaactgaagcttatgaaatttaactagcactacaagcttgttactgccgcagcctggctaacaacagttcatcagatcgaatagactacaccacgcatgccagattaaaggtaaacgatcaatcttctttgcagtcaagatccgcgtggcctttcttcagcaaatcctccagcaccatttgttcatacttattgaactcaatctgcggcgtccagtagtgaagcagaccgaagaagtagtcgaacatctcgacggatgaggagaactcttttggccccagcttcactggcttgcgctccgcctccactgtcttctcattcgcctcctctgtcttcccctccgccgtctcctctgccttctcctccgacgcctcctctacctccttagtctcctcctccaacttcggcttcttagccgccgccgcttcctccaccgccgcctcgcctccttcagcagcaggatcacctacttcatcccgttccctcttctgaccggctgcttcaggagcttcggtttccatcgctgtgtctgcggccacccctacctcgggttcagccatgggcggagaagtgcgcaaggtcgaacacgagctgtcggcgctggcggtggaggctgctctggtttggttcgagtagggtttagggctcagagttccgtccgaggctacaggttaagaggacgcggtccctgggccgaatg

SEQ ID NO: 23306 - DNA, 1526 bp, Zea mays
taggaaggcaccaagagaaaagagcggtggcctgcttcttttgtcgtttggggcgtcgtcattccaatctcacgcgatcacatccggccttcgttggtgcgcagacgacgacgacgacgacgtgcccagtgcgcggccggccggggattcatatcgaatcggatcggaggggaagcagattgcccatcacattccatcgaccagtctcaattcaaggagctgaggacgacctgtccgtcaggagctgatcgagaaacggagggacggttccacagtttcagtccagctagctagctagctagaagatcccattcgctgacagatgggttcctacatccaaggagatggtgaggtccctgtgtacgagtcgggcgccgaggtgcttgagaaggtgcaagagaaatgggcggcggcggcggcggcatcgcggcctcctccctacccggccatgtactcgagcgtgttcggcggcatcatcctggacccggccatgatggttctccccatcgacgaccacatggtccaccggggccacggcgtgttcgacacagccatgatcctggacggcgccctgtacgagctggacgcgcacctggaccgcttcctccggtcggccgcggcggcgcgcgtgggcacggccccgttcccgcgcgaggcgctgcggcgcatcctgatccagatgaccgccgcctcgggctgccgcatgggctccatccgctactggctcagctccgggcccggcgacttcctgctgtcctccaggggctgcccgtcgccggcgttctacggcgtggtgatcgcgtcggagtacgagcagtgcggggtggacggcaccggggtgcgcgcggtcacggccacggtgcccatgaagccgccgcagttcgcgaccgtgaagaacgtgaactacctgcccaacgtgctgtccatcatggacgccgaggaccgcggcgccttcgcgtccgtgtgggtggacgaccaagggtacgtggccgagggccccatggtgaacgtggcgttcgtgacgcccgagcgggagctcgtgctcccggccttcgacaagatcctcagcgggtgcacggccaagaggatgctcgcgctggcgcctcgcctcgtggacgccggcctgctcgcgggcgtcagcaccagggacatcacggccgaggacgccaagcgcagcgccgagatggcgttcgtcggaagcggcctccccgtgctgcccgtcgtcgagtgggacggcaaacccatcggagacgggaaggttgggaagctgatgccggcgctgtctgatctgctgtgggaggacatgaagtccggtcccgacaggatccccgttccatacaagcagtagcctgaagcgaaggcgaagccaagacatgtctgtcagtctgtgtgtgcgtgtgtgtgtgtttgcagtcgaatggtgattgccttgcctgaataaaaataaacctctctctgtatatctgagcgaatcgttttggaaatacgagcagattccatccaaaaaaaaaaaaaaaaaaaaaaaa

SEQ ID NO: 23307 - DNA, 1482 bp, Zea mays
  misc_feature (1476)..(1481): n is a, c, g, or t
atcgaatcggatcggaggggaagcaggagcccgcagggggcggctagcgctggtgcgtgcttcctccattatattatcattgcgcctcgtcctccccaatcctcattgcccatcacattccatcgaccagtctcaattcaaggagctgaggacgacctgtccgtccggagctgatcgagaaacggaggggcggttccagtttcagtccagctagctagctagctagaagatcccattcgctgacagatgggttcctacatccaaggagatgatgaggtccctgtgtacgagtcgggcgccgaggtgcttgcgaaggtgcaagagaaatgggcggcggcggcggcatcgcggcctcctccctacccggccatgtactcgagcgtgttcggcggcatcatcctggacccggccatgatggttctccccatcgacgaccacatggtccaccggggccacggcgtgttcgacacggccatgatcctggacggcgccctgtacgagctggacgcgcacctggaccgcttcctccggtcggccgcggcggcgcgcgtgggcacggccccgttcccgcgcgaggcgctgcggcgcatcctgatccagatgaccgccgcctcgggctgccgcatgggctccatccgctactggctcagctccgggcccggcgacttcctgctgtcctccaggggctgcccgtcgccggcgttctacggcgtggtgatcgcgtcggagtacgagcagtgcggggtggacggcaccggggtgcgcgcggtcacggccacggtgcccatgaagccgccgcagttcgcgaccgtgaagaacgtgaactacctgcccaacgtgctgtccatcatggacgccgaggaccgcggcgccttcgcgtccgtgtgggtggacgaccaagggtacgtggccgagggccccatggtgaacgtggcgttcgtgacgcccgagcgggagctcgtgctcccggccttcgacaagatcctcagcgggtgcacggccaagaggatgctcgcgctggcgcctcgcctcgtggacgccggcctgctcgcgggcgtcagcaccagggacatcacggccgaggacgccaagcgcagcgccgagatggcgttcgtcggcagcggcctccccgtgctgcccgtcgtcgagtgggacggcaaacccatcggagacgggaaggttgggaagctgatgccggcgctgtctgatctgctgtgggaggacatgaagtccggtcccgacaggatccccgttccatacaagcagtagcctgaagcgaaggcgaagccatgacatctctctctctgtgtgtgtgtgtgtttgcagtcgaatggtgattgccttgcctgaataaaaataaacctctctctgtatatctgagcgaatcgttttggaaatacgagcagattccattcaaaaaaaaaaaaaaaaaaaaaaaaaaaaaaaaaaaaaaaaaaaaaaaaaaaaaaaaaaaannnnnna

SEQ ID NO: 23308 - DNA, 710 bp, Zea mays
  misc_feature (29)..(29): n is a, c, g, or t
  misc_feature (679)..(679): n is a, c, g, or t
  misc_feature (682)..(682): n is a, c, g, or t
cgaggtcacggcccggtgcccataagccnccgcagttcgcgaccgtgaagaacgtgaactaccttcccaacgtgctgtccatcatggacgccgaggaccgcggcgccttcgcgtccgtgtgggtggacgaccaagggtacgtggccgagggccccatggtgaacgtggcgttcgtgacgcccgagcgggagctcgtgctcccggccttcgacaagatcctcagcgggtgcccggccaagaggatgctcgcgctggcgcctcgcctcgtggacgccggcctgctcgcgggcgtcagcaccagggacatcacagccgaggacgccaagcgcagcgccgagatggcgttcgtcggcagcggcctccccgtgctgcccgtcgtcgagtgggacggcaaacccatcggagacgggaaggttgggaagctgatgccggcgctgtctgatctgctgtgggaggacatgaagtccggtcccgacaggatccccgttccatacaagcagtagcctgagcgaaggcgaagccatgacatgtctctctctctctctctgtgtatgtgtttgcagtcgaatggtgattgccttgcctgaataaaaataaacctctctctgtatatctgagcgaatcgttttggaaatacgagcagattccatccaaaaaaaaaaaaaaaaaaaaaaaaaanctngagggggggggcgaaaaaaaatcgccct

SEQ ID NO: 23309 - DNA, 1811 bp, Zea mays
ttttttttttttttttggctgactaaccattaggtttacaggttttgaacaggaccatagtcgcgagacacctggaaccgtagtatatatcacatcaacagaaagaaaaccaagtaaagaatgtacaaagaaaaggtccgaaaagattgtactcgtaacagggtgatcatcattatatttgatatgaacattatgatgtttacatgggctagtttctctcctttcctaaagaacacacacgatcctaacacagtgtccagcctccgtgaccatccttcttgtgacattctagcggcctctcccccttgggcctcggcaaatcactctttgtttgaacggtaataggctgggcaatcttcgttgggaagaccaatgatccccgggaggaattgaggccaacagtaaccttcctcaaacccatgaaccgtattgtcgttgggggctctgtcacagggtgcacgaatccatccaattttccctttctcattgtcatatatcaccatgtgatcctgcatcgtaatgtctccaataatgctcaggtccttgagaccgatctcggatccgttgaggatgcccagacaggcattcccgttttctgtgacaatgaggtagttctcaggagggatctccatgagcgtcttcttgccactggcaaagttgagcaccaaagacttgaactccttcctcacatcaagcacagacttgaatggttcctgccctttccagcagagtggcagcgaagggtcggattcctcttccagcgtcctgctcaggccatccttaagagcggtgacaagtgcttggtatggctttgcagcgaagtaggtgaacgagcttccactgtcgaagaccactttcgtcagtctcacgcccagtgaccggtcgccgaagtacaggcttgcggagccaggggagtagtagttggaacgcgctgcgagccatgggagtccatgtcgcgcgttggtaaggcacgagatcgtcaccgaagaagaggaacccgccgcccctcaggctgaggcagtggccgaccacgttcttggtgacgccacgctgtttgagctgcgagagcaagctgactgagccggtcccgagccccagcacgccgtcggtaggccaactcaggtcgccgctgcggacctgctggtcgtaaccacacccgaaggcgacgctggggcgagcgacagagccgttggtgaggcggagcgcgaagctgtcgttgatgagcacgccggtggacgacccctggtctgcgtacttgatcacgtagtcgcattgctcgtgcggcgagtcgcatctgtgcttcccgccggccagcccgttgtgcagggaagcgcacagccggtgcacgcacggcaccagcttgctctttgtcggccggtacagcgggtgcggcacctcgttgcagctcctgcagggcgcgtcgcactgcagccaggtgaggtcgctgccggagtccacgtccaggaagtatggcttgggtgggttgccgatgttcatagccacgtagtacaacccgtgcgggtagacgtcgccgtagagcgggaagacggcggaggacggctccgtatccgccccggcggcgatggagctggacgccccgcccctcgccggcttgtccccgcgcgccggcgccggcgccaggaccagcgcgagcagagccacgagcacgaggcccgcgggcggtggtgccatgtgggggcttggctagcggagactctgggagggagcagagggccgggaggaggcagacgcggatagctccttcctgtcttcttctcccttcccccctttctctgaatttattttcttgt

SEQ ID NO: 23310 - DNA, 901 bp, Zea mays
tttttttttttttttttccactcgtaacagggtgatcatcgttatatttcatatgaacattatgatgtttacatgggctagtttctctcctttcctaaagaacacacaccagcctccgtgaccatccttctgctgtttctgtcattctagcggcctcccccttgggccttggcaaatcgctctttgtttgaacggtaataggctgggcaatcttcgttgggaagaccaatgatccccgggaggaattgaggccaacagtaaccttcctcaaacccatgaaccgtatttatgtcgctgttcggagaaatagaaattggaattaagtggggttgggggtgtatgtacacactgtacaggggatgtgtgtgaaatgatcacagaagggcggaggaggaggaggatccgaacttgggggctctgtcacagggtgcacgaatccatccaattttccctttctcattgtcatatatcaccatgtgatcctgcatcgtaatgtctccaataatgctcaggtccttgagaccgatttcggatccgttgaggatgcccagacaggcattcccgttttctgtgacaatgaggtagttctcaggagggatctccatgagcgtcttcttgccactggcgaagttgagcaccaaagacttgaactccttcctcacatcaagcacagacttgaatggttcctgccctttccagcagagaggcagcgaagtgtcgggttcctcttccagcgtcctgctcaggccatccttaagagcggtgacaagtgcttggtatggctttgcagcgaagtaggtgaacgagcttccactgtcgaagaccactttcgccagtctcacgcccagtgaccggtcgccgaagtaccgccgtgcagcccggcccggccggctcgaagcgg

SEQ ID NO: 23311 - DNA, 2104 bp, Zea mays
  misc_feature (2085)..(2085): n is a, c, g, or t
  misc_feature (2099)..(2099): n is a, c, g, or t
ctaaatgaaggaaaaggtttcgacttcgtaactctgttctatgagcaacgagaggtgagcaaaccagagtgatcataaaggtatatcaaatggcattgcacacccttaggatctaaggtattttttttttttgttttgactgcacaatgctctgcatcgccttaagactttcatagtaatctacctgtcaataagccgatgtgtgcacaaccaccacgtacaatgcaagtcgctcgtagccctcacggtcccgcatggccaacaacaggaaaaaaaacactaagcatgcaggcatcacagccccgtagcccagtggtatacctaagtcacgattacattagggaagaaggaagagccttcttccgttttcatcaagcgaggatacatttgacatccttagtgtgacagcatggagagaagcatagacaacttttcgcgagggctgctagaactgacatgattgactaccctctgaagcaatcaggtaccttctagagaccttaactagcttatgccaacaggtatgcacccatatatctcacggaagaaactcattcactaaatgttatgccctgacaaagctgtgctgaaacacttgatgacaaaagagtccctctaaagccttcctcaacctgcagtatatcacccttctgctctgaaatctcatctgctatgtcacggttctcaaagatttcagagtctctgacccaaagaacatccccaggaaagatactcttgtcggcaagagtagcgaagtcaccttcaatctcaacatttcctttgtgaagcttctgattctccttaacgatccctaaagattcccatatcatgagtttcaactgatagacggatgtggaaccagagactttcaaactgattgaattcccagagcttgtcctcctggaacgctttgaaatccgacgatctgatacaggaacatctttagatgcttctttgatagactttggtggtgcttttccatggacaaaataaacgtggatatcttcattctggtagttgagcttctgcaccaatgcacagctctccctttctccaacacattcttcacaaacctcaggatcagttctgacatagggctctctggccccaaaatcgtcatttgcaccataaagagactggtccaaatttccatccgtaatcggcattgcttcagaggaaccgtgcattttatcttgagcgtccttgctaaaagcgatttcagcagatataccttttccaggcgtcgcactccactcctcagagaataacttccaatcatactctgggatgattgttaaaccatcgttatttgatgttttctgagtgatgcttccgcgcttacaaacaagatccaaaggcttttgcagcaatctcgaatgcttttcacatataagtgaactgacaacagcttcaagactctgaggttctggtagtgaagaaatattttttcccgtcgttgtaatataagctctccactctgacaaccaagatgaaggaaccaaataatatttttcaccaggacgaagtgcaaagctcttcccagatattaacttttcatgtttgtgtcgttgctcaagttttactgctctaagattaccctcaacagaagcaacatcagacaattcctgactacagattttgcatggttgacagtctgatggaaaagtaacaacatcatcaaccttctcgctgatggtttgatagagaaataaccacaggctctctggtacggatacccgctttgctcctggagcatgctccggcaggagatacccatggcgacatcttaaagcactcgttggtccattatcagcatcagaaaggataccagcattttttctgcggagccaatgagtcaaccatgcctttgagatgaagtaagaaggactatctgaacaactaccagcaagagctgcttctgcaaggtttttaaatgattctttgcggtcacgatagacatcagcagatactgcatttatcgccccatctttaagacacaccatgcaaaaatcatcaccgctcaatgttggcccccctccatattttgaaaataatttctgccaagctgcagctgagagacgcttncaatgatgtgagcnccggg

SEQ ID NO: 23312 - DNA, 639 bp, Zea mays
cctatgcttggagttgagtcatgtggatgtccctatttttaaagagatttatgatgtttactcgttttctatggttccggctattggagagctggttgctggtgatcggcagtcgtaccaatacttggttgagagcatccgtcggtttccgaatcaggaaaagtttgctcagatgattcaggaagccggattccagagggtggaatatgagaacctcgtgggtggtgtagttgccattcattctggactgaaactgtagagctgaatacggatggatgttttttcatgcgtgcaccgcttctacaattagtagtatttgtttttttttaaaattaattctataataggttcggtggcttgtaaaagcagctggtgctggctgtcagcatcagcacaataagtagtatttgctaataagtagtattaagtagtatttgcgagaagtatgtgctggagcagtagcgtcagtggctattttggcttttaagccagctgacctcttccatttgtaaagttttttcttgaaaacgtgaaaccatccagaacatcaaattagtcttattacatacccccggtaaggcatttttctgttaaaaacaaaaaaaaaaacaaaaaaaaaaaaaaaaaaaaaaaaaataa

SEQ ID NO: 23313 - DNA, 1645 bp, Zea mays
gcacgagggtaattatattgtcattgttgttgctggtagtgatgttactgttctactatcacgaaggagaaatttgatccaattggtgggcctttgcctaaactttcacaagctgattccaagcaatgtgtctaaaatctttttcttgtgttggtaaccaccagatgcttgtcaattgtcaaacttattttggttggcttattttcaagattaaatgatctctggtaactgaggagaatgttgtagatgttgattttccttttaggaaggtgaagctctccgatgtggtagggggaatggaaaatgtgcatatatgcttctgattgcagtgagattagcctcgtccaagttatgggatctgccatgaactagacaagattataagtttacagaggccttacatcaagagagtacaagattgccataaggaagtaaagtctttgagaaaagtgaccttatgagaagcttgagaaaatcaacttgtgtgtgagaagttttgtctacttgtgctaattagtcatatgatatttttagtcatgaactagacaagatcagaagtttaaagaggttttaaatcgagtacaagatcgccataaggaagtacaagtctttgaggaaagtgaccttatgaaaagtttgagcaaatcaacttgtgtgcgagaagttttgtctacttgtgctgatcagtcataccttggaatattgctgaactgttgcctttgttgctcattggcttcttttcttcggaccccctccccggggccccctgctccgcggccgcgtgggtttgatcacaacaccaccctggcgcgctagaggcggggtcgaatcagcaacgacggctgacatgacgctacccatccagttgctcactgctcaggttatagcgaagaacattgtcttagctggatacaaggagatgcagaagctctgagttttgaggatggatctatggatggttacactatcgcatttgggatcagaaatgtgacacacattgagaaagctctatcagaagcttacagttgatggttctaaagcaagggtggaggttcctatgcttggagttgagtcatgtggatgtccctatttttaaatagatttatgatgcttactcgttttctatgattccggctattggagagctggttgatggtgatcggcagatagaagacaggcaacatgctaaccaggcctgtgaaccttaaaccttggcaggaaaagtttgctcagatgattcaggaagccggattccagagggtggaatatgaaaacctcctgagcggtgtagttgccattcattctggactgaaactgtagagctgaatacagatggttgttttttcatgggtgcaccgattctacaattagtagtatttgttgttttttaatgaattctataataggttcggtggcttgtaaaagcagctggtgctggctgtcagcatcatcacaatatgtagaataagtagtatttgctagaagtatgtgctggagcagtagcgtcagtggctattttggcttttaagccagctgacctcttccatttgtaaagctttttcttggaaacgtgaaaccatccagaacatcaaattagtcttatcacatacctcctgcaatacattttttgttctaaaactcgtgc

SEQ ID NO: 23314 - DNA, 582 bp, Zea mays
aaggagatgcagaagctctgagttttgaggatggatctatggatggttacactatcgcatttgggatcagaaatgtgacacacattgagaaagctctatcagaagcttacagttgatggttctaaagcaagggtggaggttcctatgcttggagttgagtcatgtggatgtccctatttttaaatagatgaaaagtttgctcagatgattcaggaagccggattccagagggtggaatatgaaaacctcctgagcggtgtagttgccattcattctggactgaaactgtagagctgaatacagatggttgttttttcatgggtgcaccgcttctacaattagtagtatttgttgttttttaatgaattctataataggttcggtggcttgtaaaagcagctggtgctggctgtcagcatcagcacaatatgtagaataagtagtatttgcgagaagtatgtgctggagcagtagcgtcagtggctattttggcttttaagctagctgacctcttccatttgtaaagctttttcttggaaacgtgaaaccatccagaccatcaaattagtcttatcacatacc

SEQ ID NO: 23315 - DNA, 3538 bp, Zea mays
  misc_feature (160)..(160): n is a, c, g, or t
tctgcagcagggatgtgtgggttgtatttggagttggtggctaaaaatgggagataaaagggagacagagatgtggtggtagttgaatggcgctacggaagatgcgcatgatgccttcttccctccctcattctcgctcgcccccattccaccttcgacnacccctttctccttctccctcctcaatcacctgcagcgaaaaggaaaaggtacacacaatattgagtccatatgcatgcattcgtgatttcaaatggttcttcgttctaacttgtttgagatccgtttggagttttgcgcagcagatctttgacatgcatagggcgtgctacacccactttgtggtttaatttctttcttgaatattaattttctcattaagagcgtattagtgatttccttatctgatctgatctctctttgttcatgtcctttacttgtttgagatccgagagtatttatgattgtaatatttgcctatgacaacacgtacggccgaggcattacaaattgttatttgaacgacgaattgtaggttgtgtgtatttacctaatagtcagtttcatgagtgcacatgcatgtacactccataaagaaaaaacgaatgcaaccacatgcatttctccttgtaatatatattgcagcaattaattcctttcattaccttttcttcttcggttggaacaaatttgagatatgcaaaacaatccaaaaaacattgtacgttgcaccttgtgccattttattgacctgcaacattttctctcaattttatgttgtagggtgtccgcccgtaactaagagctatttagcaataatacatacatagctataccctctttaggtcaagagggtggagttctccttattcggaggaagagctccatcctcattctacaagaccaaaccaataaatggcctctagcccacagtcctcgccatcatcctccaagaagtcgccgccaccacaagaagcatcagctttggcgccaaaatcatcttcaaagtcaccctcgccaccaaagggtgaatcaaattcatctcccagtcccccatcgaaatcgtccctgtcaccaccgccacgaccaaagaaaagtgctagtacatctagctctaaagatgggaagacgaagaagtcgtcttcatcgtcttcatcgtcggataatacagccgctgtgatcaccggcgtggtgcttggggtggtgggcttcgctctgctcttgtccatcgtggcgtgcgtgtgctgcgccaagaagaagaagaaacgtccgcccccaatgaacatgcccttctacaccgacgagaaaggtaacgtcgatcgtgtatatatatatattattacacacaagtaaactgttgattttgatgcatgtgtgcatgagtgcaggcaatgtgtattaccccaacgctggtctgccgcctatgtggcagcaatatggcagcaacggcagcatccctccgccgggatggcaccatcacggcggcgggaacccgctgtcgccatcgctgggctcgatggcggcgcccctgagcggcgagatgtactcgtccggcccccacgggcctcccctccccccaccttcgccgaacgtggcgctggggttctccaagagctccttctcgtacgaggagctagcggcagcgacgtcgcgcgccccgccggccgtcctgctggggcagggcgggttcgggtacgtgtacaagggcgtgctcgccggcagcgggaacgaggtggcggtgaagcagctcaagtccgggagcgggcagggggagcgcgagttccaggcggaggtggagatcatcagccgcgtgcaccaccgtcacctggtgtcgctcgtgggctactgcatcgcgggcaaccagcgcatgctcgtctacgagttcgtggccaacaacacgctggagcaccatctgtacgccaaggacggccctgtcatggactggagcacccgcatgaagatcgcgctcggctccgccaagggcctcgcctacctccacgaggactgccatcctcggatcatccaccgcgacatcaaggccgccaacatcctgctggacaacaacttcgaggccatggtggcggacttcgggctggccaagctcacgacggacaccaacacgcacgtctccacgcgcgtcatgggcaccttcggctacctggcgccggagtacgcgtccagcggcaagctcacggacaggtcggacgtcttctccttcggcgtcatgctgctggagctgctcacggggcgccgccccatcgataccaccaactacatggaggacagcctcgtggactgggcgcgcccgctgctgagcgccgcgctggcgggggagacgggcttcgccgagctcgtcgacccccgtctgggaggcgagtactccgtcgtcgaggtggagcgcttggcggcctgcgccgccgccagcacccgccactcggccaagcgccgccccaagatgagccagatcgtgcgcgcgctggagggcgacgcatcgctggaggatctgcaccaggacggcggcaagcccgggcagagcgtgctcttctccggcggtggctccgacaacatctcccgcctaaggcagctcgccttcgacagcggcgactactcggactacagcaccgactcctccaccggtggtggtggccgaccgccgcgcaggccatgatgatttatcaacttgacaacttattactagcacaaattgaagctacagtctatacacacatgcaaattagattgagcgagggagatcgagagagagctcttaactaatttgagggcgatctatagttaagctatggcagcaagtggcgatcgatgtggagatccatggttcatgtaattatattattgctgtgcttgtgatatacacatgcatggatttttactggactggatcctcgatggttacacgtacggacggacgcaggatcaaaggcggaactcataccctcttccatctttcctgaactagtacttgcacatgtttttagatcgaataacatccaatttcagtcgcaccccgctggtagctcaagaaaagacatcatgaaaattggaagattgcttagaactaaattaataagaactaatcatccctcggaggatagaaattttcctttccagttactaagttttttcgccaatattaataccacatcaaaaaatatgtgaataatgttcgtcccattccttagcaaccccataacaaaaaagtcacttttatgaaagttaatttttagacatgacaattgctcaagtaatttcacattacgagcatattccaagttatgatccataaaaaccactgtatcatctgtatattggagtttggagacctcgatctaccaaatcagacactacgccttgaaattgacccactgctagggctttcgaaaaacaaatcgccaacatatccgcaacaatattaaaaaggatcggtgagagggggccaccctgtcgtaggcctttgtgtgtattaaaaggacctatatcatcattgaccttcaccccaacgtgccctcctgaaactata

SEQ ID NO: 23316 - DNA, 1524 bp, Zea mays
cgaccggcggtaggatgcaagtatgagcatttggcaaagagagtattcctccccatgctcccgctccctcctgcaccccacgctcgccgacgagccgctcgacctcgtcgcagcttgccgagccatcatgcgccccggtgcggtggtcaacatcaatccacgccgtcaatcgcgtgttggtcctacgctcagtgcatgagtccttcaactggcggtggtggagcaaccgtactaccacagcgcatacacaggacgtagagaacaactccagaaggtgagccccagatctccgctgccgtcttctcgcctgaaaaaagaggggcatctctatcgccaccaaccactagcaggcggcggacgctgctcgcagcaggtaacggacaatgtgcatctaggctaatctgattgcaaatagtttagggtttcagtttcattcacgagtttagtacatgattaatgtattttctcgttggattctgagctcctagcctgatgattagcgttgtttgcacaaagaacggagatctgtcatcaaagaccacctaactgtttctcatggtagacttgcttacttgctctggcttgggtcattgacaatttaccacttcctcagttcctttgttctatcatttatggtgtagttttcctctgtgagaagaaacatgtaacaacacatacacgcacatgcatgccactcattgtttggttcatttagttatcatttacttttggcataacaggcacaataagccactttaggcttcagtctgttctgtgatcagtagaacattatgggctctaaaacaggaggacttttgaggtattttgatgccaaaatttttagacataccatcattgaagttgctctgatctgtacaacatttacaagatttacagagcttcaactaagtcaacttgttgagtcgcttgttacatatcttttgcatatgggaaaaaataatagataaggtacttggagttggcaaacaattgtttgatatacccttttcatatgcacttgttttttggttaccaacctgctagctaataacaagttttcactcatctctaccattttttggaatggcggcgtctcttcgctatatgtcaatcaaagaggtagtgtgagacacatattggcaactgaccaaatgacttcagatatttggggtctcatcgatgttcaaacagagaatgcacaaagtagtcagaaatggtaattatattgtcattgttgttgctgggggtgatgttacttgttctactatcacgaaggagaaatttgatccaattggtgggcctttgcctaaactttcacaagctaattccaagcaatgtgtctgaaatctttttcttgtgttggtaaccaccagatgcttgtcaattgtcaaacttattttggttggcttattttcaagattaaatgatctctggtaactgaggagaaagttgtagatgttgattttccttttaggaaggtgaagctctccgatgtggtagggggttagtacccctttcctctcc

SEQ ID NO: 23317 - DNA, 1044 bp, Zea mays
ctgacgcgtgggctcccatgccaccagcttcggtacacattgctcgtatccattttttcctgcttatatagatcctaaaagctcgtagctcagctctgggtacaagcagattcgcgaagaggataagagcaaattggttggcaacgtgttcagcagtgtggcttccagctacgacctcatgaacgatctcatgagtgtcggcctgcataggctgtggaaggacaggcttatttccaagctgaacccctttccggcaatgaagcatctcgatgtggctggtggaacaggtgatgttgcttttcgtgtactggaaagaattaagagtgtgagtcacagagctatgcagggtacacttactgaaaccgaagaagacacccacatttatgtctgtgacattaatccaaatatgctaaatgttgggaaaaagcgtgctgcagaaagaggttatagcgaagagcattgtcttagctggatacaaggagatgcagaagctctgagttttgaggatggatctatggatggttacactattgcatttgggatcagaaatgtgacgcacattgagaaagctctatcagaagcttacagggttctaaagcgaggggggaggttcctatgcttggagttgagtcatgtggatgtccctgtttttaaagagatttatgatgtttactcgttttctgtgattccgactattggagagctggttgctggtgatcggcagtcgtaccaatacttggttgagagcatccgtcggtttccaaatcaggaaaagtttgctcagatgattcaggaagccggattccagagggtggaatatgagaacctcgtgggtggtgtagttgccattcattctggactgaaactgtagagctgaatacggatggatgttttttatcattcatgcgtgcaccgcaccttctaaaaacaataaattctacaataagcagtactcctgcaatatattttgttaatgttgtttttgaaatgaattctataacatcaaactgattttattacatatctcctgcaatatattttgat

SEQ ID NO: 23318 - DNA, 2659 bp, Zea mays
  misc_feature (1948)..(1948): n is a, c, g, or t
caacttgtgtgcgagaagttttcgcctcttgtgctgatcagtcataccttggaatattgctgaactgttgcctttgttgctcattggcttcaatacttcatacaccatcaaatgagtcatgtgcaaaattcttcgaagcatcagttcttgctctagaagaacttcatcaggtgattactcttttgctttcctttattgaataattagcacatgtgcgttcaaaaaaattgccacatgaatgaaatgatatattctcgaattattctattgagttttttgtttttatcacaacaccaccctggcgcgctagaggcggggtcgaatcagcaacgacggctgacatgacgctacccatccagttgctcactgctcaggttgatctccatgcttgagttcttgaaatgttctgccttaggtgtgaattaccctcgcggccgcccacgcgtccgccgtcgcgccggtgtgatttttctgatcatgaaatggaccagagttccaatctctgttggtttagatgaagtggcaagtttttgttgtgtgtgtgtctctgataaaaggcacccatatttatgtctgtgacattaatccaaatatgctaaatgttgggaaaaagtgtgttgcagaaagaggtcccgagcatgaacttttctaatagattttgttgcctctgtctcaagtgtgggttatgttgttcaacagttggtttttatttccaggttatagcgaagaacattgtcttagctggatacaaggagatgcagaagctctgagttttgaggatggatctatggatggttacactatcgcatttgggatcagaaatgtgacacacattgagaaagctctatcagaagcttacaggtcggctaatttagaaccctaacaattattattgctcatgtttaaattattactgtttgaacttcagtatatgtgtctattcttcgtgattaagttttttttgtcttcgtgtgcagtatcatggattaagcttttttatattttaccatgtttgtttagttgatggttctgaaatgtcattactgtcatatcaattggcatatttcaaaattttttttgcttagttgatggttctaaagcaagggtggaggttcctatgcttggagttgagtcatgtggatgtccctatttttaaatagatgtaagtttcgtcaatcatgtttactcgtcaatctttaactgctctttcagattttctgcccttcttttttcagttatgatgcttactcgttttctatgattccggctattggagagctggttgatggtgatcggcagatagaagacaggcaacatgctaaccaggcctgtgaaccttaaaccttggcaggaaaagtttgctcagatgattcaggaagccggattccagagggtggaatatgaaaacctcctgagcggtgtagttgccattcattctggactgaaactgtagagctgaatacagatggttgttttttcatgggtgcaccgattctacaattagtagtatttgttgttttttaatgaattctataataggttcggtggcttgtaaaagcagctggtgctggctgtcagcatcatcacaatatgtagaataagtagtatttgctagaagtatgtgctggagcagtagcgtcagtggctattttggcttttaagccagctgacctcttccatttgtaaagctttttcttggaaacgtgaaaccatccagaacatcaaattagtcttatcacatacctcctgcaatacatttttttgttctgaaaacaatgccagagttaaaataagattgacttagcatctgagctgacttaccatcaaggcaaagatgtattcatagagcaatagcatgctcgctaccttggcagcttgaccagaaacctcatcatgtccacaggctgcttcggggtcaggagccgctgcgtgacaagagccaacaganacgtcttcttgggtttggccgggaagaggcacgattgcaatggaacattggacttgttggacgacacgagccctaggttgctgttgctgctgccaccatggccggacgagctgtcgtcgccgttgtcctctgctccacctccgcatggagacccttgatgtggtctgctgccaccatgggcagacgagctgtcatcgtcgttgtccttctgctccacctccacatggagacccttgatgtggtccagccccgtctgcactcctgctgcatgttgaggacctcccctggaaattggcggactaatacgacaggaattgatgatcggccttcgtgtctagcgccaccgtgatctcccgtatgtcgcacacagtggcagacatagaactagaatttacgggagcccaaaaagatcgtattacaaaattaagcatgcccataaaaaacaagtattacataaaattaaagtttcataccaatatacgatacatattcaaaaaataaagtatatgaacaaaaaaagtaaacatatctttgattttttattggccgaatcaaaatctctacaacttattaaggctgcaaggggtagcctgcctcccttgcgttctgccgttagaaatcacatccgtccgttctatcgtcctgtgatctaagccgcccgatcccatcccacgaccccgcagacatcgtactcccttccccacgaaatcc

SEQ ID NO: 23319 - DNA, 2047 bp, Zea mays
  misc_feature (486)..(486): n is a, c, g, or t
ggggcgacccgggctgcctgagctgcagccccgcatcgcggcctagtagaggcccatcgtcgcgcgacgcgacctagcggcagacgtccttcgtccagccccagcccaagctccagccgccgcttggctcctgccgtcctgcgtcctggtccagcgcttcctctccagctccagcgccgcagcgcgctcgcccgtgcctcatctccagctctccagcgccgcagcgcgctcacggcccaccagcgccagccgccaggccgccaccgcggcaccgccaggcgcccaggcgcgctcgcccgccgaccgccgttgtccttgtccagccgccggagtccggagcaccgagcacgggagcagccgaggcgagcaaccgagcaccgccattgagcaacagtgaccgtgagccaagccgggctctctcaatatcaccacaggaacaaaggatcagaaccccccgtccgggccgcagggaggctagcgtctttngaaactccaacgacccctactccttccctctcaggccgagtccccaagcataagcatcccgaccgcagcggcggcggcagccttcctccactcccatgccaccagcttcgggtacaagcaggttcgcgaagaggataagagcaaattggttggcaacgtgttcagcagcgtggcttctagctacgacctcatgaacgatctcatgagtgtcggcctgcataggctgtggaaggacaggcttatttccaagctgaacccctttccggggatgaagcatctcgatgtggctggtggaacaggtgatgttgcttttcgtgtactggaaatagttaagagtgtgggtcacagagctatgcagggtactcttactgaaaccgaagaaggcacccacatttatgtctgtgacattaatccaaatatgctaaatgttgggaaaaagcgtgctgcagaaagaggttatagcgaagaacattgtcttagctggatacaaggagatgcagaagctctgagttttgaggatggatctatggatggttacactatcgcatttgggatcagaaatgtgacgcacattgagaaagctctgtcagaagcttacagggttctaaagcaaggggggaggttcctatgcttggagttgagtcatgtggatgtccctatttttaaagagatttatgatgtttactcgttttctatggttccggctattggagagctggttgctggtgatcggcagtcgtaccaatacttggttgagagcatccgtcggtttccgaatcaggaaaagtttgctcagatgattcaggaagccggattccagagggtggaatatgagaacctcgtgggtggtgtagttgccattcattctggactgaaactgtagagctgaatacggatggatgttttttcatgcgtgcaccgcttctacaattagtagtatttgttttttttcaaattaattctataataggttcggtggcttgtaaaagcagctggtgctggctgtcagcatcagcacaataagtagtatttgctaataagtagtattgttgctggcgcgaagtatatgctggagcagtagcgtcagtggctattttggcttttaagccagctgacctcttccatttgtaaagttttttcttgaaaacgtgaaaccatccagaacatcaaattagtcttatcacatacctcctgcaatacattttttttgtttaaaaaacaatgtcagagttaaaatacgattgacttagcatctgagatgacttaccatcacagcaaagatgtattcagagagcaatagcatgcttgctaccttggcagcttggtcagaagcctcatcatgtccacgggctgcttcggtagcagcggcgtgacacgggccagcagagacgtagacgtcttcttgggcttggccgcgaagaggcacgattacaacggaacattattggacttgttgcaccgcacgagccccaggttgctgttgcttaggcagacgagctgtcgtcgccgttgtcccctgctccacctggagacccttgatgtggtccagccccgcctgcag

SEQ ID NO: 23320 - DNA, 1300 bp, Zea mays
tttttttttttttttctttagctttgaacagctgtgccttttttttacattgattcatataaagaatgatgttggtcatctgatattattgctcgcattcagaaaaaatcagaatagccgccgaaagggatgcaagtaaaaatcactcaagtggtcgttatcgttgacaacactacagcctttatacatgcgcaggcctgagaaaaacgaccaaaggagaaaggagccgtaaacaggaactaggtgtggagttacagttagtaatcagccattagctttcatattctgatatcactgcatctgctgtgccatcacctggactcggttgtggcccctctagtctggttaagacatctggtgctccagcagcgtccctgacaatcaatatttcttcatccaagtaagagatcatgaataatcgttgaaatgccccaccgagtggcaatttaagcccctccgaaacagcttcccttatagggctaggaagttgttgtagagctcctgcagtttggccaagcaagcccttcaactgttcaggcaatgattcttcattgattctgggaatcgctataaggccctcaacgtattcctctttcatcctgatggggccctcaacggacaattgagtagtcagtaggaatttgctttgtatcgtgtttagaaacttgaggttagatgagagcttggagtatccatccttgatcaacacatcaagtcccataaagtgtgcaaccgatgtaggcgacctctcaaacaaaaggcgggccgcaaatgctccaggactgctatcaccaaaccattcaaaattccatcgaccctccagaaacggcgatgttgtggggcgtggtgtcggattcaagcgctcaagtccaacaattcgctcattgacatcgatcctctgcatctcagtggtcttcccgctgactaaggcctcgaaacccccagcatctttaaaggcgaggagcagggactccttggcggagaggcgctccatctcgcgggcgtagctggcagcggcgcccccctggaaggtctgggccatggctctgcagcgccccgcggagtagcgggggcggcggggcgagaggcgcacccggccgtcgcggcggacgcggaaggggacagggaggaacgctggataggccggagtcagcgccacggcggctgccatgcctgacgagctgctgggctacagatttctctctcgtgctacagtctacagccgccggtggtgcggtgccgtggtggtggtagcagagaaaatttgactgatattttgcctccatctacttctattgtc

SEQ ID NO: 23321 - DNA, 838 bp, Zea mays
ggccgcttttttttttttttttttggaaaagaatgatgatggtcatctgatattattgctagcattcagaaaatcagaatagccgccgaaagggatgattcaagtggtcgttatcgttgacaacactacagcctttatacatgcgcaggcctaagaaaaacgaccaaagagaagaaaggagccgtaaacaggaactaggtgtggagttacagttagtaatcagccattagctttcatattctgatatcactgcatctgctgtgccatcacctggactcggttgtggccccggacgcgtgggcgggacatctggtgctccagcagcgtccctgataatcgagtggcaatttaagcccctccgaagcagcttcccttatagggctaggaagttgttgtagaagctcctgcagtttggccaagcaagcccttcaactgttcaggcaatgattcttcattgattctgggaatcgctataaggccctcaacgtattcctctttcatcctgatggggccctcaacggacaattgagtagtcagtaggaatttgctttgtatcagtgtttagaaacttgaggttagatgagagcctggagtatccatccttgatcaacacatcaagtcccataaagtgtgcaaccgatgtaggcgacctctcaaacaaaagacgggccgcaaatgctccaggactgctatcaccaaaccattcaaaattccatcgaccctccagaaacgacgatgttgtggggcgtggtgtcggattcaagcgcgcaagtcgggcaattcgctcattgacatcgaacactaacatctcagtggtcttcccgctgactaaggcagt

SEQ ID NO: 23322 - DNA, 2385 bp, Zea mays
ggccgcaaattttttttttttttttttcttttttttttttcatataaactggtgatgaacatttgaatatttagatattgttgctcatattcagaatagacaaatggtatgtattaagtaaaaacactcgagtggtcatcatcgttgacaacactagaactagaaagctttatatacgcgcgagactgagaaaatgaccaaagaggagaaaggagccataaacaggagctaggtgcggagctacagtcagcactgaggcattagctttcatattccgatatcactgcatctgctgtgccgtcacctggattcggttgcggcccctcaagtctggttaagacgtcaggtgctccagcagcatctctgataatcaatatttcttcatccaagtaagagatcatgaataagcgttgaaatgatccactaagtggcaatttaagcccctctgaaacagcatcccttatagggctaggaagttgttgtagagctcctgcagtttggccaagcaagccctttaactgttcaggcaatgattcttcattgattctgggaatctctataaggccctcaacatattcctctttcatcctgatggggccctcaacagacaattgagtagtcagtaagaacttgctttgtatcgtgtttacaaacttgaggtttgatgagagcttggagtatccatccttgatcagcacatcaagtcccataaagtgtgcaacagccgtaggtgacctctcaaacaaaagacgggctgcaaatgctccaggactactatcaccaaaccattcaaagttccatcgaccctccagaaacggcgatgttgtggggcgcggtgtgggattcaggcgttcaagtccaacgattcgctcattgacatcgatcctctgcatctcagtggtcttcccgctgactaaggcctcgaaacccccagcatctttaaaggcgaggagcaatgactccttggcggagaggcgctccatctcgcgggcgtagctggcggcggcgcccccctggaaggtctgggccgtggctctgcagcgccccgcggagcagcgggttcggcgaggcgagagggccacccggccgtcgcggcggccgcggaaggggacagggaggagagctggagaggccggtgccagcgccacgacggccgccattgcctgactcgctggctgctgggttacagatttctctttcgtgctacagtctacagccacggctgctgcctttggcgacgtggaaatcgcccagaatagccgggaaaacttgatattttcgatttttttccacctcaaatgtgtttcaactagggcggctcgcccatctccgcccatctcgcgagtttcaaaaaacggttcgtctcggcttgtggctcgctcgacggccgagccaacgagcctagccgactcgccgagccaatgaacctagacataagaaactaggcataaacgtaaatatgatctccaaattataatataaaattttaaaaatattttaaattaataaaatagatatattactaatataatatataaaataaattatttttacagtaatctcaaataatataaattaattgtctactcgtactaatattatatgctaattaagattttatctaacaaattattgttggatcgagccacggtgcagctcgtgtgagctgcaccgagtcgagccgagctagctcgctcttttcacgagccaagaaaaggctcggctcgggctcgttctgaacatcgagccggtctgagccgagctgagctgctgcgagctcgagccagctcgtcgagctcgagtttttttccagccctaggcttatgtgtgatattgtacctttttcatgcggactcacaatattttttcctttgccttcttatcttttggtcgtttcttcctctcacctttcattgttactctctgaaagagaaatgtgcccttggacaatttctataagtattttggtgattagatgtccaacacattaaaggagtacttatgtggtaaatatgtgaagagtgtaaatcaaagtgtaagatatgtttctagacttgataaattgatttatgtactaacatggttatcaaagtgctagaaacagtgactaaagaagaagagaagaaaagaaaaagagttggctgtgtgcagccaacactagctcagtctggcacaccggactgtccggtggtgcatcggacagtgtccggtgcgccaggctggccggcggtgaaatgactgctctcgagaaaatgaagagacgtacggctataatttaccggactgtccggtggtgcaccggactgtccgatgagccaacggtcggccgcgcgatctacgggcgatgcgtggcccacaacaacggtcggttgggcacaccgaact

SEQ ID NO: 23323 - DNA, 3213 bp, Zea mays
gccggccgggccggggggtccattccgatcccgccgctacccctccgcttccgccctctcgctttcgttgtcatgaggagcctcaccgtggcaagccgccacccgggcgccgctttctctacccgccgccgcccccttcttcaccccgccgcagccggaagggactcgaccttccagcggtgctggcgatgggaaaaaactcaggacagctccttcgggagctcactaaggaccagccgccttccaagaactgtgcacggagatattttgaagaatttgctcgcaccaactgctggtgctgtttcagttgagcaagctgaagctattgctgacctcccaaaaggtgacatgtggtcggtgcacaagtttggtggcacatgcatggggacctctgagagaattcacaatgttgctgatatagtccttcgtgatccttctgagaggaaactggtagttgtatctgcaatgtctaaggttaccgacatgatgtataatcttgtaaacaaggctcaatcaagggatgattcttacattgctgtactggatgaagtttttgataagcatatgacaacagcaaaggatttgcttgctggagaagaccttgcaagattcctgtctcagttacatgcagacatcagtaacctaaaagcaatgcttcgggccatatatatagctgggcatgcaacagagtctttctctgattttgttgttggtcatggagagttatggtctgctcaaatgttatcatatgcaatacagaagtctggaacaccatgcagttggatggatacaagggaagttctagttgtgaatccgtcaggagccaaccaggtagatcctgactatttggaatctgaaaaacgacttgaaaaatggttttctcgatgtccggctgagacaataattgctactgggtttattgcgagtacacctgaaaacatcccaacaaccttaaaaagagatggaagtgatttctctgcagccataattggttcccttgttaaggctcgccaggtgaccatctggactgatgttgatggggccccccccccccccccccgaaaagttagtgaggctgtaatcttaagcacattgtcgtatcaggaggcctgggaaatgtcatattttggggcaaatgtcttgcatccacgtactattatacctgtgatgaaatataatatccctattgttataaggaacatattcaatacttctgcccctggaactatgatctgtcaacagcctgctaatgaaaacggtgatttggaggcttgtgtcaaagcttttgcaactatagataaattggctttggttaatgtcgaagggactggaatggctggtgtcccaggtacagcaaatgccatatttggtgctgtgaaggatgttggagcaaatgttatcatgatatcacaggctagcagtgaacactctgtatgctttgctgttccagaaaaggaagttgcattggtttctgcagccttgcatgctaggtttcgtgaagcattggcagcagggaggttatctaaggttgaagtcattcataattgtagcatccttgctactgtcggcctgaggatggcaagtacacctggagtcagcgcgaccctttttgatgcactagctaaggcaaatattaatgtaagggcgatagctcaaggttgcagtgagtacaacattactattgtactgaagcaagaagactgcgtgcgggctctgagagctgcccactcaaggttcttcctctccaaaaccacactggctgttggcatcattggacctgggttgattggtcgcacactacttaatcagctgaaggatcaggctgctgtcctcaaggaaaatatgaacattgatttgcgtgtcatgggaatagctggttctaggacaatgcttttaagtgatataggagtagatttgacccagtggaaagagaagctacaaactgaagcagaacctgccaatcttgataagtttgttcatcatttgtctgagaatcactttttccctaacagagttttggtagattgcacagcagatacaagtgttgcatctcactattatgattggctaaagaaaggaatccatgtcatcactccaaacaagaaagcaaattcagggccacttgacaggtatcttaaacttagaactcttcagcgtgcatcatatactcattacttctatgaagcaactgttggtgctggcctccctatcattagcactctgcgtggtctcctagagacaggtgacaagatattgcgcattgaagggattttcagtggaacgttaagttatatttttaacaacttcgaaggagcaagaacctttagtgatgttgttgctgaagcaaaaaaagcaggatacacagaaccagatccaagagatgatctgtctggtactgatgttgccaggaaggtcataattcttgcaagggaatctggtttggggcttgaactttctgatattcctgtacgaagtcttgtgccggaggcacttaagtcatgtacctcagccgacgaatacatgcagaagttaccatcttttgacgaggattgggcaagagagaggaaaaatgctgaagctgcgggagaagttctgcggtatgttggagtggtggatgtggtcagcaagaaggggcaggtggagctgcgagcctacaagagggaccacccgttcgcgcagctatctggttccgacaacatcatagccttcaccacctcgaggtacaaggatcagccactgatcgtgcgaggtccgggggctggtgcggaagtgactgcaggaggcgtcttctgcgacatactgcgcctgtcttcctaccttggtgccccctcgtagtctgtcaaggttttgcggtgccgtggtgttgtgttgctgctctactactggttttttttgttgttgttgttgttagtgcttggaatagctggagtaagtatggattaagtgagttctggggtgttaagggttgggtgtcttagttagaaggtcgtattggagggaatggaatccgttcaccgttcttgcgtgttgcaataatcttgtgtggagtctccaggtttgttcggttgctaatagtaagccaagccaatggcgagtctagtgaagaaccaaataaaaaaggctgggctgtaaggaatgtatccacacgttacttcattggtgtcaccataaatatatacctggatcatattggcttggttaaatttggttcgt

SEQ ID NO: 23324 - DNA, 1044 bp, Zea mays
  misc_feature (10)..(10): n is a, c, g, or t
gtaccctcgnaggcctcggccctgggtacctcgaggccggccgggaagcatcgagaagctagcccacatagcccttccagcaacgcgcgatcgaagggttgagagctattggaagcaagtacgtgcatggcgaggtttgcgctcgtggcgtgcgccgctgccacggcggcgctgctgctcggcgtggcggcagcggacgtggcgtcgatcatcacgcaggacgtgtacaaccagatgctgcccaaccgcgacaacacgcagtgccccgccaacggcttctacacctacgacgccttcatccaggccgtcaacttcttcccggggttcggcaccggctccagcaccgacgaactcaacaagcgcgagctcgccgccttcttcggccagacctcccacgagactaccggtggcacgacaggtgccgccgaccagttccagtggggttactgcttcaaggaggagatcaacaaggccacaagtcctccctactatggacgcggaccaattcaattgacagggcaggccaactaccagcaagccggggacgcgataggcgaggacctggtgaacaacccggacctggtgtcctcggacgcggtggtctccttcaagacggccatctggttctggatgacggcgcagtcgcccaagccgtcgtgccacgacgtgatcctcggcaactggacgccgtcgagcgccgacgcggcggcggggcgggttcccggctacggcgccatcaccaacatcatcaacggcgccaaagactgcggcgtggggcaaaacgccgccaacgtcgaccgcatcggctactacaagcgctactgcgacatgctcggcgtcggctacggcgacaacctcgactgctactcccagcagcacttctgatgaactgctgttcgacttgactgctagcactgttgctacagtataagatctgtgtccggacgtgttccatacatattttattattttaatacaataaaggctgatgatccggttatatatatatgaaatctttatcttattatgaacgggggattttcg

SEQ ID NO: 23325 - DNA, 2154 bp, Zea mays
gaccaaagtataatgtagtattttaaatattgtggttttcaaaaactttgttgcctaaatggacaattccacaactaacaagcactattttgtccatcattccaaagccatataagcaaacccatgttggccagcgcagcaagagaatttcgaagtaccaacacaaaatgctaaaagaaacacgactctgactcgggtgcaacatttagctttgctgaaggtgacacactgaaacacaggtatacgcgaagacacaacttttgttcagacgaagttgtgcccaaacgcctagttgaataaaacctataacacagcagaccaaatcgcttcaccaggaaagaacagtgggcatctactggagccaggggaccacgcctcaaaggaggattatttctgcgtccttggatgctcttctcatcttcaggaggcgtttgagggattctttgtccagtttgttgttgtcttctatccgcgcacttctaagtacaggcgcgtcatcgagcagaagtttcaagaagcctgactctgcacaggaaccagtgaagttgttcatgacaactgtgtaaaggttcttgaagagacaatcctgacgatcaaccgagtcccagaaactcgaggtgggtgcagaatagcccctgtgcataagctgtagctccatgcgtcgcaagttgggagcaatttgaaacaaacagtgagccgcgtttgcttccttcaggttaccaaggtcaagctccagggttatctcggtcagccgatttaacgatcttggtagtttaccaggcacaattccatgtgctgcacactcaaaagcgtgcccgagcaatgaaatattttcaatatccaaaagagaaccaatgaattgggaaagattaaagttggacccagcccttttgacataaccagtgttaacttgcaggttaatcactgctgaagagacgtgcggcgtcacaagattgagatgtttaaacatgccatcaactcttaggactttgagctttgttgagtggatggtgatatcagcaaagctgagcaacctggagagaataagttcctccaagttcgggcagctcgctactaattccccaatattgttttccgttgcacagaactcaacgaaatgaagggtacgcattcgcttaaagcctgcaaacagaggtggcaactggaatatacatccttgcaggcaagcatattccaattccacgcatgagaagaaagaagaagggattttgtaattcctccatatccttgtcttaatttgaatttcttttattccatttcttgacagcataagcatccacctgtggatgtgtcctccaggagaaaacatgtgaacccgccgagcattcatttcaaacttcaaaatagggccatcatggagggagagaaacgttatgacgaagtaaacaaatctgtcgctgtcaccgtcttcattaccattgcctaaagcaaaatcatcttctctgaacatcaattcagtcattgaagcccatgtgtacctccatttccttgacaagagacatgttcttacagcttcttttattggcaaacagcagagaattttgtctttaataacatcaggtagattactgatgatgtcaacatttgtaacagatttatgtcttttcttttgagaacctccacgatccattgggtatacttctattgtgggaacctgcacttgcaatctcgcctagagtttcgggtaccggctcggctgccctcgatctcgtccttgccccggcacaagcaagttagtttcggccccttccttgtcttccttctcttccgtggtatccggcgccgctgtcgataatccacagggcaggacggggcaggagatcggcgcctctaatactggattgcgaccgggcgggattaactggggcaggcaggggcaatcgacgacaactcctgctgcgatgcataggccagccgacccggtcatgcgccggggatcggagcgggggagaaatcactgtagggcgtggcactccatccctccgcgccggcgtccccgaggtgcaggctgtggggttttctcgtcgaattgcgcaacgggcggcggatgttctcgggttgtgggaggggccgaagcccggcgcaagagcgaggagcccgcccctatgccggtaccatgatttttttgatttt

SEQ ID NO: 23326 - DNA, 987 bp, Zea mays
gcaggcaagcatattccaattccacgcatgagaagaaagaagaggggattttgtatttcctccatatccttgtcttaatttgaatttcttttattccatttctggacagcataagcatccacctgtggatgtgtcctccaggagaaaacatgtgaacccgtcgagcattcatttcaaacttcaaaatagggccatcatggagggagagaaacgttatgacgaagtaaacaaatctgtcgctgtcaccgtcttcattaccattgcctaaagcaaaatcatcttctctgaacatcaattcagtcattgaagcccatgtgtacctccatttccttgacaagagacatgttcttacagcttcttttattggcaaacagcagagaattttgtctttaataacatcaggtagattactgatgatgtcaacatttgtaacagatttatgtcttttcttttgagaacctccacgatccattgggtatacttctattgtgggaacctcgcctagagtttcgggtaccggctcggctgccctcgatctcgtccttgccccggcacaagcaagttagtttcggccccttccttgtcttccttctcttccgtggtatccggcgccgctgtcgataatccacagggcaggacggggcaggagatcggcgcctctaatgctggattgcgaccgggcgggattaactggggcaggcaggggcaatcgacgacaactcctgctgcgatgcataggccagccgacccggtcatgcgccggggatcggagcgggggagaaatcactgtagggcgtggcactccatccctccgcgccggcgtccccgaggtgcaggctgtggggttttctcgtcgaattgcgcaacgggcggcggatgttctcgggttgtgggaggggccgaagcgcggcgcaagagcgaggagcccgcccctatgccggtcggaacccggccggccatatttttttgattttacattttaaaatc

SEQ ID NO: 23327 - DNA, 2682 bp, Zea mays
atacagtaaagcaccaaccaatttcttccatattgtaccaaattcatgtctgaaaatagtatgaattaacaatagatatgaaacaacacctattaaatatgatatgtaaaatccatgtgagaaaatatcatcgtagtactaatattatattgacgatataaatatgtaataatattataaatacgttgaaccaaaatatattgaactgatgcggagcaaacattatcaatacgcacagattatttctaaaaagtcaatatacattttttagtgataggtaaatatgtttacactaatctaatcctttttatcgatattgataagtctgtgtggtatgtcttcacttggaacctagcttagggaaagaaaaaaagaactatgagtcatacatatgggctcttactgttacatgacattaaaaagatgcaaattacacatcacatttccagctacgctcttatcgcagcacaacatggttgcttcccctcccctggggtttagataagggaatcttttggggattttagttctgaaatatccgaagagaaaacatggtcctgattcggtaaccaaatacatgtaacacaaaagcatctatgttagttagaagcaaaagaaggggctaaaattccaagcacacagatgaagtacgtgccagatgaaaaatatgcaagtttaacaaatgaaatgaaaacataagcttccatttattttggagcagtttgtgttttcaaaatgtaaagtagggcaccatctatatagttgagtttcaaatgaagcaaaaagaaaagcttagcacaccgagaatctttaaccaacatgctaaagttgttatctctagaagtagacgatgaaaaaaactgacaccctgcaaacatgaccatatgcaccatgactccatgagcaccccggagattcgaagtaacagcagtagcagtcaggtatcaaacacagacaatggtgagcacgggaggtggtaggctcccggtgcgttcgcccgtgcgttgtatgaaactgtcatgacatgcatacaaaacttttctgcaccatacccttcaaatcacaacattgccttcttcaggagataatcactcaccctcattagaatcatcagactcatactcatccttgctttttttcaagcccaagacttgattttgaagctgcagcaactgccttctcttcacttctctggtcctccttcccatcacctttgccattttccttgattactggaatgtttagctccttctcttcatcttcagaatcaagatccattattcatcttcctcgattggttgctcaaccttgtaaccaaagaaaaatacacgggtagttttcgatgtgtgtgacagctcacactctttattgaaaaccaaatcaatttctatctaggggtatttttcaatagagagggttccaatagcaagcttctggtcatcaactttgacatggcactttcacttttctttgattccccaagtgcagcactggaaagtgcaggataaagtcatgtccaagcacacacttgacagtgggtccaggcttgacctcgagacctgcaaaacacagagcaatctgagatagattatatgaagaacacaaacttgatgttgttagaacaatcatttcacaatgcacaaaataagaaatttaggagcatacctctccctgccatgttgagcatatttgtagtagaacaaaagaagcaatccgaggaaggatacaatacgaatgatctgatgttgtttaacaaaggtagcaaaagaacaaacatcctaattcagtgccatcacgtcctataataagaccctattgaaacaggacacattgacagatgcatggtttaaaaagctaataactaacaacagtaacataagcattgccctgccttacttcatttatagagacatcactttcaaataccacatgatcgaacgaaggcaagagagccttctatattaaacacaagcaaacagaaagtaacacatccatgcatatatgattccgatagtcaaacccttctctgaatttgaacacagcctgacaaattgaagaggaactgtcaagtcagaaccagaatagggttatactttaagtaattaggtctctgagatactcacagagatctgtacttttcattttctgcaaggcgattgagcacatctatctcaatcattgcagcatcacggtacttgcggatactgcgaacaacttttatggcaacatattcatgtgtttcacggtcccagcattccaaaacacgcccaaatgtacctacgaaaatccaactcgtagccctcttcattagaataataacggagatacccagcagaagaggagacgacagattgcagaaaacccaaaccttctcccattttgctcaagattttatatcggcgggtcaagttctcgccaaggtcgaatacgaagtgtccatcacggtcatcctccctccatggtggcgacgcgccacccctcgctaccacttctcgctctggtggcggcgcggcggcacagtcatgcgcctggcgcgtccgcttccgagaccgcgatgactccatgcgaaactccgattcgatgaggacgaaacagagagaaaccctagaaggagaaaggctgtcggggctcggggcgcgctaacggcggcgaggagccgcgtgccgccgcgccgccccgagg

SEQ ID NO: 23328 - DNA, 2280 bp, Zea mays
agaactgagaaaaaaagcttaatgtcaatgttttcaagaaggaagaagaaaagagtaccagccaacgagtttaacctttctgctagtttagactttagtttgtgactaggtatgtgcccgtgcgttgcgacaggagcaaaaaaatttgtatgaagcatagatacggaacgacaaatcactacactataaaatgcttaaacgtgcaactaggtccatcatccagttgacaagagctatactattccatggggcagcacaaataaatttccgtaagatgttaaatattatgtagggtacagaggctttatatatcacaagaggaagttcaacatttcatgttctaccaggaaaggacaattacacggtatattgtgccactgcgtttattgtgatcgacgatcacaagaaagtaaatcaaagtttttattgtgagtgtcatttccatccctctcaacttctcaagcatcagcgtgaaacaagttgccatggatctgcttaggaactaactgcatcagtaaaactgacataaaaataaaactgcacatcagcttcaaattcaacgagttaatggcttccaagattgtttgctacaaatggacttaaaatcaggttgcaggactcttctgttgtgtatgcatagtattctttgccgttgtccacattatatctcagagataccactgtccagtcatgttgcaggtggcagatttcttaaaatcaggttgcatgttgcaggtttcttgatgctgtcgtccatgaacaaccacatctgctcattctccagtttcaccttctcctacaggttgttaataatgacaaagcactaatgaaataaaatttatttgggaaaccccactaaggtcatgcctttcaaacaacaattagagataggtacaagaatgtctgaacaattctatatttgcacagtagacaacaatcgatgttgtagtcacatgcataagtatattgtagaaaaccatactccatacagtaaagcaccaaccaatttcttccatattgtaccaaattcatgtctgaaaatagtaattaacaatagatatgaaacaacaaatattaatatgatatgtaaaattcatgtgagaaaatatcatcgtagtactgatattatattgacgatataaatatgtaataatattataaatacgtcgaaccaaatagattgaactgatgccgagcaaacattatccatacgcacagattatttctaaaaagtcaatatacattttttagtgataggtaaatatgtttacactattctcacccttcttatcctttttatcgatattgataagtctgtgtggtatgtcttcacttggaacctagcttagggaaagaaaaaagaactatgggtcatacatatgggctcttactgttacatgacattaaaaagatgcaaattacacatcacatatcagctacgctcttatcgcagcacaacatggttgcttcccctactcaagtgtttagataagggaatcttttggggattttagttctgaaatatccaaagagaaaacatggtcctaattcggtaaccaaatacatgtaacacaaaagcatctatgttagttagaagcaaaagaaggcgctaaaattccaagcacacggatgaagtacatgacagatgaagaatatgcaagtttaacaaatgaaatgaaaacataagcttccatttattttggagcagtttgtgtttgcaaaatgtaaagtagggcaccatctatatagttgagtttcaaatgaaacaaaaaagaaaagcttagcacaccgagaatctttaaccaacatgctaaagttgttatctctagaagtagacgatgaaaaaaactgacaccctgcaaacatgagcatatgcaccatgactccatgagcaccccggagattcaaagtaacagcagtagtagtcaggtatcaaacacagcaatggtgagcacgggaggtggtaggctcccggtgcgttcgcccgtgcattgtatgaaactgtcatgacatgcagacaaaacttttctgcaccatacccttcaaatcacaacattgccttcttcaggagataatcactcaccctcatcagaatcatcagactcatactcatccttgctttttttcaagcccaagacttgattttgaagctgcagcaactgccttctcttcacttctctggtcctccttcccatcacctttgccattttcctagatatattcatgatccaaacaatccataattcaaacgaccccaacaatgccagaaaaaaccccccc

SEQ ID NO: 23329 - DNA, 1510 bp, Zea mays
tctgcccggcgctcccttcttgcttgtttttcaacatctgcaattggattatggaaccagggcattgggacgcagctcatagcgcgtcccggttaacaacatacaggcactaaactccctaggtaaaaaaaaaaatgctagtgtacattacattgggtgaccaaagccatcagctttatcaccaccgcaagatgccttactgacaggcttacacaaactctctggtaaagaggagcaagatacccatcatctttgcaatggacggctctgcctgcttcctcgataccttcttgaagcagagagttacacgagtcgagcctgtccaacaagtcatgtcgggttcctgaagaatggatggtccagagcttcttgcgctgtcagacgttctgatggctcgaaccggaggacactgtatagcaagtctgccagctctgccttcgaatggccagcgttcctcgataccaagtcctttagtcgatccagtttcttcacagctctgatgctttctcttgaaacagcaccttcaggccaatttaaacgtgttgccctcctgaaatatttctgagcagaagaacttgctttccgtatcatatgctctggtagaggtcccaaaactctctccatcattgctaggtgttccagattctcatgtgtctgaaacaatgcttccccagagcatagttcaacgagaatacagccaacactccaaatatcacatggaaaactccagcctaaacctttgtacttggaacttttatatactcagaagacacaagtagtatgttttctggcttcagatcagtgtggataagcctcaagtcatgcatatatgctacagattccaacagttgccgtccaaactcccgcacaagttccacagggaaaggtcggtatctatttctctttagaaaatcatacaagcttggcccaagcttctcaaaaacaatgcatatatgattacgatagtcaaaccatctctgtatttgaacacagagagatctgtatttctcattttctgcaaggcgattgagcacatctatctcaatcattgcagcatcacggtacttgcggatactgcgaacaacttttatggcaacatattcacgtgtttcacggtcccagcattccaaaacacgcccaaatgtaccttctcccattttgctcaagattttatatcggcgggtcaagttctcgccgagatcgaagacgtagtgtccgtcgcggtcatcctccctccatggaggcgacgcgccacccctcgctaccacttctcgctctggtggcagcgcggcggcgcagtcatacgcttggcgcgtccgcttccgagactgcgatgactccatgcgaagctccggtccgatggggtggaaacggagagagaaaccctagatggggaaggccggggccccggccggcgggactgggaacggggattcgtggcgggctggggcccgcatggaagtgagcagaatgggtcgccggtggaggggctgggatcgggcgattctgt

SEQ ID NO: 23330 - DNA, 1688 bp, Zea mays
cataaactatacggacgcatgctatgcttgatttcaacatttgcgattggattatggcaccagggcatcggggcacagctcatagtgtatcccggttaacaacatacaagcgccatctggcgaactaagctccctaggaaaaatgctagtgtacatgacattgggtgactaaagccatcagttttatcaccacaagaagccccattgacaggccttacacaaactctctggtatagaggagcaaaatgctttcagctttgcaatggacagctctgcctgcttcccaccaccaccttcagtagagttacacatgagtcaagcctgctcaacaagtcatgttgggttcctgaagaatggatggtccagagcttcttctgctgtcaggcgttccgatggctcgaaccgtaggagaccgtatagcaagtccaccagtgccacctttgaatggtcagcgttcctcgataccaagtcctttagtcgatccagtttcctcacagctctgatgctttctcttgaaacagcaccttcaggccaatttaatcgtgttgctctcctaaaatatttctgagctgaagagcttgctttccgtatcatatcctctggtagaggtcccaaaaccctctccatcattgctaggtgttccagattctcgtgtgtctgaaacaatgcttccccagagcatagctcaacaagaatacagccaacactccaaatatcacatggaaaactccagcctaaacctaatattatttcaggtgccctataatgcctcgtagaaacaatcgagttatggtcccggttatcaaaggcggtactgccaaaatctatcagctttatggcactggactgcggcaagcacttgaaatgcatctcacctgcggatttcttctttgtacttggaacttttatatactcagaagagacaagtagtatgttttctggcttcagatcagtgtggataagccgcaactcatgcatatatgctacagattccaacagttgccgtccaaactcccgcacaagttccacagggaaaggttggtatctatttctctttagaaaatcatacaagcttggcccaagcttctcaaaaacaatgcatatatgattacgatagtcaaaccatctctgaatttgaacacaaagagatctgtacttttcattttctgcaaggcgattgagcacatctatctcaatcattgcagcatcacggtacttgcggatactgcgaacaacttttatggcaacatattcatgtgtttcacggtcccagcattccaaaacacgcccaaatgtacctacgaaaatccaactcgtagccctcttcattagaataataacggagatacccagcagaagaggagacgacagattgcagaaaacccaaaccttctcccattttgctcaagattttatatcggcgggtcaagttctcgccaaggtcgaatacgaagtgtccatcacggtcatcctccctccatggtggcgacgcgccacccctcgctaccacttctcgctctggtggcggcgcggcggcacagtcatgcgcctggcgcgtccgcttccgagaccgcgatgactccatgcgaaactccgattcgatgaggacgaaacggagagagaaaccctagaaggagaaaggctgtcggggctcggttttttttcccggccggcctcgaggtacccaa

SEQ ID NO: 23331 - DNA, 1654 bp, Zea mays
  misc_feature (5)..(5): n is a, c, g, or t
ggccntaggggctttttttttttttttttttgaagggcaagcattccaaggtacaattcagtcataaactatacggacgcatgctatgcttgatttcaacatttgcgattggattatggcaccagggcatcggggcacagctcatagtgtatcccggttaacaacatacaagcgccatctggcgaactaagctccctaggaaaaatgctagtgtacatgacattgggtgactaaagccatcagttttatcaccacaagaagccccattgacaggccttacacaaactctctggtatagaggagcaaaatgctttcagctttgcaatggacagctctgcctgcttcccaccaccaccttcagtagagttacacatgagtcaagcctgctcaacaagtcatgttgggttcctgaagaatggatggtccagagcttcttctgctgtcaggcgttccgatggctcgaaccgtaggagaccgtatagcaagtccaccagtgccacctttgaatggtcagcgttcctcgataccaagtcctttagtcgatccagtttcctcacagctctgatgctttctcttgaaacagcaccttcaggccaatttaatcgtgttgctctcctaaaatatttctgagctgaagagcttgctttccgtatcatatcctctggtagaggtcccaaaaccctctccatcattgctaggtgttccagattctcgtgtgtctgaaacaatgcttccccagagcatagctcaacaagaatacagccaacactccaaatatcacatggaaaactccagcctaaacctaatattatttcaggtgccctataatgcctcgtagaaacaatcgagttatggtcccgattatcaaaggcggtactgccaaaatctatcagctttatggcactggacttcggcaagcacttgaaatgcatctcaccttgcgaattcttctttgtacttggaacttttatatactcagaagagacaagtagtatgttttctggcttcagatcagtgtggataagccgcaactcatgcatatatgctacagattccaacagttgccgtccaaactcccgcacaagttccacagggaaaggttggtatctatttctctttagaaaatcatacaagcttggcccaagcttctcaaaaacaatgcatatatgattacgatagtcaaaccatctctgaatttgaacacaaagagatctgtacttttcattttctgcaaggcgattgagcacatctatctcaatcattgcagcatcacggtacttgcggatactgcgaacaacttttatggcaacatattcatgtgtttcacggtcccagcattccaaaacacgcccaaatgtaccttctcccattttgctcaagattttatatcggcgggtcaagttctcgccaaggtcgaatacgaagtgtccatcacggtcatcctccctccatggtggcgacgcgccacccctcgctaccacttctcgctctggtggcggcgcggcggcacagtcatgcgcctggcgcgtccgcttccgagaccgcgatgactccatgcgaaactccgattcgatgaggacgaaacagagagaaaccctagaaggagaaaggctgtcggggctcggggcgcgctaacggcggcccgggcgagctc

SEQ ID NO: 23332 - DNA, 3295 bp, Zea mays
atggtgatgctagccttttgtttttggtggcatgttgttgtctagtctagctgacttgctgtgcactttgtgcatgtcctgcactcctgctaagctgctagtgcagtagacagtagtgcactaatcagtagtgcggtagtgccatccttttggtggttaactggttagtggttagttggttgtaaattctagtggttaactggttaattggttgtaaattctgatgtggtggctacttctgtaaattaagccatgaattgatgttgtgatcatgtgatgcatgaagccatggactgatcacagatgcatggttagtggttgcctggttggttgtaaattctgatgttgtgaactgtgatgcttgaagccatgaactgatgaatgttgcaggttgaatgcctgattatgaaatgtgatttgtgttctcacctgtgaactattttctggtgttaaattgtttttgtatttgcatatatcagtatatatatgtgttttttttgttatggctcgtgagccaaacgagccagctcgagctcgttaacgagccgagctgagctgctcttttggctcggttgtttaacgagccgatccgagctggctcgttagcttaacgagtcagctcgaactcggccgagccgagccggctcgatattcagatgtggcgacggtggcagtctgtatgagggagagcagtgaccacgacgccatgcaatgattctcgctgaaggcatatggcggagaacgtggtgacgtggtggtcgaagcgatgaggcagaggcatggcgagccgaggcaacgaagatgttatcccgcggacagttgaaacaattagacatagctaactcatcgcattgtgttcaatcaggtccaactgatagacttagttaaaaaagtgagaatttctttttatgtttgttatgggtgtttgcactatctttaaacttttaaactttgttagtttgttcaacgttaagttccgaaaaagtttcacatctttaagcaattcttggtagtttttttagttcgctagcacaattatattttagtttttttattgactaatgcaagctttagcttattctatgatttatttcgcacactttttccacagatacgtaaacaaacactgatacagcactaggtagcttcagagttcagatgaacagctgctgactgcacattattttccaaattcttgaataaacataggaaactattttgatcacttggctctcttcagtccaaagagggcaaattaaaacggtacagttccaacacattccacccctgaatctgggagggagctagaaggggagttagagttcatttcttatatatgttacacaggagaagcattaccatctttgatcatccacattggggtcagggtccaaaaaagattataacggtaattgtaaactacagaaatcatgaaaggggaggcttttctaagctcgactgctgactgctggctgctatgctagcgggtctaaatctcacattcctacaccgtctcaacttcacgacagcttcctgggacttcccttgcaaaaggtctacgtaaaccgatgctagcactgcccgggggttgttgggcaacatcgccaggccacggctcaccatgtagttggctttttcaacttctccctgccttgcagcaatcatgccaaggttgatatacaggacaccacgggcctcctccggcctgagctgctcaggttcttctgtggcgagttttgtcactgcaggagcaaccaagtcttcaccatcactgtctttctcaaccaaggccttttcagaattctccacactataaggcaactcgacatgattaccatctcttatataaactgatagattctcggcggcatcctctgttctgttcaaagtacatagagcttcggctgcgtatacatggctgaggaacgcatacatcctggaacagtctgtcacctgcagtactgactttgcatacgtcaaagttttcaagggattatcaaggcacaattcaacaaatgccaagttcgccaggacagcctgtctgattttgatgtactcttttctacggatctcgtcatagaaagcaagagaactctgcaaggtagcattcaagcttgtgcccttttgttctccatttacattagctagagttgggcctgaaggtgttttagaatctgtacttgtagtattcttctggcctgagcttttatatccatgtacggttccttggtcccaatcctctgtatcagatgcgattacccaattttccttctcagtagcatccaataatagcagcgcattttgtagacactgtctagcaaatccaagtgaaaccaaatttttatgttcgcctaaagtcacacctgcagaatctaaattacttctcgagttcactgggttgacaatcaactgcctccattgtcctgaccccacaacattgatttcaatctcatcgttgaatgaggaagcaccatttgcacacaggagacccttttctagagctagcaggctgcactcagaaaaacggagccagaaaaggggtcgcttgtagaagagcggcatggcttcacgaaaacaagaagctgctaacaaaggcttcccacacatcaaatgttggataccacagttgtatgaaataaggcaagacttgtcttgtgataatgtagacaacttcattggtttctctgaacgaaatgataagctgtatttcagcgctttgctaaagcaccatatagaggcgtgatacgatctctgttggtggagtatacatcccatgttgttgtggaaaatggctagcattgctggttcagtccgattatttggtgtgctcaatagcttcacagccttcctataattcccccgggcatactccagctgagatttcaagagaagctctgtagatgaatccctaccacgtgccatgttcattagtactttgagttctcgcttcgcaaccttaaggttcctagtgagcagtagaagacggaccttgtaaatctgaagtctaactttcaaatcagcagcagtagcagcaagatcagcagacgcccttgagaaatcattcaagatacgcctgcccacattctgatgtccatcaaaactagagcatagagattcaaattctatttgctcatctggtaaaattccagccgaaaggttctcatatccaccagcataagcatttaattcagaatctggaggcacgctaattttcacaggaggcttcggttgagctaattgctgctgagctatgctggattttcatcgggctcgtatccgaacgagcccgagggta

SEQ ID NO: 23333 - DNA, 2459 bp, Zea mays
ccggccgggaagccggccggccgcgagagagaagggcgacagcccggcgggggactgtctgccagcgccagactgccagtggactgcgagggagcgcctccgcctcagatccaaccccaccgatgcgagctccggcgatgctccgctgggccgcggcggcgctcgccgcgctcctcgccgcctcaccggccgccgcgttctatctacccggcgtggcgcccaacgacttccataagaaagatccacttttggtgaaggtgaataagctgacatccacgaagacgcaacttccctactcatattactctcttcctttctgtaaaccaaacacgatagttgacagtgcagagaatcttggagaagttctgcgtggtgatcgcattgagaactctccttatgtgtttgagatgggggaacccaagatgtgccagattatctgcaaagcaaaaattgatgataaacaggcaaaggagctcaaggaaaaaatagaggatgagtatcgggtgaacatgattcttgacaatctcccactagttgttcctcttgcaaggcaggataggggtgctactgtttaccaggctggatatcatgttggtgtcaagggccaatacgctggtaacaatgataagaagtcctttatccacaatcacttggcatttttagtaaaataccacaaggatgaaactacagatctctctagaattgttggatttgaggtcaaaccattcagtatcaatcaccagtttgaagggccgtggaatgataaaaacactcgtttaatcacatgtgatcctcatgccagcaagcttctggtaaactcagatactcctcaggaggttgaagccgggaaggaaatcatatttacctatgatgtaggcttcgaggagagtgatatcaagtgggcttctcgctgggacacctacttgttaatgatagatgatcaaattcactggttttctattgtgaactctctcatgatcgtactcttcttatctgggatggtggcaatgattatgctccgcaccctgtatagagatatctctaggtacaatcagcttgaaactgaagaagaaacccaagaggagacaggatggaagcttgttcatggagacgtattccgccctcctgcaaactctgacttactctgtgtctgtgttgggactggtgttcagttcttcggtatgctgctagtaaccatgatctttgctgttctgggtttcctttcaccatcaaaccggggaggactgatgactgccatgctgctcacttgggtcttgatggggttgtttgctggatatgcttcttcacgcctgtataagatgttgaaaggatcagaatggaagagcatcaccctgaggaccgccttcctgtttcctgggattgctttcggtattttcttcgtccttaatgctctaatatggggggagaagtcgtctggcgctgttcctttcaccacaatgtttgccttggtcctcctctggtttggtatctcggttcctcttgtatttgtcgggagctatctgggcttcaagcaacctgccattgaggctccggtgaagacgaacaagatcccgagacaggtccccgagcaagcttggtacatgaaccctgccttcaccattctgattggtggcatacttccgttcggagcagtcttcatcgagctcttcttcatcctgacgtcgatctggcttcatcagttctactacatctttggcttcctgttcctggtgttcattatcctcatcgtcacctgtgcggagatcacaatcgtgctgtgctatttccaactgtgcagtgaggactacctgtggtggtggaggtcctttctgacctcaggatcatcagcaatctacctcttcctgtatgccgggttctacttcttcactaagctgcagatcaccaaggtggtgtcggggatactatactttggttacatgcttcttgcctcgtttgccttctgtgtgctcaccggtacgatcggcttttgcgcttgcttctggttcacaagattgatttattcgtctgtgaagatcgactaggcaagttgcacgaccttgcagagtatgctgatctgaagcggcctccattttccactggttttttttcctgatttttcaggaagctgtactttagcttgtgaaccatttatgcccactatggttcagacttgagttgtataaggataggacactactgtcagcttcatatggggttaattttccttgtctttgagaactgctgtatacgttcaatccatggctcattaccgtctgccacccaatttctacctctgccccatgttgatgttgctgcaccgtgccgttgatacgtgctttggtttcatcaagaattgcttgcattcacttgtgcatattgaggaatgtttgcttcatctccacagaatattcgcgctgcatggcaggaggcaggcctccgggagagcttcggtgtgctgt

SEQ ID NO: 23334 - DNA, 2912 bp, Zea mays
aattcggcacgagggccgatttgagcttccttgaacgcaacccgccgccatgcatccgcccaaattctgtctggcccgttcaccatttctcgttcagagttgagacatcagagaagggccacagcacagagagagtcagtctaaaaaaggcatagagagcctccctgccagtggccggactgccagtgtactgtgactgcgagggatcacctccgactccgactcagatccaaccccgaccgatgcgagcgccggcgatgcaccgctgggccgcggcggcgctcgcagcgttcctcgttgccttgccggctgccgccttctacctccctggcgtggcgcccaatgacttccacaaaaaagatccacttttggtgaaggtgaataagctgacatcaacaaagacacaacttccctactcgtattactctcttcctttttgcaagccaaacatgatagttgacagtgcagagaatcttggagaagttctgcgtggtgatcgcattgagaactctccttatgtgtttgagatgggggagcccaagatgtgccagattatttgcaaaacaaaaattgatgataaacaaacaaaggagctcaaggaaaagatagaggatgagtatcgggtgaacatgattcttgacaacctcccactagttgtttctattgcaaggcaggataggggtgctactgtttaccaggctggatatcatgtcggtgtcaagggccaatatgctggtaacaaggatgagaaatcctttatccacaaccacttgacatttttagtgaaataccacaaggatgaaactacagatctctctagaattgttggatttgaggtcaagccattcagtatcaaccaccagtttgaagggccgtggaatgataaaaccactcgtttaatcacatgtgaccctcatgccagcaagcttgtggtaaactcagatactcctcaggaggttgaagctggaaaggaaatcatatttacctatgatgtgggcttcgaggagagtgatgtcaagtgggcttctcgctgggacacatacctggtaatgacagatgatcaaattcactggttttctattgtgaactctctcatgatcgtactcttcttatctgggatggtggccatgattatgctccgcaccctgtatagagatatctctagatacaatcagcttgaaactgaagaagaagcccaagaggagacagggtggaagcttgttcatggagatgtattccgacctcctgcaaactctgatttactctgtgtctgtgttgggactggtgttcagttctttggtatgctgctagtaaccatgatttttgctgttttgggttttctttcgccatcaaaccggggaggactgatgactgccatgctgctcacttgggtcttgatggggttgttcgctggctatgcttcttcacgcctatataagatgttcaaaggatcagaatggaagagcatcaccctaaggaccgctttcctgtttcccgggattgctttcggtattttcttcattctgaatgctcttatatggggggagaagtcgtctggtgctgttcctttcaccacaatgtttgccttggtcctcctttggtttggtatctcggttcctcttgtatttgttgggagctatctgggtttcaagcaacctgccatcgaggctccggtgaagacaaacaagatccccagacaggtccccgagcaggcttggtacatgaaccctgccttcaccattcttattggtggtattcttccgttcggagcagttttcattgagctcttcttcatcctgacatcaatctggcttcaccagttctactacatctttggctttctcttcctggtgttcattatcctcatcatcacctgtgcggagatcacgatcgtgctgtgctatttccaactgtgcagcgaggactacatgtggtggtggaggtcctatctcacatcaggatcatctgcaatctacctcttcctgtatgcggggttctacttcttcactaagctgcagatcaccaaggtggtgtcggggatactatactttggttacatgcttcttgcctcgtttgccttctgtgtgctcaccggtacgatcggcttttgcgcttgcttctggttcacaagattgatttattcgtctgtgaagatcgactaggcaagttgcacgaccttgcagagtatgctgatctgaagcggcctccattttccactgttttttttcctgatttttcaggaagctgtactttagcttgtgaaccatttatgcccactatggttcagacttgagttgtataaggataggacactactgtcagcttcatatggggttaattttccttgtctttgagaactgctgtatacgttcaatccatggctcattaccgtctgccacccaatttctaccaaaaaaaaaaaaaaaaaaagctgcggccccttgggcctacgtgctttggtttcatcaagaattgcttgcattcacttgtgcatattgaggaatgtttgcttcatctccacagaatattcgcgctgcatggcaggaggcaggcctccgggagagcttcggtgtgctgtgttgccacctcagatggcctatgaggtcgacgacacctccggtccggacacagtcggcatcagcctctctccggcggcgctcaccgtcactcccccaccatgcgaataccgtggactagcgggatttatttatgcaaaacaatcatgttgtgattaatgatcgctatccatttacttatttcgtatgaatgatacgtatttttgatagactttttggatctaccaataaccctaaccactagatcaaatgcataaagccttgttcgtttctgtcggattggtgggtcggaacgattcctaaccggattgtttctcttatttatataaactttgg

SEQ ID NO: 23335 - DNA, 973 bp, Zea mays
  misc_feature (762)..(762): n is a, c, g, or t
  misc_feature (764)..(764): n is a, c, g, or t
  misc_feature (779)..(779): n is a, c, g, or t
  misc_feature (788)..(788): n is a, c, g, or t
  misc_feature (791)..(793): n is a, c, g, or t
  misc_feature (795)..(795): n is a, c, g, or t
  misc_feature (806)..(806): n is a, c, g, or t
  misc_feature (808)..(809): n is a, c, g, or t
  misc_feature (818)..(818): n is a, c, g, or t
  misc_feature (821)..(823): n is a, c, g, or t
  misc_feature (825)..(825): n is a, c, g, or t
  misc_feature (827)..(827): n is a, c, g, or t
  misc_feature (835)..(835): n is a, c, g, or t
  misc_feature (837)..(837): n is a, c, g, or t
  misc_feature (844)..(844): n is a, c, g, or t
  misc_feature (853)..(854): n is a, c, g, or t
  misc_feature (856)..(856): n is a, c, g, or t
  misc_feature (862)..(862): n is a, c, g, or t
  misc_feature (864)..(864): n is a, c, g, or t
  misc_feature (866)..(867): n is a, c, g, or t
  misc_feature (871)..(871): n is a, c, g, or t
  misc_feature (875)..(875): n is a, c, g, or t
  misc_feature (879)..(880): n is a, c, g, or t
  misc_feature (882)..(882): n is a, c, g, or t
  misc_feature (896)..(896): n is a, c, g, or t
  misc_feature (900)..(900): n is a, c, g, or t
  misc_feature (903)..(904): n is a, c, g, or t
  misc_feature (913)..(914): n is a, c, g, or t
  misc_feature (918)..(918): n is a, c, g, or t
  misc_feature (921)..(921): n is a, c, g, or t
  misc_feature (923)..(923): n is a, c, g, or t
  misc_feature (928)..(928): n is a, c, g, or t
  misc_feature (930)..(930): n is a, c, g, or t
  misc_feature (932)..(933): n is a, c, g, or t
  misc_feature (938)..(938): n is a, c, g, or t
  misc_feature (942)..(943): n is a, c, g, or t
  misc_feature (950)..(950): n is a, c, g, or t
  misc_feature (957)..(957): n is a, c, g, or t
  misc_feature (965)..(967): n is a, c, g, or t
  misc_feature (970)..(970): n is a, c, g, or t
attgaggctccggtgaagacgaacaagatcccaagacaggtccctgagcaggcttggtacatgaaccctgccttcaccattctgattggtggcatacttccgttcggagcagtcttcatcgagctcttcttcattctgattggtggcatacttccgttcggagcagtcttcatcgagctcttcttcatcctgacgtcgatctggcttcaccagttctactacatctttggcttcctgttcctggtgttcattatcctcatcatcacctgtgcggagatcacgatcgtgctgtgctatttccaactgtgcagtgaggactacctgtggtggtggaggtcctttctgacctcaggatcatcagcaatctacctcttcctgtacgccgggttctacttcttcactaagctacagatcactaaggttgtgtcaggcatgctgtactttggctacatgcttcttgcctcgtttgctttctgtgtgctcaccggtacgatcggcttctacgcctgcttttgcttcacaagattgatttattcatctgtgaagatcgactaggcatgttccatgggcctgcagcgagtataattgtgtttttttcatgaattttcagtgcagctgtacttttggtgttagcttataaaccatttatgctcactgtggttcagagttgtacaaggataggacactactgctagctttatatggggtaattttaacttgtgctgttgagaactgctgcatacattcaatccaaaataggantntgagattaaaaaaanaaatggatnctnnntnccggggatccncnnttctagagnggnnncncngggggggncncactttnttcctttanngnggtaantncnntgcnaatntggnnanctgtcctgtggaanatgntcnntaattcccnnctanatncnaattnantnnaaccngggnncaaaganccaacantacgcgcnnnccntcc

SEQ ID NO: 23336 - DNA, 2341 bp, Zea mays
ttgggtacctcgtggccggcccgggcggcatttcgcatcgttcaattcagaatctgatacatcagagaagggccacagcacagagagagactgtctgccagtggacgcgagggagcgcctccgcctcagatccaacccccaccgatgcgagctccggcgatgctccgctgggccgcggcggcgctcgcggcgctcctcgccgcctcaccggccgccgcgttttacctacccggcgtggcgcccaacgacttccataagaaagatccacttttggtgaaggtgaataagctgacatccacgaagacgcaacttccctactcatattactctcttcctttctgtaaaccaaacacgatagttgacagtgcagagaatcttggagaagttctgcgtggtgatcgcattgagaactctccttatgtgtttgagatgggggaacccaagatgtgccagattatctgcaaagcaaaaattgatgataaacaggcaaaggagcttaaggaaaaaatagaggatgagtatcgggtgaacatgattcttgacaatctcccactagttgttcctattgcaaggcaggataggggtgctactgtttaccaggctggatatcatgttggtgtcaagggccaatacactggtaacaatgatgagaagtcctttatccacaaccacttggcatttttagtaaaataccataaggatgaaactacagatctctctagaattgttggatttgaggtcaaaccattcagtatcaatcaccagtttgaagggccgtggaatgataaaaacactcgtttaatcacatgtgatcctcatgccagcaagcttgtggtaaactcagatactcctcaggaggttgaagccgggaaggaaatcatatttacctatgatgtaggcttcgaggagagtgatatcaagtgggcttctcgctgggacacctacttgttaatgatagatgatcaaattcactggttttctattgtgaactctctcatgatcgtactcttcttatctgggatggtggcaatgattatgctccgcaccctttatagagatatctctaggtacaatcagcttgaaactgaagaagaagcccaagaggagacaggatggaagcttgttcatggagacgtattccgccctcctgcaaactccgacttactctgtgtctgtgttgggactggtgttcagttcttcggtatgctactagtaaccatgatctttgctgttctgggtttcctttcgccatcaaaccggggaggactgatgactgccatgctgctcacttgggtcttgatggggttgttcgccggatatgcttcttcacgcctgtataagatgttgaaaggatcggaatggcggagcatcaccctgaggaccgccttcctgtttcctgggattgctttcggtattttcttcatccttaatgctctaatatggggggagaagtcgtctggcgctgttcctttcaccacaatgtttgctttggtcctcctctggtttggtatctcggttcctcttgtatttgtcgggagctatctgggcttcaagcaacctgccattgaggctccggtgaagacgaacaagatcccaagacaggtccctgagcaggcttggtacatgaaccctgccttcaccattctgattggtggcatacttccgttcggagcagtcttcatcgagctcttcttcatcctgacgtcgatctggcttcaccagttctactacatctttggcttcctgttcctggtgttcattatcctcatcatcacctgtgcggagatcacgatcgtgctgtgctatttccaactgtgcagtgaggactacctgtggtggtggaggtcctttctgacctcaggatcatcagcaatctacctcttcctgtacgccgggttctacttcttcactaagctacagatcactaaggttgtgtcaggcatgctgtactttggctacatgcttcttgcctcgtttgctttctgtgtgctcaccggtacgatcggcttctacgcctgcttctgcttcacaagattgatttattcatctgtgaagatcgactaggcatgttccatgggcctgcagcgagtatgcccattgtgtgttttttttcatgaattttcagtgcagctgtacttttggtgttagcttataaacaatttatgctcactgtggttcagagttgtacaaggataggacactactgctagctttatatggggtaattttaacttgtgctgttgagaactgctgcatacgttcaatccatagtctcgttatcgtctgccaccaatttcctgcttcagctgcatgatgatgtccccgcgtgcttggcttcatc

SEQ ID NO: 23337 - DNA, 4100 bp, Zea mays
ctatatgagccccctgcagatgatattttcttgacaataagctgttgtcacgcaaaccattctccgttctgtttctcttgtttctggttgcttcgtgtaacatgtgaatccaccctactctctgacagtcatatgtgcccatgcataacgctagctgattcaatgaatgatgacaacacattattttcagatccttaaaaagcatgtatgtgtcctagtagttgcgtttacagaaaagaatgtcaaattgtgtatgtttcaatcgtttgagctacggggatgatcagagaattacatttccttcttaaatcatagccttttattttactgaaatatgtgttgtgtgttctaattggttcatacataattttctgcagaaagatccacttttggtgaaggtgaataagctgacatccacgaagacgcaacttccctactcatattactctcttcctttctgtaaaccaaacacgatagttgacagtgcagagaatcttggagaagttctgcgtggtgatcgcattgagaactctccttatgtggtcagtactagattactgcttgtcacatattcagcattgtaatttgtaatgtaccaaatcactgagtcgtcatgcactttgccgttttacgtttgtgttgtagtttgagatgggggaacccaagatgtgccagattatctgcaaagcaaaaattgatgataaacaggcaaaggagctcaaggaaaaaatagaggatgagtatcgggtgaacatgtacggattttatatgtggcactgtaattttgattgcatgaaaaatgctgcagttacataacgtattttcttcacaggattcttgacaatctcccactagttgttcctcttgcaaggcaggataggggtgctactgtttaccaggctggatatcatgttggtgtcaagggccaatacgctggtgtaagtttgtgtgctcagctggtgttttacttttaacagtgtgtaggtctccttttttcttgagagggtggagttatcttattacaaaatatatgttacagaacaatgataagaagtcctttatccacaatcacttggcatttttagtaaaataccacaaggatgaaactacagatctctctagaattgttggatttgaggtcaaaccattcaggttagttttagttatgcttgccctattttgttagtatgatgcctttcacgctgacactatcttgtttactaacttatactttttttgttaaatttctcatgccagtatcaatcaccagtttgaagggccgtggaatgataaaaacactcgtttaatcacatgtgatcctcatgccagcaagcttctggtaaactcagatactcctcaggaggttgaagccgggaaggaaatcatatttacctatgatgtaggcttcgaggtgatgtttctcacatctgcttctctttttgtgccctaacatctttccttaatactccctctgattcttagtgtagaccatttaggatggtgacacggtcttaaatgtgacacttgacctgcaatttttctaaaagtatgttttctatatatattatagaagtattttccatgttgaatctaccacatgaactgcgttgtcaagttacttaacatacattttaaaatttgagtttgttttaatgttttctgatttgcttggtattgctctgcaggagagtgatatcaagtgggcttctcgctgggacacctacttgttaatgatagatgatcaaattcactggttttctattgtgaactctctcatgatcgtactcttcttatctgggatggtggcaatgattatgctccgcaccctgtatagagatatctctaggtacaatcagcttgaaactgaagaagaaacccaagaggagacaggatggaagcttgttcatggagacgtattccgccctcctgcaaactctgacttactctgtgtctgtgttgggactggtgttcagttcttcggtatgctgctagtaaccatgatctttgctgttctgggtttcctttcaccatcaaaccggggaggactgatgactgccatgctgctcacttgggtcttgatggggttgtttgctggatatgcttcttcacgcctgtataagatgttgaaaggatcagaatggaagagcatcaccctgaggaccgccttcctgtttcctgggattgctttcggtattttcttcgtccttaatgctctaatatgggggggagaagtcgtctggcgctgttcctttcaccacaatgtttgccttggtcctcctctggtttggtatctcggttcctcttgtatttgtcgggagctatctgggcttcaagcaacctgccattgaggctccggtgaagacgaacaagatcccgagacaggtccccgagcaggcttggtacatgaaccctgccttcaccattctgattggtggcatacttccgttcggagcagtcttcatcgagctcttcttcatcctgacgtcgatctggcttcatcagttctactacatctttggcttcctgttcctggtgttcattatcctcatcgtcacctgtgcggagatcacaatcgtgctgtgctatttccaactgtgcagtgaggactacctgtggtggtggaggtcctttctgacctcaggatcatcagcaatctacctcttcctgtatgccgggttctacttcttcactaagctgcagatcactaaggtggtgtcgggcatgctgtactttggctacatgcttcttgcctcgttcgctttctgtgtgctcaccggtacgatcggcttctacgcctgcttctgcttcacaagattgatttattcttctgtgaagatcgactaggcatgttccatgggcctgcagcgagtatgcccattgcgtttttttcatgaattttcagtgcagctgtacttttggtgttagcttataaaccatttatgctcactgtggttcagagttgtacaaggataggacactactgctagctttatatggggtaattttaacttgtgctgttgagaactgctgcatacgttcaatccatagtctcgttatcgtctgccacccctttcctgcttcagctgcatgatgatgtccatacgtgcttggctttcatcaagaaaatgttagcttcatctccccagtaatatttcggggactccggcggcactcatcctcaccaggcgaataccgtacgtgatcagtttatgcaaaatattcgaagcgtatgaatgttagtagttaggtgattaatgatgggtatccattttacgaatttcggatgaaatgttcggatcgatatgtatcttgcttcggcttcgttcagatcagctaattataattttttataagctataatagtggaagtgagctagccaattgcttttttataagctagatgatcgaatacttcaaattagaccgcagatagtgtaaactaggctgtttgaatcagctataaattgttttgacagctagcaacctatatcaggggctagtttagaaacttcattttctcaagagattcttattttcctaaaggaaaataaactaatttctcttgtgaaaaggaaaattccattaaaaatagggttcccaaactagccctaataaatcaaaacaagactttagatattttatttttatgaaataatctccaggttgagtctttaagtcaaatccaaaataacctcttgtatcttttgagggcttgtgtttagaagtgaagtattttttagtttctaaagaatatcatggttttagtaaaaaccatagtattttatgtcataagggcatgtttgataatgtagttttaaaagtctatagttttgaaatccggtagtttataattgtacatgacccaaatattgcaatattgccttaccatagtaaaaccgcagtataacttacaatcgagacgtgttttgtttcattagaaattacataagaaacctgaggtcccgagtggacttttcaaatctcctaaaattccacagttttgagtacactatgatatttaaaattgtgttttacttgtaccaaccgtcggctttttaaaaaccaaaaccgcagtattatctaataacaaagtattgtct

SEQ ID NO: 23338 - DNA, 820 bp, Zea mays
  misc_feature (324)..(324): n is a, c, g, or t
  misc_feature (786)..(787): n is a, c, g, or t
  misc_feature (792)..(792): n is a, c, g, or t
  misc_feature (794)..(798): n is a, c, g, or t
cagcaactgaacacgcctgtcccttgctggttcaatttttttccggttataatccgaatgtataacagaactcacatctgattccccacttcttttagaggagagcaaatgttttgaccattcctccaagcttttgcggtgaagagtattcatgctaatagaaggtcgcttctcacggatcatttgtgcagcagctttccaatcttcagcgaaccctaatgcgacaagaagcgcacacatcacacagacacttctgccatgaccataggcacagtggacatagacaggcttgttctgtgaccgctttctcacagcccattgcancggcagactcattctgtgatggctgaggagccctcgtgccccaggtagcaatgcacaaatatgcattgttagagatagtcgagctttttggcagctcgcacgtgcaatctatgatcgcggggtcacctggtggcaggtgttcaactgaagaaggccaccctccaacaaacacaccatcttgtctcagctcccctcgagtctgcaaatccaggagatccacgcgctcttcacagctctaggaaggcttcggaggagattcttccgcttatagtcggccagacggcctcgctaacctcgtcgcgtcctaacgctgtcccctccccgaaagacacgcagtcacgcagaagcgcgctgcccgggtcgcgcgacctagggtttcggggctcgccggtcgcgtcgcctgggggtggggatctttctctagttctctcctctctgagtttttttttttttttttttttnnttttntnnnnnacagagaagattccggccggcc

SEQ ID NO: 23339 - DNA, 1301 bp, Zea mays
ccaaaacaagccccaaaggttaggcaacagcccttccctgtcttgctttcgatgataggactgttatattacaaaaaaggaggccaggagactaaatcttccgtaaagaactaacagtgtaaagctacagtactaatataatttgatacatatagtttttacaacacaattaccacaaaatggtaacttagaatgaaccataggcattcactaggacaggagcaaacaatacaaccaaatgtacaatgcatcttaaatatctgaacacgcctgtctcttgctggtccaattttatttccggttataatccgaatggataacagaactcacatctgattccccacttcttttagaggggagcaaatgttttgaccattcctccaagcttttgcggtgaatagtgttcatgctaatagaaggtcgcttctcatggatcatttgctcagcagctttccaatcttcagccaatcctaatgcgacaagaagcgcacacatcacacagacacttctgccatgaccataggcacagtggacatagacaggtttgttctgtgaccgctgtctcacagcccatcgcacggcagactcaatttgtgatggttgaggagccctcgtatcccaggtagcaacacacagatatgcattgttagatatagttgagctttttggcaactcacacgtgcaatctatgattgcagggtcacctggtggcaggtgttcaaccgaagaaggccatcctccaacaaacactccatctgcaacctcagtgtataagggctcgtttttcacaaatcttcgtatcagcacaaacaggtgaatgaaaagaagaaatggtgagaagatgatccatgaccacaacggaaaacttccatcggatgccttgccaagaagtaaaggaagatcaattgatgggtgggaagctatggagactagtattgcaatcacggatgcatatatgagaggaaatgagataaggatcactcctaatccttggaaaaaacacgccacagaaagcaggacagcagccttcagtccaatcaaccttgatattccccaacccatctcttttctcagctccccctcgagtctgtaaatccaggagattcacgcgcgcttcttccgcggttccgccaatagtcagccagacggcctcgcccgcttcgtcacaccagcgctggccgtgtcgacctaggttttcgggggctcaccggaaccgttgaaaagagggtgaagactgaagacgaggcctctggagtccggacgtggccgtgtgactgtgtgagcgctgagcggtgagccgt

SEQ ID NO: 23340 - DNA, 3069 bp, Zea mays
tggagggggaggggctcgcgcatcgcaccagcgctgcctcggttgcgcttttgagttttttacttgcagacatagcgtagcagaaggaatggaagaggcaggcacaggagagctaacgaggggccaaccacacctcgttcgtgctcctctgcatgccccttccaccgctgctgctacagccaggaactcccagaactagagaggagaagatgctcgacctgccatggctttgcaggccactcgtgcccctatttgtagcactgatgcagtgatgctcgctccagtacgtactactagctggtagctgctgcagtacacctgggaagtaggaagaagagcgcggtggctcctttgtgtactgctccttccttccatgctcgcgaggtttccgagtgtactactagtggtcttgacctgtactgcagcccgagggagacccacccacacacatcccctcggcgagacggtctgcggccacccgtgaccgttgtcgtgacgtgatgttgcgtgcctaccgcccggggtaatctaacagctgaccgtcacatttgacaccaagcagaattttcgtattgagtacataaaattcactgttataaaggtccacatttctataataacaccattcttgagcaccccatgttttataggttcataaccaatgctcattacaacagaccttgaagttgtatatatctgaggatctgaagagtcttgttacacactaaaatgagctgtaaaattattgtgctgcttctaaacctattgcggcctcattttgcaaaagctggacttgttgtctttaggaaagttccgtttattcataatataacatgctacctccgttttcgaatatttgtcatccgttagttcaattttgaactaaaactcaacagataaaaaagaacggaggatgttcgtttttttttttttttttttgtgtaacacgcactctctcaacaaacgtgtgttttacagtaataaactgagtccttcacattacattcaagaaaacaatgtacaactgcaaaaaaaatgaggggggcttcaaaagaatacaacaatgtgaacctgggtgaaaaggctactgaaagtgatgagtactcgcaggaacaagaaatgttatcagcaaatacattgctttgtgggaagaacggctagtcagcttttgcacgaacccttcttttgtgaagtgctgttaggaccaatgacactgccattccgaacaaatacccagcaactgcaccataagtgacacagattggccattcctgccatggtctctcccagtcaagtggcataggccaagcaccgagccatgctcctagcacagctccatggcaaggtgcagagatcatgtagttctcaacatcagttggcgtgaaataaatggagtgagaaagcacatcctgccaatcgatcctggatgctccaaagacacatgctgcgggaacaaacgtaaacagggacatgacaagcgaccagtaaatagtagctatccagtacttgactccaacaggtgccccaagaatgattgctccaaatgcattaaggaacgctcccacgggcaagccgatcaatcctcttgcaacagccctgaaaaacgagcaacttttagcatcacgccggaggtagctgaacactgcgatgactatgggcgcttcacagtcctaagtgaaggagagatggttagttcggatcagaagagataaggatggggagaccaaagatacgtttacaccggcaccggcagctgcctggtgagtgaaagtaccacgagaaggcgaagggcgagcgcggggtcggagacgagcgcgccgcggccagcgagggcgtgggcggcagcaaggcccgcagagcagagcacgtgcgcggccacggcggttagggcgctgatctgggtgacctccgcgcgcatggcggggccgctcttgggtaggttacgggcaggcaccctgagttgggaactgcagcggcgtagtcgcgactcacgagtccgcccgcggctgcggccgtcggcgggcctgtcttctctggtggagcttgatgcagttggtttgtgccggatgcgggatgaagacgatcaaaaaaaaaaagtggcgtgataacgttaaattatgtttgttaagttcaactgtaattagatacaacactaaaaatggatattggcctatttaaacttgttatagcaggtactatagtgtaaatcattaccattattatttacattacattttgtaaaccaaacaacacctaagttagtttgtgccggaggcggactatataaagtctctgtcaagcaaatccacaatgcgacatggatgacaaagacctcaccgagtaagttcacgagtcgggacgaacgatcaagttttcaccaagtgtacccgcgaggatagaagtatagaaccctagcccgcatcaaaggcgtgccaagtagttgccatcagggcatgtaccgtgtgccccccgcgtatggactgagcccaccaccaccaccactacgtagtggggctaatcaagcccggacgtttttccccgcgcgtcgtcgttcgggcgccgaaggcaccacagggcgcggcgccatgccaactgagtcggtgacccccacggtcggtgtcaccatgaccagggcaggatccatggtcggcccacccgtctcggccgggacgttagagcgaactgctgcatcgccacgacacgtcgggccacccaccaacgctatgactttcgcccctccgaaagcggtggaagatggtgtggaggacgcaccctctgagtcagaagaggaggcgattccctcgcccaactcgatagggtgcaaggctttcttgcctttcttctgcactcgaaggcgcctctggcgcccccaaggtatcattctcactgaacggcgaccccctcagggagcggtggaagactgggcactagaagtttgatcccctgcaggtcccacgaccgaaccacctagaggcagcaagccaagctccctttcggtagaatatgagttcctactgtaaagtcccccttgagttataaaagggtagggcaaccttctttctagacaca

SEQ ID NO: 23341 - DNA, 1063 bp, Zea mays
aacacgcactctctcaacaaacgtgtgttttacagtaataaactgagtccttcacattacattcaagaaaacaatgtacaactgcaaaaaaaatgaggggggcttcaaaagaatacaacaatgtgaacctgggtgaaaaggctactgaaagtgatgagtactcgcaggaacaagaaatgttatcagcaaatacattgctttgtgggaagaacggctagtcagcttttgcacgaacccttcttttgtgaagtgctgttaggaccaatgacactgccattccgaacaaatacccagcaactgcaccataagtgacacagattggccattcctgccatggtctctcccagtcaagtggcataggccaagcaccgagccacgctcctagcacagctccatggcaaggtgcagagatcatgtagttctcaacatcagttggcgtgaaataaatggagtgagaaagcacatcctgccaatcgatcctggatgctccaaagacacatgctgcgggaacaaacgtgaacagggacatgacaagcgaccagtaaatagtagctatccagtacttgactccaacaggtgccccaagaatgattgctccaaatgcattaaggaacgctcccacgggcaagccgatcaatcctcttgcaacagccctgaaaaacgagcaacttttagcatcacgccggaggtagctgaacactgcgatgactatgggcgcttcacagaccatgagaaggcgaagggcgagcgcggggtcggagacgagcgcgccgcggccagcgagggcgtgggcggcagcaaggcccgcagagcagagcacgtgcgcggccacggcggttagggcgctgatctgggtgacctccgcgcgcatggcgggaccgctcttgggtaggttacgggcaggcaccctgagttgggaactgcagcggcgtactcgcgactcacgagtccgcccgcggctgcggccgtcggcgcctcggcgggctgtcttctctggtggagcttgatgtttgtgccggatgccggattccggatcgggacgttctaggtaatggtctcgtgc

SEQ ID NO: 23342 - DNA, 2036 bp, Zea mays
ttttttttttttttttagtaaaattgaactggactgacacgcttcggttgggtacagttcggtttgggagagctgcagtgtcgcatcgcatgttgttgtttcagagaaagaataaacaaatggaaataagtgaccctggctgatgaggttccacaccccaaaatatgcctctcagcctctgcgtctaatctagtactagtataaattccatcttccaattccagatgtgaatttttacatatgcacatattttggctgagctgctggatgaaatccaacggaactctgaacatggaagactgaagaaaatgcaggacacaggttcgcgcgcctgtcgcggtctcttgaaatttcctgaggtggagcagtgagctggagaatcaccggccacgaactgcttgcatcgcgttgcgttgcgtcgttcagctcccggcccaggacacgaaggaagcaacgcgggggtctcgtcgtcggcgaccatgcttcctccttgggtcgatgatgccatgccagccatcggatcccggtcagtcaggacgtgaagagctggctgccgagcgtgacgatggcggtgccgccatcgcccatgacggtggtcagggccatctccttctccaggatccggtccagctccgccgccaccagccgcatcctgggccgccgcctcgccgacgggctcaggcagctggacgccaggcccaccacctccgccataccctccgaggtgaagctccctcccagcctcgggtcgaccagctcgttcgagccgaaacgcgcctccatccattgagcgagagagtccttgctggaccccggcggcatcagccccgcagcctccctgcctgtgaccagctccacaaggaacaccccgaagctgtacacgtcgctgctctcagagagctgcgcctgcgccgatgaatgtaccctgcagtgcaagcgagcacgccaggaacgcagtgcatgcatgcatggtaagaatccagatggcagcagaacgtacatttcatccaggccgggctggtttgctactactcactccgggtcttggaagacaccgcgactcgccggagcggcgacggcgccaccatcagtccctcgcagcagcctgtggatcccggcgtcggacaccttggcgatgaagttctcgtcgaccagcacgttgctcgtcttgaagtccctgtggatcagcggcggcgccaggctgtggaggtgactcagacctttagctgctccaatggctattgacagcctctgcttgaactccagcctggtcatcctctccttgccggtgtcgtacaagtggccgctgacactggcgttgggcaggtattcgaacaccagcatctgtagaccgccttcttggcagaagccgatcaacgtcacgacgttgcggtgccagatctctgacagcctcctgatctcgtttgcgaagtcctggcgcggcgcgcccgcgcggcgcttgatggcgacgacggtgccgtctagcagcaggcccttgtacaccaggccaaaggcccccgcgccgaccaggttggcctcggcgaagccgttggtggcgtgcgccagctcctccagcgagaactgcctggcgccgtggaactcgggcgccgacgaggtgcggccgcaccggccccactccgccagcgtgggaggaggagcctccgacgaggatccggtgtcggagctccggtcacggcgccggcgccgcctcacgatcacgagccaccaccacgccacggcgagggcggcggccagtagcagcgcggcggcgccagccgcaacgccggctaccaccggggttggcagtgtcatccgggcggcgaccggggcatcgaaccttggaacgagcaaggaccgctatagcttcggcattcatcaatgaagcgacggagctcggacggggatcgacgacgactcttcacggcgcgcggctctcttgccttcagcgccgcagctcgacaccgcgcgccgccgctgccgccacgaccaacgagagctttgctttgctcctcggtggctcggccgcgagcctgatt

SEQ ID NO: 23343 - DNA, 2574 bp, Zea mays
atctctgaccaggcactgtcatgtcttattttagtattaaataggttggtcatacatacctgacatgaggattaattgtgaagttttaatactaatcatgaagtttgctaattaattatggaccaagttacggccgcgtactgtgcataaaataaataaaaataaaactaatattggatggtagttgagttagttgatgataaaagtatataatattggtgtagtggggtatagaggtttgatatagggggaaccgctgtagagcgtggagatatagggggagagtgttcgctgtcgtggcgagcaccccatgtaaatagtttaatttactgttgcccttgcatgtagagggctaaggaaaaaggaaagatgctattcgctacagtactagaccatttggcagctctggttttacagtgcaaacatcatggtatcttctttcgtaggttctaaatcaacactactttattgtctcagtggcaatcttgattccttcttttctaatcacgcatccatctgtacatcctcagtgtaccattggaaaaacatcgcacaaaaaccgtgctccaaggtacttctgggaaaaaagatggaagcgaaaaaaagaagggaaacaagctccaggacatggatatcttcatcttcaggagctgcacacagggaagtgctgaaacaagctccaagccatggatatcttcatcttcaggagctgcacacagcgaagtggtggttcactccacttggtggttgcaccatcctgtttgtgtggtggcaagacatcactatggaactgaggagcgccttctcaacatcctcagaggcttctctccttagcaaacacatcacatactccatcactgctttatcgcaaggcagtgtgatcctcccatcacttgtgaacccaaactcttcctgcgacagcttcaggagctctacaaacactgccgtgtggaggtaagaaagggggatctcaaaccgcttcccatcagaagagtagacgatgcagttgcccttccctgcaactatgctgctgcaagatgggttgatttcctttctcactactgtgacccttcttcgcccaactgcacccattccctgcatcttcttggacaactgagctagcttcttggagctgatcattttgctaccggtctttgcctaacaaggagacgaactcctgtctttgagatggaatgattagaaacgatctgagttgtctgtcccggcggcctcgggcggtgcccgagtatttatagggcacgtgtgtggtaggatttgtgagggtttgcatcgtggtctcagctatcacaaatggcaagctggcaagggacaagcccatgcgcttctttggtgagatgttcatatcggtagttgggagattcaatgcaaaggaccattgtttctcacatggtggagccatctttactggcttggtacgtgattgtttctgtgtacaggagtggcctaattttgacttaatggtattaggattatactttttcatgtttacatcagtaaagccctttttacgcactcatgtacaggtatattgcccccatgggactattatcctatagaagatctgttcataacaaatgttacaaaacactggatccagtttttccagtgaaatattaaatgtgataacaacatattttcccttgttatataggttcaattaactctatcatctgttgtttgataagggttacatcatcaaatgacgtccatttgtgggtgggtgggtgtgtgggtgggggggggggggggtttgcagaaactaattgatgctagctttacttaattttctcctctcttttccagcatttgcaatatgacggaaacaagataacaaagttgcgaatgagcaaatacattcttgaagtttcattacatccatgtagaataccgcccgcctatgtttacctatataaacttcttgcttaaagctcctgcttagactagagcatatttcgctaatttgctatctagatgtccggattaaaactgatggcctgttggtaaggttagggttatggatattataaatatataattgccctgggtaaatctaaaaaaatatgtataggagatggtgtcggtttcaataaaaaaatggttcatgacatttgagtaatagttattgatgtgtctagttggcaagctgcaaggcaatgaatctcaatgtttgctacaatgaaggcaatgtgattatgaatctaatatttctgggccaaattttggtgcgccgtggtccttgcaggtgtcatagtagggactcggtatagttgaataattgaatcggtattctgttctattgtctccatgcttaatataagcattcagcaatcacttggcgccagctcttgtgaacatacggagatatttatagaaagggtttttttaaattggtgcctttagtttcgaggatgaccaccgaaaagtttatctaggttgcttcatgagtccttcctcagctgatgatgatgtcatgagggagctattcaatggtcaagagacatgagggaaacatgtagggtcctgagattcaagaagtagcctccttgttagttc

SEQ ID NO: 23344 - DNA, 2213 bp, Zea mays
tcggtaccttgcgcttgggcgctccctaatcttgtcagtactattacctactatgtaaagacttggggctgcctcccctaacgaagtaggtcctttttgttggagaaatatacaactccctgattatttgaggaaaagtgaaagaggtattggtgatcgcctaaaaagaaagagctaagctattgggaagctaataaagatgctcttggatggctaacagatgctctctactctccagttagtatagatcttcagccagttgcttactagtagactgatggatgtgtatatcagccttacttgcattgcatctctccaaagaagcaagaatcaccaattgcatctagagttcatcaataatttgggaggggagaagactgggcacctttgaactgttatttcgcttcatacgagttgcttaatacaaccaatactgtctactcaatacggcatattccacactgtcagaaatcagaaggctgtagaagatacatataaaaacacaaaaaaaatgtagggggtatatatattgactgaaattgcagataaataagcatctgtcagtatccgttgtgtcactttaagctatacgtatggtatataaattaccaatcgaagtcttgggtgctgtagagtagagatgagacaggtgttcataacggaagccgtggtcgaagttaaaagaacagcagggtagtactagtggtctggtaccattaagatgagtaatcaatccgagttttgagatccatcaagttcattgctcaacatatggtgcagaagaatgtcaaccatagtacccttcgtcctcacacgcatggatcgccgcttgtttcttccttgtggggtagaatcctgcgtatcagcttctccagctttctccagttccatctcagcaaaaaacgcctccaacacaaatgccacaatcagattaagcagcagtaatactgaaataaggtaaaaactgataaaataaaccaggctccaagaacttccagtcaggtgtgcatagctctccatccagacttgccaattgcccatgactaacaaattgaacagagtaaccataccacttgggtagtcattgaagttgaaaagaagataatcgttcccaaagagatctgtttcttccaacttcaagtttcctgcgtacacgatgccaccaaaaaactgtaaacctatggagcaatatacacaaagtatgcaaaacccggtccccaagtatggcaacaagctagacatgagggtaaagaatgttgcaacaaatgctctgaaacgccgaatttgcaacaaaattcttgttaaacgcaacatccttccaaggagaagatatcgaatccactctccatttgaaagaaaaggaagcgttgatgggaaggcaaatgtcagagtctctccaataaaaatagtccaagtaatcacaaaatcaaatttattctgaccctccatccaataggcaccaaatcctaatgaaaatattttaagtgccatctccacaacatagatccatccaaagacaaattccacttcttgccacactttctgtgaagagctgttctctatatctagcgttgtttcaataacgacagcaattaggttcaccagaagaacaaagacaacaatatactcaaagaggcgactccgtacaaaggacttcaacctttcacactgtggtgaatggtagaaagatgggtacttctccagatatgaaggtggtggttctttctggaattttattgcaatagtattgcataggtcagcaaattcctcggaggtaaccttgaaatcaccactccgatcaagctcggaaaagattagttcaaaatcttccctcgaggttttgggcaacgacctgtacttgtttagctcatccagtaacgatatgcactgttctttgttaaggtagccctgaccgttagtatcgatgagatcaaatgccttctgtagaatacttttccttatagagtcaatttgagcaagttgttttgcaagctgctctttaaagctatcataaatgacagcaagaattaaatttgttaggaaataaactcctaacagcacataaataacaataaacagggcgttccaacgagagctcttgtaagcagggacccatacgtcaggattattggatgtggtgaacaggacaaacatctgatataatgttgtaccgtatgatgtgaaaatggtctttccttgtggtgtgtcctcac

SEQ ID NO: 23345 - DNA, 2440 bp, Zea mays
atctcctatatctattttctctccaacaatgccctctaaataacgtcctctatatgtaaatacctatatcaaagacattttttaatttttaatttttatacatacgtatttgtcatactaccaaatgtattgtacatattttagttttactaaaccgattgtttaaagtattcaaataaatagagaaccgtttatagaaactttatatatagaggatccaacaacgtcctctaaatttagaggaccgtttagactacactgttggagggagtagaggacctcgtcctctaaatttagggtacaggaccctttagagctccttggtggagctagtcttatagcacgagtgatgtatgagctagtcttatagcactgatgttttggtggagtgatgtatgagctaagatttctatttatttttaaactaaaactagttaatagctcaaacaatttgtgaatcgtgatccattatcacctctaattgcagcccatctctgtccattcccccggtccgtgttgtacatttgggctgggctcagcggcaggctgcgcatcagcccttccgttgttggcccaactggcatcgtcaacaacgatgcggatggtacccgtcaagcgtcaacacaccgcaactcggaggcacgcgagccacatatttgttcgtagagatgatgatgaattgatgatgccgaacttgacgagagttggttcggaatcggatgcaatgcacggtgccaaattggatccaggtggcacagcacagatactcaccgcgtaaaccacgagcacacatgtgagtggctgacgcacgcttccttggattggagccaagcagccaacgctagtcatcagctgtttctgtctgtcatccatcccatgagccgcgctaaacagttctctaaggactagaattaagtatccctaccaaaacatacaactatttagtagtaatactacgcaacctgtgacaggatttcctatgacaggtgtacgtacgtatcttctactagtatactggagcagacagatgcaacccaaggcctccgcatgttctgcttccaattccaaccagtagatataaactaatgaagagattcgagctcccatcgcgccctgatgatgccaatgattgataggtacgcaatcaggacaattcctcaagctcctccccaccttcgcaagaatattcctgttccatgtttgagatcttaagaaaaaaaaatcctccacaagttcaacaaaagatcactacagcttttatctgcatcgagctaaattaacagcctacggattccaccgcgctgagattaccagatttacattggatctaacaaataccaaacaaacatgcaaaaaacattcacatattccgagaggtggaaacacacgaattagagatccacataggagtaggttcgaatcgtctactctttcattcacagagtcaagcatccgcatctctagaacagaagttagctctgaaccactgctttcatccaggctccaatcttgcaaaaagcaatatccgccgtggttcccaattattagtagagagaagaatctagcgctagtgcttctccacgatgatcttggcttctatatacactttacttaagaccgcacacgacgccatactctcggctgctgtgaacggaggtgggggggatgggtggagcagcagagattcgaaagggctgggccgggagggaacctctaattacctaggcgatcttagcgaagcagcctcctcccctggccatcatgaccttgaactcgtcgaaggagatgaggccgtcgccgttctggtcgacgccctcgatcatgcggcggcactgcgcgacggaggcgggctcgccgaggctgcggaggacgcgcgcgagctcggcggcggagatggcgccgctgccgtcggcgtcgaagacgcggaaggcgtggcgcaggtcctcctcgacggcggccgcgtcgccggccaccgtggcgttgagggccgcgaactcgggcaggctgatgaagccgtcgccgtccgcgtccgcctcggccatcatgcgcgccacctcgtcgtccgacgcgccgtggcccaggctctcgaacagcgccgccagctccgaccgcgagatccgcccgtcgccgttcgcgtcgaacttgcggaacacgcgcgccatctcctcctccgccgtcgcccgctccggggacccgctgccgtcgccgtcgcccgcggcaggcgcctgctgctgcggctgcggcggcggcggcttggaggagcggcggcggaacagggacggcacgggcatcctgatcttgcccatgtcgcgtggcgtgagggggctgcgactgcgagggggttcggctggatccgtcacggctgcggtttcggttctgcgacgggcggcgtatttatagaggcaaggcagaggcagttcctttcccattgctatcgatc

SEQ ID NO: 23346 - DNA, 1160 bp, Zea mays
  misc_feature (16)..(16): n is a, c, g, or t
cggccgcgtgggcggncgcgtgggttttttttttttttttggttcggaatcggatgcaatgcacggtgccaaattggatccaggtggcacagcacagatactcaccgcgtaaaccacgagcacacatgtgagtggctgacgcacgcttccttggattggagccaagcagccaacgctagtcatcagctgtttctgtctgtcatccatcccatgagccgcgctaaacagttctctatggactagaattaagtatccctaccaaaacatacaactatttagtagtaatactacgcaacctgtgacaggatttcctatgacaggtgtacgtacgtatcttctactagtatactggagcagacagatgcaacccaaggcctccgcatgttctgcttccaattccaaccagtagatataaactaatgaagagattcgagctcccatcgcgccctgatgatgccaatgattgataggtacgcaatcaggacaattcctcaagctcctccccaccttcgcaagaatattcctaggcgatctttgcgaagcatgctcctcccctggccatcatgaccttgaactcgtcgaaggagatgaggccgtcgccgttctggtcgacgccctcgatcatgcggcggcactgcgcgacggaggcgggctcgccgaggctgcggaggacgcgcgcgagctcggcggcggagatggcgccgctgccgtcggcgtcgaagacgcggaaggcgtggcgcaggtcctcctcgacggcggccgcgtcgccggccaccgtggcgttgagggccgcgaactcgggcaggctgatgaagccgtcgccgtccgcgtccgcctcggccatcatgcgcgccacctcgtcgtccgacgcgccgtggcccaggctctcgaacagcgccgccagctccgaccgcgagatccgcccgtcgccgttcgcgtcgaacttgcggaacacgcgcgccatctcctcctccgccgtcgcccgctccggggacccgctgccgtccccgtcgcccgcggcaggcgcctgctgctgcggcggcttggaggagcggcggcggaacagggacggcacgggcatcctgatcttgcccatgtctgtcgcgtggcgtgagggggctgcgactgcgagggggttcggctgacccgaaccggccggc

SEQ ID NO: 23347 - DNA, 5666 bp, Zea mays
  misc_feature (1311)..(1311): n is a, c, g, or t
gccggcggcgcttctcgccacaggcggtagtagctgggatgccaggattatcgcccccgccgtcgctgctagcctcctccggctgctgctgctggctgcccttggcctctgcgactgttgcttgttgatgctgttgctgctcaatggttagggggacgtagtttccgtaagcgacaacagcatcaccagcaagcgcaccatttacgaagatctatatcacagacctagacctcggcgccaaggtctaacacaaaactagaccacgtgagctgccagctcgatccatctacgtcatcggggccaacacctcggcgccaagatctgtgacgctgaaacgtgttactttggtgccatggctcatgacgctgagcaaagagtctaaatttaagaattgttcctacaagaatctaaatgtgaaatttctctgcaaaagggtcctaaaatgaaaaaaaaatcagtcgaagggtcacaggtgtggaccacttttctacggacgcggacacgcggtgctttggctgattctttcctaccattgtattgcggcttgcgtgggaagcgttgtgccgagaagctgtgggagaatctcggcgtttgttatcacgtgatctccttttttcgtttttatatttaaaaattcaatatttgtttgtttatgagtgtttgatgagtatattgtacctcttgtaaactgaagcacacgattaattctttgttaaagaatgccatgataatagtttgctataaatgaaattaatgttaaatcaatttgttaaaaattatggtttcttctgaatttagttattgccgatagagaaaaaacattgaaaaaatatttagatcatatacggctgaatttagttattgatgatcttatttgttatattttatttgtttgaggaatacacgcttattttacttcaccctgtttgttactttagtcactagattaaactttagtttaatcgctaaagtacctcgttggtttcagtgactaaaccagactaaagagcattaattgatgtaaataatgactatgttgtccatattaattagtggatatttgctgcaaaaagaaagtgaagagggcaaataaggtaaaaatcctactttaatcccttttagccatcccttggtgactaaagaattaaagtttagtcacaacactttagtcaccatatttaattctttagggactaaaagtgactaaactttagtcaccccaaactaaacggtaccttagatctatttatttgaggaatgcaagtgtttgaataactattctatttaaataagatctacctaacgacgtanggacatctaactagtatagaattaacgtacacatgtattgatttgagtgacccatggctgattccagtgatcaacaataatcctgccaagcatcaagctaatcccaaggtgccacggaatggtctcgcccgccgccgctggccacatataccagcaggtgaccgtcggattgggtggcgcttggcacgtgttcgggtggtagctggctcctccatgcaatgcctatgcctgtcgtcgcgatcgcaaccaccagtcaagacgaatggcaggcagctaagtagctaacaacaacaggcttgtattgtatgtacagcaatatatatacatctcgagaagctcctagcagagatgcatccatctcgacgacgatccatccatcttaaagcaagcagagacatggagtcgtcgccgctgctgcagctgccggcggcacgcgtggaggctctgagcctcagcggcctctccgccatcccgcccgagtacgtccgccccgccgacgagcgagccggcctcggggatgccttcgacctggcgcgcacccatgccaacgaccacaccgcgccgaggatccccgtcgtcgacatctccccgttcctcgacagcagcagccagcagcagcagcgggacgaatgcgtggaggccgtgcgtgccgccgccgccgactggggcgtcatgcacatcgccggccacggcatccccgccgagctcatggaccgcctgcgcgccgcaggaaccgccttcttcgccctccccgtccaggacaaggaggcctacgccaacgaccccgccgccggccgcctgcagggctacggcagccgcctcgccaccaacacctgcgggcagcgcgagtgggaggactacctcttccaccttgtgcaccccgacgggctcgccgaccacgcgctctggcctgcgtacccgcccgactacatcgccgccacccgcgacttcggccgccgaacgcgggacctggcctccacgctgctcgccatcctctccatgggcctccttggcacagaccgtggcgacgcgctagagaaggcgctcaccaccaccaccaccaggacagcagctgacgacgacctcctcctgcagctcaagatcaactactacccgaggtgcccgcagccggagctggccgtcggcgtggaggcccacacggacgtcagcgccctctccttcatcctccacaacggcgtgccgggcctgcaggtgctccacggcgcccgctgggtgacggcgcgccacgagccgggcaccatcatcgtccacgtgggggacgccctggagatcctcagcaacggccgctacaccagcgtcctccaccgcggcctcgtcaaccgggaggccgtgcgcatctcctgggtcgtcttctgcgagccgccaccagactccgtgctgctgcacccgctgccggagcttgtcacggaaggccaccccgcaaggttcacgccgcgcacattcaagcagcacctggatcgcaagcttttcaagaagaaacagcagcacaaagcaaaagcagaggaagaggatggcggcaatggtgaccaccaccgccacgagccgccgccgcagaccaactgatgggctgcacatgtctttccatccgcccacgcatatcttctctcgcgaaattaataaggatccatcagcattttccatatatttatattagtttcatgctcctacgttactacgagaaaaaaaatagtatctatgatatataaaatccatgtgttaaaatattactgtaacactaatattatatatgttgttacgaaatcaatataataaaataatttgatataccaaaacactaattattattctataattttgttagcgtaactaaaagttaagatttatatactttaaaagatatataagattgtaccatcactagtaaaaaaaataaacaataccaatattttataaaatatgagtatacaacgattacataaaaatacacaagagatttattatcatcgatcctaactcaaattatttaccaacaaccaaaatgttgttaatctcctgcaccatccatctcctgacgcactacgacgatgaaaactggtgtattataagagtagagagtagaggctacttccggtcaacccaaaaatccttataatcatcaaaatatttcaaatataatctcaattgccttttgtttgacgagtctcatgacaaatggaaatcaaatacaatctcactggctctaaaacttttcggctgcagagaagtccgtgcacaatggaaatcagtcgagtctcgtgagtcgtgactattgaagatcacaggaccaagatagtaccctcacaagataacccttcttgttagttgcatgttcagctctgactctgcctgcttccttctgctcaggatcttgcatactgacggccgcgactgctttgctgttctcaaaagaaaccattttgttattagagttgttctatatcatcacgtccacttactactcggaaggtctttgaattctctgtaggttgttccacagtgtggttttccttgctctcagcatggtgaaccaccatagcattctgcctagccagcacattatcaccattttcaccctattctctgtaggttattccacagtgtggttttccttgctctcagcatggtgaaccaccatagcattctgcctagccagcacatcatcaccattttcacccttccctgtcctattgttgccatgctcgaagctaggagcatcaacattgaaggagctctctgagcctcgctctttatttcgaggaggcgccccattgctcacagctgtagcgaccgaataactgtcagagtcttggcgaccttgttttgcagccatgtgttggccattgctagcacagattttagctgcaaaagcacaacgagggtacttcagaaactatgagcaaacaaatgataaactttatttctcagcggactaccaaacaaaattacccacgaaggatggtgccacatccgccgcacttgtagactataacgttgtgcggttctgggagaatgtcgagacagtttggacatctcacgaggcaagaaccttctgcattcgccatcaataaagaaagtacaagaacatcacccacagctcagaatcccaggcgcggcggttaccgggcagcaccagaccgctaaggctgagagagttatcttccaagttcagagcttcagatagtaataggagaagacggtcgcagctgctagcctacaaaactgcaatatgcaaaaatatacaaggaaacgatgatgagaatctagccaacaaaacaggctagcaggtctgggctaaatttaagcacggaaatttgttaacagattactagtggagatgtatgagagaagaggaagatacagaggaacagagagatacggcagagagctggtagcgccgtgacggccggaaacaagtggaagtttaggttattacatttcataccctctaccgcaacacattcctactatatatatactccagtctctgcttgtgcattcgtgggttcattttcctttgacagaacgccccttctcggcccatcatcagcttgctcttctggcccatcatccaactcagcgttcaaccgctcctgtgccacaaccggcaagacctgctctgtcgaagggctgatgctgacattccccccttcttcgaacgccgcttgtccccaagcggccgctgatgggaagcgattcttctgcgcttcggcgtcctcccaagttgcatgcgaagcatccatccctgaccagatcacttggaccatgtaccaactgcatagtgaaaggtgaattgggatatgctgagacgatggccaattgagtcaacaactcttgtgcttgcgtatcatgatctttgagagccggtgtgtactgatagaggcacacagtaaacatatgtgcaccgagtaacagagggatattgtgatcacccggcctgcttggaggcaacccaactggatcctcaaaaatatccaaaaactgggaaggaatatcctgcacctgagtattgattgttggcatcttgctgtcagggaaacggttctgctgggaggtggccgagagtaaccacagctccactattgctcctgtgggaacagaagggtgaacaccttgtaaacacctagttgctccttgatagggaatgctcatccatttgttagaccagttcactggcataggactatatcgttgcagcctgtccatgcccacgaccagatcaaacaagggtaagagtaaaaacgtgagatccactgaaaaactgcgaacaggcatggtccactcagctgaaggcacctgataattacaagtaataacttgaccaaatgaaggtattg

SEQ ID NO: 23348 - DNA, 2237 bp, Zea mays
aaatattcttgtgcacttttcatgagttaaacgtcacagagcagatgccgatgggcatctgaactccacacttgttcttgggttttcctgttaaaattttttttttttttggtgcgaatttaagttccatagaaatttcggcactgagcaggtcaataaaaacacagatttgaactcgaatcagacatgactacatgagcgatgcagatgcttccatggttgaataaatcagctaatctgggttccattagtggtacatgcatatagagaatctcttcaaatttcttcagctttgaaccaattgcagctatctcatacaggttctactacaagcctagcccgaactgaattcttatctgttataggttcgatgctataaagtatttctcctccatttatcaccttctttgatatcaaatcgggagccagatcctctaaaatatgcagctgctcttctatctccccaatctcttctatctccaagttgttggcaagaatattgtggaaaagttcctgtttcgtgataagtggattcttggtagaatgagaaatatcatagacaatgtcaaatgtggtacgtagagaagctatcctttcctggctatccactgactccacttcattgattttgtctttatcagtaaagaagacatggctatcttcctcaaatgacttgttaaaacttgacaagtcttctgagatcatgcactttttagctgtagccgtatgttccattccatcataataagaagggcttcctccttcatatgttaaggatgtatttagtgatctgcgggcagaactggctgaacgtggttcactaatgtgtccacatgtggccttgggtttctcaagcggagccagcaatggcctttttggtgtctgcattgcaggtgttccagacaacaatggtgactctgaggtctgttgttttggcgtactctcttgacaacaagagatcaaatggcggcttggagtagcagaaatttcagagttcactgaaactggagcatgttcatcttgctttttagggtttctgtttgacccttttgtacctgctgccgtcacagagctcagttctgctgggtcggatagcaattgagtcttttcagttccatcagcaatgatttttttcgacatgaatttttgaaaagattgtgggaagtgggaagcatttgagaatccctcctcaacggcaccatgcagaggtggctcagcagcatgtccgttatgtactgcctcaagatataacttctcccttggccttgagttaaagggttccggtaggattgcctcaggaatgtctgcacccttatgatgagcatccaaaaatctcaaaagctttgagaaaaaagcctcacaaattgtcatggatagagagtgatcagggcttgtgcattccacaacatccattacaagtgtgatttccatatcagcatacatgcatatgctcttctcgtcatgtactagtatcctctttatctggattgcttctgggaacaaatgcttcatctgggccaaatggctgtataataacttcctttttgtgagtatctccacctgggtggcaatattattaaatgtagccatcttcttccgtaggtgaagcaatcttatagaactctccattctattgaaaagattcagcaaatccttgtgtttctcaagaagttcaatgctttctaaaaaaagagatcggctaccactaggcgaaacactttcattatagtcttcatcatctgtctcactctcatcttccaccagctgatttgcaagtctgtctttgtacctctctgcaagcaaattccttgccagtgaactcacaacgacccctttgcttctagattcacgtttttctggagtgggtgattcgatttcacttccaccttctgtctcaactttcatcttgtgcaccgttacagggctactcgaatcattatcatgagacacttgagaaaatcctttctcaaggtccagctgagtattattcacctcactcattttcagctccgaacactacagaaagagctcgcgttgtgctcggtgtctcgaatccggacgagcacggcgctccgactcaggatgtcgccacggagtcggcggtagtggaggggagggtagaaaatgaagcgcggatgacgcggagtaccgcacggcgcgcggtgccgcttcaaagtgtcagagcaaagccgcgggggggggcggccggcgacataggagctctctctttctctctc

SEQ ID NO: 23349 - DNA, 1942 bp, Zea mays
gattataaatttccaattttactggaaaactgctctggttattagtatttaatagtttgatggctggcttttttccaaagcatcaacaactgcagtgctagcattctaggaactattgaacagtcatatatacctattccctgaatattgtgttagatgaaggtagttagttaggaaatgtatttgacataacccacattaatgttgttaatacacagaattaaatgcagaaagagttgtccatagttattaacttattacattgcacactgggttttcaaaaaaaatcaggatccaagcatgagcagtttatgttattgactatctgtgatcttctagaatgcagttatgtgctatacaaacagataaaattttatgtgatggatgggaatcaggtacctcaaatgacttgttaaaattcgatgagtcttctgagatcatgccctttttagttgtatccgtatgttccactccatcataataagggcttcctacttcaaactttaacaatgtatttagtgatctgcgggcagaactggctgaacatggttcactaatgtgtccacatgtggccttgggtttgtcaagtgaagtcggcaattgcctttttggtgtctgcattacaggtgttccagagaacaatggtgactctgaggtcccttgttttggcgtaccctcttgacaacaagagatcaaatggcggcttggagtagcagaaatttcatacttccctggaactggagcatgttcatcttcctttttagggtttccgtttgacccttttgtaccataagcaatcacagaactcaaatctgctggatcagacagcaattgagtcttttgaattccatcagcaatgattttctgcgacatgagtttcgaaaagattgtggaaagtgggaagcatttatgaatctctcctcagtggcaccctgcagaggtgactcagcagcatatccattgtgtactgcctcaagatataacttctcccttggctttgaattaaagagttccggtaggattgcctcaggaatgtctgcacccttatgatgagcatccaaaaaactcaatagctttgagtaaaaagcctcacaaattgtcatggatggagactgatcaggacttgtgcattccacaacatccattaaaagtgtgatttccatatcagcatacatgcataggctcttctcatcatgtactagtatcctctttatctggattgcctctggcaataaatgcttcatctgggccaaatgactgtataataacttcctttttgtgagaatctccacctgggtggcaatattattaaatgtagccatcttcttacgcaggtgaagcaatctaatagaactctccattctattgaaaagactcagcaaatccttgtgtttatcaagcagttcaatgctttctgaaaaaagtgattggctaccactaggcgaaacacttccattatagtcttcatcatctgtctgaccctcatcttccaccagctgatttgaaaatctgtctctgtacctctctgcaagcaaattccttgccagtgaactcacaacgacccttttgcttctagattcacgtttttctggagtgggtgattcaatctcacttccaccatcttctgtctcaactttcatcttgtgcatggtcgcagggctactcgaatcattatcattagacacttgagaaaatcctttctcaaggtcaagctgagtagtattcgcctcactcattttcagctccaaacacagcagataaagctcgcggtgcgctcggtgtctcgaatccggaggattatggcgctccggtctcaggttgtcgccacgggagtcggccagcggcgccggtactggaagggagagggggaaaactgggagggcccggagtaccgcacggcgaatggcactcgagccgatgtcggctcgagctcgagccaaat

SEQ ID NO: 23350 - DNA, 856 bp, Zea mays
  misc_feature (848)..(848): n is a, c, g, or t
  misc_feature (850)..(850): n is a, c, g, or t
ttttttttttttttcctttttttttttttttttttgagcagctagggcaaatttaagtttcattaaaatttcagcattgagcagggtcaacaaaaaatatagatttcaagtccaatcagacaagagcgatgctgctgatgcagatgcttccatgatgttaattagctaatgtgggtttcatcagtggtacatacatataaagaatttcttcagctttgaaccaactgtagctatctcatacaggttctacaagcctagcccgaactgaattttgatctgatataggttggatgctataaagtatttctcctccatttatcatcttctttgatatcaaatcaggagccagatcctctaaaatattcagctgctcttctatctccccaatttcttctatctccaagttgttggcaagaatattatggaaaagttcctgtttcgtgataagtgaattcttggtaggatgagaaatgtcgcagactatgtcaaatgtggtatgtagcgaagctatcttttcctggctatccactgagtctacttcgtcgattttgtctttatcaataaataagacaggactatcttcctcaaatgacttgttaaaatacgatgagtcttctgagatcatgccctttttagttgtatccgtatgttccactccatcataataagggcttcctacttcaaactttaacaatgtatttagtgatctgcgggcagaactggctgaacatggttcactaatgtgtccacatgtggccttgggtttgtcaagtgaagtcggcctcggcctttttggtgtctgcattacaggtgttccagagaacaatggtgactctgaggtcccttgntntggcgt

SEQ ID NO: 23351 - DNA, 1048 bp, Zea mays
aaaagggcaaatttatttttacatatagctaagaaaagtttcaagaacaaaaaaactctacatgcacacaactgataggtatattcaaattcattttcactttgttgcattgcatcccaactggatcagcataaccataaaaacaacaagcccaaagcagttgttgcagccacggccctaaacttgacaccaaagaccgcaacaaacgtttgacggcccatgcagcaagcagaatctttacagcgctaagagatagatttatactctttcaggaatcagtatgcatcaaagcagatactgtgattccatgagcaagtcaggagaaacaacttgttgattttgccatgagacacctgtatcaagccagcaaccgtctccctttcacaatacaaacactcatcaccactcgagcactccacacagaagagcaagcacgcaaacgacaagctcttttcatatctacaggaagcttatctttgggtcaaggctaggggtttctgtatacaccaattgcggcgagcaggggccgcttctatggttgatatgcactcaaacaattacacgaatcagctacactcagtgaggtcgaccgagcagattaggaaacgcttcacacccaacaaatggttacagctttttattacctgtaggcacagtctccggtgagaaaacatgaggccgtgtgatgttgttagtgaccacccaatgtggcgagggcaaactgatctacaactgtgccgggctctgcttttggtttcgctgtagcatatgagtttgcaaactgcagttttttacatgtattgctgcaaccgtggacaagagatcctttgattggtccaacaacatttgttcttgtgttgcaagtttagaaagctcagacaccacagagcttgttccctcgaccttagacagcaaattacatattgatgatgtcattgtgttcattacatccactgctgagttaactgcttccttcacagcttgtgcatcagcctttgcaccatcacccacgcgtccgcggacgcttcgggccttcagagctttgatt

SEQ ID NO: 23352 - DNA, 2667 bp, Zea mays
tgcagtcaaggctgcgggcgagcgggtccgacgccttgggcttcgccgccggccaccgtcccgccggccgcgcgttctcggcctccggcacggaggagacgctcttccggcgctccggcgtgggcccgcggcgcgctgccggtgaggacggcgacgaggcccgcggcgcgcgcgacgtcttgtagaagaaggactccccctggaacgacacggagaggctccgcatcgtggtcgcggtggcggttgccgctgccgacgcggtggtggtgggcgacgtggagtgctgcggcggcggggtggacgaccgggcgcgctgcgcggagagggagcggcgggacgaggacgaggacgaggaagacgacgaggtggaggaggccggggacgcggcggcgggcaggtacctcgaggacacgggcttgttggagcgcgagttcctccgcgcggcggcggagttgggcttgtcgagcgccggcgtgagcggcgggcgcgaggggcgggccggatctggcgcggtggccgccgccgcggcagccaccatgccggtgctgcggcaggggacggggggagatctgcctacgcgcggcggtctcgcggcaatgcaggtccgccgggctccagattcgccggccccagtcccgctcctgctcgggcctccgctcccgccggcggcggcgggcgccctccggatcgacgcgcctgcgaggacgaggagaagcagcgaactggtgaagcagtgtttacagtttgagggagagtagtgaagttgggattttgcttgagtttttttttttattcccaccaccccccactcctctcgctgcttttgcagttgttttgctcgcttctgtgtcttgcttcggttatcggtgatctttgcttgggttgggcagctgattcttctgccctgcgcttgcgacgcgcctgtgtgggagtggtgtggccatgacgctgtccccagcatctcagggagggtgagactgctcagcggtgtgtggccttttttctttcgattttctctttttcaaagaaaaaagtttgttaaaatgtttccacagacgattctggtgcatcacattctcagtggggtagcatgtaaaaaacgtggattcggtgacaacggttgttgaaggaacagttgcttcgtgggttggtttgctatataggacatgataagggctactcctacagtatttattagagaagaaaaacatgaaagaaatgatggtttctgtttgaacaatttattactactatagctggaaagcaacacgtgtgcacatggctgaatcaagacgaacaacttggattctctactctgttttgctcgttgtcattccacaaaagcatgcaagccgaaaatatgaaacttcagattcaaatgattagaactgtggtgcacattttagctactctctatgtttttgcattacaagggtctaattttttaagtcacgtaacgtttgttatgcatataatgtattattgtattacctccattctttgtttattttttaaattaaaacgcgacacatacaaaaaaacgaaggaagcatatattatatccatgtgtgtggaaaaaatatgtatctagaaaaaaaaaacaacttacagtttggagtgaagaatgaagaaagtattatagttttattttataaaaaaagaagttgacaatgatacacatatcgaatgagcgaattgcaatgacatgacctttaataccgccaaaagtatcagaaaaatggaatctgtacaattgtggattggagtggacaaacagttcaagacgaatagcaggtcaagatattaggctaaaaaggaaattatataggtatcggttggtttggttttgagataaaagcattacgggagttgaggagcttaggtaggtttaggttagctaaacttgagttatctactagggtactagtactaatagtttagggtgtcattgaagtaacggtacatacacttttagcaaggtttattaaattgtttgtccattacctatatatcaatatggaaattcataaacagattgtttcctaacatgtattcatccgagttcgttactacatatagtgtttattaatctaattcaataattttgtagatgcacaaaactcaaatagaaggctaataagagttaattaagaagacaaaaaaatgacaaatcacggtgcacatttcattaaaaataaaatgagctaatagttagttatttgtgtactataaaccgtccattttatgaaccatatatgtgatagaatcacttatttaaaagcaggaacatgccttgctcgcagtctcgcactagtgcactactgaatcatcatacagtctactagctaggaagtggttgaagagtaaatgttatctttccttctaaaaaagaaacaccataggaaaatgaaaatctctccggttagtatttaatgcaaacgccgaacaaatgctctttgggacggtgttattaaagacgttaaagccatcacggcacgcatgattctaaccgaacagtggactgattaacgagttggttttgtggttggagacgctccgattggttcacgatttgatcgatatatatgccgataagacgagtccacctcatgcgcttgcaccacacacatgcactatatacgtgctttggtgctgatggctattgcg

SEQ ID NO: 23353 - DNA, 7616 bp, Zea mays
gctagtctagtcgtcatccccggtcttgtcgtgcgcagccggacgggattttccacttcgccaagaagccaatcattggtggccgtaccccaccccccgagtttcggataacgcgctggtggccgcgtcctctcgtctcgtctcgtctcgtctgcccccccctgtggcctgtggcctgtggggagtaaagaaaacaaggcccggccggacagctttacaagtggaaagtggggcggtgtcccgtagcgtagcggcgagcgagagcattcttctgtgtggttggttggattcagttttgcggctggcggcgtacacaggcggcactgtttcggatctttttcgcttgacatgatcggacgcgatcggaggttccaagacgacgaggatgattgggctctggggttttttttttccctccccactaccaccaaattaaaagatctgacattgccttcaatgtgagcctcacgttttcgttgtcgctggcaggcaccgctatagcctagtactatatagctccgtttatgaatcatgagtgctctcggtcgagccagccatcgggaaaaaaggggtcaagtttccgtacgtttctactcgcaggtgtcaagtttctggtggcttgttgcgagtgtttgaggctgaagaagccagggcgacgccggctggctggcactatggcataaaggcttgaaagcctgaaacggcgaaggcgggcggcgccgccgtcgtttcaggtagcgcgcgggcggcgtgacggctgcaggatagagatagcggcaggtggatgaggacgcgacgccagccgtggcccgcgcgccccacggttgggcgcacgcacgcacggacgggccgtcggtcgtctcctagcgcagtttaattaaggcgggcagttcgacgggcgggaactgatggagtgtgtggcgtgcagtacgagcggctcattcagcagggcacaccgccacctgcgcccctggtttcgtttccgcttctcctccgggtgcagccccaaactgccttgcaagttgcaagatggtcgagctccagcccgtagtgtgctcatcttcacggtgacggctacacgacgcctgcatgcgccgcctcattttagaagcctactatactcttgtttggctccagcgcaagtgcatgcacgtatgatgaggtgcattgcttcccatgtgaattccggtgcttgtaggcacatcgggtaaggcatatgggatatatatgccattcattattcggcggactactagtgatcctagctgcccagcccagcgatgtccttaccatatacctccagttaccaagaagaggaaaacagatcgacgacgacgtcgacgggggagatcattctgatgcgcacatgcacatccaccaccatccgcgaatttatgccttgccctagcggtcggggaagccagcagccagcagagcggccttgcgtgctgtgccttccgacgtggacgcgccggagaaggaccgcgacggtggtgatcgacctggaggggcggcagaccagaggtcccccgcgtcgccgtccgcccgtccccagcagccatcggtggcacgccgcacggccagatcaagccacgggggcgcggactacggccattatttcgctggccgcgacggccgcgccgcgcgcacctggggtcgacagcgcgccgccggatgtcatgttaactgttaagagctggtcgcgtccgtattttgtgaatctttctccaaagtgatgtaatactattaagatccttcttagtggcctccttttcttttgtgactacacaaaccacaaaaggagtgatattgaaatgaatatgtacttaagatattgatcgttaccgtatagtcatacgaaacattgttcactgtaaactgtattgtttgtatagtcacacaaaacaccgttaaactgcattgtttgtatagtcatacaaaacactgttttgcactgtaaactacattgtttatatagtgaagtttggaacaagagaatgaacatagagtaggataagtagggtcagcgtgagtacatgtacatattcagtccatgagcgcgcatgcacaacggccccaaaacgagcaccacgctatatatgcagccccacgcgctaccgcagctagtagtacaggcatgaaccgactaaaatgtcgcccgggacctaacaaacggagacgaaggccgtagtaaagtggcctgtgtgcagtcagaaatgaggacgtgttcctcgtgtgaagtccacctgctgcacgccgcgcgtgaccgtgaatcatgagttgggaagttcagcgcgctggggatcttcccaagccgatgaatgatgatggacctcgcctctctcgtccacgattcacgcgacatgcgctgctgcttaattgcctgtttcccacgagacaagacgaagacgagacgaggccagcagacaccgtcctgtgcctgccacaggccagaccgccagaggacacgacgcttctcctcatcttcggcttcaccgggcagcaaatgcaccatatgcatgtccgtcgtgagcaaagcagagtagggcctgccgaccatgcaaccgctccgacgctttccagatcgtcgtccgcgtcacccacccgtccgttgcagcaacagctgatgagctgacgaaggcggcaagcccaacagaccgaccgagcactcgccttttagtgcttgctatcagttcagatcgagttactatctgggtggggtctagaagcgtatctcagacgttagaaaaatctgggatgattcaactcagttgaggcctgagatctccaacggcaaaacctgcgtctgcgtgggcgacgccaaatcgtgcatcgtgcccacttcccagtgtgtgggaccgggatgccatttcccagtctacctgctctgccgcatgcagtccgcgagtcaatgcgtccgcagcgcagctcagaccataggggaacatgagtacaggtattgaggtatacaacagtacatgaccgttccgttcgtaccatgcacactcgcagactacctggcccattattcgttgcattattattatgcttggcagcagaccaatcaagtacaaaagcaaaaatcttggacggcgccgcgttgacaaagctccgactccgagtcaacaaagcgtgcgaggcccaagtggccgtccccacgtttctgggctgttcagaacgtttgcgccctagcttttccatgttttcacaagtggggcatggcagtgactcggccctctcagcaagtgggctgaccaaagtccgctgctatgggccgacgaggagatggctcgtcatcattgaagccgcgacttgttgcacgcggggcgacggactgtgactgtgagaaaggcttggagaatgcaggagggagtggactgacgcaggcttgttcggcagtgcttttctttgactaggttgagtgagttgtttaagcgtaggtccatgcgtgtaaacgcaggaaacagccaacattttattggagagagagatagaaacgtaaggaattacaggtgtaaaagctgacgtggattaccatatatcagaaccatgcgtgtctggatgcgacgctgcgtgtccttttgcaggtccaaaattccttcaacactgggttttaaacaacggataaaccatttgggagccgtcttccacaaaaagaaggggcgaagccaggatatgagattagcggggactaaattagaatagagagctgttagaagtattttttttatcgtttacatgagaattagttaaagaaactagcagttcctatagaattaggagagcattagtggagacattgcccccatgctccgtcgtcgtcgcccctgacaaaaagctaatctatttcatttaagattgatttggtgaccagtgattgaagaagatctatgggttctcatagatcctctccaattcactggtcaccaaactagcacttagtggtttctataaaagcatgaaattattaattatttcatgtataaaattatgcgaatgggaaaaatttatgaacataaatactcaaataaatgtgcatacggcatacctataggataacatatcttcaaatccatcgcttccaattcattaaaggtttgttcagcttcatgctaattcatatggattgtgtgggattgagtcggtttaaattcataataagtctaaatccagctcaatacatctcagtctctttcaatcctcatggaataaaataaccgaacaacacctaaatctatctattggctacaatgaacgttcgtatattcattcaacaatcatcaattcgaagaagacttctcaatgtcttatcatatcatttagtagataaagaacgcaacaaagagatacatattatagtcatcgtgagtaaaagaacacacgtttgcctcagttaaggttagttgtgctgaaattatctcacggctctctggaactaattcttagcagccagctaataagttgttagctggtttagctagcttaaagcagctaacaactaatagctattttagagatataaataataaattaaatggttcattagttgatccgttctaaacctcttagctaactttaacggctaactattagtagacctaaagccaaataccgaatgtttagtagacctaaagcactaatggtgatagtgccgaagaactgaatttggtctcgacggaccaccaagaggcaagagcatagcgcggtggtgccctcccgtagtagttttttgtgcgtcggccttgaattgatcatgtctgtgtcccgagcacgacgcgacgggacgctgcagcagtagcggctatcccatatagcagcctagcgccgccgcacgtcatcggctcgcaactggacgctgcagtagcggctatccatagcagcctagcgccgccgcccgtcatcggctcgcgtcgctctcggctctcgcgtcggaggcggtcggtacgagtgggggtagccggtaaagtaacgaggtggcgagttggtttcggccgcgtcggcgtcgaggcagaccatgtcacggtgatgtgacgaggcgccaaacggacgcccgcccgccactactggacctttcttcacatatttgaatatgacctcccaatccaaatctacgggactcgactgcgtgggttttagttttttagttgtaaatattttatattaaaattatagtcttagtttgttatgtattttatattaaatttatagctttatcgttttccccattctataaacacaatctataattttcagtttcaaaaataaaaatcatcttaaacaaaactataagtccgaaaaacaaaatctgattttatgttagcacaaagacaattaataagtatttctacatcagacaagaacaaaaaaattgatatgttataacataaaaataaatagcaaatcatcaaagtaatatacttgtgttagctaagggtgtaatgttgttgtctgaaattatcttaaaatccaggcacctgaaacagagagaaaatgtaagtctataatctaaaagagttgtttataacctctacaaaaataaccttcaattgttgacgtacagatggtacagccctagtcgttgttctgcttctgctgttcgttctcgtacgttgttttttagtggtattgtgagttgtttacgctttacattatgttccgggttggtatgcaattatgcattatgccaatccccctatgtgctgcaatagttgaacccagtcaaaagactagagcatagctctaaaactctttaaaaaaagaatcttcaattgcgtttcactttgttgcattgcgttccaactggaccaataccacaaaacaactcgctgaaaacagctgtggcagccacggccctaaactctggggagttgggacgactgcaacacaaacgtttgatggcactcccagctagaaagcagaacctttacagcgctaagagtattaggatttcccagtacagaacctcccagctagatttccactccaggaatcaggatgcataagagcatctccagcagctcatcaataattcatccccaatagtggtattagtgatcaccaatactgtttttttttaaattattgggggcgcccctgcagcagattagcaatacatcaacccctcctaccatatttgagaaatgggggatacattggtgatcactaaaaaggatagttattggaaaggttctaacgcaataaaattacctcatctccccccccaatatgacaggtttaagggggaataagggttgatatcagagagcagctcgagacactctcaaagcagataccatgactccttgagcaaatcaggatgaacaactttcgtgtggatttagacaagaaaacacctgtatcaagccaacaaccgtctccctttcacaatacaaacactcatcaccactcgagcactccacacaagagtaagcacgcaaacgacaagctcttttcatatctacaggaagcttatctttgggtcagggctagggatttctgtatacaccaactgcagcgactgcaggtaagaggggccgctcctatggttgatatgcactcaaaaaattacatgaatcagctacactcagtgaggtcgatcgagcagattaggaaacgcttcacacccagcaaatggttacagcttttattacctgtaccacagtctccggtgagaaaacatgaggccgtgtgatgttagtgaccaccaacgtggcgaggcaaactggtctacaattgtgtcgggctctgcttttggttacgttgtagcatatgagtttgcaggctgcaatttttgacatgtattgctgcaaccgtggacaagagatcctttgattggtccaacaacatttgttcttgtgttgcaactttggcaagctcagacaccacagagcttgttccctcgaccttagacagcaaattacatattgatgatgtcattgtgttcattacatccactgctgagttaactgcttccttcacagcttgtgcatcagcctttgcaccatcaacaactggaagacgtagagtactagccttcagagctttgattgctgctgataaagcacttgaatgatgcttttcgatatgagaccaggcctctagatatgacatctgtcccctaagaatagcaaacagcttgagtttttgcttttgaagctggagtctgctccttttgttactgacattgtcacgcaatcttgatatttctttccatgcactgtgaagagttttctcagcagtgaagctctgcaccagaagcgtagcatctgtccgagcattgatgcatcgccactgcaaatgccgattgtccagcagccgcaatctgtgtgcctcctcgattctcttctccccctttttcgcccttctcacctctgccgcaaaactgatgatagatggcgcatttgctggagcctgcaccgtatgtccatttggcgatgcctccccactgcgccctcttgatggactcggagcgccccggcttccacggcatggagacggggaccgacctggcagtctgggtgacattgggctgtctgaaaacgacctccggccagacgacggtagcggcagtccaggctctggaagtcggcgcaggcggcgggggcctccgtagctga

SEQ ID NO: 23354 - DNA, 1652 bp, Zea mays
aggggacacccatatgtgcaaacagctatatcaacgtgtatttctcaacaagtgtatacataaaatagtatttggttgacagtttggacataactttacaacagaacaaccacgagtacatttttccttttctttcccccctttttttttgagtgtgttaatacagcccactctagtctactacacaagcaacaattacttatttgatcaagaatgtccccaaaaagagagaaaaatctaagtatgtcagcatctctaaaaattcctaatgacagattccaggaggctttaggaaacaatcctaaagctcaccttcatgtatgtagcagtatcctaaacacgctggatttgatgtagcacacccttactacaaaagttcaagcattggaaaacactctccttttaaggatagacaaacgctttggttaaatgctaaaaattagaactgtgaagaatagcaaacctagcactgtgtgtgggcacctgagtttcttttgcgagttagcagatatccaacatgagtgtacccttatatggtgtgcatcacattgctgaagttgatagtggagtgtcatatgatgtgcggaaacgaacaccatttcctatgttccttgatattgggcacagccagcacaacatgttaggacctagcaccgaaactaggttctcatagattcccaggttataaggatgatgataaacgtttccagccttttcagccaaccatgtagccctaactccttcatgatactcgatagtagtcttattatgtaagatgaggtaaacatgccaacccaataggaccattagtgccaatgctaaagggcacagaagaaccccacaaacaacaatagatgttctagaagaatcactgcttggttgttcatctttaggtaaatgcacagcaccccctataatgagaaccatagaatagaagcttgcaattacagcatacagaacaaaaactaggaatatcttgtagttctcatgcccaacacagttattaatccatatacagtggtggtccattcttagaacacatcttttgcaggcacgacaatggtgcgctcgaggaggtttataatgcgaacatttctggcagtatctcaaatcaccacccttgcgcttgatctcgtggatggggctcccggcgtcctcgacatcgggcacgaaggacgctggcacgcggcccgggtcgcgcgatacggcgacggcgtaggtagcgacgcaggcggcggcgagcgcggtgaagaccgcggcgttggcgagcccggtcgccgtggagagccccagccacgcggggatcgccaggaacaccgtggtgtagtagacatagccgatcgcggcgagcaccgagagtatcggcaccgtgatgtaccccgggcgccccatccgagccgccgcctagtgctcctcttccgcccggacggagcggcagagcattccggggaaaaggaatcccccgcggcgtcggcggccgggagaggagctcgcccgtctcgcgcgacggtaggcagcggcacaggcacagagccaattggcttgctttgtactccagttagctcgcttgctgctgcgctgtggtgtttgcgttggcgcgatgagagaagtgcgcgggttcccggccggcccggccggcctcgaggtaccca

SEQ ID NO: 23355 - DNA, 2629 bp, Zea mays
ataagcttaattcatctcattttaagcatcttgatcctttcaattttaattcaaattctttgctttgtttgttctttttttttggtactaatatcattgcaaagtgcttacttcaccacaaacatagttttcatcacacatgatctcatggacactcgtcccatgctagttaaccaaacaacttattcagaaaaaaacgaaacacgtattcgccaaataatcatgggtagacctcgatgatggatcgaacacctagaacgggtatgattttgtagtcgctaaatccagcttcggaaattatctttttccactcatgttcgtctcgctcggcgccattgatcgtcatgatgaagagatcaaacaagacctgagtctctttgtgcttaatgtttgacgactggcctccaacaaccatatcaacgattatcacctttcctcctgcatccctggaaggtatagctttcttacagttcttgagtatcttgatacaatcagcatcgccccagtcatgcaaaacccactgaaagcaaataaataaagtgaatgaaccaagtactatgttagttataacgaaccagctggccaacataaatacatgaatcttggttagtgataaaaatatgactaacatattactccctctgtactgtaatataataaagggtatgcatgaattcaaaaatttatagtcaattataagaatttaattaagaaaaaacagttagcattaaataatagcataaatttgttaggtactatattgttaacaatttgacaatcaatcgcctttaatcatgttaatgatagtgtttaattagaaaataaagtgaaaacacagtttggggtgactaaagtttagccaaaaaactaaagaaactaaattgggcccaagatttaaaaatcttgactcatcatttattactgttagaaaggaataaaactgagcattttatgctgaactagagacacagatttaaaatttttaacatggtagcactttatccggtcaacactataattaaagaggatatatcttatgcacatagaagcttagtgtatatagtgtacatattaaatcatcactatctattttagatccaacgtctttagttgatcattgtaatttataaataacatattctcccgctacacccaccatgtcagagggtgtttttagcaaaatataccagcaactagagacattagatctaaactgagtgattatgatttaatatgtgcatcatatgcacaaaactttcatgtgcactagatatgttctcttaattaaaaggttgcaaatccgtatataaagaccgaaccaacagttttgctcttctgttctatagcactggaggggtaaaactgagtaaaaaaacacgactaaaggtaaaactgagcacaccaccaaaatcgagggcaccaccataaaaaaacccattaaacaaccatactaacaacggatgatgtaccttaaggaagacggcgtctgccggtggaatgctctcaaacatgtcgccagcaatatacttgacactggtgttagcgggagcattggcggcgacatgcgggagatccagcacactgcactggacatgcgggaacgcggtcgagatagccagggccgccgcgccaagccctccggcgacgtcgacaagggagctcagaccccggaagacgtcgccgcactccttgacgacgatgtccatgacgaagctgctgtcgcagaccataccttggttgaagagctcgccgaaggctggcttgtggtcattcaggtcccaggcagtgagcccatgcgtcatctcaaacagggtcgggtctgagcgctcgtgctgtaaccatgtgccgaggccaaggaaaggcgacacgtagacctggtgtaacaccagggacatgaagggagccaggcttgaagagccgccaaccaagagctgagacgccggtgtgagtccatagacgagctcgccgccgccgtcgtccggcgagcggtgggcggcgctgaagatgccggcggctgtgagcacccgcatgaggcgacgcaggcaggggatcttggacgggtggagcgcggccctggaaactatctggggcagggtggcgttgccaccgtggctgtggatggcgtcggctatgccaaggtccactgcagacttgagagccatggacttgatgaaagcaaaggatgtgtgccagagctctagctgagcgtcaagcaaggcttggttgttagtgctcgtggtgagcgccatgatgctgttgtgctggatttcgggcccggccgggattggtagggggtgatataagtctgtataaatagataacatgcagtgcgcacagttaaagtgtattaactcttttcttttatacatataactactaatatggcaacattatttgcatgtgttaaacggactggccgtagaacggctagtctcggtcgtgcaaacagtggaggccatcagatcttagaggcccagggcaaaatttaaatataggcctatataattatttttaatgtataaaaatactaatataagtagttaagaaatatttaaaaatgttcatatcaatataaacactcaataaaattgggttgttcttcaaatattatcatttttagtaggagatg

SEQ ID NO: 23356 - DNA, 1342 bp, Zea mays
cttttttttttttttttttttttttttaagcatcttgatcctttcaattttaattctttttctttgctttgcttgaacaaatgctatggtactaatatcattgcaaagtgcttacttcaccacaaacatagttttcatcacacatgatctcatggacactcgtcccatgctagttaaccaaacaacttattcagaaaaaaacgaaacacgtattcgccaaataatcatgggtagacctcgatgatggatcgaacacctagaacgggtatgattttgtagtcgctaaatccagcttcggaaattatctttttccactcatgttcgtctcgctcggcgccattgatcgtcatgatgaagagatcaaacaagacctgagtctctttgtgcttaatgtttgacgactggcctccaacaaccatatcaacgattatcacctttcctcctgcatccctggaaggtatagctttcttacagttcttgagtatcttgatacaatcagcatcgccccagtcatgcaaaacccacttaaggaagacggcgtctgccggtggaatgctctcaaacatgtcgccagcaatatacttgacactggtgttagcgggagcattggcggcgacatgcgggagatccagcacactgcactggacatgcgggaacgcggtcgagatagccagggccgccgcgccaagccctccggcgacgtcgacaagggagctcagaccccggaagacgtcgccgcactccttgacgacgatgtccatgacgaagctgctgtcgcagaccataccttggttgaagagctcgccgaaggctggcttgtggtcattcaggtcccaggcagtgagcccatgcgtcatctcaaacagggtcgggtctgagcgctcgtgctgtaaccatgtgccgaggccaaggaaaggcgacacgtagacctggtgtaacaccagggacatgaagggagccaggcttgaagagccgccaaccaagagctgagacgccggtgtgagtccatagacgagctcgccgccgccgtcgtccggcgagcggtgggcggcgctgaagatgccggcggctgtgagcacccgcatgaggcgacgcaggcaggggatcttggacgggtggagcgcggccctggaaactatctggggcagggtggcgttgccaccgtggctgtggatggcgtcggctatgccaaggtccactgcagacttgagagccatggacttgatgaaagcaaaggatgtgtgccagagctctagctgagcgtcaagcaaggcttggttgttagtgctcgtggtgagcgccatgatgctgttgtcccggcctgccggcccgccgcctcgag

SEQ ID NO: 23357 - DNA, 3673 bp, Zea mays
  misc_feature (260)..(261): n is a, c, g, or t
tatactgttttccccctaccggtaagactatcttcagctgcttatcatccttatattcaaaattcactttgcaaacagttttttggtgatcatatagataaaatgttagacacgatctaacaaacaattacatttaggctatctctagcagcttacttattttcatgctcatattcaaactccactctatgagtctataatacaaaacagtataagtcagtagactatatgagtgaactgttggatatgatcttgcaaannacagtataaaaccagtagactatatgagtgaactgctagatacgatcttaacccatcaaaagcaggccggaaacaatctagttttcatccttaccagtaacaaacggatgcatcaaaagcagctaccggaaacaatagttttgaagcaaacggaaagaaacaatcacaagctgaggtatgaagaaggcatacgagggcatgtttaatataaacgataagaagattagcgtggcaatttccgactaatatcaaaacaagaagaaagagcaagcatcattcatcaccaattttgggattgctggtttcacataaatgatatctgataaacaatagcaccattcatgctgcattcggatccaatgcctcggggagcaacaatagcataaggaatctccagttgttggcggttttattacgttttattttaatcgcgatctaaatagagctactggtgtacaaaggtaggaaacaaatggaggaaggtccgcgtctgcaggaagtgccatcaaggacagccaaagccaccgccaccgggcgtgaaaatctgaaggatatcaccagcactgaccgttacagtgttctttcctccaaggtaaatctttctaccatcttctctgactaaatagtttgcaccacgatctccatctcgtcctcctttgagtcccctgggagcatgcacccgtctctcagatagaacgctcacaacaataggccgccggaactcaatctcccttacaaggccatcaccacctctgtgtaaaccagaacctccactgttctccctgatgctaaatgtgtgcagaagggcagggtaccgctgctcaaagatctcagggtcagtcatccttgtgtttgtcatgtgacactgaacaccgctagtgccgtcccatgtcggcccagctccacatccacctccgatggtctcgtagtaaccgaaggtgtcgtccccgaaggtcaaattgttcatgcagccctgagagcaggcacaggcttggaacgccattaggataacatcggtcactctctgagacgtcagcacattgccaccaacaacagcagccttgtcacttggtgagaggaaagagcccttaggaatgaggatcttcacaggcgctaggcagccttgatttagtggtatatcaacatccaccaagcagcgtaggcagtatatgacagcagctgttgtgactgcttcaggagcattccagttgccatagacctcaggactggtaccctcgaagtcaattgtagcttcacctttaatagcatcaagggtgagtttcaagtgaatgacagagccgtcatccatataatcttcatcctcgacaacacatgatccattctcctttgcaactctagacgcaactgttttgagcatctccctgacagctacctcagcattcttttgaacatggttcatatatgattgaacagtgatcaacccgtactgatttatgagttctttgataagtgctatacctctctggtttgccgcaacctgagcacggagatcggaaagattatcttggatcctacgtgttcctgggatcttatagccagcaagttcatcagagcaaggtgactgcagcagctggattattcctttctcttggaaaacacccctttcgacaagtttaaatgctctgatggcagcaccttcctcccaaatacactttgagaaaggaggcatgcttcctggcgtgatgccaccaatctcagcatggtggcctcgactagcaacaaaaaagacaagcttaccgtgatcaaaaactggtgtgacaactgttatgtctggaagatggctccccccagaacatggatgatttgttacaagaacatcaccctcattgaggttctcaccccaaaagttaagctgccaacacacagtactagacatggctcctagatgcacagggacatgaggtgcatttgcaacaaggccgccatctggaccaaagagagcacaagagaagtctagcctttcctttatgttagtggaaattgaagttctttgaagtgtccgacccatctgttcagcaatgcccatgaatcggtgattgaaaatagaaagctggaccacatctgcaactttctctgatatcgatacagtgcttggagctgcattgatatctatttttatgttaccatactttgtaattatggctttacagtctttttctatgatcacagtactattcccattcataataactgcaggaccctccaatagatggccataacccaaattctcaagcttgtacagcggagtatcttgccatccacttgaaaaataaatccggcatgaactttcttgcacaggtttggttgatatttgcgtcagttcacgaggctgcaggatgtttgtagtaccaacaccctgaactctcacatcacatatgagtattttcctgtttagcaatttgaagccatactcttgctgaaataatttttcaaactcatcagcatagtcatttccagatccttgctctggctgtctaaccattatggctgtatcagttccctcatacctcaaattcaagtatgaatctgtcctgatgctctcctctacaaaaccctgctccctcagcttttctttcacatgttttactaaaagggcttctcttctagatgcttctgcagaagaatcggtattataaacagcagagtatggttcttgcaaatcctcaatgacatcagcaagacccatcccatatgcacttagtattccacagtaccggtggacaagtacctcagacatgcccaaagaccttgccattgcgcatgcatgttgtggaccagcaccaccaaagcatgcgagggcatggttctttgtatcgtgccccttcatttcagtcagttggcgtataggccggcacattgtctcatttgcgacattgacaaacccaagtgcaacctcttcaattgtcatgtcctttgctgatgggtcctgactctttcggtgagagttgatttcaagtgcaagattttcaaaggcctttcttgtagcctcataatcaagaggcatgtcttcattcggaccaaatattgatgggaagtattcaggaataacggttcctaggatcaaattggcatcggtaattgctagctcaccaccttttcggtaacaaactggaccagggtgtgctccaacagattctggcccaaccttgaaagcgccaaattgaaacttaagctttgatccgccaccagcagccacagtgtttatgtcaagctggggagcttgaataatagccccagcaatctgtgtctccagaacttgttcatagcttccatcatagcggctgacatctgtggatgtacctcccatgtcaaacccaatcagtggcttggatgtctcaagtccaaataaggtctgcgaatagccaaccacgccacctgcaggcatgcaagc

SEQ ID NO: 23358 - DNA, 697 bp, Zea mays
cattgggtacctcgaggccggccggccgggaataccaccgacgcgtagcacagtccattattgccgtctcccttttgcgtgagcaaagaaagagagcgagaagagcagtcgccatgtctggcatcatccacaagatcgaggagaagctccacatggggggcgaccacaagaaggaggatgagcaccacaagaaggccgaggagcaccacaagaaggaggagggggagcaccacaagaaggacggcggggagcataaggaaggcatcgtggagaagatcaaggacaagatcaccggcgagcacggcgacaagtccggcgaccacaaggaaaagaaggacaagaaaaagaagaaggagaagaagaagcacggcgagggccacgaccacgaccacgacggcggccacagtagcagcagcagcgacagcgactgagatctggtgtcgcagcacaggtgcaacacaagtatgcttgctggatggaggattcataccagctgatgctgatgtagtgtttcactggtgtcatgcatgcatgtatcgtgctattataatcaaaaagaaaaaagaaataacagtcagggatggtttgtttgccatgtgatcttgtacactcctacttaaattatggctgctgcacggtgctgctagcttgtactaataaagtgttgatctgcatgcttgcgtcttaaaaagcggcc

SEQ ID NO: 23359 - DNA, 744 bp, Zea mays
gcgttctgcggccggccggcccaaagacacaccgacgcgtacgtagcacagtccattattgccgtctcccttttgcgtgagcaaagaaagagagcgagaagcagtcgccatgtctggcatcatccacaagatcgaggagaagctccacatggggggcgaccacaagaataaggaggaggagcaccacaagaaggccgaggagcaccacaagaaggaggagggggagcaccacaagaaggacggcggggagcacaaggaaggcatcgtggagaagatcaaggacaagatcaccggcgagcacggcgacaagtccggcgaccacaaggagaagaaggacaagaagaagaaggataagaagaagcacggcgagggccacgaccacgacggcggccacagtagcagcagcagcgacagcgactgagatctggtgtcgcagcacaggtgcaacacaagtatgcttgctggatggaggattcataccagctgatgctgatgtagtgtttcactggtgtcatgcatgcatgtatcgtgctattataatcaaaaagaaaaaagaaataacagtcagggatggtttgtttgccatgtgatcttgtacactcctacttaaattatggctgctgcacggtgctgctagcttgtactaataaagtgttgatctgcatgcttgcgtcttaatttgcgacacgcattcatgaacaagctggatcgaggagacccgcgtctttttggctgtgccatgtg

SEQ ID NO: 23360 - DNA, 761 bp, Zea mays
  misc_feature (1)..(1): n is a, c, g, or t
  misc_feature (9)..(9): n is a, c, g, or t
  misc_feature (15)..(15): n is a, c, g, or t
  misc_feature (46)..(46): n is a, c, g, or t
ngtgccatnacgtcnttcttatccgattggccttccattccttctntaaataccggccggcgccgaaccggccggaaagaccaccgacgcgtagcacagtccattattgccgtctcccttttgcgtgagcaaagaaagagagcgagaagagcagtcgccatgtctggcatcatccacaagatcgaggagaagctccacatggggggcgaccacaagaataaggaggaggagcaccacaagaaggccgaggagcaccacaagaaggaggagggggagcaccacaagaaggacggcggggagcacaaggaaggcatcgtggagaagatcaaggacaagatcaccggcgagcacggcgacaagtccggcgaccacaaggaaaagaaggacaagaaaaagaagaagcacggcgagggccacgaccacgacggcggccacagtagcagcagcagcgacagcgactgagatctggtgtcgcagcacaggtgcaacacatgtatgcttgctggatggaggattcataccagctgatgctgatgtagtgtttcactggtgtcatgcatgtatcgtgctattataatcaaaaagaaaaaagaaataacagtcagggatggtttgtttgccatgtgatcttgtacactcctacttaaattatggctgctgcacggtgctgctagcttgtactaataaagtgttgatctgcatgcttgcgtcttaaaaacacgaattcatgaacaagacggatcgaggagatccgcgtcttt

SEQ ID NO: 23361 - DNA, 3722 bp, Zea mays
  misc_feature (3577)..(3577): n is a, c, g, or t
ggacaattatgtcatcatgccgccaatctcctgctaactggatatcgaatgccggaaggagcgctcatctcgacccaccgtttttttttttgtgttccgtccaattttttttaatgtagtattgctaggtactacacttttttttccaaaagttaaatagccgacacgttgtgtgttcgtgtaaaacttttcctttacaacccagcgaaacagattgttcgtcatgatccggcctagaaataaacccaccggtttaggcctcggaagcggccttgagaacaaacacctggccgtccaactcccaaaggtaaaagaatcgtgaaccacagtggaccatgcatcctagagttgtgatcatcaatggcctcctcccatggagacggaccggaagctggtcttgggctgctttggcagcatgatgatccctgcgacggcagcggtgaaggcgaagacggcggcaaggccgaacgccgggatgttgcccttgccgaacagctcgtcccacggcccagagccaatcgcgatgaccatctgtggcaccacgatggagatgttgaggacccccgtgcacagccctgcagtggatgcacagacacacagttggtaatcgatccaccaatgcaactaggtccatggaaagcaagcgagtccaccacgcaccctgcccgccgcccttggccgccgccagctgtgccgtcacggcgaacggaacgctgcataggaccgcgaatgggaagccgaggaagacgaagatggcgagcgcggtggtcttgaggcccttatccacggcggcggcgtcttgcacgttgcccccgatgtcgccgagcgaccaggagctgaggacggtgaccaaggccatggcgacgcagacgaggaagctgctcatgacccacacgaccttggcggtgagcttgcggcacatgggctcgatgaggaaggagctggctccgaggacgacggagttgaggagcaggccgaaggcgccctgccggacgccctcctggaacctggccacctcctcggggctgccgtcgggcctgccgtggtacatctcgcggcccatccagtcggtgtcgaagaggatgaaggggaaccaggagagccaggtgaggcccgtgacgatgagcacctgcggcatgccggggggcatgttcttcatgcccttgaaaacggcgaacgggcccgacgactccccggcctcgtcctgcttcgccgccgccgccgggtccagcggcacctcgcgggcgaagatcatggtcaccaccgtggacaggcccaggaacaccaccgacaccaggaaggcggccttgaggttggcgcacgcctcgcagcatgccctcgtctgcaggaacgggaaccaggtgtgccacttgtcggtggaccccgacgagtagcccaggatgttcccgatcgccatccacgacacgaagatggcgttcgccgtgctgggtccgtggctgcctgcgaggtccgccatcagcgcgcgtgcggggccctgcaccgtgttgttggaaaagtccagcagccagaatcccatcacgaagaacaaggccgcgtgcagccgcttccccgtgtaaacactgcagtcgcccgtcgggtcccatcattcagtttggctagctgcagactgcaggggccggcctatatatgtcttattacttgcagtcttccgtcgtgtcaccgtgagcgtaaccgatgtctgaggagaaaccgatgactatcacctgtacgtggatcatatggaaataataataataataataataataataataataataataataataaatgaatgaatgaatgaataatccctagctactcacagatatacagatgatgatgcatcctgtaaagatgaatggcctccgtctcccaagcttagaagtgcatttgtcactatagaggccgacgcagggttgtacctgcgcatggtgcaatcaacaataagttagaactatatatgtattaaatgattgtataaacaaaaaattattgctttgttttcatttccaaatattcgacaaattgtcttatacacacagagagagagaaagagaagtaacaattaaatattctcttcaagtttatttttttcctatctacatctacatactcacatgcaggtacttacaagtaagccagcaataggtccacagagccacatgactgatgtaagagcatgaggaatccccagtgtctggtgcaaatatatggcacaaagaacccaaatagttagtgaatttcaggtgtatatcaatatgcagcatgtaacccacccacaccctattcaagctagatatataatcgatgcactagcttggattataatgagttcttatcttatctcttttaggaacttggaccatgagttagatgcacatgtaaactctacattctacatgcagcaaaacttggaccatgagttagaatgcacaagtcaaggttcgcctaattatttgttcgtttaagcatcatgtaaactctacgtacatagtatactctatttttatttaatcgaatcaatttaattggttgtttagtctgtctaaatggccaaagccttaataataaaaataataataaatggtaggtgaccaatcgtttaccatttaatatttcaaaagaaaaatactagttatagtagtagaataaattatatgctatatgatgcgatcatccattaaaagtcctatcgtattcaaggtatatttcaatttgtgaattcaaggacatccatgcaggaactactgatgaatgtttgaataatgtaaaaaccatatttgaaaagcaattgtgtcaaaccaaatgaaagtgctgtgaaatttctacaaaaatactatacaataacaacataacacttttgtgggtagagttaagacctgtatctaataatcttatgcaaattaactcaaagtttaaaaatgtacaaaaagagagcatgcaatgctcttaatggacaaacctgggtaaaagccatcccactttaaatgatatattgatacaacaatacataattctcatcatatcagaataaataaatgagatgatctcaccacggacaggagaataacaatggatcacaattcattcaggcaataatttgaaggtcttcattaatttggtaaataaataaataaatataataacagatgaacaaataaaaaagatggagagagagagcgcaaaaaagaacattttcgtaaagaaatgccgaccatattcatcaatcatcatatcagaagcaacacacacacagatatatccatgcatacctggacgtagggggtgagaagggagagctgcagcccccctccgtactgcacgccgccggcgaccatgcatgcgaggaacagccccaaaaggctgatctgcggctgcttgttgccgccgccacccccgctggcagatacctccatgccatcaccagccatgttgtaccagagtggtaacctagctagctagcctagcccgagggagaccgagggaggagaccttttggagacggatgtaattattaatggagggaaaggacgagcaaggggatgtgaagagcttagaggccgggaaagcgagntgggggcggctgacacgtggggttaaagggagcggcccttcttgttttgagcaagcatgcgttgttccgttttgttgcatgcctgcatgtcctggctcattctatttcagagatctcctaaatatgtgataatgatcagttaatg

SEQ ID NO: 23362 - DNA, 1916 bp, Zea mays
tccgtccaattttttttaatgtagtattgctaggtactacacttttttttccaaaagttaaatagccgacacgttgtgtgttcgtgtaaaacttttcctttacaacccagcgaaacagattgttcgtcatgatccggcctagaaataaacccaccggtttaggcctcggaagcggccttgagaacaaacacctggccgtccaactcccaaaggtaaaagaatcgtgaaccacagtggaccatgcatcctagagttgtgatcatcaatggcctcctcccatggagacggaccggaagctggtcttgggctgctttggcagcatgatgatccctgcgacggcagcggtgaaggcgaagacggcggcaaggccgaacgccgggatgttgcccttgccgaacagctcgtcccacggcccagagccaatggcgatgaccatctgtggcaccacgatggagatgttgaggacccccgtgcacagcccctgcccgccgcccttggccgccgccagctgtgccgtcacggcgaacggaacgctgcataggaccgcgaatgggaagccgaggaagacgaagatggcgagcgcggtggtcttgaggcccttatccacggcggcggcgtcctgcacgttgcccccgatgtcgccgagcgaccaggagctgaggacggtgaccaaggccatggcgacgcagacgaggaagctgctcatgacccacacgaccttggcggtgagcttgcggcacatgggctcgatgaggaaggagctggctccgaggacgacggagttgaggagcaggccgaaggcgccctgccggacgccctcctggaacctggccacctcctcggggctgccgtcgggcctgccgtggtacatctcgcggcccatccagtcggtgtcgaagaggatgaaggggaaccaggagagccaggtgaggcccgtgacgatgagcacctgcggcatgccggggggcatgttcttcatgcccttgaaaacggcgaacgggcccgacgactccccggcctcgtcctgcttcgccgccgccgccgggtccagcggcacctcgcgggcgaagatcatggtcaccaccgtggacaggcccaggaacaccaccgacaccaggaaggcggccttgaggttggcgcacgcctcgcagcatgccctcgtctgcaggaacgggaaccaggtgtgccacttgtcggtggaccccgacgagtagcccaggatgttcccgatcgccatccacgacacgaagatggcgttcgccgtgctgggtccgtggctgcctgcgaggtccgccatcagcgcgcgtgcggggccctgcaccgtgttgttggaaaagtccagcagccagaatcccatcacgaagaacaaggccgcgtgcagccgcttccccgtgtaaacattgcagtcttccgtcgtgtcaccgagagcgtaaccgatgtctgaggagaaaccgatgactatcacagatatacagatgatgatgcatcctgtaaagatgaatggcctccgtctcccaagcttagaagtgcatttgtcactatagaggccgacgcagggttgtacaagtaagccagcaataggtccacagagccacatgactgatgtaagagcatgaggaatccccagtgtctggacgtagggggtgagaagggagagctgcagcgcccatccgtactgcacgccgccggcgaccatgcaggcgaggaacagccccaaaaggctgatctgcggctgcttgttgccgccgccacccccgctggcagatacctccatgccatcaccagccatgttgtaccagagtggtaacctagctagctagcctagcccgagggagaccgagggaggagaccttttggagccgggatgtaattattaatcccggccggcctcgtgggtcccaatcgcccataggagt

SEQ ID NO: 23363 - DNA, 1714 bp, Zea mays
ccggccgggctgtcttgtcactcccgtcttgttccccttttctattgttcattcacccccgtgcgctctctccctgccgtggcgacgactgggcgacagccgccgccgcagccgtacaccaggcgccaaggccttcttcgggaccctcgccggcggagtatattctgtgccaatgaaatgtctgcctctgaaaaccaggctgctgaagccagaatggacaaaagtgccatgaaaattggcccaactgggaacaaaatccgaattcgtttgccattatcactgagaaagcggttggccgaaggccttcagaccatgagcacaggattacctgaggatacaacaaaacacgctgctaaggaagtacctgaatatactgatgacactgccaaggctaatttcattgtcccagacctgaatctgacaatcactgctggcacgcaggataaaagggaaagcatttgccctgtaagaaaagggtcatgtgaagagcgacacacggacattatgagcaatgggctgcctcctgacagcagcaaaacaacaaaaaagcaagcatgtgtaggagccatggacaacacccaaagcatggaaccttcaatcacaggagtgcaaagtgaagtggaaaagaataactccattaagaaaccctgtgaacctgctagtgaaaatatcttaagcaagaagctactctatgagacaaacagcaatacctcaaggaagagagtaactgaagaagctaagatcaacaacccaagcaagaacctgaaaacctctgcagtgaagtgtggagaggcaaatgactgtttcccaaccagacggtctgctgatcaatctaatgacaagaaatttagcaaaagactgtgtacctctgcggtacaagctactgacagctgccagaacatttctggaatgaaacttcctacctctgttggcgtggctgtagaacaaagtaccagcactgcattctcggaggccacaaaagtgtataaagagtttgagaagcaggttaagaggactgtataccttgacaacttgtcttgcctagctacagatggagtcattacgacggctttgaaccagttcggtagtgtcaaacacgttagttttctgaccaactatacagttccatttgacattcccaaatctgcattagtagaaatggaaactgagaaggatgctgattctgtggtcaagatactagatgagttcccattcatgatatctgggatgccaaggcctgtgagggcgaagcatgccacagctgaaatgttcaatgaccgtccatgtaaacctggtataaagttagaattccgttgggtgggccctacagaccctgattatcataatgtcagaaagttcaagtttttgtccaagaggcatgagttggagaacttagcactaatcaagaatgaactgcgagaggagcaactgctcgcgaggcatcagcaggacaatctaaattttcattacatgaagcttgagactgtagacagcatgattacgagtggctgcatcaatcgcctgactcacatctacaacctccgtttcgctgacatgtattgagagtgtcaggtgtacatggacttgttttgacctcggaacatacctgttgggtggaattgagctgtgaacatgatgttacgatctgattaaagcctgcttttaataaaaaaaaaaaaaaaaaaaaaagaaaaaaaaaaaaaaaaaagcggcc

SEQ ID NO: 23364 - DNA, 1458 bp, Zea mays
ttttttttttttttttaaatccatggcgccgtgtaacgacatgcactgtaatgaatcacgtcgatagtaatgctactccaagtctccaacaatactaccagtacgcagtaagcctatccgcgccgctcgagtatcgagcagctccgatgaagtcgatcagtctctgaatgaagaatgatcattcctactacataaataaagtaaacacagaagcgggtgagcctccctagggggatcccgccgtgaagtcgacgtggtagacctcgctcatgtccggctggaagaggccgaagtgctgctccacgccctcggccttgccgttctcgttgaacatggcgaacaggtaggtctccagggcattcccgggccgccgaggggtgccgccgtcgacgtgccgcaccacgttgttgttgtacgccgccgcgttctccacgctggcgccctcgccgccggccgacggccagccggtctccgacaccaccagctccagcccctgcaccccggccttctccaccgccgcgtgcgtcgcgtccacgatcgcgtcgaacatgttagtgtacaccgccccgccgtccgtcaccgtcgacgcggcgccggcgccggcgcccgacagcagcgcgtacccgagcgccacctgcccgccgctgcccgagtaggcgaagtacgggtacacgttcaccagcagcggcgcgcccctggacgacaggtacgagacgagcggcgccatcaccgtcgtggccgcctcggagaaggcgccctgggacggcgggtacgacgcgccgagcacgctggtggccacggccgtcgtgacggggacgcccgcgacccccgcggaccggagcgccgactccaggttcttcatggccgggagcacctgcgccgccgggtcccccgggatgacctcgttgcccgcgttgatgtaccggaactggacagcgccggcgaagggctgcacgttggtggccacccacgacgcggcgaaggacgggtcggacgccaggcgcgggaggtcctcgttcagcgtgcccaggatgacaccgatgccggagccgcggagcgcgttcagcacggtcgtgtccgggtggaacagacgcacgtagctgatattcttggccttgtacatggagacgacctgctccggcgccggcaggttgttggcgatcatgccgtagttcacgccgatcgcgccctcagctccgtgaaaggtcgccagggagagcagcagcaagctgcaagcaagaagccatggcgcagccatcttcgccgcgcgggcagctgcagccgccaccactcagaacagcgatcagagagctcagcgccctcctgttctctcttcccacttcttgtgcttggaaatggccgggagtttctctcctccgcctgattgatgtctgaactcccttccggctgccgtgctctgctgcgtttatataaggcacagagcaggcaacgggcgag

SEQ ID NO: 23365 - DNA, 1362 bp, Zea mays
ttttttttttttttttgtagtaaacataaacttatttaaagaataaatgttgatattatttttctatataagatattaaaaaataaacagtaaacgtgacgtgcggcagttttgctactccaacaaaacgaagtagatcaggggaatgaaggatgagcctactactaaaagtgaagaagcgggtaagccgcctcctccctagacctagggggatcccgccgtgaagtcgacgtggtagacctcgctcatgtccggctggaagaggccgaagtgctgctccacgccctcggccttgccgttctcgttgaacatggcgaaaaggtacgtctccacggccttccctggtcgccgcggggtaccgccgccgacgtgccgcaccacgttgttgttgtacgccgcggcattctccacggtggcgccctcgccgccggccgacggccagccggtctccgacaccaccagctccagcccctggaccccggctttctccaccgcggcgtgcgtcgcgtccacgatagcgtcgaacatgttggtgtagaccaccccggcgtccgtgaccgacgacgccgcgccggcgtccgccgacagcagcgcgtacccgagcgccacctgcccgccgctgctcgagtaggcgaagtacgggtatacgttgaccagcagcggcgcgcccttcgacgacaggtacgagacgatgggcgccatcaccggcgcggccgcctcggagaaggcgccctgggacggcgggtacgaggcgccgagcacgctggtggccacggccgtggtgacggggacgcccgtgacccccgcggaccggagcgccgactccaggttctgcatggccgggagcacccgcgccgcggcgtcccccgggatgacctcgttgccggcgttgatgtaccggaactggacggcgccggcgaagggctgcacgttcgtggccacccacgacgcggcgaaggacaggtcggacgccaggcgcgggaggtcctcgttcagcgtgcccaggacgacgccgacgccggagccgcggagcgcgttcaacgcgtccttgtccgggtggaagagccgcacgtagctgatgttcttggccttgtacatggagacgacctgctccggcgccggcaggttgttagcgaccatgccgtagttcacgccaatcgcaccctcagcgccctggaaggccgccaagcagagcaagaagctgcagacgctaacccatggcgccgcggcagcagcagcagacgtcatcctcgtaccaccgccgcgcgctgccatcgctcagaacagcgatcggagagaaagccctgctgtctgaactctgaactctccttgtgttcctgctctgcctgatgtctggactcc

SEQ ID NO: 23366 - DNA, 2731 bp, Zea mays
ggggccgaattttgcttcttgctaggatatgcgtgtagtttctttttgggtttgcgatcgtgtagttttttacttattgtgttctacagattcctattaggtcccatgtgagcctttgctgtgatgttctgtcattattctttcttccgaatgagattgcatctcaccaatctccacaccatgactccatgagataatcacgttattgggtgttttgtgcatctgtggaaaattgaattccttgaatgttcttctttgttgggagtaggagtacaaatttctgcttactaattctatgaaattctgctgttccggctgttaaattagagtattgcaggtcgacttagttggcatcttgcataatacagcattatccgttaagatttttatgttaggtgatatattgtgtcagtctgacttcattagtgtgtttgatcaatcaaaaggggtcttcttgtgttctgcgtttagccctgaacaatatattattaatatttgtattattaactctaccatttcaattaaaaaacacaggagtatattctgtgccaatgaaatgtctgcctctgaaaaccaggctgctgaagccagaatggacaaaagtgccatgaaaattggcccaactgggaacaaaatccgtattcgtttgccattatcactgagaaagcggttggccgaaggccttcaaaccatgagcacaggattacctgaggatacaacaaaacacgctgctaaggaagtacctgaatatactgatgacactgccaaggctaatttcattgtcccagacctgaatctgacaatcgctgctggcacgcaggataaaagggaaagcatttgccctgtaagaaaagggtcatgtgaagagcgacacacggacattatgagcaatgggctgcctcctgacagcagcgaaacaacaaagaagcaagcatgtgtaggagccatggacaacacccaaagcatggaaccttcaatcacaggagtgcaaagtgaagtggaaaagaataactccattaagaaaccctgtgaacctgctagtgaaaatatcttaagcaagaagctactctatgagacaaacagcaatacctcaaggaagagagtaactgaagaagctaagatcaacaacccaagcaagaacctgaaaacctctgcagtgaagtgtggagaggcaaatgactgtttcctaaccagacggtctgctgatcaatctaatgacaagaaatttagcaaaaaactgtgtagctctgcggtacaagctactgacagctgccagaacatttctggaatgaaacttcctacctctgttggcgtggctgtagaacaaagtaccagcactgcattctcggaggccacaaaagtgtataaggagtttgagaagcaggttaagaggactgtataccttgacaacttgtcttgcctagctacagatggagtcattacgacggctttgaaccagttcggtagtgtcaaacacgtcagttttctgaccaactatacagttccatttgacattcccaaatctgcattagtagaaatggaaactgagaaggatgctgattctgtggtcaagatactagatgagttcccattcatgatatctgggatgccaaggcctgtgagggcgaagcatgccacagctgaaatgttcaatgaccgtccatgtaaacctggtataaagttagaattccgttgggtgggccctacagaccctgattatcataatgtcagaaagttcaagtttttgtccaagaggcatgagttggagaacttagcactgatcaaggtaaagttcttctttgttagcaacttggcgtctaaaccctcagttccaaatttcacgagcttgaatagtagctattgttctagaatcctatcactaaaactcacacttcagaagtttttgcagcagtaaaatttgagccaaaacaatgttatcagggtcatgtgacgctgtcgcagtccttgcatatgacgtgccttttattttgcttcatttggcaatgtgcttatatcgctgaatccttgtagaatgaactgcgagaggagcaacttctcgcgaggcatcagcaggacaatctaaattttcattacatgaagcttgagactgtagacagcatgattacgagtggctgcatcaatcgcctgactcacatttacaacctccgtttcgctgacatgtattgagagtgtcaggtgtacatggacttgttttgacctcggaacatacctgttgggtggaattgagctgtgaacatgatgttacgatctgattaaagtctgcttttaatacttttcggctgttagtgttttttaaatgcttttaggctgttttttaaatgcttttagctgtgaacatatcctagtttggaccacacgtagctccctggttttcggcattgaacagcctggaacaatcagctgatggcgctgtatggatggaattcggactactgtactaagcatttaacaaaggagagcttgggtgctaaagatactgaatattactatatgtctaggcctacttttgtaatggagattttttcccctgttcttgcgcgcgcgcgtgtgtgtgtttgaaaaaatgaacaatttcctgtaaaatgcatagaccattcgtgctcaaacatgcccttagaatgggctgatcagacagacgtcaatatcaattttgtttcttacaatgatgtcattgaataataatagtttcttgagcaaactataataattg

SEQ ID NO: 23367 - DNA, 983 bp, Zea mays
  misc_feature (59)..(59): n is a, c, g, or t
tttaaaacggccccccctttttttttttttttttttttttttttttttttttttttttntttttttttttttttttttttttttttttttttttttgttggttcttggttttctgctgtcttttttttttttttttgggatttcagtttgttataccattttatttacaattgctaggctcgacggtggaactaccagatctcatatgcaaaaaaaaaaaaagatgaagataagcttattgcagagcactatatttcagacatcaggtcagatgagcttcatctttcggaagtactgttgtagatgccacagctgtaaaacagagactgcaatgcaaacaacaagagacagcatgctcagccacgtgaccctagaattcgtctgctcactgacgtccctcatgttagcttctttggattttagtagcagcaggttgtcatggattgattggacagcaacttcgagcttgagcaactccagttcaactccctcgatcttttcctttttggcaacagaatcccagtctctactagccagcccaattttccagtcaaggtttagcttcaccactaaccctctgtcctcaccatcaattgagaagcaggcaaggtagttccctgcttctgctgtggtaaatgcaaattgccccatcgaaaccttctctttcttatgaacaatgtctccaaaaggggacgtaaccttgacggagatggtaggctgggcgtggtggtgatcatagaggacggagtagtcgccgatgacaacaacgttggattggatctcctccgacacacacttagtccctgacggcgcaatctccagccataccgccccggcccccgccgccatccaccacacggccgccgccgccaccgcggcccacgcgccacctcgcgccatcgtctcttcctgccgcaccaccacaacgaacagccccaagcgccactttttcgattaggatgttctaggtaatggtctcgtgc

SEQ ID NO: 23368 - DNA, 2177 bp, Zea mays
  misc_feature (12)..(16): n is a, c, g, or t
ctgaaaagtgannnnnagtgccgttaattcgtgttaccaagttacagacataaaagtgatacacaactgcagctcataagtcataattagtgccgattcttagctttgagcttttgacaattttttttttttttttcagggtcatcagcttttctatctttaactttcattttaaactccattttggtagtctacattgcaaaacagtggtataaccggtctagtgaccttagactaaagccaacaaaggactgaatcaacgcggcaataaactacaccagcacacacactgtaaatacttactgcagagatacaatctacatgtattcctgttctttatgtacaatttattcacaagccagcttgctgtcgaagctggtcaaacagatggcgaaggcctggaatgccgagagtgggtatcggtagtccatagtgaacatgtcattggcgaccttaccaaactgcaggatcactttgtcatgatccgatgctgaagacgaattcgaaggctgggtttgctgctgagcttgctgtgacggttcagaatctagttgtggtgcagctatcaactggaagttcttcacagaagccacggtcacccgaccatggaagttgaggcaccaacactgcagctgctcgtgccaccttggctccttgttgcagagaaccaaaggcctctccttagcctggtcactgtcatcgtcgtcctgctgagccaatccgctcgtctctgagaatcgagaggagctccaatccaaggagcggtctgcgaccgagaaccttgagctggaaggggtgttgtttgcactgcgaaaggaatcttcgaaggacgacgagccagggacgaagatctgcttgggttggccaggctcaggcaccatgccttgagggtccagcgttgaggctgggatggaatgcatcgtgcaattcatacgcctgggcccccttgtgccaagcaggtttagctcatagttcacccgggcaatggggtagctggcagtgggtaccttgggggaaaccctcctagaggagattctgcggctgccgcgctcacaggagacaaggctcccagcattgtgtggtgctcgagtgtcatgcacgatgaatttagtgccaagaaaatttgacctcatttttccaacacagccatcacttgatcgtgatatacttttaggatccacagaaatgatgtactcagtatatgttgtacggcgattcctcttagctgctagcagaaacttcccatcctcgctgaggacaacagggctaagacataggtaaagataataagttgatgtcgatttgtccctttttatgaaacactggattattccatttcttggtcccggctgtttaagtgatactggaaaagtgagcttcccgcagaactccgggctcagcactatatccttgcatatctctctccatgttccacagacggctgcacaggcaacaacatttttccgggatggccaattgctctcaccttcctcaagccttctcattacatctcgaagcaattcaggaggaagaccaacccacctgctttgatcaactactacaggtctgtcgcgcaggtcactcacagatccaacagatttccctctatgatgaccaccagacagaccaggcaaaccagaaatcctgacctcaaggctccgtcttgataagctaccaaagctttccctaacatcacggactatgctgcgaaaggacatgtccagtggaaaaagtacagtgaccggaaattcagcaaatctcttgtggtgatcaagatcttcaaagcaagtcttaccgacaccgcggtcctcgagctgctcgggaacttcaaatcgaatctgtgaaaaaagatccgactttcagacgcagaggaggcgcttttccgcaagggagatgagcaaaaagttttggcccctggattcaaagctctgtgctccgaattccagtgggatttgtcgcctttcagacagggacatcgaatgagcgagcttttgagcaacaggaaggacacaggacgagcccaaatcgcagaggaacaggggtagcttcgatttggtgcggggaagagggagattgagacggacaggtcatgggggaaggggaggggaggggaggggaggagacacgtgaatgaggaacagtcccgaaatttcccggccggccgcggagggtacccc

SEQ ID NO: 23369 - DNA, 5776 bp, Zea mays
gccccccctcgagcttttttgctcctgttttgaagaaaaaaaatcggttctttcacttccaaaatatacatgttttcgggcttcttttttgaagagtaaagataaatacaatgtaaaggaagggaggatctaccaaggcaaccatgggagccttacacaccatggtgccatttaacgtctaaaatatcctacaaaataatatctgtacagtttatgtccacagcgaagggggacggcaaataaaggcaaccctgtctatatacaaaatcgcgctaacttgccacgcggtaaataaccaataatgttactggcgaagatcatccattccttctatctgatgacaaagctgttgtcttgcagatggggcacacgtttttcaccatcaaccattgctttatgcaatcctcatggtacttgtgaccacattcaagggctcctataagttctctagcttcatactcctcctggcatattatgcaagcatcgttctctaacgaaagctcacagaactgatcagaaatgctagctgctcctggaacatgaaaagtggacctcaagttttcttggatatagctttctgtcaaaccagtattgacatcacctatctgctcttgcaatgctacaagctcctcataagtcatgttatccacatctaaacgcatatctctatgttcatcaataacatgtcctgcttcataaatccttgaatgatccatcactgtagcattctgatatggcagaattcttaaagccccattgttggcttggtttatcagaggtggatgcacttgatgcccaaaagtgtgctcatcattgaatgggaaagccagcattcttggatctaacggaaggcctgcggctgaaggatttaaaccatgcaccacattgttaccgatgaactgttgatggggtacttgtatttgaggtacttgcatactacgcaaaggaatctggcagaaatgaggtagtggcccatgaatagaagaatgcccagcttgataatcctgaatatttccattcggcatgtctacggttcctggaggattgaccatgacattaccatatccccactgtggtattccatgacttgcagtctgtggaacccatgtattgcactgtattatgtgacaagctggatataaattgttaccatgaggtaccaactctggacaagcatccactgaagtgaaactgtttgaagcatttgcagaagattcttctaagaacggccacccattactattgtggtattctggtaggtttgaagctgcagaactgggtaaacaatttgattgagatgaagcattccatggcccatacacaggattctgagggacatgaacagatgaacttgagccagcaaatccatgaagaatgtgatggtttccggcaactactgcggttttccttttcatggatccaatggcactatcaccaaaattgaaactgctgttattctcatcaatagttcctgtggaaacttgactatgtaaagatggtggtagcacattgcccagtccaaagctttgagtctgaggaatatatatgttgacagctgctgctggcatgcaagggttgtacatactagttgggaggacaaatctcgatgtaacactggcatgtgggtatgaattatgaacaggcaggcgctcatgattccacagatcacatataccaacattaacagtatttactggaacaccaacagcaacttgcatgcccaggttggatgaatcacttacagtgcctgcataataggaacttcttggttggacttggacatgtccttgctcccattcaggattaacggactgatgtgtccagagcatatttctatatgacatgacgccaatgtctatttccttaaggagaaatactgcgagtttggtcagcatatatcctttatcatcacctctccctgcatacgagatagaccaaacacgatcagcattcaatctaatatggataacagagatgtaaaatgtaaagcaagtcacgtttaagtaaatgatgttagcagacaagataattcccagtacatgctgaagtttgtaagtgggagcaaaatattgacaaaagaaacttgcacatgagtgggcctagctagcagaagatattgaatagtccatatttagggggaaaaggtaaaatagtttcattcttgctgatatgcagatgtcctgataacttgatctcacaaccttataggtaacaaaaatgttaatcagttatatgaagaggactgtgtttactaaaggcgcatacactttgtatcatacaacattttgcaatatatatataatctgcgattcaagtttcagtagcattggctgtccatagggccattatatcttgcaccacaaaaatgactgatcttttattgtttgtttgtcagaacaagattgtcccttaatttgtgatctatatgcacatttaattgttcatatatttatacaagataaatctttcgaagcatcacatcatcaattacaaaattgcaactaaaattccagtaacagtcatgcgtgcaagactgatcagcagcagccagacagtaactactatagcacaatactgtagtggtgtagtagctacaaccgggttcccatgcaaggcaccagcttatcagattagcccatatgcattatcctgtatcggatttcagttagttagatctcgacagtaaagctggtacaagttggaatgctgcagatggagtttgcatcttaagtgacatgtcgaatcagccctataacaagctattgcataataacttgtgtatatggtaattgaagagaacttgttggcaccaatgaggggccatgcttatgacataatacaaccaaggtacagatacgcattattgagttactcccacaggtgactgggtggcattaatttatgttacaaaagaaatgatgcaacttcccgccaaataggcgaataacattgagtgagctatttaaatgtcaaccaggaaggcaggaatagaagactcagcaaaataagctgtaaggtttatgtcgcttgaacattttttattaatctacgcctttgcactgagcaagggtgcatctgccactaccagggtccaggggtgcagaactgcagatagggtgccttagcattattcccactgccgcgatttggaataacattggagtcgggagcaacagaggctcagagaacttagggggtgtttggttcctttagtcaccctcataaactttagcccctagaaattctatttggaagacttattttagtcacactgtttggtattttagggactaaaagtgactcactaaagtttaggaggtgggaaccaaacacccccttatgctgggcaaagaggcaccatagtctaaacctaattggagtttggaccatgttcggcctaatgaccatgtgtgcgcaagtgacaaccatgtggttcagattgagccatagaaattagaatagtggcacaccagtttgtccacttctcttattcatcataaccctagagagcctcacagtggttgttgagctctcgtgttccatccatctgtgcaattacacacattttcctctttaaaaatacctttcgatcctactatgtggcatcggtgtggtttgcatttaaatggcaacattgatttaatataaatgcaggattccaaatcgagttctactacggtagaatgaggcaagatataagaatataatccaaacccgaccagcaagccgcaaatctgaaactctagaagcacccatggtctggatcactcggtttgaaacatatactttaaatttaaagtacactcggtgcatctagaattcaaattttaaaaaagtacatgtttaaaaattatgacaattgagatcccatggttgggaataaataaatagattagtacccattttagtaataatttgtcttatctaaaatatttgctgttgctttccttatttaaaaagattagatgctttgtagaaaaaccatttcccctctcttgagtcttgaccctaaaaaagcccaaccagaaactaccaacatccacaatgctagcagttgaattagtgaataacgggaaaaaaaagagagaatttaaaaaccaaaacaaagaacgtactgtaactaaactcttcagaccaaaaccaaagttcagacttaacaatttaaagtccaacctattccctggtcgatagaaacaagtctgtttgctaatcagaaatgagcatggcaacagactgtcacatctatctcctcaccacaatcaaccaagtgtctctcgttaccaagcaaaattttccgcacctacgtagaagcttatagggtctcaatctgtacagccatcccaaatgaaaaggaataacatactacgccgcacgaatttcaaaccatttacgtccacgacccaccgcaagtccaattccgccgctccatcaccgaaaatgttgactccaagctcacggcccacattccgagttctgaaattaggttagctgcatcaaccgacggaagcactccgctgcagtacagaatccttcgtcgggcgaaaaaaaaaagagaaaaaaaaaccgcccccgtcttctagtagcttccgggctccggcgaccggcgcggcttgcggcaggaatgctccccagccccaaccaaacgcgctcaaacgcatagtataataatacccagccccagcccctcacagccggccgaacgtccaatcgcggctctcggggacccgattccttcccggcccgccgcgtgagcgcagacacggtcacacgggccacgggcgggagcacagcgagctcacccgccgcccatacaattcgacgaggaagggggagggggacgagctgcgagaggattcaggaagcatcacctccggacgggtccgcgacgcgatcggcgcgggagctgtaggaatccgctggtgggtggcgagagaagcctcccgctcgagcgtgaccggtggtgacgaggtcggggccggggggacggaacggaatcggttggtggaggcggtggtatccggtgggggctggagctcgatcggaaattcggaagcggacgacgatacgggtgggtcctgtatttataagcacgatgagcttttcggggacggacagggtgggggagaaagaccaagaggagggtgtctctcgctttttttataatgttttttcagacaaaaaggatgccggatgtggattcgggtgcggtgattctcacgttttttccggcttctgaaccgggctcgaacagcgcgtctcgggctgtgcttatctgttcgtctctattcctgcgtcagaactcgaaagatatcctccagctaatctctgtgtggtgtgtgctcatcgggccagtgccacgttggttcctaaccccattcagacgagcagggtgaaaatagtatggatacgaacgtatattaagtgctagttcgagaacctcaatttctggagtgattcctatttttctatgtgaaaataaactattttttcttgagaaaatagaaaattcttgaaaaattgggatttctaaactagccctaaattaattatttttagtcaaatttaggattaattatagacagcaaaaaagaaacgggtcagctacacaacgagttcaagtagtatttggacagatagaaaacagatattatatataacgtatatgatccaaaacacttaaataaattaatataattaaatttagacacattataagcataggacatgttataaatttgtcgggtatcgtaattaggggtacccctaacactcctaa

SEQ ID NO: 23370 - DNA, 1828 bp, Zea mays
tcgcgatctagaactgccgccctttttttttttttttttttgaagaaaatttccggttctttcaattccttttttttttttttttacggttttcaagcttctttttttgaagagtaaagataaatacaatgtacaatgtaaaggaagagggcatctaccaaggcagtcatgggagctttacacaccattgtgccatttaacgtctaaaacatcctacaaaatatctgtacagtgtttcgaagctcagtttatgtccacagcaaaggggacgggcaaataaaggcaaccatgtctatatacaaaatccacgctaatttgccacgcggtaaacaaccaacaacattattggcgacggtcatccgttccttctatctgatgacaaagctgtcgtcttgcatatggggcacaggtttttcatcatcaaccattgctttatgcaattcacatggtacttgtgaccgcattcaagggttcctataagttctttagctttatactcctcctggcatattatgcaagcatcattctccaaagaaagctcagaaaactgatcagacatgctagctgctcctggaacatgaaaactggacctcaagttttcctggatatagctttctgtcaaaccagtattgacatcgcctatctgctcttgcaatgctacaagttcctcataagtcatgttatccacatctaaacgcatatcgctatgttcatcgataacatgtcctgcttcataaatccttgaatgatccatcactgtagcgttctgatatggcagaattcttaaagccccattgttagcttggtttatcagaggtgggtgcattggatgcccaaaagtgtgctcagcattgaatgggagagccagcattcttggatgtaaaggaagacctgtggcagaaggatttaaaccatgcaccacattgttaccgatggactgttgatggggcacttgtatttgaggtgcctgcatactattctggcagaaatgaggcagtggcccatttgacatgtctggaggattgaccactgcattactatatccccactgtggtactccgtaacctgcaggctgtggaacccatgtattggactggcttatgtgacaagctggatataaatagttaccatgaggtgccagctccgggcaagcagccacagaactgaaactgtttgaagcatctgcagaagattcttctaagtatggccacccattactattgtggtattctggtaggtttgaagctgcagaactgggtaaacaatttgattgagatgaaggattccatgccccatgcacaggattctgaggcacatggacagatgaacttgacccagcaaatccatgaagaaaattatggcttccagcaactactgcatttttccttttcatgaatccaatagcactatcaccaaaattgacactgctgctactctcatcaataattcctgtggaaacttgattatgtaaagatggtggtagcacactgcccagtccaaagctttgagtctgaggaatatatatgttgacagctgctgctgacatgctagggctgtacatagtagttgggaagacaaatcttgatgtaacaccggcatgtgggtatgaattatgaacatgcgggcactcatgattccgcaaatcacatataccaacattagcagtatttcctggaactcccacagcaacttgcacacccaggttggatggatcacttgcagtgcctgcataataggaacttcctggttgaacttggacatgtctttgctcccattcaggattaacagactgatgtgtccagagccggacgcgtgggcggacgcgtgg

SEQ ID NO: 23371 - DNA, 941 bp, Zea mays
aggtttgaagctgcagaactgggtaaacaattgggttgagatgaagcattccatggcccatacacaggatctgagggacatgaacagatgaacttgagccagcaaatccatgaagaatgtgatggtttccggcaactactgcggttttccttttcatggatccaatggcactatcaccaaaattgaaactgctgttattctcatcaatagttcctgtggaaacttgactatgtaaagatggtggtagcacattgcccagtccaaagctttgagtctgaggaatatatatgttgacagctgctgctggcatgcaagggttgtacatactagttgggaggacaaatctcgatgtaacactggcatgtgggtatgaattatgaacaggcaggcgctcatgattccacagatcacatataccaacattaacagtatttactggaacaccaacagcaacttgcatgcccaggttggatgaatcacttacagtgcctgcataataggaacttcttggttggacttggacatgtccttgctcccattcaggattaacggactgatgtgtccagagcatatttctatatgacatgacgccaatttctatttccttaaggagaaatactgcaagtttggtcagcaaatatcctttatcatcacctctccctccggacgggtccgcgacgcgatcggcgcgggagctgtaggaatccgctggtgggtggcgagagaagcctcccgctcgagcgtgaccggtggtgacgaggtcggggccggggggacggaacggaatcggttggtggaggcggtggtatccggtgggggctggagctcgatcggaaattcggaaccgccggcccagcggtacgggtgggtcctgtatttataagcacgatgagcttttcggggacggacagggtggggagaaagaccccggccggcctcga

SEQ ID NO: 23372 - DNA, 5681 bp, Zea mays
tggttgtagaaaaaatctagttatggagaaaatctgagtatctcgaggattacgtgtgaagtaagatgaagtggtccaaatggtttaggatctagaaagcgatggattctattatcgtaacgactcgaccgatgttgtgttcattttaattttagacgatctttaccaaatcagtttttatacaagctgactgaaaatacaagacgtttggcttctgcatcagtttttggtgactaaaagctgaaaaaaagcccaaacaaaaagtgccatcatcgttcaatttgtgacccgcatcaaataggtcgttttcaaataacgcaagcatatagctaaacaattccccccggacgaaaattaagaaatctagctcagaaaacatgagagagagagagagagagagagttgaaagtaatacgggtagcctatgcaactgtgccttttcgtccaactcacagtcttgggtatcggcgtaccatgcacatgcacgtgcagagtgcagcgcaaacaaacatgtagaaaccgttgcgcgagcagaaaatgcaggcggccggaggaacaagtgcagcagtacttcccgctctgattgtttcgtcacggcgcaacgacttccgccgcaggtacaggccgcgtccgcgtcacgactcacgccccccaccgtccgttgccgcgcgcgccacacacgtactaccaccgtaccgtggcctttgaggccgctggcgctgggcggcgccgccaactaccgcgcgccgttgtcgtctgcctgctgccgtgggggtctgttccgttcgtttcgtggctccgccacgtctccatccaacccaacccaacccgctgcccgttttttaataataataataataataataattccttggtggaagtggagccgtggtgtttggaattttggatacgggcagcgagcgagaggagctcaaatgattgcagagatgggaggggaggaagtaaacaaatccgctcccgtcaatcatctaaactagggggattagtttagtggccgggcccaaccactgcatctgcctggctcacgtacttggggcggtgctggctgttcggtaaggcaaatgactggctccgcttcaatcatcccctgctttccgttccgtagctctacagctacaggcccagctttgttcgcaggcacagcaaaaaaaaaaagtcgcagaaacagacaggtcgggcgacgagaagcttgtttcattattcggcaaggcgcaaggattggctggccgtaatctaataatactccagctagtacaaaccatgcaggcgaagacaaacaacccacccgtcggttctttttcgtcctttccatttgcttcaggagtggatggcaatgcagctcgatttgctttgggcagcgagcgagcgagccagcatgtccccgctgtcaagcatctcctgtccatgctgcttctcggcaccggctagctttttagaaattagaaaacgaggctgtatttgatgatgattgcttagaatgcgaccgctcaaccacggcgtccttatcgtagagcgctgtctgtgtgcatgcctgtccttggctgaattctgaccgtccttgcataccctgtggattcgttgttcgagctcacagtaggaggactcgtatgtctcggctgccaatgctgctcaaaccttattttcgttcgaattcctgctctttgacgtcatgcagtgtcacaccatgctgtgtctttcctttcttcgacctcctgcgcttggcgcattcttcatatgcttcttctttctaacagcgttcagcttctctctgtgagtgttcagagtcacagctttgactagacaagctactgaggttgaccacttctgtgacaataataatttcttacagaactgtattgatgatctagggaaggtaaaatgggaaccttgttgtatttaatctgacaagcaaaacatatcttacaccatggtgctgctgcctccgtcagtccgagtgccttcttggatttcagttcaaattttggtccaagtggagagctttagtcgtgatatatattgtctcatctggccataccagaggacggacatctatttacttgattcgagggcacttcgctttagatgcgtggagtttttggttgagacaacggctacttcaaaagaaattctaatacttttattcatcctctcttgtctcattgaacttttagatatatcccttattacttatgttaaattattatgtgcggccgcgccgccctttcctcccgctttgtttttttttgcaaagcaaaagtcggaagctgacattgcatcaacctttgggatctagtagtctgctggtcttcaggaactataacaatcaatgtctaagatgagctgtggtggagttatccgtgacgaacttcttgaacgagacgaggatcggggtgcgcactacgttcttgggtgagacccacgtgaggtgcccctcggcgatccctttctggatacttgtgtccatagacccgatggtgaccgtgaaccccttcgcctcgttcaccttcttgaacaggagcactctcggagttactgtcaccgacaccgtgctcggcatctccaccctggcgacgtacaaggaggtgccgcgcccaacgttcgtcacgacgcgggtgacattaacgacgtagggctcctgctctaggaacgcggtgatggacgggtagttgaggtccttctgctccacgacgcccatctgcgcgcacgacaccgccggcagcgggtggatgatcgagttgatctcttggtcgggtcgacgcggccgccacaggtaggggatgtagtccaacgccgtcaggttgtacacgagccccggcgtcagggccttcattggttcgacgaacccggcgcccaccgtgagcaggttggcagggtacccgtcatgggctgctatcggctccccgcggcggttcttcgggtcggccgtcgttataatggccgatttgatcgccgccggcgtccatgtagggtgcgctttcttcagcaccgcggctatgccgctgaggtgcggcgtggccatggacgtgccggacaagacgtcgaacttggccgccagtggattgggaggcgtcatgagccccgccggcttggggacgccggcgatgatgctcactccagggccggtgatgtccggcttcaggatcccctggttttgtttgcttggcccccgcgacgagaacggcgccaccactggcgagtcgcggttgcccagcacggttcctttgaaaatcagctcgcccgtcgggatgtctgtggagttcatgtaggccctgatctgctgccctgtggcgtaagtcacctgcgacgccgggagcgcgtgcgccttgggttggaccaccgagccgaattcctcgatggtgatgacgaccataccggctgcaccgcctgcgcgtagggcggcgcccatctcgagtgcggtgaagttgccaccggcgtcgcagactactatctttcctccgacgtgctccggcgtaaggaccttctcgtcggaacatgtgccgtcgctgaggtctcttaccagcagccgcggcacgcttaggaaaccctgtggctggaacaacgactcgccgtcgagctcgactccattgccaagccttacggaggcgacgaacctccggtcagttgtcgctgccgccactgtgagcagccaaggcgcctcgttggcaatcgttgcatagtccgggcccatgttcccacccgcggcgctgacgaagatgcctttcatgatggcggtgtagcccccgagcgcgatggggtcgtaggcgaagtcaccggcctcgtcgtcgccgagtgagagggagagcacgtcgacgccctcatcgacggcgtcgtcgagtgctgccagtatgtcgtcacggtcgcatcccttgtcctcgaagcacacctggtagagcgcgatgtgcgcgcggggggccatgccggcagccgtcccgatcccgttgcccatgacgttcgcgccgggcacaaacgcgccggccgccgtgctcgacgtgtgcgtcccgtgcgagcccatgctgacgggcagcaccggatcgtcaatcccttgccacttccacttggccgactcgtagaacgaccgcgcgccgataagtttgttgttgcacacggagctgttgaagtcgcaccggcccttccacttggccggcggcggcgggacgcccgtcgcgtcgaacgacgggtgtccggggctgatgccgtcgtcgaggacgccgatgatgatcccttcgcccatgttgctcttgtcccacagaccgccgtggaagcctctgccgctgagcccgagcatctgcggcgtgtgggtggtcatcaacctgtacgtcttctctggcatggccttaacgaaccagtccttgtctgccatctcgcggacctcctcaacggtgaggcgggccgagaaaccgttcacgacgtggcggtaggagtagatgaggcgcgccatggcggccggatcctcgttgagctcctcctcggccatgtcgcacacggacgcgagcagggacgcgtgccagttcgacacgtccttgaacatgctccggtcatactcgtacggcgtgcgcacgatgatgaggtagttcttgtgcacgccgaggtcattgtgggcgacggcggtgcttaccagaagcaaggcgaaggagaagacggcagcacagagggagagaagtgccgctaagcgcattggatttggaggatccattggagaacaaactaaaccaaggaggacggatgatgaccagctacatgcgaggagattgctgattatcctaaaaatggcatggtgcctaactaacggtaatgatgggtaaccttttgcctgcaggatgaacaagcttaatatagcattggcaagcgggattgaggtcgcttgcttgtgggccacaagctcagttgtgcttcgtttgagctccaaacgtggaggaaatggaagaggcatctgcacctcagactgtcttgaacgcgcttcccgcgagcccgccgcccctccccttgtttagcggcgacagtggttctcctctctccttccgtcgcgcgctcgtccggaccaaggaagtctccttcggcggcggacacagcaagttccggcttgccgtggcgccgtcccactctccctggatgctatccatgagtgccggatcttgctccggcgcaaccgaagccgtgcatgagcaatcttcgtccgatttattgccccgccgagcagttcgggcggatccaaggcagcggcgatttggaagcaagcgacgacaaggcgcgtgcaccggcgacccaggaacggcggcgtcgccagcaggcctcggcggggaaggagattcgtctcgccgagctggaggatccgcctccgtcttggttggctgacaatcggagaagggacggtcccaagcgtcgccgccttcgttgtcgaccgtacctcatctttgttgtcccaagacggtcctaaaccttcttaccccaagcggcgtaggcagcaccaagatccatccgcattgcacacctcattacgccgttcctcatctttggatctgcagcatattggaaaatcgccgccctcgtgttcgtgtttcttttttaagcataggatggtccggttaatagaacgatgaaacatttattagtaagggaaataaaaattaatttgcaaaaaaaaaaaaaaaaaatttgcggcc

SEQ ID NO: 23373 - DNA, 906 bp, Zea mays
gacaaggaaattatttagactccattagccagttgtcatgtaggaaatccaatcacgtacggccggctgtttttttgtttttttttttcagggcaaagcgacatttttattaactacacattgttcggattacaatcatctcggatgagatgcagcaagaacgcaagcccttgtctcaaacaagcaagggcgagtatgtagagctttgaagtgcttcggatttatttattttacggaacgaagcttgacccaggaacgtctccggtttcgatcgcatcatgtaggcagggtttgctgaggtattgcacgataaaatagaagtagactgcaaatcatggtctctgttcacttctcattccctgcaccagcgctagtaacctctaggccattgccgtcagggtcgaagaagaagacctggcgcgtgcgcccatccggctgcgacttttcgaacacatcggtgccgcgcgccttcagcccggtcacgaacccgtcgtagtcagcgacggagaaggcgaggtggtggcgccggggcagctgcgacggcggcgcgccctcggcgccaggccccaccgcgacgggtgccgcggcggggtcccgctcgatgaggtggagcgcgacgtcgggggagctcgggaggcggagccatgcgacctggaagcccgagtaggtgggcgaagggatgcgctcgaaccccagcacggcctcgtagaaggcggcgagtcgggccacgtcggaggtctcccgcgcgatgtggttgagctgcagcgtcgccatcggagaagagggtggggacaaggaagaggatcagaggagttgggcgcggcgcggccggcgaggcgtctcgtaatgttgggagttgggacttgagagtgtcgggcgccccgccgggcccccctgcccgcgagg

SEQ ID NO: 23374 - DNA, 2364 bp, Zea mays
cccccaaagggcaaaggcccaaacccagccggccagtcccccaccccccagcagccatggagttcggcttccgcgcaggaaaccgcacgcagcgccgcccttcccccgatcgacgcttcacagcacagcaagccggacccttccacggcgaccacccgcagccctcgccgttgcagtgggaggatgcggcccggcgcgagcggatcaaacgcgaggtggagcgccggctcatcgaggaggaggtccgcctggagctcgcccttgagcgcgcccgcctccacggtggttttggccccgccccgttcctcgggaccgacggctccgtcgtgccggtgcagccaccacctccacctccaggccggttctccagggccgacggcccatcgatgacgccggcaatgtcgtgggacgacagccctcggcggctcgcgagatttgagcaaccgatgctcctcagcgagacgggaacgtggtccctgctgccgaagccgaggcatacgctcctgctgcgcgagatcgcgcccagcgagagctccgaggttctttcatcagcaacaaaggcttctggcgtgaagaggaaagcagcagctgcgatttccgcaacaacgactgaacaacaaccaacgggagtacaagacccgagttccgggcaatggagctgcgcaatctgccaggtgagcgcgaccagcgaggccaacctgaacgagcacctccaagggaaaaagcacagggcaaagctggcccgatgcggagcgacgaccaaggcgacgacggatcctcctcctaacagaagcggcgatggcgcagtagcactagcagcaggcccgagcgacgcgccgaagaggatccagatcctggtcgacggggaggcgcaccaggtcgtccagaggagcagctgcgtgtggtgcgagcgctgcagggtcggctgcaccaacgccgccgccatggtcgaccatctgcggggcaagaggcacagcctgtcgaacaaggtctggacggcgataaaggccgtgaggaggagcagctaatacggcgataaaggccgtgaccgtgaggaggaggccgtggtgaggtgaggaggcacaatcttgtcgaatacggttgagcagggcctgtgttgagctttggaaagaaagggcacagatactagttgtttgacaactaatgaagtgtgggttttcatagatcctcttaatttagcagcggaaagaaagacggtatattccttgcttgttatcacttatcagacaatcacttattccccaaaaaaaaaaaaaaaatgtgggggctaatcgttgggagtgtgtgtgtgtgtgtttttggatgggctttttccttgtgatgtttatgtggcaggtgtgttcctcctgctcatgtagctttcaggtctgatgctttttatggctgcggcctgcgggagtggtagcttgtggcatgcatctcttgcgtgctcgctgcctcaaggtctttcagacctgaaaacaaaacaaaaccaaaacccagatgagcccacgcggcggtctgttctgttggtcttctcgagtctagcttgcgcgacggagagcgtagctagctataggaaattaggagtaatgctgcgtgcttaccaggacgtgctgcagaaaaaagaaccgcaaaatccgatccaatttttcgtaatcgattagttaacatggtggttaaccgtattatgacaaacactatcagtcaccaagatgggaagaagagtcaatcttttttttccctagctacagagagggctcaggggatcatgtactggtataatatataagaaaaaggatctaggcatttccagattccaccgaacatcagcaacgaaaaagccattccaagatctcaccactctgacgtcgccaaaggcgtccttgtcgctgacgatctcccgcatcttggcagtgcgcgggttgtggatccacatggtggtgtccatgaactggaccccggaggcgtcgcaggcgctgaggatggcgtcgagttcggcagtgcagagcgcggtgggcttctcgaggagcaggtgcttgccacgcgcagcgacggctgtggcccagggcacgtggagactagtggggagcgggaggtacacggcctccacgtccgggtcctctaggagagactcgtaggacccgtggacgcgcgccgcggggaagccgatttcggagatgaagcggcgggccttgtcatcggagcgactgcctacggcggcgatggtggcggcgcccggagggagcatcagcattgcgcgcgagatcttacgcgcgatgtcagcgcatcccaggacgccgaagcgccccggcgcgcggcgccggcggctgcaccggcgctgcaggtcgactatataggatc

SEQ ID NO: 23375 - DNA, 2354 bp, Zea mays
cattggtacctcgagccggcccaggttcagtcgctcaccattctgccgttcacacctctctcgctgcctttatttcctgttggcgacgctctcgccaggtcttcggcggcccgttcggcgacgactagcgcctccgtttgccaggtcttcgtcgtccgtttcgccgtcgactggtgcccagcagccaggtacatctggaagaatgggggtttaccttagcacaccgaaaactgacaaggtatccgaagatggggaaaacgataaacttaaattcggactttcatctatgcaagggtggcgtgcaactatggaagacgctcactcggctttgctagatcttgacaatgacactgcattctttggtgtttttgatggacatggaggaaaagtagttgccaaattctgtgcaaaatatctacacagagaagttctccataccgaagcctatgctgctggtgacctgggtgctgctgtccacagagcttacttaagaatggatgaaatgatgcggggtcaaagaggatggcgggaactccaagcacttggagataagataaatcagttcactggcataatagaaggcttgatttggtcccctaaagcaagtgattcaaatgatagacatgatgattgggctttcgaggaggtacttgtggaactggcatggttccataattctatactcatcttcctatgtctaggagagcatgccatctgccttttatttattaatttggcacagtcattggatttcattctgaaagtgtcacgggattatcattaataaggtttctttcttctccttcattttttcgctaaaatcattcaatacagaaacttgtaacagtagacttatggttcttgagtacacgtgcaagtgcaactctgatgttttaagacctaaaagggtatgcctacgaaggaaatttgttcttttaacatttaaaattcataaaaaaaaaaaaaagggatgctacctcttgaaaaggatatctatgcataagaaggaagtttattcttgtaacacctaaaattgatggatgtgttgcctaacaatgctaactcttgaagaatgacctccaatttcctgaactggagcctcttcttgttttgctggaaggcaaatcttggcatttctctttgttgccagttcttttgttggaaatgaacattccatccacctaggtagtcttatagaaatttcttttatcagggaccacactctgactttactgggccaaattgtgggagtacagcatgtgtagcattagtgagaaataggcaactcgttgtggcaaatgctggtgactcccgctgcgtcatctcaaggaatggccaggtcagttgttactcctaaaagaaaacaggagggattaccctctagtggcatataaagtttgtgggattgtctcattttgtacttcttccacataaaacaggcatacaatttgtcaagagaccataaaccagagcttgaggcagagagagaaaggatacaaagtgctgggggttacattaaaatggggcatgtaaatggaagtttaaacttgtcaagagctattggtatcatttttttacttgcttctttttgttcatacctctcaccttaactgatgtcttgcatatgcaaaatacctttctaggagacatggagcttaaacaaaacaagttcttgtcccctgataagcaaattttgaccgcaaaccctgacataaacattgtgcgtaaattctgcagttgcctctcgctcttgctatgtagactattaagttagcacttccttcttgttgatagttattgtaacgttattcttttgtacaggtcgagctatgtgacgacgacgaattcattgttttagcatgtgatggcatttgggactgcatgtcaagccagcagttggttgatttcatccgtgaacatataaacacatgcaggaggaaagcctttctgcagtatgtgaaggagtgcttgatagatgcctggctccatcgaccatgggtggcgagggatgcgataacatgacgatgatcttggtgcagttcaagaagccatttgctcaggtaaaggatgccagtgatgcggaacaactaactggagatgcgggatgctctgagacccatggggccgaggagaatgactctgacaagcagatatagcgaagacaggactcttttggagtcttggtacatggcctgacgctgaacctgggtaaaacaggagtacgatgttgcaatgtacataccaaccatgcgctgagttggcgtgaaggatatattcattgttccactgttgtctttaaccaaacgtgctgttttcttccggttgtgatttttggtgacctgatcatctgacaa

SEQ ID NO: 23376 - DNA, 1694 bp, Zea mays
ccaatcacccctgcgctgcttcctgtgtcaggttcagtcgctcaccattctgccgttcacacctctctcgctgcctttatttcctgttggcgacgctctcgccaggtcttcggcggcccgttcggcggcgactagcgcctccgtttgccaggtcttcgtcgtccgtttcgccgtcgactggtgcccagcaggtacatctggaagaatgggggtttaccttagcacaccgaaaactgacaaggtatccgaagatggggaaaacgataaacttaaattcggactttcatctatgcaagggtggcgtgcaactatggaagacgctcactcggctttgctagatcttgacaatgacactgcattctttggtgtttttgatggacatggaggaaaagtagttgccaaattctgtgcaaaatatctacacagagaagttctccataccgaagcctatgctgctggtgacctgggtgctgctgtccacagagcttacttaagaatggatgaaatgatgcggggtcaaagaggatggcgggaactccaagcacttggagataagataaatcagttcactggcataatagaaggcttgatttggtcccctaaagcaagtgattcaaatgatagacatgatgattgggctttcgaggagggaccacactctgactttactgggccaaattgtgggagtacagcatgtgtagcattagtcagaaataggcaactcgttgtggcaaatgctggtgactcccgctgcgtcatctcaaggaatggccaggcatacaatttgtcaagagaccataaaccagagcttgaggcagagagagaaaggatacaaagtgccgggggttacattaaaatggggcgtgtaaatggaagtttaaatttgtcaagagctattggagacatggagcttaaacaaaacaagttcttgtcccctgataagcaaattttgaccgcaaaccctgacataaacattgtcgagctatgtgacgacgacgaattcattgttttggcatgtgatggcatttgggactgcatgtcaagccagcagttggttgatttcatccgtgaacatataaacacagaggaaagcctttctgcagtatgtgaaagagtgcttgatagatgcctggctccatcgacggctggcgagggatgcgataacatgacgatgatcctggtgcagttcaagaagccatttgctcaggtaaaggatgccagtggtgcggaacaactaactggagatgcgggatgctctgagacccatggggtcgaggagaatggctttgacaagcagatatagcgaagacatggactcttttggagtcttggtacatggcctgacgctgaacctgggtaaaacaggagtacgatgttgcaatgtacataccaaccatgcgctcagttggcgtgaaggatatattctttgttccattgttgtctttaaccaaacgtgctgttttcttccggttgtgatttttggtgatctgacaacaatatctaattatacatttgggtggaaatgatgttacactagttattgggggtgtttgtttgggattataatctgttcagattatataaattaaagtgtcagttcgaaataagttagattatataatctagtcagattataattccatccaaaaaaaaaaaaaaaaaaaaaaaaaaaaaccgagaaaaggggcggtacc

SEQ ID NO: 23377 - DNA, 1508 bp, Zea mays
gcacgagaccattacctagaacatcctaatcgaaaaccattacggacacagccattccaccaaccaaccaagccaaacggtttatagccccgctcggttcaagccggtaccgtacacctccagagtagcttaccccaaccaaatccatccaaattcaatcggaattcgcgtgcgcaagcccaaatcggaccacggtaatccaaaggccgcggcgtagcggacgcgcgggcgctggtgataaagcgggggctgggcctcgacgcctcggctctgctctgctctcctcgcatatagggtttatcttctcccctcctctgcccccatctcgcttctcgcacacggcagccggattccgaagcgcgccccctcggccccagccaaaagcatcgcagtttctaatcgtttggagagcacacaagaatgtcgttcgtgcagctctctggtgctggagtcgctgcagtggccttcacgaacaagagcctagtctctcggcacgcagcgctacgggtctgctcgtcgaggcgctcgatccgtagcctggtcgttaaggctgcaactgtcgtcaccccaaagtacacttcactgaagcctctgggagatagggtgcttgtgaagcttggtgccgcagaggagaagacagttggtggcattttgcttccatctactgcccagactaaaccacaaggaggtgaggttgttgctgttggagcaggaaggaccatcggggacaagaaaatagctgtggatatagagactggagcacaagtagtatactcaaagtatgctgggactgaggttgaattcaatgactcaaagcatcttattctcaaagaagacgatatcattggtattcttgagacagatgatgtgaaggacatgaagcctctcaatgaccgtgttctcatcaaggttgcagaagccgaagacaaaactcctgggggccttatcctcactgaaacaactaaagagaagccgtccataggaacggttgtagctgttggcccgggtcctctggacgaggaaggcaagagacagccactgtcagtgtcggcgggcagcacagtgctgtactccaagtatgcagggagtgagttcaagggcgcggatggcacggcctacattgtgttgagagcgtcggatgtgatggctgtcctgtcttgagcatttcgtttccggctcgttaatgtagtttgcagccaatagttgtcatgtggtatgaaacgatcgctttgtggtggtcatcacaccatgctggtgatcatcacaacatatgctgatactgttccggacaatcggctagaatttgttgtgtggcaggtataaacgtcagcatctgatagtgagagcactcggttacttctacagatggtatttaaggggtgatagtcacgcctctttgctggataaaaaaaaaaaaaaaaaagccccggggccgccccgtccgttgggatttgtttgctgccaaactttaaacattcgtataaccagaaaaggttacatgaaaaaaa

SEQ ID NO: 23378 - DNA, 1110 bp, Zea mays
  misc_feature (137)..(137): n is a, c, g, or t
ctcgaggccggccggctcgcatatagggtttatcttctcccctcctctgcccccatctcgcttctcgcacacggcagccggattccgaagcgcgccccctcggccccagccaaaagcatcgcagcttctaatcgtcngggcgcgcgcgcaagaatgtcgttcgtgcagctctctggtgctggagtcgctgcagtggccttcacgaacaagagcctagtctctcggcacgcagcgctacgggtctgctcgtcgaggcgctcgatccgtagcctggtcgttaaggctgcaactgtcgtcactccaaagtacacttcactgaagcctctgggagatagggtgcttgtgaagcttggtgccgcagaggagaagacagttggtggcattttgcttccatctactgcccagactaaaccacaaggaggtgaggttgttgctgttggagcaggaaggaccatcggggacaagaaaatagctgtggatatagaggttgcagaagccgaagacaaaactcctgggggccttatcctcactgaaacaactaaagagaagccgtccatcggaacggttgtagctgttggcccgggtcctctggacgaggaaggcaagagacagccactgtcagtgtcggcgggcagcacagtgctgtactccaagtatgcagggagtgagttcaagggcgcggatggcacggcctacattgtgttgagagcgtcggatgtgatggctgtcctgtcttgagcatttcgtttccggctcgttaatgtagtttgcagccaatagttgtcatgtggtatgaaacgatcgctttgtggtggtcatcacaccatgctggtgatcatcacaacatatgctgatactgttccggacaatcggctagaatttgttgtgtggcaggtataaacgtcagcatctgatagcgagagccctcagttacttctacagacgatatttaaggggtgatagtcattagtcacgcctctttgctggataaaaaaaaaaaaaaaaaaaaaaaaaaaaaaaaaaaaaaaaaaaaaaaaaaccttgcctcggattgacttcaatatataattgctccagtgaataactaaaaaaaaaaaaaaaaaagcggcc

SEQ ID NO: 23379 - DNA, 1996 bp, Zea mays
  misc_feature (1950)..(1950): n is a, c, g, or t
ggctctgctctcctcgcgtgtagggggtatcttctcccctcctctgcccccatctcgcttctcgcgcacgggagccggattccgaagcgcgcgccctcgggcccagcgcaaaagcatcgcgagcttctaatcgtgttggagagcgacacaagaatggcggtcgggcagctctctggtgctggaggcgctgcaggggccttcacgaacaagagcctagtctctcggcacgcgagcgcgtacgggtctgcgtcggcgaggcgctcgatccggagcctggtcggtaaggctgcaactggcggcactccaaaggacacttcactgaagcctctgggagatagggtgcttgtgaagcttggtgccgcagaggagaagacaggtggtggcattttgcttccatctactggccagactaaaccacaaggaggtgagggtgttgctgttggagcaggaaggaccatcggggacaagaaaatagctgtggatatagagactggagcacaaggaggatactcaaaggatgctgggactgagggtgaattcaatgactcaaagcatcttattctcaaagaagacgatatcattggtattcttgagacagatgatgtgaaggacatgaagcctctcaatgaccgtgttctcatcaaggtattcataaattctttctcctcgtaacaattttgtcatagacgtttatattttgggttgtagaacttgttgccttgtttttgttattatattctgcacttgtgcaacattgctaccctacagttacatttctcgtgggcatgccatgacaggttgcagaagccgaagacaaaactcctgggggccttatcctcactgaaacaactaaagagaagccgtccataggaacggtgagagttcttgccagcagcttgtctataagaattatgtatttctcttctttgcttgcgctagttgcagcttacatgtgtaggagatagcactagcagaagttaaaaagctctgtttcgtcgggtgcaggttgtagctgttggcccgggtcctctggacgaggaaggcaagagacagccactgtcagtgtcggcgggcagcacagtgctgtactccaagtatgcagggagtgagttcaagggcgcggatggcacggcctacattgtgttgagagcgtcggatgtgatggctgtcctgtcttgagcatttcgtttccggctcgttaatgtagtttgcagccaatagttgtcatgtggtatgaaacgatcgctttgtggtggtcatcacaccatgctggtgatcatcataacatatgctgatactgttccggataatcggctagaatttgttgtgtggcaggtataaacgtcagcctctggtagtgagagcactcggttacttctacagacgatatttaaggggtgatagccacgcctctttgctggataattactttggattctggactcctgttctgttacatccgttgggatttgtttgctgccaaactttaaacattcgtataaccagaaaaggttacatgaagaatataagtctctagttgattttttttacaggggcggacgtattaagggttttttttggggtaccggcttctgctctggtggttttttccactcggaacaaatcataatgttagggctagtttggaaactttatattttaaaaaatttctatttttctaaagaaaaaaacaaactattttttctaaaaaaataaaatctaaatgggatttcaaactaacttttagagtagaagctagtgccaaaaaaatccggtcaaaaaggctcttacatttctcgatcacaccatatttggttatacataaattaaataagattaaattcttttatatttaattttaattagcaaaagatttaaggcatgtttggttcactaactcagttgccacactttgcctaatttttctgcctaaggttagttattcaattnaaacgactaacgttagacaaagtgtggcacattatttagccacaaa

SEQ ID NO: 23380 - DNA, 1292 bp, Zea mays
ccaaatcggaccacggtaatccaaaggccgcggcgtagcggacgcgcgggcgctggtgataaagcgggggctgggcctcgacgcctctgctctgctctgctctcctcgcatataggcatcgcagcttctaatcgtttggagagcacacaagaatgtcgttcgtgcagctctctggtgctggagtcgctgcagtggccttcacgaacaagagcctagtctctcggcacgcagcgctacgggtctgctcgtcgaggcgctcgatccgtagcctggtcgttaaggctgcaactgtcgtcactccaaagtacacttcactgaagcctctgggagatagggtgcttgtgaagcttggtgccgcagaggagaagacagttggtggcattttgcttccatctactgcccagactaaaccacaaggaggtgaggttgttgctgttggagcaggaaggaccatcggggacaagaaaatagctgtggatatagagactggagcacaagtagtatactcaaagtatgctgggactgaggttgaattcaatgactcaaagcatcttattctcaaagaagacgatatcattggtattcttgagacagatgatgtgaaggacatgaagcctctcaatgaccgtgttctcatcaaggttgcagaagccgaagacaaaactcctgggggccttatcctcactgaaacaactaaagagaagccgtccatcggaacggttgtagctgttggcccgggtcctctggacgaggaaggcaagagacagccactgtcagtgccggcgggcagcacggtgctgtactccaagtatgcagggagtgagttcaagggcgcggatggcacggcctacattgtgttgagagcgtcggatgtgatggctgtcctgtcttgagcatttcgtttccggctcgttaatgtagtttgcagccaatagttgtcatgtggtatgaaacgatcgctttgtggtggtcatcacaccatgctggtgatcatcataacatatgctgatactgttccggataatcggctagaatttgttgtgtggcaggtataaacgtcagcctctggtagtgagagcactcggttacttctacagacgatatttaaggggtgatagccacgcctctttgctggataattactttggattctggactcctgttctgttacatccgttgggatttgtttgctgccaacctttaaacattcgtataaccagaaaaggttacatgaagaatataagagttgatttttttatttatataattaccgtccgacaaatcattattat

SEQ ID NO: 23381 - DNA, 1225 bp, Zea mays
cctgagctctatgaacaactttatctttctccacacgtaatcgtaatgatactcagattttccccacaactagattctctccacagccatattttcagaaaagctggtcagaaaaaagttgaaccaaacacatcgatgatatcacaaatactgtcactgattgcttctccttgccgtgtctagggaactcgtcatcgtgtatgtggccgtgacgttttacagtgagtgacgtttgatacgacgtacgtgtagcgaggaacttttacatgaccgacacgacacgtacagtcactcagcagacagtaaccgtgcagtctttcagactagtgcaagcccaaacaaatcgtcagctagccctgcaaatccttccaaatctatgtacagagcaggtcgtctcagtaatccgtgggaggctggcaagcgtcgtcgtccagggcggcgacggcgtcgaatcggtccttgtgcggctcctgctccactcgctggtgccccttcttgctcaccttgtgtgatctttcctggaagcggtggtccgacgccgacgccgacgccgccacctgcttccggcgcggcaagctccggccgcccttgagccggctcttgttgcccgtgggcctatggcaggcgaggccggaggaggcgtcgaagctgacgaccgagacgtcgttggaggcgcagctctccttctcctcgacggcgaggtcgctccgcctcctgacgaccaccacccgccgccccgtggcggagcccgtgtccgagttgcggctcgcgcagtcgtccgcgggctccgcctgccgcgtcgccatccaccgctccagccagctccaccccacgttgaactccccctgcccctccgcgcgcgccgacgaccgcttcttgctggtgccgccgccgcagctccgaagctgctgcgagaacgcgtaggcgagcgctcgctcgcgccgcgtggtggcctcgatcctgttctggatcctcatcctggacacgttggagctcaccgtgctgtcgtcccactcctccttgacccggaacgctggcggcgggcgcgacgacctctggctgcaggaccgctgctgctgcaccgacgcgctctcctcgcttagccggagccggaggttgcccagcgacgacgactcgtcgcctacctggaccagcaccgacgtcgcgacggacggcccccaggtggggctgctgggctcttggtccttggcgccgtccggttctg

SEQ ID NO: 23382 - DNA, 473 bp, Zea mays
gcaactcaaactacagtagtaccactacatactgtactagaacgaacgacgtgccccgccgcggacacagtgaaacgccaacaagtgaagaacatgcgatgtaagagaaagcacgtacactgtggccacggctgccggcggacgagcaagggctcttggagaagaccctccggacaatgccgccggcgagacccatctctctccgggtccggtgccgcgaaacctcgcgagctagaggctagagcagggatgcggggtgcatgcgtgtcagcgtaacaatcagtggcctggtatataatcagtgtggctcgagaccgctgatgcactcactccacagtacagtccagtcgtaccaccctgctggctgcgcccgtgcaccccgtcctgcaccgccctggctggcttccccttatagcaaagtagcaacaggccaaccgccccacgggacgggcgaaacggctaaaatccaaggc

SEQ ID NO: 23383 - DNA, 2019 bp, Zea mays
gggtggacaaactggtggattcataaatcataataccttgttaatagaagaacagaatgcatactccacgcctccaatgaaaacacggagaacatgaaaaaccagaacatctaccattgagattatggactggatggtaaattcaactatgacgatgaattgttctgacatagaataaatttgttcttcgcatcctcgttatcaagtaccagtattagaccattagtacaatgtgattgagatgcctgatacatgaacaaggaaaagagcataaccacacatttgcagaattgcggctacaaaaaaaaccttgacgtatatttagtgcttattgtgtaatctcattcaatatggtagtatagcataagcatttttttgcaacagaatcctggaataaattaatactaattggacagggaacttcaaatggataaaatggtatgcattatcaaatggaaaaagtgtaaaaacattataagcaattctctaaaatatggttccaggagagcaagtgtgcaacccacaaactgatttccagattataattttgacactatatgatgtgctgtttaagtccctccactcttcacacaggaaattgtaaattcagtacagtaaagataatcacaatcatagtatactagtgcagcaaagcaccttggcaagtcaggtgcaagagcataacctccacagttagaacagcgaaatcgcactagattagtggcatttcgacgacctaccagatcgtataacaattcgtatgtacgagattgcaaactaaatggggtactaaatcgcaactagtatacgtttcggtgccaatcaaacgggaaatttcatcggagtactactatgctctagctctacaagacaaaaaatatatatatacagaatcgaattatatagcacgctaatcataacactgcggcacttcgacatactggatcacattacaattatttgcgattcagcgcacaggtactcgtgattatctagcaaagcatcctcctagccttcagggagccggccatgctgtacacggacggcacacgctcgactggaaaaaagtgcggaaagagttcaggctatggagatcggttcctcttccttcccatcatttgctcctggcggcgcgggcgcgggcgcgagcggcgcgggctcctcctcgccgtagatgtggcggagccgggacgcggaaatgggggaggagggcgcggcggcgagggcgaagagctcctcccgccaggcccacatggcggcggacatagaggcgttggtggctcggagagagctcttctcggccaacaggctctggatctcgcgctgctgctccgacgacttccaccccagcgccaccgccgagcccagcagcagaccgctgatcaccttctcccggtgctccgtcagcttggccctgatcccgcgcagcgccgcctccatcgcgctccctcgtcgtctgcgcagattcgccgagctccgacggcaacccgtgcggttagtcgggcccagccgtgaacgtgtgaacggcccatcgggacgcagcgttcagtgggccttgtgttggcgggctcagttcaaaacgatttgcacgtttgcaattttccctttggatgcagcacacggtttgtatttctatcgctgcggaacgacgatctgtgtacccttattttactcttttaaaagggaacgcatcagctgcaaaccaaactttgtgtaaattgtgcaagcagttataaaaaaaattcaaaacaacctgtcaccgtgcattagctttcaaaacaatccttccacctccctagtatattttcaaatacatcctccacttccaacaacatattgatttgcacaatttgcaccaaattattggtttgcacctcaagctatgtttactcatttgatactcactaaactaatggactaatgataataataataataataataataataataataataataataataataataataataacaataataataataataataataataataatgacgacg

SEQ ID NO: 23384 - DNA, 1846 bp, Zea mays
tacagctcggtaccttttggacctctacagtcgacctgcagcaggggaactgggattgatctacatgtatcatggcaactcaaactttacatgtatcatggcagctcaaactagcactgaaatacatggaaacagatcttccacacacgcacaaaaaaaatgcaagcaagctagcaagaaaataaactggagaaaaaaaggtcagaaagcgatgtgaggagcccagggcggagagactagctagataagattgggcctcagtgcctcacctgggtaatatcggaggcgatgtgctcctgctgcggcgaagtggctcctccggattcatcagcccgcgccgccggcggtttcagcagcgaggggatccctctcctccctgcccctgcctccatgctctctccagcgtgtttgtttggtcttcagctactacctcgacccactaaattaaactcccagcactactctattcgttccctctgagttctgcaaggctattgtagtttatacaaacatgcaatcacctaccaataaactactagcactagtagtgtcatctagttcggtgggcttgcattgagcccctcctacccgctgcaagccctaaagcccctccctgaggcctgcatgcttcacttgcgttcaagaagcccatccgttttttgaacgcgttgcagttgaagcctcctctccttcggtatttcacaggctgagcgcgcatgttgtcatccttttgtgctctcaaccatgcaaaattaaaacagttagcgtttccctgttaattctcatgatatacgaagcgcctactttcactgctttagactgtgccaagcagactatgttctatgtaaaatattatcttacatttcagactacacggctttacagagcacagtttaaaataaaagataaaacaggatagcctgttggagactgtcttatgagttatttttatgctaaaagacgatgcaaaacatttgcagacaagcacagttatgcctgcagcttcgtcgtttcctgcacggcggctggcacgttcatctcaaatcgtgtacgttttgttgtctattcccttgtccatttggcactcgactttgcttgaagcacagcatctgaagtagacaaaaaaaaaatctagagcctgaagctcatcatcatcatagtagcagcaccgaaatataacattgactgtgactggactttatgtcagtccacggtaacggtacagctccactgttcctttcgttaggtgaggtccatgaaaattatttgcgattcagcgcacaggtactcgtgattatctagcaaagcatcctcctagccttcagggagccggccatgctgtacacggacggcacacgctcgactggaaaaaagtgcggaaagagttcaggctatggagatcggttcctcttccttcccatcatttgctcctggcggcgcgggcgcgggcgcgagcggcgcgggctcctcctcgccgtagatgtggcggagccgggacgcggaaatgggggaggagggcgcggcggcgagggcgaagagctcctcccgccaggcccacatggcggcggacatagaggcgttggtggctcggagagagctcttctcggccaacaggctctggatctcgcgctgctgctccgacgacttccaccccagcgccaccgccgagcccagcagcagaccgctgatcaccttctcccggtgctccgtcagcttggccctgatcccgcgcagcgccgcctccatcgcgctcactcgtcgtctgcgcagattcgccgagctccgacggcgacccggccgcgtattcgggcccagccgtgaacgtgtgaaccccgacccggccggc

SEQ ID NO: 23385 - DNA, 1628 bp, Zea mays
acttaatactccctcagagaagcaatgatgtctcaattaagtatcttaagcagtgatgtctcaaaaattgattttacaagatattaggatcactggcctctaatatacaaatcatagtagtctttgctgctacaagtacaactgttacaacctacaaacaggcaaaaagataataaataatttgaagaaagcattttatccttatccttactgtaaccgagaagaataggaagacagggcacctttccccactgtccattaaattttgagcttcatggtatgcagcatccagcttattgttcccatttggtgtacttgcccaaacgttgtatttgatacctttatgaatgtcatcttcactatatgactttatcataaaaaacttggcctgattatattgaactgaaaaatctgatctattatactgatttctacggatcaatggacttgtgatatctttcaccgtggaggatactgaagcattgttcaatttatttgccctcggcccacgaacttggtccattaaatcctcagaatttctccagcgattacctttcatattgatcctatgttggtcactacagtttctgttaatcatcctaggttttgcaaaggtatgtttgcttgtgataactttggcttgctcattggtattaatcctggaaaaacaattccttgagtgaccattgccatgagaagtaccttgctggtatcttgacggtatatgtgcctcagcatcatggcaccaattaccagaacgcaaacgggtcctatctcggtaaccatagtgaagagagagtgacgggatctcatcaccatagtcgggtctccttgaggacagtgcggtttgaggaccatagtgccactgacttgagcgtgaaggtgccacgttatacttcttcctagataaagaagggatctcatcgccatactgcaggccccgtcggactgaaggaccttcatcctcaaagcaccattgaaatggaacatgattgatctcatctgcatggtggaaccctctggcatattgaaccatctgtttcaacaagaacttgtcacgatgaaatatggatacacagaaaaaggttagctgttatacttgcggcagataaaaacacaggcataagttgacattttagtagtcagaatgatgaacagatatacctctttgcatttttctacagatcgaccattacggcttgaaaataaagtaaattggtctgatcttctgttggaatgttctgaatgacccaaaccgtgatcaagttcaactgctcctggacacttccgcatgcaaggagcagcagtaggataagacgaaagataatctggacttgcactgagggtgctggatttgattttggttctcattgtccctaatgcatctgggctacttgatgctgcttctaatgcagaagccttctcaaaagaacagtctgaagtagaaaattgtagcttctgcctatgataatctcttcccattggcaatggatccttcaaacatgcatgtgacccaagttcagtaacatatttggtgtcggcagactgtgctctataatcctgagaaggaaagatttgttcaaatagagagtgaacaagagtttaatatagatcccgaaaacttatcc

SEQ ID NO: 23386 - DNA, 2336 bp, Zea mays
  misc_feature (1155)..(1155): n is a, c, g, or t
ttttttttgctcctaaacaacaaaactgtggaattctataatatatcaaagtaaacatgtttcaggaaacatctggtgttaagattgcaccggggctgtatttaccagcacatccgtgcttctacgtaaacactatataacaattataagcagtttcaattgcaaccatataaacactttgaaggagcgtcagtgccttcaactagttcactgacccatcttgatctttatttcaattgtgcagatatctatatttgcattactccaaagtctcgaacaaactccaactctccatgtttgcctccaaattttccatagatttcgagtcatcagagaatcgagctccatatgtcgactctgaatttcctctcttttgggtgcggcgtgcattcgccttttcttcataaaaatcaaaatcatccagaattgatgttccctgaggctgttccttgaaaattttcaacatttgcacaccttgcggcaacccaatctcctgtgtgtccctgctaaaagcaacaatcctgttgtcattgttttcaagaattatatgtttgaacaaccgatttgaaatatcctttataatatgccattttatagggaaaaagccactccatttatcttcttcccaaaaatccatggtcttcttgaaatcaacaggacctaacatttcagccaaacctacgaactgtccactggtgttaaccgagaagaataggaagacagggcatctttccccactgtccattaaattttgagcttcatggtatgcagcatccagcttattgttcccatttggtgtacttgcccaaacgttgtatttgatacctttatgaatgtcatcttcactatatgactttatcataaaaaacttggcctgattatattgaactgaaaaatctgatctattatactgatttctacggatcaatggacttgtgatatctttcaccgtggaggatactgaagcattgttcaatttatttgccctcggcccacgaacttggtccattaaatcctcagaatttctccagcgattacctttcatattgatcctatgttggtcactacagtttctgttaatcatcctaggttttgcaaaggtatgtttgcttgtgataactttggcttgctcattggtattaatcctggaaaaancaattccttgagtggaccattgccatgagaagtaccttgctggtatcttgacgggtatacgtgcctcagcatcatgccaccaattaccagaacgcaaacgggtcctatctcggtaaccatagtgaagagagagtgacgggatctcatcaccatagtcgggtctccttgaggacagtgcggtttgaggaccatagtgccactgacttgagcgtgaaggtgccacgttatacttcttcctagataaagaagggatctcatcgccatactgcaggcctcttgatactgaaggaccttcatcctcaaagcaccattgagatggaacaggattgatctcatctgcatggtggaaccctctggcatattgaaccatctctttgcagttttctacagatcgaccattgcggcttgaaaagaaagtaaattggtctgatcttctgtaggattgttctgaatgacccaaaccgtgatcaagttcaactgctcctggacacttccgcatgcaaggagcagcagtaggataagacgaaagataatctggacttgcactgagggtgctggatttgattttggttctcattgtccctaatgcatctgggctacttgatgctgcttctaatgcagaagccttctcaaaagaacagtctgaagtagaaaattgtagcttctgcctatgataatctcttcccattggcaatggatccttcaaacatgcatgtgacccaagttcagtaacatatttggtgtcggcagactgtgctctataatccaaatgtgacaaatccctctttgcctgagacagcaaatggccatcttcttcaaatttcatactgccccataactgatatgaagagcatggatcttgctcgaaaatcacatccttcccaatggaagtaatattttttgtttctgctttccttactgtttctggtggatcagaaacctcctgcatctgggctaggcggactggcgtgcagcgagcagagcaaccaagcgacggctcgacgtgaagggtgcagggcaacctaatggcagctcggcgggggcagaagtggggaggcggcggcgcacagtgagcggtaggcgacggcgcagcacgagtgcaagtggagaggtggtcgacggcgcacagggagcagcggctgagccgctacggcttctcggccggcctcgaggtacccaat

SEQ ID NO: 23387 - DNA, 1727 bp, Zea mays
  misc_feature (44)..(64): n is a, c, g, or t
  misc_feature (78)..(78): n is a, c, g, or t
caacggatactcatgcaatcattagctgaaaactgaaaacatannnnnnnnnnnnnnnnnnnnngagggcccggggtntttcttagccgttcctttcacttttttttttttttttttactcatgcaatcattagcttattcagcagctgattcagggcataaaccagagtttcacttgcgagttgcgaaggatgtttcaggagagcatgaaacttgacaaccgctacggtactcaaaagtacccgatgaggcactgactcatctttcagctcaaactacatagtttgctacagaacaaacaacatgtactaaacatcgtactacatagattgctacagaacaatcgcacaaacactatcacttcagattgctccaatatctggaatcactgactcatctttcagctcaaacttaacaggactgttgtccaaaaatgggtagtcgtcaagctcatcatcagtaggagaatcttcaaccagctgtgttttgtcaccttgcacatccttatccagcttctgacgatcatttcctgtgaagtgagtgccctccgacacatcattagccgattcatgacactttttggtctcttcaacagtgaatattttcactgggttcttcacagcttcatggctgcacagagaagggctccctttgacagtgttagacaaatcctgaacctgaagagccttcggttcttgaagcttaggcttcagccgtttggcgcttggtgcatcatccctcttgcctgaggtagacatacacctagtgatgtctggaagaatctctggttccagctccagctctttcgattcttcagaaaacttgggaaccatagccataaacatcacatgaccatatacctcatgtgaccagccatacaatgctgacgtaactttcgccactttcttcttgatacgtttgtgttgcacatctttatccaacttctgagaatcatttccagtgaagtgagtgccctccatcccatccttagcccattcatggcaccctttggtctcttcgtcatcagcaaaaatattcactgggttcttaatagcttcatggctacacagggcagatttctctttcaggatggacctctcattgcgggtgttagacacatcctgaagaggaggcctctctttcaggatggacctctctttgaggttgttagacacattgtggagtgcaggcctttctttcaaggcggacccctctttgactgtggatctgttctttaaagcagtgcctttaggaatgttagacacatcctgaagagcctttctctcaggtttggctgatgatttcagtggtttggcacttggtgcatcaaccctgtttcctttatgaatctgcatgttctcattaagcaaaacagctgctgcagttgggaaagccatgaccggacagaaaagtttctttttctaccttgatgaaaacctgactttttagatctgatactcccagatccaattgatttaggatgtcttctccccaaccccttcttctctgtaaccacggcagaagcagttgtagtcgccggcggcgtgtggagcgtaggaggtgattgacgagccaagcggagagcaaaagatggcgagcagagaaggggaaccgggggagcgagtcagcgagtgtagtcagttgacgctggggctgggagttggggggaaggcaacggtcggctcggtgaatgtttgtcttcatgtcgtcccgccgccatctctttt

SEQ ID NO: 23388 - DNA, 2541 bp, Zea mays
ccttggtgccaatgtaaaacctttagtaaactagtaaaatgacagtgtgttgtggttgcacacaagaacaaatattacattttatcttactcaaaatacctaaaaggtatcagttgaaaaggagtctgacatcttgttttataactcagatcgtccgtcgttcttcagctagtggagtgggactatatggaagcgctacgagtgagcgacttcctgttgtgttgagcttgagtggctccttacggcctatttgtagggtaatgaaccactaatagggtttgagtggttttcacggcgtatttatagggtaacggcccactaatatgactttgtgtggtttttacggcgtctggctgagaaggagaataaacctacctgctttatgtttcgtacatgacgcatgataacatttgaaattgatgttttattgtagtagagaaatgtatttatactggtgacgggtaaccatgtcccacagttttatttctactaacgtccacatattatgatctgtcagtaaaaaaagaatagctaccatccgaaaaatctactgtactattgttttattttatattaataatcaagggtaaggcattgaaatttcgtttaataaatgagtacgacattgagatgacatttgaaatgattgagacaaatagccagtctgattaggtaaccactcaacataaactcttgtgttttactcagcttccactgaaaagaattagttgtgatttaacaagcttccactcaaaaagatcaaagtgtgttccctagtcgatgcgtcacaaaatcacagtttcagccgtgacgtatctaggcctgcgcggccagactatatcttgtgtttttttctaaaactctttttcctatcttaaataacttcgcagagcacaccgactattctacatcttcaatgagaatactttgccattgatttcacgtcaacaagatttgaccatttaaaagggaaaacgattttgcttaagaaagaatgaaaacaaaaatggaagacagaaaagatgtactgctttatatatggtgaaaataattaaataagttctccctccacacatatatatttgatctcaactttctattgaaagcataaaggcacaatcatctcgtatgaatcatttcaatctattatgaagtatatcttcatgacaaaaagtttctgcttttgtttcttttaggaaagtatatattcatggcacaatcattaccgttaacaacaacatatttttcataccaatcttctttcagcggtacaaattatggcaatctcagaccacagagctggatcagtcacccttgcctgaaacaacatatgcaagcaaagaaaacaaaaaagattgccactcgaaccagcacacggccggccatcctgtacacagcaagtgagcaactacgcctaaattctaaaactctaccaaaatggatactagctccaaaccaaaaaaaaaacatatagaatggaggggaagtcatgtcccatggagaccaatatctaatcgctccagcgaagcagcatgacgacgcagcggcggaaaatgtagaaccttgcccttttctccctgaaggccctgttgagcctccccatctgcctcccttgtcctccaagcttcatggtctgacgaagaagaggtttttggtgtgcaatgcaagtgagagaaggaagaaggggttgcagaactgggcaacctgctgtagtgcagtggtatgttgagagggaatgcagcaggcaatggctttatatagagggcacacagcaaagaggatatgccatatcaaaaggacatcatacccccacatgcagggactttgttaatacactaggaggcatactgctgaccctacgcttatcctactcgttcggctgtgcaggcaaagagctttaggagctagcaaaagcttaaactatgcatggccatgaccgcaccacagaactgctacggtaaaaacagacaagataaagtggccgcccatccacccgtgcaactatggtggaggccggttgtttagtcactccaagaaaaggaccccaaaaactattcccagcatgcagcagtgcttagtgggaagcttccaggaaggtcaccttgatgcatagagtaagagcgattaacctcatccatgacagacttgtctgatttcaccttctatgtattggcatgaagttactgctaatggattactctccatgtgatgaacactcaaaccttttgggtacaacttcagactaagagacatggttaggtgttataagtaccacaggtgagtacgagtctcttcaagtgagtacgaatcacagtggaaacgaattttagactaagattaaaaaaagtcacttgctggtactcttagttgtgtgtacatgagatagactgatctattgtgaggacagactaggagggctcaaatcacgaataaagatctactactccggtgtactattagttgttgtttagtacagcgagactgttgggggccttcggcttccgaaggtcctctaaaacataatttgacaactttccaagg

SEQ ID NO: 23389 - DNA, 2277 bp, Zea mays
cgattgttaatttgggtcaggccgacttgatcccaatccatgccggatctagccgaactcaagccagatcggcccaacccgtgtatagaagaaacagagaagaatagagccttaatagacactttaaaagtttataggccgaattgacacacctaccagaaccagaaatgtactttactctaagctgattaacacagaaggcattttccttaaaaaaactcaaaagctagtttggaaatttaaatccccaggattcccagcgagaaaaatgagcaaatttccttttttttttttttttgcccattagaagatatagctcatgctaaaagccggcgtgaactgattcttgtgctacggaatcaagtttctgtgactgcgcagaacagaaacaaccaaaactacagaccccgtgtcgctaagacaagatttttacgatgatgaaactacccgatggatgaattacaatgaaatgactgcgatatggtggcagtctatcatatagaaatctaaaacgggtattcatgggtccatctccacgggttctgtggctgtaaaaattggtgccttgcccataatcactgcagtcatcatcaatttaccagcatctggaaaatcctcgtgctggatcaacacttcttcaactgacaaacatttactctccaaacctctcagatgtacatcctctttcttcacaggcagaacatcctcaaaggtgccgtcatacaccacagcatccgggctgtaacacaacctggaagctttgaagaggacagttgcttgaagagattcttcgatgacctcgtcactccaaccttctgacatggatgcctctgaaagctttacccaatcatcttggtcagttgcattcatccagcatgcctctagaaggcctctgttggaacttcggaacgatgagcttgtcaaagcaaatacttcaaaggctttaagggagagctctcggtctctcctcaagcacatctcaatcagttctgatggaccaagcaatgtgtttgtagatttgacttgtgcatattctggatcatgctgaacaatttcttcctgcagttttagaatccggatgtccgcttctatccgtgcaaccttcacttcataatcaatgtccttacctgctgttgcagcaattttagagagataaagaagacgtcttctttcagcaaaggatagtggctttctgctggttgtgaagctggcatctccatcaggactacgacgcagagcataggtatgaagggtgtcggaagcagatgagaactggtttaagcatatctcatgaacccacagcagatcactccgctctttcagaaagcttgcaagctcttcctggaattcttcacctagccttaacagattagagtagtctcctctgttgactaactccttaaagacaaagaaactgaatcccccatgaggccctacgctatcatgcattaggctgcggaggagacctgaatcatctaaatcatagcaaatctgccacagtgtttggtacccttcatgtcgtttggctgttgctaaaataggagaaataacctctctaagtatagattccttcagatctggcttgtccgtaccatttcttgactcctggtatttggcctccactatttgtttagcaaggttgtagagggatctgagaagttcatctcttcgttcacaatattcttgcactagcacaccatgttcctgcccacgttcaaattgggcagttaaaaggcacatatatgcctacagtagaatatctgtaagtccttccagctgagaccatagactggatttcattgacatgtctgcagctcctgattctcccaaaagctccataatcaaggatgccaaattccagattccagaccgtagaacaggttggctgttccatgttatcagtccttcaggagatggataccattcattgtgatccttcttgtagtgtgatgctgcctgaactatggtgatacaagcatttgctaactcaagtgcacgttgcatctgaacagaagggtgttcttctctactaatgatgtattgaagttcatgagataaacaataaaatagatcctctatatcagaaaccctactgtagaacacttcagcattatcacgatccattaaaagaaccatgtttcttcgagctttctcaccaaccaactttttcgattaggatgttctaggtaatggtctcgtgctcgactgaggtgaaaaatgggtgcttgagccatgctgaataagtgtgttttgtaactccctaaggtgtgccattcc

SEQ ID NO: 23390 - DNA, 5463 bp, Zea mays
  misc_feature (1431)..(1431): n is a, c, g, or t
  misc_feature (1682)..(1682): n is a, c, g, or t
gtcggcttacgccatcaaatcgatatagtgagtgcccgcctattttagttggtaccgactgtctaattttaagaaacttaaaactaaaagtaataaaaatgcaagaattttaaaaaaaacattataaattatttaactttatttgtatatatcgtgtaacttttattttgataaaacgacatgttttattttaaataaaagttagtaagaaatgttgatgtgagactgcgattggctataggataatgataaaagttgtacactaaagtattatggtagatacaaactaataatgatagatacatacgcgacgatagcaatgtggcgatagatgtcgtttcaagaaaaatatgtgtgctgtgctttaaataatcgagaattatgattgagctttagtgttttactgactcggaaaatgacattttatatcaaagctattctaacatgcttgcataattgctttgtataccactagtatcaattaatcgcccaagctgtacctcgaaattacagcaccgaagtaaacattagctacggatacatcagttcagaaaaagagtcaccacttcttcaatatttctgtaatcaattgagcccacatcttgtagtcggaaatttacatcacaacgtttcgtgcatgaaacacctcagatttccagtatagttcttatctgctcaggagagtgcttaaccaacgaccttgggtcaggataattgttataagattctgctagagctcttgccaaaccatagcaggcatttgaacgtaaccttggaaccctgcagttgctcaaattcaggcaaaggaaccttctgttccagtcacaatgccaaagagtgacttcaagcatttataaaagcatttgtggcgacgtttcgattatatctgccagagaccttgcatcaaccttgctaccgtactcctttatgtatggcatcttatttgacagtccacatttcctaagaatgttgtcaacttctttatcgacaagggcacgaatatgtacttcgatcatagagcgcaggttgtttacatagcttgtagcaacctcctggcccatcaatggctcctgaatagctgacaagcagttgatgaggtagactttggatgaagattcagcacaaccgattcccgttttctacagagctcaaccactcaacacctacgtcgttcactaccgtcagaaactgtctttattcttttagatttaagcccggtttttaatacactattagctgttaaaaatagcttaaaacatataaactgtctagcaaatagtttaactattaactacttttagcaaattagcatgttagtcgactaattttactagtaatttttcaaccgatatactattattagctctattgcattcaaacagatccttatattatctttgctatctaaatcactgtggccaacatttttgntaggccaacaatttagagaaacatagaaaatatttctcaagaacttttcatgctgacatacgtaagttgatgagtaaagtgcattttcagtccccttgtgcatgtgtgacaatctagtccataagctttaaagtgtcactagggcaggacagcgccctatcgggcgctacaatctccagtgcagtttcacacaaacaaattcatgcgcgtggtttgaggcaatggtggcccaggctgttctttccacggtnattattcatatagctgatcctgtgctttctctggttcacgttctttgatgttttgttgcaacatggattaagaatgttgtattttaggagtagtctgccatattttttagatgatagtcgagtgtcagacaataaaactggtggaagaggaagcagaagacttatcaagattgggcatgaaaaataatctgtttcagaaaacataaatattgaggatccttttaagaggataatgttttcaaggcacatagggacgattcacgaaaacatgcagctattgatggcaccataagtttgatggacaagaaaataatatgcagtcttttacgcttttatggaagctttttttttttttttgaccaagtgtctcattattaaacagttctctgtaaatagcagtagtgtaatagcttacaattccatccagggtaacaagcatatataaacaaaagaacaaaaggaatatatcaaattggaaagaaaaaaattgtcagtaagttttaacctttgaggcactgaataagcagcgaccgagacatgccataattgagtggaatgtcatataacacagcaattagtagtagccatttgtagaaatgtgatagaaaacacaaacctcatttctaaaagtttgcccaatttgagcagtcgccaagggtcgcacgcgcgctggctgaagctccgtggagtgcggggaggcgcccaaactcggtcaggttttaataactcagattaagaaggataaacccaggtacttgtgggttgccaggaaggtaaatccttttctgcagttcatacgatggacctgggatgcgttgtagacgttgtagtgattgtgcaggagttcagagctcgtaactgatgatggcactggcttgccatagggaacgataacatccctccacttcacacactctgaccgtctgatgacagtggcacagtttgcctaagcctttggtcgaatcgaatgcttccctcttcgagatttgtccatgtactacagcaacaagcatcaatggcaaactgccacgagatcataaacatggacaattccctcaagtagcagacataaaaaataaactggaagcaagaaatcgatgttgttttcccaaccgttttgtccattttatttatttatttatttcttatttatctttcatccagatgagaggaggaagaataggattacctcgagaagaaaccagcatgtcaaggattgtagttgggagggaggagggagacgcttgaattggttggtctggtatggttacctgggtgagcagcaggagctcctccactccgaaggagcgtgcggcggcgagcgtgtcgagcgcgaggtcgacgacggcgtagtgtgcgtgcctgcatgcgcgctcaccgccgcccgggtgccgctgtataggaaccagatcagtagcaggaagacctcgtagctgacggagttgacaggaatgactgtgtccagtgctgtgtggggagaagaagaacccggactggtagcgcgggctgaggcagtccaacagcagcgcgccgggcccgacgtcggcctggtcggcgacgacgaagctggcgaatcgggtttaaggatcagagagagagggaggagtggagaccggagaggcgctcgagagaaccagcacggatagagcagctcgtgatgggacgagaagaggactgtgctgtgcccacatcaattgttggatgctgcgacgtgcggtgtagtacggcgacactatcccagtaaccgacgtgacccagctaggtggaacgaaggctagcccgcctggattccaggcgctggcgtgaagcgggatgtggtggagtcgcggggcatcggttggcgcgtctgaatgtctaccgccacacgtcagcaagcgataggtgtcgaacccgtgaaacgcgacctgcgctccaaactgggtcaagttttaagaacttagattaaagtcttattctcagtttgggttccacttaagtcacaacggtcaaaatgaacccgatatatcatatctcatcattcctatgtttctgtttctatgtgacgtgggctctatatgggaaaaaatctatacatctgggatgcaaacgccctcttttacaggccttcacatttacaacttaaagaattgatcaaaatttataacttaatcattcaataatttatttatttttctatttatatggaccatcagataattgatgtgagggactaaaaaaatgttatttgcatcctggatgcaaagattcccccatatagacacattagactcgtcaacatatagacaaattagacacgtcaatcggccgtcacggttgataccttagcataccgtgcctaagccttgcttgggacccatgagcagacacagcatgactcgcttgctaatttagattaggccggcatgattccaatctgtgccggacctagctgaactcagcggaacggctcgattgttaatttgggtcaggccgacatgatcccaatccgtgtcggacctagctggactcagaccagatcggttgggccgtgtatagaagaaatagagaagaatagaaccttaatagacacactttaaaaatttataggcagaattgacacctctaccagaaccagaaatgtactttactctaagctgattaacacagaaggcattttccttaaaaaaactcaaaagctagtttggaaatttaaatccccaggattccctgcgagaaaaatgagcaaatttcctgctaatttccaaactaaccattagaagatatagctcatgctaaaacccggcgtgaactgattcttgtgctacggaatcaagtttctgtgactgcgcagaacagaaacaaccaaaactacagagtacagaccccttgtcgctaagacaagatttttacgatgatgaaactacccgatggatgaattacaatgaaatgactgcgatatgggggcagtctatcatatagaaatctaaaacgggtattcatgagtccatctccacgggttctgtggctgtaaaaattggttccttgcccctaatcactgcagtcatcatcaatttaccagcatctggaaaatcctcgtgctgcatcaacacttcttcaactgacaaacatttactctccaaacctctcagatgtacatcctctttcttcacaggcagaacatcctcaaaggtgccgtcatacaccacagcatccgggctgtaacacaacctggaagctttgaagaggacagttgcttgaagagattcttcgatgacctcgtcactccaaccttctgacatggatgcctctgaaagctttacccaatcatcttggtcagttgcattcatccagcatgcctctagaaggcctctgttggaacttcggaacgatgagcttgtcaaagcaaatacttcaaaggctttaagggagagctctcggtctctcctcaagcacatctcaatcagttctgatggaccaagcaatgtgtttgtagatttgacttgtgcatattctggatcatgctgaacaatttcttcctgtacagaaaagaaagagctactattaatctggtatgctgaccatccctactccactgagggaaaaatgatatcatgatttcaaaagcgttttgaggaatagcacacaccacgttaggacctcataaaataagaaccccggactgatacaagacggttacatgctaattcccagtctaatcgcattcactttgcatactcccttcaattttctttcaaacatccaacaaaatccaatcaatctaactgcctcctgagttcaaaac

SEQ ID NO: 23391 - DNA, 857 bp, Zea mays
tttttttttttttttttttggagactaaggacatttatcaattatcagagacttccgaatacaaagtttttattctagtcttcctataaaaaaattacagagcattttgaaagaagaatttactatgtcacttctatcgtcgttttttacatgtcaagaaatatacagaattgagagagagagagagagagagagagaaggaaggatctacaaactgacacggctacagcctacaaggtacagacagaataaattatgaatgctaagttaacaggttgcaaattctacgattcaaattcttctatcttggagatttggtcgaaatgcatcttccacacaatatgagccttgatatggtgcgtgatcttcgattcctgaccttaattgaagagagcttccgacgagtccttgaggttctccaacaaagtagactcgatttaggctccatcctcaaattctcttgctctagcttttcagcaatcgatatagcttttcgtctagaccagcctcctcgctgagaacaagcttcagccctcccaataacatgagcaagagatacctttcctcttactatgctgttctgtcgattctgtctgttcccatttcttccttttggattagtcacgctctcttggtttggtgatgacgaagtttcttcctcccatgtgttctcctttcttctttcatttacgtcaagaacatcattatttgtttgagcatgccaatgcatgcgagaaggtccaacttcaattatttcaccttctccagaagagagtggactatgtttagtaaaggacctcctcagtgtcgagtcattctcagggtaaggaaacattgatggagcatgacctgttttg

SEQ ID NO: 23392 - DNA, 2765 bp, Zea mays
  misc_feature (1)..(97): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttttttttttttagttttgattttttggattttctgatgacgggcaaagggacataacacagaaggtacaaaatgctgacccgctggcagtatcagtctcacatctcgagctaaaacaactcattgcaagttagacatggtgatcatgtatatacatacactaaatcataaagcattggcactgcggaactctcctccatgccccggggagggggggttggggggttataattacacatgctatctagccctagattacccatctagaaatctgagcaccacaaaactggagctgcagcaaggcgtggtggacatggaccaatgagcctaccctcgcaatggtacaccgcccttttgccggactacgattacaaggtacaacgcatcatgccctgacaagttgaccgaggcattgagagagttccctcgcaatcatatcctaaataggtaccgcaggtcttccacggtgagccgggtcgcatggccgccggctttgtcatcaccgaaagcagagttcaccatggttctcttttcctcctgcagagctaaaatacgatcttccacagtgtctttaaccgtcaagcgagatacagtaacaggcctagtctgcccaatcctgtgtgccctatcaactgcctggtcctcagcataagggttccaccagagatcaaggagaattacatggcaagcagaaaccatgttgagaccaagattaccagctttcagtgacataatcataactctaacctctgggtcagtgttaaaatccttcacatttttttctcttaaattgagagacattgttccatctagtctcctgtactgtatacagttgatattcagtgaaagctccagcaaatccagcatgccagtccattgggaaaagacaatggctttcacagggcctagtccacttctgcttgattccattgtataactttcagtaagaggatccatgacaatgattgaattcagtatatcaatggctgcttgtatcttggatgagacaaagctgctttgactgattgaagatgactcgttatctgatgatgaactagctactgcagaactcgatttgccagagatgcaaatctttaaagctcctgacgaaaataacaattcaagacctaatgttctactgcaattaggggcagggcacatattctcatcagtcgttattcgttcatgtatacattgatagcagaaaacatgaccacaaattgtcacaatagcatcctcaggtgtatcattgcataagccacaaagtgttgaccccacttccagttttgcaagcaaatctatcaccacttccttaggaagtttctttgccatttctatagaaccatcacctccatattctgactgattgccctttacaagaataggatgatcacaggcttgccgaagtcgcagcaacattaaaaggatgttggcatagttttgtttgagtgtcccagccgcagcaaatgccttgaattgttgccgagagcgttcttccagcatcaaataaaacgaccgctcctcttgtgtgaaatctactttattcagattaattgtcttaggaggtaaatttattattggtttgccattgatcacagtttctttcgtacgacgcaggagaactaccttcagcacagcctgaagtttcttgtatccattaattgcatctctagcaattgggtgcttaatcattgtgcaaaacgagttatacgtgcaatacggatcatatttcaaaaaacggaaatagctaaacagatcatcaattgcattttgtataggtgttcctgataagcaccatctccgctttgctcttagcccacaacaggctctggccactacagttcggaagttttttattgtctgagcttcatcaagcacaaccctaaaccatcgcactcttgcaattggaccactgtcaaggtcaaagtttgagtccttaagtttcttcttctttttcttagccttggtttgcatattcgccgatggctttcttttattgctagcagagggttcttcactgttcttttgatctgcgtcatcatcagccatctgtttaggtacttcattggccacaattgtatatgtagtgacaactacatcgtattttgccagctcacgtggatctttggtccttgcaccaccatggtagactaaaacagataatttagcactttcgctaaccttggcagttaattcgttagaccactgcttaagaacactagcagggcacactactagagtacctgcagctggccttgtcatggaacgtgaggtggatgcagatgatgtggaaactttagcttttttcttgcgttctgctttggtttcaaccattttattcacaacattattcggttgattaacaaaaagttcagcactagtaccagcagatgttgacaatgaacaagcgccttggtcctttttaggttcattgctaacagtttgttctccctcatcatcttcatcaaggtttagggcttcagatttcaaacgatctgaatcaacaaacataaatttcgactgttccatcctctgtttttgtataagggcaatagtagacactgtcttcccaaggccctgatcatcggcaagaattccgccagcacaatgtgagctattctcctttgaaaccatccaagccaatgccattttcttgcaatcaa

SEQ ID NO: 23393 - DNA, 1539 bp, Zea mays
  misc_feature (25)..(25): n is a, c, g, or t
ggggtaccctcggagctggccgggnacaggcatagcatagccccaccggccccctcccgatcgaggcccgaccaatctaatagcgccgcaacgcgaagcgcgaagccgcgaagcctcacctacagttccttcgcgcaccggcaccgcggcggcagttcagcatggtggcagcatccgtagccgagcgggcctatgaggcggcgacgcggtccgcgctggtggcgctggagcgcaacctcatcccggacgcggtgacccggcgcctgacgcggctcctgctcgcgcagcgcctccgccagggctacctcccctccgcgccgctccagctgcagcagctcctccagttcgtccactctcttgaagagatgcccattgccattgaaacagacaaagctaaagcccaacactatgagttgccaactacatttttcaagctagtgctgggaaagaatctcaaatacagttcctgctatttccctggtgattcaagcaccctagaagatgctgaggttgcgatgatggatctgtattgtgagaggtcgaaactacaagatggccaaagtatcctagatgttggatgtggatggggatccctttcactgtacattgcaaagaaatataggaactgcagtgtaacagggatatgcaactctactacacagaaggcttttatagaagagcaatgtagggataacgagctgtcaaatattgagataattgtagccgacatcagcaagtttgagatggagcgctcttttgacaggatcgtatctatagagatgtttgagcacatgaaaaactacaagtcacttcttaagaagatatccaggtggatgaaagaggatggcctactattcgttcacctcttctgccacaaagcatttccatatcactttgaggataaaaacgatgatgactggatcacgaggtatttcttcactggaggaacaatgccatctgcaaacctacttctatactttcaggaggatgtatctgtggtagatcattggcttgtcagtggcacgcattatgctagaactagcgaggagtggctaaaacgtatggacaagagcatcacttcagtaaggctgatcttcgaggaaacttatgggaaggaatcgactaccaaatggatagcttattggcggacgttcttcatctcggtagctgaactttttggatacaacaatggagatgaatggatggttgcccattacttgttccgaaagaagtagaggctactgcttggaagtacccaatcaaaaatcaatgttttcagtaattttgtcatgtacactgacgaacaactccttttctggcacgtagttgtatctcgtaccgacttcgtagtggtttcaaaaacaaaatctggaatccctgttgtgaaatttcatcttggacagcgcctgcatatgctttgcagagttacgctaattcttgcaactatgccttcagatgtttgtagagttaggctcattcttgaaagaaaacaaaggattgtttttttagataataatggaatcaaaaaaaaaaaaaaaa

SEQ ID NO: 23394 - DNA, 1684 bp, Zea mays
catatggaaaggcaataacaaccaacagttcaacaccaactacaactttacaacagggaacccactaccagtgcctgccattgcttgtaacatacaacagcatccaacaacggctcaaatcggcgattcagattcaaaacactagatgcacggtaacacctgcccatcggtgattcaaaccgatagatagatacatggtaacacctggcccctaagggccaacgctaataacaaggttaaacgcctcatgaactgcggtaaaatatatatatgtatatgctataaacgccccttaaaaacctacaacatgatcacagctacacacctcactccgtgtgcatctccgcaggcaaggggatcgacgagcagcaatagtagtacccacttctgtcaaacttgaacctctgagaaaggtggatctcatggatgggatatgcaccccactccgccttcccaaatctcccgaatatgccccgggcatcaaacgaatccgtccatgtgttccgtttatttctgctcttcctgtgccgcacgttcattacggtcgcgtgcaacttcagttctctcacgtccctttcaaaaactaggcctgccttgataaacgcgtcagttatgactttgcaagcatgagctaggcgcccttcgctaccaacttccagcactggaacatataccacccgagccttagctggaaagcctttcatgcatgtcagacccctaagctgtatggaaataggtcgattttccaaagcttcatttacttgggtagatactgactggagcacatccgaggccttatctatacgttccttgttccacaacttcaacataagaaccgtcaggtgaaacgtttcgggtttgataaatattgacttgtcaatgccaaaatctgattgggagcctttggcacccatttttgcttccgcttgcttgtggtcatagtccatttcaccaatagaaccttcactttggctcccatctttgttactgttttcttccccaaggatcgaactctggaagtagttcagtttgttgacaagatctgggtgtaaagccaatggaagtgatatgaaatgagagtagtcaagctgtcgactttgaaccgcctcaacagaggaggaatgtgtcccgaagacattggacccagctagatccttattgaagccagataactccgcatggtcttctataactactttagttgaactgtacccaaaacttaaattattttttgacgatgaagcatcattggcggtaacttcaacaacattggttgttccatctggtggcaaattctcactagaagctatgcaatcctctataattttcttgcttccagaatttgatgtctcaataatgtcatcttggtgatgctggggaactgcttctgttgaaactggcctccatctctgcacaggagactgccttttattgtgttttgtcacaatgcttgatccttgcgccccttccatcacgaatgaggccaacttatttcgacaatatgatcccttgcgaggagagacctgcaggcgaacatgggcggcctcgaacctggaaagatttttggtgagcttggtaaccgccggcccggcggacacgcggctcggcgactgcagactgctcaatgctcgctagctgaagcgggttaccgatagactaaaaaaaagtttgtgagacctcgagg

SEQ ID NO: 23395 - DNA, 1651 bp, Zea mays
gaatgggtcattatggaaggcattttttttttttttttcaacaccaactacaactttacaacagggaacccactaccagtgcctgccattgcttgtaacatacaacagcatccaacaacggctcaaatcggcgattcagattcaaaacactagatgcacggtaacacctgcccatcggtgattcaaatcgatagatagatacatggtaacacctggcccctaaggacctaccactaataacaaggtcactccgtgtgcatctccgcaggcaaggggatcgacgagcagcaatagtagtacccacttctgtcaaacttgaacctctgagaaaggtggatctcatggatggggtatgcaccccactccgccttcccaaatctcccgaatatgccccgggcatcaaacgaattcgtccatgtgttccgtttatttctgctcttcctgtgccgcacgttcattacggtcgcgtgcaacttcagttctctcacgtccctttcaaaaactaggcctgccttgataaaggcgtcagttatgactttgcaagcacgagctaggcgcccttcgctaccaacttccagcactggaacatataccacccgagccttagctggaaagcctttcatgcatgtcagacccctaagctgtatggaaataggtcgattttccaaagcttcatttacttgtgtagatactgactggagcacatccgaggccttatctatacgctccttgttccacaacttcaacataagaaccgtcaggtgaaacgtttcgggtttgataaatattgacttgtcaatgccaaaatctgattgggagcctttggcacccatttttgcttctgcttgcttgtggtcatagtccatttcatcaatagaaccttcactttggctcccatctttgtcactgttttcttcaccaaggatcgaactctggaagtagttcagtttgttgacaagatctgggtgtaaagccaatggaagtgatatgaaatgagagtagtcaagctgtcgactttgaaccgcctcaacagaggaggaatatgtcctgaagacattggacccagctagatccttattgaagccagataactccgcattgtcttctataattactttagttgaattgtatccaaaacttaaattattttttgacgatgaagcatcattggtggtaacttcaacaatattggttgttccatctggtggcaaattctcactagaagctatgcaatcctctataattttcttgcttccagaatttgatgtctcaataatgtcatcttgctgatgctggggaactgcttctgttgaaactggcctccatcgctccacaggagactgccttttattgtgttttgtcacattgcttgatccttgcgccccttccatcacgaatgaggccaacttatttcgacaatatgatccctggtagaggtaacgaagcggcgaaccggcggcgcttggaatcgcaggccgagtgagccgactagcccttgcgaggagagacctgcaggcgaacatgggcggcctcgaacctggaaagatttttggtgagcttggtaaccgccggcccggcggacacgcggctcggcgactgcagactgctcaatgctcgcctgcggtggccggggtacgggtctcgtgctttt

SEQ ID NO: 23396 - DNA, 821 bp, Zea mays
tcagtttgttgacaagatctgggtgtaaagccaatggaagtgatatgaaatgagagtagtcaagctgtcgactttgaaccgcctcaacagaggaggaatatgtcctgaagacattggacccagctagatccttattgaagccagataactccgcattgtcttctataattactttagttgaattgtatccaaaacttaaattattttttgacgatgaagcatcattggtggtaacttcaacaatattggttgttccatctggtggcaaattctcactagaagctatgcaatcctctataattttcttgcttccagaatttgatgtctcaataatgtcatcttgctgatgctggggaactgcttctgttgaaactggcctccatcgctccacaggagactgccttttattgtgttttgtcacattgcttgatccttgcgccccttccatcacgaatgaggccaacttatttcgacaatatgatccctggtagaggtaacgaagcggcgaaccggcggcgcttggaatcgcaggccgagtgagccgactagccctatcggaaacgaacaaggacaaggaagaattagactgatgagatcctaaccggaggtgatttaagcttcggcctttgtgaggagaataactggacgaagagaggattcgctagtacaaggatgcgccgggtaggaagcgaggagaagagtatttatattagagataagtttgttgagttggattgttctatccatcgctatacggacaagattatagatagatagtttgttaggatctggttcggaattatcataaggattggttctct

SEQ ID NO: 23397 - DNA, 690 bp, Zea mays
ttttttttttttttttttcaagtaagtactcctaattattttattagaatgggaatataaggagtaagttgcccgttgctctctaatacttcatgcatgtgtaccaagagcatccatgcaacatgggcttaatttggcggagatggtggcgtcgcgctgggggcggcgtcgggcggggatcaggcttaggcgggccaggagcaggcgggccaggcacaggtgggccaggcgcaggtgggccattattgatgaagcacttctcgcagcagtccttcaagcacgccgttttctttctgctatggtgcggaaggctgaggcaggtggcgatggcgcactgcgggtaggtgatggccggcaggtccttgaagcacgcgttgtcatggcagctgttgttcttgcactcgcgggtgacggcggcggagaccttggcggcggccccggagaggaagtccgccacggcagcagcgccgttgtcgtggtcgtggtcgtggtggtggtggcagcctctggagcatgacctgaagcactgccagggctgcgtcttgtcgtcgtcgtctgctgccctcgcggccgcgcgaagagcgcgccacggccaggagaacgccgaccgccctgcgcgccatctagctggctggtctgtcggtccaccgcccaagctagacgaacgagcagatgctgtagctttatgtt

SEQ ID NO: 23398 - DNA, 980 bp, Zea mays
ttttttttttttttttcattaattaatatattgaaactggaatgagatgccaaatagctttggtgctgggtttatgttacaccccaactcaatagaaaatgtcccttcggttacagtcatgagatccttctctctttttttcaagtaagtactcctgagtattattagtgtaggaatataaggagtaagttgcccgttgctctctaatacttcatgcatgtgtaccaagaccatccatgcaacatgggcttaatttggcggagatggtggcgtcatctccatcggcctccggtccctcatcgccgccttcggcgtcgccagccttgccgctcaaatcatcatccgacgagccgccgctccagctcctggccccagcagcaatgtcattgtcatcgacggacgcgtggcccgggaagcggacgaagcgcatcctgccccagccggcgccgcgccggctcggcgtcgtcgtcgttgctgctgccgctggtctcctcccacggccacgtgccgccgtcgctcgccgaacggatgcgtgagctggtacacgatccagacggcgacggcgaccagcaggaaggcctggaaaccgtggcttgcccggagcttcttgcttctatggctcctgcttgacagttgcctcagcatggtgggctcggctcgtttcctttcgttcggtggatgaggatcacttcaggtgctggctctgtactcctcccgaagaggaaggaagaagcgctggaaagcttggcttcctggcaaagtcactgcgaccgagagaaactggagtggaaccaaccgcctgcttcacgagttgatgctccaggcctttactgactctgtgcgccctgtctcggtttgggagaggacgaagaccagcaagacaccatgaatgcatgccgaccagagaaggcacgtacggagctacttcctccgttataaatttgattcaattagatttggcatgctttgctttgagtctt

SEQ ID NO: 23399 - DNA, 1047 bp, Zea mays
ttttttttttttttttttcttttttttttttttttttttttaaaaagggatttaagtggattgagatgtattatgagagtttttgatctattaaggatttatacactcttcaatccctccaaaccacttctagtattacccaaactaggtcttaatatattgaaactgttttttttttttttttggctttggtgctgggtttatgttacaccccaactcaagagaaaatgtcacttcggttacagtcatgagatccttctttttttgaagtaagtactcctaagtattttattattatgggaatataaggagtaagttgaccgttgctctctactacttcatgcatgtgtaccaagagcatccatgcaacatgggcttaatttggcggagatggtggcgtcgggctgggaccaggagcaggcgggccaggcgcaggtgggccaggcacaggcgggccaggcgcaggtgggccaggcgcaggtgggccattgatgaagcacttctcgcagcagtccttcaagcacgccgttttctttctgctatggtgcggatggctgaggcaggtggcgatggcgcactgcgggtaggtgatggccggcaggtccttgaagcacgcgttgtcatggcagctgttgttcttgcactcgcgggtgacggcggcggagaccttggcggcggccccggagaggaagtccgccacggcagcagcgccgttgtcgtggtcgtggtcgtggtggtggtggcagcctctggagcatgacttgaagcactgccagggctgcgtcttgtcgtcgtcgtccgccgccctcgccgtcgccgccgcgaggagcgcgccacggccagtagaacgccgaccgccctgcgcgccatctagctggctggtctctcggtccaccgtccaagctagacgatcgagcagatgctgtagctttatgtgcgtggatggctcgttctatatactacagtgtgatgcaacaagcgccgcggcccgacgacgacgagtaacgcacgcgcgcacgtcgaacgcgtgaggccgcgatgtccaac

SEQ ID NO: 23400 - DNA, 1450 bp, Zea mays
gggtaccgggccccccctctagttttttttttttttttttttttttttttttatggattgaaaattatcaatacattacaataacacccacaatgtcaatcaggttccgttgcctgtaagcttacaacaaagcataaataaacagtccaaactgatacacatggataacaaatggctgcattttacttgacattataaaacgaatatgtcatttgcgactacatccccatcatgcatgcttcgaaccacttgctagtatcatcaagacagaagccatatggaccatgcatgatgtcaagatccatcaattttccttattatctaataggttgtcataaaactcccacatactaatctcagctgccacgtcctcactgacatcaccttgcaaaatagaaggaatatcttcactttccatctcttggaaaataggttgttgattcatctttttcgcagcatcaacaccagccatgggtgttgcattagtcaaagtaggaacaatcacgccatcatttcttcctatcatccttgaaggaccatcaaaagtaggttgaatgaaaattggcatgccagcttgtggtaagaaagagcatccattcaggttcctactagcttcattgcccaatccattacttaaaccatatgtcattctgttttgatttgaacactcacccatccttgggatgtcataaggaacacgaggctttttgatacattgtaagccaaaggccgcagtagaaataaagttaccattgtttccactaaagttcaccattgagaaaaaatcctcatttgagtagtttttatggcacatcaattcattggcattcaacttgtctgctgggatagccattgtagtcattgcagtaacaattagttttggtgcattgctcaccatgtttggtggttcattagggaaattcacctttgctttattgcccctaatcttgcgggcctcagcgtcatatgctctagctgcatcttctggtgttttatacgtgcctaaccaaacacgaacaccctttgtaggatcgcggatttcagcagcccattttccccaagggcgtcggcggatgcccctatatggggtctttcgcttgcacttcggccttacaatgataccttcattggtggtggttggtttttgactaatcacaacatctttcatggcaaaatgaagtccaactttctcttttgttggcggtgagacattaggaagaccattcttgaatggtaataaagccatgaacttatagtggcactcatccttctcatcgtacttcttagagaatgcttggtaatcagcttcaaagtcgtcctctccctcatctatcttcatcgccctctttaagcggcgctctcgatagttcttcgccatactatcttgaagtttcccttggcccttccctacaactggcctgcgtccttttgtgcccggccggcctcgagg

SEQ ID NO: 23401 - DNA, 671 bp, Zea mays
tttttttttttttttttcctacacttatctgggtcttttattccctaggatacaggacgtgtttccgtttgaccgtctgtggccttgaaacatcgaggttcaccgcttgatgcacgcaaccctttgttacagttacatacatgaactgccgattccacctctgaagactctgtttgtgtttgggggagaaacagatgctgatgaatgtttgataagcacgcctggcggcaatcgtcacaattgtcggctgggttgagtagtctccatgacgatcttgggcatgaggctgtttgggtatcagttgacaagcatcgatgcatgctcttaaacattctcggcgttggtcttcaccctgtcggactcaacggttgcatatgcttatcgagttgaactgactcttccatgccatctcggcattgatcctgatcatagtggtacactgccctatcctcacatcacatcaccttttattcttacattccccccaacgtaataccccaaaacgccacagatgcaacaattcattatcattgtcccccgcccctcggcctatccttcgccgcaagtccatgtatcctctcccccctctgctccatctccttctgcctcgacagccgcacgtgctcgggcaatccccaccactcccgcataaactcctcctgggcctgtgc

SEQ ID NO: 23402 - DNA, 2101 bp, Zea mays
tatatatatatatatatatatatatatatatcttgcaaggcctcaagccgcacatatttgacaggttgaagaaaatccgcggggcgatgggcgactgaattacccgcggtactctgaagcatgcagacaacaccatctagggcaacgggcttcacacctttcttcttggcattcgacgcgaaggcagtgctccctaaggagctagagtatggatcaccaaggactgaggcctagaacgacgagcaagcaacgatggatgtgcaactctacgtcagcgtactcgatgaagcacgtgatgaagtcatcgtccgctcataagcattcttcgtagcaaaaatatctaattcatgggttttcaatttataataaagcacatatgaagttagagtgctcatgagagtagattctctaattgaagctacattcatattccgatagatatgtctaatacactaagtaattgtctagtatttttagcgtatgcgaaagtaacattaacatatcgcaaattgctaataattttattaaaacatacaaataactcatctaatgattcaccagattttatctcaaagcacatataatcctttttaaacatatattgacgaacaattttattgtgttagaaccttcgtgacaatcataaagtgctttttatatctcatatatagacttgaagtgcagcaagcagtcaaagtcactccttctaaaaccttagatgatcaaatttcttgccttgctattaatatcctcattcgtctcattagtttcattaacttgattccaattcatgccgagctctgcgtccattaagtgttggggggttgtgatctcgatgagtatataggcatgatatctcgaaaataattgcacatctaatgggatgtttagtttctatgaactaatttttagtcgctctattttattccatttaaaatggagggaataaaatcagtttctcgaaaccaaacaccctctatatcttaatatttttaatgatttgaaaaactcattagcttctttaagttctaacatggcttgataacacaaaaatgtgattgcaaaaatactagcatgcactaaattgaaaactgaattttcggggtgcaaaaattctctgccgactggcgtggaggcttgcaagttgcacccctctatttcgaaacaaaaagggcaagaaaaaaggcccgcgggccgctccccgcggcccggacccatcgtgcgccttcgcttcagccgtgagcccgcaaccgacccgccgcaaaagaccaaaaccctagccgtcacagcgccgcccccgaaccataaacctccacctcgccggcggccatggcgttctccggcaggatccaggagctcgtgaggaagtatggcaaggtggccatttgcgtccacctatccgtctcctgcgcctccatcgccggcctttacgtcgccatcaacaacaacgtcgacgtcgaagccgttttccggaggttcggtatctcccccggcgttaccgtaggcggcgaggcctcacccgcccccgtttcccgcgatgaacacctgcgcgacgtccccctgccgcccatggccaacgaggtactgcaagaagagacggagcgagagcggcagccccgcaacaggacgatggagctcgtggcgtcaagtggcggcgcgttcgcgctcgctgtcgtctgcaacaaggcactattccccgtgagggtccccatcaccatcgcgctcacgccgcccgtcgccagggccctaagccgctggaggctcgtcaagagctgatctgtgagtccgtttgccgcttcggattgccctctgctattttagtttcagagtcaaactttgatgcaaccttcaacttcaatatgctgttggatgatgtgggcttattcataatttgtgtgaggtttcgttgattaaatggtgtgacattgcaatttgctgggtatcatgtatgtcattgtgaggtcggatttaccctgagaaacgtgaaattggagaagaaacatcaatagtattaaatatagtctaattacaaagctaattacatagatgaagactaaacaacgagacaaattcattaaacataattaatctatgattagca

SEQ ID NO: 23403 - DNA, 1074 bp, Zea mays
  misc_feature (31)..(31): n is a, c, g, or t
atagctggagctccccgcggtggcggccgcnctagcaacagtggattccccgggctgcaggtacccgagaccaggattgagctcactagtcccccccccccagccgcgacgcggacctttcgcgcgccttcgcttcccctgggggcccgcaggcggcccgccgcaaaaggccaaaaccctagccgtcacagcgccgcccccgaaccataaacctccacctcgccggcggccatggcgttctccggcaggatccaggagctcgtgaggaagtatggcaaggtggccatttgcgtccacctatccgtctcctgcgcctccatcgccggcctttacgtcgccatcaacaacaacgtcgacgtcgaagccgttttccggaggttcggtatctcccccggcgttaccgtaggcggcgaggcctcacccgcccccgtttcccgcgatgaacacctgcgcgacgtccccctgccgcccatggccaacgaggtactgcaagaagagacggagcgagagcggcagccccgcaacaggacgatggagctcgtggcgtcaagtggcggcgcgttcgcgctcgctgtcgtctgcaacaaggcactattccccgtgagggtccccatcaccatcgcgctcacgccgcccgtcgccagggccctaagccgctggaggctcgtcaagagctgatctgtgtttttttcgtcacaactgctctgggatatagggtgcatccacatccaggaaatccagagagaaaattcgccgcggtttgttttttgtggtcatggatgaaagctgaaatccctggagcgaagtctcatgtggaactcccctttgttcatcagcgaggtgtgaatccctggcagaacgccctgctgattttgtaacatgaacacaatggcttggggacaaaataagaactgcgatcgaatgattgatacaagaagctacgtctacactcgctttatgtgactttgcctgtttctctgatcgagtgtgtggaatctatgtactgttctcacttctgagtgaatttataaatgatcaaagagctgaatataaaaaaaaaaaaaaaaactcgag

SEQ ID NO: 23404 - DNA, 1058 bp, Zea mays
acaaatcaatagcagtagtatattccgttgcaccaaatatgagctctgtgctcgataataccttgagcatatgtaggagatgtttggctctcctctgaccaatactttagcacttccgaaatcgcaaattttgagttggtgtgtatgtgggttaacaagaacattctgcggtttgatatcacggtggcagatgccaatgcagttatgtatataagcaagcgctcggcatatctgatacgtgtacagtttgacataaatgaggggcatccgctgattcattcgattgtactgccttgcaatcctgtttactgtctctggaacaaactcaagaacaaggttgagataaagctcatccctttcagttgttgaaaagaagtaatgcttaagaccgatgatgttaggatggtcaagcatatgcatgatttgcagctctctgttcttataacgcttatcttgaagaaccttttttatggcaacaatttcccctgtttctcggcattttgcctgatacacaaccccaaaagaaccagttccaaccacatgttcagcgatgtatgtgacagactgtttaggcaggccgttgcgcccgtgaacagtagtcgctattacatgaccagcttcattactagaactatcagtcacatctgaacttgaccacatctccctttcatcatctgtgtcgggcttggcatccctcagtcgcattcccagcatctccctacccaggaactccaccgagttggctgcccccttgaatccattagctggcctcgaggagctcccaacaccagcatgcctttgtccagaatacgccatacctcagaccgaaacctcgcagagaagagatcgacgaggagctcttgcagcagatcgaaccgcaggctcttcacggcctgacggttccagcagcagctccggcctcgtgctggggtttatcccgttgtgtggtggtaggggagggagggaggagaaggctaggaggagtcaggactctggagcaaagctggtggtgcgagcgagcgagtgaggctgaggtcgaggccatgagacccggccgg

SEQ ID NO: 23405 - DNA, 1340 bp, Zea mays
ctggtgatttccaccagatcggcaaatgaggaggagagagcaggaccggctagctcgaatggaggctgactaccagaagagaaagaagatggctgagttcgaactgcggagggaggagaggatgaaagcagctgaggagcggacagccaagaagcgcctgaaacggcaaaagaagaagcagcgtaagaaagagaagagagctaaaacgggtaataacggtggtgatgaacctaacagagtggagtcttctgatgacgatcacggttcggatgacgatgatgagtccaagcaatgacacgtcagttgcatctgaagatgatttcggacactggttgtctgggcattgaactaacgtctgtatggccgttgtaacaggttacaggccgaatctggtgctctatctgtaagaggacgtgatattttgagcagagaatgatagcactagataatttcatgttagtgttcatcattaaggtcttattcgtttacacaaattcagctctacattagcatggattgatgtgaggtatggatttatctaatctaaacctagattaaatctatgatgtgattccataccttgtaaccgaacaagtcctaagagagctagaatcatatcgtgtgcctgcgcgcttagtgtgaaaaaaaaaaaaaaaaagagtgtaattatacgacgtattgacaaaccattacaaattaatgttagtataaacggcgcacttgatatcacggttgaattttagtaggcagagagtatgccgatgtgaaatttgcatcttagtggataatgcgggcatgtggcatgttggtgctgatataacttaataaatagataagtgtcattaattgttaaaagggaaatggccttaaccattttctataatcgattttggtgcttgatggacatcacaaatcttatggactaactagtttgtctagtttctttgattcacaggtgcataagtccatccatcccagacatgagaacttcttaaggttttttattgtaccacgaaccgtctgggcccttctagcggacaatctacgatgcctcgaagcacttcagacaggaactatgttaaaaatcacacttctactatggactgtctgaaagagagaagagcaccgtccgggaccaagcttggaccgtctggcctcaagcgcggaccgtacacccattgaaaagcagagaaacccgaaggtgacgggtttggtaaaattcatttttagcgtcctcatggaccatccagggtgcatggccagactgtccgcgattgctttatctaacatatgatgacacaattaatgcacttatagccattgatatagacattcttgct

SEQ ID NO: 23406 - DNA, 2044 bp, Zea mays
  misc_feature (1117)..(1117): n is a, c, g, or t
cccctaattagttggtatgctgccttctagtaaggggtaaaaaagggattcaaaaaatacagaagcaaaaacaataatttattctcattttcactcccgcaatataccattcccgaatgaaagaaaaaacaaattcctttcttttttatccctactaacggccgaccatcggatttggtctccacctcaagtctctgcgagagttcctgccatcctctcaaacttacggacacacaccccttggggcgtttgggcccctcggccccggccgggaccccacaaagcaataacccggccctctcctttcgtcaccatcacatccagccagccaacaaaaatgtcgcgcgtcacagctgcggtgctcttttacatcctcgccgttgctgccctcagcgcggccgaggccccggcagagtcaccgaaggaaggcagtgctgccaaggcacctgaggctgccaagagaactgctgcccccgctgaagcacccggagccgcgtccacccccgtcgccgccgctgccccatcatcgtcgtctaggaagtctggtccagctaccgcgccagccaccgcctctacacccccttcttccacggacgaggagttgagcccttccccgccagcatccaccgccgcggcgtcccctgcggctgagggaccggctgctgatgactccgccggtgctgctgcccttggaagtggagctgccatcgccggcgttgccgctgctgttgctaccatgatcttcttctactaaactcaccgacgatggtcgtgtcgcggtgagacattagggtggacacgtaattggctgtgctgtaatcgctctcgtctggtggggagggagggaccaagtgtttctttgctttgctcacttcgtttgctcttgtaacattatggggtcaaccgttatgtaactaatggatttgattaatctggtctctaactctcaaaaaaaaaaaaaaaaaaatgcggcccccaaaaaaaaaaagattttacatgtttgcttaaccggatctttatatcataaacaaaatattcagagaaatacatatcttataggagataatctttccaccgcaggccaaattaaagcggccgggatcacacatttatgtgnatatatgtaaaaacaacctgtgatcatgtgctagctagattgcacacttctcaaaactaccagaaaatatgtagctatatatactacgtaccatgtatgtatgtatgtatgtatgtataagtcgttatacacaccatgcatgagaccaacacacaattttggattgttcaacaggtactatatattttctttccctcgtatatactctgtctgacctctacatcacaaatacctcttaatttgatgtcaaaatctacatggatatgtaatgtacaacatggcgtctccaaatttttgtcgttttcaaatctttttcgaaacagctacaactatatttgtagatattttgaagttcatcatatttcttctgaatatgaatccccagctagatccgttttcaacggtagtaattaacaaagttgcacctgccctcttgatagattgacgcgttacaagcagctagacaacacattgagacctgagtggagtactgagaagtgacaacgcgttacatgtaaccgagtggagacacggcattacaaagaggtgacgacgctagaaaaggaaggtttcaggattgaaccctgcgttattaattccatggtacatatactaatgagtaatacaacaagtgttaattactactaggacggacaacatgtacgtactctgcccatatatatgtagcctagaccttcaaagataaactcagagacctagttacaatatgtctaacgacgtacaagttcggcagtctcgtgtattggtgatatccatcaaatgcatcaatataaaggcacaaacatatatataaggatctccaaagtggatctagagaacatacaataaacctcgtgcctcactaccggaatcgagcgctttgccgagtgcctgaagcactcggtaaagcctgaaaaacactcgaca

SEQ ID NO: 23407 - DNA, 813 bp, Zea mays
gcccgccccttttttttttgactcctataggggcctgggggcttcgcggcccggccggggaccccacaaagcaataacccggccctctcctttcgtcaccatcacatccagccagccaacaaaaatgtcgcgcgtcacagctgcggtgctcttttacatcctcgccgttgctgccctcagcgcggccgaggccccggcagagtcaccgaaggaaggcagtgctgccaaggcacctgaggctgccaagagaactgctgcccccgctgaagcacccggagccgcgtccacccccgtcgccgccgctgccccatcatcgtcgtctaggaagtctggtccagctaccgcgccagccaccgcctctacacccccttcttccacggacgaggagttgagcccttccccgccagcatccaccgccgcggcgtcccctgcggctgagggaccggctgctgatgactccgccggtgctgctactcttggaagtggagctgccatcgccggcgttgccgctgctgttgctaccatgatcttcttctactaaactcaccgacgatggtcgtgttgtcgcggtgagccattagggtggacacgtaattatattggctgtgctgtaatcgctctcgtctggtcgggagggagggaccaagtgtttctttatttgctttgctcacttcgtttgctctcttgtaacattatggggtcaaccgttatgtaactaatggatttgattaatctggtctctaactctcaaaaaaaaaaaaaaaaagggccaaacggccccctcttactgaaaaaaaaaaaaaaaaagcgggc

SEQ ID NO: 23408 - DNA, 900 bp, Zea mays
caccgtcgctgcattcgcaccaatatccaggaacctcttgctaaatccaaacagtaacccaaatttcccgagcttctcctcagcgcacccttgtccacctcctcccctttcttcaccatctcaagcaagcgactgccactctccagtaacctctcaaacacgcatgccttcaccttactcaccatcacccgatcggtcgacttcgccaacacgatgaagaacggagccagcagggcgtccaccgtctccaggctaacggggagcacaggcaagagctcgtctaggaatgcctcggcgacgtggtacccgaggccccgggaggtgccggcggcggcgctgtcggcttccgggagcagggccttatctgacaggacggacacgacctgggaggtgacgacgggggcgaaggagttggcgctgaggagcaggaaggcgtggtggaggaaccggcggttgaggaggtagaacttgtcgaggcggtggacgtcgatgtgtgcccactcgcggcggagcgtggtgaggtaggcggcaaggaaggcggcgccgtcggcgggggacggcggggcggagacggcggaggcgaggcgcgtggcgacggagctctggtagagcggcttgtcggcgtgccagaagcagaagaagaggcccttccagagcttgatgaggtcggtggcggaaaggcgccgcgcggaggccggcaggaagtcggagaggaggtagcggacagcgcgctcccgggtgccggtgttgcaggaggccaggcgccgcgcgatggcggtggcctcggcgggcacatcggcggcggcggcggcggcggccatgggtgggcgtcgcgggggtgggtaacggaaaggcggacgaaacccgccggcctcgcggtgccctcggtttttgatccgt

SEQ ID NO: 23409 - DNA, 964 bp, Zea mays
  misc_feature (943)..(943): n is a, c, g, or t
  misc_feature (963)..(963): n is a, c, g, or t
cccaatcaccacatgattatcataaaagcaaggtgacaacacaaatcattaagcaatccatcaaattatgaactggcagagaagtcaacttagtataaaactaacctacaaaaaggataagaactaagtaatgataagcccagaacaaaaaagatacaaaagctcatgctgaaaaactctgcaacttccgcaagcgcttcacagcagatgaaggttgcttcttcaagaccttctttgcagattttgccttaggcttcgccttcctcaatggtgtcggtgttatgggacctggctttacgcccttttttagagcacttccccttggagtagccgaaggtggcagcctcaaacactgcggtggcaaaggattgtgaggtttccaaactaaattattcttcatcgagaacctcaccttcttaccactcttctctccatcctgggcaagaagattaccttcgctgccatcacccccatcagaagcttcagacagcttatcggcagactttgagcgcttcctctttgttgccactttcccactgactggtgtcactggtgaagcgcttgagctgctgccccctttgaccataccagcttctgctgcagccatctcaaactgcttctgaagattggactttaatgtctcatcaaatgtaatgccatcagcaccatcaccgatctgctgatcatctacaggagcatcagtactcttatcggtggtgttcccttcatcaacaacctccaccttcctctttttcttcttctctttcttcaccttcttgtctttctttaccttcttctcacgcttcaaatccttggcatcccccatctcaccttcagccaatgcaacattcttcgtctttttcttcttttggccttttcatcgcccgcatttggttgcacggacagctcagcagcctcaaactgtggcacagggtttcgaganccagatagctgcaaagcttnc

SEQ ID NO: 23410 - DNA, 2910 bp, Zea mays
gctgggtttttttttttttttggcataaactgggatgtgtggacccatctcagtttccataaaccagtttcttaaaaactgggggggtttttttttttttttttcactgttgcaatcaccacatgattattataaaagcatagtgaccacacaaatcattaagcaatccatcaaatatgaactgacagctaagtcaacacagtataaactaacctacaaaaaggataagaattaagtaatgataaactaaaacagaaaagatacattgacatgaccatcatggcgtcatacaccaaaaaaactcaggctgagaaactctgcaacttccgcaagcgcttcacagcagatgaaggcggcttcttcaagaccttctttgcggattttgcctttggcttagccttcttcaatggggtcggtgttatgggacctggctggacacccttttttagtgcgcttcctcttggagtagctgaaggtggcagcctcaaacactgcggtggcaaaggattgtgaggtctccaaactaaattattcttcatcgagaacctcaccttcttaccactcttctctccatcttgggcaagaagattaccttcgctgccaccatccccatcagaagcttcagacagcttatcagcagattttgaacgcttcctctttgttgccactttcccagtaactggtgtcactggtgaatcacttgagctgctgcccccttctgccataccagcttctgctgccaccatctcaaactgcttctgaaggttggactttaaagctgcatcgaatgtaatgccatcagtaccatcacccatctgttggtcagctcctggagcatcagtactcttctcattgacatccccttcatcaacaacctccaccttcctccttttcttatccttcttttccttctttatcttcttctcacgtttcaaatccttgtcatcctccatctcaccttcagccaatgcagccttcttggtctttttcttcttcttttgtgcctttcccttgcccacatttggcggcactggcacctcagtagcctcaaactttggtgcagggatctcaagaccagataactgcaaacccttctcgatcttcacaaacgcatccctcaacccaaagaccaccttccggttcgattgcactgtctctgccattgcaccaatatccaggaacctcttgctgaatccaaacagcaatccaactttaccgagcttctcctcggggtcacccttctccacatcctccccctttttcaccatctccagcaaccgactgccgctgtctagtaacctctcaaacacacctgccttcaccttactcaccatcacccgatcggtcgacttctccaacacagtgaagaacggagcaagcagggtgtccatcgtctccaggctcacggggagcacaggcaggagctcgtcaaggaacgcctcggcgacgtggtacccgaggccccgggaggtggcagcggcgacgttgtcggcttccgggagcagggccttgtctgacaggacggacacgacctgggaggtgacgtcgggggcgaaggagttagcatggagaagcaggaaggcgtggtggaggaaccggcggttgaggaggtagaacttgtcgaggcggtggacgtcgatgtgggcccactcgcggcggagcgtggtgaggtaggcggcgaggaaggcggcaccatcggcgggggacggcgggacggagacggcggaggcgaggcgcgtggcgacggagctctggtagagcggcttgtcggcgtgccagaagcagaagaagatgcccttccagagcttgaggaggtcggtggcggagaggcgcggcgcggaggccggcagaaattcggagaggaggtagcggagcgcgcgctcccgggtgccggtgttgcaggaggccaggcgccgcgcgatggcggcggtctcggcggacgcgtctgcggcggccatgggtgggcggcgcggggtgtggtaggggaaatgcagaggaaaccctaggcagtagcgttggattcgattttgatccgtggagactggagaggaaaccctaggtgtggatatgttcgtttccgctagggatgttctaggtgatggtctcgggccgtttcggtgtggcgggtggaacagtggtgtcgttggacatgtggggccatgggaaaggcaaggcacgggcaccgcacagcggcacagggagacgttgcgtcccgcactcccgccaggtccccaccgccagccgcacgctggtggttcgagttcgactcccgcgtgaaaactgggccggattatgctccggcctgcgatggtcactggtgtatacttacatgggcccaacttcgttcctcaaacatccgcggattgctgctgcatggtgccgtggcaaaagcagcccatgtaggctcatgcctatcccgtttggttctggcccatgcccatctggccatcccgtccctcccgcgcacgcagaggcacacaacagccgccgggcgccgactccagcgggagcggcctcttccccgccccgccgcccgctccagcctccagctgcaaaatccacccagctcctgctgacgtgttcagcgccaaaaaaatccagagtttttagaaaacaagcccacccccaccaccacgtcgcggtcgccgtggccgtcgcagtcgccaggaattgcccgcccgataatctattcgcagcaaggctggttcaatgttcaatctgggttgcgcgcaagctaagctcctttggctctctctctctcgcgcggccggcagacggcagtgccagcgcccgccaacgcggcgaccgcgttggcggattggaccggacgcgccacgcgagcggggctacagcttccctccctcggagaaaccgataactatgccgtcgtctcggcattgtggaaggtcc

SEQ ID NO: 23411 - DNA, 6265 bp, Zea mays
  misc_feature (6044)..(6044): n is a, c, g, or t
cattgggtacctcgaggccggccgggccagccaaccactaccactctcgattaccagccctctcgccttctccgctcctccgtcgtcgccgaaccccatggccccaaaaccctaaactgagcccgccgctgcttctccagtccgcacgaagcgccccacaaaatgccgcggctgacgccggcgcacgccaccctcatcctggaccacgtcctgggcgatccctcgatccccaccgcagtcaccatcgcgttaatcgctgggatcccctctccctccgatccgaccccgcgcctccgccgcggggtccttctccgccgcctcgccaccgaccccgtatccgaatcctctctcgaaaccctccacctcctggcctcgctcccggcctgcgcctcccccatcgcagccgcccacatcgccgtcgcggcattcctcgcggcctccgcgcccgacttcgacgccgtcgccagggctctcttcgcgcgccccgacggccgcgcgcgccaagcggtccacggcggaagttcccccgcgctcgcatccgacgatgccatcgccacagtagaccagttcgaggctgccgtcgggatgtcctcctctcagaccatcctcagggtcctgtggggcaaccgggccgccgtggaggagcgggtccaggagctcctcgctgctgaatgggccgcgattggcccgtcgcggctcgaggcgttggctatgcggatcgtcggggatggggccgtcgatacatggggtgccgcagatgaggccatgcgtgccaatttgcgcatcttggctggggaagcaaaaacgcgcgagattctcgacaaacttgaaaaaactacctgcaacacaaatccaatttcaacaccagctgttgagaaggtgatggatgcgctcaaagcaagctgtgctgacctccacagcattgtggaggatccccttccagctgcaaaggcagttgcagatgagttattgactgcgaggatggaaaaattagttagcctgaatgcccaagaagtaggagggcagccaacaacttgtggcgttgcaggaccgagtattcataatgacaaagacaatggtccaggtataggcaaacctcacagccttatggagcggaacgcaacagcacgaacctctcagtgggaggagtcacttggtcttgatggttcggaaccaccctcaccaccgagaccacacttgcctagcccaaggagactaccaccttctcctttgtcaccgcctgggaacaaaaacaataatcggagaaaggcaaggaggtggagcttgttcgaagaagaaaccttaagaaagggtgttgaagagtatggtgttggcaattggagggatattctagataacaatgctgaggcttttaccggcaggacaccggtggacttgaaggacaagtggaggaacatgcttttccgttgatgtaacggggaaacatgtagctggacatgctttactagggtaaagtacctagcaattagcatgtagtcctcgtacatcacagcagactcttggtcaagcttttctggcagctgcagctacatgattttgtgtctcggtgtagtagcagccgcagcttttctggcagctgcagctacatgattgtctcggtgtagtagcagccgcagcccaaacggttggctttcctggcagctgcagctacagtattttgtgacggtatgcttaccgagtggctgattcgcgcactgacgtattatggactcgattttgtatttttattatgtacattgtcctgcatgcttgcattgtactagctttactcatatatttggatgaatagggatcggaaaggtgaccccttgtagcagagcaaatttaggtgtcgtttggttcacgaaatgtaatataaatagtaatggtaacgattcacacttgaataccagcactaacaaatttgaataaggaggtatccatttgtaatgtgatatcgattacggttgaacttaaataaacatgatttaacgttattggttactcattaggttaccaatgtgaaccaaacgacaaggcatttggttgcggtcaattaaagttcagtttctgaatatttaaatgataatggtgggtattaaatgtagtctaattataaaatcaactatctagatgaagactaaaagacaagacatattttaaacctaattgagtctatatttaatacttttagttgatatctaaatgtggatgtgactgttattgtgtgagagctattctttgggttccacctctaagccttgttattgtgctcgcaatcacaagttccacctctaaaacctatttgcttataattatgtgatggaactatcatatcatgtacaaccgaaatcacaagtgtattaactgtagtggttggttaattatcttatgtgcatccatatcatgtatgagggaaccataagggcttgcttatacatgctgtgagagctcctaggcctaatgtttgtccgacgataactccactacaatacaaaccctctccctcgagagcaatcaggagagtacattgccttttactctcacaagatggtaggcttgaatctccctctcatatactttcttctttaaatccttgatcatgagagtacattgcctcaatccacctcaatctgaataagccataagttagaacttagttcaatcagcctctttcttaagtagatagatgggccctatgaagttggaatagaaaaggagcttgcttgagtgcctgtggagaaagatgaggatacgtcacatgttccaccaccctatgaatgtatgatgcatgcatgcacgatttatataaagaattgaaggtatgcaacggcgactccacatgttccaccaccctatgaatgtatgatgcatgcatgcacgatttatatagagaattggaggtaagcaacgacgacttcagctgcagcaacaaaattaaggaaccatatttgtacacctacctacctttgttttaaaaaaatgtcaaaatgaatgttctaatcttttatggttgatgccggtgaatccaacaccaaaccacctccgtgtcacgtcccggagcagggcgtcctccacctcgcagaacatgtgtgaccactcggtcggttcgaccgcctcaaaccctaggccgggtgtgcgatccttagacccattgttgacccggtcggtccagtccgccacgtaggtggacacgcagcgccgaaacttggccttgaactcatcccaagcctggtacttgtaatggttgactctcgcatccctggaccgctcccacctgaactccggccgcagctcgaaatggttactcattatgttaccaatatgtgaaccaaacgacaccttaggagcgtttggttgcagtcaattaaagttcggtccctgaatatttaaatgataatggtgggtattaaatgtagtctaattataaaatcaactatatagatgaagactaaaagacgagacatattttaaacctaattgagtctatatttaatacttttagttgatatctaaatgttgatgtgactgttattgtatgatagctattctttgggttccacctctaagccttgttattgtgctcacacagggctatttgctaataattatgtgatggaactgtcatatcatgtacgatgaaaatcacaagtgtattaaccgtagtggttggtcaattatcttatgtgcatccgtatcatgtatgatggaaccataagggcttgcttatacaagctatgagagctcctaggcctaatgtttgtccgacgataactccactacaatacaaaccctctccctcgagagcaatcaggagagtacattgccttttactctcacaagatggtaggcttgaatctccctctgatatactttcttctttaaatccttgatcatgagagtacattgcctcaatccacctcaatctgaataagccataagttagaacttagttcaatcagcctctttcttaagtagatagatgggccctatgaagttggaatagaaaaggagcttgcttgagtgccagtggagaaagatgatgatacgtcatatgttccaccccctatgaatgtatgatgcatgcatgcacgatttatataaagaattgaaggtaagcaacagcgactccagcctgcagcagcaaatttaaggaaccatctttgtacacctacctacctctgttttaaaaaaatgttcaaaatgaatgttctcctaatcttttatggttgatgccggtgaatccaacaccaaaccacctccgtgtcacgtcccggagcagggcatcctccacctcgcagaacatgtgtgaccacccggtcggttcgatcgcctcgaaccctaggccgggtgtgcggtctttagacccatggttgacccggtcggtccagtccgccacgtaggtggacacgcggcgccgaaacttggccttgaactcatcccaagcctggtacttgtaatggttgactctcgcatccttggaccgctcccacctgaactccgaccgcagctcgaaatggtggacggagttcaccagcgacggggccacggagtcgagcctgacgaccgacttatgccgctcctccgctcgcctccggcacgtgtacccctgtgtgactccctcctgggggtgcctggtctgccccgacggcccgaagtccctgcaccctagagtgacctggccgacgtccggctcgacggcgtcgacgacgagccggagcatggatttggccgcctcgccccgcccggcccagctcgcggagaagatgaactcgtcgacgtcgatgaatgccatccactcgcacgagtctcggtgcgccgccgccgcgtaggagaacccggcctcctgcgtcttgggccaggccgccagggccacgcgtgcgccgacacgtggaagccctccgcgctgagctgccgcacctcaccctccaggtcgtccccgctcccgttgtcgtagacgtggaagcggtccacgcccactgccgcgtggtacaccacccactcccggaggaacttggccacgtcgcggaccatggtgcacgcgcagatgagctccttctccttcttcgtcgtcgtcgtctgggctgctggaggaaggggcatgtaggtcgccaccgatgggatggggtcctcgccagcgacggccagcgtcacgcggagctgctgcgcgccggctgcagggggcgcagggcaccggaagacatgctgcgccgacgtggcggccgggagcgaggcgaccaccacttctccggcggtgcagcggcggtagtagatgcaccggatatccgcggcgtcgcggttgactccttggcgcgggttgactcccttggcgaagacgaggacgccgccgccgccgtcgtcggccagcgcggcggagtcgtacacgaggcggccgttccaccgcgtcatctccggcgtttttgaccgtgccgccgccgccggggacgacggcgccgtggcggccacgacgaggcgtggcgcgcggaagggcctgctgctggcgcgctccggcctgggcatgacgcacgtgtaggctcggcggccggacgtgggcatcctcccgagctgtcgcgccggggatgtggccccgcccgggaacacgcacgtggcgttggctgccgtcgtcccgtgcgcgtcgtcgtcggggcggagcaggacgaggacctcccagtccgggagcagcacggcgtcggggtggtcgaggcccgacgagtccgaggcgggcctggcctcgttctcgcccccgtccttccggaccgcggttagtggctggcggcggcgtggcggcacgatctgcagggcgcggcgtgcgggcgaggaggcggaggacggggttgaggtggcgaaggcgatcatcgcggccagggagagggcggcgaggaagagcaagcacagtagggccctggtaatggcccgtcggcgtgaagagggcggcggcggcggctgcatggctgcacctgcagattgggggttgctgagtcaacgccgcctgctacctggcttctcatcatctgactatatatatatatgcaccacgcggtctncgatacagaactggaggaggatagttggcgtgttttgaatggaattccatgcgagttcgttcaagtcggtggttcattcgaaatttcctacgaacaagtagttagggtcacgttggttttttttatttaaatttatgtctatcctctagtctattattagcgtgtctggtagctggacatgaaaaaaaaatataggagatgttaaaaaaacacgctaaccg

SEQ ID NO: 23412 - DNA, 2583 bp, Zea mays
cgaggccggccgggagtccgcacgaagcgccccacaaatgccgcggctgacgcccccgcccgccaccctcatcctggaccccgtcctgggcgacccctcgatccccaccgcagccgccatcgcgttaatcgccgggctcccctctccctccgatccgaccccgcgcctccgccgcggggtccttctccgccgcctcgccgccgaccccgtctccgaatcctctctcgaaaccctccacctcctggcctcgctcccgccctgcgcctcccccatcgcagccgcccacatcgccgtcgcggcattcctcgcggcctccgcgcccgacttcgacgccgtcgccagggctctcttcgcgcgccccgacggccgcgcgcgccaagcggtccacggcggaagttcccccgcgctcgcatccgacgatgccatcgccacagtagaccagttcgaggctgccgtcgggatgtcctcctctcagaccatcctcagggtcctgtggggcaaccgggccgccgtggaggagcgggtccaggagctcctcgctgctgaatgggccgcgattggcccgtcgcggctcgaggcgttggctatgcggatcgtcggggatggggccgtcgatacatggggtgccgcagatgaggccatgcgtgccaatttgcgcatcttgggtgaggacccattttttgggtggattttgcagcagcgttgtgatcaagaaactagtgtgtagtgggacttttctgtatttttgtgatatagtaaaaatgagaaggaatttagaggtcatattttatcttggctctatgaagcaaccatgggttgaagctatcccaaacagaccttatattttgactgtactccatccttgctaattttgctgcttttagtttcttgtttatcatatatcaaactacatgatttcaatcttgtgaatacttttgatggcccccccgcaatattttaatgggttcatatctttgatgatgctttcagttagtttaggatcctcttgtatgcctgcatctatgcttcttattgattttgcaattctatgcatccttgtagagcattttgagtttcatctctttgggacagctctaggtctaaatgtgcattgttagctgctagatgttttatgttttctaatttgctatgattctggtgtccgcaaggtcgcggacttcgtagcctataattgattatatgatatgaaacttacagctggggaagcaaaaacgcgcgagattctcgacaaacttgaaaaaactacctgcaacacaaatccaatttcaacaccagctgttgagaaggtgatggatgcgctcaaagcaagctgtgctgacctccacagcattgtggaggatccccttccagctgcaaaggcagttgcagatgagttattgactgcgaggatggaaaaattagttagcctgaatgcccaagaagtaggagggcagccaacaacttgtggcgttgcaggaccgagtattcataatgacaaagacaatggtccaggtataggcaaacctcacagccttatggagcggaacgcaacagcacgaacctctcaggtttgcatttctttttaaaaatagttttctttgtttttgaacattgtccatgctgaacttgctttgtctttttaaattgagtttgtgcttgtaatagctagcgtttgtttccattgcgatagtttttagtatgaattgttctgtacattgctcctgctctgcaaaatcggtatgacatgtctaatagttgtaggatttgtttcactttagtaagttagctactgaaattaggacttggaattatgaatgctctactacggtccctcttcgcgtgacacttaaaagtaaacttactgtagtctaatttgagctcaatcaaggcgcctcataccgttctaggtaggtagcttataggatagctcggtatcataaccgcaaaatctaacttacattgtttatggtcgtgtttctcaaaactaaaacgtttgtttgcagtgggaggagtcacttggtcttgatggttcggaaccaccctcaccaccgagaccacacttgcctagcccaaggagactaccaccttctcctttgtcaccgcctgggaacaaaaacaataatcggagaaaggcaaggaggtggagcttgttcgaagaagaaaccttaagaaagggtgttgaagagtatgttaccttgtcttgatgttcagttgttatcgtttgacatgtcagttttttttattattattgctgttgctgtatgttcctcgttctgtttgtttcacgtgtaggtatggtgttggcaattggagggatattctagataacaatgctgaggcttttaccggcaggacaccggttggtaattctgttattacagtttagttgctgtggttggcaatcaacggtagtgatctggttgtattgtaggtggacttgaaggacaagtggaggaacatgcttttccgttgatgtaacggggaaacatgtagctggacatgctttactagggtaaagtacctagcaattagcatgtagtcctcgtacatcacagcagactcttggtcaagcttttctggcag

SEQ ID NO: 23413 - DNA, 1216 bp, Zea mays
tccattacgtgcacccgtcgagtttcataatgtcaaatttctcccctgcgagacaagccctacctaccactaccactctcgagtctcgagcaccagccctctcgccttccggtcctccgtcctcgccgaaccccatggcccaaaaaccctgaactgagcccgccgccgcttctccagtccgcacgaagcgccccacaaaatgcggcggctgacgccggcgtacgtgaccctcatcctggaccacgtcctgggcgacccctcgatccccaccgcagccgccatcgcgttaatcgccggtctcccctctccctccgatccgaccccgcgcctccgccgcggggtccttctccgccgcctcgccgccgaccccgtctccgaatcctctctcgaaaccctccacctcctggcctcgctcccgccctgcgcctcccccatcgcagccgcccacatcgccgtcgcggcattcctcgcggcctccgcgcccgacttcgacgccgtcgccagggctctcttcgcgcgccccgacggccgcgcgcgccaagcggtccacggcggaggttcccccgcgctcgcatccgacgatgccatcgtcacagtggaccagttcgaggctgccgtcgggaagtcctcttctcagaccatcctcaggggcctgtggggcaaccgggccgccgtggaggagcgggtccaggagctcctcgccgctgaatgggccgcgattggcccgtcgaggctcgaggcgttggctatgcggatcgtcggggatggggccgtcgagacatgggctgccgcagatgaggccatgcgtgccaacttgcgcatcttgggtgatgactcgttttttttgggtggattttgcagcagcattgtgatcaagaaactagtgtgtagggagtcttttctgtatttttgtgatatagtaaaaatgagagggaatttagaggtcgcatttcatcttggcctctatgaagcaaccatgggttgaagctatcccaaacagaccttataatttgagtgtactccatccttgctaattttgctgcttctactttcttgtttatcttatatcaaactacatgatttcaatcttgtgaatacttttgatggcgccactgcaatattttaataggttcatatctttgatgatgctttcagttagtttaggatcctcttgtatgcatgcatctatgcttcttattgattttgcaattctatg

SEQ ID NO: 23414 - DNA, 3278 bp, Zea mays
  misc_feature (2166)..(2166): n is a, c, g, or t
  misc_feature (2336)..(2336): n is a, c, g, or t
ggtgagattaaagaggaataatatgaagcgttttcttaactccaattgtaatggataactaatgttgtctaattccaaaaaatatggattctttttgtttagatatatggatattttttacaaaacgacttttgagtttggtttaaccatgatgggctacaagccagccaaacattccttccatttcataaaccctgtttgaatccttgtaatcgaattccattctaataattctgatttaggcataaatcaattaagctaatatagttttatatagaattgttggtcatatggaagagatatttatatactacatttttactataggggagcgaaccgaagagtaagttgtagagtatatacatagactagtgatacataaaaccaattctcatcctaggcttatatctaaactttagaaaatggtgaaatgtcaaattccaaactaaatagcctactctattaagtagattacatttttttcaaaatgaaggatccaaacaggcctagcctaattttgatcaagccttttaaaaatattagtgtctataatttaaatatgtagaacatttgctataaaaaaattatagagaatttaaataaactaatttggttttatcgattttaatacaatatcctatagatttagttaaattttgataaaaacgatttaataaaaattaaactaaactataaggtcatcttcagcagattgtgtaaacggtcgtgcaaagtattgttttgcactgtagattgcactgtttacagagttaagtttacaatagagagtgagatagaagtctaatggagataatctaacatgctccatccattataagacgctttgacatttttaaatacatgtcttttactatgtatttagatatatacactacgttcaaatacaattttaaacaatgtataaagaagtaatccctctgtcaacaaattaaaaaaattatagcattccaaatttgttcacaaatatgagcgtctggtataatctaatgcagtcaaaatatcgcgttcggtataatctaataagatgaaattatctttctgacttctccccactctccagccaactgtcatcagatccggcagtcccatgaacatgaaatcgtttcgttaatttcactttgcttcttttcgttgccgcaaaattaccagcaggccacaccgagcttaatccggtacaagattccaggcctgttcagtccacagaaacactagctgaatctgaacatcaggacagattcacgcgcaaatgtctaacaagtcaggtagcggatacatcaaaattgcactgattcaaaatatcagatactagattgcagactatctacacaaagacggatagcattagttacagcagcacatgtatgtagagttgtcaactgatgcaaaatatattatcagcgcacggagtggcagcagatgaacggcatccacggctgcttcttttctctggaaatcttgtcaacgtccttatgtggcagtttggctggggagctccaatggtggtcatcagggccagatttgcgtgaccccgatttcactgacaagttgttgtccttggtcacctggcgccggaacgacagcattcgttccttagtgctgggtttcttcacttggttctccatgcttgcctcggcgaggaggaccttcagcgggacacgaactcttcctgaattcagttgggcacctgtcgatgcaatctcttcattcatcttcttgttgcttccatcttggacaaccacgatgtttagctgctgcttctcttcaacgctgcttgtgctttcggctgcagcaatctcctttgcagtctgtgttttgtgctcaacatcgtttgcattaaaccgtgcattagtctcctttgcatcagtattttcagtctgcttattttcttcagaattccctatgttctgtactgcactcaactcctttgtgtcactagcattgtgtctcccctgccgcgtcctcggtcgctcccaccccattcatccttgcagtggtgccttcaatcaacttcttttcttcaacaatagctgcatatgtatcatttgctgtagtgttgatagcctgtttcatttcaatacaatcaatgctacatactgcagtcatgtcctttgcactagcatcttcggtttgcataatttcaacttnactgagtgcactgatatcctgcatagatattgtgctaagctctgtggaggctgcctgagatggcacaaaaatatcaccacttgtatgtccattttcctgcagggcatggtcagtcaagcaagtcttgttcaccagttcagaactactcctgacagtaatgtcttccggancaaccacttcaccattttcactggcacttgatgaagataatatgcgttcaactgcagaaatgccaacaaatttcagcataaaatgcattcaaagttaaagatctggtagaaaaacataaagtaatattgtgcctcaaaataaaatatcttagaatatggaaaaactgtgagactacaatacaggtctcagtgcacagtcaacttcagacgtgctgtttaaacttgcaaggcaatgggaattagataaactccctccatactatactactacagtactgcgatacttgatcaaccaaactagaaatgaagatgaaacatccatctctaggttaggtatgacgaatgctttctaaaagccatcaattaaattggcaaagaatgtgaaacagtggactttctttataatgcaacaatagtatgcattccctaagatatttgagctcacagaaagtaacaagctaaaaaaggggtatagaacagagttcatgagagcaaacttacatcaaacaatgtgtaattgaagagtcagaaattcttacttgagttatggcattgttgaacttcagccatcctaatttggttagagactattggtggaaccaccattcgggatgtagagtcaacttgttttctcgattcaacaacatttggtacctccaaaaagcagctctcagtgggaagttcaaataagtcgtcattcctgtcatcgtctagattaaatggattcttgacagaaggtactcgatccattagtaaagtgtcatgtttctgacccctagaaaatgagagaccgagctcctgtagggatctcagggttaatctgcttgttgcagacttcctctttagtgaacccgttagtcttctgtatggaaagattttcttctacagtatctgtctgtggcttctcatgaaaggtgaattctacatcgtccacatagtaac

SEQ ID NO: 23415 - DNA, 1850 bp, Zea mays
  misc_feature (374)..(375): n is a, c, g, or t
  misc_feature (388)..(389): n is a, c, g, or t
tttttttttttttttttcgttaatttcactttgcttcttttcgttgccgcaaaattaccagcaggccacaccgagcttaatccggtacaagattccaggcctgttcagtccacagaaacactagctgaatctgaacatcaggacagattcacgcgcaaatgtctaacaagtcaggtagcggatacatcaaaattgcactgattcaaaatatcagatactagattgcagactatctacacaaagacggatagcattagttacagcagcacatgtatgtagagttgtcaactgatgcaaaatatattatcagcgcacggagtggcagcagatgaacggcatccacggctgcttcttttctctggaaatcttgtcannacgtccctttatnngtggcagttttgggctggggagctccaatggtggtcatcagggccagatttgcgtgaccccgatttcactgacaagttgttgtccttggtcacctggcgccggaacgacagcattcgttccttagtgctgggtttcttcacttggttctccatgcttgcctcggcgaggaggaccttcagcgggacacgaactcttcctgaattcagttgggcacctgtcgatgcaatctcttcattcatcttcttgttgcttccatcttggacaaccacgatgtttagctgctgcttctcttcaacgctgcttgtgctttcggctgcagcaatctcctttgcagtctgtgttttgtgctcaacatcgtttgcattaaaccgtgcattagtctcctttgcatcagtattttcagtctgcttattttcttcagaattccctatgttctgtactgcactcaactcctttgtgtcactagcttgtgtctgttcttcaacataatatgtctcccgcaccccattcatccttgcagcggtgccttcaatcaacttcttttcttcaacaatagctgcatatgtatcatttgctgtagtgttgatagcctgtttcatttcaatacaatcaatgctacatactgcagtcatgtcctttgcactaacatcttcggtttgcataatttcaacttcactgagtgcactgatatcctgcatagatattgtgctaagctctatggaggctgcctgagatggcacaaaaatatcaccacttgtatgtccattttcctgcagggcatggtcagtcaagcaagtcttgttcaccagttcagaactactcctgacagcaatgtcttccggaccaaccacttcaccattttcactggcacttgatgaagataatatgcgttcaattgagttatggcattgttgaacttcagccatcctaatttggttagagactattggtggaaccaccattcgggatgtagagtcaacttgttttctcgattcaacaacatttggtacctccaaaaagcagctctcagtgggaagttcaaataagtcgtcattcctgtcatcgtctagattaaatggattcttgacagaaggtactcgatccattagtaaagtgtcatgtttctgacccctagaaaattgatcttctgtagggatctcagggttaatctgcttgttgcagacttcctctttagtgaacccgttagtcttctgtatggaaagtttttcttctacagtatctgtctgtggcttctcatgaaaggtgaattctacatcgtccacattagtaacaggagtatcatccatcttggtaacaggaagatcatcctcaaaaacggcagtgggacatctcaaagttttcttgctagaattctcaacaggttgactatcacctggaacatcctcaacactccagttcagtctggggagctccatggaacaatctgtagcagtattatc

SEQ ID NO: 23416 - DNA, 3940 bp, Zea mays
ccgcggtgggggcttcgtgtccttttctgctttgtttccattacatagcgcacggagcgaatcggcagcggttgcttcgcatggaaccctctgtacccgaggtcaagtcaatgctccagccttgagtgaagcaggaatctccaggtcctgttttggacaaggatgctcgtcacgagctgaagctgaaggccaccatgggccatggccaagctcgctagtcgctactagtacagtcgacttgcatggcgttgctctctgcagtgcagaggttttggagtgggatcaggggctgctgaccgttgccttttcgttgtcgagcttggattggctgagacacgctaaaatacacatggctatcaagtatcaacccatcgttcgtcttcggttgcaaatcggcgataaaagcgttccgctggtagtggtgggttgcatttctccttgttttttttttccttttggaataataagatgtgactagttgccaatattttatttgtctaggggttgttactattactactaggcatttctttcgacgagagaacatgaagggtaaaatactactcttcctattttaaaacataaggcgctttaacttttttaaacacgatacttttaatatataacctgacataatattacatatctaagtgtaaataaaaatatatgtgtaaaaaaagttaaaacatcttacaatttagaatagatataattttgggatacgtttgttgtagcgattaggataatcaatcgtattctaaaacgaattatctgcgacaaaaaataagatctattctacttgtgtaaaaaggcttaagaaacattgctccaacacaatactagtaccgtacacattccaaaattgtaaaatcgtttcagctatgtacggttagatttataactaagggcatatttagaagcattcagtttttaagaatctggtttacgaaaattaaggtagttttcaaacatactgctttatatctcagtttataaaaactggattaattctaatttcttaaaaaccaagaatctagcattcactagctaaagtcagtttacaaaagtttttataaacaagtttttagaaactatagatagaaaccaaattcttaaaaactatggccaacaggacctaagtctactgtctaattatcataaatttgcgaatataaataaaataaaattaataggtggtcaaagtgtatttttaaaaatgtgtcatgttatcatgtcaatgtgtgtcttatatcaaaatgaaggctgctcttggcccaggcggagggagcgatgggacgcacgaagtgtgaagcacccattggatcgagtcaatccatgttcggtggttctaaagctgtctccatgtctctagtagtgttacctaaatctcattctctaaagtagtattttatgtcttttactatatactctaaaagattattgtcttctatattttttcatcttcagcaacactctctaaatttcaaactctatatcaacagtattaccagattttatattttatattgttctaatacacgttagctctagtagtgtcttatattgttgtcttggaacaatgtaacgtaaatggtaattgtaacgatttgcgctcgaatactggcagtaacaaatttaaataaggaggtattcatttgtagtgtgatatcgattacagttggacttaaacaagcatgatctaacgttattgattactaattacattaccaatatgtgaatcaaacagcacctgaatgcattgcattgcaggcatggttggatagacaagtctttttttcaacacaggatgcaagatataaagagatatgatacgaagatgatggagagacaagatatgtgagtgcgaaaaatatatatttttaaaaaagctatctatcgagaaatatagttttttatatgttgcgtttatacgattttggtgcagcaacccatcgtagtaatccctaacctctggacccaccatcccgtcaccgtttaaatgttacgtgcacattgaccgactcccacagcaagtctccctcgcagtccgcagccatagaaaccatctgactcccgtcggcgagccgcgagaggcgcaacagaaggtgcgatctcttgctccagcttcccacttcccgtctccactcccgcccggctcgccgtcgaggacacgtgggtagaacaatcttgtctcctcctcttcccggtgcgtgcgatcgccccttttcgtgttggtggtttcactgcggagttccaggccgcttccgccctttcaggccgcgtggggaaggtgggttggtaatgcttcgttgttttgtggaggtttactgggctgacggaagggttttggggaggtttacgtgggggtgtcgtttggagaggtgctaataatagatgcgttggaattaaaagcgatgtgaagttttgggggtaatgcgcatgtcctatgatgattcatgattgatgaaagttttctgtctgtgaacgaaatctgttgccctgatctgttcatgctttagtgctttacctgactggcgtctgtttgttaatgccttttctattctaggagtgacgtttcatgtttcgcttctaaatcatgtttgtgcagctgtgctgctgcattgacgtgatttaggctcgtcgagggagaaatgagatgctttttagtttttacattataattctgtatggatcaaggtatcgaatcagatgcttcattttttttaaaaaaaaaagatcaattcccagcattagaaatttctggttgaggcttgagtgtttatcacccttatctttctcctctttcatatgctctttttttttgtttaaaatgtaacagtaataagagaaaaataaaatgtgtgcgtctgaagactgaacctgcctttatatcttgagctttgtatccctccctaatgactaattgactttgtcactacattgttgctgtagttgtgatatgcaccatggttgggagaactattcaggtccaaggttttgctctaactgacagtgccgaatctgtcaaattgtttttggagcgaattgctggtgctggaaccatctgtgctctcaagctcaggcatccaaggaacatctctgccaactcaagggcatttgctatagttcagttccagtcacaggaaagtgcttcattggtagagaatgcggctcaaagacaggttctcaagattggacggttttatctgagaaccagacctgcagaccgggacattgttccaagaccaaggattccaatgttttctctagaggacattgtgctgcatttgggatgcttggttaaggaaaatatcctatctgctctttttagagcaagtaatgtttcggttcaatttggatttgatatgaaaaagatctacttctacctctcctacaattttactaaatttaaacttgaactttcttacgtatcttcagcggggccggggcagctacaatgaagggtatgatcggccgcatcttattagcttcccatggtgcgtatatgacaagcttgtggccatcaagcaggggaggaatctcctcacgcagatggatcgaaacttgaggttccgttgagcattgccagcagggtttgctcttgtacatatccctgatcgtttgcaatcagcactgccagcaagtgtgcatgaacgatctgatgaattaagacgggcaaactgccgcaagctgacgctctggcgtacgtgcgtcttgaaactttcggatgctgccgtctagctaaatgcatgttccttgatttccactgggaccttgagtttgaagtgtgtaaatatatgctgcttatgatgtttttagtatttgacctctatcaactgccgttctagttagtaacaatggttgccagtcatggattctaccaggtttcgccgagctcctgtatggacgacgaccgcgaaggtctatttgtttcgttacc

SEQ ID NO: 23417 - DNA, 3605 bp, Zea mays
aggttttattgttgtagagttcatgtaggatgtgtttggttgtcttgctaaagcgtaggctgcgcaggactagtgcagggttccggcttgcctgctttcagtgctttgtggtgtgcactggtcgtttgtttggtttctggtcatctgcaagctggccactagtaggtggtgtttggttggctgttttacagcatgcattgcattaagcaatacgcagtagccactctggcccacaacaaaaagccagcgcgggctaacccaagcctgcacagttgggaacgcctgatttccctgtgcccgcgtatgcaggcaagaggccgctttttcactatttggggccagcatatgagagctattcgagcatccaaacaaccttgtttgcactaccagagactgttcacggagttgtgcagcgtaccaaacgcacccataaactcggtttttccatgttccaggttcaggcagctcctaaaatttataaactgctcccaggccgtccaggtcttatgtttgaggatcctttcttcaactggtttagggatgacacagatgaacaatggaccaggacaattgattttactccatcagctagcatcgggcaatcatctattttatgtctggaggtgccacaacagtgtgagcttccaagaattggcgactactttgtttactataaagagcagaatcttgactttgaatgtcggaatgggtattcatattcctgtggtagcaaccttgtaccaattgtgaaatctcctgattacatagaggtcccttatgagatactcttcaaaatcaaccatttggttcagaatgggacactcagtgggccaacagttgatcatagtttcttccgtcatgttagcccaaaatttgaacctattgatcatataaaacgagcacttttaaagatgacatatttgaaaagcacctgcttgaacccaacagattggttatctgtgcaatactccagaatacggaaatcacgccatgcatcacaaaagttatctaatatatctctggatgatggcttggtctatgtccacagggtgcaagttacccctgctaaagtgtatttttatggacctgagataaatgtctccaatcgcgttgtgcggcatttctctgcagacatagataacttccttcggatttcatttgttgatgaagactgtgagaagctccgttcagctgatttgtcacctcgatctacttctggaaatgatgcaaggagaactgctctgtataatagagttttgtcagtcctttcaaatggcatcaatattggtgacaagcactttgagtttcttgccttttcttcaagtcagcttcgagataactctgcatggatgtttgcttctcggcagggattgactgcgagcgacataaggaagtggatgggggactttcgagatatcagaaatgtggcaaagtatgctgcaagacctgggcaatctttcagttcctcaacagaaactttaaaagtacacaaatctgaggtggaacgaattcctgagcgtgcgtcgcgcccgaggtacatattctctgatggagttggaaagatctcagctaattttgcagtggaggtggctatgaagtgcaaattgaaacgctttgctccttctgtttttcagataaggtatggcggttacaaaggtgttgtcgctgtagatacaagatcaaatcataagctttctttgagaaaaagcatgtcaaagttccagtcagaaaatatcactcttgatgtccttgcatacagcaagtaccaaccatgcttcctgaatcggcagttgattactcttctctcaacacttggggttagcgataatgtctttgagctaaagcagaaggaagccttaaggcagttgaacagaatggtaactgaaccacaggctgctcgtgaagcagttgaacttatgcccatgggagaagtaaccaatgtagttaaagaattgttgtcatgtggctaccagcctgatcatgagccatatctttccatgctgctacaaacttttagagcatccaagcttctagagttgaaaacaaagtcaaggatattcatcacacaggggcgagcaatgatgggttgcctggatgaaacctgcacacttaagtacggccaggtattcgtccaagcttcttacagtgcagatgaccatcgcaaggtcgttgtaactggaaaagtagttgtcgccaaaaatccttgtctccaccctggtgacatacgggttctccaggctgttgatgttcctgctctgcaccacttgtttgactgtgttgtctttccacagcagggaccaaggccgcaccctaatgagtgttcagggagtgatcttgatggggacatatattttgtttcttgggatccacatcttattccaagtcgtttggtggatcctatggactatactccagcttcagcagaaacattagaccatgatgtcactattgaggagatacaggagtacttcacaaactacatagttaatgagagtcttgggattatcgccaatgcgcatgtggtctttgcagatcaggaacgtatgaaggctgagagtccaccgtgcgttcaactggccaagctcttctctatagctgtcgatttcccaaagactggagtgccggctctgattccacatgagctacatgtcaaggagtatcctgacttcatggagaaactcgacaaagtcacctatgaatcaaagggtgtgatcgggaagctctatagggaaataaagaagcacacaccacacataaagcacttcacgagggaagtggcaaggcggtcttatgacaccgatttgattgttgatggctatgaagattacattactgaggctatagagttcaaggaagagtacgatttcaggctgggtaatcttatggaccactatggcataaaaagtgaagctgagataataagtggatgtattctaaagatggcaaagaatttcaccaagagtagtgatgctgatgcaattagaatggcggtgagatctttgaggaaagaagctaggtcgtggttcaatgagatgagcacaggagaggatggccaagatgccatggaggccaaggcctctgcttggtaccatgttacttatcatcagcagtactggggcagctacaatgaagggtatgatcggccgcatcttattagcttcccatggtgcgtatatgacaagcttgtggccatcaagcaggggaggaatctcctcacgcagatggatcgaaacttgaggttccgttgagcattgccagcaggtttgctcctgtacatatccctgatcgtttgcaatcagcactgccagcaagtgtgcatgaacgatctgatgaattaagacgggcaaactgccgcaagctgacgctctggcgtacgtgcgtcttgaaactttcggatgctgccgtctagctaaatgcatgttccttgatttccactgggaccttgagtttgaagtgtgtaaatatatgctgcttatgatgtttttagtattggacctctatcaactgcctttctagttagtaacaatggttggcagtcatggattttgccaggtttcgccgaaaaaaaaaaaaaaaaaccacgaaggtctatttcttccattacc

SEQ ID NO: 23418 - DNA, 2566 bp, Zea mays
ggtagcaaaaaatttatcgaactctaaaccaaagacagaaggtttgaggaattggttcatggtttccactttactttacttaaggcagacaatatcagcacttaaaagacaaaataacatccctaactgaattacgccaagctagaccagcaaggattcaatggacacaaataaagacgactaaccgaaaaacaccgctcaattagcacccagcaaaaactgctgagccaaaaatggctgacaaagccacctagaacagtttgctgtagctatcttgaactgcctgatcaatactcattctcaccggccaaatcccaaactccgaatgaccctattctacgcatcagagacgattcgaccttggtggaccttcacagggcatatcatagcgaactcagggctcatcaccatttttcaacagcaagtgcccatcttctgtagaaatgcagatctccgtcacaacctgatggtactctctgtcagtaatctctctttttatatgtttcgcagcagcagcaacaacttcctgcttagtcaatgttccattgggttctttgtgacggaagagcaaaataaatatgtttcgtagagctcgcttatcctcatgctttgcaacaaaaacactatgaacaggaacagcaactagatgtatttttcgattcagctcatcatgaggcagcgatgcacaattttttgcagcattgcacagagcttgcagtttggatccatcctttctattggaagcatattttgcagccaactggcgcaagtctctaacaactgcctgcatgctgcgaactttattggcagtgaaaacagtgcccaaaacagatcgcgcaaggtcatcacttccttgagaagggccatccctgcccttgctcatatttgaatgaggccctttagaagcaacattaggtctggttgaattcatggtcttctttgccaaagtagtgctcatttctagggactcacggagagtggtctcccgagcagaccaagcacactcttgttcattgactatatgcggatagcgttttatgaaagacaaatctgccgatataaatttatggtccttcagaatttgacgtcttttacacaatggagacagtatccagtctctcatagcacgattgccaatcagattgataaatggttccagaatatttgatgggacgggatccctttttgtaaactcaagaagaattctatccatgggaccagaatatacaccatcaaacaacaaagaacttttgcagacccacaatccacgcaccaaatatgcacactctggaagcattttcaaaatttcaacctctgaacaggttggagcaaggtccttcagagcatcaaatcgatttactcctgaaacctcagtaaaccattttttgaggcgttcttccagtggtagcaaaagcatctcccttattgcttggaatttgttgatacgctttctgctagtagaggccccaggacacaaggacgtcaaataacaagaggagctcattgtgaaatcaataggcacaccctcatttgctatcatcttatcatggtacttagttgcagtattgcttcctgctggttggtagatgagagaaatccatggctcagactcttctgctcggtccttggaatcttcagggcgctcatttcccttatgagatgaatccatcgaggtactagctcccccattcatttcccggggttgtgaagcctgcctagtatgtgctcggccagaaataatatgtgacattgatggtcgcatttgcaccactgcatcaatatgattcaaatggaccaagttgccattaagaactccaaccgcgtaattagtaacatcaactgccttggatgacgatagtgtctgttttgtcagcctcaaaggtgcctcttggtcataattttcactctgtgtattgatactcaaatcaacttcaacttctgaactcaatggcttcacacgaacctcttcacatatctcatgtaactcatatgggcgccaacatggcctcagggggtactgcataatgtacagctgggtgtcgtcttcgaagggcttggggttgaagtacacatcgatctcgcgcaacacgaagtcctcctccaccgccccctccccatgtccaggagcgtccaccgccccgtcgacctccatcgtgtcctccggtgccggcgcggggttggcatcgggctccggcatcggaaccgcctctggctctggctccggctccggcttgggtacggcaactggtacgggtctgggaggctcagccttcggcctgggcttccccttggccttgggacggaagcgggtggaaggcgcgccgcccgcggcggcggatgtagcggccgtggcgtcgagggaagctaggtcggccatgtcgacgtctgcgtcaagcgacgggggcttgtcgttgtcgccggtggccatcgccgccgcgggatgctagtttcgtaggtatggggaggcggcgatgcctacggtttcgtgagcaggggtgtgcgcccggcccccctcgccgcaactgacgggtagggaaatagtaatccggccggcctcgaggtaccc

SEQ ID NO: 23419 - DNA, 2386 bp, Zea mays
  misc_feature (2371)..(2371): n is a, c, g, or t
  misc_feature (2373)..(2373): n is a, c, g, or t
  misc_feature (2381)..(2381): n is a, c, g, or t
taggggccttttttttttttttggttacaaagctgaaatgcattgaacttttctattacaaacagttacatgatttgtaagtgtttcctcttgcgagcgaaactaggtgatggcttacatgactgaacattctagcttataaatactctccttcggtatgaggaggtcaagtattgtttaattagattcaatcacggtgggttcagatccttcttattgtccacttggatctcagacctccaacaaatgagctttctcgttcagaatcgtcccagacccttcccatagctcccatagctcattccgtaaccatgacaagtactccctccggtgcatcaataatcgacgttctagctttgagtccaaagtgcacgataaattgacgtttcacgtggagcgaggagaactctcgattgacgcagcaagaagtaaattcaccagccgtccgttggccttctccacgccatgcatttgcatgcaaaatggtaaaaaatttagtattgcgtgagtcaagaatcgaacctaggcctcctgcctgggaaggagtgaagatgaccactccggctattaaagggatttgactaggaatgaaaaagtgtggtatttattagttccttggtatgtgagaagctgtccaaaacgtcagtttttggtacaccggagggagtacatgacaggtcccagtgtcgatggcaccaggtacagtaaggctggttgaggagactgagacaagatcccagcagctagtgcagctaccaagccaataccataacctgttacagcataccacacataattccgccgttttgggggagacacatctggtggaaaattcacatccttgaacttccgattatcaaaaaagagtaccagagctagaagcatccctggaatggccatgtctccaaggccaagcatcatgtagtcaccaggattgcttcctggaacaatcccacccaacaaattccttggaaatacaagcttgactggaagctccagcttctttgtaatcaattgcaatccgggcaggctgagcttatttgctactgtgtgaacaggattagatgccttctgggtggcaacagaaaccatgacatttgctccaaagaacctttctgagaagaacacccagaaaatatcatacacaaacaagcaggcaagaagcagcgcacagatttttatgttgggaagcctcacatggctgacaaacgctatacatatggaaattcccagtaggttatttagcaaccaatgcccagaaaccaaccaggctaagactgtggctatgcagaagagcatcagcaaaccttgcaaccgtgtaaaagactttgaacaacacctggacacgaatgggtccattagattgaactgcatcttgagataagtgacatacggagacaggcaaaagaacagtgccatcgcagaggccacagcagtaaaagcagtcacaagatgtgagacagacgagaacaagtagaacatcagcaacagactgcatgagcttgcaaggggaatcattagtgcctgtgaccgatccaatgtaatggaagcctctgaaaaatccaagtttctctccatctctttgccataatctagagcacgcgatgcggatgcataggccacagagatagctgtggcaatgagagcaagtgatgccggctcgagcaagtaggtcagcttccacaaggattccatcctatggaaaattaataacagtccacccttattctatgctctgactaccaaggtatcttcaaccttgggtagtccaatttgggggaggggggcaaactaaaatggatcttgcgccggcagagggcgaataacctagctggatggtttggagttcctcaccgagtaaggaagaaatcagtccaagatggatctccacatctttccgcgtcacggcatgccagtgcaaaatcagtagaggcagctcgcggggaggaaggttaggcctgggagagaagatttgtgtggttgggtggaagcacgcgtgcgagatggcgtcgtggtcgtccgaggtggaccggtccgcgtggggttggctagagtggggatcggagtcagtgcccggctgcggcttccctcttccgactgccttgcggccgtttccgactgtagctggcggtataggcagtggggcgggggcggctggccggcggccgcgctgcgctggctcctcgcatcccctggcagcctaagccaggagactggcggcgccgtagccgccggtagtcgattaaccctcggagattgcgattgcaccggcggattgggcgtcgggtgggcggctgctaggttcggcctcggcagtgtcgagggacggtcggacggaaggagaagaacgggaacgggggatggcggatgngnatcggaangaaac

SEQ ID NO: 23420 - DNA, 1786 bp, Zea mays
  misc_feature (1771)..(1771): n is a, c, g, or t
ggttttttttttttatttgcattgaactgaacctttctattacaaacagttacatgattcacgatgggcaactgcttagtactgtctccgttcttttttatttgtcgcggtctagtttaaaaatgaactagtgggcaacaaatatttgagaacggagatagtagctcacatgcatgaatagaacactcagcttataaatactccctttcagtatgagctcaagtaatgtttaataattaattaagattcaatcccggtgagctcagatccttcttattgtccacttggatctcagacctccaacaaacgagctttgtcgttcagaatagttccagacccttcccatagctcccacagctcattccggaaccatgacaagtacatgacaggccccagtgttgacggcaccaggtacagtaaggctggttggggagactgagacaagatcccggcagctagtgcagctaccaagccaataccataccctgttagagcataccacacataattccgccgtctcaggggagacacgtctgatggaacaacgttcacatcctttaacttccggttatcaaaaaagagtaccagagctagaagcatccctggaatggccatgtctccaaggccaagcatcatgtaatcaccaggattgcttcctggaacaatcccacccaacaaattcctaggaaatacaagcttgactggaagctccagcttctttgtaatcaattgcaacccaggcaggctgagcttatttgctactgtgtgaacaggattagatgccttctgagtggcaacagaaaccatgacatttgctccaaagaacctttctgagaagaacacccagaaaatatcatacacaaacaagcaggcaagaagcagtgcacagatctttatgttgggaagcctcacatggctgacaaacgctatacatatggaaatccccagtaggttatttagcatccaatgccctgaaaccaaccaagctaagactgtggctatgcagaagagcatcagcaaaccttgcaaccgtgtaaatgacttcgaacaacatctggacatgaatgggtccattagattgaatcgtgccttgagataggtgatgtgtggagacaggcaaaagaacagggccaatgctgaggccacagcagtaaaagctgtcacgagatgtgaaacagacgagaacaagtagaacatcagcaacagactgcacgagcttgcaaggggaatcattagagcctgcgaacgatccaatgtaatggaagcctctgaaaaatccaagtttctctccatctctttgccatagtccagagctcgtgatgctgatgcataggccacagaaatggctgtagcaatgagggcaattgatgccgggtcgagcaagtaggtcagcttccacaaggattccatcctatggaaaactaatagcagtccactcttattctatgttttgacttacgcagatatcttccacctgccactggtggacgcgccgcaccttgggtagtccaatggagggcggacaacccagacggatcttgcgcaagctgaggaacctgttggacctagaagggtggttttgagttcctcaccgaagaaggaagcaataaatctaattttagctggatctccacgtcacggcactgtgcaaaaccagtagaggcggcgcaggggagaggttaggcctggccgcctggcagaaaagacttatgtggttgagtggaagtaggcgtgcgagatggccgtcgtggtcagacgaggaggatcggtnctgcctggggttgac

SEQ ID NO: 23421 - DNA, 442 bp, Zea mays
ttttttttttttttttccgcaagttcgttcgatcgattaggattaggattacgtatacgtacaacatgtaggaggaggatcggagtagtacatgcattgcacgcacgcgcgcggacaatgcaagtgacggacacccggaagttccgagctgcacccatgctatgcacttgtatatctacatcaccagttcaccactcatcgccatacgtacagctgatcgatcgatcagtcggtcggtcgtcggcgtcggcgtcgtcattaaccatgcaactcctcctcctccccctccatagttgtccgattggattacggtgcctctaattacgtaacgtgatcctgagcccctccaccccacccctttgcacatgcggacgcatgcacacacgtgcgcgcgcgcgctctactgtgttccacttcgttccacgcatggctaggggggggg

SEQ ID NO: 23422 - DNA, 1154 bp, Zea mays
attgcctatcaaccgctactcacgccgtactgtctgatcggcaacacctcgtgtacacgtaggcccggagatatggcggcatcgccggtggccatcggcacggcggtgttccagcgggggccactccgcgtggaggcgaggcacgtcgactacagccaggtccccagcgtgcccaagccgctcatggtggtcgcccccaccgacgccggcgtctaccccgtggccgtcttcctgcacggctgcaacacggtcaacagctggtatgagagcctcctgtcgcacgtcgcgtcccacgggttcatcgccgtggcgccccagctctactgcgtgacgctcaacatgaacgacttgaaggacatcgacgccaccaggcaggtcaccgcctggctcgccgacaagcagcaaggcctggcgcacgtgctcgccaacatcctccagctccacggcgtgaggccggacctctccaggctggcgctggccggccacagccgcggcggcgacacggccttcgccgtggcactcgggctcggacccgccgcctcggacgacgacgacaacaacgcagacgcaggcacatcgccggcggcgttgccactcaagttctccgcgctgatcggcgtggaccccgtggcggggctatccaagcaggcgcaggtggagccgaaggtgctgaccttccggccccggtccctcgacccggggatgccggcgctggtcgtcggcacggggctcggccccaagcacgtgggcgggccgccgtgcgcccccgcgggcgtcaaccacgccgagttctacgacgagtgcgcgccgccgcggtaccacgtcgtgctgagggactacgggcacatggacatgctggacgacgacggcgtgccctacgtcatcaacaactgcatgtgcatgaggaacaccaaggacaccaaggacctcgccaggagggccatcgggggagccgtggtggcgttcctcagggccacgctggaggacgacgacgaggatctcaaggtcgtgctcgagaaccgccctggcctctcgccggcggtgctggacccagttgggcatgacttggcttgaatagcaaggctggcggagtgtgctacattgtcgctccttatttacacacacataccacatgtttcttttccattttgtgc

SEQ ID NO: 23423 - DNA, 2269 bp, Zea mays
gtgcatgtgacttgtgttttcacaggagcatcgagtaagaacgcggcatggctctctatcggtttctgtgtatggagtcgtaacttatccggctgtagccttgaatcgtgagtgcctttgttgcctctagaatttgtttcttggtgtaaagacagcaagctctgccgtggacacagcaacttacattggtgggattcttcctgtgtggtagacgagtcatgattccaaggattgtttctgcctttctgggtgtttccacatcacaccccaagggtgacgtttgattccttttttcatgcgttgattaattcaggcaggcacgctgatggcatcagccatggcaccgcctcaccattcaagcagtcacggacaactgatcccctttttaataagctgaaacgcattgaacttttctattacaaacagttacatgatttgtaagtgtttcctcttgcgagcgaaactaggtgatggcttacatgactgaacattctagcttataaatactctccttcggtatgaggaggtcaagtattgtttaattagattcaatcacggtgggttcagatccttcttattgtccacttggatctcagacctccaacaaatgagctttctcgttcagaatcgtcccagacccttcccatagctcccatagctcattccgtaaccatgacaagtacatgacaggtcccagtgtcgatggcaccaggtacagtaaggctggttgaggagactgagacaagatcccagcagctagtgcagctaccaagccaataccataacctgttacagcataccacacataattccgccgttttgggggagacacatctggtggaaaattcacatccttgaacttccgattatcaaaaaagagtaccagagctagaagcatccctggaatggccatgtctccaaggccaagcatcatgtagtcaccaggattgcttcctggaacaatcccacccaacaaattccttggaaatacaagcttgactggaagctccagcttctttgtaatcaattgcaatccgggcaggctgagcttatttgctactgtgtgaacaggattagatgccttctgggtggcaacagaaaccatgacatttgctccaaagaacctttctgagaagaacacccagaaaatatcatacacaaacaagcaggcaagaagcagcgcacagatttttatgttgggaagcctcacatggctgacaaacgctatacatatggaaattcccagtaggttatttagcaaccaatgcccagaaaccaaccaggctaagactgtggctatgcagaagagcatcagcaaaccttgcaaccgtgtaaaagactttgaacaacacctggacacgaatgggtccattagattgaactgcatcttgagataagtgacatacggagacaggcaaaagaacagtgccatcgcagaggccacagcagtaaaagcagtcacaagatgtgagacagacgagaacaagtagaacatcagcaacagactgcatgagcttgcaaggggaatcattagtgcctgtgaccgatccaatgtaatggaagcctctgaaaaatccaagtttctctccatctctttgccataatctagagcacgcgatgcggatgcataggccacagagatagctgtggcaatgagagcaagtgatgccggctcgagcaagtaggtcagcttccacaaggattccatcctatggaaaattaataacagtccacccttattctatgctctgactaccaaggtatcttcaaccgagtaaggaagaaatcagtccaagatggatctccacatctttccgcgtcacggcatgccagtgcaaaatcagtagaggcagctcgcggggaggaaggttaggcctgggagagaagatttgtgtggttgggtggaagcacgcgtgcgagatggcgtcgtggtcgtccgaggtggaccggtccgcgtggggttggctagagtggggatcggagtcagtgcccggctgcggcttccctcttccgactgccttgcagccgtttccgactgtagctggcggtataggcagtggggcgggggcggctggccggcggccgcgctgcgctggctcctcgcatcccctggcagcctaagccaggagactggcggcgccgtagccgccggtagtcgattaaccctcggagattgcgattgcaccggcggattgggcgtcgggtgggcggctgctaggttcggcctcggcagtgtcgagggacggtcggacggaaggagaagaacggg

SEQ ID NO: 23424 - DNA, 2373 bp, Zea mays
  misc_feature (5)..(5): n is a, c, g, or t
ctggntacacacacacacgcacacatacccctctccccatgcaatgaattgtctcactgtcacgacacgagaaggatgacacacacagcactatatcctatatgtgcgcgattgaatacgcgagaggacagttcgttgcacccgccatccagcgagcataaatgaggcgcattcaaactcgacccttgcaccaactcgatttcgactccgctgccgaatcagctcgcgctaaatgaatatgcattcaaactcgatcgaccctggcatgcgtcgggtacgtacgtagtactgcacaccctagctagcttggtgtgcacgacagcgtcggacgatttaatttataccaatatagcgtaaaatttagagccattgtcacttatatatattacaaatccgattcaaatatctggacaacgcagcagcggtcggccacagagcggtgtgttttcctcgcgagaagccgaggcccgatcgttcgagagcgtcccgatgcagcagcaccgtcgcgtacaggggggcgcgcgcggcgccaataaattattcctgctgaccaacggccaaccaacttcccgcatcgagcagagaccggtcgcgacgagttggaatactagtacatgtttacagtacgtgtacatgcatttttttttttttttaacgccgaaagttccgagctacatttatgctatgcatgcactttatgatatctacaccaccaccatccatccatcgccacatgagtaataacattatgacacgatataccccttggcgaaccgtacgtacgtacgcacgcacagccgatcggtcggccacgggcataggcgccgccactactgatcaactcctctagctagctaccacaccatcctgcctctgattgaatattacgctgtgtcttccttgcacatgcgtgcgacacacgtgcgcgcgttctactggtgcacgcatgcctgctggggagccagcccatccatgggtcgttgggacgctttggtctctagctagtccctgcagcagagcagctggaggccgagcttgagcggcggcggaggcggcgtggcgcggctgggtgggtgcaggaacttgcagttggggcacgccgggctggcgcggcacatcatcaccagcatgtggcaccgcacgcacacgccagccaccatctccctactgctactgctgctgtcgctgtcgtcgtcgtcctcggcctcctcctcctcctccgcgggctgctgcttggccctcttcgtcgtcttcccgtgggcggcgagcacgcggcgcggctcgaacgtgaggttcagctccaggtccagccctggcggcgcgcaataattcgcggagtcctcctcctcctcctggccttcttcggcgcggtagtccggctgcccgtcgtgccccctggggtccttgcacgtccgcttctgcgtcctcgtgttgtagtagtggatctgccccgacttgatgtcgaggcagcgttgccactcggggggcagcggcgcggcgtcgaaattgagctcgatcccgtccacgacctcgccacggtcgtcctcgtcgccgccgccgccgctgccgtcccgcttccgcttcttgctggtggccgcggtaccggtggaggaggcgacgacgctgccgacgagggagagccacggcgggagcttgttcgcggtggcggcctccggcaggagcggcgccgctgatgagggctgcagagacaccatcgatcgatcgacgatctcgtcctgctgctgctatatgtgaggaggctaggctacacggcttcggccgggctgctctgctagctagctagctagctgcggcgcggatatttatatatatgtaagtcgttgttgcaccctcgcggtcggtgcagcaagagtggtagcgtactttggctgggtcggccggcccccggtcgcaactcgcaacctccttccctggtgatgtttagtactctgcggatacgagtgggggcgagatgggtttttggattcgggcgcagcgaggggtcggggtttatatagggggggagaactggcctgagagagagggtggacgtcgacggggggacggaaatttatgagcacagaagtggtagccaggatctttaaaaggggggacactgctacggggcccacgagatgttcacgcagctacttacacattactgctggtcaggtcgggtcagggtccgctactccgctccgcctgcatcgcattccatcttcgattgcgtttgcgtgtcatccggatccggggccatcccctgctttaaccgctagctggccgcctgcctgccgaggcgggctcgatcggtgctccgctccgctcccggctctccccgcgcgggcggggcacgcgttgccattactgctgcta

SEQ ID NO: 23425 - DNA, 1256 bp, Zea mays
gcggccccggggagatcgagacagctagcaagcaacaagcaagctgaaatggagcgctactcttgctgccgttgggtgcttgcgtgttctatccttgccctgtgcctcggtgggcagggcgcgaggtgccagctgacgtcggatttctacgacagcacctgccctcagctgtactacgtcgtgcagcagcacgtgttcgacgccatgagagaggagatgaggatgggcgcctccctcctcaggctgcatttccacgactgctttgtcaatgggtgtgacgcttcgatccttttggacggcgacgacggcgagaagtttgcgctgcccaacctcaactccgtcagagggtacgaggtcatcgacgccataaaggctgacctcgagagcgcgtgccccgaggtggtgtcgtgcgcggacgtcgtagccctcgcggccagctacggagtactcttcagcggagggccttattacgatgttcttctcgggaggttggacgggcgggtggccaatcagtccggagccgacaacggtttgccgtcgccgttcgaacccgtcgactcgatcatccagaagttcgccgccgtcggcctcaacacgaccgacgtcgtggtcttatcaggagcccacaccatcgggcgagcccggtgcgcgctgttcagcaaccggctgtccaacttctcggccacggattcagcggacccgacgctggaggccagcctcgccgacagcctccagagcctctgcgcgggcggcaacggcgacggcaacgagaccgccgcgctcgacgtcagctccccctacgtgttcgacaacgactactacaagaacctgctgacggagcggggcctcctgtcctccgacctgggcctcttctccagccccgaaggcgtcgccgccagcaccaaggatctggtggaggcctacagcagcgacggcgaccagttcttctacgatttcgtctggtccatgatcaggatggggaacatcccgctcgccgccggctccgacggggaggtccgcaagaactgcagagtagtcaactaaatagcatgtggcgatcagcaaatttcgatcgccgttcactgttatttatttattgtgtgtgtgtgtgaggggtacttgaactgttaagagtcacctatatatgtaatgaaaggtttatgggcgcaacgttgagcagctacatgcttacgaagatgaggaataagaattgtacactgccaaattggtcccacaataagaactactatgagatc

SEQ ID NO: 23426 - DNA, 1399 bp, Zea mays
ttttttttttttttttcttttgctaagaatcagttattagtcttcgcatgtgggcaactataataaatcaataaacgacacagtagtcacgagacatgtaaaacaagaggggatgtgaggcattttttcttcagcatacaccagttgatccactaatcaacaagccgtccatcgctccagaaactaccagctctaggcaaagttgatgtcatacgccttactgccgtccgccctgaagatgccaaagtggcgctcgaactcggggccgggcttgccgtcctcgtcgtacaagtcgaacaggaacacctccacgggcacgccgggccgcttcggcgtgccgacgccgcgcgccgccctctccacaatcttggcgttgtacgctgcggcgttctgcggggtggcggccgggtgccccgcggttggccacccggtctcggtcaccgcgaccggcacgccgccgaacccctccttctccagcgcggccaccagcgcgtctaccgtggcgtcgaacaggttcgtgtacaccagcgcgccgtcctgcaccggcgccgcgcccgctccgaagagcgcgtacgcgagctgcacgttcgccgggtcgttcacgtggctgatgaaagggtaggcgttcaccatgaagggcgcaccggtgtcggccaggaaccgcagcatggggcggaggacggggagggaggcggcgtcgaacgcgccggcggagggcgggtacgaggcggccagcaccgaggaggcgtgcgcggaggagaccttgaccctgccgtccagccccagggtggcgagcgcggcgtgcaggttccgcatggccggcacgaggtgaggcgcatagaactggttgttgtacagcacctcgttgccgacggcgaggcaccggacgcgctcggcgggggcgtgggccaggaccgcggaccgcagccactgcgccgcgccctcgggccccgccgcggccaggaaggtgaggttctcgttgggcacgcccaccatgaggtcgatgcccgccgcggcgaaggccgggagcacggccgggtccggcaggaagagccgcgccttggtgatcccgttccgcttgagcagtgccgcggcggccgacggcggcgggaggttactgccaacgcggccgtggcagatgccgatcttgcccgcgtcaccggccgccgccgccactgccatcgacgcgacggcgaggaggacgtggccgagaagacacaaggctattctcgtggccattggtgaaggaaagaaggaaggaagaatgccacgctttggttgtgttgtcgccgttaaatagattctgctttggcaagaattgtatggttctggttgcttgtagttgtagttgtggcagatcgaggaagttaaggttgagacttgaggatgggctttgtgg

SEQ ID NO: 23427 - DNA, 1314 bp, Zea mays
gcttgctcgctaacaatcagtgaactgaacaccttccgcctcccggtctcctccctgcccggtgctgaagaaccctgccatccccggaactggatcgatctgccgccaactctgaaaatccatccgatccatctctgtcgtccaagtctactccccgatggacattatttaccaggacagcagttgtcttgccctagagcaggcgctacatgatgaaggcgtgggaccaatcgacctacctttcatgcttctcagggccatcacaaaagatttctctgatactcaactaattggcaggggtgggttcggagaggtttacaaggtatgcatggggtatttggcacctgaatttctgagcagcaatgcaatcacattcaaggcggacatatacagtctaggtgttataatcactgagattctgacggggcataaggaatgcaccagtgttgacaaggtgcttgaaagctggacggacatgtttcagacattaggaagccatccgctactagaacaagtagaagtatgcgctgagatagcgataaattgcatgaacgatgacccgagcaacaggcctaccatacaggatattatctccagtatcgatgaaacggacgctcgaagtgtcacaagttcttcaccaggagggcaggttattaccatggccggcagcgaaagcagcagcagtaggagcaggtcgccatgcgcgtcgtgcaggatgctgcgccagcagtgcacacaggagtgcgtgttcgcgccctacttccccgccgaggaacctcacaagttcgccatcgtccacaaggttttcggtggcagcaatgtcttcaagttactgcaggagctgcctgcccaccagagaggggatgcggtgagcagtatggtttatgaggccaacgttcgcaccagggaccctgtctatggctgcgtgggcgccatctccgtgctccagcaacagatctcccagctccagatgcagttctccatggcccgtgctgagatcttaacattgcagcaacagatggatgtcaatgatagcctacccagtcaaaatagctttgacagatatggcaatggtgatctgaaacctgactccccgcccgaaattctttcatcggaggatgaggttgaggaagtttcttccccaatgtctccatagagatttggatttttccattataaagaataggcttcacaaaattgccactggtctcgcatttcatagactcagatagtcagatggacccatcgttcataaactaagtgacaattataatcaaagagatgatctttcgagtggtaaaaaaaaaaaaaaaa

SEQ ID NO: 23428 - DNA, 1278 bp, Zea mays
  misc_feature (8)..(8): n is a, c, g, or t
  misc_feature (13)..(14): n is a, c, g, or t
tcgaggcncggcnncgggccgggatacgaaaactaaaagtgcagctagctgcattatacgtgctcggccggcccaactggcgaggctctcccatctcaatcaaatctacaggggagtagctcttgctcttggcttcgctggctaacaatccgtgaactgaacaccttccgcctcccggcctccttctccctgcccggtgctgaagaaccctgccatccccggaactggatcgatctgccgccaactctgaaaatccatccgatccatcctctttgtcgtccaagtctactccccgatggacattatttaccaggacagcagttgtcttgccctagagcaggcgctacatgatgaaggcgtgggaccaatcgacctacctttcatgcttctcagggccatcacaaaagatttctctgatactcaactaattggcaggggtgggttcggagaggtttacaagggagtgcttccaaatgggatggtcgtcgccgtgaagaagcttcttgacaagatcgatgtcctagaggcgaatttccaaagcgaggttgcttgtctcatagaggtcaagcacaggaacatagtccgatgtctagggtactcatccgagacgcaacatgtgagggcaccgtacgaaggaagatttgtctgggcagacctgcgccaaaggttgttttgcttcgaatacctaagcaaagggagccttgccgattgtctgaccggggcatcttttgcacttcagtggagtgtgcgctaccaaataatcaaggggatttgtgagggtgtgggttatcttcaccagcacaatattattcacatggacctcaaacctcaaaatatacttcttgacgataacatggtgccaaaaatcgcggattttggtctgtccaggcgcttaagtgaaaatcagagcaggatcattactaaaacaataattgggacgccggggggcttcccacctacctctgtgacctcctttttgatttgtcaacagctcagttgaatacccgttatttgatttaccactcactacatcaatattttttattcttcacgcagggggtatttggcacctgaatttctgagcagcaatgcaatcacattcaaggcggacatatacagtctaggtgttataatcactgagattctgacggggcataaggaatgcaccagtgttgacaaggtgcttgaaagctggacggacatgtttcagacattaggaagccatccgctactagaacaagtagaagtatgcgctgagatagcgataaattgcatgaa

SEQ ID NO: 23429 - DNA, 4654 bp, Zea mays
cgaattcgcggccgcgtcttgagtttttttttttttaaggaaacctttgtgctttacttccaatatcgcttgcatttgacaagtcctggtaaaaacgtacagagaacagaaggaaacctctgtgctttttccaatttcgcttgcactcctgataaaaccacactgtacagagaataaaaaggaaccttccagcccaaaccaaagaagcccactctctctctctttttttccctgtttggcggacaaaatagaaaacgaagcccacttattaaaccccaacagcggcactttgcgctttgcactccaagaaaaagcttggcctatatttcatacgtgatgccaaccttgagcagctggtctttgggaatggccagcgccttgtggccctcggtcaggttcttcctcaggaacgtgtagatgtagttgaccactatcttcttgaggacggacgagttgggccccgccgacacgttggcctcccccatcaggtacaccacccctcgctccacctcccggtcgatgagctgcttctcctcctccgccgtctggctggcgtggaaggtgatccggcccgagtgcgtgctccccctcgactggatcgcctcctcgctgtgcacgacagagcccgtggaccgcctgggcggcctcggcggcgcctggtggtccgtcgccgcctcgtcgtcgttctccgcgtcgttctgcgcgaacgcgacctcctcctggatgaacatcttgagcctgtcggccaggaaggacgcgaagtccttgggctcctccagcgcgtcgctgtagccgtagcgcgcgacgcagcggaagatgcgctgctctctgggcccgacctgccggaacaggaacctctccgcgggcagcacgtgcgggatgggcaggtgcttgatggacatgaagaggaagatggagtgcacggacgggatcttcttgatgagtcgggggaacacgggcgggatgccctggaccagctccgtgtacaggagccccaccccggggatccgccgcacgtcgttcttctccagcagcgccgtcatctggttggtgggcacgatgtggtccagctcgtaccagtaccgcttcacgtggacgtagtgccacgtcgccatcagcgtcatgaggaccagcgcgaagcagaaggggaggtagccgccctggatgaacttggacaggatggacgagaggtagatcatctccgtgaggccgaacaccacgtagaagaggaggacgtagacgatgtgcttcttccatatgacgagcatcaccacggtcatcaggtgggtggtgatggagaacgtcggccacacgctgaaccctgcgcgcgccagccgccccacgacgtcagcttcgatcgatcggtcgatccaaggcaggcaacacaacaatcgatcccttaccgtatgcgttgccaatgctggtggtggtcctgaaggcaatggtgacgatgatgctggccagccccatcatgaagttcacctccgggatgtacacctgcccttcgtacttcttggaggtgtggatcacttgcaccctggggagacagcccagcgacaaggccttggagaggatggcgaacgcgccagagagcatcgcctggcttgcgatgatggcagcaaggattgcgatgatgaaggttggccagaacagaggtgctgcggaattgaacaaacgtgtcagttagttgggcctttatttattattgatgtgaaagcccattgttctatggattatttaaacctgggatggatttgtagaaggtgtctccgacgttctccgggaatttccgcaggtacgccgcttggccgatgtaacacagtaccaccgatgggaacaagatgccgttgaagctgatctgcaggaggaaaataatacacaagcgccattgtcagattacaaggttgtgttgtgtcttgtgtgacacatctggctctggcctctgggtcaaattacaagtttaattaggtcttgttcttggccattatatatatattacctgaacggcccggatgttgaagtgtcctaggtcagcaaacatgccttccgtgcctgtcgcggacattgagaattcaggtcgcatgcatacaaaaatgccaaggatttgcactatgcagttctctcttttgtggtcagggcaaaacaaaaacaaaaagggggggaggaggcggggtggttacctgtgacacacaagatgacaccgccaagcgaaacccacccttccttcccgttccgtttgaagtactgcacgatgtaccacgggttgaaggcccgcagcacgccgacgtcgtggacgacgaggttgtagagcccgatgccggcgatgaggacgaaccacaccgagatgaccggggcgaaggtgtagccaaccttgtcggtgccgaagcgctggacggagaagagcaggaagagaatcgccacggagatccagaccacttgcgctgcagcaaattaaaaatagtcatatatgcagttggtcatgcattgaccatgccagcaggcgctagctcttcgattatattccacgtactctgagtcaggtttggcgccttctccttgatcccgctcaccgcagacagcactgcagaacacccacatccatgaacaaaggacacattagttagatagttagttagttactccatgccagtaactagctagctagatgtttccgttattaccagatattgacggcgtaagggtgccgtcgcccatgaccatggacgtgccgaggatcgtgagggtgaagagcaggatcttggctgccctgctggactcgagcttctgcttgaaccactgcgccctcttcagctgcgaggtcggcgcttcgatgctgtagttggacaccatggcgtcctccgcctgctggttggggatcagcctgatcttggcgtaccgcgagatgagcgagtagagcgcgaacgtgccgcctaggggagagagagagagagagagaaaagcagcagatcgatcagtgctcgtgtcgttgatcagtaaataaatacaaagaaatatactctgctcaccgtctccgttgtcgttggcgtagagcacgacgaagacgtacttgagcatggggatgatgatgagggtgtagatgatgagcgacagcacgcccagcaggtcgtcgttgtacttgatgccgtcggggaaggtgctggagtagacgtagagcggcgacgtcccgatgtcgccgtagatgatgcccacgctctggaaggccaggtgcagcgtccgggcccagctgccctcggacccgtggtacttgccgccggacaccttctccgcgtcgccgaagagcgagtcgtggcgcttcaggctgagccggttggccgactcgccgccgccgcctgctcctccagctgggttgtccacctccagcgacattatcgcccgcctcggttgggtgggtatccctctccccaagtacgtcccaacgccttggaacgacggatcgagtagtctgtctgctctctccggagagtccccacgcgccctaatcaatcaagccgcgccagctgattcccaaggctgtttggtggcgtgactgctgatccctgtgacagcgaagcaacgactttgtgtcacattcacatttcgcaacagcatccgtctttgggtgtagttaaatcagcagcacagctgtgcgaaacaagttctttgggtagtactatcgatctgactgacagtcgggattttgtcacgttgccagtgaataatccgcgtggtgatggtgtcattaatacttggcgaaatgctacggcatgtatcaattctacaaccacaattgcctggatccagaaaagaaaccacccgcaaattattaactggcagcgcgtggagtgagagaaacagcagcgctatgtggtctggtcaacgcactagtgggctccagacgtcagtcacagggaggcgactccaaacaaaacacagtgaaggcgacggcgtgatggagcggccgagagctggaatcagccgccgcccaccaccccccatttcatcctccaaaaaaaactgtgacgtcatacaaaatttcccctgacctgttattattattattaattagtaattaaagtactatctcagctaatcagctgtgcacaccaacccatctgacaagaaatttgagctgcacgatccggaagctgagttgttaatgtatatttcccacggatcgcctcgggtcgtgtacactgtacaccgaccctcgctcggtgccaaaaggcaaatacgatatagtacataataaactaactaaacaagattagtttaaggggtaatcaggccgtaaacggacgccattggaggtacccttgacctcgatgctacgaccttcaacgctcttgctgacacgtgggcatcatgagcgctcagggcgagcatcaacctcctcttcttcttttttacccgctgctgctactagcgactgacagagatttttggcggagagggtgtaaacgaaggccagggagccattcaatttccacacgcaatctcttggtgcacgatcttttatttttttcttctcttgtttctggatagatgatctgaactgcatatcgagatggagactgtgggaaaggctaggaagaggtcccttgcgtacgactgcaacttccaaacaggcttgtgcgtgcccggggggggggggggg

SEQ ID NO: 23430 - DNA, 2154 bp, Zea mays
  misc_feature (22)..(22): n is a, c, g, or t
  misc_feature (238)..(238): n is a, c, g, or t
tgatgaggcggggaacacgggncgggatgccctggaccagctccgtgtacaggagccccaccccggggatccgccgcacgtcgtcttctccagcagcgccgtcatctggttggtgggcacgatgtggtccagctcgtaccagtaccgcttcacgtggacgtagtgccacgtcgccatcagcgtcatgaggaccagcgcgaagcagaaggggaggtagccgccctggatgaacttggancaggatggacgagaggtagatcatctccgtgaggccgaacaccacgtaagaagaggaggacgtagacgatgtgcttcttccatatgacgagcatcaccacggtcatcaggtgggtggtgatggagaacgtggtcaccacgcagatcccgtatgcgttgccaatgctggtggtggtcctgaaggcaatggtgacgatgatgctggccagccccatcatgaagttcacctccgggatgtacacctgcccttcgtacttcttggaggtgtggatcacttgcaccctggggagacagcccagcgacaaggccttggagaggatggcgaacgcgccagagagcatcgcctggcttgcgatgatggcagcaaggattgcgatgatgaaggttggccagaacagaggtgctgggatggatttgtagaaggtgtctccgacgttctccgggaatttccgcaggtacgccgcttggccgatgtaacacagtaccaccgatgggaacaagatgccgttgaagctgatctgaacggcccggatgttgaagtgtcctaggtcagcaaacatgccttccgtgcctgtgacacacaagatgacaccgccaagcgaaacccacccttccttcccgttccgtttgaagtactgcacgatgtaccacgggttgaaggcccgcagcacgccgacgtcgtggacgacgaggttgtagagcccgatgccggcgatgaggacgaaccacaccgagatgaccggggcgacccgggggccccccttgtcggtgccgaagcgctggacggagaagagcaggaagagaatcgccacggagatccagaccacttgcgtctgagtcaggtttggcgccttctccttgatcccgctcaccgcagacagcacagatattgacggcgtaagggtgccgtcgcccatgaccatggacgtgccgaggatcgtgagggtgaagagcaggatcttggctgccctgctggactcgagcttctgcttgaaccactgcgccctcttcagctgcgaggtcggcgcttcgatgctgtagttggacaccatggcgtcctccgcctgctggttggggatcagcctgatcttggcgtaccgcgagatgagcgagtagagcgcgaacgtgccgccgtctccgttgtcgttggcgtagagcacgacgaagacgtacttgagcatggggatgatgatgagggtgtagatgatgagcgacagcacgcccagcaggtcgtcgttgtacttgatgccgtcggggaaggtgctggagtagacgtagagcggcgacgtcccgatgtcgccgtagatgatgcccacgctctggaaggccaggtgcagcgtccgggcccagctgccctcggacccgtggtacttgccgccggacaccttctccgcgtcgccgaagagcgagtcgtggcgcttcaggctgagccggttggccgactcgccgccgccgcctgctcctccagctgggttgtccacctccagcgacattatcgcccgcctcggttgggtgggtctccctctccccaagtacgtcccaacgccttggaacgacggatcgagtagtctgtctgctctctccggagagtccccacgcgccctaatcaatcaagccgcgccagctgattcccaaggctgtttggtggcgtgactgctgatccctatgtagccagggaatgctttgctagctgacgaagaggacgacgccgccgaggtggtgcagggttcagcagcagcagcaggcgaccgtccgccctggctggccggcgaccttgttggtcgtccgccgaggcgaggctgtgacgaaaggaggcagagcagagcagggggacgctagttagctgtgacacgaagccccccgccccggcccgcggggggacccggccttaaatagaggagcccaggcccggccggc

SEQ ID NO: 23431 - DNA, 1100 bp, Zea mays
ttttttttttttttttagagccacgcgcgcccccatggcatggtgaatgatcgtcagggaaccaaatttttccatgacaattctatttttcgaaccacgaatgcacgcacgcgtcaggagcatacgagagagggcaaatcaccacacgcccaaagaaaattcagctcccgaaagtgaaagggttaacattcgtaacacagaacaaaaatgtacgtagctcaaaacagacaaccaacttcagaacgcagactagaaataactcatcactacttgatagtagattctgattctgactggcaagcagggaggtagtaggtgtccagttgccagtacttccgcttcacgcccttccagacctcctccgccaggcaatctttgaccggcagagggatgaactgcgtcgagtacccaaggttcgcgagctccagcgcgacgagctggcaatacacggcgtggaagaacgcgttgtcgccgcagaggccgttgaagtacgagtagatgcctccgggcttcagtagcttaggaaggtgctggtggaactctctcatgtcctcgtagtattccccgtacgtgtcgaagaatatgccgtcataagatccgagctgcggcatcacgtcctgccatcgcccgaacacgatcctgacgttcttcttgtcgccccatccgagcttgagcatccgctcgtacacctccgggtgggcctcgacaatggtgtgctcctcgggcccgtacctctgtatcgcttcgtccacgagccccatgccgaaccccacgttgagcaccttgccgccgccttggcacaccgcccgcgcgtgcgcctccatcagcggccgctcccacgccatcatcaccgccttgctctccgcgtccatcaccctctcctcgctgaacgagaccctggattcgaggtagctctcggccgggggaccgttcgcgggggccgcttgccgccgcgcgacggtgcccagaacgagctcggagcggatggcgtggtccaaggagaggccgtaggtgtcggggtcggaggctatgtcccctgccgagaggcccgagggggagagcgcgttccagggcgcccgcagtcgaggaggaggcgcgca

SEQ ID NO: 23432 - DNA, 992 bp, Zea mays
  misc_feature (967)..(968): n is a, c, g, or t
  misc_feature (977)..(978): n is a, c, g, or t
ggccctaggcggtcaatcagatctagcatcttttttttttttttttcgctaacatattaatcttgttcgaagacagagattaggtttagtcaccatgaaggtgttaaggaaaatatacagaacggctaggtacagctctcagtgaaagaatcctggaaaaactgtgaaatttttgtgacagcttccatttcaagatcatgttgatttaaccctttagattctaggtactttttgccgaccttaaaagagtgatcaccgccatcaatgatatgcagttcattcttgcaggtcatcttcttttgagtagacagaagtttatctaaggggcacagggcatctttacttccctgaacaaacatcgttggtaccttcagctgtaagagtgtctcatctctcactgctccattcactccctttagcgggtagcccaagcatacaacagcagaaacatcaacttcagtggagcttgccaccatgcagctgaccctcgatcccatggacttccccatcaaaataagagggtgcccctgatacttgacagcagcatccttcacgatgcccaggtggtgatcaacaagcttctctgcctttggcggcgccctgcgcttcccacccgacatatatgggtagtcaaaggtcaccacggctacagcatctaatgcgtcctgcaccatcttcttccaatggaccatccagtcggaggaggaaggggcaccggcgccgtgggcgaagatgacaaccggctgaagttttgccttccgcaaaggaggaggtggcgcaggcaccgacgagccctgatccgcgcgacgtcgcttgggggccatgaggtacggtgattcacgggccgaagacccctagattaggatttgggggatggaaatggggtggcggccgtctgagcgcgggaaactctcttccccttcccgcccggtccgtgcacggttgcccccgggcagcttttgattannatgttctanntaatggtctcgtgc

SEQ ID NO: 23433 - DNA, 1236 bp, Zea mays
gagttttttttttttttttttttttttttttttgatagaatcagcttttcttcttttctgtcaccgtttcagactaactgtacaatacagatgatttccctgtcacacaggcactgagaaactgaaatctaaatggaataatgaccacgcaaaccaagcaagaggaaaccagggagcaaatctcacagggttttcaggtaaaaacaggacacaggcgactctagcacaatttcatgtcatttttcttctataaattatttttttgccaagactcatcaaccatctcctccaccagacagccgtccagaccagaccacaacaaaaacaaaatcaaagaacgccaactcaacaggaaccgccgccaagaatgctattcgtacatcccatctatcagagttatctggtcacagactgggcatgtctcgctcctctccatccattcgagtatgcaacagagatggaaatgatgctcgcacttggtgaccgaacgtggattttctttgtcgtattcttcaagacatattggacaaacatcctcctcctcatcagccttatcctcaggggcacctttttcgcacgactcaaattcgtccacttttggggactgctgcccgtcagttttgattttaatgcctgacttctccacatcaggattttctgaaactgtgaagcaaacatcatatggcaaaggtgcaggtggtgctcggtaagtgtcaagagatggtgtatcaagatttgtgtcaactgcaactatagcagaagttggcgatggtccatcaaaggctgacgacaagggtgcatgttcctcgggattttgtcggtgatagatgcgcaccggtgctctatctgaatcagatgcccttgcagaacagcagcagcagcagcagccacccattgtatctccagaatgaaatgctcactccaggctatcctctagctgccgttaaaaaccagagtcccgttgttcatatcctgggagacgaatcgcgacaccgtcgatcgcctctggactcgcgagagacctccagggctccgtccccgtgtcgcctcgcgctctgctgcttggtggttgctcttccgcctctgcctcctcctcctcctcctccccctcaggagagagtcagagagagagaggactcctgctccggattccagggtcttgggcaacaatgggcccgcctggcctgtgtctgggtggaaggagacggaccccggccggcctcgagggtcccaatg

SEQ ID NO: 23434 - DNA, 1001 bp, Zea mays
tggaatcagcttttcttcttttctgtcaccgtttcagactaactgtacaatacagatgatttccctgtcacacaggcactgagaaactgaaatctaaatggaagaatgaacacgcaaaccaagcaagaggaaaccagggagcaaatctcacagggttttcaggtaaaaacaggacacaggcgactctagcacaatttcatgtcatttttcttctataaattattttttgccaagactcatcaaccatctcctccaccagaccagaccacaacaaaaacaaaatcaaagaacgccaactcaactggaaccgccgccaagaatgctattcgtacatcccatctatcagagttatctggtcacagactgggcatgtctcgctcctctccatccattcgagtatgcaacagagatggaaatgatgctcgcacttggtgactgaacgtggattttctttgtcgtattcttcaagacatattggacaaacatcctcctcctcatcagccttatcctcaggggcacctttttcgcacgactcaaattcgtccacttttggggactgctgcccgtcagttttgattttaatgcctgacttctccacatcaggattttctgaaactgtgaagcaaacatcatatggcaaaggtgcaggtggtgctcggtaagtgtcaagagatgatgtatcaagatttgtgtcaactgcaactatagcagaagttggcgatggtccatcaaaggctgacgacaagggtgcatgttcctcgggattttgtcggtgatagatgcgcaccggtgctctatctgaatcagatgcccttgcagaacagcagcagcagcagcagccacccattgtatctccagaatgaaatgctcactccaggctatcctctagtgggagacgaatcgcgacaccgtcgatcgcctctggactcgcgagagacctccagggctccgtccccgtgtcgcctcgcgctctgctgcttggtggttgctcggacgcgtgg

SEQ ID NO: 23435 - DNA, 4227 bp, Zea mays
  misc_feature (222)..(222): n is a, c, g, or t
  misc_feature (960)..(960): n is a, c, g, or t
gaattcttcatacaattcacctttgagcgttcctgttcctatcctaatctttgtgccaaattatactcagagtatattgtgaaattaaaagtaccaataattatattacttatattttcatatcgtttctctccttattttcaaaaccctaatttcaatttagggtttaatccaacttctagaattgttatctcattgttgttatccttattattttatttnatgcacaaacatataaactccacatgatgcactttcttttattttagtgtcattggtttaatttaatcattcttaacttcatctatgttcttttcatgatgcaaataaggcacataaaatgagggaacctctatatactcctttttatacaatttgagtattacagtcatgtcctctaaactttccaaatttgttggatttcctctttcccataacccattttcgtcgctcccctcggatcatagaatttttccttccccgtgctttccttccgacgacgacacctcccttctcctactaccctcccttccctcggcgcgactgtcgtacatcgccatagacgcacctctggctccatctctgctctgatatcggagcacctcctcggtgtttatggcaagaagaagataagagaagacgataagtgaagcccatatatcactttgtactatggtatctttggttagcttgttttaagctagtgttgttggagaagacaatgaaagaaatggatagtattaaaatactccatttgtcccattattcgttttagacttttatttttttgtccatatttaaataaataacaacgaatctagatacatatataatgtacatacatcaaatattgtatgaatccattaacatcctataaactggatactattttgggatgggggagcagatgactcatcaaacaaaaagccaagtagaaacctacgtcttgggtagctgtantcctgtagagcatttcagcatttgcatctcttccttccttgtagcgcctgtatttcaatttgatcccgtcaccaagcaggtgaacggtgaaccatggaacacgtattatgacaagttccacgttcctacatgtcctagactcctagtgtgccaggcctaataatcgtgctcgcgaattcatcatctaaaccggattcaggtggacgtgaacacatgatggaaagaacaatgcccttaggcaggggtagggaatgaacaggctaagacgtcagtgtcacggtcacctctctggctctctcaagggaatttggcgagggggcctggaggctggaggaggaggcaatgtcgtcggcatgcccgagaaaggtgaccagtcaagagagaggggggtggcgctcattctccggcgccccccacaatctgccaaagcggacgggaaaaagcaatcaaggagacccaaagcgatcgacgtccgccaccgccactgtacctgggctggggcgcttccttccttgtccgagtgcctgctggctcttgtcgccgcgggtgctctgatccaacgcaacgttcaaaagcaaaagcaacagccacacaggccactcacagccacaggggagtaggggacagagggagagaagccagggcccagggccagccgcggctgctgcagacgtgccgagaccgagacgctattccaggctcgctttgaactgctccaaagggatcccaaagcaccggcctttctcgcggtccgatgcgttcaaagatctctgcgaaaacaaaggaagaatgtgagagagagtgggaaaggagagatgggagcggcatcatcatgccatatgccactatgccagcagctgagctgagtgaggagtcggctcgagcacttggcttgtgagaatgagaagaagaaaaagatgcaaaggaaggagttgctcggttcaaatcggcgccttcggctcccaccataaaaggaccacaccacacactcccctcagtgcccaagagtgagactcaaacggccgaaccgttgcttggattggagtgagaggagtgaccgtttagttagctcgagagagccgagagaacccaagaagcaagggcatggcttccttgcccgatcccacggtgtactacccgacgtcctccaacgccatcctgcgcgcgcatccgtccgccgccgccgcggcgtccaggggctcgttcggcccggtcttcgccgtgctcgcggtgatctccttcctcgccgtgtccgcctgcgtcgtcggcaggctgtgcggccgccggctcttcaggaaggggtccgccgaccaggactcgtacgcctccgactccgacctggagaagggcttcgaggtcaagtacccggccatgaagcccatggcgagctcccgcgccgtgatccacgacatggacgacggcttcgagatcaagttcgcgcccgggaagcctgcggcgtggaagcacgacggcaaggccgacagcaaggggagtcgtcagggccacggccagggccagggccagcgtcagcatcacggccagggccagggtcagggtcagcatcagccccagctcgttggcattcccaaaggctacgccgtgcccgtgcccgtgcccaaggactacgcgggcttcagataccctgcggaagccgtggtcaggcaggggcagatcaggggcggggcattcgttccagcgaagcctggcacatgaacgttacgtatagcggccggcagcttaggttcacaactccattgatgctatcgcatatgatacgtacaatctctctcatcatccatccctccacgaacgatgatagcgttagttttcatcttcactctagttttttggggcgcagtgtgcaaaaaagttccctcggcgaactggtttcaggcacttgcatatcgtgttttgtacattaacccattacaagcagtgaagaacatctcattctcattctcattctccagtgactgacacggcttcaaaccatcaatcgtcgacagggtcctgacgagcctcagtagcatgcttaacgcagaactcgctcgccgtgcccacgaaaaccctggatatagcagcaacaaaaagatcattcagattcggtgcaaagcaaatttcctgtagatttttcttaacattgactgactaaacgaaattagatcccaaatgcaccttcagacggggtaaaagtaatgaatcagtctatataaattgcgagatctttctattagtacattatattatatccgaaagtatatcaaaagaaaagagtgtttgttattaggattatattagtgcatatggctttcgccgtaagcacgttacactgcttattgatttgtattgtacggcacaatcttcttatctagggtgcacgaatatcaaaaggcgttggcataatcatatgagatcactacaacatgcatgcacacaaataataacaaccaacagcatcctgcatatattcacgaaagttgagaaatgtactatcgtcggatgatttgaggaccaacacagccaaaagagaaaatggtgacaggatcataacaaaggcaataattacacttcactacaaacagcatggcgaagtagacaaaagaaagtgtcctgctttttatttttcttccttttcatgtatggtgccttttccatttcaaaaactttgtgatgaaaaaagcttgtttgtatgcttggtgattgatttgattttgtttaaactccttagattccattataaaggaaaatcttataactgcaggcctgctacaagataatccctggtacagagaggatgatgggggcaactcaggtcatctgaatgggataactcaaaagagcccaatggtatttgataaagtgataccggagcaagacggatttctaggtcacaatcaaaccataccttacaaggataaagtgcatatactattctgatttctaagatgatacagaaacatcatactaccaattgactagtggtgggcattttttcaccgacaccgaaccgaagtttcagtgttcggtgtcaggttcggttctagtttctgtatacttcggtctacggtgtcgggttcggtttttatgatgtaacaactgaaacactggaaaatcgaatcatgcattgctcgttgctcgtcccgccgtccactcatgacgcacctaacctgtcaacgtcgctcggagcccagcccatacacgtcacgttgcttcagcctagtagcccaccaacggtccaccacacctttgttgcacttcacacacacg

SEQ ID NO: 23436 - DNA, 1378 bp, Zea mays
aaatagcaactttttttttctcctagcattagtagtgatttattgagctcaagctatatagcgaggcagtcctctatcgactatcaatgtagaaaaacaggattacacactactgattttagatcactaggattgcacatttgcacacccattttaggtcaccaggagcctaagtacatcaactgctcagtaaattcagctattcatccagctacaaggtcgcactaacacatctatcaaacacaaacagtaatgattagagtagaggcaaacgaggtgaccgtcgatggcccagccgttttgctgcggccatcgttatttttcgccgcgcgttcgtcccgtcggcgaggttccttgttaattatttttcgccggttccgtagacggcggtgacagttgatttaccctggtgctccctccgccgccctcatccgtcctcatatgtacaccagtcctaacaaaacacagcagatgaagcaggtgaccaccggacaccgtccacaccccacgcggacaacgatcagcacgcgggcaccaacgccggcgagtcgcacgacgcgaccacatcgaccgctggggtgcctgtttcctcgtcgtcgtcttcggcgtcccacaggaagctcgcataggacccgagcacgtagcagtcatccggggcggcctgcacggcgcgctcgaagtaggccgcggcgcggtccttctcctggcgcgcctcccagatgacgcggccgtagaggctgagcaggtcggcgtccccggggcacgccagcagcgcgcgcgcgtagcagccctcggcgcccgccaggtcgcgctccacctcgtgcaggtacttgccgtagttgcgcagcagcagcgggttcccgggatccacccgcagcacgcggcggtagtactcgcccatgtcacagccgccgccgccgccgccgccgccacggcctccgctgccgccgcggtggctgctgccgttcctgccggcgccggcgccgtcgaggcctgctggcgccttgctgttgtcatcctggcgctcttcctcgtcggccacgataatggcggggatcggagcgtggcggacgaggacggcggatctcgcgaagtaggcgacctcggcgtcggacctggctcggcggagcgggaggccgcgcggggacgcggcagccgagagcggggtgaggtgtgggggtggtggcgggaacctggcggtgcgggagcggtgggggcggccggcggagagggaggcggagcgggacaaggtggctgctgtggcttccattgtttggtaggcagagatcagggcctaggcctcggggctcgggcggtggcggtgatggaggattggcttctcttttcgattaggatgttctaggtaatggtctcgtgc

SEQ ID NO: 23437 - DNA, 1986 bp, Zea mays
ttttttttttttttttgtttctataaaaacttctatgtgtagcaattttatatgatgcatcttgcacacgacaagttcgcagaaacagattctggttacagataaaatctgagatacccttttgagtgaaaacaagacgggggaatggttgtacaatgagccataaaaaatcggcatcacaagtatctctattacaggacgtgtaaccactaaacaatattgttctctatggtgtacctctagtcaagctctacagtatctattttaagaaccaaactaatttacagccaggtggaccaagataagcatcaggagcaagctatcatataacgctgctggtgctgaattgttcagtggtctcaactgggaaacaccagctgggttccttgcttcctgcggagagtagttctcagatgttgaaggtgagaaacaattaaatttcttccatccaagaattttcctttcccgatcgaacacaacacgaagaccagtcatgaaattttgtccaataatgttgagcttcatgctcttgacgattgccaggcaataaacatactcatgttcctgaatggagattacttgccctggatcaataacaggaaacatacttccagtaactgttcttaggattatatcaggaattggaaatcttgcttcactagagctcaaatcataacaatattcaaaaggaatcctggagtcagcagcatgacgatttgcttgaacttgcgcatgaaaactctgggttatataagtatacgctgggtctgccaagtatgtgaaagaagtaccagtgtcaaaaatagtaatgaagtccatgtctgttggtttatttccaacagtaatcccgcttatagtgatggcgtatgtgggatgttgtcggttgatgtcaagaggtgtctcttcttggtctgagctctcttggtctccaaagctgattcgcccaataccatcacgaccaaagcacatcgagaaggaattagatgtcaaacctttctgagctaaaatacttggaactgaaacctcatctattccaagtccaaaaagaccattaggagcagcagcatccagaaatgaccctgtttgagtctgtccacaaccaagcattatttgtgccttgagaatttgaggatgggcattctccgttgagagataaagcacatcttcaactaaaaatccagaagaagatgtgcccgcagagacatacaccatcttgtatggacattgcaatgctgtggagcattctttttgaagatcacagaagttgctgttgcacggaactgctttactagttgacgacataccagggatgtaaaatgtagctgatccagaggcagcagtggctggaggcgtgcagccgtcacactggcaaggcagccagaagagatcgctgcctgtgtccagcgccaccatgaacgtctggcccggtgtgccaacggtcacaagagcatagtgcaaaaatccgaggttgctgaccttgagggtggcatttccctcggcgaaagtgagcggtggtgcgtcgctgctactaccccctgctgccgacaccgcccggtggcgatcgtgcccggcaagggcggcgacgtacgcggcgctgccgggagccggccacccgccagggagcgcgcgccctcgggcctccacccaccgccgcagcggtgcggagaaccgatggtggaactccagcgacggcgcagtcgaggcgtcgccgccgcggcccaaagcagcggcggcgaagagcgggagcaggagcaaagtgctctggagttgagaggtcatttgagaggtggccgcagcatgtgatccggcgaatcggggctcggataaagctgtttgggcggcgggagcgggcggcagcgtggttcgcactcctgcggcgacagtgacggcggcggcgtcgcaattggcgaggtgttgcgcgctgcgctgggttggtctgctttgctgctgcttttgattaggatgttctaggtaatggtctcgtgc

SEQ ID NO: 23438 - DNA, 1300 bp, Zea mays
  misc_feature (1269)..(1269): n is a, c, g, or t
cattgggtacctcgaggccggccgggactaaacatggacgcatctgaaggttgagacgagagcagcagagcgccacaacgcagcacgcacggacgccatcgaggaaccctagaccagagcacatcacacggccggcgacgcgtcaccggcgactggcgccccctcttcggtccccagcgcggcgacgccctcctgcttgagcaggtgtcctcttctgtctgcttgagcaggtgacttcctgggctttaggtactcgctttcgcttccaaccagcgcgtcctcagccagcgctggaggccgcccagccgcgcctgcgaccgcagaccgcgcgtcctcactcagccagcgctggagatctcctgtccgcccagccgcgcctgcgacagtgcgaccgccctcctgcccccagcactgcaagatgatactgctccagtccccatcgaggttcctgctccagatcctgcaagaccgtgttctcagtggcgagaagggcatggacattgactgtcacacggtagagttcgatgatgtccggtatcatatccagttttctatgaggaatccaaaggtaatggtgttgtcagttgctttgcctctgccacctcctgaagcgattctgtatgatgggctaccactaggtgccattgaagctataaaagcagcatatgggccagttgtgcagattcttgatcctccaaaggacgggtttgatctcacaatgaagataaatttgacaaaacttccgctagatgaagagcaaaggaatactatcttgacacaaattgcatctattagagaggttgtgttgggtgcaccactgaagctcctgctgaaacatttagcctcaaagacagttgcacctaatgttaacaaccttgttgctcttgttcaccgccctaatgaatcatttttccttgctccccaggcagataaagttactattgtgtatccaatgagattccaggactccattgatattgttttagcaacttccttcctgcaggaatttgtggaggcaagacgaacagctgcacttaataatgttccttcttgtatgtggtctccggtaccacctcttgagttaaaaggagtatctgctgatgcactaaatgcaaatgctggctttgttactttcgttgtttaccctcggcatgttgagggtaaaaagctagatagaacagtttggaatttgttgacatttcatgcttatgtaagctatcatgtaaagtgttctggaggattcatgcataccaggatgaggcgcagggntgagtcgctgatccagggcgttggacccggc

SEQ ID NO: 23439 - DNA, 808 bp, Zea mays
  misc_feature (1)..(1): n is a, c, g, or t
  misc_feature (771)..(771): n is a, c, g, or t
ngccattacctaagacgagagcagcagagcgccaccacgcagcacgcacggacgccatcgaggaaccctagaccagagcacatcacacggccggcgactggcgccccctcttcggtccccagcgcggcgacgccctcctgcttgagcaggtgtcctcttctgtctgcttgagcaggtgacttcctgggctttaggtactcgctttcgcttccaaccagcgcgtcctcagccagcgctggaggccgcccagccgcgcctgcgaccgcagaccgcgcgtcctcactcagccagcgctggagatctcctgtccgcccagccgcgcctgcgacagtgcgaccgccctcctgcccccagcactgcaagatgatactgctccagtccccatcgaggttcctgctccagatcctgcaagaccgtgttctcagtggcgagaagggcatggacattgactgtcacacggtagagttcgatgatgtccggtatcatatccagttttctatgaggaatccaaaggtaatggtgttgtcagttgctttgcctctgccacctcctgaagcgattctgtatgatgggctaccactaggtgccattgaagctataaaagcagcatatgggccagttgtgcagattcttgatcctccaaaggacgggtttgatctcacaatgaagataaatttgacaaaacttccgctagatgaagagcaaaggaatactatcttgacacaaattgcatctattagagaggttgtgttgggtgcaccactgaagctnctgctgaaacatttagcctcaaagacagttgcaccta

SEQ ID NO: 23440 - DNA, 1548 bp, Zea mays
cgagggcccgcggccccggccccccccctctcttgtttttttttgcagacagaaatggaagccctgatgaatatataaccacatcaatacaaaagtttagttacatcaagctgaaaaagtccagcacaaaaaaggttggatgcaggtcaagttgaacattactcgtgtaaactactttagtggtttcaaccccagtgaggcccgtagcttgttcatttctatgatctcagggtcattcgggtccggagcatttccttcacccttctctttcttttccttcttcctcttaggttcctctcttgggccaccgtcttcaccacgtcctcgaggacttacactgccacgaccacgcctcctgcggtactctccatcttcacggtctctgtcccgtcgatctctgctccttgagcggctcctgtgcctgccacggtctctgtctcggcgctccctttccctaccatccctctccctgtccctatccctgttgcgattgtaatcatcatctcgcaggcggtgacggtctctatccctatcccggtttctgtctctttcacgatctctatctcggtgtctttcccgccctctcccatagtccctatcataatcccgatctctatcataatctttgtccctgttatgcctttcatgtttcctgtcatggtcccagtccctatcccgttccctggcaaggctccttccacgatgattatcattttcacgaccattcggttcatcaatttccataggctgttcctccttgtcttcctcttcttcctcaaaatcgtcctcaagtgcacttcttctcggttccagagttccagacgcttcaagaacccatcttttctggatgcgaggcatggctgtatcacaggagtaatccttggtcagcaactcatcaatgaactcatcaacatgggtaagtgtgaactgtccatcgctgagcttgtgcctgatcttgcggtagtcgttgtagagcggctcaagatactggtagacgtcagcaattgtgccagtgagacgcaggtagaaggccccgagaacacgaacatacttgtaatcctcgttcttgatgaactcgactacgatgtccttgtctggttggatctgcagcatcttgagcgcgaggcagaggaaaggggtgggcttgcggttgccgccgtaggttccgccggtgtggtcgagctccatggccttgtcgactagcgtctctgcggtgaggccgaagcattgctccttccagtaggtgctctgatagatcttggagcgcacgatcttctccaccaggttttgtgggttcgtcccatggatgctcttcgcgagggggtccgtgcggttagccatcgcgagcgcccgcgcccgcggcgcgcttcggcggcggctaccaaggtggtggtgatgaccggacggcggctgctaccaaggttggtggtggtgacgggacggcggcggctgatgtggttgggaatcgaattggggtttgcaaacaaaaccctaatagctagtcggcagactcggtcctcccggccggcctcgaggatcccaattgcc

SEQ ID NO: 23441 - DNA, 1817 bp, Zea mays
aagcaggagccaatggaaagcgctgatgcaaggcttcctgatcctcccacgtagccaactcatttggaaggccggaccaggtcaccaagacttgttggaccaggcgttgtcttttttttttttttttttttttttgagttctttgaggtgcctttttttttttttttttgtttaactatgcatatatattgttcttgtctcatggctcatgcttgtgtaaataaaaccaaacatgcatgggtgcatataaaattctcctatcagctgggtaacttgcacccatgcacacattcattctcctatccaagtcacatctatcgatcggctatcatgcatgttcgcttctttttcttggtgctaataaagcagcatgggaactgagcaagagccgccggagatctcctccatcagctggacaacgacctgctcagtggcatcgtcgaacaaccagttctctatggaggacagatgctgctgctgctgctgccgcttcttgggtggtggtagtagtgccccgccggacttgtggtcgaaagggtcgatgtcaatggccgaggaagtcttgatggtgtcggtagcgtcgtcccgcgccggcgaggcgctcttcatgaagccgttgagcagcttggagatgttgtccgtgctggaggcgtacgagtacgacgacgacgacgaggtgtcaccgtcggtggcggcgaactgctgggcgatgagctgggtgacgacctcatcagccgctggtgtgctgtcggccaggcaagcgtggctgtccttggaggagcgggtcatgtcgtgacggcaatcggcatggccggcggtgggttcggaggggggaggtggcgcgaagatggcgccgatggcttgctgcttccggagcttcttcttgaggtgggtgttccagtagttcttgatgtcgttgtcggttctctgtgggaggtaagaagcaatggccgcccatctgttgcctagcaaggcctggaggtggacgatgatgccttcctcgtggggtgtgaagttgccgcgccggatgccggggcggaggtagttggtccagcggaggcggcagctcttgctgcagcgcatgaggcccgtgctgacgggcacggcgcgccagttgccggggccgtgctcctggacgtaggacaccaggacgatgtcctcctccggcgtccatggccccttcttgacccccgccctgtcgcagcacggcggccttcccatcgatcgtgtccggccggccactagtatgtagtagctaataacttggctagctagcttctagccttgttcgttcggttgcgcttgcgctgacggtcccgcggcccggcccggccggaaggcgctgaggggatctcattaacaagcagggtttaatcctcttcaattcctcccaaccccccatcttggtttttgttttggatgaaaggaacagagctaagtgagacagtgagagtgagctccttttcactgctagctgctgtcatctagttaacgactaaccaaccctagctagctttgctagcaactacctgcgcgctttctccttcacatgatgcatgaaccatagaaattgacacttcaaaagcaaggatagattacctggaggaactgtttgactataggactcactcaaggcaatttattccgccgtgtgtatgtaggaaaaaggttgccagagttggatgacagctacgtttcagctacatctatatatagtatatagatgaacataaagcacgaagcacgaaagctcggtccaaagcaagttttttttgcctgatatgagcctggtctggctcacttttatatgggctcgg

SEQ ID NO: 23442 - DNA, 3308 bp, Zea mays
gaacgctttacagtgcgttgttggagctagcctaatattattacttttaccgaaatcctccaagtacggaacaacgatgcagtctcagcaatcatgttttccaagctgctgttttaaggacagttctgcaaattgaagcaatctgcaacgatttcaaaacctgaacaggccatgttaacagactatattaggtgataaaacattcattacaacacaacttaggagcatcatcaagcatgtggcatcattcaatgaagtcaatgaaaggtgaaacaattgaacacgcatcaccggtgtttcttgttccaaacaaagatagtatcgccatcaaggcatttctgatggatggggcaacgcacagagagattcaaaaacaggccgctttttttctttttgtttttttttttttgtagtaggataagactctgagcagctcagtagaacatttacataattacatggaacctcgcaccccacaaataacttagtcaagctcaaatgctactatgtaacctctattctagagcagttacaaatttaccaaccgattaacagtttagacactgatcacaagaaaaacaaaccatcctgaagcctaccagaaccgaataaaatgggaccagaatctctgagggcaacaagagcagaggctcaccaatttaccaaagattcacaaaatacatcatgttgctgatatcatcaaggatctcctgtgtgaagggctgaaggcaagaccaaggaatagaaaacattgacagtgatcccattgaggatagcagcagcagatcgcaacttttgaaatacccttatatccaagaaaaatggtgcaaaaggatggacaatactatgacctatggacctcccacaaataaattatctacaacaacaacaaaaggtaatgagctgattatcactcttgatcttccaaattttggatctgcaagagaatgtgttgcagcattaactcgaggatgtgtcaacctccttcccatgatcttcgtttattgttcttcgcagtcgtttcaaccagatctcatagtccatcgggtacgaagttccacagaggctgtcgacataatccgcaaaagcttttaacactgctgagatgtcgcccaacttctgctgtatgactctcctagaccatgacgtctccctccactgaagtgcactttcgacagagtcaaggtcggggcaaactccgccacaagagaaatatagaaggtagattaaactttctgcgtcggacgctccacatagttttccttcctggagcgcaaatgtagacgagaagaatagattcattactggtcgatccctatcttcaaggatagcatggccccatccaataagcacaaaatacggatgtgttgaaccattgttgacacagatcacattctccggctggatatcaccgtgacggactcctgcagatgctgctgcagcaagagcagataaacagtcatggcaacatctcagagcctcctcggcaccaaacaatccattccgtatcagattcgaaatggtctcaccaactggtgaggtgacaagcattggagtactgcaccatggatgaccacaacttgcatttgagttagggttgttacatgggcctggatggatgacccgtccggacgattccatgtgtggtatatatctgctggaaatgcatctttgcttcatcacggtcagtacttttgtctgcctctgtacttggtaccaggagtccatatcctcccatgccggatccagatgagaagggctggagcctacatacagcaaacaagttttggtaggttcttccacaggagcagaagtataaataggaggatcactgcctgttaggatgtcactgatttgaaaacctttctgtgtgtaagcatcatccatcaatacaacagaccctatttcaagccttaaggtttcatgtggtttcacatcaactgctgcttcctcctgtaactcaacaatttcaggagaatgacttcgctgttggaatcgaaataaaccattgccattagcttgtctgtcaaccagatgtctttctgatcttcggctctgtagccttgaactatgttccgttgccagttcatcgagagaatacttaggctctccgtaaaattggatcatcgagtgaaatattgcgatgagaacctgaagggtcccaatgtctccccagttagcattcccaagtttgttccatactcggtctacggaacagactgaaattctggaatgtttctttatccattcagcagcacagtcataaacgttgttgagatcaaaatccagcctgttcaaatcaccttgcacttttaccactccgccaaactgtgaatcaaaaagaagcacgtaaacagagtccgaattgcgaagaacggtggaggacttgctgaggcttcgagatagcaggacacgcagagcaaagaacagtgcctcccctaagacagcaggagacggctcctcgtcaccctgtgcggaaaccattccgacatcaggtctcaacaaagccagcacgacgatatgatcccaccttccttgtgaaggcttcaaattcttcagcagcacagcagtcgcgcaaacaccatcgagccttccactgcttatagccttctcagcaggataaaatctggagctcgtgctgtgtacacaggcaaccgagaaaggcatcgcttcatcaggaccccagaaagtttgccacagtcctttaacgcctgcgtgaaggaaatcctccagagcaagatacgcgctggcctcaaaaacatccgacgtcgacgcgtacagagcgcttggcatccgtactagctgctgaaaagtaacgccctccagagcgtaatcgaaattgtgtaactctgtaagctcgaaaggaacgtcgaaacctggcttcctgaaaccacaatcttcgctgtgaccggagaaccagtcctctaggcttgacgtcagaagctcgctgtccacaaacttgcggagaaaatccttgcacgttgacgacgagaagttacggcgccggcctcgtgaggaagcgctatgctttttcggcgctgaagctgaaccgaccgatgtacggtcaggcgactggtcttccatgaggaggcggccgggtcgtcgttgtcgactggtcgtctcccccaggggccagggccgggccggcggctagattggagcggctggtggagctggagcggtagtcggacgactactcccgactgactccgtggtcgctggacggccgccccagccgcaacgagaagacatccgtcgccccccgcgaacagacggaaggagatggggaaaaggtggggtttttattt

SEQ ID NO: 23443 - DNA, 2069 bp, Zea mays
aaaaataataatgttgtgtatttaatggaataaatactctaggttcagttcaatggtttctagatccaacctgggggtgggaaacaggcctaaactgcttggcaaaagattgataccacacagttagaggtacacattcaccaactgattaacaagttctgacactgatcacaagaaaaacaaatcaccctgaagcctaccagaaccggataaaacgggaccagaatctctcaaggcaaccagagcggaggctcaccaatttacccaagattcacaaaatacatcatgttgctgatatcctcaaggatcacctgtgcgaaggaagggcttagggcaagcacacgggatagtaaacactgggcagtgatcccattgaggatagcagcagcagattgcaacttcagaatacccttatatccaagcaacggtatatcaaaacgatggacagactatgacctatggacctttcacaaataaattatctacaacaacaaaaacaggtaacaggccaatcacttgatcttccgaatctcggatttgcgagaaaatggcgctgtgttattaactcgaggatgtgtcgacctccttcccatgatcttcgttcattgttcttcgaagccgtttcaaccagatctcatagtccatcgggtacggggttccacaaaggctgtcaacataatccgcaaaagctttcagcaccgcagagatgtcgcccaacttctgctgtatgactctcctcgaccacgaagtctccctccactgaagtgcactttcaacagagtcaagctcagggcaaactccaccacaagagaaatatagaagatagattaaactttctgcgtcagatgctccacatagttttccttcctggagcgcaaacgtggatgagaagaatagattcatcacaggccggtctctatcttctaggatagcatggccccatccaataagcacgaaatatggatgccttgagccgttattgacacggatcacattctctggccggatatcaccatggcggattcctgctgctgcggcggcggcgagagcagataaacagtcatggcaacatctcagagcctcctcaacaccaaacagtccattccttatcagatttgaaatggtctcaccgactggtgaggtgacaagcattggagtactgcaccatggatggccacaacttccatttgagttaggcttgttacatgggcctggatggacgagccgtccagaagataccatctgtggtatatatctgctagaaatgcatctttgcttcatcacagtcagtacttttgtctgcctctgtacttggtaccaggagttcatatcctcccatgccggttccaaatgagaagggctggagcccacatacagcaaataggttctggtaggttcttctacaggagtagaagtataaataggaggatcactgtctgttaggatgtcattgatctgaaaacctttctgcatgtaagcatcatccatcaacacaacagatcctatttcaatccttaaggtttcatgtggtttcacatcgacagctgcttcctcctgtacttcaacaatttcaggagaacgactccgctgttggaatcgaaataaaccattaccattagcttgtctgtcaaccaaatgtctttctgatcttcgactttgtagccttgaactatgttccgttgccagctcatcaagagaatacttaggctctccataaaattggatcattgagtgaaacattgcaatgagaacctgaagggtcccgatgtctccccagttagcattcccaagtttgttccatactcgatctatggaagaaactgaaatgttggcatgtttctttatccattcagcagcacagtcataaacattgtttaggtcaaaatccagcttgttcaaatcaccttgcacttttaccactccgccaaactgtgaatcaacaagaagcaagtaaacacagtctgaattgcgaagaacagtggaggatctgccaaggcttcgagatacctcgtcccgcaaagcaaagaacagtgcctcccctaaaacagcaggagacggctcctggtcac

SEQ ID NO: 23444 - DNA, 2805 bp, Zea mays
  misc_feature (2009)..(2009): n is a, c, g, or t
gaatttagggagtataattatacataactattggagctgctcgaggttctcctattactagtgcgcacattgttaagcaggatacaataaactaactgtaagataaaaataaatgtttcaacataactatgtacctttgctgcgacaagcccactgatatgtgccatgtcgcaaagaagcaccgcaccacacttatcagcaatcaatctcatccgtgcaaagtcccactctctggggtaagagctcccaccacagatgagaattttagggtggaaatccattgctctttcttcaagcttgtcgtaatcaatatacccagtctgtgggttcaccttgtacgacatgctctcgaagaaaatagaggcacctgacaccttcttgccactgggcgtgtagtaaccatggctaacatggccgcccgacggtggctccagccccatgatgcggtccttgggttgaaggagcccagtgtagacagccaagttggcagacgtgcacgagtagggctgcacgttgacgccccagcaggcagggtcgagaccgaaggcggtgagagcgcgctcatggcagagccgttcgatggcgtcgatgtgctgattcccgccgtagtagcgagcacccggggccccctcggagtacttgttagtgaggtggctgccgagtgcatcgagcaccgcgcggcagacgaagttttccgacgctatgagctcgatgcctcgcacctggcggtccaactcctgcttccatcagcgagtgcacgtccgggtcggcctccgccagcgactgattgccccaggcgcggaccgcggcgcggcgggtctccagatctgcgccgctgccctcccccgtcgcctgtcgcttggcagggcgaagcgccgcggacgtggacgagcaggatgacgtctctccgcccccgccgccgttgccggcgcggcgcgggcgcttgacgaagagggagtgcccgaggagggagaagtgctggtcgcccccgtcctcgtcatccctctccgcgtcggcctctccggccacgacgcgctccggcttcggctcctccgcgtcgtcgaacaggcgcagcggcgcggctaccgcgtgcctgcgagcgtgggcgtgggcgtgaccgtgagagtggagcccgagcgagaggtccgacgatgtgggccgcgagagatccatagcttaccaattctcgaaccgatcagcgagaaatcgcgaaccctaaagagctacgcgtcttcaacaacggcagcaactaacgcgacagcagcagcggaggtgggcgacgcaggaggaagcagagtcagcagcggtggctactagaggcgacgcggcggcggagaaaaccatgggccttagggatcgatcggggtatggggtccggatgcagagacgacgcggtggaattggagatctcgtggaattggggagccggaggcaagcagcggagaagaggggaatgaacgggcgccgtgctccaattgatgaaggggagggctggtggtggtgtcgtgtgacgtggtcagatactcacctgcggttcgatgggaacccgggataatgggacgatcgggagaaagaacctggacgatacggtgtccacgatcgggaggaagaacctggacgatacggtgtgcgatgggccggtgggtgcctcatgttggacctggcccctgtgctgtcgtggttggtctcacaagcttggggcctcgtgggtgacttggaagtctggaactgaaagtggaatcgaccggtcagtcactgagattttttttactccctcgaataaattatactccatccattccaaattaaagtttattttattttttactgaatttatataacttccattccaaattaaattttattttattttttactgaatttatataacttaatgttttctgaaaaaatggcttaatatttaatcgaatgagtgttgattggaatgacttaacgtgactagaaaacgagccgcgcggggctgagtcgtgcgggcgtgagcaacgggngtggagctgtgcgggccgaagttgcatgggcacggtcggtgcaggcgggcgcacgcgcaagaaggtccgggtgtcaatcaccctagatgatgaatagtgtttatatttatatatattaattatatttatttagacaaattcttgtaagtatataattcatacaagtagtaattcacgtaaacaactccaccacatatttatttaagagattgtaatttcttatgtaaaatctagatagtttaagttaattgtttctagagaatgaatcttgaatatatagttttaagaaagggtaacttataagaatcttttatgtagtctcttgtttgaaaccaaatttatttaggtcacgaaataagtttttctagtttatccaaaataggatattggagtgttacaattccatgatttgagagctatgaactcatggatcttctatttccatgactgtttagaactttaggttgcatttgtgaatggccgacacaaataacggagtatttgctcgcaattgttgcatcggaaaggagagagttgtgcgtggtatgtatgttgatgacgtaggaccaggagagaggagctggccagtagatgagttagacatgagtacatttagagattctattgttgcagcgctaatttttgtacggtgtacatgcagcgttacttttgttgtgatggacacgtacgagaaacttttgtacgcatttattgttttttaaaaaaatgaattgtcagaatctgtcatttgaaaaactggccacccaaactactagattataaccagtagcttctc

SEQ ID NO: 23445 - DNA, 2945 bp, Zea mays
  misc_feature (1845)..(1845): n is a, c, g, or t
tttttcctggaggaggagagggtggtcaataagatcattagcagtgtgccaaagcatttgaagcaaattatggtagcgataaagaccctccttgacgtgtcactcattgtcgaaggccttataagtcaactcaaggcgacgaaggatgcaaacaaggaaccaccaacgtcgctgcagcaagttgaaatattgtacctcacggagaaagagtgtgatgtgcgacgaaagaagcatgaagcataaaaccactctagtggtggcaatatggagggtgtccctgttctaggggacagcgcatccaacaaggccatgaaagcaagaacaataaagcagaaagtctaaacattgtcgcattttaatagttgattctactgaccatgagcactcgagtctcgacggggttgcaaactgacaaaactagttgcaagccccagtacaatttaccaaatatcatcgtctaataattagccagaaaccatatggttaaagcttattcagcctcggcaacaaacaggtgtcaaaaggcaacaaagggttctgttgtagtgacaagaaaatatctcctataggaacccgtcataccaaggttcactgcatacataattcatcacaacttgctgtacataattgtttgaatcaaccatctagaccgtctaccatcaaattaaaaaaaactccctaatcattgtgcagttgaaagcaatagttgctagtatcggagtaacggaagggatggcaatgttgctgtgaatctgaaagttgctgactacgtatatatgcacattcatacatcaaaacctggcatcgcaaactgtgacgcaaatgcctcaacctgatttcggagttctataacatcattattgttctgtaggcctcttagaaactccttttgcactttgccatgttctttcagaacattgttagcaatttgagtagcccttatgaggaagtctgcaatcacctcgaagtcctcttctaagcaacctctagtagtcattgcaggtgttccaatccgcacaccacctggcgatatcgagccattatctccataaattggtgtcttgttgacagatatgtggcatgcctcacaaaccttctcgaagatcttgccagtcaagccaagagttctgaggtcccaaagtaccaagtgattatctgtgccacctgtaaccaatctgcattttcttctgatcaaagctgatgccaaagcctgagcatttttcttgacttgttgaatgtatgctttatattcagaagttgctacctgcttcagagttatagccaagccagcaatatgattattatggggccctccttgcattgaagggaaaacaccaaaatttatcctatcctcgaagtcatattcattctcatctccttgagaaaaagatccagctcgtttccttaaatttttccctttcctgaagaatattataccacctctagggcccctaagattcttgtgagtagttgacgtaacaacatcacagtagtcgaaagggctacggcattcctttgctgcgacaagcccactgatatgtgccatgtcgcaaagaagcaccgcaccacacttatcagcaatcaatctcatccgtgcaaagtcccactctctggggtaagagctcccaccacagatgagaattttagggtggaaatccattgctctttcttcaagcttgtcgtaatcaatatacccagtctgtgggttcaccttgtacgacatgctctcgaagaaaatagaggcacctgacaccttcttgccactgggcgtgtagtaaccatggctaacatggccgcccgacggtggctccagccccatgatgcggtccttgggttgaaggagcnccagtgtagacagccaagttggcagacgtgcacgagtagggctgcacgttgacgccccagcaggcagggtcgagaccgaaggcggtgagagcgcgctcatggcagagccgttcgatggcgtcgatgtgctgattcccgccgtagtagcgagcacccggggccccctcggagtacttgttagtgaggtggctgccgagtgcatcgagcaccgcgcggcagacgaagttttccgacgctatgagctcgatgcctcgcacctggcggtccaactcctgctccatcagcgagtgcacgtccgggtcggcctccgccagcgactgattgccccaggcgcggaccgcggcgcggcgggtctccagatctgcgccgctgccctcccccgtcgcctgtcgcttggcagggcgaagcgccgcggacgtggacgagcaggatgacgtctctccgcccccgccgccgttgccggcgcggcgcgggcgcttgacgaagagggagtgcccgaggagggagaagtgctggtcgcccccgtcctcgtcatccctctccgcgtcggcctctccggccacgacgcgctccggcttcggctcctccgcgtcgtcgaacaagcgcagcggcgcggctaccgcgtgcctgcgagcgtgggcgtgggcgtgaccgtgagagtggagcccgagcgagaggtccgacgatgtgggccgcgagagatccatagcttaccaattctcgaaccgatcagcgagaaatcgcgaaccctaaagagctacgcgtcttcaacaacggcagcaactaacgcgacagcagcagcggaggtgggcgacgcagggaggaagcagagtcagcagcggtggctactagaggcgacgcggcggcggagaaaaccatgggccttagggatcgatcggggtatggggtccggatgcagagacgacgcggtggaattggagatctcgtggaattggggagccggaggcaagcagcggagcagaggggaatgaacgggcgccgtgctccaattgatgaaggggagggctggtggtggtgtcgtgtgacgtggtcagatactcagatgcggttcgatgggaacccgggataatgggacgatc

SEQ ID NO: 23446 - DNA, 1988 bp, Zea mays
ttttagtttaaaaataattttttatttatcatgttttagtttagaaatactttttaatttatctttttaatttatcatgatttagtttaaaaataaactaacagacgatatagagatagtacttacctagtacgaattgatttccccactgccagtagatttgtattgaccgttttttaagtgtcgccagtgtaaattacagatttcgaagtggcaccggtgcaaacacctttcgctaggcgaatgaaatcatcgtcagtaaagatcaaactctaccaccagtacaaatcccgtccctgcgctagtcggcggggcatccaacatggccatgaaagcaacaataaagcagaaaaataaatctaaacagtgcagcatcacttcgcctaataaatctaaacagttgatgcaacaagccatgagcacctgattcttgatgtgtttgcaaacatacgaaactgacggtacgccccagtacaattaacctcatcccttcgcctaatagttagccagaaatcatatggtaagcttattcagtctcggcagcaacaggtctccgaaggccacaacaggtctcctatagactatagtaactcgtgataccaaggttgacatacataactcatcacaactttcctgtttgaatcaaaatcaagagtcaagaccctctacaacctaataaaaactctcctaatcgttgtgcagtcgagagcaagacttgctagtattcgaggaactgagcggatgacaatgttgctgtgaatctggataattgctgactacagtatatatgcacattcatacatcaaaacctggcatagcaaactgtgacgcaaatgcctcaacctgatttcggagttccataacatccttattgttcattaggcctcttagaaactccttttgcactttgccatgttctttcagaacattgctagcaatctgagtagaccttatgaggaagtctgcaatcgactcgaagtcctcttctaggcaacctctagtagtcattgcaggtgttccgatccgcacaccaccaggggatattgagccattatccccataaattggtgtcttgttgatagatatgtggcatgcctcacagaccttctcaaagatcttaccagtcaagccaagagttctgagatcccaaagtattaagtgattatctgtgccaccagtaaccaatctgcattttcttctgagcaacgctgatgccagagcctgagcatttttcttgacttgttgaatgtacgctttatactcaggagttgcgacttgcttcagagtaatagccaaggcagcaatatgattattatggggtcccccttgcattgaaggaaaaacaccaaaatttatcctatcctcgaagtcgtattcattctcatctccttgagaaaaagatccagctcgtttccttaaatttttccctttcctgaagaatattataccacctctagggcccctaagattcttgtgagtagttgacgtaacaacatcacagtagtcgaaagggctacgacattcctttgctgcaacaagcccactgatatgtgccatatcgcaaagaagcactgcaccacacttatcagcaatcaatctcatccgagcaaagtcccactctctggggtaagagctcccaccacatatgagaattttcgggtggaaatccattgctctctcctcgagcttgtcgtaatcaatatacccagtttgtgggttcaccttgtacgacatgctttcgaagaaaatagaggcacctgacaccttcttgccactgggcgtgtagtaaccatggctaacatggccgcccgacggtggctccagccccatgatgcggtccttgggttgaagaagaccagtgtagacagccaaattggcagacgtgcacgagtacggctgcacgttgacgccccagcaggcagggtcgagaccgaaggcagtgagggcgcgctcatggcagagccgctcgatggcatcgatgtgctgat

SEQ ID NO: 23447 - DNA, 2336 bp, Zea mays
gagcaacgctgatgccagagcctgagcattttcttgacttgttgaatgtacgctttatactcaggagttgcgacttgcttcagagtaatagccaaggcagcaatatgattattatggggtcccccttgcattgaaggaaacacacccaaaatttatcctatcctcaaagtcgtattcattctcatctccttgagaaaaagatccagctcgtttccttaaatttttccctttcctgaagaatattataccacctctagggcccctaagattcttgtgagtagttgacgtaacaacatcacagtagtcgaaagggctacggcattcctgcatgaaaatataacctaaatggcaacaaaagccttctaacctttggaaataagaacacaagggtagctggtaagtgcaatccaaactcatacaagtatacaacactaagaggtacaattctgttagatgccaagcagtataaagtcatagtaacagtaggatcacaaaatgggacctaagaggtactccaattactcttgtgcacattgttaagcaggatacaatgaactaactgtaatataaaaataaatggttcaacgtagatatgtacccctgctgcaacaagcccactgatatgtgccatatcgcaaagaagcactgcaccacacttatcagcaaccaatctcatccgagcaaagtcccactctctggggtaagagctcccaccacatatgagaattttcgggtggaaatccattgctctctcctcgagcttgtcgtaatcaatatacccagtctgtgggttcaccttgtacgacatgctctcgaagaaaatagaggcacctgacaccttcttgccactgggcgtgtagtaaccatggctaacatggccgcccgacggtggctccagccccatgatgcggtccttgggttgaagaagaccagtgtagacagccaaattggcagacgtgcacgagtacggctgcacgttgacgccccagcaggcagggtcgagaccgaaggcagtgagggcgcgctcatggcagagccgctcgatggcatcgatgtgctgatcggacgcgtgggagcgagcacccggggccccctcagagtacttgttggtgaggtggctgccgagcgcatcgagcaccgcgcggcagacgaagttctccgacgctatgagctcgatgccccgcacctggcgggccagctcctgctccatcagcgagtgcacatccgggtcggcctccgccagcgactggttgccccaggagcggaccgcggcgcggcgggtctccagatccgcgccgccttcttcccccgccgcctgccgcttggcggggcgcagcgccggggacgtggacgagcaggatgacgtctctccacccccgcccccaccgccgttgacggcgcggcgcgggcgcttgacgcagagggagtgcccgaggagggagaagtgctggtcgccaccgtccccgtcgtccctctccgcgtcggcctccccggccacgaggcgctccggcttcgcgtcgtcgaacaggcgcagcggcgcggctgccgcatgcacgcgagcgtgggcgtgggcatgagagtgcagcccgagcgagaggtctgacgatgcgggccgcgagagatccatagcttaccagttcccgaaccgatcggcgagaaatcacgaaccctagcgagctacgcgtcttcaacaacaacggcaacaactaacgcgacagcagcaggggaggtgggcgacgcaggaggaagcagagtcagcggcggtggctacgagaggcgacgcggcgtcggagaaaaccatgggcctttggggatcaaccggctctatggtgattgggaagcacgagacgacgcggggggagttggaggcaagcagcggaagacgagacgggaatgaatggacgccgtgaggtgtggtgtggtgtgggtgtggtattcgcgtgagccatgaggtgaatacaggatcggggtaatgcgacgatccggaggaagaacctggacggggaaccggccagagacggtgtcggttggtgttgttgccatcgggacgggaggacggacacgtgcccgcgacggccggcaggccgactggctgcgtcatgttggacctgggccgtcatggtcgtgggcaactgaaaatgtaaatggcccaaccagtcagtcactgagagtatctctttagactagtttgacaattccattttctcgagggattctcatttcactaacgtctcgtttagatctttgaaattgaattatattttaataataataatttaagtacatgtcaattaagttaatttaattttatataaaatatttatatactattatta

SEQ ID NO: 23448 - DNA, 2058 bp, Zea mays
aaccgcccccctcctttcactcgctcgctcgctcgccttccatctttctccctctgtcggcagtctgcagcagcccagcgccgtcgcgcatgcaggaggcgtcatcggcggcggcggcgggggccgagcccggccgtcgggcggcgcagcatcagttcgccggcgtggacctccggcggcccaaggggtacgcggcgccggcgccggcgccggcggtgggcgagggggacccgtgcccgcggtgtgcgtcgcgggacaccaagttctgctactacaacaactacaacacctcccagccgcgccacttctgcaagggctgccgccgctactggaccaagggtggcacgctgcgcaacgtccccgtcggcggcggcacccgcaagaagccctcctcctcctcctcgtcgtcgtcctacgtggccgccgcggacgccgacaggcagcccaagaagaagcccgccagcaagaagcgccgcgtcgtggcgccggccccggagctcgccgccgcggccgacccaggcaagacggcacccaccacgacgacgacgacgacgacgacgagcgagatcaccacggagactggcgcgctggaggactccgactccctggcgcacctgctgctgcagcccgggacagaggacgcggaggccgtcgcgctcgggctcggcctctccgacttcccctccgccgggaaggcggtgctggacgacgaggactcgttcgtgtggcccgccgcgtcgttcgacatgggcgcgtgctgggccggcgcagggttcgccgacccggaccccgcatgcatcttcctcaacctcccgtgacagccacagacggtcacggcgccgaggcgtacgtcctcctgctttgctctgctctgcgcctgatgatgagtgcaaggaaatggagcgctttgattcttctgctattggttgcatctgctaattgatttagcagtggtggtaaggtacacgcacgacgagctgactgcgtggttcttggcttgggccttagtatatgatgatgatgatgatactagttgtatgtgtgacgtgagagacgatcgcgacgacgaccttgaattttagtttctgagatgagaaaggtcaactagtggcctctgtatgactttagttttactcatgaactcatcagatggctggctatggctgtggctgtggctaactcatcgtcaagtgtttctaccggctgcctataaactagactgagctcttgttggtctgggattcttccttgttcttatgataaagttctgttgtgctgtcatgcttgttttcttcttttctgtgaagaaaagatcatggggaaaaaacattctaaattcgtcttcctcggctctcaatctcatggtgcgcgcgcgcgcgcgcgtgctgtgtgtcccagagccagagtcgcaggggagcatggatgctgaaagctgtagttagcactcgccgccataatcgatccgccggccggcgacggcgatcgtggtgctgatcggttggcatggcatggcatggcaggcacgtctgctgcgactttgtcgcggcaagacgattcgccgggcggggcgctcggttccgttccagttccaggcgtcggaagaacattgtcagcgtccgtcgatgcccggcggcggtggtcgtgctccactcctgcggtcctgcctgtcgtcgtgacgctcgcatcgcattcggattcgcatccaaccaatccagtgcaggtgggtttgtcatgattacgagccgagcagtgtagaccgtccggcgtccaggccagcgggcaacgccacgcggcgggggggcatccggttcccgacgccatcattttcgcccgccgaagcctgcccgcccgcccgccggcgccgagtgcgactgcggtcccagaaaggaacccattgctaggcggctcaaccactgcgaatcttcgatgatcttcgacgggccgggaacaagtacacctacgcccacacgcccagtggccgcgccggcctgggtgttccggtttgcacgtcgacgtccgcatccacatcctatgggtggatcgtcggtgagccccgag

SEQ ID NO: 23449 - DNA, 1313 bp, Zea mays
  misc_feature (2)..(7): n is a, c, g, or t
  misc_feature (102)..(134): n is a, c, g, or t
  misc_feature (187)..(226): n is a, c, g, or t
  misc_feature (270)..(292): n is a, c, g, or t
  misc_feature (381)..(407): n is a, c, g, or t
  misc_feature (465)..(470): n is a, c, g, or t
  misc_feature (1243)..(1243): n is a, c, g, or t
  misc_feature (1272)..(1276): n is a, c, g, or t
  misc_feature (1280)..(1301): n is a, c, g, or t
gnnnnnntcctttcaactcgctcgctcgctcgccttccatctttctccctctgtcggcagtctgcagcagcccagcgccgtcgcgcatgcaggaggcgtcannnnnnnnnnnnnnnnnnnnnnnnnnnnnnnnncgggcggcgcagcatcagttcgccggcgtggacctccggcggcccaaggggtnnnnnnnnnnnnnnnnnnnnnnnnnnnnnnnnnnnnnnnncccgtgcccgcggtgtgcgtcgcgggacaccaagttctgctacnnnnnnnnnnnnnnnnnnnnnnngccgcgccacttctgcaagggctgccgccgctactggaccaagggtggcacgctgcgcaacgtccccgtcggcggcggcacccgcaagnnnnnnnnnnnnnnnnnnnnnnnnnnntcctacgtggccgccgcggacgccgacaggcagcccaagaagaagcccgccagcaagnnnnnncgcgtcgtggcgccggccccggagctcgccaccgcggccgacccaggcaagacggcgaccaccaccacgacgacgagcgagatcaccacggagactggcgcgctggaggactccgactccctggcgcacctgctgctgcagcccgggacagaggacgcggaggccgtcgcgctcggcctcggcctctccgacttcccctccgccgggaaggcggtgctggacgacgaggactcgttcgtgtggcccgccgcgtcgttcgacatgggcgcgtgctgggccggcgcagggttcgccgacccggaccccgcctgcatcttcctcaacctcccgtgacagccacacacggtcacggcgccgaggcgtacgtcctcctgctctgctctgctctgcgcctgatgatgagtgcaaggaaatggagcgctttgattcttcagctatttgatgcatctgctaattgatttggcagtggtggtaaggtacacgcacgacgagctgactgcgtggttcttggtttgggccttagtatatgatgatgatgacgatgatactagttgtatgtgtgacgtgagagacgatcgcgacgacgaccttgaattttagtttctgagatgaaaaaggtcaactagtggcctctgtatgactttagttttactcatgaactcatcagatggctggctgtggctgtggctgtggctaactcatcgtcaagtgtttctaccggctgcctataaactagactgagctcttgttgttggtctgggattcctccctgntcttatgataaggtcttttggctgcatgnnnnntcgnnnnnnnnnnnnnnnnnnnnnncattctaaattc

SEQ ID NO: 23450 - DNA, 1915 bp, Zea mays
agctcgaattccgttgctgtcgctaagatgtctacaccccagtgggttgacgctgtccagaattccagatcgacgccaacaaacacatttcaccaaactgttaaaaaatcatgctaataactatgtaatgggaattcacatcgtcatgctaagaaagcacagcacatcattctcaagaaccaaaaaataccaatgaatattgtggactaagcatacaacaccccacctaaattacgacgaatagccttcgtcctcgacacccttcatgacgacggagcacagcacttgcttcgagatgtgggtctccagatccctcgacacctcggcgagcctcaggtcgaagttgctcctgtatctctgcggcttaggcgacgatgaccctgagaatcgcctcctggggctcgagatcctcgctgtgggcgacaccgacagccagctcttggtgaagaccggtacgatctctttcccggtcgtgatgtgttttctctctgggttcagagggcctcgctttgtctccaccggcagtggtttcatgggtgatgttggcagcttctgtctgatccgctcacgtgcgcgctcagcggcagccatcgccttctctttgctcatcttgatcaatgtccatgggttgatttggatgtcatccttccttcctgaagcatccatttggtcgctctcgaccctgatcgacagcttccgcgcactttcattcacttcatcttttctgcaaaaggcccttgaaaagaaagatggcttctccggtgagtcaaagtcgacgctctcgtcagagtcagagtcttcgaatgggtcaaatgctgctcctgcttctctcatcgcaagaatgtagtcgtaggtcctcatgccctttctaatgagaaccatgtggaaaaagaagagctggcccagtgctgcagtgctgtaaattgtgaagatgacaaaaaccactgatagtgctgcatgagctccttttgggagcctcaggtgcagcctgtgctccatttccattttcacccctttgctgtcgacaaaacagcggatgaagatcgcaattgctgttcctccctcaatgacaagcatcagcaagacaaagaacataagcagaataaacgttgcatagttccttcttccaatgcaattgtttagccacctgcagtggtgatcaaatccatcaacgcaacgctcacaggtcttgcagtgcttgctacgcaacttcacctcgcagtcgcagatggggcagaaagagatgtcgtgcccgtcggcagtggcgcatggcgagacgatgtcatcgaggctggtgaaggcgaaggggagcatgggatcgagctgaacgctggtgttccactgctccaggtagctccgccgcacccagcggttggtgacccgcgcctcaacccgccgcagcaaccgcaccgcgtagcgccacaggatgtagccataccgcagccgcggcaacttcgccgtgcccccaccgccccgagcgagctgccgccgccgcttggtcttcttcgcgtcagtccggtctgacgggtccaccgctgtgcagcgcacgtagagcgccgctgtcgctgcggccgagaaggagaaggtgattaggaggatattgccggcgagggtgttcccgatgtagggccccaggacgacgtagaacgcggccacgagaagcgcgaataccgctgcggccaccagctgaagcgggtgtagggggagctgccatccgtggcggcggcgccagggctgccgcgccatcgccgccgtgacgatgtctctatcaccgcagcgggccatctttggcggtgagatctgtgggtggacgcgacgagagttaggtgctctgcgcgctccgctccggtcgagtaaagtcccccgccggccgcgcgggtcccgtgactgatatgtggggtagggtcccggccgg

SEQ ID NO: 23451 - DNA, 1027 bp, Zea mays
tttttttttttttttcataccacaggccacagctactgctataaacccaacacacgtctgagatggtcaatagcagagaatagtacaatagcatcctgaacatgactgagaccatggtcacatcatagcaatccgattcatacatacgcactgctctcactaaattgtgcagcttcataggcatagctactgttacacagtgcgccataaacgcacccttgttgatctacctggtacaactgcagatccagtgaacatccagtttcataatttcaccagaacacacttcaaagccccccaaatgcacctcctggcgatcttatcagcaatcagtcttcaggtcctcaggccacagatatctctgtggaactactgactcacctttgacctgccagtctgccaccactgttgctcgtggcattctcttcctcattctcattcaatgtctgctcgagctcaagtttgtgggctgacattcgggcaatctcagagatagctgcatcacggacctgcacatcatcaccagcaagttcctcgtatgcagcctcaaacgcctcctgccagaaccgtggaagccgtacctcatcactggtccgtgtgtacatgtcccacattcgtcccactaatttctccctctcctccatctcaagggaatcgaggtcgtcggcgagcgggacgtccaggtccccgtagacggaggcgaggtcacccgaggaggaccagcggagtgagacggaggcggcggacatggaccagagcgcgaggagcgcgatggcggccaaggcccagaccttgtaccgccccttcccgaggagcgccgcctccgcgccgcccaccgcggaaacgggaatggtgatcttggtcgccggcatcggcaccgggggcgcggcgctgtcggctggcacggccttcatcccagcgtcggtggtggcggggtggagagcgggactgcgggagggagaggatccgtgggcgtggttcgccccctctggacggaccgagcgcccccgccggctcgaggtaccca

SEQ ID NO: 23452 - DNA, 1006 bp, Zea mays
taacccttttcccccccttttttttttttttttgggctaagctgtttagttattagcagagaatagtacaatagcatcttgaacatgactgagaccatggtcacatcatagcaatccgattcatacgcactgctgtcactaaattgtgcagcttcataggcatagctactgttacacagtgcgccataaacgcaccttgttgatctacctggtacaactacagatccagtgaacatccagtttcataatttcaccagaacacacttcaaaaaccccccaaatgcacctcctggcgattttatcagcaatcagtcttcaggtcctcaggccacagatatctgtggaactactgactcgcctttgacctgccaccactgttgctcgcggcattctcttcctcattctcattcaatgtctgctcgagctcaagtttgtgggctgacattcgggcaatctcagagatagctgcatcacggacctgcacatcatcaccagcaagttcctcgtatgcagcctcaaacgcctcctgccagaaccgtggaagccgtacctcatcactggtccgtgtgtacatgtcccacattcgtcccactaatttctccctctcctccatctcaagggaatcgaggtcgtcggcgagcgggacgtccaggtccccgtagacggaggcgaggtcacccgaggaggaccagcggagtgagacggaggcggcggacatggaccagagcgcgaggagcgcgatggcggccaaggcccagaccttgtaccgccccttcccgaggagcgccgcctccgtgccgcccaccgcggaaacgggaatggtgatcttggtcgccggcatcggcatcggcatcggcaccgggggcgcggcgctgtcggctggcacggccttcatcccagcgtcggtggtggcggggtggggagcgggactgcaggtgagagaggatccgtgggcgtggtgagcttccgccttggaattagcagctgcacttagtttttgattagg

SEQ ID NO: 23453 - DNA, 4506 bp, Zea mays
  misc_feature (3535)..(3535): n is a, c, g, or t
tatatcctagcagctaatagctaaataaatactcctgaatatgtaggatatgcatgatatatatgcactcctgctactatagcaaataaagtagcaatcgtatcaagagcaagaaacaaacttattagggatgtcggcgattgaagagaagagaacgaagcgcaagctaagcatggatcgatctggacgtatatggaagagaagtagcctgtagaaaagagcggatcaaatcaaacaaggaggtgatcatcgaaagttaccggctggtggttgtggggagccgatgatgctgctgcagcgctgttgctggtgttggaggtcatgtccatgggcgctctggctccttcctagctgtagaaaatactgcacaagtacatgaacatgtgcctatatgtaattaacacccacaaaatcgattcaagcaaaagacccatcacacaatctcataaactaaaccagggtgaccgatggatcaaacctgttgtgcagtggaagcgccgaacagtagcaaggcgaaggatcctgttgtgcacgcaggaaagacgagacgagggagaggaagagagatgacgagtcctttagttgtatatatagagaaaagagaaggctgggagtgagatggtctgccggatggcgtgatgatgagggggggccgcctggcgcacacacaccgtgggctggacgatggacggagagcccgctagcggacggcgaggcgaggtagtagaaacggaaccgatttcacgtgaaaggaagcacgcggcgcggctgctactgctagacaatggcgcatgcagtgcaggcacgcatgagagccagccatcgtcgacgcatgcgtgccgagacgagatgccttgcgggtcttctcttccgttcatactacgtaacagaaacggcggagggagacgatcaagacaacctcttgacggtgcagatctcgcactcctcttgcagtccatgacacaaataccctcctttgattaactagggtaataaactgtaatattacttagatcctattgtttggaagtgtagtatttttgtatttttgaaacaatattatggtattgaaagtcaaaagatgttaagtttggttgatgaagataaaacacagtttttaataccatggtttacttaaaacctcgatggtatttttggagttttcgaaaatccacttaggaccttagttttcatgtcttctctctacatatactttgttttttcaatatgaccaaacagatctcggtattgagcaatattatggttttattgtggtaagtaatatcgtagtatttgtgtcattacaaattgtaaattatggtatctcaaaactacattattttaaaactgcattaccatataaattgttaactttgaaacaactcagtttttataaaccagtttcttaaaccaaacatgcccttatttaccatcttttaaaaaaaaatggcaaatgtgttaagataatcgtaaaagtgattttttggagagttgacatccgtaatgatggcaaatagttaaatttccccaaaacaaagcaagggatgaggaggaactggaatttggaatgtggcgggcggtatgacaactttacccctgtgttttcaaactcttcaccacatcttcgtataactaaagcatcatgtcacacttttataagtcataacaaatgggatacaaatggaatctgtgggtagtaaaatcataccacagctactgcagtaaaccgaacacaggtctgagctggtcaaacctacctggccgtggacgtggaaatctgtgggtagtgaatggaatcagaatccaagccaccggtccttgagctaagctgtttagttattagcagagaatagtacaatagcatcttgaacatgactgagaccatggtcacatcatagcaatccgattcatacgcactgctgtcactaaattgtgcagcttcataggcatagctactgttacacagtgcgccataaacgcaccttgttgatctacctggtacaactacagatccagtgaacatccagtttcataatttcaccagaacacacttcaaaaaccccccaaatgcacctcctggcgattttatcagcaatcagtcttcaggtcctcaggccacagatatctgtggaactactgactcgcctttgacctgccaccactgttgctcgcggcattctcttcctgcacaaggtcactggagataagaaagtcgtgttgataaacccttattatcgtgcatagccagttttattagcgcacagttgttgagtctcaagaataaaccagatcagttaggggcctagggtctgtgcaaagtatccacgttctggtgtagattgagcatctgatatgtcatgtatattctgtacttcatcaggtaggctggtcaaagatagatggattgtttatgaaactatacaagacagagcatgggtacaagacaatgtgcaaaccgaacaattcacgacaacgctatcagtttcaccaaaaaatgctgatggtgctgtaccaaaataattcacattaaaggagagaagcgatttggaggtaagcagaaacttgcaccgcattacaatcaaagcataataattggtaccccccacatgttgtttttggaaggttgtgaattctatgttttaagtcgttagttccatcagtcattatgctcatgatggttctgctgaggccagtccattagctgaaaccaaacatcctatgttgtcaggcctcaggcgtcatagtgaattcggaccatggctctaaaaatgggatacaaatgcatgccttgccttcataacaatatttggtctgaagtgggatgagttgacatggtaagaagtgtcactctcacgaaataagggaaaccacagaatgcatagtagtttacttaaaacataaggcatttggaagcaattgaggtgagatacaggttttgggcgtacctcattctcattcaatgtctgctcgagctcaagtttgtgggctgacattcgggcaatctcagagatagctgcatcacggacctgcacatcatcaccagcaagttcctcgtatgcagcctcaaacgcctcctgccagaaccgtggaagccgtacctcatcactggtccgtgtgtacatgtcccacattcgtcccactaatttctccctctcctccatctcctggtcatattgtaagacaagcataagcatccacgcatagaaatacagcactgaagtattccttttcgtgctttatgctagacaagacaatagtgaatcaggtaaccaaccattcaaccattttaacaattttgaaacgtggtactggactagtgaattgaattcagaccaaatacgaaatctgaatatggtaggctaggtgttttgcccgcagtacaatatgaccagtaaatctaaggtgttattttggttcacataattgtaacataatgggtaacacacaacgttaaaccatatttgtttaagtctaaccgtaatcagataccacactgaaaatgaataccggcttattcaaacttattaccgctgtnactcgagcgtgaatcattaccatttacgttacaattcgtgaaccaaacggcacctaatactcggtactgtacatcgttttgtgtgtgttttctcacggatggtccgataagcaaactcaccaaggccaagcgattgcaaaattctccacacatcgatctgaaactacctaaccacaggctaaaccaattatattcagtttcacccgacctggttggaaccaaccgtcgaagatcgacggcggcgagtccgcgacgccggccggtggtgaccgcggacgctggaaactcaggaccgagagtatagagaagacacgagaaatttctctgcaaatgcgtgcaatcagcaccaatgcaatccttgttccttttatagagggattcccccgtgttccccaccgcaacagatcgctgcacggtgcgccgttatttccggaacgcccagtgcgacatgcacggcaaatctgctgcggtggttctttcctgacaaaatgcggtcacggcgtgagattgggcagtctccagctcacccgcgattctacgcaaaaattgcatgatttgttactaaaacaaactacctacatgcatctaaatgagatacgtgttcatttgacacgattacaaagagatcaatgcaacatttcacccccttaatctgtcaaatgttaaccacccctagctgcctccgcatctctgcaaagcgaatccttgcaagtggttttgtcagtatgtcggcgagctgatcttcagtgcttacatgctgcacctccagcaccccatcagccacacattccctgatgtagtggtacctggtatctatgtgcttcgatctctcatgaaacactggattcttactcagctcctcggcagacctgttgtcgatgaacagcttgaacttcttcacgtcactacaggttaggtctgccaccaatctgctaagccacactccctgacaggctcctgtagctgcagct

SEQ ID NO: 23454 - DNA, 1009 bp, Zea mays
attgggtgcctcgcggccggccgccagtttctgccgtgtcagcctcgtccgcccctatctatcccctatatagccgtgcaggtcgtcttcttcctcctctccactcctctcgtctccgtctccatctccgtctccgtctccacaccgtgccgtagctgctgctgtccgtgtccctcgcctcgaagaagacaactccaacactgttgctgcgtgactgctgaatcgctccacacacgcgcgaacccagcaaggcaagaacacgaacgagagagagagagagagagacagggagggatcatccatccatcagaccatcacccatggacaaccttaaggagcagcggggccacgatgccgcgggcgccaacagcggcgtctggatgacggtgccggcgttcggggactgggacacgaagaacggcgcgctgccggactactccatggacttctccaagatccgcgagatgcgcaagcagaacaagaaggagctctcccgcgccagcctcggcggcgacgacgacctcttcgcccacgcccacgcccacgcccagaagccgcaggccaacagcgcccagcccaagctcggccgcccctgccccgccgccgaccgccgaccgctccacgcccgcgaccactccccaacgggagggaagaagttcctgagctacttccagtgctgtatcaaggcctgaagaggagctgccgcaatgctatgtctgtgtgcctgtgctttgtcgcagcagaacactcgtgagcaattaggtcccggctttgttaagtatccaaaaatgtgcaatgtatttgccctgttggtcactcgttgggcctgttagcttgtatgaagaacaagtcaggttatgggggcaggcagccgtctatctgtacatggcaccatcgatttgtttgcgactggtggtataatgttgccctgtaatcattgtattggatgggaatttgcaccgcctccgtttttttgaacgatcaaaaaaaaaaaaaaaaaaaagtctca

SEQ ID NO: 23455 - DNA, 968 bp, Zea mays
ttttctttccgcttcggtgtgctggtcgacgtggtccttctctcctctcgtctccacagtccacacacaccgtgtgcggcggtagctgctgctgcccgtgcctaccgaagaagacaagtccaacactgttgttctgttccgtgattgcggaatttgcttcaccacaccttcatcagagagccgagacgacacgctcgggacccagcaaggcaagaagaacacgagagagatagcaggcaccaggcagggatcaatcatccgtccatggagaacctaaaggagcggggacacgacgcggcgggcgccaacgcctggatgacggtgccggcgttcggggactgggacacgaagaacggcgcgctgccggactactccatggacttctccaagatccgcgagatgcgcaagcagaacaagaaggagctctcccgcgccagcctcggcggcgacgacgacctcctcgcccacgcccaggcccaggccctgaagccgcaggccagtaacgccccgcccaagctcggccgcccccgccccggccccgccgacgaccactccccaacgggagggaagaagttcctgagctacttccggtgttgtatcaaggcctgaagaggtgctgctctagtgcctgcagtccctgtgtttttttttcgcagcagaacacttgtgagcaatcaggcatcggttttgttaagtactccctccgtttctttttatttgtcgctagatagtgtaaaattgcactattcagcgacaaataaaaagaaacggagggagtactccgtgtccaaaaacgtgtaatatatttgtccttatggatcagtcgttgggcctgtatgaagaacagaccagcttatggggtaagcaacgttctttttgtacacacaaatcaccatcgatttgtccttgatacgatcaaggggcatggttcgaatgaattggttttgtaatcaaaaaaaaaaaaaaaa

SEQ ID NO: 23456 - DNA, 1007 bp, Zea mays
cctcgaggccggccgggccggggtccgcccctatctatcccctatatagccgtgcagggcgccctccggcccggcgccactcctctcgtcttcgtctccatctccgtctccgtctccacaccgtgccgtagctgctgctgtccgtgtccctcgcctcgaagaagacaactccaacactgttgccgcgtgactgctgaattcgctccgcacacgcgcgaacccagcaaggcaagaacacgaacgagagagagagagagacagggaggggtcatccatccatcagaccatcacccatggacaaccttaaggagcagcggggccacgatgccgcgggcgccaacagcggcgtctggatgacggtgccggcgttcggggactgggacaccaagaacggcgcgctgccggactactccatggacttctccaagatccgcgagatgcgcaagcagaacaagaaggagctctcccgcgccagcctcggcggcgacgacgacctcctcgcccacgctcacgcccagaagccgcaggccaacagcgcccagcccaagctcggccgcccctgccccgccgccgaccgccgaccgctccacgcccgcgaccactccccaacgggagggaagaagttcctgagctacttccagtgctgtatcaaggcctgaagaggagctgccgcaatgctatgtctgtgtgcctgtgctttgtcgcagcagaacactcgtgagcaattaggtcccggctttgttaagtatccaaaaatgtgcaatgtatttgccctgatggtcactcgtttgacctgttagcctgtatgaagaacaagtcaggttatggggccaggccgccaggcagccgtctatctgtacatggcaccatcgatttgtttgcgactggtggtataatgttgccctgtaatcattgtattggatgggaatttgcaccgcctccgtatttttgaacgatcacaaggggcatggttcgtttggattggttttgtcggtacttatgatggg

SEQ ID NO: 23457 - DNA, 1013 bp, Zea mays
cctcgaggccggccggggtgtgatgcaaacacagagggaaaccagctggattttctttccacttcggtgtgctggtcgacgtggtccttctctcctctcgtctccacagtccccgcccgccgtgtgcggcggtagctgctgctgcccgtgcctaccgaagaagacaagtccaacactgttgttctgttccgtgattgcggaatttgcttcaccacaccttcatcagagagccgagacgacacgctcgagacccagcaaggcaagaagaacacgagagagacagcaggcaccaggcagggatcaatcatccgtccatggagaacctaaaggagcagcggggccacgacgcggcgggcgccaacgcctggatgacggtgccggcgttcggggactgggacacgaagaacggcgcgctgccggactactccatggacttctccaagatccgcgagatgcgcaagcagaacaagaaggagctctcccgcgccagcctcggcggcgacgacgacctcctcgcccacgcccagaagccgcagcccagtatcgccccgcccaagctcggccgcccccgccccggccccgccgacgaccactccccaacgggagggaagaagttcctgagctacttccggtgttgtatcaaggcctgaagaggtgctgctctagtgcctgcagtccctgtgtttttttttcgcagcagaacacttgtgagcaatcaggcctcggttttgttaagtaccccgtgtccaaaaacgtgtaatatatttgtccttatggatcagtcgttgggcctgtatgaagaacagaccagtttatggggtaagcaacgttctttttgtacacatacatcaccatcgatttgtccttgatacgatcaaggggcatggttcgaatgaattggttttgtaattaaaaaaaaaaaaatacgtacggaaagcacaaatgactcctggcacctttttctataggagcacacaattttttatatatagaagtgtggagacttctcagcg

SEQ ID NO: 23458 - DNA, 889 bp, Zea mays
ccgggccaatccaccacaccgtgtgcggcggtagctgctgctgcccgtgcctaccgaagaagacaagtccggcaccgcggggccgttccgtgattgcggaatttgcttcaccacaccttcatcagagagccgagacgacacgctcgggacccagcaaggcaagaagaacacgagagagatagcaggcaccaggcagggatcaatcatccgtccatggagaacctaaaggagcagcggggccacgacgcggcgggcgccaacgcctggatgacggtgccggcgttcggggactgggacacgaagaacggcgcgctgccggactactccatggacttctccaagatccgcgagatgcgcaagcagaacaagaaggagctctcccgcgccagcctcggcggcgacgacgacctcctcgcccacgcccaggcccaggccctgaagccgcaggccagtaacgccccgcccaagctcggccgcccccgccccggccccgccgacgaccactccccaacgggagggaagaagttcctgagctacttccggtgttgtatcaaggcctgaagaggtgctgctctagtgcctgcagtccctgtgtttttttttcgcagcagaacacttgtgagcaatcaggcctcggttttgttaagtaccccgtgtccaaaaacgtgtaatatatttgtccttatggatcagtcgttgggcctgtatgaagaacagaccagtttatggggtaagcaacgttctttttgtacacatacatcaccatcgatttgtccttgatacgatcaaggggcatggttcgaatgaattggttttgtaattatgatgggaaaatacgtacggaaagcacaaatgactcctggcgaagcggccaaaaaaaaaagcggcc

SEQ ID NO: 23459 - DNA, 980 bp, Zea mays
cattgggacctcgagccggcgggactggggttcaggccgcaagtcagacaactgctttatcaaacatccggagaagcgcagaatctattacaagagtccgcggggccggccggggcttgtggaaatccaagagggatgaacaacgcccattaagatatgatatgtcatataatcttgacctcagggttctatccttattaacacagagatttaatgggctagcggagagaagcagaaattatttgacaagttggaaggaaaattccaggacttctggaaggacgggtgggcttcatatacaaggccaacaacagaacattcagtttggccgttctattcggatcaccctcttactggtgctgagtatctttctgattgtgccatttctcgcctcggcatgacaaggcatgtattgcttcaccggtgaggaacattggggcagctaaccatggtcctgctcgtactacatacagatcatgactggtggtgttctctggtcggcaaatgcagcaaaccaaccatgtctttgctgtgtggtgtggctgctgcatgtgacaggaaaagaagcacggcggtgaaggtttcgactgtccaatgcgtgatgctccgataccataaactcctcaccgggcgcataaccatgctaagatttatcagggttatgatcaatttgtgatggctgattgctgccaaatggaggtggctgttctcatctcactactctatatcccacgagtgaaagcaattgtaaaaagttctagagccactctatatcccacgaacgaaagcaactgtaaaaagttctagagctggtaggataagtcctgaatactgttattgataataatacatttaatactgtatttgccaaaccgttcgccgccgctcgtatggttttctgtttagaggtgctcttttacaaaaaaaaaaaaaaaaatccaggtttctgcacttgtcctcattttattgtatgcttgcca

SEQ ID NO: 23460 - DNA, 1164 bp, Zea mays
  misc_feature (19)..(19): n is a, c, g, or t
  misc_feature (60)..(60): n is a, c, g, or t
gaacgatcagagtgatccncctttaatcattaaagacatatatgaagtggcacgcacagnaaatttctactgttaagtgtgatgtttgtggtctagctgaggagttacatggccttagaaggaatttgagttcagggaatgatcattggaagattgacattggtaacaatatggatgatgatagaaaatcgtcaactggggttcaggccgcaagtcagacaactgctttatcaagcatccggagaagcgcagaatctataacaagagtgagatggttttggaatagcttgtggaaatccaagagggatgaacaacgcccattaagatatgatatgtcatataatcttgacctcagggttctatccttattaacacagagatttaatgggctagcggagagaagcagaaattatttgacaagttggaaggaaaattccaggacttctggaaggacgggtgggcttcatatacaaggccaacaacagaacattcagtttggccgttctattcggatcaccctcttactggtgctgagtatctttctgattgtgccatttctcgcctcggcatgacaaggcatgtattgcttcaccggtgaggaacattggggcagcttaccatggtcctgctcgtactacatacagatcatgactggtggtgttctctcgccggcaaatgcagcaaaccatccgcggctttcctgtgtggtgtggctgctgcatatgtgacaggaaaagaagcacggcggtgaaggtttcgactgtccaatgcgtgatgctccgataccatgaactcctcaccgggcgcataaccatgctaagatttatcacgggttatgatcaatttgtgatggctgattgctgccaaatggaggtggctgttctcatctcactactctatatcccacaagtgaaagcaattgtaaaaagttctagagccactctatatcccacgaacgagagcaactgtaaaaagttctagagctggtaggataagtcctgaatactgttattgataataatacatttaatactgtatttgccaaaccgttcgtcgccgctcgtatggttttctgtttagaggtgctctgttgatccaggtttctgcacttgtcctcattttattgtatgcttgccattgcccacgaaaaaaaaaaaaaaaaaa

SEQ ID NO: 23461 - DNA, 1603 bp, Zea mays
ccgcggcccctaggggcttttttttttttttttttttgcatggaccgaatcattttttttttttttttaactgagtaccaagaaacggagcttccaaattgaaaaaaaagtcaaatgaacaaccgagcaacgcagaccatccacttcaacacaattccaaacgggtaaagggtgttgtaacaatgagagaaatagcgttacataaggcatatatcgttcgaaaatttaggagcatgatacgatgaggccagcaccgaagagtcgtcaaccctaagacgctgggatccacatgcacggtactcgttcatctcgacggtattccacccggcgatctggagctggtgttggagaagtcggaggtcgccatgggaatggagatggagagctgggtggccgagaagccgaggctgctgtcctcgcccagctccggccacgagtccctcgacttgggccactcgtcgaagaaagggcgcagcgtctggttctcctgcttggcggcggtcacgaagtcgctcccgaagaaagagaggggctccctctgggtcttcggcagcgacgcgatggtgctctcgtctagcccactcagcgtgccgaacacagggtagcttgtggcttggaatgtgttggtttgggatggcagcaggcgccacgagttgtccatcatcgacggatccatgccgcccgacaagagcgtgctgtgctcgtccgacagagatttcaccccgtatgcagagtacctgagatatttgctccctccaccggcagcagtcgcgtaggcagcggcactgtccatgtgcagctgagaggtgggccccaggccgaacgtgccaccaccagcaccagcacctaacccgccgccgccgttgccgttgaggatcgacgggtacagcgagtggttctggaagccagcagcgggcgcgggggcctgctgctgctgcggcggctgggcgtgcggcgggggcgcgagctgcgcttccacaggctttcttgaacggttgcggccgcggtgcatgtggcgctcgcagtacttggagtccggggcggcctccttggagcaccgccacttcttgccgtccgtacgccggcaccgcccgggctccgggtccaccttcttgccgaagtaggggccgtacccaagggcgggtggctggtggaagacgaagcctcggcgcagggggaggaggaggtccggcgggacgggcacgccggcgacgaggtacttgtatatgagcgcctggtgctccagctcctcgtactgcgccgcggtgaagagcgccggcctcgcggcccacctgccgctcatcgcgtgctgctgcgcggcgtcctcccccgccgcggagagaggggcggcgcggcagaaggggaggagggaggaggggcggtggtcggctgccggagacggggaggcaaagggcatcgccatgcccatatatgctcttctctctccctctccgctctgccgctgcttccgccctctctcttttgccttacctggctggccgtgtctctttccctctgtctcgctcgctctgggctgctcctacgccgagcagggcggctgctgtgctgtttttttttttttttttttttttttttttttttc

SEQ ID NO: 23462 - DNA, 2846 bp, Zea mays
tttttttttttttttttttacaggaaacgtaacactctcagggaggtttattttacttctcttcccaacttcttcgaacgaccgtggctacccttaccaaaacggcacaggaaagaaccactcgtgttcaagctccggtttttttttttcatgtggcctcgcctcgccctcgaggtcgtagcaaccacaaaacgtttcttgctggtaatcagtgcatcactcatctgcaaacagcacaaaaaacgaaaaaccatggccggaacaaagacatgaagctaaagagacgtagtgctcgttacggtaacagggttcacgaacaagacgtacattgcgcctcgtgcccacggtagcgggaggtgacggggaggtcggcagcgcccgccatcgggatggacatggagagctgcgtcgtctcgccgtcgagtcccccaatccaccaccccgccttgctccctttctcgtgcggccactcgtcgaagaaatgccggagcggcttctgcgcggcgtcgtcatgtgcccccggcggccgctccgccagccgcaggtcggcgccaagaacgaagcagtgctgctgctgctgctggcgccgcgtttcctcctcctcgtcttccttggcctgaccgacgccgtacccggcggcggggagcagcggcgtgggggtggggcacggcttcgtcgcctccatcgtcccgagctgcttgaactgccactgccccgcggcctgctgctggcggtccctctcccccgcgccgtcggagaagaaggcgcgctcgccgacctccttgccgtaggcgtagtccctctggtccgcgtagtagtagggcggcggcggcggcgggtgcgggtgggtggtctcgaggtggaggtggaaggggctcatcacctgcgtctgcgtgtgatggtacgcggcgccgtagggcgcgtggtacggcacggcgtcgtgcgcggcgggggccgggccggtggtaggacggcgccggggacgtcgaggtggtggcagcggaggaggccggcggcgccggcgtggccaaggacatttccacaggctttcttgaacggttcttgccccgggccgtgtccttctcgcagtacttggagtccgggtacgcctccttggagcagcgccacttcttgccgtccgtgcgccggcaccgcccgggctccgggtcctcgtcggcgggcttcctgctgaagcccatcccgaagcagcccccccaccccactgcatgcaaaggcaaccaacaacgcggacgtgaaccggaatatactggaaataaagacacatggcgggcgcatagagagagagagagagagagagagagagacagtagtcgcgtacgcgagggttgcggctggaaggcggcgagcgacggcgacgtggtgagggcggagtcgaggatgcggcggagcggtggcatgaggtaggacgggatgggcttgccggacgccaggcacttgtagatgagcgcctggtgctccagctcctgccactgcgacgccgtgaacgggtaccgccccgcggtggccgctcgaccgctcatcatcatcatcccgacgagctagctaggctacggttacctacctgcgagcgacctacaaggctatagccagacacccgcggggcgctgcggcgtggctgtgtgctccgtcagcgaggtcagctggtcgagagggagaggacaggagtgagtgaagcacttgggtgagcttcatggggaagggagttctatttgtagtggcaggcttggatcgcgcaagctggccttggtggggcaccggcgcgcgcgcgtgtgttgttgagccgcaagaagtttgggccattcgatcgacggtcaccggtgctccgatccgatccaaccgacgttgttttgttgcgttcctacaaggcagcacgataagataagcaacaccagccccggcccccctcgtcagcaaagcgcgctccgtggcgcgaatctggcagcttacgcttaacccgtcacgtactgtacttccgtaccaccacacggtgtcatcatcggagtctggcaggagcagacgggtgcggtacgtgtgtgagcgaagcaaggagggcagggccagggcaggcgcgaccggtcagtgtattggacggttgctgcgaggcgagaggccattcatcagtcaagacgcagagtccgcgctgcagaatctgctgtgtgcgcagcggccgcacgcctgcagcccgctcagacggcgaaagtccggcgtccggggcggctgacgagtgacgagagccgaacgggcccgctcagtcgcgccgcacccgtgcccgtccacgggatgatgggaccacggccctttaccgatcctatccacctccgtccagcgaaggcgaggcgaagaagcatcagccggtagagcctagagagcgcccaacgatccagcggcagctagggagacggcgtacttctgccgcgtcgcgtgaggaggtgggccgtcgggactcgggagggaaaaaaatttgctacattcggtctgtatgcaaaccagaatatttacagcctctcataaaataaaaattgacttcacctacagcagtagcaacaacaactaaagcattatcggaagcggagcgtgtgcatggacgtggtaatagatacgatctaaatattatttatattattttcacaataaattaagatatttaattaatattagtttaaaaataatagaaataaaatctgattttaatttaatttgattcacaaatttcatagcgtacaatctaaatcctattaccctccctacgtgtaaaataatatagcgcccaacgatcaagcggcggccagggagacggcgtgcttctgccgcgtcgcgtgaggcag

SEQ ID NO: 23463 - DNA, 2633 bp, Zea mays
cttgcatgcctgcagatcgtaacagcacaagtcacgaaaaaaacgctggatgagaacgagaccgtctagtcagccatgacgatcgaggtaacgacaggttaacgaacgaacaagacgtacagtgcccaccgttacggaagcgggaggtgacggggaggtcggtggcggccatggggatggacatggagagctgcgtctcgccgtcgagccccatccacgacccggccttgtcccccttctggtgcggccactcgtcgaagaagggccggagcggcttctgcgcggcggcggcgtcgtcatggtcatggccatggccatggcccgacgacggccgctccagccgcaggtcggctccaagaacgaagcagtgctggcggcgcctctcctcctgctcgtcgtcgtccttgcccatctccacgccgtacggcgacgccgcgccgtgcccgtacccggcgacggggaacagcggcgtggggcccggcttcgtctccaccccgagctgcctgaactgccactgccccgccgcggcctggcggtcgacccgctcgcccgcgccgtccgagaagaaggcgtgctcgccgacctccttggcggccgcgtgcccgtacgcgtagtccctctggtcggcggagtagttgtagggcggcggcgggtgcgggtgggtggtctcgaggtggaggtggaatgggctcacatgctgcgcgtggtggtacgcgccgccgcctccggttgctcctgggcgtgccgacgccgagtaagggctaccgccgccgccgccgcctccatacagcgcgtggtacggagacggcgtggcgtcgtgggccgggcggtggtaggacggcgccggggatgaggtggcggtggcggttgtggcggcggcgggggccggcgccggggccggcgtggccaaggacatttccacaggctttcttgaacggttcttgccccggtgcatgtgcttctcgcagtacttggagtccgggtacgcctccttggagcagcgccacttcttgccgtccgtgcgccggcaccgcccgggctccgggtcctcgtcggccttccgggtgaagcccatcccgaagcagccccagcccactgcatgcgaaagaaaccgccacctcagggctcaggcgcgcgctcagctaaacaaaagccggcccccggcggcctgcccggtgaaaccccatcccgaagcagccccagcccagcgagggttgcggcgggtaggcgagggacggcgacgtggcgagggcggagtcgaggatgcggcggagcggcggcatgaggtaggacgggatgggcttgccggacgccaggcacttgtagatgagcgcctggtgctccagctcctgccactgcgacgccgtgaacgggtaccgccccgcggtggccccgccgcccgcccggccgctgctcatcatcatcatccccgcgcaccgccggcggcctctttctctcgctcctgacgagcttggtagcttggctagctacccttgagactgtagcgcgagagaaggtgagcggagcacggctatgcggcctggcggtaggggtggcggtagcgtcagcgagctggtgccgagggatggcagaagggttggagagtagacggtggcaagagcgcgagtagcagtgagtctcttgggcgacgtccatggggaaggggttttatttgtagtgggcggcgcccggcagcaggctgctgtgggtcgcacgagcaagcctcgcaggcgcctgcgtgtgtgggtttgttgggccgcggaagagatttgggccattggatcgaccacacgaacgacgggcaccggtgctccgacccaacggccctgctgcgttcctccaactactgtaacgggcagcacgaccgagcagcagccgtgcccagtcccccctcacctcgtcaacaaaggcgagagctccgggacgcgaatctggctgcttacgctaacccgtccgtcaggcgtcagacactgtagtaggctgtgttccgtaccgctcgctcggtgtcatcatgggagcctggcaggagcagacgggacgtgccgtgcagcatgcgggtggggcgtacgacgtgtgtgaggtgagcgaagcaaggactcaggagggcacgcgcggcagcgcgaccggtcagtgccttggacgtgattctccacatgtaccggtcagtgtctgggacagttctccggcggcacaggctgccagcgctgcgcaggccattcacagccgtgacagcatgcagggtgcgcgctgcaggctcgcccgtgtccgcggctgctgctgtgcctgcatgcagtgctggctgcagccgcgcgacgagagccgaccgggcccccgctgctctcacagtcgcgtcgcacccgcccaccgcacggtccacgagaccagcggcgggtacggacggagacgcggcgacggcgtacgcctgccgcgtcgcgtgtgattgtgaggaaatgtgaagcagctgatctacactcgttcacggttgcttataagtatgtgtgtttacagctcttcgctactttttacaacacaagtaacagttctctggtagccgcccgtgtgaaaacggcaggtgcagtgaaaaggggagagcggcaacgctggctggtgtcagacgctcgccgcgggtgacg

SEQ ID NO: 23464 - DNA, 853 bp, Zea mays
accacctaccccgccgccgccgccgccgttgccggcgaggatggatgggtacatggggtggctctggaagccagcggtgggcgcgggggcctgctgctgcggctgggcgtgcggcgggggcacgagctgcgcttccacaggctttcttgaacggttgcggccgcggtgcatgtggcgctcgcagtacttggagtccggggcggcctccttggagcaccgccacttcttgccgtccgtacgccggcaccgcccgggctccgggtccaccttcttgccgaagtagggcccgtacccaagggcgggttggtggtagacgaagcctcggcgtagggggaggaggaggtccggcgggacgggcacgccggcgacgaggtacttgtatatgagcgcctggtgctccagctcctcgtactgcgccgctgtgaagagcgccggcggcctcgctgcccacctgccgctcatagcgtgctgctgctgctgcgcctgcgcctgcgcggcggcgtcctctcccaccgcggagagaggggcggcgcggcagtaggggaggagggaggaggggcggtggtcggctgccggagacagggaggcaaagggcatcgccatatatgcttctagttctctctctctctctccgctctgccgctgcttccggcctctcttttaatgtgctgtgcttttgccttttacctggctggctctgtctctttccctctgtctcgctcgctctgggctgtgcctgtgcctacgccgagcagggcagggcagggcggcggctgtgcgtgctatactgctcgctacggctacctgatgagggaggcgggccgaggtgagggacggacggacggacgggggc

SEQ ID NO: 23465 - DNA, 3781 bp, Zea mays
  misc_feature (134)..(134): n is a, c, g, or t
taaaacaatgttttacacgaccatatacacgatcagctggacagaatctaacttcatagcgttgcaactccacggtacactatcggtgatcggtagtttgtattgagggagaagataaaattaggtcagattgngtgcgtcgaatcgagcattttatgttttatttcttggtcatgtggatcgattggtaacggaaaattttaatattaacaaaaacttgtgcctatgtattatatcggatctgtcacgatgatgcgagcgtggttacacgagaactgttgctatgggctctgacatcgcaaccaacaaaaaccatcattgtacatccactatcagcatctccatgggcgttcaatttggattgcttcacgatcaacgcaccacccgtggaccgcacgtgcacgaccccatgatctagtagcgggcatcatataggtaagtcgtcagcgcacgaaaggagggcgagcgtatagcgagtgtatgtgcacgctgcaactccaacatagaggcggtgttttgtttgaagaatcaagcaattttagacgaggttgtatatcatgaatccattttataaatttggtgaaattaactcatttctcatattattattaattattagcttatgaggaatgtaatgataataaatgaacttattccgtttcataaaccaaacaaaaaataagaaatgaaaagatgataaactactctcgttcctcagaccaaacacgctaatagtagaacaggagtgagtcttgagggtcaacataaatccgcgcagactgtatgcggcaaacagggaatttcatgtgtgcggcaaacagagaattccatgtttgattagtatggaatatgaacggacgactagcaaaaagtgataataagtcgtgtgcatcgccgccgacgaggcctaacgacattcgcatttcagcagcgttattacgagagaactgtgatgatcagctgaccttggcagcgttcagcggagctcgtagatctggcgcgaccgtgttggtatctgacatgggaaaatgctgtcagcgagctagctctgacatccgcaaagcacgaaaaaaacaggtcacggtgcatccctgcagcacgcacttcgctgctaccctatggatcccttgaggagaagaacaagaacaccactgcgtacagcgaccacatagatgggcgatggcgatggcgatggcgttcttaataaacttaggtctcctttggacaagaatctctctacgcaaaacaccgacgaccgacttcgccccggtttgttgagcagcgctggtacgttgctgcaggaccggttatcccgaggcgcctgtcaggcgaggcatgcccttgtcagcagaccactgggccgcgaataacatgtctagtaccgtcacggcgtgcgcgtgacagtagtttatacgcatgcctgccatccctctgcgagaatatcggattcctaggttgcccacgtgcgtcgcaccggtgtcaccgtcagtgtcctgcatgcagtctacgagtattatattatatactccgtaagtactagtgattgtccatcaagaagtacggtaaaacctgcacggtcgaggtaagtgctgcctgcaaccggacagacatgctttcggtcgcctagcttttactagctgagagcctgagacttattatcgtgtcgtccccccttcaaaaacaggtgaaccatcagagacacaattcatcatcactcccacaagctacgtggcacgagaacccgggtgcgcgcaggcgccacatgcacacacgcaacgcaatcgcacaggtaaggtcagcgcagctaccccgtaatggccgtattgtcgggtgaagcatggtgattaattactgcggtttagtattcgctgcaggctctgagcacaaaccatcacagacaaaccatcacagacaggcagaggaatccgacagcgggaaaaggcaaatccagaccagagctgagatcaggaaaggccctcacttctagcactaagcgtcgtctcacaggtacagcaaaggaagcaagcaattacaggaaacgtaacactcccaaggaggtttattttacttctcttcccaacttcttcaaaccgtgccgaccggccctgagcaaaacggcacaggaaagaaccactcgtgttccagctccagtatttttttttcatgtggcctcgccacctcgaggtcgcagcaaccacaaaacatttcttgctggcaatcactcatctgcaaacagcacaaagaacgaaaaaccatggtcggaacaaagacatgaagctaaagagacgtagtactcgttacggtaacagcctttgggttcacgaacaagacgtacagtgcgcgccgccatcacgtacggtagcgggaggtgacggggaggtcggcagcggccgccatcgggatagacatggagagctgcgtcgtctcgccgtcgagcccccccatccacgaccccgccttattgctccccttctcgtgcggccactcgtcgatgaaatgccggagcggcttctgcgcggcggcgtcatgtgcccccgacggccgctccgccagccgcaggtcggcgccaagaacgaagcagtgctgctgctgccgccgcgtttcctcctcctcctcgtcttccttggcctgaccgacgccgtacggcgacgccgcgccgtggccgtacccggcggcggggacgagcagcggcgtggtgcacggctgcttcgtcgcctccatcgtcccgagctgcttgaactgccactgccccgcggcctgctgctgccggtccctctcgcccgcgccgtcggagaagaaggcgcgctcgccgacctccttgccgtaggcgtagtccctctggtccgcgtagtagtagggcggcggcggcggcggcggcgggtgcgggtgggtggtctcgaggtggaggaggtggaaggggccccgcgtcccctgcgtctgcgtgtgatggtacgcggcgccgtagggcgcgtggtacggcacggcgggggccgggctgtggtaggacggcgcctgggacgaggaggtggcggcggcggcggcgcttgtggcggaggaggccggcgccggcgtggccaaggacatttccacaggctttcttgaacggttcttgccccggtgcatgtgcttctcgcagtacttggagtccgggtacgcctccttggagcagcgccacttcttgccgtccgtgcgccggcaccgcccgggctccgggtcctcgtcggcgggcttcctgctgaagcccatcccgaagcagcccccccaccccactgcatgcaaaggcaaccaacaacgcggacgtgaaccagaatatacaggaaataaagacacatggcggccgcatagattgctgaagcccatcccgaggcaccccccccgcccccgcgagggttgcggcgggaaggcggcgagcgacggcgacgtggcgagggcggagtcgaggatgcggcggagcggtggcatgaggtaggacgggatgggcttgccggacgccaggcacttgtagatgagcgcctggtgctccagctcctgccactgcgacgccgtgaacgggtaccgccccgcggtggccgctcgaccgctcatcatcatcatcccgacgagctagctaggttacggttacctacctgcgaacgacctacaaggctatagacagacacccacgcggcgctgcggcgtggctgtgtgctccgtcagcgaggtcagctggtcgagaggagaggagaggacaggagtgaactgtgaagcacttgggtgagcttcatggggaagggagttttat

SEQ ID NO: 23466 - DNA, 3096 bp, Zea mays
tacagaatacatgccgcagagtaatagctttcaagataatttgatacatgatgtagattatacaaataaaaaatatattggatggaatttcgtatttcatactttataacaacacaattgcaaactattcccccaaagccacaagtatagtaataaagactaaagagttcaaataactcacagatctcaatatctcatgtgagaaggtggcagggatgcagtacaggggtggtacaatattacatcagggacgctagaaagacatcactaggcagccaacttggtcaggcggtgaattgtactcctggcaagcctatttgtaggatcaatcttcagaaccaaacgcaggtcctcggcaccaagcctatatttctctgtgctttcataaaggagagcacgctgcactagcactgagacattatccttatcttgatccagcacctgcacagaagataacagataaccataaagttactaaaactctgaacacatttgtgtaccatcactcaagcttactagcaacaagcatatcatgccaaataggccatcatattaatcaaagtgcactttcagacaaatcaatacgtctacaggaaaatgcaataccttcgagcagtcagtgatggccttcttgtactcaccaacctccttatatgaagaagctcttgaagacaacacctcaacaatgtcagcatctttccctgatttctcaattagaacaacagcccatgacaaccacttgatagcatcagcatactgccctcccttgtagctatccatccctttggccttggcagctgatattgtcaatccggatggtggcggtggcaggccatccagctctgtggttgtgccaccactatcaccaccagcaaactctgcctccacatcgacccaaccatccatctcaccaaacatgtcaccgccactgtcaccattactagcggcagctgcagtcggtgcacttgtggttgaagcaaaaagattatccagaggatccatgcttgagttaactgctgcagccacaggagtaggcattgaagctggtgctggcggtggtgtaaagttagaaggtgtggtcgtgccagcgctttggaaaccaccagatccagcatcagtactctggaagctcccaaatccagcagcgacactggaattcacaccctggaaagctccaaatccctgatccggcttgaccgaattggcctgcttcaccgcgttcatggacccaggctttgcggcaaaggggtctattgagccaaatggatccctctgctgccccatcggctgcgcagcagccgtcgcggccatgcccacgggtttcatcggccggccaccaacgccgtatccaccggagcccatcggtgctcccgtagttttcgggagcgcgcccgccatgccgcccatcgagaagggagagctgctagcgttgacattgggcttctcaccggctggcctggatgcctgtggcgcggcggcggatctgagcggcgcgttggactgggagcgggaggagccgagcgcggagccgaggagatcgctgaagaggccggggttgttggcctgagggatgccgaacccagaggagggcgcggcggaggaccagctccggccaaagatgtcgccgaccatggaggttggcccggatccaggccccgccatggtgggcgccgacgccgcggcgggggaaggctggtgggtccacgacggcttggcgctggcgggctggtgcatccacgtggcgccggtggcgggcctcgttggagggttggtagccgcgcccggccgctggtcgcggagggggcgagagccggaggagcgggaggagttgatgccgaagtcgaacttgtaggagtcgaaggaggtgttggtggggcgcaaggaggaggaggaggagcggtcgccggagtaggagctcatggtgcccggtgccggagatctacgaggaggatgggaaggcaagcaggcgattggggagcggtggcttccttctcgtttgatttttttcctttcccctccgttggggtatctgagtatctgtccacttcgggaaaaggcccgagcggacgcgggcagcctggcacgcacgatggtaggtggcgcggcgggtgcgtccgcgtgcgcgctggaatggaaagcttgcggcgcttgcctggtgagtggcgaccggctgtaatgagcttcagccttcagctgatcaatcctaagcgggtgtttggcaaaatcagctcagcttcataaaactttaggccccgtttgatactgctcctagccggcttcggctctggctcctcgtcggagccctcccaaacggcatggtgaaaatagctccacactgggagcaggagctagtttgagggccgagagccggagcccgaaaaagtggctctaaccggctccgtgatgaccatctctggcgagcgtggagactgcacgagcgtgcgcgccgccaaacagtagcatgagcgcggagtcggcaggcacaagcggtaccgacgtgggagggcgacaacacaaggtgatttgatttggcctggtttattcgcagatttgatttttgttacttgcaatcaccgctgcagttggcatgccttgccgaagcttgaggaggaggtgtggccgtgaagaacgcgtgcgaaggcgcacacgaagtgtttgtgtaaatgtccaatagcactttggacatttgagttataaaataaattaaaaaagtgtttgggagtcactgttttgtcaaatgatttgtaaaagacatcggctccggtagagaagctgctcttttaaaagagccgctgttggagccagttttagaggagccagagccctcccaaacagggccttagagttaagtagctatactttaaagttacaaaatttctaaaaatgtttgacttacagatgtaacatccaaaattttatatggggattgatataagtttttttcaaaaaaaatatttgagttaaaaaattaattaataatatattcctttctcgtatatttacctaaagtaaataaatagtaatatcaaaagctcagtagcttaaaatttagatccaaaactggaaactaaagattcaagtaaaactatgaacaaa

SEQ ID NO: 23467 - DNA, 1730 bp, Zea mays
cccctcccccctccccccctctcccctctctctctctctctctctctctctctctctctctctctctctctctctctctctctctctctctctctctctctctctctctgaccgggaaacgaaaaccggtccggtttgtagtgtatttgggtttagaattttaaaatataagagttgacctttggtcaacaaaacagtattcaaaaatacaaaacgaaaatgttttccttgctgctcagtaaaaccagcacaaaagattattttttattcaggttgccaaacttttccagtacaacaaactcccaccctgaagaacagttaccacgttactgaacagttcgctgaattaagctctcacatatgccctaaagccaaaactgcctcaatccctaagcaaattcaagaaaagttaaacactggtgtgcaataggagggttaagcaccgagaacgtgaagcatgatggcgttctgagcgtgcattctgttctcagcctgggggaacacgattgaatttggagcctcgatggcaccgtctgtcacctccactcctctctctgcgggcaaacagtgcataaggtaggcctgtgggccagcaatctccatcagggcttcatccaccgtgaatccctggaacttctgttttctataatcagcttcttccttctggcccatgctggcccaaacatctgtatacacaacatctgctcccttaactgcttccctgggatcgtttgttatttcaatcttactgattccagcactcctggcgatctccactgtctttgcatcgggctcaaatcccttgggacaagcacatacaaagtgaaaaggaagtacagcagccaatagaagccacgagtgcacaatgttgttcccatctccaacatagacaaccttagtgttctcaatgcgaccaacgtgctcaagcatagtaagtgcatcagccattatctggcatggatggttatagtcggtgagaccatttatgacaggtacagctgcatattttgccaagtccagaatatcctgatgagcaaagaccctggccataatgatatcattatagccagaaagtactcgagcaacatcacgagtctcctcacgcttgcccatctggatatcatctggacccaaataaatagcatgcccaccaagtaagaagaatcccgcctcaaatgaaacacgggtcctcattgatggcttggcaaaaatcatcgccattgatttcccattgaatggttggaagctcctgtctccagactttatcgctgccttaacctcgatcgctcgattaaggatattcattattgtatccttgtcaaaatcattgatatgaaggaaatccttaggagcctgtttggcatccttccccgcgacggccgacacagcggggctggacacggcggcgaccgcgaccccgccgcgggccacgggcgaggcggcggcggcgattgggcgaccgctgcgagaagggagcgtgagcggctgcctgaagcggggggaggagacgacgaggtggccgctggagccggagatcgccgccgccgccatcatcgcgggtggcgcgcgcgtgattggggcgcggtggcagtgagccagtgacccggatgggtgcacgagtgtgaagtgaactcggatagttgccttcgccggagtcgggatacggatttgttgctaggcggaatcaggttagtctaggcggcggcccgaattcctgcgcccgggggatc

SEQ ID NO: 23468 - DNA, 1666 bp, Zea mays
  misc_feature (889)..(889): n is a, c, g, or t
aatcactgctgctgaggaaaaaccagcacaaaagattattttttttattcaggttgccaaacttttccagtacaacaaactcccaccctgaagaacagttaccacgttactgaacagtacgcttactgaacagttcgctgaattaagctctcatatatgccctaaagccaaaactgcctcaatccctaagcaaattcaagaaaagttaaacactggtgtgcaataggagagttaagcaccgagaacatgaagcatgatggcgttctgagcgtgcattctgttctcagcctgggggaacacgattgaatttggagcctcgatggcaccgtctgtcacctccactcctctctctgcgggcaaacagtgcataaggtaggcctgtgggccagcaatctccatcagggcttcatccaccgtgaatccctggaacttctgttttctataatcagcttcttccttctggcccatgctggcccaaacatctgtatacacaacataacagttgctaaggagaccaataactgagaaacactgaaacaagacattgcagaacagttgcttgtacagtttcactctcacttgaacaccagaattatgattgagataaagaccctaatatcttgaaccatatgaaggtcggaacacaaatgattatttatctagttttaactcagtcgcctcacgggcttattcaaagtatatgtagttggtgtccagcaagacacagaaattctagaaagtgtgaaaacagacaaaccgtgaatccctggaacttctgttttctataatcagcttcttccttctggcccatgctggcccaaacatctgtatacacaacatctgctcccttaactgcttccctgggatcgtttgtttatttcaatcttanctgattccagcactcctggcgacctccactgtctttgcatcgggctcaaatcccttgggacaagcacatacaaagtgaaaaggaagtacagcagccaatagaagccacgagtgcacaatgttgttcccatctccaacatagacaaccttagtgttctcaatgcgaccaacgtgctcaagcatagtaagtgcatcagccattatctggcatggatggttatagtcggtgagaccatttatgacaggtacagctgcatattttgccaagtccagaatatcctgatgagcaaagaccctggccataatgatatcattatagccagaaagtactcgagcaacatcacgagtctcctcacgcttgcccatctggatatcatctggacccaaataaatagcatgcccaccaagtaagaagaatcccgcctcaaatgaaacacgggtcctcattgatggcttggcaaaaatcatcgccattgatttcccattgaatggttggaagctcctgtctccagactttatcgctgccttaacctcgatcgctcgattaaggatattcattattgtatccttgtcaaaatcattgatatgaaggaaatccttaggagcctgtttggcatccttccccgcgacggccgacacagcggggctggacacggcggcgaccgcgaccccgccgcgggccacggccgaggcgggtggcgcgcgcgtgattggggcgcggtgtcagtgagccagtgacccggatgggtgcacgagtgtgaagtgaactcggatagtt

SEQ ID NO: 23469 - DNA, 1588 bp, Zea mays
tttttttttttttttttttttttttttttttttttgatccagggtctcggccaaacgtgtctttcaatgttaaagctgtcatgattcgcgaatgaaactagcacataagtttattttttattcaggttaccaaacctttacagcacaacaaactcccaccctgaagaaccgttatcaccttactaaacagttcgtctgaactaagctctcatatatgccctaaagccaaaacagcctcaatgcttcagcaagacagcaatgcccaataatctaagaggagcgtgtcactggtgtgcaataggagagttaagcaccgagcacgtgaagcatgatggcgttctgagcgtgcattctgttctcagcctgggggaacacgattgagttgggagcctcaatggcgccgtcagtcacctccactcctctctctgcaggcaaacagtgcataaggtaggcctgtgggccagcaatctccatcagggcctcatccaccgtgaatccctggaacttctgttttctataatcagcttcttccttttgtcccatactggcccaaacatctgtgtacacaacgtctgctcccttaactgcttccctgggactgtttgttatttcaatcttactgattccagcactcctggcgatctccactgtgtttgcgtcaggctcaaatcccttgggacaagcacatacaaagtgaaaaggaagcacagcagccaatagcagccatgagtgcacaatgttgttcccatctccaacatagacaaccttagtgttttcaatacgaccaatctgctcaagcatagtaagtgcatcagccattatctggcatggatggttatagtcagtgagaccatttatgacaggtacagatgcatattttgccaagtccagaatatcttggtgagcaaagaccctagccataatgatgtcattatagccagaaagtactctagcaacatcacgagtctcctcacgtttgcccatctggatatcatctggacccaaataaatagcatgcccaccaagtaaaaagaatcccgtctcaaatgaaacacgggtcctcattgatggcttggcaaaaatcatggccattgttttccctttgaacggttggaagctcttgtctccagactttatcaatgccttaacctcgatggctcgattaagaatcttcattattgtatccttgtcaaaatcaatgatttgaaggaaatccttaggagcctgtttggcatccttccccgcggcggcggacacaacggggctcgacacggcggcgaccgcgaccccgcggcgggtcacgggcgaggcggcggcggcgattgggcaagcggtgcgcggagggagcgtgaacggctgcctgaggcgggcggaggagacgacgacgtggctgctggagccggagatcgccgccgccggcgtcatcgcgggtggcgcgcgtgtgattgcggtgcggtggcgctgaggggatgggaggacagatgcgatgcgatggacgggtgcgcgagtgcgagctcggatactgccgtcgccggactcgggatacggatttgttgctagggcctcctggcccggccggcctcgaggt

SEQ ID NO: 23470 - DNA, 1163 bp, Zea mays
ggcccccgcggcctttttttttttttcgaatccgggacagttgcacacgcatgatatgttgcctgacagaatgaactgttgcttgtacacaatttgaatccgaggagagttactgagttagcactctttttttttcctgagaatgacgatgctgattaatgttatttattattcagcttttgtttgtttactctccactaggactttattgatgaacaaactagcaaccgcgttacatctttccaaccaagggacgcaggatagaaatccagtccttgtattccagaggagaacctgaatcgttgatgggtatgccattcacaaagaagtagggtgtcccggtcacacctcgtgcacagccgttcttgaaagatatccttgtagcctgatcagaatgtgaatcgttgaaacctgctctgaatgccgccaaattagtttcaccgatgatgggcacaacaaggttcttggttatttcatcaaccactgtagctcttgatttttcgtatgttggctgattatagtaacgtttctggtatttgaagaacttctccagcagagggtacacgaacgacggatttagtttgttcaccgcatgaattgaccggcacgcaatgaaggcatagctgtggtaaggcagcgggaagaggtgaacgacgacggacacgcgtgagctatagtgctcgacgaccatcttgagcgccggccacgcgtcgcggctgtcggggcacactgggtccaagaacgcctctaccaccaccgtctcgccccacgccggcggcttcccgccgtacacgaacccgtccgtcctcgccgggatcgggatctgggcgcggcaggcacagcacccgatgatcaccaccagcagtggcacaagagagacgcggcggcggctgctagcctccatttcagctagctagcttctctctctaagctatacttggccctctttcgtcaatttattattcaaccaaacacggacacgggcacaaactaattactccggcccggcccggcgcgcggcacccacgccagtaggcccccggcgcaacttgcgttcaaaaactcgatggttcgcgggattctgcaattcacaccaggtatcgcattttgctacgttcttcatcgatgcgagagccgagatatccgttgccgagagtcggtcg

SEQ ID NO: 23471 - DNA, 1428 bp, Zea mays
tttttttttttttttttaggcggccttcgtaactcaatggatagatatatcatggtttagcccaacacacaatttgttcaagaatcaaaatactataatgagtgaagcacgttcggtaccagcacgtgcccaaccatcatactaaacacaaaaaggaaactcgactagtcgagtctaaacaagagcacctcccacagtatacactccagtgatttggaaattattagccgagactggaacacctttctgattcaaggtttggtgcgcatccactccaagaaaaaggtaccaacacaattcaccaatccagtgctgtttgaaggttggcctttacataagattcagtagggttgcaaaattcagtcagcagcctggttaagagggttgtctggggacttcttccacagtttccatatcatgtctttgtattggtgcagcgttagacctggcttttcttccttcagcttagggagctctgcctcttcaaatgccttaaaggtcgacttgaggcgacgctcaggatgcttgtcagcgggcagggacgcctgcggatccacgaccgacatccgcgcgatagcctcctcaaccgacctggcctcgatgagggaatcatccctgttagtgttttcgacgaggactacgcgctcgtactcctcctcctcggcgacccgcgcggcgcgcttcttggcggcctctgcctcccgctcgaggcggagccgctcctcctcggaggcgcacgagctcggcctcggtaaccttggggggcggagcggcaacgcgggacgccttgcgcgcggcggccttggacggcgccgatgcggaagcggcgacggcggcggcctctgcctcggcgaggcggcggttctcggccttgcgagccgcggcctcggcgcgcttctcggcgtcctcctcccggcggcgcgcagcgcgggacttggggccctcagcctcggcccagtactgctcctccttggcgcgctcctggcggtcgcggcggtcggcctccgcggcggagcggcggtcgcgggccgcctccgccttggagttgacacccatcttcttcggcatcacgggccccctcgtgcggcgactggcggcgcggcggcgtgtggctgatgtgacggccggatgggccgaagcaactgcaatccggactccgctttgcggttcggggggaatcccggccggcctcgaggtgtccttctgtaggaattggccagcggtggggtagggcacgcgttcgagagagttcttctgtacgcgtctggcccagaaatcgggtgacaccttctcacttggggctgattcggtgggaagggatagggagaaattagtttattttcccttaaattcttctaatccttctgtgatcttcttatcaccaaatcagttcttgctaaatgcaatttccacctttgacttctgcag

SEQ ID NO: 23472 - DNA, 3347 bp, Zea mays
agattatattattttccttactagaatttcggttctatctcaggtggatcgatgagattagaaaaaattataaatttttttgacttatttggaaattaaacccactcaatctatatgaattaaaagcaaaaaaacaaaccgttagattattataaaaggtaagatggtaaaatatcactttagaactacaaataaactaagctagcattagttaacttatttcaacttatttgtgatactacaactacaaataaactaagctagcattagttaacttatttcaacttatttgtgatactacagtgatattttatccttctacattttcactataatccagcttatataatctagtaaaaaaacgagagagattgaggcaaataatgaggcggccttcgtaactcaatggatagatatatcatggtttagcccaacacacaatttgtccaggaatcaaaatactataatgagtgaagcacgctcggtaccagcacgtgcccaaccatcatacttaacacaaaaaaggaacctcgactagtcgagtctaaacaagagcacctcccacagtatacactccagcgatttggaaattattagccgagactggaacacctttctgattcaaggtttagtgcgcatccactccaagaaaaaggtaccaacacaattcaccaatccagtgctgtttgaaggttggcctgcacatataaaacaatggtatgctattgctcatgaaatccgacataagtagaatgaacctattaagttagagatttaatacttgcctttacataagattcagtagggttgcaaaattcagtcagcagcctgcacataaatatttgtttgatgttagacataaatcacactaagcacagataatagaacattaagatgcctacggccaaaccacttgatatttctaggaccaacaatgataaatggctcaccatatcactagtgaaaattagtggaaacaagtttacgtataatttcaattacatgtattaaagctgaagatgccaaatatggcagattcatacaaactatgtactgtagataaatcaacagaactacagaagacatggtacaaaatcgctaggagatagaagccaaacctggttaagagggttgtctggggacttcttccacagtttccatatcatgtctttgtattggtgcagcgttagacctggcttttcttccttcagcttagggagctctgcctcttcaaatgcctgtcataaaattagcacaaatgcattcaatcaccaaatatacaccaaacagtagaaaaactaaatgtctactgaagcacacaaaattacacaggggtcaaggtattgaaaattatcacaaatgctgtattgaaagtgaatatagaagaccatggttgtgaattcttcagatgagttatatgccacttcgatattttctatgtatagagtatagacataacattatcctgtatgtgtttcttccttcagaagatgtaataatattgctgatcacgttgctcctaagttatagcagtacaaccaaggtttgagatagctcagcagcaatactattagtcaaacaatatgtgttgtgcggaaaatattccaaatttatcattcttataaattgcagtaccatatggaattaggaactggattaaaaatggaactatgcatataggaatgtcccgaaacatgggaacgatttggaatagcagagtaaaagaaaatcatgcaacactacagcattatcaattcgctatagcatatcaattatgatgatattgtgctattttcaagcgctcctacaggttacaggtatggtaacagagactgccatgtatgtgtcccactgtccccattcatatgttcataaggttttttaaaacttataggtttatagctgctcaggtatgggagcacgctggttgttaaatttagctcctcaactcacaaggaccaaatcatttttaactgtgattacacactacacagcctcgcatatctttctcaatcatatgaaaatttgatatatctacattactagtatatcagacacctattttatttgtaattgtggtacaatactacgaaatttcacatagccagaaagttgtttagtaaaagagcacaagaaacaaaattcctgcagcttagggagctctgcctcttcaatatgccttaaaggtcgacttgaggcgacgctcaggatgcttgtcagcgggcagggacgcctgcggatccacgaccgacatccgcgcgatagcctcctcaaccgacctggcctcgatgagggaatcatccctgttagtgttttcgacgaggactacgcgctcgtactcctcctcctcggcgacccgcgcggcgcgcttcttggcggcctctgcctcccgctcgaggcggagccgctcctcctcgcggaggcgcacgagctcggcctcggtaaccttggggggcggagcggcaacgcgggacgccttgcgcgcggcggccttggacggcgccgatgcggaagcggcgacggcggcggcctctgcctcggcgaggcggcggttctcggccttgcgagccgcggcctcggcgcgcttctcggcgtcctcctcacggcggcgcgcagcgcgggacttggggccctcagcctcggcccagtactgctcctccttggcgcgctcctggcggtcgcggcggtcggcctccgcggcggagcggcggtcgcgggccgcctccgccttggagttcacgcccatcttcttcggcatcacgggccccctcgtgcggcgactggcgcggcggcgtgtggctgatgtgacggccggatgggccgaagcaactgcaatccggactccgctttgcggttcggggggaatggaggtcggcgaggtgtccttctgtagaaattggccagcggtggggtagccgggtagggcacgcgttcgagagacttcttctgtaagcgtctggccctgaaatcggatgacacgttctcgcttgctgaatgcaatttccaccttcgacctctgcggctctaccgtcctaacttttcgttttttaacctaaatttctagttccagccttccgtggacgccaaaatccaaaccaggtcgaaaaaaaccctcctatttccgttattattttcttttactaaaaggggatcagagcggtatagccgaaaacgaaaaagatagtaggatacggttacacaaaaatgaattagaaccaatagatatgtacgaaaacggatggtaaccaaaatctttggccgatatatgcaatattgtgcaattactcaataatacaatattaagagtttatcacactataaatcataacttcaaaagaataaaaatc

SEQ ID NO: 23473 - DNA, 2017 bp, Zea mays
tacatatttaacacatatttttatggaaagcttgaggaagcattgtgtcggcaggatgagttctcaaagttgagaagatggtggaaaggtgtcaatatattaaataaagcatacataatcttgccgatccatgggatggcgcactggagcttggtaatcatttgcattcctgcaaaagagagtatttcaggaccaatcatacttcatctggactccctagcgatgcatcccagtactaagatcttgaacacagttgagagataccttgaaaaagaatggtgccaattatcatcatgggaggattttaaaaataatatacataagcaaagcgttgaggttccacgacagaataatgagtatgactgtggcatcttcatgctttattatattgaacggtttataaaagaggctccagaaagattcacaattgagaaactgggtatgtttaatcggagttggttcaaacctgaagaagcatctggtctaaggcggagaataagagagcttctgctggaagaatttgaaagtgccaagctggatgatgctttaccaggagcggatgcatctgagcgtgatgacagcataaatgatggagaattgaaaccagatgcatcttctgacagttcagaaatggtcgtagaggtggtaggagggttgggaggcactgacaagagcaatgaaggcatcaaggttgtagcatcagaagaggcaagtggagagtcaggagatgctggtaagagtaccgaaggtactgttgcagcatcagaagaaaagagtattgaaggcatcaatgttgcagaaccagaagatgcttgtgagagtataggaggcatctatgttgcagaatcagatgaagcaagtggggagtttggagagattggtaagaccaacaaaggcaccaaagttgcagtgtcagaaggagcaagtgtgtctggatacactgataagaatatggaagacatctctgactctgaggttgcagtattagacaaagctcccactagcagctacagacgtggagagaagaccacagcctgtgttctatcagaagcagcttcactttccgatagcgtcaaagatgaacaaggtatggtgaaaccagattctggcagctcaaaagctgagagagaaggagatttgattgtaattgcatcgccggaaagatcggaagggaatgatgagatcattggtagcatgccaattacagatgtagtttgtgacagctgcgacagcgacaccgagaccaaggtgaggatcgtaaaaattcacagaagaaaatttgtcccatcgtgtggttgcagcaattgacacaaggggccatgcaccgtgcaaaccttctggttgcgttctcacgaagatgcgaaattgtgacagattttggtaatgatattttgaggttcctgtggccgtataccaagcacatagatgaccaggccaggcggtgatctcagtaaaccgaataggtagcgggtcgatgcatggcctgcttccccctgatctcgggcactaggctcctggaaagcagttttgggtaggcagttcattggcttgggcccgggacttgtaaagtgtacaggcgattggacgttattacgtatgttatggtgtttacattagaagatctgtgactgtgaacacctgccacaatttgagataatatgcgcgtaaggtcttgcgttttcctttttgttctgccccagagctgccaaacatgcatccttgttcttctccagccttgatatgatggcatttcttttgaccttggagtagagttatcgtgtgaatgaaggaagctattacagtacagtgcaaatttccaacggcatgatacatgtctagctctctagtcttggtgttcgtggaagtgacatggatgacactgccatggcagcagcattcattcgtgtgagttcgcatgaacaacacattcttgttaaatgctcgcagcggtctagcggatgtcaagcattagtggcatgaggtttttgaaaggaaaaaaaaaaaaaaaaaagcggcc

SEQ ID NO: 23474 - DNA, 6304 bp, Zea mays
gttaccgcgcactcgtccccgggccggggcccgggggaggggccgaggcctcagcgcaccgcagctcgggattagcgataagctggttggccagctcttgtttttgtatttgtgttcgcactcttcttctattaacaaagatgcacagctctcctgcgtattagacaaaaaaaaagatgggtcggtcgcgcgcagagactttttatgaaaaaaaaagttgtcaagttgtactacgtacaccagcattgttctaaagtttcggcaagggacaaccgaacggaggatgatgatggctagcggctttgcaagttgctttgctgcctccggaaaaagaagctttgcaccgtaaactcgtcaagtgtgtgtgcacatagcatcggcaaaagaaagaggcagatttttttttcgcccacgcacgagacgacgcagtgtcagtccgtttcgcgaaccaggaatctcactcggctgggttcctactatcttttatttatttatttatttattatgtttttttttgttttgtttttgccgttggcatgcaagggagggacgaaggaaccggcgctgtgacgaggccgaaactggaaaggcctgcctgcctgccactctcctccatccatccatccccagccctggtattgctggtgcgccatctctgtgtctctatctcctctgtcttttgtgctcgatttttttatataatttttttggatgctagtgctagagctaggctttcaaatagtcaagctatatatatatatatatatatatatatatatatatatatcagtctgagcaatttgcatttggtttctctctattagagcctgtccatctctttctgccgctctgcgaccccctgtgcgccgcgcgtgcgtcatgtcgttgtgttccgtgcgcagccggatggatcggccggtctagacgccctcttgccccggcggcggcgcgtagaataatcggcgcggcggcgagatacgacacgacgtcaagggccggcgtggccatgagttgcaagaaagccttgtcgcctgagcggtgcagaaacgggacgggacgggacggaaaggaccgagcctgttgcccggccctgttctgttcatcgacaggcacgtaccggccgcggggcgggcggagaaagcgatgaacagtcagaagtgtgaagaggccctgaacgacgacgacgacgaagcatcgggagggtgatcggcgacggtgacgcggccccgccttttaatccagagggcactcgcactcgcacttgcacttgcacttgcgcccgtttaactcccggaaagtaacgcgtgtccgccgtgctcggacatgtcgtgagcgccaagttgaatcgctcgatgctttttgccctgatggggcggtggacggaagaaggctggctctggctgggcttcgtgaaagagaccggcagcgacggcgatgggccaggccggtaatgtgctgcggcctgcggcgcaggcccaacggaacggaacggaacgcccccgtcgtcaactgtcgcaggccgcgaaacgcttaatcgagaaagaagcttttgctgctggattttttttttctgctgtcaattcatcatggaaggaagcgtgagcccggcacctcgccctgccctcacagtcacaggtcgtatacatggacacgcatctgcctacccccagccggccggacggcgatagtccaaactgtgatcaagtatcgtgtgctgtctgcaaacaaaatggaaacgcgtgtcaagtcctctcgacgccgttttcatatcatttgtgggttcgttgtgtcgcctgaggagccgtcttagccgaacccggaagggtacggactcacaggacatgctccctacggagaggctatccatggcaccacttcccatactcgcaactcatattatgttgtaacacttccactcacacaatcatgttgtaacactttcactcacaccgagcctcttttttatctctgacatggaatataagagcgaacaataatttttttaaattgtgctaactaggattcgaattcaagacatttgctatctctgatactatattaagttgcataaatcaataaattaaactaaaaagcttgatcagatgaaaagagatgtacaaaactgtcatcactcccgagttggatgctgcagccgcgtgcttcaggtgccaccacgtttctaaacgagatgcagatgagatgaccggcaggcaaccgtgcagctcccgagtcccgggacagttctgacgagctctgcctctctgaaactgaaaagtctgtggactctggtctggagtgctcctggccactcgtacgcaaccgttcaaaggcgtccacactccacaacggctcccgtggatccccccatcccccacggcccacggaccacgagctgcgcggtgggatgggatggcttttgcgtgcggattgctgcctagtcttgttgccatgtactacgtcacgagtcattctcaccggctcgttttgacatccttcaattttccagtcttccaaccggacgaatcatcatcctaagatctcaacagcgaaacggagggagatgcaatgcaacatcttctgctacaaatctacgagcgtttgatctgttgccatccctgctgccgcatgtagcaatgacactgtacacctacttgtagagtcaggttacatgccttctcaattttccaattacaggaatgattatccctctttgcaaagactatgtacagctgacggcaaccaattgtgacttttcgtaggcaagaagcacggttagagatatccaaacgggccgcccggtccaggcccgttgaagcacggcctgcttaagcatggtacggttagacccgattaattatttgggccagatcgggatgtctgtcgggatgtccgacaggtttaactcatcgaactatagactaaatattcaccgttaagcagcccagcccgaaaatattcaccgtaaatatggtgactaaaagagactaaactttagttctttagtcactaaggggtgactaaaagggactaaagtagtatttttaccttatttgtcctctccacttttttcttatagcaaacatccattaattaataggggtaaaatagtcattattcacagtaattaatgctctttaatccagtttagtcactggaaccaaacgtgtactttagcgactaaactttagccactaaaatttagtctaatgactaagggaaccaaatagggcctaactgtctaccaaagcttcctattcatatgatctttccaaaagtgcctttctacaaaaaaaaagactaaaacaacagtttacattactggaccttcttttggacacaacctaaaaatgttgtgacgtcgaaccgaagtgacacagtggtttgaatagatcttatgggagaccactaatagtcacccttaaatgtggcgcaccacgacatcaaggaatgccatgacaaggaaggcagcagcagcagtagcagctggagacaacttctcccatccacggcctcctgcaaatggtccagcaaaagccaaccttgcccaatcatacaacgctacgctccatgaatgacaccgcgcccaccctccggtccctactcccctctctctttctctctgcatttctaggctgcaagactttgtggcattccaaaaccatcgtgacctctatacagtttattatcccaagaccatcttatggctccaacaaaaaatgaccaagttcaaaataaaagccataaatctggtctcggttctgaatggtttctacattgctgaaacttccaagaacagaatacaatgtgtatatttgaacaataaaacaacaacagcaacaacaaaaaaatgcaatggaatttacactgcagacatatatatgttttacaagaacgtcatctttgcctctcatcatcatcacatcagaatcacgggccaacacaacaccaccggcacacaaggttgcagcagcttcgctttcgctgcatctctgtcagctcagatagctccgaacccaacaggtaacgcagtaagccaaggcagcctagctccttcctgaatggctcacagccataccacaaaaactgtacatcagcagcactcctgctggtccgtcatagccgcacgtcgccgatggtctccctctcgaactcgcgcacagcgccggcgacgcgcttcatgctgccgtcgtagtaccagggcgtcttctcggaccacgtcaggccgccgcccttcttcggtggaacggagacgaactcgcggcacacctcgccgaggacgttgatggtgttgtggtagtggtagtaccggatgaggtgctccgtcttgtgcgtggtgttgccgatcacgttctcggacatgtggacgcctgtggcgtacgcgttcttcgcctggatcgcgtacttcctgtccctcctcaccccggtgatcgagttccggaaaaccagcttctcgaatccccattggctgcacaagttaaggcgaagaagaataagtcgtctcacttagcttctttggacatgcaactaggaatgcttctacggcactagaaattgccaatcgaaatgcttctacgggactatgggagtgggcattgcaagaaagcagcaactttagaagcaaacgcaacgcacagccaattgggccctttagtcaaattcagatcgatttcgaggaataaaggagtcacttacttggaatagtcggccgccggatcatcgacgcacagcttgctcgacattgggttctgttcgatggtgaactgcgtgtacggctcaagctcggcgagcacatcctcgagcgcgcggccgtcgggcaggaacatgtactcgtcgacgtcgaagaagaaggtccacttggccgcgtgccggtaccggtgcaggcagtcgttgacgacgaggaactggttgtggtaccacccatcgtactcggcctgcgcgcgcacgtcctgcagcgtggcgcggccggcgcgcacccacggctcgagcgcggcgcgcacggcggggcccacgccgccggcgtcgtggaacacgaagtgggagcgggcgccgaagaagcgcgcgtggtacgccatccactcccgcacccgcgccgcgctcaggttgccgtacagcgaggacccgcagtagaggtagtcgtaccggtgcggcggcgtagtccggaacgcggcctcgtcgtaggcgccggggctctcctccagcgccacgatccgctcgcggcgggaggccggggaccgcgacggcccgtagtgcgcgtacaggacgagcctgccgcccgcgctgtcggcgttggggacgcgcgggaacgtgcagttcccgacccccccggtgtagacgcggccgtagccccagtccgggagcatgtggtacgtcttggccgcgcgcatcggcggcgacgaggcgtcgctgggctcccactcgcagcggaaccacggcttgccgtagacgtgcgtgggcttggacgccagccccacgaccgcgaaggtgtagggccccccgcggtacgcgcccatctgcacgaacagcgccgccgcgctgcccacggcgtggaactcccgccgctcggggccgggcggcggcgacggcgaggacgaagctgtggagttggtggcggaggagcccttcttggcgtggacggcgagcgcgcgggggagcgagacgccggcggtgggttgcgggcacgcggcggagaatggggaagcgaggagggattggtaaggccggagctgccaggcggcggcgaggagcgtcagcacggtgagcgcggcgaggaagggcttaaggtcgaagcagagaaacgcgggcgccgaacccggcgcaatgccggcggcggcagcgtccttccgcattgccgtgtgagcgctgccacagtgccaccgcgcgccgggctggtcggctggggtatgggactgggtgaagcggagcgggagtgtcggagagtgtgaggtgcggttttccattcgcggcccgcggattaattagccgcccgcttttggcttttctcgtccaaaagtttccggtcctggccaacgcccattgattgatggaggactgacccctcgccgtctcggtatcgacgcgcgtctcgagtcggggtgttccggacttccggtgaccctttggtccgcagaatgttgtctcggcgttctctttacccaaggaagctgctagaagtccactgtgccgtttgattggattctcacaaatcagaataaaaggaattatagttctatcagattttaagattctaaaatatacccctccgtcctaaaatatagtttttttctagctcactatttttctgtcc

SEQ ID NO: 23475 - DNA, 1325 bp, Zea mays
tttttttttgcaaactaaccagctaatccaccctatttccggcaagcatgcagcaaacccacggccagcccggcagcgaacgaaccgccgcccttgcttcgctcgcggccgctcgcgccgtcgcctcgcagctcctataaagcggcgccccgtcctccggccgggggagcaattcggagagagatcaccgtcgaaaagcagtctcccaattccaccgaataactaataacatctcctcgagcgcgaggccggcttccttggaccaatccagcagcaagcgacccggccagcaccagcagccatggagatgaagaaggtcctctgcgccgcgctcgtcgccgccgcctccgccaccgccgtgctggccgaggtcgcctccgagtcgccctccgaggcgcccgccggcgcggccgccggcgcggccggcggtgcggctggcccttccgccagcgccgccgccgccgccgcagtgcccgccgccgcggcgctcgtcgtctccttcctcgcctccttcctccactgagcgacgtaccgcgcggagtgcgggaaacctgggatggagcatcgtgtttggttcacccgattaataattaattaatcgttgttttatttatttatttattgcttgcggttgcctaattatgtgatcgtctgttgttccttccttcgttccttccttggtgatgtgtgggtcgccaagggggtttcgtttctgtaatcctgcctgatcgatgctaatactatgatcccaatttggtttatgcgagacgaccagttttgtttgaatcagaattcagaatgatgccaatttggttttgtaattctactgttgttttatccatggacacatgctgacgtagctcctcaggtcattgcattgtttgaatcagaggatacctaaacgatgtggagaaaagaaaaagagaatggagcagttatgctttgcatcatgagtcatgccgcaaatgtcagtcgtcactgcggttgcaaatagttgtggttgatgcagaattccaagatattggttgggatcaccaacgagtacctttattttgtacataattttttaatacaaagaatactgtaggaccaccctacaataattacttaaaaataataataacataataatcgcgcgaatcagctgctagattcgacatcttcggaaacaaagccgacgtacacaaaatttacatcttttaggccttatagtttgtgccggattggtgggtggaaacgattcctaaccggattgcttctctaatttatatgaactttaattaggccttgttcatttgcgtcggaatcgttccgactaatcaaag

SEQ ID NO: 23476 - DNA, 1483 bp, Zea mays
ccacactctcttcagtcttcactcctctcctctccccgctccagtcgggcccggcagtctcctctcctcaccttgccaggaacccaggaggaggagggatacagcctgaataacctaggtgcaaaggcatggtgtggaatgtgcaaatctcttaaaagaatcccttcagtccgcagagactatagggaaaaatattggcattagcacgactccaaccaggttgtctgccatagttttgctggagggacaaaaacagaagcgttcctgactctacctcaaggatgagagctgcgtcctccacggtttaccctgtctaccttagcctccaccgccaccccaacagccaccaagcctcttttcgtccctcgagagcaaaccatgacaacacccataaatgtaccaagccacccaaagttcttagacggtctctcttctccctgcctgcctcatttcttctcctccacacatcctcctcccttgccgtagatgacgcaaacatgccatctacctcaacaattgacaccacgatcacagatcgcatcttcatggacttcagcgtctgtccaagctactttcgctcagacagacctctaggagctgagctttcctcgtgccctgattccgagcctcttggtcgtgtcgtctttggtctctatggccggcttctccccgtcactactgcgcgtggccgcgccccgggtactgcagctgcatataggggcacccttgtccacaagctccttcagggacagttttttgctgctggtcgacaaggtcctcggcatgacaagggtgaggtccagcctccctctggcctcgttaggaattctgagactgttaaccctaaagcgttcgagctaaggcatgcaaggcccggcacgctttcgttatgccttggacagaatgacgatgatgacgacatcaagctcaaccccaattatcacaatcttgaattcttggttactacagggccaggaccctgtcctgagcttgatggacagaacatcgtctttgggactgtattggaaggaatggatgtcatcaccagcatcgcaaccatacctacctacaaaccagctgaaaggatccgcctcttcaacggctttgcgcagttgattggtgatggaagggctcaaactgcccgggcggccgctcgccgcccgcttaagaccgtgtatatcagcgactgcggggagctgacagtaaccaaaccatctctttcccctccaagcttgccatgactgccagtgtaatgacactacccacatagccagttttctgtctctgttgcttgggtcctctttctgtactctatatatgcagtgtatatattacctgtgttattaaacttatgcatgttccatgagctgtatatatatcgcttccgttgttaatttatgcatgttccctttgacaatgactgtacttgatgagtacatggatgttaattatatggtcaaggcctaatcaattatagagtcct

SEQ ID NO: 23477 - DNA, 1766 bp, Zea mays
tgcagattcttagtgatgtctttccatatgaatagatgtctgaagatcatacaaaattaacatgtgtgcctatacaatttgaggcccatgttacttgactgacgttatgaaaattaacttataattttgaaactggacatttcccatcacccttaactctgctaaaatattcattcttagctgaaccatgtgtttccaaagatggcaaccttacaaaacaagaagtagacaggttaggttcacaacagtgaagcaatgtattctgctcatttacacctagcaggaattcatatgcaaaaataatgcaaaataaatctgatgcaaactagtgcagagaaaggggatgtaatctatgaactatggtgcctatgttactcttgaactcctctaaaacttgttaatgctgtcataagttatgttatcaatcagaccgcagaaacaaatcattgtcctctccaaaagaattaaggggggaaatggtgactcaggcacactgaccatcttgtgtcatgagcggataatctgacgcactgagattgatgaaccagtcccactggagcccctccttgaggagaatggcgacggcgtggagcgtgcaggcgaccatggtcggccccttgtaggtgacaaggttgcccttggcgatgacacgcacattcccgacctggctgaacatgggatcacccttgacatacattgccaggtcgatccgttcccgcggcggcgcctccaggtcgaggtgcaggatgtactggttgcgcgggtggtagatggcctgcagagtccgccgcatccgcaggccgtcccccttggtgccctcgaggaggtacgcgatccgcggcggctcggcatcggagtcgtcagagttgacggcggcgtcgtcggggttctcgtcatcgctgtcgctggcggcgttaccttccagcagccggttcttgattcccgcctcgacggagggggcgccgtcgccgcctgtcgacgagccgccgtcgtcccagtcggcgagggagaccacgtcgaacaagaccgcgtcgctgccgccgcccgggtacggcggcgagaagaggccgcacgcggcggcgagtaggagcgtggccgtgacgagcatggtggcgaggaaagggagcagccagcggcggtcaccgaacggacgcgcggggcccgagccgagccccagattcttcctcatttgcccgtcatgcgcgcgcgcgtcttccttcttctttagcgcaactgaatctcaggatgtccgaccttacggagcacaccggcttttctccggtgatatagaatctcgcgagcgcaccaaattggtggcggggacgaaacggatctggaactcagatgagctctggagagcaagatcctcaagcgaagcctcggaatttcaagagggattttgctcgccaggggagtgaggacagcggatgaggcctcctaaacaatccgagctctcgttcgcgacgagcgagtggcccggcgaggcgcgcaggccaccgttgttccgcacgggcagcgagcaggcgccgcgtcggcggcgagcacgtacgcgcgacgaggacaaggcccagccccggcgtagagcaacgagggagagctcgtgaggccgccgggcacggccggccaactttagcacggctccgctcctccccagtgaagcacttcgcgcgcggcggcgctgatctcttctcggtaggcggtggcaggtgaactgaagctctcactgtgggagctcccgccccggcccgccccggccggcctcgagg

SEQ ID NO: 23478 - DNA, 1560 bp, Zea mays
ttttttttttttttttggcaagcaacaggtatatatcagtgcatataggaatcttcggtcacgaacgcgccgccctgagaaccttctcgacgccgacaagaatctctacagcctttagcttaaaccaatctcttaaaatagttgccacacacgtacttactgatgcttattattatcattattacagttgcagcgatagtatatcatacgtatcatcgaagcatgcatgagcattcaatcagagccaaaacagatgctgctcatggccgcgacgacggcgccaccagctgctgcacgttgatcgggtggacgaaggtcccgttgtcgctgaagagctgctgcgccgtgaccgccgccaacgtctcggtggggtggaacctgtcccagaagaagaagctgctccggttggggcacagcggagccgaactgttgcacgcgcccgagccgaaatcccctgagccgcagcacgcgcggtcgggcgtagtgaagttgttgggaggtgtgctagcgtgggtgaatatccactgggccatcgcgacggcgtctccgagtgagtacttcatgccgggcagctcgtcttggctgaggctctccagcatggagccgatcatggggtacagctgcctggagaggttgttcgccgtgccgaggcagccgaagccgtccacgtcgtgcgtgtcctccgctatcttcctctgcgacgggcagcacccgaccagcgacgggctaacgacggagaacatggttgccccggcggcgtacagatccttcacgtaggtcgcgtaaagagcaacgagccctcccagaaacgcggtgtcgttgcggctaacgttgcggttcttagggtctgcgaagaagtcgctgtactcgaacaggtcgttgctgccgacgctgatgaagacgagcgactcggagacgagaccgggcgccgtccgctcccgtctcttgctgccttcccacgtcgtcgtccgaacgaggctcgtgaagttgccgacttgctcggccatggaaaccaccgcgccgccacacacagaatcgccggttgtagggaggagacccgaccctccggacgcgaagttgatgcccgtgctcaccgtcgtccgccgagtgtgcctcgccctcgcgttcgccagggagaggaaaggtggcgggctcccggcaaagcccagccatcgtgctagatggtccgccaagttgtagccgttgctgaaccggccggtcggtgactgcccggggtggtagtcgacgccgtagggccggtagttcgctttgcagctgtcgttgacgctggccaggtggttgttgttgccgacgtccaccagggagtccccgaacacgaacatcgccggcacgagcggcttcccggccgcacctggccgcggcgcgaacccgagcagcgagctgcacaggacaacgagcaccacggatgcgccgccacggctggccatcggaggagctagctagctagccccggcctctgcgcgggcgttgttcgtctccgctcactctctgtcttgtgtgctatatgtagagatgcatctcgaggggggaaaaagatag

SEQ ID NO: 23479 - DNA, 1469 bp, Zea mays
ttgggaccctcgaggccggccgggataaccgccggacgccggtgatgaccacgtaatccggtgtacgctcgttaaccacaaacgtccgagcgtcacctggcgtcggctgtctggccgcgcggactggagcaatcaaaatctctcggccccccaatccatacgcgccgcggacacccacccaccaccaccacacgcagcgacgcagcccgcccatctctctctctctctctctctcggggcccccccacgcccacacgcacgtttccagttcgaccgagccagagccccgccccgggcagtttctattcgctgtcgcgctcctcctcctcctcctgcacatcccctccccccgaattcgagccggaggaccgaagagtagatctgcgccgggcgaccagaggatggccgtcaactgggagctgcagggctgctgccaccgcgaccagaggatcttcatcgccgccgttggcgtctccaccgtcgtcatcctcctcctctggaggacgttcctgctcacgccgttcaagctcatcaccgtcttcctccacgagaccagccacgcgctcgcctgcaagctcacctgcggcgatgtagaaggcatgcaggtccatgcgaatgagggtggcgttactcaaactcggggtggcatatattggataatcttgcccgctggatatctgggttcatctttttggggaatggtgttcatacttgcatccacaaatctcctcactacaagaattgcagcgggttgtttcatacttgcactgtttattgtcctttttgttgcagacaattggtttcttcgctggctctgccttggattcattgtattcattgctgttgtttgggtcatacaagaatttacatctttccatattctgaaatatgtgatcttattcataggtgtgatgaacagcttattttcggtttatgatatttatgacgacttgatatcccgaagagttaatacaagtgatgctgagaagtttgctgaaatatgcccttgcccttgcaatggttttgcatggggtgttatatggggattcatctcgtttatcttcctctgcgcttcaatataccttggactggtcatattgtcttgagggttccaacctcgcgcacgccgttttgatctgacaaccaactctggttggctttttccagagttctccttgctctagattttgggttcaaacttacattgttctggcggctgtacagtatacatgtagggtaaacatgtacatccatcgtggagttaattcggcggggattgttcatgtgattcttcgattttagcggttctatagataccattgctcatttatggtctgtagcctcattgctcatttgaccaatttgaaatcgtattcagaaacgccatattcttcgatttacaggtacatgtacaccatattacctttgccccattgctcatttgaccaattgattgaaatcgtattcag

SEQ ID NO: 23480 - DNA, 613 bp, Zea mays
gccttggattcattgtgttcattgctgttgtttgggtcgggcaagaatttacatctttccatattctgaaatatgtgatcttattcataggtgtgatgaacagcttattttcagtttacgatatttatgatgacttgatatcccgaagagttaacacaagtgatgctgaaaagtttgctgaaatctgcccttgcccctgcaatggttttgcatggggtgttatatggggattcatctcgtttatctttctctgcgcttcaatataccttggactggtcatattgtcttgagggttcgccattctgatctgacaatcgactctgattggctttttcgaagcttcgttgctcgaggttttggttcaagcttacatggttctggtggttgtacagtatacatgtgcagggtaaacatgtacatccattataagttaatttggtggggattattcatgggattcttcgattttagtggttctatagagtaccattttacttaccattaccagttgcatttatggtctgtagcctcttcaatttatgtacctgtatatcatatattgctcatttatccatttcaaaacgtattcagagatgcaatattgtgcatcttt

SEQ ID NO: 23481 - DNA, 1148 bp, Zea mays
atacgcgttgcccgcccatctctctctctctctctcttcctgcgcccacacgcacgtttccactccgaccgggccagagccccgccgggcagtttccgttcgctgttgcgatccacctcctgcctgcacatcccctcccccgagttcgagccggagggccgaagagtagatctgcggcggcggccagaggatggccgtcaactgggagctgcggggctgctgcgaccacgaccagaggatcttcatcgccgccgtcggcgtctccaccgtcgtcatcctcctcctctggaggacgttcctgctcacgccgttcaagctcatcaccgtcttcctccacgagaccagccacgcgcttgcctgcaagctcacttgcggcgatgtagaaggcatgcaggtccatgcgaatgagggtggcgttactcaaacccggggtggcatatattggataatcttgcccgctggatatctgggttcatcattttggggaatggtcttcatacttgcatccacaaatctcctcactacaagaattgcagcgggttgtttcatacttgcattgtttattgttctttttgttgcagaaaatgtaagacttgtttgaattgtgcagtggtttcttcgctggctctgccttggattcattgtgttcattgctgttgtttgggtcatacaagaatttacatctttccatgttctgaaatatgtgatcttattcataggtgtgatgaacagcttattttcagtttacgatatttatgatgacttgatatcccgaagagttaacacaagtgatgctgaaaagtttgctgaaatctgcccttgcccctgcaatggttttgcatggggtgttatatggggattcatctcgtttatctttctctgcgcttcaatataccttggactggtcatattgtcttgagggttcgccattttgatctgacaatcgactctggttggctttttcgaagcttcgttgctcgaggttttggttcaagcttacaaggttctggtggttgtacagtatacatgtgcagggtaaacatgtacatccattataagttaatttggtggggattattcatgggattcttcgattttagaaaaaaaaaaaaaaaaaaaaaaaaaaaaaaacaaaaaaaaaaaaaaaa

SEQ ID NO: 23482 - DNA, 5013 bp, Zea mays
  misc_feature (4469)..(4469): n is a, c, g, or t
  misc_feature (4473)..(4473): n is a, c, g, or t
  misc_feature (4541)..(4541): n is a, c, g, or t
  misc_feature (4556)..(4556): n is a, c, g, or t
  misc_feature (4690)..(4690): n is a, c, g, or t
  misc_feature (4723)..(4723): n is a, c, g, or t
  misc_feature (4730)..(4730): n is a, c, g, or t
  misc_feature (4766)..(4766): n is a, c, g, or t
  misc_feature (4918)..(4918): n is a, c, g, or t
  misc_feature (4922)..(4922): n is a, c, g, or t
  misc_feature (4924)..(4924): n is a, c, g, or t
  misc_feature (4928)..(4928): n is a, c, g, or t
  misc_feature (4942)..(4942): n is a, c, g, or t
  misc_feature (4983)..(4983): n is a, c, g, or t
  misc_feature (5006)..(5006): n is a, c, g, or t
tgcagtacgggtgagcgcacggaaggttatttcctcactctatcgtagtttacagttagctttccagtatgtgagtgcggacagccttgccaattcagcatccaggcctcttttaattgtggccccaacactacctagaggcccttcactatccaaaataacagccatctacaaacactttttgtgtagaggagtatgattggacattggagccctatacagttgtagtcggatagcctcctgcctcctattcatcatgacatttttttggtcgctaatccacgatactcctataacgtatggggttccgggccccccctcccgattcttttttggtgttctctccttttgaaagcgtacatgtcaaatttgacttgtattgatcggaataatcttctgtacagcaataactagtggcatatgtactgtatgagcactagacaggccaaaatatgtacacgcctgtggacttgtaatcttaccccatgctggagaagctatttccacactttgacagcgccgtctctgctgcctgataccaatctctggctagacaagttgaaggatgccaacgcgagtattgcgtcacgatggcaccctgcagaatctgcagctgccaccgcgagctgagtcttgggcgtcaaaccggagaccgagctactctgtttgtacatttcctgcacgacctgtattccaaaactggatcttatatcgtaagactcatcgtttccaactgctttctccaagatatctccttttgccgaacggacttctttcgccgagggaccagcaatacagaagctttgctcaggccttgcttgatcccagtaacgaatcttcaaatctgttcctccagttaatagatcaccacctggcaagggcagcaaagaacgtatccctggatggcgtacaggtgggtcattcaattcgtcgattctgtacttataattgcctgctcgccttatatctttgatgactggcttgttaacaggcctcgatggcgcctttgacatcacagcttcattgtcagtgcttgctgttctaaacatctgatggcagtttccattctcagcattccacagagaaacttcgttgcatccagcggcaacaaaaactaatggccttccagcagaggatatcgaacttggtggaggtataagcaagcatagtttctctattgggcttaatgttgaataattccacgatttaacaggtactaaaaacctattatcccacagtgtaaggacgcctctcgaagaacctgagatgaaccaattcccacacgggcccacaacaagtgccgatcgatagccctcctccggagaggatttaaaagacaaagattctgagttggttcttgtatcccatttatggatgccacaatgttcagtgctgaaaagaacagtcgggctaaagctgtcggttgaacaatttacaacgctgagaattgcgtcttctttaatctcgttcctttttacatcaacaattccagcatacctttccacaacactcccaacgctgcgtgcacaatccacagaaaacaagtgtaatgttccatcgctagcaccgacaataacctgtgaagtaccatgaaccattgtcgtacatagagctcggctattacccatgctgtatgttaacctagatctgaaagcaatgtccttttccaattttcttgtatcccatattttgatacttgagtcatcagaagcagtcacaaaaaaggtattatcatttgatacggcaatgtcattgacagaagagcgatgctcctggagatgtgccactagaattccacgaggcttccatccagtctccaagttcactgctgatctggagaaaggcaaccctccagtatcagagttcggaatgatatccccttgcaaagaggaattgctcttcatagagtcattgatgctgaaatcttgtcgcgtgctactaaaatgatcatctctggtctgcatggcaggacggtttggttccaaccaaggtagccttattgaagctttatacactgatgaatcagggaccatgtgtgtttctcctaaaccccgcttattatcagtacaaaaagaatatgatggtattcctttagataagccatcataaaaggagctatttgcagcagatgcatgcagagcaaaaccagaatatagtgatttttcaaaagaaacagagtttttgacatacaaggacatgctgctggaaatattagggcctttcggtcgcaggatatcttcaaggttggccaaggatccactttgtgctgtaccaggatatcttccaccatgtactatctgttctttcttgccactgctcttcagtaaaatgtctccaatgtcctgagcatgctctaaaccttcatagaagattgattttggtagtggaggcttaagacatgaaagaagagcagtttcagaggccaatgaaggtggctccatgtgtaggaactgccttagatgaggagaaagatacacataagtatctacagatcctaagctctcgctgcaggcagcaacaaatcttacagcagactgtttaacccaattgattggataccggagcagggggagaatctttaccaatagaccaacaattactcttttcctcaaataaccacttctgcacatcatggtcaagcaatcaagtgcatttacaaggacagcctccatgtcatcacttagtgcctgttcaagatatggcagaagatattcctcaacacttcttgctccaataaaatagcaaacatagacaatctggccaaagaaaactgcacggagctgctcatcatgatcatttagaaatgctggaagtataggaagaagaaaatcgttactttgtttgtgcccaaagaagtaacacaaataacctatatcctgcagaagagctctacgggtattaggtgtctgcttttgtcccatcaccaaatcttgcactatctcataaatagatttcctcagttctgcaagctggcgaaaaaaattatcttgcctcttcgctggtgaatctgcagattgggatctgtgagctaccactgattcatccagaggtcgaatatctgcaatgctacgagaacgaagtaggaacctataagctgttaaagccagcttatgaatattgctagcatagcaaaccctaacactctcttccgtatcatcagggagcaaagagagcattgggaggatatactcagggaatataacagcatcactgatagggaaatcttgcacaagacaaagaacatcacatagggtttccaaagcagcacagcggacaatggcagacggatctgaaagcatcgtaatcacatagggaaccactagctgtaggcgactatcatcatctatgtatgtggacgagaacttcagaagaatgaggctggcccttcttagctcaggttttttcacactgcttatgcatgagcaaagtaatgaggcaagcaagaccatgccttcacagctcaccttggagtctgtctgctgaaaaatatcaaaactataggtatctgattgatcatcataagtagccaccaaggagcgtatgttactctttgagatcttcacatgagatacaacatgtttgtggcccatcaaaccagttccaatttgtcttcctgctggattaactagatgagaggactgaacaccatttgcacaggtaatgctcggtgcaacaaaatgataagtgtcttttgtgacctttgtgcttgtgttgttactcctgccctccacttctttgaggaggaaattgatatctccaataatatgttgatggtctacaggagtttttttcttaaatacagatgtgctatttctataatttcctggcgagtttaaaatttccccttccatgccttttctcccagatggttcactatgctcacacgatgtagacctctcaatttgttcaattgttgaactacccatcattatttcctgtatctttccaaaattttcttgagtcttctcaaccctagcatcggaatcaagtggaacgatatccgagaagaacttgtgcagaaattttgaaaaataaaatgggaacacaacagattcatatttctgcagatagcttcgacatggtaccctttttttggggtccaactggatcatgtgaagtatcatgtcacggataccagtatcttgtatcttttctagggtatgtatggggtcatattgaccacgccggtaagccagaagttgagaaagctcaaaaagtggctggccttcaaggaaaagttcagcaagaacacacccaagagaaaatatatccatagatggttgcagaggtgcgtctgctgcaacttgggattcaccaccactttcatagaatctttcaggtgctagatagcatcgtcgtcttcctccagtgtcaaagtagaatgagaaatcagacgggtcatcatccgggatatacgttggcttgaatgatgcaaagtccgcaagatatagccaattccaagaagtaangagnacattttcacattttatgtcaccatggcaaattcccttactatggctcctgttccactgcatgaattnactgaaaggcaagcnatttctttgcaacctgactgaggaaagggcgtgtactcaaccgatcttgcaagttgctgaagaagtattgtctcaagagatatgctgccttatctgtttgcagccaaacctggaagggccatacgtgggacccntcgatccccttgaacgcgttcctaatccgctcnagcctcngctcgtgctccttgaggtctatggactcgccggcgngcttaaagtagaccttgacgaggagcaacccctcgtcgtgcttgcagcggacggacttgaggaagcggccgcggctgacgacgtcgaggagcacgagattgtaggtggacggcaggtcgtggaggtagtactccgtcgccgacgcctgcgtngtcngngcgntcttattccccatngcgtcctccgccggcggcgccgcctggggcttgctttcttngcttgcggcggtgcgtcgtgggntcgtgcc

SEQ ID NO: 23483 - DNA, 977 bp, Zea mays
agggggggggaaaaaaaaaaatgtggtttctttgttttttttttgttggtccgcgtacgagagcacgaacctcatctaactataatggacatcgtttttgtacaatgtagtatgagaagggtactcaacaacctcctcaaacaaagaaagtgccacattacagatataaaaaaacacgcacacagttacatttttaagtgctcctcgtctgtctgttacagaaaaagcgacgcaacgtctttcaatcatctttctcatgtctagcgccaggtagactacttccagtcagtgctgcatggtacacgcgcttctctgccagcccaatattagaaagaactaaattgccctccattgctattagttttctgacattatttgcgtagagcttcggatcttccttttctagttgagaaggatagtatacaggcaaccggaccacctcgatgtgatttataaattgacagagcagcaataacacatgacgtgctccatccattgaatcccatgctggactaaatctcctgtaagggtatttcaaaatgactggctgcactggtgcacctgcaagaaaggctccagtcttaaatggaagaaggtaatccccatttgtagtagttccctcgggaaacaacaacatcattggggtattcttatcttgacaaacctcttggatcctttcagctacagcgcctgagacacctttagcttctgaagactttgattctcgttgaacaaaaatgcatccaagacaattcccgatgagaccaataagtggcaacctggacactgactccttagcaacaaaacttggaaaggatgctgacatgtgataaagaatatccacataagagacatgattagatacaattgcccctggcctttgggattcttcaaattggtcctgatttaaacccttagcattagtggacctcctgcgggtctcgcggatccagtagaacccgaagacgaagagcatc

SEQ ID NO: 23484 - DNA, 1511 bp, Zea mays
ccccgggctgcaggaatctttttttttttttttttttttctgaaagacttttttttttttttttgacctcatcaaactataatggacattggacattgtttttgtacaatgtagtatgagaagggtactcaacagcctcctcaaacaaataaactgccacattacaggtataaaaacacgcacacagttacatttttaagtgttcctcggctgtctgttacagaaaaagcgacgcaacgtctttcaatcatctttctcatgtctagcgccaggtagactactaccagtcagtgctgcatggtacacgcgcttctctgccagcccaatattagaaagaactaaattgccctccattgctattagttttctgacattatttgcgtagagcttaggatcttctttttctagttgagaaggatagtatacaggcaaccggaccacctccatgtgatttacaaattgacagagcagcaaaaacacatgacgtgctccatccattgaatcccatgctggactaaatctcctgtaagggtatttcaaaatgactggctgcactggtgcacctgcaagaaaggctccagtcttaaatggaagaaggtaatccccatttgtagtagttccctcgggaaacaacaacatcattggggtattcttatcttgacaaacgtcttggatcctttcagttacagcgcctgagacacctttagcttctgaagacttcgattctcgttgaacaaaaatgcatccaagacaattgcttatgagaccaataagtggcaacctggacactgactccttagcaacaaaacttggaaaggatgctgacatgtgataaagaatatccacataagagacatgattagatacaattgcccctggcctttgggattcttcaaattggtcctgatttaaacccttagcattagtggaccttctgcgggtctcgcggatccagtagaacccgaagacgaagagcatcacccgtgagagcgcgcaccccgatcgcagcacggccttcctcctccaccccgccaacctcggccgccccccatctgcatccacgaacagcgtgcacgcgcggcacaccaagtagtagagcaggagcacgagcatccccgcgacgaagcggagcgggaggagcacggcggcggccagcgccagccgcaccgcctgcgccgcgggcagcgggccgcggcccatggttccgtacgcgtcccggcgcgcgtagggcgcgtacctggcgtccagctgctccgctgtctcccccgcggccgtggagccgtcgtcggagaggagcgggtgcacggcggcgctggcatcgaggcgcaagcgcggcgcgtcggcgtcggcggtgtcgagggccattgcacacgccgcggggccgagcgccgggctggatcggcgcgacgagacgggtggggcgcgtgttctgtgacgaggaccctgtttggtcggcgctgggccgttgcggacttttttcgattaggatgttctaggtaatggtctcgtgc

SEQ ID NO: 23485 - DNA, 1230 bp, Zea mays
  misc_feature (9)..(10): n is a, c, g, or t
  misc_feature (1184)..(1184): n is a, c, g, or t
  misc_feature (1193)..(1193): n is a, c, g, or t
tcgagggcnncggccgggaccagggccgccggccgcgcgggaaagaaagctgcggccttttctgctactcctgcctgccagcggcctgcctgcctgcctactagtgcggcgtggaggtggagcagtgggcgctacagcctccatcagctagctgccttgccgtgtcctcctcttcctcctgtcggtggcgatctctgcggaaacccgagcttcgtccaagccgggcagtagtgcgcgccgcctgggcgtaattatggattcttttgagggctctgatcatataactcaaagaaaggttgttcctgcaaaacatattgcattggttgatggaaagaatgagcctgctggagaggggttgcctgatggttggctgaaagaatgcagacctagaaagaaccgatatggatctagagccaagagtgacacgttctatattgatccaatcaatggatacgaatttcactctctcaaggatgtacaccgctatcttgaatctggagacatcagtaaatgtattagattgccaaacaagagaaaaattggggacctgcatactaaagaggaccaatctcatcatacaggaaaactatcagatcatacccagctggatactgctgatgagtctaatcgatatgatctaccggaaggtaccaatgcactgggatatgctctgctaaatccagaaagcgaagagaatgctgaaaatattgcactgtccaagcctgacaatataagctcaatccaaattgaagctggtcaggttgaagctacagaagataagagcatccaatcaggctctatagaatacactccaggggaagctaaatctgtcactaggaaaggaacagatgtgaaggagaaacggaaggggaaacagtacaaaactaaacctgccaaagggattgctatacctcttagatcgtcacctcgtttagctgcactgaagattagccaggaagcaaataatgcaaccagagatggacatattggcacacagacagacaccattaacgtgccacagccaaagcaagtcgaaaaacccaggcgaaagacgaattcttctgtaattcctgagaggaaagatggggaacctaccaggagttgtgcagaaacccttccttcacttcccaatcagatacagggagcatcattcccacagtcttcaggagatgctggatgccagnatgcacagncgaggcacctgttctgcgacacaagcaggagcaggac

SEQ ID NO: 23486 - DNA, 1026 bp, Zea mays
  misc_feature (5)..(5): n is a, c, g, or t
cctcncagaaccaaagcaagtccaaacacctttgtttaatgactaattcttctgtacttcctgcgaggaaagatggggaacctaccaggagttgtgcagaagcccttccttcacttcccaatcagatacagggagcatcattcccacactcttcaggagatgctggatgccagaatgcaccagccgaggcacctgctctgcgacaacacgcaggagcaggacaaggcgagacatctgatggtttgcctggatctgccctgacgtcgctgtttcaacatgtctggtcagacccgcgccttgtgtccgcgtacaggactctcctgggtgatatcccggtccttgatgccgctcgagcatatcggtcttcggcttatgatggtaacagagactactaccttccaccacagaacatgaataaaaacgctgcagccaactggtccgctctggcttatgatggtaacagaaaccacgcgcaagtcgaccatgttatgccgaggccatcagatacgttctacatcagtggttggttccctccccagtgaattcaatctaggaaataagaaagcaatttcttacctggcaaggacaaatcagaagcaagctcaagtcctagtcctagtcttggctcccttttggcccttgcctcaacaaggatgcatgttgcaagcaagactgcagctcgttgtaattgtgtggaggatccataactaatagtataatatagctgtcacatatgctaccgtgcgccatcagcatcagcctaattcacaggaagctgtctggtggtagacttggcaatactttctgttgtttgtatttttgtactaccaacttgatcatccattcacttgttgcattgttacttgttagagcagcctcaatatcccaggaaatgatctgggctgtactttgtctttgagcatccacctgtgtattactacttgtaacttggtagactttcaatgtacgtgtttggtttcagaaatgaagtagtccatttctttccgctcccaaggaggaaagggt

SEQ ID NO: 23487 - DNA, 2590 bp, Zea mays
ccgggctgcaggaattcggcacgagtctgggggcatttcttctttaaatgaactgtggcgattctcttgctgccctttcggaaaaaaattctctactattataaagcaccaatttttctggttttcactctcgtcacttttgtaaaaaaaaccccttatatttcatagcacgggcaaaccatcctttcccatccttatgtgcaaaaaaaatcctatatgcacctgaacacaagcactgttcttgatagacacttgttcggagtctatccaatgcgtatttgcaatgcacctccgttatagttgacgtaagatgcatcttgtattgatgtaggctgtcatgctgaattatgatgcatttttatattctaactgagtgaactggaaggaattcttttcttgttgctattgctctttcagaaatacccaaactgttgatttgttttgtaatggctctccagacaggaaaactatcagatcatacccagctggatactgctgatgagtctaatcgatatgatctaccggaaggtaccaatgcactgggatatgctctgcaaaatccagaaagcggagagaataatgaaaacattgcactgtccaagcctgacaatataagctcaatccaaattgaagctggtcaggttgaagctacagaagataagagcatccaatcaggctctatagaatacactccaggggaagctaaatctgtcactaggaaaggaacagatgtgaaggagaaaccgaaggggaaaaagtacaaaactaaacctgccaaagggattgctatacctcttagatcgtcacctcgtttagctgcactgaagattagccaggaagcaaataatgcaaccagagatggacatattggcacacagacagacaccattaacgtgccagaaccaaagcaagtcgaaaaacccaggcgaaagacgaattcttctgtaattcctgagaggaaagatggggaacctaccaggagttgtgcagaaacccttccttcacttcccaatcagatacagggagcatcattcccacactcttcaggagatgctggatgccagaatgcaccagccgaggcacctgttctgcgacaacaagcaggagcaggacaaggcgaaacatctgatggtttgcctggatctgccctgacgtcgctgtttcaacatgtctggtcagacccgtgccttgtgttcgcgttcaggactctcctgggtgatatccctgttcttgatgacgctcgagcatatcggtcttcggcttatgatggtaacagagactactaccttccaccacagaacatgaataaaaatgctgcagccaactggtccgctctggcttatgatagtaacagaaaccacgcgcaagtcgaccatgttatgccgaggacatcagatacgttctacagcagtggttggttccctccccagtgaattcaatctaggaaatatgaaagcaatttcttacctggcaaaggacaaatcagaagcaaggatgcatgttgcaagcaagactgcagctcgttgtaattgtgtagacgatccataactaatagtctaatgtagctatcacatgctaccgtgcgccatcagcatcagtctaattcacaggaagctgtctggtggtagacttggcaatactttctgttgtttgtgtttttgtagtaccaacttgatcatgcattcacttgttgcattgttacgtgttagagcagcctcaatagtcaatatcccaggaagtgatctgggctgtactttgtctatgagcatccacttgtgtattactacttgtaacttggtagactttcaacgtgcatcgtggcatcggactaagttgtaccaatgtgtttgtttcgaaataaggtagtccatcatctttctactcctcacttttttatttggtttataaaataaaataagtcgatcatgttagagccccgtttagggttttagtgctagccctttgtaattaccgttatacccttgtgtaatggtgcatccccagtcagtcgcagatcccctttctgagattaattagtgtaagttatcctatagatactgtattcatgcctgttcgaaatgtgaattatagtattttttgtgagaatggaaatgaaaagcacaagatactttttttagaaatatggacaaatggaagtttaactcctaaagaaacgctttatgaaacttctcgtaatttgattgatttatttcttccttttctacacacagaggaagagggcactagtttcgaagaaaataaaaataggttaactccaccccttttaacctttcaaaaaagattcactgatctaaagaaaaataaaaaaggaattccattgaattgtatttttattgatcaattagaattgccttctagaatgtaacggttttcatgtctatatcagcgcttcaccgttgtctacgcctccaaactatcgaagcccttccctacacctccatttcgtcgaaaccaactctgtcgtgttccataatagcaataatctcctttctgagctggccaccacttcccatggagtcgtcgcccccggaaccagatccgctgccttacttcagcctgccgtgcgctc

SEQ ID NO: 23488 - DNA, 1067 bp, Zea mays
ttttcgcggccgcgtcgatttttttttttttttctttttttgggaaccaaaacattgcattattttattccgtatacaacgttgtgcatgcaaaagagcagaaacaacacattccctcgaaacaggtggtacagtgcgaaaacaagagagagagagagagagtgtgacagaacagaacagacctctgaacaaaatgcagagatggaagaggggataaactattgaggaaaaatcaggggtaaaagctgctgccccgtaaggtagtgattaagctactatcatgccgtgggggtgtgagtaatcattgtagaagacacgagtgctctacttggtagcctgtgcaattatgttcctcaacgagcctgcctcctcctttgcggcttccaccaaagcgtcctgtgtagttactagacgtagcaccgatttcttgtttgattcttgaagctcaccagcaatcaaaatttcgtccaatataaagtacgccttatgaaaattgaatatcagatcaagctcacagacattgccaaagtagcggtccaatatctcaacatagtgatggatgatctgaagggtttccagttcattgtcagcggggtcaatgcacatgcagaagtaaaggctagcatacctcttgtacacaactctgtaaccttgccagtcgacaaaattgcacagcttggggcctcttgtcaggacgagcgtactaatctctttgatgatcttggatctctgcttctgtgggtatggagtgtaccatttcgtcagcctcaccttcccctgcctgctgatgaggagcacaaaatgtatcatgattcgcgcttcgaaggagaatcgtgggccgtagtcgtcgacgttgatcgccgccgccgcaggagagagtcgatcgcccacgagaggaaaggagagttgaggccttcacgaatcacgaacggtttgatttctcgcttttttcgattaggatgttctaggtaatggtctcgtgcgttctacgcatgtaggccctatggggtggcatgtatccgcgcgaacggggccacatggccacgcctcgaccactacgcgaattc

SEQ ID NO: 23489 - DNA, 874 bp, Zea mays
tctgcatcttgcgtggtcaagaagtgaatagcttgttagcaccccgggtactcccaaaccagataattgtttggagatatccaccaatgtcgaagcttgcgactttgacagggcacacgtacagagtattgtatttagctatttcccctgacggccagaccatagttactggtgccggtgacgaaacactccgtttttggaacgtgttcccctctccaaagtcccagagctctgatagtctaagttgcatcgggggcacatcgtttgttagaagctacatccggtgaccgcagaaacgtagtttgaactgagctcataaggttattgcagcatatgttgatgatcatcagcatcactccattcacaacaaccaggtagctgaatttttgagatgccacgacgcagtccgatggaagtggcttgcgaatccgggcatggctcttttggccgagagtgtacatatttatcagagcaacaacggcgcgcatgttacaggagtgcagcatagcggaggcctcaagcatcggcattgttcccagctgataagaatacgcccccaatttttttgttgttatttttttgtccattttgcgggtcaaacgtcgacctgggatgtgtgtctagtgcgctagcagttaacctattcgaaacgcttactgacctgtgacgcccatttctcattcatgctgccacggtgtaagatgagagcacttgttccatggtttcgttcctggtgtctggaaaaggaggcctggttctgccctcgactggcttgtttcgcagtaatagacagtcgagaaacgtgtgttcgttgttgtttgttgatgtatggacaccaagacaatgctgaaccttgtctggctacctttgttgt

SEQ ID NO: 23490 - DNA, 3296 bp, Zea mays
  misc_feature (391)..(391): n is a, c, g, or t
  misc_feature (458)..(458): n is a, c, g, or t
  misc_feature (486)..(486): n is a, c, g, or t
  misc_feature (718)..(718): n is a, c, g, or t
cgtggcactgaagagacgtctctggctcgtaacccaagaaacaacagacgactcacttcccaatgtacgaattcgtcgtctattctatctattcgatactgtacaaatacatttatgtgtgtatttattaataaactacaattatatacaacccattgtataataaagtcttttatttgacttttgtgtttggagaaccgttttgatgtttctctactacatatgcccttagagcatcttcaatagttatgtaaatttagcaccctaaattatatatttaagaagttgctaaatcactttaaagagtacaaaaatgtgtgtgttccaacatttctctatttattggttgttaatttttaaaattgtcaatgacaacaaaaaagtgagcatnatttctatttttaattgagatagcacatcaacaaccttctataatgtcttggaaggtcgaatttgtngatggaaaaccaaaaggtcgcgccgacnacataaagacaacacatggcactgaagatagatttgtggtcaatgagacggtgggcgaaatatggttttcgtgatggatttagaaccaacattgatttagggagtcccaacgatgttcgtaaatgtagggatgaaattaggttttgtaagaagtttgtaaatttaagaaactgctttacataactgttggagaatagtttttttcaaaaacttttaaaattcatatttaganagttgtttacataattattggagatgctattagaggagtgaaagaataaggaatagagagaatggatcttaactgagtagaactgacggtccataagtatctgttccaatttccaaatacccaaactggacgtccaactgttggccaagcaaggccctatcagccggaacagcccacaggtggatgctgcgaatcgagtgggtcggtccgataagcctggtctagtcgagcccaccaagtttctcgaggctagggtttgcacgagcagcgaagcggtttgcgtgttggcgttgggcggcccggccgagccggggcccgagatctgagggagtggaccccccactaggccccgctccgacggcgccgacaaaaccagaccatcaaacaagtgccagcgccctctcgcagtcgccgcaatggagagcaccttcatcatgatcaagcctgacggcgtccagaggggcctcgtaagcatcatatgttcccagttaatttctgttcattcgattcgatttggtgatgtccccgcgctttgtgatacgattttgtactagtttgtgttcactccatcctgcttggttttttcagattggtgagatcatcagccgttttgagaagaagggcttctacctcaaggataatctagcgtccatgttttgattcaaacttccattatgttccgaaacagccttcaatttctccatttaaagactaaagatgtggctttagacggaaattcaacagtttgtgctcaaataagatgtcacttttcctaaatctgttgataaagattttggtgcatagctgctaagttttttgtaatctgattacggtttgtaaaacaagtcgtgcttgataacctgccaactcgaaatgcagccttgaagcttgtgaacgtggagaggtcgtttgctgagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactttgctgtcgacattggcaggttagatctcagtccgatttttgtatcttatggttttcagtcaccgttattcatgcattggttatgcttagatgcttaatgtgttaaagctgctcaatccaattgggactgccatacatccaatgtaaaaaatgttcacactcctgagttcggcgtagttatatatcctaaaatttgctcttttccatagtgatgctaaaattcttgactgactagcattggatttatgtagagctacggttatttattttgtgtagtcaaattagatgttaagagacaatgcatgtagatgattatgaccaaatgttggctctcagttcattagtttgtttgtatcttggggtaatgaacatttgtggtcatctcatgattgcagccatgctgcagatcaactgttttaatgttggcattatgacctgttacatccaactcgtgggtccagtaggtacatcctctggcatgtgtttaccagatctgagcttatacttgttctgaatctgatgtggagtccacaaaacatttagacatcagtggatgtaagtgatgtactttcctggtgttgtggggactggttgctctggttgctgtttaatcatccatttaactcgtctttagccatgaatagttggggtgtactgtatcttattctgcgtagttgtccatgagggttttgctgtattgtacttctgatttaatctagaaaacccattttttaaatgtagtgttaaagcctctcggattatgtctgtggtatcagattctactatgatgccaagttctcatgaccttgttttgtgctataggaatgtcattcatggaagtgacagcattgagagtgctaataaggagattgccctgtggttccccgagggccctgctgattggcagagcagccagcacccctggatctacgagaagtaaacatggaaagtttcacatcaaaccttgagagccagaggaagcatgtcaccatttgtgctttagcaatgttttcgaaaagattatgatctgtatcttggaaccttatttcaatggaccaaatttctttctttgccaaaagggggggccggtacccgcttggcccgattccactcgcctatagaactagcatatagtttgtgataactctatgatggaagaggagggaaccgggagggaggggtagtagggggcacgagtaaggaggggtttatacaatgatctaatctagtgtgttaagtctgggtgcaatttatttggtggatttagtggagcttgagtgagatgatttggtttagtgagttttgtaaagtttaaactagtgacatagtatagttgtatagaaagtaatataattcttgtattttgaaaattttaagttatgctaaatttataaaaaatgttaatatttatgatataaagtaatattagattagattacttacaaaattattttttttataataaattagcttagagacatcaata

SEQ ID NO: 23491 - DNA, 870 bp, Zea mays
ggcgttgggcggcccggccgagccggggccccttctcggggcgagtgggcgcccgggcgggccgggctccgacggcgccgacaaaaccagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactttgctgtcgacattggcaggaatgtcattcatggaagtgacagcattgagagtgctaataaggagattgccctgtggttccccgagggccctgctgattggcagagcagccagcacccctggatctacgagaagtaaacatggaaagtttcacatcaaaccttgagagccagaggaagcatgtcaccatttgtgctttagcaatgttttcgaaaagattatgatctgtatcttggaaccttatttcaatggaccaaatttctttctttgccataagatattgacttagatcattttgcggtatttgattccactcgcctatagaactagcatatagtttgtgataaatctacgatgagaaagcgggcgcaccgggagggacgggtagtaggcgcacgagtaaggaggggttatacatgatctatcta

SEQ ID NO: 23492 - DNA, 923 bp, Zea mays
gcacgaggcaaggccctatcagccggaacagcccacaggtggatgctgcgaatcgagtgggtcggtccgataagcctggtctagtcgagcccaccaagtttctcgaggctagggtttgcacgagcagcgaagaatttgcgtgttggcgttggggccggcgagccgggccctatatatgagggagaggacccccccccggggcggcctccgacggcgccgacaaaaccagaccaccaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtcaacgtggagaggtcgtttgccgagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactttgctgtcgacattggcaggaatgtcattcatggaagtgacagcattgagagtgctaataaggagattgccctgtggtttcccgagggccttgctgattggcagagcagccagcacccctggatctacgagaagtaaacagtgaaagtttcacatgaaaccttgagagctagaggaagcatgtcaccatttgtgctttagcaaagttttcgaaaagattatgatctgtatcttggaaccttatttccatggaccaaatttatttctttgccatgcaaaaaaaaaaaaaaaggccaaaacagcaacgaaaaaaaaaactcgagactagttctctcctcgtgc

SEQ ID NO: 23493 - DNA, 3823 bp, Zea mays
  misc_feature (641)..(641): n is a, c, g, or t
ctaatttcatttaatttgatataaaatagtaaatattccaaaaaaaataaatttgacattctaaaatgaatgaataccctgtatgaatgtgtgtaccaaaatgtaaatgaaaataatgaataaattagtatatataagttaaagtggagagttgcagttgaatgcttatgaaacttatttgagatgtgttctatttgacatttagctgaatgaatgtcttatataaatgtgtgtactaaaaataaaagaaaataatgaagaacatagcgtgaagtggagatttataggttaaatgattatgaaacatagttgaatattatattttttaaacaaattatgtatatcaggtatatttgtattttggactctaaatatataatttttgtatattaggtatatttatattttggactctaaattcgcaattagtgtttttaatattgattaaaacttatcattttatatcactagtaatgtaagaacataattatttgtttatcatataaatatttttcactttaaatggtgtatatcattttctagtataatattaaaattagaatcatttgtaattaataattagtattaaaaagtaggttttaaattgtttcatggatacaaatagtatcgaatatttcacngttttgtcaaatatggatctaaaatttgatagagaaaaattaaattagatatgtacatttaacattaatattaaaataggagtctagacatccaaatctgaataaataacctgacctaataacggtctagacaagtaggttggccaacaaggttaaaggacgacccgactaaattaggcagagtaacactccctccgtcttaaaatagtaatcattttagctgcagtcattttagttcttgatttttatctctatttaaatttataatgataaatctagacacatatctcaattattgtataaatgtcgagttttattttggggcagagggagtacatttcccatttgttatagtttcacgtataaacagtaacgataacaagaaatacgaaatataagtggcaacgtatccgcgctcgagtttggtttttttttttttggatgtaattaaacaaaacagtagatagcatcagatagagttgcgagctgcaaccttagtagcagtacacttggtggagccgtggagcacagtttgtctccgcgcttacatacgtgcgccagcagcggcgtcgcgtaacaaacaaatcacgcctacgagtactagtggcaatatattaagacccacaagcgaagcgtccttggttttgcttgcactggggtcgtcaaatcgcgatgctctaatttccgaacaatcaatcaacacggcaacaattaacgctagggagcttagagctggccgtaggagtgcgcgaggtaggcgagcgcgccgacgagcggcgcgttgatgtaggtggccggctccgagtgctcgtggtcgttccgctcgtcggggaacctgtcctgcatgtcgggtcccccgacgacggcaccgacgagcaggttgggattggccccacccgcgtacagcgcggtgaacccctgcgagcaaccgatcctagccgggtgcgccgccacggacggcagcgacgaagcgcggtggtggatgcggcgcgggtacttggcgccgtagcccaccatgtaggacatccccatcgggttgctccccagcaggtagtccacctgcctgcgcgcgatggcgcgcagccgctgcggcgtgaccgccacgccgccgcagcgcaccgtctgcttggcgaacgccaggtacttggcgtaggtgagcaggaggaaagagctcgacgtcacgtactgcatgttgctgtcgctaagcctgaacagcagcccgccccgggtgtactgcgtctggtccgtggccgtgccgggcaccatggagcaaatgaagccgtcggcgtggcccttgtactcgtggagcgcgcccaggcgctgcaccaggaacgacttggagatgagcacccgcgcgcccgcgtgcttgttgtcccacccgaacgtgttgtccgactcgtccgcgcccagcacctgcccgttcgtctggatgtagctcaggtaagaggggctcttggtggcgcggtggagccacgccgcgccccacagcagctcgtcctggtacccggagtaggagcagtagtacgggcacacgtccgccgccagcccggtgctgtaggagccgcggtgcttgtccgcgaactcgaacaccctcttggccctggcgacaaggcggctggcgtaggccgggtcggacttgcggaagacgagggaggcggcggcgagagccgcggcagtctcggcggcgacgtcggatcccggggtgccacggtccaccttgtacaccgtcctgggggtgtccatgtcctccggccgctcccagcacgcgtggtccttggtcgcgtcaccgacctgtgatgaccacagaagggagtgcggagatcgatcagatcagcttgcggtgcgcccccactgccaccaatgtgtagacgcaacaccagcagtgcttgcttggcccacatggcgatggtgttaaccgtgcaagtactaacatttcatatttccattggttgtgaaaaaggaagcagcctttcgtgctgtgctgcttgtactactagctagtgagtttgaccatgactcgctcgatgaggaacaggagcaggaacaggaaggcaacaactccacttgcctggacgtagatggtgtccgggtgcgccgtggccttgagcaggtagtcggcgccccagcggacggcgtccctggcgtgctgcagctccgacttcatgaggccgccaaactccaccacgctccacgccagcatcgtcatgctgaacgccatcgggaacccgaacttgacgttgtcaccagcgtcgtggtacccgcccaccaggtccacctgcccgccacacattcaacaagaacgccggccatcaacagataaaacaggactgaaagcagagaggccgtccggtgacataacctccacgctagggagtacttaccttggcggagtgaccgtcggagagtcccgagtccctgcgccaggacacgcgctgcgacggcggcagcttgcccgaccgctggccctcgaagaagaggatggacttgacgagcgcgtccctgtagtcgtgtgcggcggggccatggtgcccccgggaggcaatggcgtcgcctggaaggcggagggcagacgagagcaggacgaagacgacgaagacgcagcggagacgagccatggccggccaatggaccacctcctcgctcgcctactggacagtggacactggaacgtcgccgctcactgtcactggccactggctcccgtctccgcactgcctcctcgcttggcacaagtggccacccgagcgctgcttttaaaggcgcgcgggactgttttccgccgtatatttattgtcgtttcctttttcggttttagaacggccattacttttctcccgccatggacgcgtgccccgagagccctctgagctccttcacatggacatgggcatggcgactggctggcatgcgccagtgagcgagcatgggtgacagggtcagccgcttcgtcaaggaaatggtatccatgtcgtcagtggcagaaagaacaggttttgctttttttaagcccatttcggcgcatgaaaacggggaaaaaatgggtgggataagatagatgcctccctggctccctgcagaatgcaaatgcgcgacgtggttcagcttttgtccattgtggctgccgaggaaatcgccattgccaagaaatcaagcacggtcaggctttggtttctcaaggcggc

SEQ ID NO: 23494 - DNA, 1953 bp, Zea mays
ggcggataggttcgtggatgtaattaaacaaaacagtagatagcatcagatagagttgcgagctgcaaccttagtagcagtacacttggtggagccgtggagcacagtttgtctccgcgcttacatacgtgcgccagcagcggcgtcgcgtaacaaacaaatcacgcctacgagtactagtggcaatatattaagacccacaagcgaaggtccttggttttgcttgcactggggtcgtcaaatcgcgatgctctaatttccgaacaatcaatcaacacggcaacaattaacgctagggagcttagagctggccgtaggagtgcgcgaggtaggcgagcgcgccgacgagcggcgcgttgatgtaggtggccggctccgagtgctcgtggtcgttccgctcgtcggggaacctgtcctgcatgtcgggtcccccgacgacggcaccgacgagcaggttgggattggccccacccgcgtacagcgcggtgaacccctgcgagcaaccgatcctagccgggtgcgccgccacggacggcagcgacgaagcgcggtggtggatgcggcgcgggtacttggcgccgtagcccaccatgtaggacatccccatcgggttgctccccagcaggtagtccacctgcctgcgcgcgatggcgcgcagccgctgcggcgtgaccgccacgccgccgcagcgcaccgtctgcttggcgaacgccaggtacttggcgtaggtgagcaggaggaaagagctcgacgtcacgtactgcatgttgctgtcgctaagcctgaacagcagcccgccccgggtgtactgcgtctggtccgtggccgtgccgggcaccatggagcaaatgaagccgtcggcgtggcccttgtactcgtggagcgcgcccaggcgctgcaccaggaacgacttggagatgagcacccgcgcgcccgcgtgcttgttgtcccacccgaacgtgttgtccgactcgtccgcgcccagcacctgcccgttcgtctggatgtagctcaggtaagaggggctcttggtggcgcggtgaagccacgccgcgccccacaggagctcgtcctggtacccggagtaggagcagtagtacgggcacacgtccgccgccagcccggtgctgtaggagccgcggtgcttgtccgcgaactcgaacaccctcttggccctggcgacaaggcggctggcgtaggccgggtcggacttgcggaagacgagggaggcggcggcgagagccgcggcagtctcggcggcgacgtcggatcccggggtgccacggtccaccttgtacaccgtcctgggggtgtccatgtcctccggccgctcccagcacgcgtggtccttggtcgcgtcaccgacctggacgtagatggtgtccgggtgcgccgtggccttgagcaggtagtcggcgccccagcggacggcgtccctggcgtgctgcagctccgacttcatgaggccgccaaactccaccacgctccacgccagcatcgtcatgctgaacgccatcgggaacccgaacttgacgttgtcaccagcgtcgtggtacccgcccaccaggtccaccttggcggagtgaccgtcggagagtcccgagtccctgcgccaggacacgcgctgcgacggcggcagcttgcccgaccgctggccctcgaagaagaggatggacttgacgagcgcgtccctgtagtcgtgtgcggcggggccatggtgcccccgggaggcaatggcgtcgcctggaaggcggagggcagacgagagcaggacgaagacgacgaagacgcagcggagacgagccatggccggccaatggaccacctcctcgctcgcctactggacagtggacactggaacgtcgccgctcactgtcactggccactggctcccgtctccgcactgcctcctcgcttttttcgattaggatgttctaggtaatggtctcgtgc

SEQ ID NO: 23495 - DNA, 1947 bp, Zea mays
  misc_feature (1025)..(1025): n is a, c, g, or t
tattgatggttgattttgtcagggaccgcgcgccccgggagttcttcatgaattccgaaacaggttccagaaccccattgaaaatgggcaaccctcggccccccccccagatgatgtcaagatcatgaaccaacgatcacacatcttgtttgaacaactgaaaggttttgtccagcgaaagagcatgaacgttgtgaagaatgatctaccaccaaagaaggtttttgttattactgtaaagctctcacagctgcagaggaagctatacaaaaggttcttggatgttcatggtttctcaagtagtggttattcagaaaaatctcacaggtccttctttgccaagtaccagacattatcccaggtatggaatcatccggggctcctccagatggctaaagaacaaagaggaaatttgcgtcgtgaagacgcggttgagaattttatgatggatgagagttcaagcgatgataatgttgaaaattacttgcctaatggagagaagcaaaaggataaagctgatcagcagtccaagaaaagcaacatcattatgaatgagaaagtaactggtgggaggaacttttagatgagaatacttatatgaacgcagattacagtggcaaaatgaccttgctccttgatatcctgtcaaaaagttctgaattaggcgacaaagtattagtgtttagccagagtttgaccactctggatttagtagagttttatctggcataatgcaaatcaatggaaaagaaggcaagcattggaagcgggggaaggattggtacaggcttgatgggagcactccatcttctgatcgtcagaatcttgtggagatgtttaatgaccttgaaaacacaagagtgaaatgcacattgatatcaactcgtgctggatccctgggtatcaaccttcatgctgcaaatcgcgtggttcttcttgatggatcatggaatccaacacatgatctgcaagccatttatcgagtttggaggtatggccagaccaaacctgtatatgcctaccgnctaatggcacatcaagctttggatcagtttatatataagcgccaggtgacaaaggaaggccttgcagcaagggtggtggatagacagcaagtttcaagaaccatctccaaagaagagatgctgcatctttttgaatttggtgaagaggaattaatggaacagaacgagaatggttctactatgattgagaagccatccacttctaacactattaaaacctctgtgcctgttcctgtcgacagtctcatgctgagcctgctcagtgagcaaactcggtggatttcaggttaccatgaacatgaagctctcctccaagaaaatgaagaagaaaagcttacaaaggaggagcaggacctggctttgtccgaatgggagtcattgaggaaagctgcatctgatcctgagagaaaatcaagcatgagcgcagttccaacatatcccaatcctgtgcggccacttaagcctgcttcaagaagccggcaactgcagcaacctaaggctaactcaaataaccaaaagaagtgcaccaacttaacccacttgctgactctgagaagccatggcacaaaagcagggtgcacgacaacctgtaacgagtgcggccaggaaattagttgggagactctaaacagagatggtagatcgagatgatgcctgtctctgtggcattgccagatttttttggggtctttatgtaatgttaacgtccaggtagcagtatatatattgcgtatacgagagtattagagtaggtagaatgtagaatggacaaaaaatggctcttgtggtacacatggtagaacgcatgggatgcaaaaaatgaacgatcacattgttatggaatgtagtcgtaacaagatgtttgttatgcacttattgtcattttcttttccaaaaaaaaaaaaaataaagaaatttataa

SEQ ID NO: 23496 - DNA, 1061 bp, Zea mays
gggtacctcgaggccggccgggccccgcgtgcccggcaggatacgtctcatccgttgtgtcgtcttttttttcggtgtcgcgagctcttcctccttccgcttctcttcgacagaaaactagggttttgctcttggaatctctctccccgctgccgccgccgccggacagtgcaccgacgatacgacctcctccttcctccgatctggcctttttaatccgcggatcccgtacaagatgcttcccctctcgctcctcaagaccgcccaggggcacccaatgctcgtggagctgaagaatggtgagacgtacaacgggcatctggtcaattgcgacacgtggatgaacatccaccttagggaggttatttgcacctcaaaggatggtgacaagttttggaggatgccagagtgttacattcgtgggaacaccattaagtatcttcgagttcctgatgaggtgattgacaaggttcaggaggaaacttccaaaagccggtcagataggaagccaccaggtgttggccgcggaagaggaaggggggacgttggtgctaaacctggaggcagaggcatcggacgtggccaagatgatggaggtagaggcagtggtggccgaggaaggggtggagttggtgccaaaggtggtaacaaaggtgggggccgtggccgtggctaaatctggtggacacatgggagaatgccgctttttaaggcctgtaattgtgttgcatagattgcttaggacatgatgaatgaaccgagttggctggtcggtttgggggcaaaaaccagaatggttcctgtcttctggacattgaggaagcggcggcagtcaggcttgtcgctgttctcaaaaacggtttggttgatatcttatccaatctgttcagactgttcgttgttagtaaatgttccccctaaattttccactctatatgctattatacaccctctctttcttccggcaacggttcctcctatatatattctactatgtctcacactacacagaatattcatataaattcaacttccatcaactaccttcttacggtaggttc

SEQ ID NO: 23497 - DNA, 1049 bp, Zea mays
cgtctggtacccggtacttttttttctctagatttggcgtcgcgccgcgccggccgccctcgcgcttctcgccgagagaaaactagggttttgctcctggaatctcctcccccgcagccgccgcccgaccgtgcgccaacgatacatccttctccctcctccgatccggcctttttgatccccggatcccgtacaatatgcttcccctctcgctcctcaagaccgcccaggggcaccccatgctcgtggagctgaagaatggtgagacatacaacgggcatctggtcaattgcgacacgtggatgaacatccatcttagggaggttatttgcacctcaaaggacggtgacaagttttggaggatgccagagtgttacattcgcgggaacaccattaagtatcttcgagttcctgatgaggtgattgacaaggttcaggaggaaacttctaaaagccgatcagataggaagccaccaggtgttggccgtggaagaggaaggggggacgtcggttctaaacctggaggcagaggcattggacgcggccaagatgatggaggtagaggcagtggtggccgtggaaggggtggagttggtgccaaaggtggtaacaaaggtgggggccgtggtcgtggctgaagctggtcgacacaagggagaatgccgctttttgaggcctgtaattgtgttgcatagattgcttaggacaccatgaatgaaccgagttggctggttgtatgggggcacaaaccagaatggttcctgtgatctagacaccgaggatgcggcggtagccaggcttgttgctgttccccaaaactgtttggttgatatcttgagtatgatccaatctgttcatttgcttagagttatcccggttagatgactaattgattgatgttgcccattattttgctagtggcgcacgttgtgctgagtatgagcattttcagcgtgagatattcgaatacgatagaatgtttttttttatatataattttcaatttagcaaaaaaaaaaaaaaaaaactcgagggggggcccggtaccc

SEQ ID NO: 23498 - DNA, 856 bp, Zea mays
cctcgaggccggccggggtcgcgagctcttccttccgcttctcttcgacagaaaactagggttttgctcttggaatctctctccccgctgccgccgccgccggacagtgcaccgacgatacgacctcctccttcctccgatctggcctttttaatccgcggatcccgtacaagatgcttcccctctcgctcctcaagaccgcccaggggcacccaatgctcgtggagctgaagaatggtgagacgtacaacgggcatctggtcaattgcgacacgtggatgaacatccaccttagggaggttatttgcacctcaaaggatggtgacaagttttggaggatgccagagtgttacattcgtgggaacaccattaagtatcttcgagttcctgatgaggtgattgacaaggttcaggaggaaacttccaaaagccggtcagataggaagccaccaggtgttggccgcggaagaggaaggggggacgttggtgctaaacctggaggcagaggcatcggacgtggccaagatgatggaggtagaggcagtggtggccgaggaaggggtggagttggtgccaaaggtggtaacaaaggtgggggccgtggccgtggctaaatctggtggacacatgggagaatgccgctttttaaggcctgtaattgtgttgcatagattgcttaggacatgatgaatggaccgagttggctggtcggtttgggggcaaaaaccagaatggttcctgtcttctggacattgagaaagcggcggcagtcaggcttgtcgctgttctcaaaaacagtttggttgatatcttatccaatctgtttagactgccaaaaaaaaaaaaaaaagcggcc

SEQ ID NO: 23499 - DNA, 945 bp, Zea mays
  misc_feature (911)..(911): n is a, c, g, or t
ccggccgggagaatattattattttatatggtgttctaggatttactgcaaaaaaaaaaaaaaaaaacacagggtacttttttctctagatttggcgtcgcgagactcctcgcgcttctcgccgagagaaaactagggttttgctcctggaatctcctcccccgcagccgccgcccgaccgtgcgccaacgatacatccttctccctcctccgatccggcctttttgatccccggatcccgtacaatatgcttcccctctcgctcctcaagaccgcccaggggcaccccatgctcgtggagctgaagaatggtgagacatacaacgggcatctggtcaattgcgacacgtggatgaacatccatcttagggaggttatttgcacctcaaaggacggtgacaagttttggaggatgccagagtgttacattcgcgggaacaccattaagtatcttcgagttcctgatgaggtgattgacaaggttcaggaggaaacttctaaaagccgatcagataggaagccaccaggtgttggccgtggaagaggaaggggggacgtcggtgctaaacctggaggcagaggcattggacgtggccaagatgatggaggtagaggcagtggtggccgtggaaggggtggagttggtgccaaaggtggtaacaaaggtgggggccgtggtcgtggctgaagctggtcgacacaagggagaatgccgctttttgagggcctgtaattggtggtgcatagattgcttaggacaccatgaatgaaccgagttggctggttgtatgggggcacaaaccagaatggttcctgtgatctagacaccgaggatgcggcggtagccaggcttgttgctgttccccaaaactggttggttgatatcatgagtatgatccaatctggtcagntgctttagagtatcccggttagatgactaattga

SEQ ID NO: 23500 - DNA, 755 bp, Zea mays
  misc_feature (1)..(1): n is a, c, g, or t
  misc_feature (4)..(4): n is a, c, g, or t
  misc_feature (15)..(16): n is a, c, g, or t
  misc_feature (20)..(20): n is a, c, g, or t
  misc_feature (23)..(23): n is a, c, g, or t
  misc_feature (25)..(25): n is a, c, g, or t
  misc_feature (39)..(39): n is a, c, g, or t
  misc_feature (42)..(42): n is a, c, g, or t
  misc_feature (51)..(51): n is a, c, g, or t
  misc_feature (64)..(65): n is a, c, g, or t
  misc_feature (67)..(67): n is a, c, g, or t
  misc_feature (69)..(69): n is a, c, g, or t
  misc_feature (72)..(72): n is a, c, g, or t
  misc_feature (74)..(74): n is a, c, g, or t
  misc_feature (79)..(79): n is a, c, g, or t
  misc_feature (83)..(83): n is a, c, g, or t
  misc_feature (86)..(86): n is a, c, g, or t
  misc_feature (89)..(89): n is a, c, g, or t
  misc_feature (95)..(95): n is a, c, g, or t
  misc_feature (104)..(104): n is a, c, g, or t
  misc_feature (109)..(111): n is a, c, g, or t
  misc_feature (119)..(119): n is a, c, g, or t
  misc_feature (121)..(121): n is a, c, g, or t
  misc_feature (133)..(133): n is a, c, g, or t
  misc_feature (178)..(178): n is a, c, g, or t
naangcagaggaccnnaaangantntccttttaggcccnagnttacatagntccgttgaatttnngnantgnangaatnaatnccnagnaaagangccagttcnccagnnnaattaccncntaaagacaaaantgagtcccccgggcggccgtctagaatagtgatccccgggtgagnaatctttttttttttttgtagtttttttttttggcacaagtcataaacaataccatgacattgaagtcacaatcacttgaaaaatccttacatgtgtctgaaattgaattagcaggaagcaaccagattgatttgaaacatgaacaaatcatccttgatgctacagccttcactaccatcatggagtcatggaccaggcttcttgcaagcacaagcatgtacaccctagaagttccttgttttcttggatgcttgccccaactctgagagcttcccgttttgcttgggcaggtaagcaccaggcctggagacgaggttgatgcgggaccgcggtgcggcgaacatccagttgtcttcgtcgagagacctcacctccctctgcagcgcctccatcacctcagacttgagttcagccagggcctcgtccttgcggtagagcgcgtcgatggaatcagcgacgtcttcggcggccgagatggtcgacctcgccggcgagctcatcgcgccggctcttctcggatctgccctctccacctggctgaactggcgtttccgcctgcagagtgcagacttcggg

SEQ ID NO: 23501 - DNA, 2266 bp, Zea mays
caaactccaaactccaacatataaatattacagtctatagtaaaaaaaagtgttttgcacagtgatatacaagatctgctcagcagggcctaaggaatctaacatataccactggataggagttgttctgtctcgttagaaatacggattatgaatccgggtggatcgcatacaagatacgacgcacacagccacacaggttatagcatggcgccccccttttgttgcgtttcttgacaaaagattatagcagtcaccaaaaaaccacattcgccaaaaggataattgcacaatgctagtccctttattataattacaacatgatatacttagcttcttcggacagtggctctgttcactgtcagaatgttctgatgttacatataacgagccctccatactctatccgattctgaaaggtcaccatatccttcagtaagtccggatcaactttctgcgaggcatagtcatcggcaaaataacttgacctcgtctgctttagctctgtattgttcccccttccgaaattcccaaggtattgccgaacatcgcagttttcgagcttttttactggctcgtgggtgaaagagaaacaagaacttctgctccgcggagtgtcaaagccatcaggatcatcgctggagacgctcctgattttcaaaccagcaccatttgtgtgactaaagataacactgtcagacacatcggatccagttgcgctaattgagcactgagtttgcttgtcagattccacatgatatccatgttgatcagccagagtgtggggttcttgaaagattgatctccctttgtggaaaaatctactattgctctttggtgggacattcacaactgaatttggttgaggatcctcaggtgatgagaaatcagtgctatccattgttgaaattgaaacacattcctcaaaataattcattgcctcttcagccaaacgccttgacactttcagtctttctatgctactctgtaataatcccaaagcagatataacaggtcagctcaggattgtatattatcaacacaaatcaatctctagatggaatatataaatagtagatctactacctttcttcttggccgttttttatgtgtctcagtaaagtttggatctgttactatgcccttcagcattctgctcagttcttgttcccgctgctcttcaactgccaaatctgccctaagctttcgagcacgttcatgtgactgcaatccagcagtaaacggttataacttatgactacatttagctaaaggcatgacacagttggcacaacaattaccagacctgttttagttttaatgtatattctgttatgtcaggagcgagctcagaggtgtcaggatcaaactcaagagaagcttccaattccccccgttgctggtttgctccatggtgccatgtgtctgaaaccagctcagaagcatctgtatcaaactcaagagaaatttccatttgctcccagtgctgttttgctgcactgttcctggactcaagagaaatttccacaacatttttctttccatattctgttacataatcactaatgtcagagataaactcagcagaatctggatcgaattcaggaggaatttccagaactggatccactgggacagttgagtggtcctgctgccaaatggtttaaatggtcaaataaaaatagtagcatcactaacaagtaacaacttagcacaagggaataaaatatgaatgaaaggtctagaaaggacatgtcatagaaaaacagcaaagtttttttttccaaacatcaaaaaatagtaaagtaaaattcaaagcaaaagctggaaataaaggcaacatttctcctttacaaagagaaaggagtactagcccaatatttctgaaaaagcacattttcaacctgacaatattctattgaaagagatcatgttgtgaactcagacaaacaagtgggcagcatgatggatcgatggcatatgcattgcaataacactagaaaaagaaaactgcatatgcacacataaatgttcaaaagtaacctttttttccgagttcatagctacaccaatgaattgcaacaacaatagctttaacacaagtgattctctaattcttacatgctcgagatggccaggtgaagaaacaacagtgctagattctgactgtgtagtttcatccattgcccggcacccctgtgtacaataaacactagtagtcactcaagtattcatgttgccagtaaatcgtgtggcatgcatccag

SEQ ID NO: 23502 - DNA, 1509 bp, Zea mays
gatgtttatatacgtgagtgttgcatttcgaaatttcaaatacgttaaagaggggatgcttttttttttttttttgaagagatgtcagagcagaactttgtttagctcgaactagtatcaaatgtttttttttaccgtctagctatctttgttcagtagagcattgtcagcgacaacgttccatgaaacttgtgcaactgcagtgcaaagagatacagccctcgcattctccgcgcgctgttcgcaaggaatgctcatgggtcatttacttgtctaggccccggctaccgaatgtgcacagatggctcccaacttctgagatcacatccaccagacctccgtatccagcaacagctgctatcccagttgagtggatggagacagaaaacgccgactgaggggcacattttacttgtgaaaggactgtcccgtttattgtgagacgggagagcagaggttcagcgccaactgctaaaatatgattcttgtcaaacaataaatcttgaacaggagcatgacagtccaaattaaagatgcactcatttgagagaagactccaaactgatataccgctagacgtgccacaagccagccaactttcacttggatcaatagcaacacagctgacccatgagctttcaaatgccttgctctttcctggctgtataacccgagtgcacttcccacttctgcaatcccagatacgagctgtcccatcctctgatcctgttacaacctggcggtttgactcacgaactgcaatgctgtgcaaataatcagcatgccccttgaatgtgattttacatttactggtctccacatcccagcagtaagcacatgcatcacccgctgctgccaaaatggatccatcctgtttattaattgcaatggcattgttttcaggtactggagatcgagcaccccaaggaccctcgtgctgagggttgaccaagtcaagtgctggttccagatgatccccttgcagggagagcgggacaaggcagctctgcatctcgtgccacctccaacccttgatgcggccatcgtccccgcagctgaagagcagcggctgctgttgatcggggtaaaacctgacgtcgtaggcaggtccgctgtgcgcttgcacgatgcagacaggatctaccagagtggcggcggtctccacctgggaggtagcggaacatgcggagatgcaggatgaaagggagaaggaagcgagggagccgtcgctggaggcggcggcgagtaggatgtcggtatccgggtcgtcgctgtggtcaaagaagacggcacggaagagggtgcgggacgagaggtcgcgggcacggaggatgccgcggcggtacgatgactcgtcccaccggcgcgcgtccatcgatgccggatgggactgcgccgccgccgtcgccatggctgtcctactctgcgctgatgcgctctgcgcttttgcttcggggagcgaagggatcagggaagacggggacaattccgagttcccgacagaaaagt

SEQ ID NO: 23503 - DNA, 2120 bp, Zea mays
gatggccaccggaggaaggaaaagcctgaggaggcgaggaagagctcctcaccgctgtcgtccttgcaggggcgcgtgggaagcgtcgccgccctgctctagcagcggcgaggccgtgcgcgggaaggagggacggtggcgacggttagggtttgccgctcgagtggggcggcgtgggggctgagaagcggctccaatacaaccttttctaggctgctatcactgctgaagattcagacctaggccagaaatctataccgatgttcttttccgtcaccgatgttggcaacgtaaagatcctctgcagctacttcacctacagttgttagatcgatcctctgctattatttcacctacagttgttggatcactaacgtgttgacctaatctagactgggtccacacatcagtgacccaacgcagttgatcagataaagtaactgcatcccgatgttcatctacgagtgtttttttcgatgtttatatacgtgagtgttgcatttcgaaatttcaaatacgttaaagaggggatgcaaccggtgcaccaattgaagagatgtcagagcagaactttgtttagctcgaactagtatcaaatgtttttttttaccgtctagctatctttgttcagtagagcattgtcagcgacaacgttccatgaaacttgtgcaactgcagtgcaaagagatacagccctcgcattctccgcgcgctgttcgcaaggaatgctcatgggtcatttacttgtctaggccccggctaccgaatgtgcacagatggctcccaacttctgagatcacatccaccagacctccgtatccagcaacagctgctatctgaacgccgtgaacatattgcatagaaccagaattaggggagggcagtgatcaaacaaaaagaaacaggggagaacacagccaagaaatgagcagagcagcaagataggcacataccccagttgagtggatggagacagaaaacgccgactgaggggcacattttacttgtgaaaggactgtcccgtttattgtgagacgggagagcagaggttcagcgccaactgctaaaatctgaaggagagcaaatgaaatgaaaatgaggaaagaaggtccagctagtatgtttttttataataacaagggtcgattaataatggatgttgtaaatctcaagtgagcacacgaaaaccatgttcttgttttgaagaatagggctgttcagctatattacaactttaaccctactccttccactccaaattataatatgttttgacttgtctagatatatttcttttactatgtatctagacatagtatatatctgagtgcataaaaaagttatgtatctagaaatgtcaaaagtcataatttgaaatggagatagtactattcatatgaaagatgaaaggatcagctcttgttcccattgtgttggcttaatccagcacaacagcaaaagcttcaaaagttggcaagctgcgtgttaaattgtactatgagtaacctctatcttgtttgcattttttcctgaaacatatagcacttttttggggttaagaacatgagctattaatttcctgatctgcacagatttataaattcataaacctaattagatttgctgtcaaatagctaatggaagcttgaaaaggacactaaagaattattatatcatgcactggtggcagctatcaacatcctaaccaaatgagatcgttgaaatgatcaaatatgtggatcagcaactcgctacagccataaagcttggtaacaaaaatgatgaaatgatctatttaaatatgtttattttggacactagtttagacaggatgtaaatggactaatggagacagaaatacaagtactcacatgattcttgtcaaacaataaatcttgaacaggagcatgacagtccaaattaaagatgcactcatttgagagaagactccaaactgatataccgctagacgtgccacaagcctgaagatggtatgaacgataattaaaaaacatataaatgaacagaatataaggaaagcaaactgattgtaagtaacaagataattgatgtacataaagcattttgatagtctaaagacatgaagttaaccagccaaa

SEQ ID NO: 23504 - DNA, 2095 bp, Zea mays
gcacgagaccattacctagaacatcctaatcgaaaactttctcccctcttcgcccagccgctgccacgcccacgcccacgcgcaatcagaactgcaggccagcaccacctccaccccccgaacggctataattaggcggttgccggaatcccctctgtctcgcaccgcagcaattccccggccccttcgcaccgtttccctctgcgctcccaccccccgcacccccgaaatcaccgccgcgccccgcgtctcgcccacgctcacaaggaaaggaggagaggagaccggggcattgagctcccgcgtctccgctcccggtttccggggagagtgcggaggacccccatcgtgcgcgccattgagctctgctcccggctgctcgccggggagagggcggaggacccgatcgtgccgtctcaacccgctccgcacccgcgcggccgcgggcgtggtgctcccgcgccttccgggcgcctcctgcttctccgtgcgccctcggctccatggaggccggctactgcaaccgcaagaagaccgacggcatctgcgagtcagtctgcgacagcgagtttggctcgaagtcggtcctgagcatgtcaaggctgaagtgtgccctgcggggatttgatctgagggttctcttgatcctactgattggtgtgccaattttgatctttgccatatatgtgcatggccagaaggtgacttacttcctccggccaatctgggagaagcccccaaagcccttcacaatactccctcactattaccatgaaaatgtctcgatgggtaacctatgcaagttgcatggatggaaagtcagggagactccacgccgtgtctttgatgccgtgctcttcagcaatgagcttgacatccttgatatccgctggcacgagcttagcccgtatgtgtcagaatttgtgctgcttgagtccaattcaacttttaccggcataaagaaggaccttcacttcaaggaaaaccgccaacggtttggctttgcagagtcacggttgacctatggcatgataggtggaaggtttgtgaagggagagaacccatttgtcgaggagtcgtatcaaagggttgctctcgaccagctcattaagattgcgggcatcacggatgacgacctgctgatcatgtctgatgttgatgagatcccaagtggacacaccatcgacctcttgagatggtgcgatgacgttccggagatactccatctccagctcaggaactacctctactcgttccagttcctactcgacgacaagagctggagggcttcagtgcacagatacagagctgggaagacgaggtatgcacatttccggcagacggacgacctcctagctgattcagggtggcactgcagcttctgcttccgctacataaacgacttcatcttcaagatgaaagcctacagccacgtcgaccggatcagattcaagtacttcctgaacccgaagaggattcagcatgtgatttgcgaaggggctgaccttttcgacatgcttcccgaagagtacacgttccaagagatcatcgccaagctggggcctatcccgagtacattctccgccgttcatctccctgcctacctgctggagcaattcgatcggtacaggtaccttctcccaggcaactgcgttagagagagtggctaggcagctggctgcccgccgtctgcatcatgaccctgaggcgcacggacgtcgctcgcggatgtctgtcttatggtggcgtgggggttgtgtctgatacgattggctgacttagttgagtgatcgcttggctgctggttgagttcatatgggatttttgtgtaccgtgtaacagaaaccatggaaggcctgacggctgcgtagcgcagcgcgtgcttgatcgctgctgcgttcttgtttggcagaggagagctgagagctttttgttcgttgcttccatgattgatatatgatgaactcagaacctgttgtagatctcataccgccgagcgacattcagattctttctttctttgctcgtgatgtacattgccgttcacttacctagttacgttgagccatagatgtttccaaaaaaaaaaaaaaaa

SEQ ID NO: 23505 - DNA, 1974 bp, Zea mays
  misc_feature (1904)..(1904): n is a, c, g, or t
  misc_feature (1917)..(1917): n is a, c, g, or t
  misc_feature (1945)..(1945): n is a, c, g, or t
gctcgcagcattccccggccccttcgcaccgtttccctctgcgctcccaccccccgcccccccgaaatcaccgccgcgccccgcgtctcgcccacgctcacaaggaaaggaggggaggagaccggggcccagacgccaacgcgcggacccctcgagtagggcgaggtccgggctccgctcccggtttccggggagagtgcggaggacccccatcgtgcgcgccattgaactctgctcccggctgctcgccggggagagggcggaggacccgatcgtgccgtctcaacccgctccgcacccgcgcggccgcgggcgtggtgctcccgcgccttccgggcgcctcctgcttctccgtgcgccctcggctccatggaggccggctactgcaaccgcaagaagaccgacggcatctgcgagtcagtctgcgacagcgagtttggctcgaagtcagtcctgagcatgtcaaggctgaagtgcgcactgcggggatttgatctgagggttctcttgatcctactgattggtgtgccaattttgatctttgccatatatgtgcatggccagaaggtgacttacttcctccgaccaatctgggagaagcccccaaagcccttcacaatactccctcactattaccatgaaaatgtctcgatgggtaacctatgcaagttgcatggatggaaagtcagggagactccacgccgtgtctttgatgccgtgctcttcagcaatgagcttgacatccttgatatccgctggcacgagcttagcccgtatgtgtcagaatttgtgctgcttgagtccaattcaacttttaccggcataaagaaggaccttcacttcaaggaaaaccgccaacggtttggctttgcagagtcacggttgacctatggcatgataggtggaaggtttgtgaagggagagaacccatttgtcgaggagtcgtatcaaagggttgctctcgaccagctcattaagattgcgggcatcacggatgacgacctgctgatcatgtctgatgttgatgagatcccaagtggacacaccatcgacctcttgagatggtgcgatgacgttccggagatactccatctccagctcaggaactacctctactcgttccaattcctacttgacgacaagagctggagggcttcagtgcacagatacagagctgggaagacgaggtatgcacatttccggcagacggacgacctcctggctgattcagggtggcactgcagcttctgcttccgctacataaacgacttcatcttcaagatgaaagcctacagccacgtcgaccggatcagattcaagtacttcctgaacccgaagaggattcagcatgtgatttgcgaaggggctgaccttttcgacatgcttcccgaagagtacacgttccaagagatcatcgccaagctggggcctatcccgagtacattctccgccgttcatctccctgcctatctgctggagcaattcgatcggtacaggtaccttctcccaggcaactgcgttagagagagtggctaggcagctggctgcccgccgtctgcatcatgaccctgaggcgcacggacgtcgctctctcgcggatgtctgtcttatggcggcgggggttgtgtccgatacgattggctgacttagttgagtgatcgcttggctgctggttgagttcatatgggatttttgtgtaccgtgtaacagaaaccatggaaggcctgacggctgcgtagcgcagcgcgtgcttgatcgctgctgcgttcttgtttggcagaggagagctgagagctttttgttcgttgcttccatgattgatatatgatgaactcagaacctgttgtagatctcataccgccgagcgacattcagattctttccttcttttccttctttctttntttctttgctcgngatgtacattgccgttcacttacctagntacgttgagccatagatgtttccaatcca

SEQ ID NO: 23506 - DNA, 4618 bp, Zea mays
ctttctcccctcttcgcccccccgctgccgcgcccacgcccacgcgcaatcagaactgccggccagctccacctccaccccccgaacggctataattaggcggttgccggaatcccctctgtctcgcaccgcagcaattccccggccccttcgcaccgtttccctctgcgctcccaccccccgcccccccgaaatcaccgccgcgccccgcgtctcgcccacgctcacaaggaaaggaggggaggagaccggggcccagacgccaacgcgcggacccctcgagtagggcgaggtccgggctccgctcccggtttccggggagagtgcggaggacccccatcgtgcgcgccattgaactctgctcccggctgctcgccggggagagggcggaggacccgatcgtgccgtctcaacccgctccgcacccgcgcggccgcgggcgtggtgctcccgcgccttccgggcgcctcctgcttctccgtgcgccctcggctccatggaggccggctactgcaaccgcaagaagaccgacggcatctgcgagtcagtctgcgacagcgaggtgaggcaccgctccggctccagccagacagatctgtccctttccctaccgctccgccgcgtgtaacgcctctgcggatcgcctggtccgccggggggagacgcggacgcggtcgtcgcggtgcttgtcttttcctcttccacgctgcttaaacgcgttttgctccacgctgagctgcttgcttgcttcgaccttttcaccgctccagttgcgcggcgtgttcgcggcggctgctattttgccgatctcagcagggttgctgtcttggatcgggtgctcgtgagatttccacagcctgggatcgcatatgctcgcttaattgcgtccgcggcaggcatcttccacctgccgcgggtgctgtggattaggtggtgctaaacaaactggggcgcctggatgcttccggctgcgctagaatctctccacctgtatggatcgggtcgtctgcctaataccggaatgaatctgtctctccacctgtaaaagtttccagcttttttttttgaacaatccccgattggttcccgtgccgtagatggtgagggttcatgccgcaaaagtaattttacaggctgtttccttcctttatatgatacacaaataaaattagctgatgattgctttcctctgttggtggatccgcaccagcctatcactgataggtttttggtcggcgacgccgaaaatgcgcatattccaccagaccaccgcttacttctttaatctactgcacatgcattgttttgatggcctttaacacagctgcacactcacggcgcggcggatattttagaagctcgtgttctcaacataggagtttgtgatggctgtgatgttccctatgttcagccgttggattcatggtgctatgtcgtgtccagccagctttgtgcttgaataaataaatgctcatacgctcatgtagccagtatttgccgttctcatgtttagtaaattaaggcatgttccttctttttgtgtagcatttgtttcggcaaaactcaatgatgcctctgtctacaatgcactaggtttcagtgttttttaacctctggttgagttagtgctgcaaaagtgatctcctgactcttgactttggaatgatcagcactgtttcagagtacagttcattgtatctgtcacatgttgtagctttccagtttacttctagtttaatttatgccttgttatgatgtgtattggtgcatgtctgatttcttatttgctccctgatactgtctgcagtttggctcgaagtcagtcctgagcatgtcaaggctgaagtgcgcactgcggggatttgatctgagggttctcttgatcctactgattggtgtgccaattttgatctttgccatatatgtgcatggccagaaggtgacttacttcctccgaccaatctgggagaagcccccaaagcccttcacaatactccctcactattaccatgaaaatgtctcgatgggtaacctatgcaagttgcatggatggaaagtcagggagactccacgccgtgtctttgatgccgtgctcttcagcaatgagcttgacatccttgatatccgctggcacgagcttagcccgtatgtgtcagaatttgtgctgcttgagtccaattcaacttttaccggcataaagaaggaccttcacttcaaggaaaaccgccaacggtttggctttgcagagtcacggttgacctatggcatgataggtggaaggtttgtgaagggagagaacccatttgtcgaggagtcgtatcaaagggttgctctcgaccagctcattaagattgcgggcatcacggatgacgacctgctgatcatgtctgatgttgatgagatcccaagtggacacaccatcgacctcttgagatggtgcgatgacgttccggagatactccatctccagctcaggaactacctctactcgttccagttcctactcgacgacaagagctggagggcttcagtgcacagatacagagctgggaagacgaggtatgcacatttccggcagacggacgacctcctagctgattcagggtggcactgcagcttctgcttccgctacataaacgacttcatcttcaagatgaaagcctacagccacgtcgaccggatcagattcaagtacttcctgaacccgaagaggattcagcatgtgatttgcgaaggggctgaccttttcgacatgcttcccgaagagtacacgttccaagagatcatcgccaagctggggcctatcccgagtacattctccgccgttcatctccctgcctacctgctggagcaattcgatcggtacaggtaccttctcccaggcaactgcgttagagagagtggctaggcagctggctgcccgccgtctgcatcatgaccctgaggcgcacggacgtcgctcgcggatgtctgtcttatggtggcgtgggggttgtgtctgatacgattggctgacttagttgagtgatcgcttggctgctggttgagttcatatgggatttttgtgtaccgtgtaacagaaaccatggaaggcctgacggctgcgtagcgcagcgcgtgcttgatcgctgctgcgttcttgtttggcagaggagagctgagagctttttgttcgttgcttccatgattgatatatgatgaactcagaacctgttgtagatctcataccgacgagcgacattcagattctttctttctttgctcgtgatgtacattgccgttcacttacctagttacgttgagccatagatgtttccaatccagtttctgactgtttctcatacctgttgaccataaaataattttccgggatgccatctgtttgctctattactcgaagcgccgaggtggaaacgattcttactgacgtctcgccattggtaaaagcaggctggttgatctccaggcggggggtaaaaaaaggtgctctttttatggtcgttggtggttggtaagatctgaattgaggggtttctgcgtttgcgaaggattcgtttgttgattgcctgagcaagggcgagcaacccgtgatgagaggcggggcatgtgtggggccttgcctggctggatggagctgagctggtgcgaacaggctgttgctgtcgtgcgtgcacagtccacttcagccagattggcgaacatgctgcgaattggctggtcgtatggctcgtagcgtcttgctgatgctgcctcgctgtgccctgttcctgcactgcacgcccatcaacagtttcagacgagcctttagggcttgctcgttctactgtgtcaattcatgtggattggggtgtattgagtcggctgccatctttttggtgcgctggtcggagccgagctagtcgtagttgcagttgctggcgccgtcatccgcagatttttccagcctaccagggatgtactggtgggcggcatggccaggccagggatgggcatcgaccgcttcgtttgtctctggtccttcctgcccggggcaaacgcgcgtacggcgtccctgtccccgctagctgccggcttcgccgcccgtatcgccgtgtccgttggaatctcgctcgtcgccacagatagatagcgcttggtttggtttgactcgtccgcacgtcgcggccacgcccggtcgtcatgcaccaggaaaatgtctccgttgctaccgcttccaagctgcaaaaacaaaagctccagccaacagcgtcccattccatgcagtcgtactaccgcgaccactgttgttgagttgattgcagcgcccacccgtggccgtgggtgggtttgccatgacagctaccaccagtggtatttcgtcattatgtggccgctcttatttggccggttctgccctagtacaaaagtgtttccgtgcatctcgaggaccggaatggacgtgtaggggagtgaaaacgggactaacaacacggatggacaataagtcatcctttatcccaatcctaatatatttctaaccaaattcgagctgagatacacatagttcgaaacagggacatatatggatacatggaccatatatttattcagatagataagtgacagatacatatattat

SEQ ID NO: 23507 - DNA, 1058 bp, Zea mays
gaaacgaagggagtatgattttttcccttttcattctttgaagctgagtggctgttttctctcttcttcttttttttagttaacagagcgtcagagcgcaccatttcccttacgggcatcggggtgccgtcctacaaagtaggaaccctactcaactaactgaccatctcgtccaaagcagcaacactacacccggtttccggcgacgtggatggcggttcacagtcacagagtagacgaccgcgggcgatggattcacagtttcagatgtctcgccggcacagcgggcaggagccgtgcctgaggagccagcagtcgatgcagggcacgtggaacaggtggcggcacccgggcagcctccgcgcgcggtcgcccacccggaagtcctgcaggcacaccgagcagcacagcgcctggccggccgcgtccacggcgccgtcctccgcgaccaccgtctccggcagccggcgcaccgcggcctcggggaggcccctcacgctgccggtctcgaacaggtcgctcgtctcctcgaacggcgagctgatggcgctgatctggctctgcacggcgctctgaacagccggccccaccttctccccggaccagcctgccgctcaagagactggagatgatgtccaccatgtagaggagggtccagaccccgcagccgcccgagtgccagaggtcgcctgaagactgggcgtcacccgatggataacacggcgccgcagatggctccgaagcggacgccgcgcagcatcccgctctcggtcgccagccccaccatggacgccgtcagcgccccgaccagcgaccccacggccgcgaatacgcaggtggcgacggcgcagagcaccctgcaggcgaggccgcacgccgcggagccgagcccggcgccggaccactcgcacggcaccggcggcgcggatggcgccgacgagctgggagacaggtccatcgggggacggggaatcgcaggaacgcaactgtgagatggcaaattggctactgttctgttcctcgctgctggcagcagattcgcacagactagagtttag

SEQ ID NO: 23508 - DNA, 911 bp, Zea mays
tgcaggttgactttaaaggatccccctggctctttttttttttttaatgataaggtgaaaacacaaaatcggacagcacttcacactctaaaaggagcactggaaaacagccaaaggccactacaggactagagaagataagaatatccttttcaactgtcaccaaccaataatataaagttactgattacattagccgacttgcacaattgctctataagaggctcaagcctgctgttgaaatcaatcggtgtaataaagtgtatgaaatttttttcctgttagcctgcacctctaaaacatcagtttagatatctctggcattatcgcctattcgttccatcgtccttttaatataaaacaagctaaatcactaagcaactgaacagctaaataccataactcaaaccatccttcagttgcgggtccttcatttgccacgacttctgaatcgatcccttccctctccccacattctattactggttgggtgggtgggatcatttcaccatccaccgtgagtttgacatcgataccgttcgcctcttctactccacaagagaccggcaattcggccgtatccactgatcccgcatcagtctccacaccatcgccgtccataactttctcatagaagctgccgttcttcgcgtcgtatagattccccgtgcgcacctcctgtgcaagcacgcaaggccagcagaatagccactgcgtgtagtctgttagtgacgccgatccgaagcaccacctgcttctgggcagcccaaatgtcttcctcatctggatcctccagaaaccaccgtacagcagaccaaagaaacacagcacgatccctgcagcgccgatgaaatcacccaggacgtagttgtggcatgttcattgccgtgacattgaacaccctcgagccg

SEQ ID NO: 23509 - DNA, 4823 bp, Zea mays
  misc_feature (226)..(226): n is a, c, g, or t
  misc_feature (730)..(730): n is a, c, g, or t
  misc_feature (1192)..(1192): n is a, c, g, or t
tgaggggaacaagaaatgagctgcaaaacctaagagagaatggatggaactcacttcttggagaaggtacatttattctgcgatgaacatcacattgaaagggaaaacatgcatgatgaatatgtcaataggcatgcaccacgaaacaaaactagtaagacaaacttgcagcattaccaaatagaagttcttaattatgttattgattgacaacttcaagagttcnatgaccgtttcagtgaggtaaattctgcattgttgggtcacatggttgcttttaaccaaaataactcatttcttgcatttgacaaagaaatcttagtaaggcttgctgagttttatccagatgattttgattcaaataaattggatgatcttagccttgaacttgttatatacattaacaacgtgagagcagatataaggtttgacaatttggatggggttgttggtctagcttaattaatggtgcaaacaaataagcatattacttttccattggcctatcaacttctaaagctagtactaatattgctggttgccacaacatcagtggaaaggtgttttcagctatgaatattgtaaagaaaaagttgagaaataagatgggtgatcagttcatgagtgattgcctaatatgctacgtggagaaagatatgttttcaaccattagtaatgatgaggtgattgatctttttaggaagatgaaatttcaaagtgggaaactttnacatgtgagtatatatagtatttcaattaattgtgcatgatcaaatgttcaaaacttgtgaaagtaacatgtttttttgtttaattatatcaggaatgagaaaactacatatacattggacaacatcaaagtggttttttttgaaacatgcaaacatatgatggcagaattctattcagctggtatgttttcaccctttaatttatataatagctataagtggtattattatgatttatagttatactatgtgtattcatgaatcatgaacctattaacaaaaaattctagctccactccttttttgaaacatgcaaacatatgtgctccctctttctcactctctctctctcgagatcggttctcgacttctcgtacgcacgcaggtcttcagtctgtcgcaggtcttcagtctattccatcgaagctgtcgcctctctgtccattttagcgaagtccagnctgcgatgttttataatcgtaaaaatctcctccctggacgggtcccagcccaggctccccgctcccccagccgttgctgtcgcggagcactgttccaggatggctatgggctatggcttggcttcgcttcgtcgtctggtctggtggacagggcacatggatgcaagattttctttttcttttactcacattttttttcttttttgacgcgtgacggtttctcagatttttcgatgggatttgcgggagattggatcgagcgatggagaagatcactgtcatcggtgccatgagctgtgctaaccgaccgaccgacagacatccagcgatgaacactcggccacgcactgacaaattccctgtcttgggttttggaaaaaatcctttgctatttaattttaaaatagtcgccaaatatgatctgaagccctcgaaagggaaacttgaatgcattagcaatatctcaatcaagaacatgcctacgagaacctatcatatgtacaaaggctcacttcgcgcacgtatacacaaattcaattcggacgcttcatctgtaacaaccaacagctaacatgttctacggaaaacatcttccacgctctctttccctgcacccagaccaagtaacgtgtttcacacgagggaagagagccacgaacctcatcgcgggcatacatctgctggagctggatcctgccccttgcgcagcagttgctgctgctgctgctgcttgccaccaccgccaccaatcaggaagacgcagaagcagaacgtggcggctgcaactgcaaccccgaacgagcagagcgcgccaccagcaccgttcactctcagtctcaggctccccacgccaaagccagccttgccgacgccctcctcctcctcctcctccggagtgcactgactgagactgacgccgccgccatcaggcgcagcagctccaaccagcagcgcgtcgtcgtcctgatcggcctcttcgacggacttagccatctcctcctcgtccgcttcgtagatcagtacctcggtcgcctcgctcacaaggtccgctcgctctggttcgtccggcacggcgtcaatggcgatgcgacgatcaccatcacattcacacgcataggcgtcttctgacggtggtagcaggagcggtttctgcttggcttcctcgtctaggacgcagtggtcacagggaggagggtgagagtgagacgacgacgacgacgtagggccgaagtggtccatgtcgatcacgaccagctcggccccgagccagagctggtccttaacacagccgccgacgccatgcctgcactccgccgcgtccatgaggaaggagctcctgtggccaggcaggacctcccagtcgtcaaggctgatggtgtccatggaaacggccggacgcgctctgctctcgtgctcatgtgcgagttgagtttggatgagggatctatatagtaggacgttcgcttgcagcgatgatacctagagtggtcaagaatggatgcttcatgcttcccaggaatcaaaacgaggagtggaaggatactttgctgcttccttccttcgtttttactcaaacccatctactgatgtacgatccagtcaggccaaaaatgtgaaaggtttggcctcattcatattaagaaagtagtcttatactatttaaatactactccacgacattttattaccgatttatatactgtgtccaaaggtaaaaaaaaagactcatcaggtactcctatttcgactgccttataatagtcacaatttaggctgccttaaaatactccacaatattttattttccatactactaaaacttaccctctggtctatctcactcgctattttaaactttactctgcaaaaagtaaaatttacatttcaaaacagtactttgcactaccggagatgtcatgaaaatataatatagttgcatgctccgtgttacttcctagtcgtggttaaacaacacagcaaactcattcaatctttctctatcagcagttgtcttgtcaaagttagggtgccactgtcacttaatccagattcgtgtccatccttttgtcttgtcagaattagggtgctactgcctcccaatccagatccgtgtccatccttctcaaggtacgtgacgtaccaagagcgtttccagaataatttatgcacgtcaaataaaattcacagtacagcagattgacagaggcgcgtcaaacgggggataatatggaccgagaaaagaacagcatacacaccaggagacacccgcaccgcgtactgaagcttcggcaaagacgaagtggagatgtggccatagatagcgaatgcgttcgttcaaaaatagatagcgaatgataatggtcgacaaggaacgtgcacgcaaagatgtaacatgaccttgtatcttaaaaacattatagtgaatgaatgacctaaaactaaagacactattgagttctgcaggccaggcactaagcttcccgctcttcaaattggagtataataacgaagtgaaaccaagttctttaatgaagattacagtgtaaagtaaaacaacaccacaaacaagagagaaatcctaaaaaacccctacaaagatgttcatgatacattgccaaataactctggttaatagacagaaagattaggcaccagcaaatgcaaaggtattcctaatatacaacagcacatgatttcctcaaaatttacatgcatgcaaggtttcccccccttcctgactgcacagaaacagtggggagcaaagattaaatggttttgcacagaaacatgtgagcagctaccctaacaaacatctctaagatggctaagcttgtcttgaagatgacggttcacccagtgaaacagaaggaaatgaggaagcccacgctcgagcattatttgctcccttcctcaagtctgttgccttattgctcagcctcagcttgctccaaagcctccttacatcaagaacattcaaggctcgttccaggagctggtttgatcccctacggatccctaggttcaagttttggacacgaacaactaagaaagctctcagatgagacatgacaacaggtatgaagtgtgctacaaccttcacgataataaaaagaactgcaactaacaaatacatctcatctttggccatttcacgaatagaacgatcccatggcataactgagctcaagcttcctgtgctctcttgttcaacaacatcaatatatgcaattggatcgagacctgtagtttctttatagaaatcgaccagagagttaagatcttttgaaccccgatatcgaaccatcgtagtctcatttacaagaagaatggctgggaaaccacggactccatatcttgaaaacaggcttggtgtagcagaagattcttcaacagtaaagtgatgtatctgagggtacatagtgctgagagtgtccaaattattggtcgcagtttgctcgagaaaatggacaccatgcagcataaaagagaatggagtatgaagcacccctccttcgaaggttcaactcagtatcaacagtctctcctctcaccttcagcagaagacaaggtatataagaaaccacaactttccaaattcgcaatataacccggccggcctcgaggtacccaa

SEQ ID NO: 23510 - DNA, 3949 bp, Zea mays
  misc_feature (3858)..(3858): n is a, c, g, or t
tgcaagattttctttttttactcatattttttttccttttttgacgcggacgattaccccgactgtttctcagatttttcgatgggatttccgggagattggatcgatcgagcgatgggaagaagatcaccgtcatcggtgccatgagctgtgctaaccgaccgaccgacagacatcaagcgatgaacactcgaccacgcactgacaaaaaccctgacaagggatttggagggatctataggcagaaattcctttggtataattttaaatagtcaccaaatatgctctgaagccctcgaaagggaaacttgcatgcatcagcaatatctcaatcaagaacatgccaacgagaacctatcatatgtacaaaggctcacttcgtgcacgtatacacaaattcaattcggacgcttcatctgtaacaaccaacagctaacatgttctacgaaaaacatcttccacgctctctttccctgcacccagaccaagtgacgtgtttcacacgagggaagagagccacgaacctcatcgcgggcatacatctgctggagctggatcctgccccttgcgcagcagttgctgctgctgctgcttgccaccaccgccaccaatcaggaagacgcagaagcagagcgtggcggctgcaactgcaaccccgaacgagcagagcgcgccaccagcaccgttcactctcagtctcaggctccccacgccaaagccagccttgccgacgccctcctcctcctcctcctccggagtgcactgactgagactgacgccgccgccatcaggcgcagcagctccaaccagcagcgcgtcgtcgtcctgatcggcctcttcgacggacctagccatctcctcctcttccgcttcgtagatcagtacctcggccgcctcgctcacaaggtccgctcgctctggttcgtccggcacggcgtcaatggcgatgcgacgatcaccatcacattcacacgcataggcgtcttctgacggtggtagcaggagcggtttctgcttggcttcctcgtctaggacgcagtggtcacagggaggagggtgagggtgagggtgagacgacgacgacgtagggccgaagtggtccatgtcgatcacgaccagctcggccccgagccagagctggtccttactaccgccgccgacgccatgcctgcactccgccgcgtccatgaggaaggagctcctgtggccaggcaggacctcccagtcgtcaaggctgatggtgtccatggaaacggccggacgcgctctgctctcgtgctcatgtgcgagttgagtttggatgagggatctatatagtaggacgttcgcttgcagcgatgatacctagagtggtcaagaatggatgcttcatgcttcccaggaatcagaacgaggagtggaaggatacttttttttttttgagtggactgcttccttccttcgtttttactcaaacccatgtaccggtgtacgatccagtcaggccaaaaatgtgaaaggtttggcctcattcgtattaagaaagtagtctttatggtattgatttcaaaatcaataccatttaaatactccacaatattttattaccgatttaaatactgcgtccaaaggttaaaaaagactcaggaggtactcctatttcgactgccttataatagttcacaatttagactgtcttaaaatactccacaatattttattttccatactgctaaaacttacgtccaagagtctttgagactagacccaccatttcacttctatctcactcactattttaaactttactctgtaaagagtaaaatttaaatttacagttcaaaacagtagtttggacgaccggagatggtatgaaaatataatagctgcatgctccgtgttacttcctagtcgtggttaaacaacacagcaaactcattcgatctttctctatcagcagttgtcttgtcaaagttagggtgccactgtcacttaatccagattcgtgtccatccttttgtcttgtcaaaattagggtgccactgccacctaatccagatccgtgtccatccttctcaaggtacgacgtaccaagagcgtttccagaatattttatgcacgtcaaataaaattcacagtacagcagattgacagaggcgcgtcaaacgggggataagatggaccgagaaaagaacagcatgcacaccaggcaggaaacacccgcaccgcgtactgaagcttcggcaaagacgaagtagagatgtgaccatatatagatagcgaatgcgttcgttcaaaaatagatagcgaatgataatggtagagaaggaacgtgcacgcaaagatgtaaacctctgaaaaaattgccagaagaaacaacttaaaattagagcaattcggacttcacatgaccttgtatcttaaaaacattatagtgaatgagtgacctaaaacttaagacctcttgctagctctgcagcgtgaggtactaagcttcaagctcttcaaattggagtataataacgaagtgaaaccaagttctttaatgaagagtacagtgtaaagtacaacagcaccacaaacaagagagaaattctaaaaaaaaacccctacaagttcatgatacattgccaaataaacactctggttaatagacaggaagattaggcgtcgcaccagcaaatgcaaaggtattcctaatatacaacagcacatgatttcctcaaaatttacatgcatgcaaggttttccccccttcctgactgcacagaaacagtggggagcaaagattaaatggttttgcacagaaacatgtgagcagctaccctaacaaacatctctaagatggctaagcttgtcttgaagatgacggttcacccagcgaaacagaaggaaatgaggaagcccaagctcgagcattacttgctcccttcctcaagtctgtcgccttattgctcagcctcagcttgctccaaagcctccttacatcaagaacattcaaggctcgttccaggagctggtttgatcccctacggatccctaagttcaagttttggacacgaacaactaagaaagctcttagatgagacatgacaacaggtatgaagtgtgctacaaccttcacgataataaaaagaactgcaactaacaaatacatctcatctttggccatttcacgaatagaacgatcccatggcataactgagctcaagcttcctgtgctctcttgttcaacaacatcaatatatgcaattggatcgagacctgtagtttctttatagaaatcgaccagagagttaagatcttttgaaccccgatatcgaaccatcgtagtctcatttacaagaagaatggctgggaaaccacggactccatatcttgaaaacaggcttggtgtagcagaagattcttcaacagtaaagtgatgtatctgagggtacatagtgctgagagttccaaatattggtcgcagtttgctagaaaatggacaccatgcagcataaaagagaatggagtatgaagcacccctccttcgaaggttcaactcagtatcaacagtctctcctctcacctcgagaggcggggacgggtcgatccggacgaaggggcagcgggatccgacggcgtcgaggaacggcggcgcgcccctccgcgcgcacgtgcccgcggccggcgaccccgcagcggttgcggcggcaacggcagcgatgagggcgaccgcaagcgcggcggcggcgcagcgcatcatagtttctcgcgttctctcccctcccctcccctcccctcccgtcccctctctctctctcgctgtcggaacttcttccgcttcggaattttctccgcgtgtcggtgtgtggagaccggatttgacgaaaccanaaaaatccgctaggttattttgggtgcgggcgcgggtagtggttgccggtggggacgcgtgcgtgctgccgcggtgccgcctggttggctt

SEQ ID NO: 23511 - DNA, 710 bp, Zea mays
gggggagggttgccctgggtgcaaacgggtcccaacctggctgggctttctttctgggccaccaccatccaaatttatgcactgattccagaccggtagtttctttataggaatcgccgagagagttaggatctttgaacccccgatatcgaaaccattgtagtctcatttacaagaagaatggctgggaacccacgccctcccgtatcttgacaaacaaacttggtgtcgcagaagattcttcaacggcaaagtgatgtacctgagggtacatagtgctgacagtttcaaatatcggtcgaaatttgctcgaaaaaggacaccatgcagcatagaagagaatggagtatgaagcacccctccttcgaaggttcaactcagtatccacagcctctcctctcacctcgagaggcggggacggctcgatccggacgaaggggcagcgggatccgacggcgtcgaggaacggtagcgcacccctccgcgcgcacgtgcccgcggccggcgaccccggcgcggttgcgccggcaacgacagcgatgagggcgaccgcaagcgcggcggcggcgcaacgcatcttctctcaccttctctccctgcctcccccgtggagtcgtggcctcgtctctcctatctctttctctctcacctgtcggttcaacttcttccgcttcggaattttctccgcgtgcggagggctggatttgttt

SEQ ID NO: 23512 - DNA, 1065 bp, Zea mays
agggcggcctttacagcaccaaaccaaaaaaggctgcctatcagtacgtcggggataaaaagtgtcaggcgcgctaatgatggatttgtttatattatgatcagcgacggtgcacttcccttagcagtctagcgctaatgattaagagcgccatcttgactgccttccgcccctgggccaaacctccaaccattgttgtgctgcttcagaaacactcttcgttctgcttcagctcatttgtgtccgctcttctaaaaccgaaacaggaaatgcaaaggtattcctaatatacaacagcacatgatgtcgtcaaaatttacaggcatgtaagatttcccctctcctcctgactgcacagaaacaaacaggatgggaagcaaaccttatatggtctttgcatcatgtgagcagctagctaccctaacaagcgacatctccaaaaaaaaaacaaaaaaaaatggctaagcttgtctcgaagatgaaggttcacccagtgagacggaagcaaacgaggaagcccaggctcgagcattgcttgcacccttcctcagatctgttgccctgttgctcagccccagcttgctgcacagcctcctcacgtcaagggcgttcaaggctcgttccaagacctggcttgatcccctgcggatccctaggttcaggttctggacacggacggccaagaaggccctcagatgagacatggcagcaggtaccaagcgcgctgcggccttcaggatgatgaagagaactgcgaccaacagatacggcggctcgtctttggccatctcaagcggagaacgatcccatggtgcaactgagctcaagcttgctgtgctctcttgctggacaacaacatcaatgtatgcaactggatccagacctgtagtttctttatagaaatcgacgagagagttaagatcttttgaaccccgatatcgaaccattgtagtctcatttacaagaagaatggctgggaaaccacgaactccatatcttggtgtcgcagaagattcttcaacagcaaagtgatgtacctgagggtacatagtgctgacggtttca

SEQ ID NO: 23513 - DNA, 1048 bp, Zea mays
  misc_feature (1048)..(1048): n is a, c, g, or t
ccggccggccccccgccggtgtcgaaaccacagccacacaggcagccggtgctgggcctcggcactcggcagccatggttcgccttgcgaagttctatctcgtctgctacaactccctccaatcgctcggatggttcgtcgccctcctccgcctcgtgccctgcctcgtccctcccttccctgtccactccgcgtacgtggtcgccggcgacctcatctgtttcctgcagacatgtgcgatccttgaaacggtccacgctgccatcggattggtgccgaccgcgccacttcttgctttcttgcaatggggagggaggatccacttcatcctggctgttgtccggcaaattcccgaggttcagagcagtccatctgtgttcataacatttatagcttggagcatatctgaggtcatccgttactctcactatgctctgagtaccttaaaagtttgtccagcatggctgacttatctcaggtacactgcttttatcccgctgtatccaatcggggttggtccaggagaaatgtggacaatgtaccaagccctcccgtttgtgaagaagagggacctttactcaggtttcttcgagaagttctccatgagctaccgttcctttctagtgggtgtgctggtgctctacccgttcctgtggctgaagctgtaccagcacgtgttcaagcagcgcaagtccaagctggggaaggggagcaggaagaaacgggcctgagaaaatctggctctgctcagctcagctcagctcagctgccacttgttgctgtcatgtgaaacgctaacgggtcattgtggatttttgttttggaagaaaatctttgagttgttgtctgatgcgacggtgaaggttttgctgaatcgggcagtaattggattacgctttgggttctctgtttgtttcaattgctctgcgttttatgtctgtattaacatacatcaagcatatataatagtcatgttgctgctgcgagtctaaaaaaaaaaaaaaaaaaaaaaaaaaaaaaaaaaaaaaaaaaaaaaaaaaaaaaccan

SEQ ID NO: 23514 - DNA, 3005 bp, Zea mays
  misc_feature (2757)..(2757): n is a, c, g, or t
cctatatatcgttacatatttgctatacaatgtttagattcaattaaaaataaattttctaaattcgtaatatctttcgcttgtaaacaatggtggattgcgtggaaagagttagcgtctcacgcgcataatcaggatgcgtcgtggggacaagatttccaaacagatgaacctgccccggccccccccgcgggttttttttttttttttttttgcgaacagcaatgcggcaatgctttcctccatcaaacatggcgactgattacatcgaaatcaaacgaagggccacagcccacagagtatacaaaagtaaattgcgtggatcaggatcaagttccgcagggaccagcaacagcaggccagcagcacaacgattcttgttgctccgtcgtgactcgtggcactgggcctactccttttcggccttcgccccgaacacaacttcggcaccgtgccggagcacctcggcgtcgcggcagaccctggccgtcgcctccgcgggcagcgtcaccaccacgtcccgcgcctcgccgccctcgggcgcgggcaggacgagcaccagcccctcgccggtggccccgcccacgcggcacgacacgcgcgccggagaagccccggcctcgaactccgcgccgtacatgggcacgtggtccagcgccgcgcacgtcagctccggcccatacatctggaacggcgcgttttcctgttgctgccgcgtgtggagccactccagggcgcgccacagctcctcctccggcacgccggcaacgtggcggtccagcgccgcggccacggcgggcaggccggacgcgaggtcggcgcgcgcgcgcgtgaagtggacggagctgccgtagtacccccacggcagcggcgcgtacatccgcttgcggaagtccagcgccagtgtgagctctcgctccccgtcggcggcgccggtgatccggagccagaagagcgcggcgagcgccgcgaacggggtggtgcccggctccagggaggagagcagcgcgcgcaccgcggcggccgggaagtggaacgtggcggaagacatggcggcggcggcatctgtgctggtgggggaggcggcgctggctttctcggcgagcagaggcggtgcagggggcggcgaggtcggggagaccgccaacgccggcgggtgaaggaagggcgggtacgtgctggtggtccggcggtgggcggctgcccaggcgtggaagaagagagcggcagcggtggggtcgttgtggatgtggatgcagctcagccccagcgcgtacgacttgtcggtgaactctgtcagctgcatccatacacgtggtcaccatggaaaattttaattaaggtcctgtctggtcccatactgcatctgcatctctgcatatactgccaccacttatcagtgatgcagccatgtgacgcggcagtacaagagcacaagacatttaattctgaagctgttcctaccgaattagaattagtaagtaaatgtccccaaaactctagtgctcaactgccgagcaatcaaacctatccagacagccagacaacaggatgctcctgccatgaattagctcacctaacttccccaagcagagctaagctgagattgaatgagtcggtcaagggtgtacctggacgtagaacggagaccagatgtaaggctcggcccccatgggctcgtaatagaggaggtccatctcctcgtcgccggtcgccgtggcgagccactcgtcgagcgtgacggccgccctggcatccaccatgcgcacgccggcgtcgttgcacttcacgacccaaccccggtgcgcaggttcggcgtccgcgctgccttcgccgcgcgtgagccggccggtcatggccgggtagagcgacagcacctcggagagcgactccttgagctgctccctgtccaggcccggcgcggcgcggaggtagaccaccacgtgcaccgtgtgccgctccatggcgttgtccaggggcgacagcgcgtgcgtcttgcccggcctcacgggcgtcaccgacgccgccgtcgacttggcgaaccgagtcacacggctgcccggcccggtcgccagacccgccgctaccgtcatcgccgccgaaggcatcactgatctgcgcgggctacagagcacactggagaggcagctcacgagatcagtcagatcttactattgctcgaggcctcgagctctttgccggatggattcccgggcccggttggggacgggggagatttaaggcgagaaggtgggtagggtttagctgttggtagttgagcgtattaacgaacttttgaattcgctggacacgtggcggctcgtgtatggacagatactagtacaagtgtcagattggttggtgggtggtaggggcgtagggcgtccggaattagatcaagtcatgtgtttcgacacttcgccggtagtttaggtggtgtttggttctatagattttggaaaaagctgtatactcaatataaattctattgtcaatttatgatgagactgagtttgtgacacaaaatccaatacaaaatttaaaaattgtttgtctaataattagattctagaatgagattctaaaaatgagacctgaaaaaaaaacaccaccctaatttacgggacttttaaatttatgctaccaattgagcaccactactgagttttattcctctctactgataaaaaacttatagttctttactattagagtggaataaactaaatagtgatattaaactaggaaaacatattnaaaacgagttctagaccatatgttacacgaaaaggcacaaattgctacacatgtcacctaaataatctagagctcgaatcttggtcaagataaggtctggtctttaacggccattcctaggttttggaacaaccatcctaggatggtggagtgtatgggcttagggtgctagaccaggctaggctattgcatggccccggaccactaccgagaacgtgttcctctctctctctggacctagcctttcg

SEQ ID NO: 23515 - DNA, 1693 bp, Zea mays
ttttttttttttttttactgaaaacatccggatagagctatcctatcttagaaaatttcgtccattcacatgatgctttgcagtacctctgtccagtacaaaatttctactgggaatacggctccttttgggttgcacatgctgctgctgatgctgttgcaggtaacagtggttctgcaaaatacagcatctaaaaccggcttagactggtggaacctgcctactttagtcagccttctcacatgccttgagcatacaaaccaagtactagcaagcatattaagctttagataccattttcgttgttcatcagcacgtagccagaacaggcattgtggtccttgcggaggcgcgcccaccatcctagctgaagattaaccagtaaacaacttcctcggcaaaaaccacgcaattggcaccaacacaatccagtcagacggtttcagtgatgacaactaaaaatgacaccgatctgaagagcgaaaaagaacaccagatgtaatcaaatggaggcatataaagaaacttatctgaataaagcagcagcatgagcagcagccgaaggcgactacattcaaatatcaaaatttaacagcactggttgtattgcatgttaagagtacaaacgtcaatcccccacggcctcttgcaccatttgtgttctttgtaaacacttctttcatggcatcactctctgccgtgccttgaccgcttgcgatcctcatgttccacatcatatctgcgtctttctgattttgtttctcttcctctgtcggatctgtcatcgtccctctgcctctcacctcgtgatctctcaggtgagttgtcacgcctgaatctgtcccgatcttctgctcttctatcatcatgcctactcctagattctcggtctccataccgctctgatctcgatggtccaccatccctagagtcccgacgactgtttgcatttctctgctcgtcatgcgaaaatttgcaggatgctccacggttgcactctcccttctggaaagcatagcacatgcctcggctcttcggtacatcactgtgtttgtcatgctcccatcgtgcaccactatcctctttagaaccccaaccggtgtttgcatttctctgctcatcatgcgaatatctgcaggaagctccgcggttgcactcgcctttctggaaagcatagcagactccacgggcctccctcttcttctgcagctcctcctcatcttcctcttccttcttcttgtacttgctcacatggtcaacctttatgatcctcccaagaactttagctccattcaaattgtcaacagcaagaatcgtgcttctctggtcctcgtacgcgaggaacgcgaaccccttggattttccggtgcccttgtcgcgcacgaggttcacgtcgacaacctcaccatactgcgcaaagatggcgaggaggtcgccctcggtgaggtcgaaggggacgccgccgacgtagacgtaggccgagtccttaaacttggcgtgccacgacgcgtcctcgccgatgcccaggatcgcctccttctggttgataatctgcgtccgcttcacctgcgtgaggggattcatcgccgccgccccggccgccggcgccgcgccgccgactactcgtacagcggcggattgggagacgaaggggggagtcgtgtcggtcagtcggtgtttggggtcgaacggt

SEQ ID NO: 23516 - DNA, 2104 bp, Zea mays
aattcttcactgccaatggtacagtttgtctgaacgatgcattttgtttgttgctagcctgctattttttttttttttttggtctgaataatgcttctggtttacagtttactgccacattacacataaagacgggcacataacctgtcaaatgtactgccacaattagacagctgcatcaaccatggccaggtcagcctacaaggctatagctagctatatagttctatgaagcagaaacacatgagactaagctacatactacaatggacaagggaaatgtaataaatccaatgcttggaattttatttcgacacagtgaggttctaacttaagttttctggttgagcacatggcggagctgaatcttctggctctccatccgagcttcaaggagcttcgccttcaggctctgcctctgaaccatctccatgcaacctctgaaaccccggttgagctggctgttcatcgaatccggtgagctccattgcgtggtgctaggggtgctgtcccccatatctagattcaagcctttggcagtagagtacacaccatttggaagacttgcacttgataatctcccatttatcatatccgcaacatcttttgtacggaattcacagtttttcagtggagatgacttccacagctttgatatggcggactctttcttcttggactgttccatgtccgtcaggtacacactgctcaagtcatcacacagtttgttggcctgctcaccctcagaatcgtttccactggtccacgaaattctgtcaaagatcttgttgactgaatgttcactttcatacggcgaatggcttgagccttgcatctcttcatggctcatggtctcccagctgcttccatcttccttatcgctctcatcagaatggcttccatctgggaacaatctggctcgattttccagaaatatatcagctgttgggctagcttcttggatttcttgctttaggcatggttcggtttcctttttctccatctcttcacttgggcgtagctcttcaaagatggccagtatatcttctgatgctcttggtggctcatatgtgaattcaacctcttggtctctggccgacccaatggcctgtacaatgttgtgtgcggcttcaacaattgtgctgtctcctttggaagagctgaaagtcgaaatgaaagcctccacctcctcctgcagtttgctcaactgttcatgtttggcctcaagaatgagcttggcatcgacaagtttcatctgcactcgctcctcacgccacacctcagccatctgtagcaatttcctatcctcatccaggtcgccgcgtagtttgacagaatcctgcttcaaggcttcgatctctgacttgtgttcctctatctccctcactagcttgttgcacacctcatccgtgagttcccgcgtcttctgctcgttgtcatactcttgcaatagctgcttcgcggccattttgacctctttcaactcatcaacaagcttgaagttaatagtctccaactgcctccggttctttttctcatgctccagatcagccttcatatcttcaagaatggcttgaactttcttgtgctctctgttccgccaagctgctttctcctctgcaagtttcttgaacaagtgattcagttgcttcttggctgaaagccgttcagcttctagcttgctcactctatcccgtgcctgctgaagctccaactcaaggctagcaacatagctgcccccttgctgttcctcaacgagatttagttggctagcaatcacataggcaccatctggttctatgctctttatgtttatatgctcccattttgttgcatcctccacaccagaggaaagaccaagatgtatcttgtggagctcttcactatgtggctccaggacggagttggggcttgaaatgtcttttttgaaactacggtggtaagtaagaggattcttgcgcaggaggtgagcttgtagatgtctcggtatatgcatcttctgaaaccaggatctattgttcataccatgaatggcagtgccattgcaaccaagaagctcaagtgggaactgaacacatgtttgagtttacaccgaatgtcactt

SEQ ID NO: 23517 - DNA, 3343 bp, Zea mays
attgggacctcgaggcggccgggtgtcaattcgatacgacagcgtccacccacccgtcctgccccgcccccccaccctaacctctggcggcgatgagcagcggcggcccgccgaggaagcgcaacttcaagatcgaggcgttcaagaaccgtgtggacctcgaccccaagtacgcggagcggacatggaaggtcctcgagcacgccatccacgagatctacaaccgtaacgccagtggtctctccttccaggagctttacaggagtgcctacaacatggtgcttcacaagtacggtgagaagctgtatgatggccttcagagcacaatgacttggcgcttgaaggaaatatcaaaatcaatagaggctgcacagggtgggttatttttggaggagctgaatgcaaagtggatggatcacaacaaggcactacagatgatacgagatattcttatgtacatggacaggacatatgtccctacatctcataggacacctgttcatgagcttggtctgaatttgtggagggatcacataattcactcccccatgatccatagtcggctggttaacacccttttggatcttataaaaagggaaagaatgggtgaagtgattaacagaggcctgatgaggagcataacaaagatgctgatggacctgggtcctgctgtgtatcaagacgattttgagaaaccatttctggatgtttcagcccgcttctacagtgtggagtctcaagagttcattgtgtgctgtgactgtgggaactaccttaagaaggccgagagacgtctaaatgaggaaatggagcgtgtctcacactacttggatgctggcagtgaggcaaagataactagtgtagtggagaaagaaatgatagccaatcacatgcacagattggttcacatggaaaattcagggcttgttaacatgctagtagatgaccaatacaaagatttgggtcggatgtattccttgttccgaagggttcctgatgggttatcaacgattagagatgtcatgacttcttacttgagggaaacagggaagcagttagtgatagatccagaaagtttgaaagatccagtggaatttgttcaacgcttgttaaatgagaaggacaaacatgataagatcatcagtgttgccttcggcaatgacaaaaccttccagaatgctctgaattcgtctttcgagtatttcctcaacttaaacagccgatcacctgaattcatatcattatatgttgatgacaaactccgcaaaggacttaaaggagcaacggaagaagatgtggaagttatattggacaaagtcatgatgctgttccgatacctccaggagaaggatgtgtttgaaaagtactataagcagcatttggcgaaaaggctcctgtctagcaaaactgtttctgatgatgctgagagaagtatgatagttaaactcaagacagaatgtggataccagttcacttccaagctagagggcatgttcactgatatgaaaacctcccaggacaccatgcaagacttctatgccaagaagtctgaggaacttggggatggccctacgcttgatgtccacattttgacaactggttcttggcctacgcagcccagtcctccttgcaaccttccaactgaaatacttacagtatgtgagaaattccgggcatattatcttggaactcacaatggcaggagattgacatggcaaacaaacatgggtacagctgatataaaagccacatttggaaaaggccagaagcatgaactaaatgtatccacttatcagatgtgtgttctcatgctgtttaacaatgctgatggattgacctacaaagacattgaacgggatactgagatacctgcctcagacctaaagagatgtctgcagtcacttgcttgtgtcaaggggaaaaatgttctccgtaaggagcctatgagcaaggacatatctgaggatgacacattctacttcaatgataagttcacaagcaagcttgttaaagtgaagattgggacagtggtggcacagaaggaatctgaaccagagaaacaggagactcgccaacgggttgaggaggacaggaaacctcagatcgaagcagccattgtcaggatcatgaaatcacggagggtgttggatcataacagcattgtagctgaggtcaccaagcaattgcaagcccgtttcttgccaaatcctgttgtcataaagaaacgcattgaatctctgattgaacgagagttcttggaaagagacaaagtagatagaaaattatatcgttatcttgcatagaaaactgtcatgagataattcattagcagttggcatccttctgctcttgtaaaacggttttctttatgctcgagttctcttttatcagttgcattggccgctgggttcatagatgttcaaacattggttattggttgaccgcgaactgaagtggtgattgtattgaagtggttcatagatgttcaacacttactctttttgtttgatgggtctgcaactgcaagaactaagaagccatattatctgtttcctgtgttgcattcagacttcggtagtttctttgtttcctttgcatccatttcatctttcttaatgtcatgtatgcttctatggctttggcatcaagaattcaagatttcgttgcaatctatatccagatgtccttcgtttatgtgaaaacattggccataaataaagtaccaacttgttagcaagatttgcagtgttgatagaagtagtcatcagaatccgcactggtcatgagattgtttaatgttgaaccaggagacacccatcgattaaaaaattcggagatacaacaataatgtacttacaaagccagaaaatggtacacgttttgccgatgagcttaaaagggtgtcattctaacatttcatgtgttcaatgaacatttttatattacaaagctgaaatcgaaatgatttttttatgaggaagtgagaccattgggatttctacaattctactgccaacggctgtgcaaaggttcatttcttttctctacaaacaagcatgttaggcacattggtactatggtacattcagcacaataaattgaagtcgcattgctgttgatttctcaaatggcagcctcagtcctgtatggatgacgaatcgtgtccaaacgaaggttagctggtggtggatctgtagtctcgttagttcggtgatggaacagtttaactattgctcttctttcgcagtcctgtttcaacaacaaattgacatccatagtattagacaggctatgaaaacacgttaataaatgcaatggtgattacttgattctgcaggcatgc

SEQ ID NO: 23518 - DNA, 801 bp, Zea mays
  misc_feature (672)..(673): n is a, c, g, or t
  misc_feature (788)..(788): n is a, c, g, or t
ccctctcgagttttttttttttttttttgttttttttttgaagaacttgcgtgctctcatattcaaatcaatagattagatataagtgcataactagcttggcatgctctcatattcaaatcaatagattagatataagtgcataactagcttggcagttggccccagcattccccttcttttcctccctagctgagtaggccatataatggcaaagtcttctttttaagagcgagtcctggtgaaatgagacgaccaatttcaaacggaatactaagctgcagtcttaacaggaggggaggaggagcagagaaaacaggcgaacttgatgccaaactaggaacagcttaaggaaacctcgcaaggtatttccgagctgttcacaacaatgtgcgagaatagaatcaacattatcaacactggtgcagcggcgctggctgaaatgctccgactaaccgctaaccgctgaaccaaagctcctatcggcagaaatgctgcaagaatgttgtcgcgctttggcacgcatgtcacagctcagggcttcatcctccagtgctgggggagacgggctttctgccatgcaccctgaagcgatagatgcatgtaagttccaagttcccatggtttgagccaccccccccaccgctgaaccagtggttgtacaacacgtgnnattacatcggttctctctagttggaaggtctgagcattgctcttgtcaagatcataagagaactctcctaaagtagacatcacatttgaatccttctctgaatcatcatgtggtncttggtacccgcc

SEQ ID NO: 23519 - DNA, 2299 bp, Zea mays
  misc_feature (18)..(109): n is a, c, g, or t
  misc_feature (130)..(151): n is a, c, g, or t
  misc_feature (177)..(181): n is a, c, g, or t
ttgcgtgctctcatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggcccgggtcgtttagagnnnnnnnnnnnnnnnnnnnnnntaggccatataatggcaaagtcttcnnnnnaagagcgagtcctggtggggcctgtcgtcctttttctttcggtgtactcagacgaccaatttcaaacggaatactaagctgcagtcttaacaggaggggaggaggagcagagaaaacaggcgaacttgatgccaaactaggaacagcttaaggaaacctcgcaaggtatttccgagctgttcacaacaatgtgcgagaatagaatcaacattatcaacactggtgcagcggcgctggctgaaatgctccgactaaccgctaaccgctgaaccaaagctcctataggcagaaatgctgcaagaatgttgtcgcgctttggcacgcatgtcacagctcagggcttcatcctccagtgctgggggagacgggctttctgccatgcaccctgaagcgatagatgcatgtaagttccaagttcccatggtttgaggagatatcaagctgaaccatgttgacaacacgtgattgagcggttctctctagttggaaggtctgagcattgctcttgtcaaggtcataagagaactctcctaaagtagacatcacatttgaatccttttctgaatcatcatgtggtccttggtaccatccacggacctggaaatcctttggagcacttgatctatcataggccacactcttgtcaacatgttctagagtgacggcttcaggaattattgctgttcttagcttcaccttcacaaacccactacttcctttcactgcaaaacactctcctggctgcccaaaacttggctccagcatcttttgggctgttgtgtgcacattgctgcgaccaggtaaatagttcttgccattcatgaaaggctctgagtgacttaccactttagcaccaccagatcccaatgcataatccaccataccaaggccatctgcggaatgccttgctatctccatctcaaccacatctttggcatatagccttatatcatccaagcttatttcatcatctgtaccaccgaatcccttctttttcttcaactggctcaaaatctcctcaaactcatttttagaaagaaatcccatgtcactaagctcagccagtgacttgtccaacttgtcagttttgtcttccaaaatcttcatctttttctctatcttattacccttatcctcaaattgcttagcaatgaccccttttgctttgtcaatctcattttctagctttttatccaaaacatccaactgtagctgaagcatcttggctgtcttcttgaacccttccaccctggatagcctgttctccatatccagtgttgtaaatgataattcaccactttgccatctccagaacacctgccccatccaagcagtagctgaaataagaagacacagcttcaccagcacacttaaggcagttacccagttggcgttttcttgtttagtagggcttttcttttggcgtacagcagctgctgaagcaaccacatttgtagtgtttttgttttggcgttcagcagttgctgaagcaaccacatcttttcttccttcagaagaataatttgacttttgaagaactgattctcctcggatagtatgactcagatcattgctaggaattttttgaagaatcgaaggcaatgcttttctttttgtaataccagctgttcgctgcctagcatcttggctagaatgtgaatccgaacttactgcatggtttccatttgtattcgcagtacgaattgcagcagtagaagcagacattgtcatcagctataaagtagatcgtattctataaataatgatgctcctgtggagctgcgttccggacgcaccggagccggtcgcggagacaccggggctgcagagggcggatgccgcgccgaggtggtcacgaggacgctggggcgctgggccccaggtggtgctcaaccgagcgcggtctcgttacgggctgcgacgctgcgagcggagggaagagatcggccgcgggcaagaggcggcgggcgggggagcgacctcggccgcggaggagaggaagcggccgccaccgcggggagctccagcttggatcgggaagtgggaagtcccagccccgccggcggggagaaaagaaataaaaaataaaagagtataggatgcccggacccggccggc

SEQ ID NO: 23520 - DNA, 1828 bp, Zea mays
gaaagcaggatgttcctacctttaaccaagtggaccaagatctctatcatcgactccctgcccccctcctcctcttctatataaaccatacactgaaacgacgtctaattgtgctgtgatccaggcagcagtgagctcagtacacagctaggcacagcgacggggtccggtccagggccatggctaaggaaagcaagctaacggccggagtggccgccgcgctgaccgtcgtcgctgcttgcgcgctatgcctgctgctgccggcgacggcccgcgcgcagctccgggtgggattctacgacaccagctgccccaacgccgaggccctcgtccgccaggccgtcgcggccgccttcgccaaggacgccggcatcgccgccggcctcatccgcctccacttccacgactgctttgtcaggggctgtgatggatccgtcctcctcaccgtgaatcctggcggcgggcagactgagcgtgacgccctcccaaacaacccgagcctccgcggcttcgacgtgatcgacgccgccaagaccgccgttgagcagagctgcccgcgcacagtctcgtgcgccgacatcgtcgccttcgccgcccgcgacagcatcagtctcaccgggagcgtctcgtaccaggtccccgcgggccggcgcgacggccgcgtgtccaacgcgacggagaccgtcgacctacccccgcccacctccacggcgcaaagcctgaccgacttgttcaaggccaaggagcttagcgtggaggacatggtcgtcctctccggcgctcacaccgtcggccgctccttctgcgcctccttcttcaagcgcgtctggaacacaagcacgaaccccgctaccgcaatcgtggacgcggggctgagcccgtcgtacgcgcagctactacgcgcgctgtgcccgtcaaacacgacgcagacgacgccgatcacgacggccatggacccgggaacgcccaacgtgctggacaacaactactacaagctcctgcctcgcggcatggggctcttcttctccgacaaccagctgcgcgtgaacccgcagatggccgcgctggtgagcagcttcgcgtccaacgagacgctgtggaaggagaaattcgcggcggccatggtaaagatgggacgcatccaggtgcagacagggacgtgcggagaggtccgtctcaactgcggcgtcgtcaacccgagttcgtactcgtcgtcgtcggcggtggagctgggttcgagcgcgccagcagccgtcggtgaagagggctacgccgcgagctagtagctcgcataccagtcttcggccgccgtcgttgtcgagatcaatgattttttttctctctctcgcatgcatccctcttctgcttttattttgtcgcgtggactgtggtttttgttgtgtcgatgatctttgttgtgtgccagtgccactaaacgtacgcatgccggccggcgaactcttaacttcggtggcgggtaataataagcatatgtatgagtaagatgagattgtgtcaatttagggtgtggatgctttcaaaaaaaaaaaaaaaaggcttaggactatgcatcaacttgaacaagagtactgcatgcagtgctaattcatatggatgagttccccgccgacacataccatgtgtttggttacccgactaagcgtaactaggtcgtacacgtgtattgactgatcctcgacctacgtttggttgcttatacgggacagacgagaactgcatttgtgggtgcaatccaagccaattcgagcggttttgcctgcatccgcggagacacggcctaggtgcgtatctgacaggccatgctgca

SEQ ID NO: 23521 - DNA, 1738 bp, Zea mays
  misc_feature (27)..(27): n is a, c, g, or t
  misc_feature (32)..(32): n is a, c, g, or t
cgtgcgtgtgtgtgtctgcgcgctagnttagnacacctccatcgtcaataattgcaggcagatccatatagtctgctggtggcgagacaaagcaacggatcgtcgtcgatccggagagcggaaagcgcgcagatcgcggcggccatggggcgcgggaaggtggtgctgcagcggatcgagaacaagatcagccgccaggtcaccttcgccaagcgccggaacggccttcttgagcaggcccgagcgagatccaatctgcaccccacgaacgaaaagattcttccccgccggcgtcgctctctcatccgtcgacgtctcgctccttccttcctctctctctctcttctcttctctctctctctctctctttctctctctcagccagcagcaagcatatagtcccagcaccaccacatgcccaagggccctccctctccctcgtcgtcgggccaattgagtgtgagagctcgaaaaaacccaggggatcggccggaccagcagcgagcgagcgcgagctctgcgtgcgtgtgtgtgtctgcgcgctagattagatcacctccatcgtcaataattgcaggcagatccatatagtctgctggtggcgagacaaagcaacggatcgtcgtcgatccggagagcggaaagcgcgcagatcgcggcggccatggggcgcgggaaggtggtgctgcagcgcatcgagaacaagatcagccgccaggtcaccttcgccaagcgccggaacggcctgctcaagaaggcgtacgagctctccatcctctgcgacgccgaggtcgcgctcgtcctcttctcccacgccggccgcctctaccagttctcatcctcctccgatctgcttaagactctagagcggtaccagaggcacatctatgcttcagctgatgctgcagtgccatctagcgatgagatgcagaataactatcaagaatatgtgaagctgaaagcacgagttgaggttttacaacactcgcaaaggaatcttcttggtgaagaactggctccacttagcccaagtgaacttgaccagcttgagagtcaagtagacaagaccttgaagcaaataagatcaagaaagactcaggtgttacttgatgaactttgcgacttaaagagaaaggaacaaatgctgcaagacgctaacagggttctgaaaaggaagctgcacgagtttgaggcagaggctgcttctcccccacaattggcgtggcaaggcggaggcggcatgttgtcccatgaccctccacagccagaacacttcttcgtggctctggagagcaacgcgcctctgcaacctacataccatactatggacatgaaccagcagccagagccagcgccgggcggctgctaccctcctgcgtggatggcttagccagcgctttggttacattgccttgagaagtgccgtgtccttcagagatcgctacgagtcctgctgctgcttttgcgaacccccctttgctgcctgccatgcttaccgaactgttcaaataagaaataaccacatggtcctatataggttgctgttgtctttatcttctgttgatcacgtccggctcagatgctttaagcctttaacgctatgcaaaatggcttagcgatgcacgctggaatgggctgaactgcttgtgtttcgagagtataaatcgcttgggcgcttggcaataagcattggcaagaaaaaaaaaaaaatctgtttttaaaaaaaaaaaaaaaaaaa

SEQ ID NO: 23522 - DNA, 1534 bp, Zea mays
aaaacctaggaggagcctagtggccacctagggtgaggaaaactgaggacgcgaggcgagagcgagatccaatctgcacccccccaccaaagaaagattcttccccgccggcctcgctctctcaacatccgtctcgctccttccaccctcgctgcgcctcaggcagcgagcgagcatatagcagcccaccacccacatgccgcagggccctcacccgtcgagccaattgagtggcagccagaaaaacccagagcgcgagcagcgagcgcgagcgactcggcagcgagcgcgggctcctgtgtgcagtgtgtctgcgctagagggcgaagggcacggaccgccttcgtcaataattgcggtacgaacggggcaaatccgtcgtttaaagaggtcgctgatagcgcctgctggtggcgagagagagaaagcagcagaatcgctgagggatcgtcgatccggagaggcaaaaaagccgagagatcaggcagggcaccatggggcgcgggaaggtggtgctgcagcggatcgagaacaagatcagccggcaggtgaccttcgccaagcgccggaacggcctgctcaagaaggcgtacgagctctccatcctctgcgacgccgaggtcgcgctcgtcctcttctcccacgccggccgcctctaccagttctcatcctcctccaatctgcttaagactctagagcggtaccagaggtacatctatgcttcagccgatgctgcagtgccatctagcgatcagatgcagaataactatcaagaatatgtgaagctgaaggcacgagttgaggttttacagcactcacaaaggaatcttcttggtgaagatctggccctacttagcccaagtgaacttgaccagcttgagaatcaagtagacaagaccttgaagcaaataagatcaagaaagactcaagtgttacttgatgaactttgtgacttaaagagaaaggaacaaatgctgcaagatgcaaacagggttctgaaaaggaagctgggcgagtttgaggcagaggcggcttctcccccgcagttagcgtggcaaggcgaaggcggcatgttgtcccatgaccctccacagccagaacacttcttccaggctctggagagcaacccatgtctgcaacctacataccatacgatggacatgaaccagcagccagtgccagcgccgggcggctgctatcctgcatggatgtcttagccagtgcttcattccattgccttgagaagtgtcctgaccttcacagatccctacgagctttattactgcttttgcctgcccctttgctgcttgcggtgcttactgaactgtccaaatgaccacatggtcatatataggttattgctgtctttatcttatgttgatcacggcctgctcagctgctttagcgccatgcaaaatggcttgggcgatgcacgcttgaatgggtcgaactgcttatgttttgggagtataaatcacttagcaataagcattggcaaaaaaaaaaaaaaaaaatacaagtacactttactgtt

SEQ ID NO: 23523 - DNA, 1722 bp, Zea mays
ctgctcaatgaatctgataagtcaaacgaaatggcagcagggcctgttttttttttttttttgcaggaaaccgtatttgatacaatatcccaggtaggggcagttacaaactataggttcaatacaatggatcatttctattcaattcggccttcactttcataacaatatattaacactaggtaaccgcaccccagaaattccactctcgttgacctgccaattctgagttatatatgatgcatgagcaaaaacttttacatcatgtgttggtgctgaataaatacagggattagtgaataatattttttatgacagatcatgccactgacaagcaagcaaccagaactaccatctgtagggcatggcacattggagcacaacattgaaatgctttgaaacaatgatggtcctccagaatccatgacacagcacaagcgtgatcactatgagtacagcgtggactgtggtaatatataacacaacgtgaaccaaaactagattcacgggattcggtcatttcacatgagataccagcaggcagagaacagcaagtgcaatcagtactgctgtcactaaacggatttgaggatgattatgatctgtaaaataatcagatctacataatctcctcttaatgacttcaggccagaaatacataacccttccagattgaggtagattgaaagaaggtagcatgtttccatttctcaagctatccatatcttctccatccttcctcctcttggtaaagctttcacgatcacgacgtcgttttgtaaaccataggtttcttataaaactatggtattgtctgctcagtttgtttttgcaaaaaaatctcctacttgtagaatcagcagcatccaaagcaaacatattgctattgttatgatccccttcacatgcaccttctccacatgaacatttaagtttccccgctccttccacatctttatctgaattcctgtgttcatatgttgtatgttcttgggtggaatgataaccatttactaaaggaacattgtcgagcttaagctccacaatttcatctgtaccagtggaatgatatgcatggtcatccttgctggaaccagaaaggaaggatgccagcccatcaccatcatgttcacttgagtataaatgttttggagttctgctagaacctagcctaagactctccaaactttcttccacctgagaaatctggtctgcaattgctctaatgaattgcctgaattttaagattgcattttctcttgactttgacttgtcagagaatgcagcagcattcacctccctctcaaattgctccagctgccatttggtagttccaagagcagtaatcacatctctctcatattgtattggagcatggaactttgcatcagaagtaccatcctgcataactttcctttcatgcaaaagtaagcggtagacaccctccattctatcggcggaatcctgcacgcattcggcggcggggaacagcagatccgactcccaccgcccgaagccctccgccatggagcgggatccggtccgtcccgccgccgaacagccaggagggagggacgaggcgcgctgcgagacagcgcgcgagggcgaattcgtgcgcgtggctctagagctcgcttttggaggggaaattcgtttggttggtgtccgcttattgcggctcggttgcgctccgtttggcggctccttttcctcttccgtgtt

SEQ ID NO: 23524 - DNA, 957 bp, Zea mays
  misc_feature (33)..(33): n is a, c, g, or t
  misc_feature (44)..(44): n is a, c, g, or t
  misc_feature (141)..(141): n is a, c, g, or t
tatgtctgctcagttgtttgcaaaaaactctcntactatagatncatcagcatccaaaccaaccatatgctatttgtatgatccccttcacatgcacttctccacatgaccatttaagtttccccgctccttccacatctntatctgaattcctgtgttcatatgttgtatgttcttgggtggaatgataaccatttactaaaggaacattgtcgagcttaagctccacaatttcatctgtaccagtggaatgatatgcatggtcatccttgctggaaccagaaaggaaggatgccagcccatcaccatcatgttcacttgagtataaatgttttggagttctgctagaacctagcctaagactctccaaactttcttccacctgagaaatctggtctgcaattgctctaatgaattgcctgaattttaagattgcattttctcttgactttgacttgtcagagaatgcagcagcattcacctccctctcaaattgctccagctgccatttggtagttccaagagcagtaatcacatctctctcatattgtattggagcatgaaactttgcatcagaagtaccatcctgcataagtttcctttcatgcaaaagtaagcggtagacaccctccattctatcggcggagtcctgcacgcactcggcggcggggaacagcagatccgactcccaccgcccgaagccctccgccatggagcgggatccggtccgtcccgccgccgaacggaccccgaacggccaggagggagggacgaggcgcgctgcgagacagcgcgcgagggcgaattcgtgcgcgtggctctagagctcgtttttggaggggaaattcgtttggttggtgtccgcttattgcggctcggttgcgctccgtttcccggcccccttcgcgcttccctttgttggaaattttttcccggccggcctcgaggtacccaatg

SEQ ID NO: 23525 - DNA, 743 bp, Zea mays
ttttttttttttttttagtgccatttcatttcattaaagaagaagagtacaaagtcaaagatgtacgcaccccccaccagtgacaaacgttaaatgaaaagtaatatgaccagggaagccatgcatagacgaccagtcactcaattaaaagtgaaatgtcggaccgtgcaaactgctaaacattcagtgtaatcttgaactataactatgccataatggaaccgttatatgaaagttgctgaatatggaatgcgtagagacattgaatcctttcagtaatctcacagttaccatgccgatctatttcatctcctctgcaactacactttcgatctgcaggagcagcttcatgaatttgcttatcgatttgagctaggtatatctggaacaagcttgactgcggtggaattgctgcggcggtaagaactggaggtagaagccatagtacggatggtttcctctctaatgtctgtcttgcatagtcaagaatatccttttcctccaaattaagatattcgtcttggaatttgtcctgaaaggttctgtgaaggcactggtgcagatcagcgtgcttcttggatataggaatggaacagaaagtgtgtgacatgaagccctctatcaatgtgttccatcgccttgtaatcgaacccagcaagcatagctccatggtttcaacaagaccactatgacatgtttcttctatactttttaagggctcaaacactttcatggggctgcta

SEQ ID NO: 23526 - DNA, 6372 bp, Zea mays
  misc_feature (2794)..(2794): n is a, c, g, or t
  misc_feature (3201)..(3201): n is a, c, g, or t
  misc_feature (3352)..(3352): n is a, c, g, or t
  misc_feature (3382)..(3382): n is a, c, g, or t
atagccataggcagttggtgtggaaggggaagctcgattgatccctgcttccctgaaaaaaacagtcctgtgctcagccgaaggaaagggcattggtgcgcacactgggcgtgaccgcgtgacacagaaagcagggagcaaaggctgacgcggctaggctatgcaaaggcgcggcagctcagcaggcggcatccgccacacttcataaacagacaaactagctaccctctatgcagccaagccacttcaatctcaaattctccgtgaaatggttgaagagagaatactctataaaggtaaacaaaagcagccacaaaagaaggcagccagcagcgctagccagtctaggcacgtacacacacggcccctattgccaaacagcaggagagcgctctcaccctgatctctgataagggagagggaagaatcgctcatcaggtggctcacacgcatcattgccgcgcgctgcctcccaacgttccagcacgaacgaagggcgtctttgccttccattgctacgagggagaagcaagaacgtgggcacgtggcacacacatcacatacagcgtgtaaggcacagagggggggtggcggggtgacggcgagggatgcgggcgggggcatacaccatccaccagtcgctcaacgccgaggcggccgctgtgctgaagctcgcgctcgcgctcgcgcgcaggcgcggccatgcgcaggtcactccgctgcacgtcgcgttcgcgctgctgaccggccccgccgctgccgccgcgtgcatgcagcctctcgcggccttctactcgcccgcgtctctggcggcgccgtacggcctgctcaagcgtgcctgcctgcgctcgcacccggcgcccggcgcggcgtcgtctcacggcgcgccccagcacccactccagtgccgcgcgctcgagctgtgcttcaacgtcgcgctcaatcgcctgcccgcgtccggcccgcactcgccgccctcctcgatgacggcgccgttcacgtcgccgcttatccagcccagccccacgctctctaacgctctcgtcgccgccctcaagcgcgcgcaggccaaccagcgacgcgggtgcgttgagctcccgcagccaccgccgccagcaaatgcgccgcagccgcagccactgctcgccatcaaggtggagctggagcagctggtcatctccatcctcgacgaccccagcgtcagccgcgtcatgcgggaagccggcttctccagcgccaccgtcaagaacaacctcgaggaggagagcgcgctcatgccgccaccttcctcatcgtccccgccaccgccgcctccgcccatccctccccacttcttcatcgactccagcatttcctccggcggcaaaagcggtgaccgcttcgggctgtggccagcgcagttcttggcagcgccgggccctggggcctgcagcgccgacgtccgcgcggtcctggaggtgatggtgcggaaggagggacgtcgaagcaaccccgttgtggttggtgactcggtgtccatggccgaggccgtggccggtgagctcctgcggtgcctcgagcgcggcgacgtccccgaagcactcgccggcgctcacctcctaaagctgcagctctcctacgtgcacgttcgcctcatgagccgcgccgacgtgaacgcccgggcgtccgagctccgccgtagcgtggacgccgtgcagctccagcgcggcggcgggctcgtcgtctgcgtgggcgacctgcggtgggcgctcgatgaggaagcgaacgacaaccacgctgtctcgtcgtacagccccgtggagcacatggtcgccgagctcggacgcctcctcgatgacctccgagcctcccgcgtccgcgcctggctcgtggccaccgccagctatcagacgtacatgaggtggcagcagcggcgccggcggccgctggagtccgcctgggcgctgcaggctgtggtggtccccaccggcagcggcagcggcctgtccctcaacatcctgcattccacatcgtcttctacctccctcccaaggtaaggagcaagcaaaccagttcccaaccgagaaacctgttttcctaaagatcagtgtactatgctctccttctgccaccatgtttctgtctgagctcgggtcctccattgctgccttactgtctagaacaagcaaatgggcaagctgagtgggccatgcatattgcgagctccccgtgaggctgcatccacctacaggctacaggacactactcctagttactagtagtcattaatgaatgcacttcttctgcctcaattagtaaacgcaatatagtgaaattatctatgtaccattgaaccttcactaaaggtaaccaatgtacaatgattacgtcttgtgaatagagaaagctatatataaaaaaagagtactacggttatttggttcatagctaaatatacagctattttcgaacaaattttgaatgttcaaagtgcacatactttatttattaagaaaacgagagggagtaaacaaggcagtagagtgttgcacagaggatcagacgaagaggaaatagtggttgatgagggacgggatcgggatggtattggtagcctagctgtagcagcctgtgttttttgtcacccttctctgccgtaaaaaagaacagagattccattgctctgagctgatcagtttctgtctgacgagaaaagggcttcatctgatgccgcgacagtgcctggcgtcctgagcccggtccttctggaggacgcggcagactgatccgatgctgccgggttgcgtcccttttnctcgcaatgatgctgcctttcacaagctcttagtcacatttctgtattgcaatttgcaatgcagagttgaggggaaatatacactcaatctactctgataatgtctagaaggaaactgcttaaaaaattcaaatgtttggaaaaaagaaaaaaaactgagaactggactttagaatgattgtgatgctcttattgtttaacatggctttccttgtcctgtttgtagtgccagtgcaggggtgcctccggcaacggcggcatcacagcagcttgggcagaatcctttcgcgatggcgggatcggcgactgagtttgcaggcagagatgagcaggatgagatgcagctggtgctctgcaccgagtgcaccaggaactacgagagcgaggcgtcgctcgtgaaggcagangatgatgtggagggcccacgtgccagcctcgcgggctggctggtgttggacgggccatcggcagcccaaacaccacacaaggtaagaaaacaatgatgatgcatttgaacaaggagctattgatggttttaactgtgattcttttgatggnttagcagaagtatctgatcgagctgaagangaaatggagccggctgtgcgggaagcttcacctctgctccgatccatgctcccctccgtgtccatggtggtccggttctggcttgctaccggtcagccagagcaagccaagcgtggcggggttcttgggcttggatggcttgatagagcaacaacgcaagagcagaacaggacggtggttcccgccctcaccgtcaaggggtccccctcgttggtgcctgagtccaccgacgagggaagcatgtcagggcgtgggaaccacgcttgctctcggcagccacctgctctcggactcggcgacatctcaaagccgcgcctcgggaggcggtgacggttccgcggcggtggtgcgcgagctggggcagaggctgcgcaggaacatcccgtggcagcccggtgccgtcgtcgcagagattgccaaggcggtggttgctagtagccgccgagagcgcgacggcacgctgggctcgtggctgtacgtgaagggcagagaccacagcgccacgcggcgcgctgtcacggttatcgcggagacgtgctgcggctcggctggtcgcgtggtccgcgccgaccccagcaagcacagctgcgcggaggagctgtgctcagatgttgtctccagggcgtccgagatgggcggcgagatggtggtggtggtggtcgtggacggtgtcgagaacgcgccgtgcgacgtggccgactgcctggtcgccgcgtcgaagagcggttccctgaaggatgccgaatccggacaagtgctgcgtctctccggctgcatcgtgatcctggtagcatcgaagttgcctggcggcgccagcgacccaatcagtcctgcgcctgtggtcggaggacgaggcgtcgtccgacggcgctctcaagaggaagacggagtcaccgcagggcgagggcgagggcgagggcaagcgggcacggcacgacgccgggctgggcaggcttgatctcaacctctgcgccggggatgacgacccaggcgaagacgacgaagccgtccccagcgacataaccgacgaaggcggctcgagcgagcacgggcagccgccccacggcatcctcggtgccctgacggcggcccgcgtggtcaccctcgacagggaaggcggcggcgacgccacgacctccatccgcgcaaggctcgccagggccatcggccaaggaggggcgcgtgtggaggaggcggcggtacaggcgctcgcggcggcgtctggacagtttcttgaggaggagcttgagaggtggacggtggaggtgcttgaaccggcggtggcggtagcaacggtcaaaaatggcgggaaggggaaggtgctagtgcttggattggggcccggcggcgggagccgggagacacaagggttcatgggctcggtccttccaagtagggtccaggtggactgagctgtgcatttttttgggatgtctctctctctcacacacattttggagactgggacgttgtttttgtatgtattgtacgtaaatggttggattgggggcctggaaatggagagtttgggatgagctgagtttataagtatccatcaaatgccgtactattcttttatgtgtgggtgtggattgctcaacttgaaaacttggatatactagtgagcatatctccacagattttgtggctaaagattcacatgatttcgcactacaatggaataccattagaacgtttatttaccgttcatgcgtctgtgaaacttcttctacacactacacactgattatccatcagcagatgatgtgcaagctatacatgtccaaacgttcatgctgagccagcccggttcggacacgacttggtccgatacgaaaggaaccggatcaggcccggcacgatataagtcgtgtcgtgccgggtcggtccgtgggctacagtagtcgattcagacctgacacagctaagcttatacgagccgggcccataagcaggtttctacataaaattcatgcacagatttcatacatagatttctacacaaatttcagcaatatacacaaaattcatacaacaattaacacatattcaacacagatttcattaaaactggagccttagtgcaatgctgcctcgttaaaaaccttcctaggtaaaaactcacacctcgtgagaaaaccctaggacggaaaagagtacagctagctccttttagagttcgctccttttagagttctagttcaagtgtccattacagtactacatattgacaatccattacataaatcatgagttcaagttctaattctattgttgtgaatcatctgtgccccttagtggtgttttgataattaatgacaactgattgtggaataacaattcttggaaaaattagaatgcaggattggaccacaggaaacagtaatgtctttgagacatatacattgattgtggatcaagtaaaggcaaaggtaaaatgtaggttttgttttgccggtcatcaggagtttagagaagaaattgaccggattaataggctagacagtcgtactattaagaagggtcaatgaacttgaccggtgtaaaaacttagtgcctcgtagagcataaactgttatattggcatgagggctaacaacgcttcgtttttcgaaatacaaagtcttttgtaaaagcgcaaaataaaatctcttaactctgtggtcggcggactgttcgagccaggaggccgaaccgtccgcgactctgccagagaagtctgctggcgcacctgtctctgtatccctgcgcggaccgtccgggccacgaggccggaccgtccacatgagccaaattgagtttgggcagggacaatgtgtttttgagtctttgcactacggactgtccggggtttttagtcggacggtatgtggtcctaatacggaccgtccgaacatggttggcggacagtccgctcgggtagttttaattggtcagtgctctggtattccatattgacaggtctcggaccgtacgacccaggtgggcag

SEQ ID NO: 23527 - DNA, 1290 bp, Zea mays
ctggggcagaggctgcgcaggaacatcccgtggcagcccggtgccgtcgtcgcagagattgccaaggcggtggttgctagtagccgccgagagcgcgacggcacgctgggctcgtggctgtacgtgaagggcagagaccacagcgccacgcggcgcgctgtcacggttatcgcggagacgtgctgcggctcggctggtcgcgtggtccgcgccgaccccagcaagcacagctgcgcggaggagctgtgctcagatgttgtctccagggcgtccgagatgggcggcgagatggtggtggtggtggtcgtggacggtgtcgagaacgcgccgtgcgacgtggccgactgcctggtcgccgcgtcgaagagcggttccctgaaggatgccgaatccggacaagtgctgcgtctctccggctgcatcgtgatcctggtagcatcgaagttgcctggcggcgccagcgacccaatcagtctgcgcctgtggtcggaggacgaggcgtcgtccgacggcgctctcaagaggaagacggagtcaccgcagggcgagggcgagggcaagcgggcacggcacgacgccgggctgggcaggcttgatctcaaccctctgcgccggggatgatgacccaggcgaagacgacaaagccgtccccagcgacataaccgacgaaggcggctcgagcggcatcctcggtgccctgacggcggcccgcgtggtcaccctcgacagggaaggcggcggcgacgccacggcctccatccgcgcaaggctcgccagggccatcggccaaggaggggcgcgtgtggaggaggcggcggtgcaggcgctcgcggcggcgtctggacagtttcttgaggaggagcttgagaggtggacggtggaggtgcttgaaccggctgtggcggtagcaacggtcaaaaatggcgggaaggggaaggggaaggggaaggtgctagtgcttggattggggcccggcggcgggagccgggagacacaagggttcatgggctcggtccttccaagtagggtccaggtggactgagctgtgcatttttggggatctttctctcattttggagacggggacgttgtttttgtatgtattgtacgtaaatggttggattgggggcctgcaaatggagagtttgggatgggctgagtttataaatatccatcaaatgccgtactattcttttatgtgtgggtgtggattgctcaactggaaaacttggatatactagtgagcatatctccacagattttgtggctaaagattcacatgatttcgca

SEQ ID NO: 23528 - DNA, 1039 bp, Zea mays
acccgggctcgagttttttttttttttttttcaggcaagagcgagctacgtgtattgaatctatcattgttttgtttgcgtactaacaccgttatatacaagcattttaataaatcgccgcgtcgagcgtcgtgctcatcttcccctacaacaacttctctacaacatgtgccgcgccgcccacccgtggccggtggccctcctcaaaacaaccatgccaaagatctgcatccagcttcatgcacgtcaacccactggcaagtggcatcttcctctacaggtgcgaagagcctcaagaactattgctgctctagccaaattcgggccaacggacagcatcatcttgcgtgttcatcgtctttgacgggcgtgctctatccgtttcgttgttccaaaccatttccatctcgccgattatcaccgtatcaccctccttaactccctgtttcgtaagagcccggttcacgccacatgcctctagggcatgctgaaaccttttcaaggaatccgagtactgccagttagtcatctggacgaaacgctggattccagctccgacaacattccatgtatttgtacccgtgccgtggcgatcctcaaactcattcatgggtgcacgtctttccttttttattgcctcagacacgtggttcagattttctgtcccgctccatccttcagtttccttcatcctttgcctctctttctgcagaagcttgtaagcagcatgaatgacgtcctgtgtgccctgcctgtttattgcactaatgcagaaaggttcaatgccttcagactgtagcctttctttaaatgtattccatctctcacacgcctctggaaggtccatcttattgtacaccaccacatagggtttgtcaaccagagacgggctaaataactccagttccaagcgaactgcctcaaactcatattctggttgttgtgcagaaccatcaacgacatgcaccaatacagagcatcgctcactatgccttaggaactcaatgacccaaacacataacacacgatgagacccggg

SEQ ID NO: 23529 - DNA, 1365 bp, Zea mays
  misc_feature (27)..(27): n is a, c, g, or t
cattatctaatctgcaatgtcagcatntatctttagccctgagatcgcaccctgagcaaactgaagcagctcgtcacgttttgccaacactttgtcactataacttgagaataaccttgccaggtccttttgtgggttcttccggtcctccaccccatcgtgctctaattagtgtgtatacataccctgccgattataaaccgtatcaccctctttaactccctgtttcataagagcccggttcacgccaacatgcctctagggcatgctgaaaccttttcaaggaatccgagtactgccagttagtcatctggacgaaacactggattccagctccgacaacagtccatgtatttgtacccttatcatggaaaacctcaaactcattcatgggtgcgcgtctttccttttttattgcctcagacacgtggtttagattttctggcccgctccatccttcagtttccttcatcctttgcctctctttctgcagaagcttgtaagcagcatgaatgacgtcctgtgtgccctgcctgtttattgcactaatgcagaaaggttcgatgccttcagactgtagcttttccctaaatgcattccatctatcagatgcctctggaaggtccatcttattgtacaccacaacatacggtttgtcaaccaaagatgggctaaataactccagctccaagcgaactgcctcaactcatattctggttgttgtgcagaaccatcaacgacatgcaccaatacagagcatcgctcactatgccttaggaactcatgacccaaaccataaccacgatgagtgccttccagtaagccaggaaggtcagaaactaccattgtagcatcaaaatctaatgagaccacaccaaggttcggtagcaatgtggtaaaaggatggggcgctatagctggcttggcggcactaataacgctcaagagcgaacaacgcactcgagggcttgactgtagaggaagacatggaaaaagttcatcggctccgcaccgctgtcgtaatcgatgtacaaatccagcaggggcgtagtctggtccagattgtccccaagctgcggctcccggaccaccgtggtcgcgcgctgggtctccttgagcgcgacgagccaccggcgcagcagctgcacccgttcgtcccctttgcaggagagcgctgcctcttccagcctcttcgctgccaccttcgcgctcttgtaactccggctcccttgcgagagaaccgagcggttcctggcggctggcatcagacgacggatggggtgaagctagggatgagagccgccgcgcgagcgcgaccggacgcgtgggcggacgcgtgggcggacgcgtgggcggacgtgtggt

SEQ ID NO: 23530 - DNA, 3171 bp, Zea mays
  misc_feature (3038)..(3038): n is a, c, g, or t
  misc_feature (3089)..(3089): n is a, c, g, or t
  misc_feature (3094)..(3094): n is a, c, g, or t
aaataccaaaggatatttaaacgcatatattcagttaacacgagagccctatccaatttctcatgggttaggttagaaattgaatcagcctcaatcgctctaagatcaaacttgtcaatgactacatcagacaagagcgagctacgtgtattgaatctatcattgttttgtttgcgtactaacaccgttgtatacaagcattttaataaatcgccgcgtcgagcgtcgtgctcatcttcccctacaacttctctacaacatgtgccgcgccgcccacccgtggccctcctcaaaacaaccatgccaaagatctgcatcctgcttcatgcacgtcaacccactggcatcttcctctacaggtgcgaagagcctcaagaactattgctgctctagccaaattcgggccaacggacagcatcatcttgcgtgttcatcgtctttgacgggcgtgctctatccgtttcgttgttccaaaccatttccatctcgccaattatcaccgtatcaccctccttaactccctgtttcataagagcccggttcacgccacatgcctctagggcatgctgaaaccttttcaaggaatccgagtactgccagttagtcatctggacgaaacgctggattccagctccgacaacattccatgtatttgtacccttatcatggaaaacctcaaactcattcatgggtgcacgtctttccttttttattgcctcagacacgtggttcagattttctgtcccgctccatccttcagtttccttcatcctttgcctctctttctgcgggggcggcctacgcagctgaatgacgtcctgtgtgccctgcctgtttattgcactaatgcagaaaggttcaatgccttcagactgtagcctttctttaaatgtattccatctctcagatgcctctggaaggtccatcttattgtacaccaccacatagggtttgtcaaccagagacgggctaaataactccagttccaagcgaactgcctcaaactcatattctggttgttgtgcagaaccatcaacgacatgcacctaatgctccaacaagccataaacaattatcagcacagtcataccatgccaagatatataatattgtgactggtattttcataaccatatggaatttgactcatatattaagattagagtaaagaagggaaaagggaacataccaatacagagcatcgctcactatgccttaggaactcatgacccaaaccataaccacgatgagcgccttccagtaagccaggaaggtcagcaactaccattgtagcatcaaaatctaatgagaccacgccaaggttcggtagcaatgtggtaaaaggataattggctatagctggcttggcagcactaataacgctcaagagagtgctcttcccagcatttggagcacctactatccctacatcggcgactaacttcagctccaactctagccacctgccaaacaccagcatccccaaaaagttgtatgttagtgaaacatagagctggattatctgcggataattattgtagtcattcaagtaattcaattcaatggattcagctctttgtgaggatcttcatgcaacataaatgacttctaaatattatcagttggaaatttataaggacacgaaattcctccaacatctattaatgtgaatcataaaacaatctaggcagctgggaaattccacaaataaggcgtacaatagggataaaaacaagatgcacattaacttatctttccaatcactcataatgagataatctagaaaacaatactcatgatgtcaagtttgtggttaacttatgaatgctcaattgtcatgtggctagaaaccgtagaaacacgtgaagagacggaggtcaatccatcaattcctccatggctaggataaaactgggttcctggaccattggaccaccattagcctaacatctgcaaatgaaaatgcagatagtatccccagttccccacatgtaccatatggtgcattggtgatcattatctatgcctgatggtaatttaaattttaacctgcaggcatccccataatactgaatggcagttagcttgtgtattcctatgctctcctcaaagatcagactagtaaatgccatggtaattcatccataccagggggcacatttagaataggttcttatagtgaggacagtgagaaattcagtgttaatgtaggagacgatcaagatttttttttcatagcagagtgaacgtacatttctgggcctttctcccccttctctgcgatcctgggcaccttattcgtcccggacttgaacgccgcattgccccggccgccgcggccaccggggagcagcagcgcgcgctgcccgggcttcatcagttcaagaagctccacgcctccatctgaggtccgcaccaccgtccccggcggcaccttcacaacgacgtcctcgcccttggccccggcctgctgctggcccatgccgtgcgcaccacggccggcgcggaagtgcacggacttgcggaacggcagcagcgagttcatctccccgtccacctgcacgtacacgtcgcccccgcggcctccgtcgccgcctgacggccccccgtacggcacgtacttctcgcggcggaacgcaaccacgccgttcccgccgtccccggccttggcgaatatcttggcggtgtcgaaacaccgcatcactgccggcactcccttctccttcacatcaccttccccttcctccgcgttctcaacctcgtagccgtcttcctcagagtcctcctcctcgtcgtagtctgcgtagaacactacaacctcgtcaccgtcgttgtcatcgttctcgtcgccatactctacctcaccgatctccgcgcgtggaacggcatcagcttcttcatgatgacttttgtcgaacgggaacatctcgaactcctcctcctcgtcgtcgctgtcgacgccgtagtccgggtcgaacaccacgacgtcgtcgccgtcgtcgagcacttcgggaacaagaccacgatctctcctgccntttttgacctcgaacacatcgaggctggtgactacgagctcctccccctcnccgtngtcgccaaggcgttcgaccgtttgccgcgtaaaccgcgaccgccagtgctcttcctgccggccgcgcgggcctcgaa

SEQ ID NO: 23531 - DNA, 2063 bp, Zea mays
  misc_feature (155)..(155): n is a, c, g, or t
tattgctcttgtgaattcctagaaaaaaatagttgcagcagggtcaccaattgcaaggacaccaatattttctcttccccatgtttatagactcccaaactcagacgcaagcagattcttcactttatcaagttgtgcaaccaatgtccaatggnttcaattgctcctaatataatagaaaaataatatacaaatctcattcagattcttaaatactaagaacaagattctgtgacacttgttgatagattagtatatgtgcaatcacctccaaactgttgcatatagaacacgattcgttcttttccaagaagaacaaaatgcaatagtttcttttatcaaaatgacttatattatgaatttctcatccaatcacttgtagtgatatcagtcaaaaactatttcttgactctaggcaaatacaataaatttaaagcttatgtaagctcacccacgggctccgctggcgtcgagaagcccccataagccagagctccatgttgttttcatccacattgtacaccaaaacagatcgacgggcccttgtggctacatgacaaatatggtttgcatggctacacatcttggtgggaccttgtgccatcatagaatatggttttgtggccattcaccatataatgaatgaatgaatggaactgggaagcagaatgcccattagacaagctgctctaatgtgtaaatgagcaatgttgttcggataggtcagaggagggggtgggaatacctggtggatgctcttcactgacgaagagatcgacacatggagcgcatccattgactttatctgctgttgcaactgagtaatttcattatctaatctggaatcaagaaaaaagaggctttaatttttaaagcatgtaaacatggacacgcaaaaatggaactacaaacaccttcaactgcccaacagaaaagacagaaccttgcaatgtcagcatttatcttttgccctgagatcgcaccctgagcaaactgaagcagctcgtcacgttttgcctggaaaagaacatagaagccaacattgcagttgatgcattttatgcttttgctgccatctaataacaccaggtagaaagtacattttacatgatttatgaagatagctaaacgatcaaataactcatatacatgagtacatggtttaatactgagaactggtaaaacaaaaaagaaaattcataccaacacttcgtcactataacttgagaataaccttgccaggtcctttacactacttaagagtgcattgtgcacatccttccctcccgaaaggcacattctgtaatgaagaatcatagcattatatgttgcttgaatagaggtaacatggaaaaattcaaaggggtttataactcatattaacgttctaaatgtagtacagggggcaggcatctgtaaagacaatcaaaagataatgaacttgtcatgtatacagtaatacatggcacattttttgtacactggactcgagacttgttatgtgagaaccagacacgatcatatatgaacaaaaaatttcaagaacaaagtaacaagacatcaaatggtcgaataacttgcccaaaaacttctgagaccagtgaaacttcttcctcagttggggcttccctaatctgatcatagaagacgagtcaaaattttgaaattaccaaacaatggtacctacatggctacatggtggcaacgacaacgagaccattgcaacaccaaattgaacagccacaaatccaactcaccaaggagagaacaacacactcgagggcttgactgtagaggaagacatggaaaaagttcatcggctccgcaccgctgtcgtaatcgatgtacaaatcctgcaactcccgcgagcacaggtggttcggcgcctaatgagtcgggatcacgtaatgcaatccaaaaaattctgcaaaccaagcgagtagccagggagggatgctgaccagcaggggcgcagtctggtccggattgtccccaagttgcggctcccggaccaccgtggtcgcgcgctgggtctccttgagcacgacgagccaccggcgcag

SEQ ID NO: 23532 - DNA, 755 bp, Zea mays
aaaaaaactgatttaaccggatcatttacccattacgttacaaatatttgaaccaaacgggacctaaaatcctctcattattcacttttgaataagggaattttagtccctctaatcctcttcggtttttggactccaaaactagcccatagtgtttctagtaaatctgagcaattaaaagctgaaaaactcagcagatgtcttgaaacaaagggaatatctacatgagctcaattacaggtatccgcaaactcagcacaagaatattcatatgtataccacattcaggtattcgtgttctttctgtctaggaagttctccactgcaactcaatttggatctgaccattttttgagtctatgagatggtacttctcattaattctcttgttactgatcacgtctgcaaggttgacatcaatgtagcccaaagtttccttgccatatatcagccctttcttcggggctttacttaggacttcaacatgtagtttatcatttacaggaggctcctcacacacaaactcgaatccatcctcccatcgtggatccctattcttcttgatgaccctcgttttcttctcttcgcctttgaaaattatttttgcataggggtttgtatggtgcttcccctcaagatctttggcttcatgaacaataacataaagcaatccaccaccggctggagtaccatctggagctttttctatcacattggtaccctctgtttctccggacgcgtgggtcgaccgggaa

SEQ ID NO: 23533 - DNA, 999 bp, Zea mays
cgatgcgcagagtaaccatgatctaagatgagtgactatgggcagaagtgatacgaaatcaccccctccccgggggccccttaaaagggaatgatcatttggatgacagattgctgctgctgctgctgtagcataatctggccgtccggcgaagggagggcagggatggccggcgccggctggggcaccttggactcaatgagccgccacatgtaccaggccccaacagagcggtaggggcgccaccgctcgcacagcctgtccatctgcgaggggcgaggcacgtcttggagggcgtagagcatctgaacgcccttgcgcacgccgaggtcggcggaggggagcacgtcggggcgcgcgagggagaagatcatgaacatgtggacgctccaggcgccgatgcccttgaccatagtgagcatggcggcgagggagcggtcgtccatgttgacgatcgaggcgtcggagaggatccctgaggcatacttgcgggcgaggtcgtggaggtaggacgccttgcgcggggagaccccgatctggcggagctggtgcgggctgagcgcgaggacggcgtcgggggccacgctggcctcgccgccgaggagcgcgaggaagcgggagtagacggaggcggcggccttgaaggcgagctgctggtacaggatggatcggacgagggagtggaacgggcggtgcgggcactggaacacggggggctcgtgcgcgtcgatgacggcggcgagggcggggtccacggcgcgcaggtggcggatggccacgcccacctcgccggccgcggacaggggccggcccgggatcgagaacgtcaggcggtgcttcttggccgggtcccggccgggcgatgcgttcgcctccttcttcttgaggcgggaggccgcggcgctggcgcgggaggtggaggcggcagaggcggggtccgaggccctggtcgtggcaggtaacgcggcggaggcggaggcggagacgggaggcgtggag

SEQ ID NO: 23534 - DNA, 1892 bp, Zea mays
tttttgccagcatagtgtcaaacaaatcaataggcaatctttgaaaagatccaaaatgtaataacttcaatcaaaatttcagtttcttcgataactgatgttatttgagttttctattactgaaagtcacaagcaattaggaggagctcttttaacattccctaaaatgaacgtgtgctcaccaaaagaaagtgcacgtgtaaaataatattaaaacgcaataaagcacaaaagttctcgtaactggattttggaagaacctatttcaccggtattgcatcacacagatcaatatgcaagcttgaaaagtctggacgtagtaatcagaacttatgtctttccataggtgatgttattttagtttctaaaaccaaaagtcctgagcaaacaataggagctcaattttggttagatgggtcttgtgttaagcatggaataattacattgctaacttaacttctgtgggtttcttgcgttaagcatggtcttaatcattttatcacaggtgaactacaagcatggaacaattccagaaggttctaaaatactgctaggtggattttacaatgtaaacaacagccaaccatcatcttcacagattcttgacacagataaacaacacaaaccaaattgacaacttaataagttgggcccaaacctcatttcatatccaattctaccctcctgcggttccattccagaacaacaacgtgtggagctgactatcagatgcacagagtaaccattgattgatctaagacggagtagagtaactaattagtagacgtgataccgaattcaccccatccctgggagcatctgaagggggtcgatcatttggatgacagtctgctgttgctgttgttcttgctgctgtagcatactctggccgtccggcgaagggaaagcaagtgatccaacagggatggccggcgctggctggggcaccttggattcaatgagccgccacatgtaccaagccccaactgagcgataggggcgccaccgctcgcacagcttgtccatctgcgacggacgaggcacgtcctcgagggcgtagagcatctgcacgcccttgcgcacgccgaggtcggcggaggggagcacgtcggggcgcgcgagagagaagatcatgaacatgtggacgctccaggagccgatgcccttgaccatggtaagcatggcggcgagggagcggtcgtccatgttgacgatggcggcgtcggagaggatcccggaggcatacttgcgggcgaggtcgtggaggtaggaagccttgcgcggggagaccccgatctggcggagctggtgcggggtgagcgcgaggacggcatcgggggccacgcaggactcgccgccgagaagcgcgaggaagcgggagtagacggaggcggcggccttgaaggcgagctgctggtacaggatggatcggacgagggagtggaacgggcggtgcgggcactggaacacggggggctcgtgcgcgtcgatgacggcggcgagggcggggtccgcggcgcgcaggtagcggatggccacgcccacctcgccgactgcggacaggggccggcccgggatcgagaacgtcaggcggggcttctttgccgggttacggtcgggcgatgggttcgtcaccttcttcttggggcgcgaggccgcggcgctggtggtgcgggaggtggaggcagcagaggcagaggcagaggcagaggcggggggcggcaacgcggcggaggcgggaggcgacgggaacggggagagaggctgggccttgggctgggagagggattgctcgcccatggatggaggacggaggttggcttgacttccgccggattctgggtgggattgggggtgtttgtggtatttcggagcggacgcctggtcgaccc

SEQ ID NO: 23535 - DNA, 1952 bp, Zea mays
  misc_feature (1942)..(1943): n is a, c, g, or t
ttttttttttttttttgctcataacttgactttccatgaggcattgtcaaatgctgtttatacgaagaaccggttctttacagattgcagaatacaaaaatcgcaacacagtgaaacactagaaggaaccaaaaaatcccttttaagaatatttgcatatatacttaaggaacctaaataatgaaagaattgaactgtttgaaaacccatttaacacaagaacaaagtgggactgaaaaagtatggaaatgtggtagcctcttataaaatgccaaatcaaaaaaatggctcgagtcctcctaatagccgatttatttgattagcattatatattatatatcttgctaatatttataatcttgtggactgcccacattctcagacccagcaaaactgatatcaggtggactgctccttccatgctgccaacattctcagaaattccatcacctcagctggatccctcaaggagtagaaggcgtcactctctttgggtatagacgacaccaatattccaaagccacggttgcttgccttcagaactttgaatgcatcttcatctgttctgtcatctccaacatagatagggagaacatcttcactctcgctgagcccaagcgattcaagtaaaaactccacagctttacctttgttccaatcaataacaggacggacctcaaaaaccttcctcccatgggttagtcttaggcaagggtaaccttccaaaacagcagttacacgatggaaaacctttttatagtcatcttccgccacattacggtaatgcacagatacacagaacttgttgtcttccatccttgcaccatcaatgtccttaacactctcaccaagtttttcatacacctcagtgatcataggtaaaaactcactagcaggttggaacaggttgacttctttaccatgcacatcagttgaccgaatacattccacgccattggagtcagtagtcttcctaacagggcccattatgtccattccatggcttccagcgtagtacaattcatttagcttcacaaagtcaaaaaccttatcacgagaccttccgctaatgattgcagttgggaaaagtgatgccgcatgcctcactgcagcacgcatctcatcagacattaatgcattttcaggattgtccacaatcggtgaaagtgttccatcatagtcaagaaacaatgccaaccttttactcccagcaagatcactaattgcctcaaatgagatcaaagcagaaggatagttcactgtccagttgcagtattgcaaatcaagatcagattgagcatcacagatgacatccttgatctgccttttgcgggtaggtgatgaggccttcatgagatcaagccatccagcagcacgaacttcttcaatcttaccaggcagaggtatcttctttgtagtgttcaagcaaagccccggagagggaaagctagtaggtgttgtgaaagtcatgacagcagcaggcaatgctaacgtagggagatggtcagcaataacaggtgaattgaggcctgtcttcaaatccatcaacaggacacaaccccccaagagacttgttgtgaaaccaattacagacaacaaaaggttagtgcaccaaaaatgctttaacaagcctcttgtcaatgaaaaaccaacgtttcaatgtgttcttgtcactgcgaacatgcatgtaccacctccagcccattaaatatcaaggccctgcattcggacggaggtagcgggcgaggttatatccaatgccggcgccggcgaggcccccaacggggcttggaaacgacctggcgagaggcggcgacggagaggggattttgggagcggcggcgacggagagggaattttgggagctgggagagaaaggagtcgagaggattgaggatctcctctaccccttcctcttcctccttccatcttttcccggccnnggcctcgag

SEQ ID NO: 23536 - DNA, 4326 bp, Zea mays
  misc_feature (2255)..(2255): n is a, c, g, or t
aattcggcacgagggagatatggagatgcacaccctacatcatacactagtgactaaatacatgcacaacatatacataattacatataacacctccatttctttcttgactcctaagacaactaggaatacagcgatacttagattggaccttcccttcacaaaccaattataactcaatcttctattcttatctcaacccaaccagattaaactcaacccaactaggaatacagcataatgtttgcaaacctaagactcctaggataaacagtggttgctctggtggagaccaatacggagaagggtgtgccactgtgcctagggctgaaaacggttggtaacgtttcatctatgcggaaaaggttactgatcagtcagaattttcccatatttctcaatttgttaactattcaggtgcgacttagaatacgatacagaaagaaattaaaacatccaaattttatattatgctctttcttgcttgtccgaaccatttgagctatcttgactttcaataacctttttttaaggaaaagtagttcctgtaccaatatggtagcagtggaattacaaatgagttgaccaaatctcataaagaacgtgacacctaagacctaattgcacagcagtcgtcgccattatggcaacaaatcatttgtcatctgcgcttttaccacgtggttcaagttctctgcatgatcatttgtatttgttttctactagatgagcatttataatgtttttgagttgcataaaacaatgattcactgtcactttgtcatcaccttaatttgtgtgtgcacatagctgtgggcgggtgcgtgcaaccttttctgaagaattttacaatgaaatcagttatgttaattgggcatttgttatatgtacggacatgtgcgtgcaaacttttgttcagtcatattgattggatcttttttgcagtttcagtcgctgagcctattggttctttattattgtcagaggtatgcaatatgctatcgctaggtgttcatgttgtaataatattcatttcttgctccaggctgaaggggactaaattttatcctctttctgtagggaatgtcaggtcaacataatagtggtggttccacctcctcttgctctgatggaagcgaatatgatattgtacctaaatcatacacatcaacgccccgcaacttcccaagtcgtcgatcattcctgtcgaagccaatccaccctgtttcatttccagaacatgcactagaagcacaggaaactcgaagtcatgttgcaagcgcaagctccaacaatcctctgtgctctgaatacaagggaacaggagaactttgcttcccggactacggtagcggccgtcacggggagtcaggaaattggagtgctgcaagcagcatggatcttactgatctatcagaacaacccgaagctggacaagctggactactgcgtcctaacaatgcaatgcagaaaacaaggtgcgacctctgcgagaggcttctgacaaagaggtcaccttgtggttctcgtagaatcgtacgcaccggagatttgcctgttgctggtgttctaccatgctcccatgtctaccatgccgagtgtctagagcggaccacacccaaggggcagaagcacgaccctccttgccccgtgtgcgacaagctggctggtaaagataccgagcagtggtcaatctgcaggttgaaaaatgggttcccaaggttccgctcgctaggggaagggccttctcgggttttcagctgcgctgatgctggagattgcgttgctggggccgttcagattccaagatcaaatagcatcgggctattgactcgcagtggtcacaagaggcatgcatcttcgaagggagagcccagcaaagactcggctgagacatcaagaaatgcttgcatgtaacttcctaatgcactcagtaggtcttatgtccatgaccttgcattgttatagttgcaaggtcttatgtccatgacctcgcattgttatagttgcaaggttatgtatgcatgcttacggatgttttcatggcttaatggcgccgctaggaaatgacatagatatgcctgtttatctcctatcatccctggtttgatgacaaggggataggagaggagaggaaatcccttgctattcaaaaaattttcttcaccatggatcccctctacaaaaaaaaaaaaaaaagctctcggttatcaggttgccacttgtgcataatgttgttcagttgtattgtgctngaaatcgcaagtaaactgctcatccagttctatgaaactaccgcaattacctggcccctacagtctacggccctacattgtaacactgtatggttgtaacgctgtcaatattgagacgagatttgacatggaacttggtcgctgctctgtattgatctgtaaaccgaaacgcaaattggatgaggctaggaaagcaaacttttcaggtgctcgatgaacctttcgtagaaggcgatgccattgctttggttggttggctctgaaaggaagctgcatctgggacagttcagccattttgctgcatgttcgccttcctaattcaggagtgcgtgcgtctgaggctctgagcggccacatctcccgccacttctccaggatctccatccagccgcttcggacagaccgagagctcctccatataacccaccgctgctgcttctgtgctactgtgcttcctgcgtccccgtcctggtgatcacgcccagatcaaatcctattcaaatttggtaaacgtcaagaactcctggcaaatgcattttttttgtgtgctgttattatgcggacctagaatctttgctggacttttgccgcaagtagagcagcagaattctcgcgcgttgctcgttccatgcatggacattcattgccatcttcctctctcgctgtaggagcgcaatatggctgaagagaagagccgtccgcggctgaacgagcggatcatgtcgtccctctcaaagcggtcggtcgctgcgcattcctggcatgaccttgagataggtgagtgcacattttgcgctgcggtatggtatgattcctgaggttcatgcaagctgacgcttcgtgttttcaaaaataccaggacctggagcccctgctgttttcaattgtgtacgcatcatgtgtcttgttgttcatcctggctatagtgaaagtagagagggagacattagtctcagacctccagaagccaacaccttccatgcttgcaggttgttgagatcacaaagggcagtaaagtgaaatatgagctagacaagaagaccggaatgatcaaggtaaagacgattatctgttaacatttaaggtcacgggaaagatacaaaaaaaaaaaagagttaccattttttatttattcctgacggcactgaaaatgtgacaattatgcttccctaggttgacagggtgctatactcatcagtggtctacccacacaactacggtttcattccacgaacattgtgtgaagacggagatccaatggatgtgctggtgttgatgcaggtcagcatgttcttacgacttgtttgtttcatcgatctagcccacttaattagtgtacttagatatatataggttaagccttcatcttctggggttaattattcactgactggcttacaaccaaataggaaccggtgatacctggctgttttcttcgggcaagggccatcggccttatgcccatgattgatcaggcatgatgcgtctattgacacttcattagaactagcttgtacatatcgcattatgttggattgatggcacatctgtttctgcaataactagggtgagaaagatgataagataattgcagtttgtgttgacgatcctgagtaccgccacttaaccgatctcaaggagctttctccgcaccgccttaatgaaatccgtcgcttctttgaagactgtacgcaccatttcgtctccaaatctgtctgattttttttttctttctatgatcgtagcgctacggttgctttgaaatccatttcacatgtatttaatttgcagacaagaagaacgagaacaaggaggttgctgtgaacgatttcttgccaccaactacttccctggaggccattcaacactcaatgtgagtctgcttttttttgagtcagacactgctggtgcaatgtatcggaagaaagtatggtcttacatgatcgtgagatgtgaaacctttgatcatctgaattttcttcccttctactcactccattccaagaacagacatctcgcttctcaaggaaccaaacaatctcaagtttatcaaatatataccaaaacaaat

SEQ ID NO: 23537 - DNA, 1408 bp, Zea mays
  misc_feature (9)..(11): n is a, c, g, or t
  misc_feature (13)..(13): n is a, c, g, or t
ccggccgannnanaaaaactcctatgggcgattgggaccctcgccggccgggactgtgcttcctgcgtccccgtcctggtgatcacgcccagatcaaatcctattcaaatttggagcgcaatatggctgaagagaagagccgtccgcggctgaacgagcggatcatgtcgtccctctcaaagcggtcggtcgctgcgcattcctggcatgaccttgagataggacctggagcccctgctgttttcaattgtgttgttgagatcacaaagggcagtaaagtgaaatatgagctagacaagaagaccggaatgatcaaggttgacagggtgctatactcatcagtggtctacccacacaactacggtttcattccacgaacattgtgtgaagacggagatccaatggatgtgctggtgttgatgcaggaaccggtgatacctggctgttttcttcgggcaagggccatcggccttatgcccatgattgatcagggtgagaaagatgataagataattgcagtttgtgttgacgatcctgagtaccgccacttaaccgatctcaaggagctttctccgcaccgccttaatgaaatccgtcgcttctttgaagactacaagaagaacgagaacaaggaggttgctgtgaacgatttcttgccaccaactacttccctggaggccattcaacactcaatggacctgtacgctgaatacatcctgcacagtttgaggcgctagatctggtttccagatggaacagtccctctcctggtctcagggggaaaaaaaataagcaataaccgatcagcctcctggctttgtttcaggagccgttttgcggtatatataacttgatcaagggataattgtgattcttctgcaagttactgcatataatatgctaaccatgagatatatattgtctacttctgtacatttttgtggaatatttgagtcaacgattggagtctcttcttgctttctgtcaaaaaaaaaaaaaatcgacgcggccgcgtcgtagaaagtgttgtactttgctacgcccccccaaattatgattgccacagaaagtgtagtggctaaaatcgaatcaaaggtagggtaaagtttggcaaaaaataaaaataaaataagtctacgacatgtgccgccgcagtgatctaaacaactatccacgaaaacgtttaaagaacgtcggccataactatccactacaggaaaacgcttaggccccatttatttcgttggaattgaattccattttaataattataattgagacaaaactaactaagtttatatatttatatatgtaatatatttgtatattatcctaaatcatatgagagatatagttatatactacatttatgttacagcccagcaagtagaagagtgttatataagtt

SEQ ID NO: 23538 - DNA, 1133 bp, Zea mays
ttcaccccgattcaactccgactccgcgaggccggccgggaaagggtctcacctctatcgccatccgttccctactccacttcaatctgctattcctgctccactccgcttcaatccgccgcccctgctccagtaggaacgttccccaccccggcaaccccccacgctagctactccggagcaccggaacgcaccgtcgcccccgtcaagcaggttgcgccgcccgcccgtggtgccggcgctgtgctggaggcggtggagctggggccgtggggaagcttctcgctggggagagccgggacaagctagagcgacggacatgggtcaccagtaagccacggtcaggggcatttcagtcctacctagcagtggtgatggcaaaaatctaacataatgattgaagtgttatctgaataggaatgctctggtggatttgcagcaagaaaaaccttggaatgaatgtacaagccacttagggtgctgtattagagctgtaacaggatgggttcgttatgctgcgtggcggcacggcctcatggggctagcacagcaagccgggagtggtcctctattagccgtagcgacccaccctggcgtactggtgctggcttctccccacctctgtctagagggtgggagtacaggatcaactcggaagggctgtcttatggatcccatggtgatagtggggtcgctgtgaactatggatcatcactatcatcaaatagtaaaggggctagtaggagctgggagaggaatgagcttccacaagatcaccgctactctacatctgagggtgccattttcgtatctcaacagcccagatatcagcttccagaatcaccatattatgctaccgatgctgcaagattctagtgttgatgaatacatgagagtctcagtcgctgagcctattggttctttattattgtcagacggaatgtcaggtcaacataatagtggtggttccacctcctcttgctctgatggaagcgaatatgatattgtacctagatcatacacatcaacgccccgcaacttcccaagtcgtcgatcattcctgtcgaagccaatccaacctgtttcatttccagaacatgcactagaagcacaggacactcgaagtcatgttg

SEQ ID NO: 23539 - DNA, 1566 bp, Zea mays
gacattcattgccccctcttcccttcccaacccaacccattgcatttgcaagcccttttacattgcagagcgccagagcctcgctcgctctcggaacagagctaggcagctaacagacgaagaagaagcaagccaagcagaattgagagagaggcgaggacgtggcgacgacggcagccgcgatggcgacgacgacggacctggggttcgaggcgacggagctccgcctgggcctgcccggcgggggaggtggaggggagccggcgctgggcggcgaggggaggagctcttcctccgcctccggcaagaggggcttcgccgagaccatcgacctgaagctgaagctggagccagcggccgtcgtggaggcggaggaggaggaggaggaccacggcgttgctgttgcccttgagaaggaggaggaggccgggaagatgaagcggtccccgagccagagcagcgtcgccgccgccgccgccgccgtgctggctgaccccgccgagaagccgcgcgccgccaaggctcaggtggtgggatggccaccggtccggtcgttccggaagaacatcatgtccgtgcagtccgacaagggcgccggcaaagacgccgccgccgccaacggcgacaagtcctcggcggcggcaggcggcggtgccgcgttcgtgaaggtgagcttggacggcgcgccctacctgcgcaaagtggacctcaagatgtacaggagctaccagcagctgtccaaggcgctcgagaacatgttcagctccttcaccatcggaagctgtgggtctcaagggatgaacggcatgaacgagagcaagctggtggatctgctcaacggctccgagtacgtgccgacctacgaggacaaggacggggactggatgctcgtcggcgatgtgccgtgggagatgttcgtcgaatcatgcaagcgccttcggatcatgaaaggatcagaagccattggcctggcgccaagggccatggagaaatgcaagaacagaagctgaggagaagacggacggacggaagcttgcatctcagcaccaccaggggtggatggatgcaagaagaacaaatctccatggcttttgcagctctgctcgtctctgtatcatactcgtcgtccctgcccttcaggcctctgtatctccctgatcaatgaagtcgttttggtgtgtcaactgttctctccgtgcccagcttgtcagtgaaagagtcagtcagtgtccatcaagtctcatcttgtcctatacagaagagagaagccatgcatgaacatgtacctgtcctataacaatgtctttttttgctacctgtttttttttctctctctctctttttttggcacaagatgcaaaggcaccctgctcctgatcaaagggccttttgcatcataagctgtttgattataattaccatggtgtgtcagtggaacaaataactgttgcaaggtgttaaaaaaaagttgtattgtaatatgatcacctctcttccttgttgttttaaaaaaaaaaaaaaaaagcggccccgtggaacaggattatatatataagctcagtgatg

SEQ ID NO: 23540 - DNA, 2412 bp, Zea mays
  misc_feature (24)..(24): n is a, c, g, or t
  misc_feature (1807)..(1807): n is a, c, g, or t
  misc_feature (2268)..(2268): n is a, c, g, or t
agtccctagaataccaaacactcncttaatgctatagtgtcctccatgtgagtaagcttgctagcataaaattcctgcaatacttgtagcgctatttaccaaatgccataaaaatggctgctgcaaacttattttgtgccaatattaaaacagtttttttcctgttcgcaaaggatttcctataagctgtactaatgtaaaacggacttgtagccatctattgtgcattccactatactgcttctaatatacccctcccttcctgtacaggttgcgagcccagagttccttagccgaggcagccaccgcttctggtgtggctcttcccaaaggtccgatcgacgtggcgaagcatgttgtccgggacgccggcgccaaaggtctcttcaagggcctggtcccgacgatgggacgcgaggtccctggcaacgcactgatgttcggcgtgtacgaagccacgaagcagtacctggccggcggcccggacacgtcgggcctcggcaggggctcccaggtcctggcgggcggcctcgccggcgccgccttctggctgtccgtgtacccgacggacgtggtgaagagcgtgatccaggtggacgattacaagaagcccaagtactccgggtccctcgacgcgctgaggaagatcgtggcggctgatggggtgaagggcctgtacaaggggttcggacccgccatggcacgcagcgttccagccaatgccgcgacattcgtggcctacgagatcacgagatcggcgcttggttgatttgattggtgctggcctttgccatggccctttgcagtttattcattctccttgcgcggctggagcaacgcgaacaatgcgagacaattttagggaggaaagagagagagaaacttttcacttcaatgatgagattctttaatgaagcaaagcttacttaaaagtttgttcaagtggagccacagagtgagtggttggtgacagataagtaatactggccttgtcgtaatggttggttggcctggcctggcgtgggcatccgacggtgatccgatggcgcgcgagtccgactggtggtgcttgtgatggtgagctgtgtggcccatggttttgttggcgtctggtggtgggtggccctcgtcagctcgcattcggcattcccttttgcccccacaatcccacgttcgccttgcctcctttttcttcttggcctaaattttattctttttctctctcacacacacaaatatatcagtataccgttctccttttattagtgccagtatgtaatggcatgttcggctgcctttctagcagatttttattttagtcttttttctaaaactgttattgttgttacttgacttcaattatcaaaaatcaaggcaatataagttaaatattaggaccttcgttctttggtttaacactttttcaaagtgttaacgagaagcaacattgcatagtataatatgatagtcatcttgtgtgccttaacatttttatgttatctttctttaaatcaagtaggtttacaagcatactttcagctcttgaacactaggtggcacgaaggttcttcgaaggctaaacaactcaaagtatggctctcgaaaaggtggatttatacagagcaatgttcatctatttataggaagataaacagtttcatgaaaaaattacaaacatgcccataaagtttacacacatgttttacaaatgacacagggacgttgatgacttttctctttctttcttgttgctcaagtcttgaacttggtatctttgcgtccgaagtctcactcgtgtcgaagctancggcttcggctcgctccttcgccgtttgcacacttggttgaagcttttctttacgtcgcttcagcttttcttggtagtgtcccgaccgaaggttagcttcgttcgttgttagacatgtacctgaaacacattttttcactccaaaacaatagttatttgaggaccttcggcgaaggtaggcaccaaacagtagccccttgcgggttgagtttgtttcttcgtaacgagcttagatcgcaaaaagtggaatttggaggccttatgccgaaggttcgacaaacaccttcccgaagctcattagggaaatggtagaacgattcaataaaaacaattgatctggaagttagatagacaaagaaaagttaagggtgatgcgcgggaacctttcatggcgactcgcgccgctttgtccatttcttagtataaaaacagtagagcaggtggatgcagatcacatttantgccctcagcaacctgttgccaaaaaaatttgtgcctctgtcgggtatggtaattaggggtacccagattacacccctaaaacatgattaaaccctaagaacaccatcaaagtacattccccgaggtcgaaggatcgagagcca

SEQ ID NO: 23541 - DNA, 1213 bp, Zea mays
ccggccggcacgtccgcccctgccagtttgcgttcgccacccgtccaaaaccccccaaccaaagcccgctccggcagcccccaccccaccatcgcgtcaatggcggcgccgcctgtccagcctgtgccaaccgcggcggcggcggcggcggctgtgaacggggacgcgttccgtctgggcttcgtcggcgcgggcaacctggccgagagcatcgcccgcggcgtggcggcgtcgggcgtcctcccggcctccgccatccgcaccgcgccccaccgccgccccgagcgcggcgaggccttcgcgtccttcggcgcgtgcttgctccaaaccaatgcccatgttgtggacgacagcgatgtgatcgtcatctccgtgaagcctcagatcgtgaagcaagttctacttcagctgaggccacggctgtcagaaaaaaagcttctcgtgtccattgctgccggcatcaagatgcaagatttgcaggattggtctggtcaacgacgtattattagagtaatgcccaacaccccttcagctgttggacaagctgcatcagtcatgtgtttgggagagatggctactcaggatgatgaaaaccgtgtaagaaaactgttcagtgccattggaaaagtctggacagctgaagagaaatattttgatgctgtaactggtctgagtggtagtggcccggcctatatcttcctagcaatagaggccatggctgatggtggagttgctgctgggcttcctcgggaccttgcccttggtcttgcatctcaaacagttcttggtgctgcaactatggtgagccagacaggcaaacatccagggcaactgaaagatcaggttacttctccagcaggtactaccattgccgggattcaggagctcgagaagggcgcattccgtggaacgctgattagtgctgttgttgctgccgcaaagcgctgccgcgaactgtcatagagttcgaaacaaggctgcattttgttgatatacatgcgttggtatgcaaggtgcaaatcttctggaatagtagactaataatgtactgggtggcttcagaatcatgtgatatgataagtacatgctcccttccaaagcttggtgtcaccattatatggtcgaacggcaagccttaacaataaatccaaaaattggggctcaaaaaaagaaacaaagcgccccgcaagacacggctgaggggggacaatgt

SEQ ID NO: 23542 - DNA, 1431 bp, Zea mays
  misc_feature (1416)..(1416): n is a, c, g, or t
cattgggtacctcgaggccggccgggaacccgccgcccgcggaacagcccccgtgaccgtgaaccaaccagttgtccagttccgctccggcactccacccacccacccagccaccccacgcccgcgagcgaccaactcccctctcgaacggttcgggcctttgcagtcgacagatcgatcaatcagcaccgaccactcgcgacccgattcgaatcgagccagagtcccaggcagcggcggcggcggcgcccgcctccaagaccacctccacccggaccccagccccaaccccaagttaacagatgggggacgttgcgaaggacttgacggctgggaccgtgggaggggctgccaacctcatcgtcgggcacccgttcgacaccatcaaggtcaagctccagagccagcccacccctgctcccggacagctccccaagtacgccggcgccatcgatgctgtgaagcagacggtcgcggctgaaggcccgaggggcctatacaaggggatgggggcacctctggccaccgtagcggccttcaacgctgtcttgttcagtgtcagggggcagatggaggcgtttctcaggtcagagcctggtgtgccgctgacagtgaagcagcaggttgttgcgggcgccggtgctggaatcgcagtctccttcttggcttgtccaacagaactgatcaagtgcaggttgcaagcccagagttccttagccgaggcagccaccgcttctggtgtggctcttcccaaaggtccgatcgacgtggcgaagcatgttgtccgggacgccggcgccaaaggtctcttcaagggcctggtcccgacgatgggacgcgaggtccctggcaacgcactgatgttcggcgtgtacgaagccacgaagcagtacctggccggcggcccggacacgtcgggcctcggcaggggctcccaggtcctggcgggcggcctcgccggcgccgccttctggctgtccgtgtacccgacggacgtggtgaagagcgtgatccaggtggacgattacaagaagcccaagtactccgggtccctcgacgcgctgaggaagatcgtggcggctgatggggtgaagggcctgtacaaggggttcggacccgccatggcacgcagcgttccagccaatgccgcgacattcgtggcctacgagatcacgagatcggcgcttggttgatttgattggtgctggcctttgccatggccctttgcagtttattcattctcccttgcgcggctggagcaacgcgaacaatgcgagacaattttagggaggaaagagagagagaaacttttcacttcaatgatgagattctttaatgaagcaaagcttactaaaagtttgttcaaaaaaaaaaaaaaaaaaaaaaaaagaaaaaaaaaaaaaaaaaagcggccancaaaaaaaaaaaaaa

SEQ ID NO: 23543 - DNA, 5068 bp, Zea mays
  misc_feature (1514)..(1514): n is a, c, g, or t
  misc_feature (2859)..(2859): n is a, c, g, or t
  misc_feature (3256)..(3256): n is a, c, g, or t
tcgcctttccgtctgattcgatatattcatggaccgtccatgcctatgagcgaaccgtctggccgtgatcagtaccacaaatgctgctcaacaatacgtgatggtcttacttacaaagcctatgcttattgtgatgcggcgctagtaataaaggatctcggaccgacaaaggtgattgttaaaacgggttgccaaggattagtggctccatggaattctagaagtagtaattggtgtgctattaaatcaaatcaaggaacttggccgacaaagcacacatttttctctttgctttatgtaaaggagggtagcaaacatgtgtgtttcattacacaaacaaccaagttcgctttgatttcaaattctgaatatacgtggttgcatgatatcccgaacttttttatgtctcaatgtattcagcatgcagaactctcgtgctaagaaatgaatgaagcaataaaaaggctctttttcccgggtgttttggtggtttagtctggctttgctttttagattgttgtggttcggtgtccgtgtgaactcctggatctggattctggactgtggagtgtttgggtctgtgttttgaaacagagagtcgagactttaattctgcgagggtggtatgtgcaaaactggacgggccgtgcattatcatgagagcctactattatttctacacacccacaaccacaacccttgtgacattattgccccctcttcccttcccaacccaacccattgcatttgcaagcccttttacattgcagagcgccagagcctcgctcgctctcggaacagagctaggcagctaacagacgaagaagaagcaagccaagcagaattgagagagaggcgaggacgtggcgacgacggcagccgcgatggcgacgacgacggacctggggttcgaggcgacggagctccgcctgggcctgcccggcgggggaggtggaggggagccggcgctgggcggcgaggggaggagctcttcctccgcctccggcaagaggggcttcgccgagaccatcgacctgaagctgaagctggagccagcggccgtcgtggaggcggaggaggaggaggaggaccacggcgttgctgttgcccttgagaaggaggaggaggccgggaagatgaagcggtccccgagccagagcagcgtcgccgccgccgccgccgccgtgctggctgaccccgccgagaagccgcgcgccgccaaggctcaggtcgtccggtcctctcccctcccgactgtcctagctctagctctgttccgtacgtatgtgcatatatgcttagctgttaatcgtctccactccatgatgcacatatatgccccgcgcgcttcaagtcacgaatctctctgctccagtttatccgtttgctcataggtaatagagaaagacagagagggccggggggagaattaatccaaccgtgttaataaccatgcgatctttgttcatccaacaacgaagaacacgatcgagcacgaacgcacatctacgtantcctacctatcatcgcaacaacgatcgagcaccagccgcgtgccagctggttgaagacaggatgcatgagttgagcccggatacgatccacgaactgctcgtagtcgtagccagctcagcccagcagtcgaggaggaggaggaggaagagacagcggcacgttacgtgtgggggcagcgggagacagcggctagtgccgacacgataaaagaaagaaaagaaaccccaccacactgcacgtatagatctctttctctgcctctgccatttttttgtccacatcaacatcattttccacatcactcgcctgtccggttcgttcatgcatccggtcctgatcgctcgctcgctcgctgctccaggccaggcttagaaccgatggtgacggcacggtagaacagagaactactgtgtgtgcgtgtggggttatacatctatctatctctctctcttttttattatttgggcccctgttctgtttcccatactgccaaagactatactatagacgcccatgcactgcgccatggtcgtaagctacattgggttcaccgttcatggatcgccattctagatctgctgtcccccggcctagctaagctagccctcctccatattactatcgacttttttctcataaagcaccacattttgcacatgcctacgacgtgtatgttttgggcaagaaataaaacaaggtaccactacccagtccacacagagactacatgcatgagcaacgaacaaacaaaaaaaagcagtaaagtatatatagtgtatatacttatactatacaacagcaacgaaccaaaaaaaaaaacaggacagcttaacaatttgcacgcaatttgcagtaaagtatatagtatgtatatacttataaatctaatgctggatctggatggacgtctcagtctcatctaccgtgtgtacgttttgagttttgacagagggaggtatattgtatatacacctgcagggctcagggggccggatggccaccggtccggtcgttccggaagaacatcatgtccgtgcagtccgacaagggcgccgccgccgccaacggcgacaagtcctcgccggcggcaggcggcggtgccgcgttcgtgaaggtgagcttggacggcgcgccctacctgcgcaaagtggacctcaagatgtacaggagctaccagcagctgtccaaggcgctcgagaacatgttcagctccttcaccatcggtactaaatttaatttgacagctgctactactactaccataattactacatcgcggtaaaaacacagcgcactcgattcttttttaacctttctaatgaagtacctacaaagtacaccaanagtatatatactcctctttttttttggaaacggaactgatctgtttttaaattaaaatgcatgcaaggtgttttattttagttcgttctaatataataagtcaaatcctgtatgtgtaacaccatgcctggaatcaaatttacaaaataaatgtactaacgtttggagaatacgaacatactattagttaagatatagtgttcaatggtagattagttagatgaaaacgaaattgcatcatatcggtatgtacattttgtaaacataaaaaaaactggccaaatgtgaagaagcctgacctacatgcatgtagtttttagtttgctcatgacactcattttctttaaaaaaaaaatgagtatactgtactcactccgttaacaagagaatgcaattncttgttttcccaaaaaaaaaagtctaaactttgactaaatttgtttttaaatataagcatttataatataaaataagcaccattagattaagttatagaatatgtttttatagtaaattcatttgcagacataaactaaatgttgatcctatttaatataatataaactcggttaaatttcagctatattaaccggcacaaatacttgtatttttgtttgtggacgaggagggagggactactagttaaaccactcattaccaatgcatgaagtcgataatttttacgggctgaggattaattgggtaggtatatatgattgcattggcattcatttgcacgcatgcatgcatgtgtggtggtggtcaccatgtgccagcggtgtggtgcgctccatgatttgcatccttggtaggtgtccgccctggctggctggcataatgcccttgtctctgccaacaacacatctcccgatcctctacatcatgtagcagctcatgtgtgcacgcttgacagatgatgatgatgatgatgatcagctacctagctagctccatcattgttgccatgcatgtggtgttcttggagctccgtgtaaactaatccacgtgtgttcaccgtaccggcggcgtgcacgtatcttagagctagaaataagaaaaggcctgctgtcgttcgttgctcagcaactgccatggatttggttgtatatttccctaagaaccatcggttgaagtatatatatatgccttgtttgatggattattccacatcaagtttgttagctatcttttgaggttcaaatcgactgtttgcagcacattattgcagagcatacactaccttgacttggatatataactaaccaaatgaatggatggatggtgaggttcaggaagctgtgggtctcaagggatgaacggcatgaacgagagcaagctggtggatctgctcaacggctccgagtacgtgccgacctacgaggacaaggacggggactggatgctcgtcggcgatgtgccgtgggagtgagcactgcatgcatgcgcttcttcctgcactatactccttattatattattgcctaatcggaaaataataataatttccatttcattttcaggatgttcgtcgaatcatgcaagcgccttcggatcatgaaaggatcagaagccattggcctggcgccgtgggcctttatgattattattattactaatctcaacaacaaaagagactttctagggtagtaagcagcccgtttgtttcatctggtctctatctctgaattttccagcgccaagggccatggagaaatgcaagaacagaagctgaggagaagacggacggggacggacggaagcttgcatctcagcaccaccaggggtggatggatgcaagaagaacaaatctccatggcttttgcagctctgctcgtctctgtatcatactcgtcgtccctgccctccaggcctctgtatctccctgatcaatgaagtcgttttggtgtgtcaactgttctctccgtgcccagcttatcagtaaaagagtcagtcagtgtccatcaagtctcatcttgtcctatacagaagagagaagccatgcatgaacatgtacctgtcctataacaatgtctttttttgctacctgttttttttctctttctctctctttttttggcacaagatgcaaatgcaccctgctcctgatcaaggggccttttgcatcataagctgtttgattataattaccatggtgtgtcagtggaacaaataactgttgcaaggtgttaaaaaaaagttgtattgtaat

SEQ ID NO: 23544 - DNA, 1278 bp, Zea mays
tgccacccctcccctggattttttatgggagggcgggggggctcccaatttcagaagtgtttttctaaacccgttaattggccccaaataaattctctccttaggcttggtaaaggcactttcctttaatagccaattgaggtcagctccagctttgaagcccaccctaaaacccggccccaaaatcttccccagactttcatcacaggatgtcaagatctcagacattcttaatatggtcagctccagaagggtaccatagcccaacttctcgttatagattcagattcagacaagacaagtttaatcccctccgcttttttttttttttttgaagactaagaggaaaatctctatgattatgaaattgatgttgcccgtataacagatcctaggaacaacccgtgtgtgtatatatatatatatacaatcgcaatcaggggcaattacaaatccaacacgtcaaaccctggcaagaaacagcggaaggccatcgttgccggccaccaaatcttgcgatatctcaaggctcaagcttgttgtcttccttaccattagaggttgcgtcatcagggccttgtttgctccccttacagttacagcagcacgcaaagaattctcctaatggacgtttaggaataggaataagctttcccacgaatgccagtggccagctgaagaaagcaagacctatcgataccaaccacagctgccaacttagcctaactgttgaggcaaacttgccgaggaactcaacgataagcgcctggagtataactgttattactatgatgccaataaaaagatggttccctgaaatgcccttgaatatattcagctcatctggtttacgtgaattgaattcgttgaacacctggcagagaacaaatgtgttgaatatgaaggtatttttcactttatctgcatgtgctggatcatcatttttcaactgcaggaggcttatccccttgaagttgagactaaggaggactgaaacttgaaacgtagccatgataatcaagtttctccacatgatatttgttaccaatggctcccttctccctactgggggtctctccataagatggtttgtaggtggttctgtcgccaatgcaagggcacccaaagtgtccataattaggttaacccacaacaactgaacagcattcaatggcacgtttccggaactgacggcaacgtcgtgcttgattatcagagctgcgacgttgactgttagtcccacctgtataaacttttgtatgtttgcataaaacgatc

SEQ ID NO: 23545 - DNA, 1814 bp, Zea mays
caaaagaagccgagttgcatttccagccttcctgtttgaagtacaatagcaatcagtggtaatcacaaatccaacacgtcaaaacccggtaagaaacagcacaaggtcattgttagcaaccatcaatcttgctgacatctcaaggctcgggcttgttgtcttccttatcattagaggttgcgtcatcaggggcttgtttgctccccttgcagatacagcagcatgcaaagaattctcccaatggacgtttaggaacaggaataagcttccccacgaatgccagcggccagccgaagaaagcaagacctatcgataccaaccacaactgccaacttagccttaccgttgaggcaaacttgccaaggaactcaacgataagcgcctggagtacaactgttatagctatgatgccaataaacagatggttccctgaaatgcccttgaatatattcagctcatctggtttacgcgaattgaattcgttgaacacctggcagagaacaaatgtgttgaaaatgaaggtatttttcactttatctgcatgtgctggatcatcatttttcaactgcaggaggcttattcccttgaagttgagagtgaggagaactgaaacttgaaacaaagccatgataattaagtttctccacatgatatttgtaatcaatggctcccttctccctactgggggtctctccataagatggtttgtaggtggttctgtcgccaatgcaagggcacccaaagtatccataattaggttaacccacagcaactgaacagcattcaacggcacatttccagaactgacggcagcaactacattgattatcagagctgcgacgttgaccgttagttggaattgtataaacttctgtatgtttgcatacaccgaacgaccccatctgacaaccctcacgactgatgcgaaattgtcatccaagataataatatcagaactctccttggcaacttcagttccctgaatgcccattgatagaccaatatctgcctcatgcagtgctggggcatcatttgtgccatctccagtaacagcaacaacatgacctcttgccctcagtgccttaacaagtaaaagtttatcatttggtgaagacctccccatcacagagattttttcagcagcatcctccctttccaagtctgacagcgcccggaatgttttcccttcaatgatgacaggctctgacacattgggatcatcaagtatcccgcactccagggcaatggctcttgcagtttgaagattatcaccagtaaccatgcgcaccttaatgccagctgcctgacataaacgaacagaatctcgaactcctggacggcagggatcctttattcccacaattccaagcataatcaggttatcttcaggaagttgccactcttctctccgatcttcgtctggaacatcatccatctcatgagttctataggcaaacgcaacacagcggaggctagcagcagccatatcttcaatgaatttcttgaattcggcaactttttcaggagtcattgaatgcttcgaaccaccagtgtcaacccagcttgtgcatgaatccaaaataatttcagctgctcctttccagtgtatatggacctcagagccagccaggtacaccgcaaccccgcctcgctttttctctgagttgaaaggaaatacatgaagaatagatgacttcgatcttgtttcactgaatttcatacccagctttagtccccaagacaggatagcttttctgtaggtgatccagtcacctctggttcttgaccaccctgctcgggctcaaatatgccgc

SEQ ID NO: 23546 - DNA, 1040 bp, Zea mays
tttttttttttttttttgttcttatgtaacttgtgaacttatcttttggtaggttttgcatccccaatcaatgcggccggctagggatggtgatataccagtgagagttaagaactcgtacaatcgtcatgcaccgggccccctagctagtggcttggtaattttgcggccggcgtgacgagcttgagcttgccaccatagatctccggcagctgggagtcgtcgatggcctcgcggagcgtcctgtccaggtccttgtccggcacgaagacgaacttcttcttggtgttgtcgtcgataaaagggtagacgatcttccaggcggccatgaagacgtagggcacgtggacgaggaagacgcgggcgaggcgctccgggtagtagctctgcatgatgtcgagcgccgccaggtagcctcggatgtcgcagttggcgtagccccagccggcgaggtcggcgacggcggcgaacttctcctggcgaccatctcccggagggggagggggcaggcgcgcgacggtggcgtcgaggacgtggacgacgtagcgcttgaactcgtcgaggtccctgcgcgccgggtggtggcgcgcgccgaagccgtagatgagggggcggccctcccggtcgtggccctgcaggtagagcttcccctgcgccgcctcccgcgccacctccgccgctgcgatggcgccgtggggcttggccgcgggcttccacttgaggtacttgagcagcatcgccgacgccttgccgatgttgtggtcccgcgcgcggaggaagcgccggagcgtgtagtcgtcctcatccttgcaggaagggtcctgggcctgggtgacggccctcagctccgccacctgcttccactccgccgcgtcgtcgctagccacctgctcttgctgctcccgctccgccatggccgacgacctcagctgctggtggatgggtaggaggcgggtcgtgtggttactttataggaggaggaaggactactgttcgtgcagcggtccccaggctagctgaggctgagctccagccgggtt

SEQ ID NO: 23547 - DNA, 1715 bp, Zea mays
  misc_feature (1542)..(1542): n is a, c, g, or t
ttttttttttttttttttttttttgttttgttaaatatctcattcccatggcattggcaacgtcacaacaatacatcatttatgcgttcaccaagagaaaagaaaagaaaagaaaagctgagatatctaggaaccaaagcttgatattgtgttctccaagactccatgcggatcctatccacttgctccacggacatgccagccagatgccaccacgagccactagaagaagagctgaatggatctgatcgacgccagtcagctgctctggtattctgaagcactcaagtactccccgttctcctcgaagtattcgaccaagcgtttcaggaacctgtcgctgctcacggtctccacgtcgcacaccaggcagcactgcctcctggctcgcgtcaccgccacgttcatccgcctgtgatcgctcaagaaccccacctctttctttgagttagaccggaccatagaaatgatgatggcttctttctcccggccttgaaacccatcaactgtagatatctctaaatctttcaacttggcatctttgtttctcatcatcttcaagcaggttacctgtgcagcgtaaggcgtaattattccaatatcagaagcattaacgccactctcaacaagcaacttggcatgagcaatggatactgctgcctcgccctcattcatggtgctctcctcttcatcttttacttcttccatatcacaccctgtagtgtcaatgagtacaatagttggttctgttgaagaagatctagtgacttcttctagatcatagagcatatgcccagcaacactagaatgtgctttgatcttattattgtaaagttctttagatgaccagctcataatgtgctcgtgcattctgtactgcacagtgagcatggatgtgatttcctctccataagcttcagtaaggcgttcaaagagtgtctttcccatccccttcttttcagcctcaacactttgaattgttggaggaagttgaagatggtctccagcaagaatacatctcggccctttcaacaaggctatccagcatgccacctcaagtgcctgggcagcttcatcaataacaaccaaatcaaatgtaattccgtttaactttttcgaagatgcaccagtcagagtggtcagcacaacatctgcatttttcagtacatcagtgactgcaagctgctgtcgttttctctcctcttttgcaagcgttttgagctctttcctgatgtcccgtttagtgttcctatctttagccttcagcaatttgctattgagcaccttcatttccttgcgaatgtctcctgccaagctactattatcagctcgtaaaacctgtgcatcaagagcgctgtcgagcacttgaggcagtaaacgagcagggtgccctaacctcaccaattttgttctgtatcgtgcaagtcgctcaacaatattatccacagcaatattggaagcagcacaggcaagaatctttgatccacgcttgacctcctgcaatattatctcaataatagttgttgttttcccaggttccanggaggtccgtgaagcaagaaaacatcccttgatccaagagccttcgaaatagcctctttctgttgaatcatccaagttcttgttgaatggactgaatttcatagcatcctggagcgcatgggtgcccggacgcgtgggcggacgcgtgggcggacgcgtgggcggacgctggg

SEQ ID NO: 23548 - DNA, 1839 bp, Zea mays
ttttttttttttttttgctaaatatctcattcccatggcattggcaacgtcacaacaatacatcatttatgcgttcaccaagagaaaagaaaagaaaagctgagatatctaggaaccaaagcttgatattgtgttctccaagactccatgcggatcctatccactattccacttgctccacggacatgccagccagatgccagtatgccaccacgagccactactagaagagctgaatggatctgatccacgccagtcagctgctctggtattctgaagcactcaagtactccccgttctcctcgaagtattcgaccaagcgtttcaggaacctgtcgctgctcacggtctccacgtcgcacaccaggcagcactgcctcctggctcgcgtcaccgccacgttcatccgcctgtgatcgctcaagaaccccacctctttctttgagttagaccggaccatagaaatgatgatggcttctttctcccggccttgaaacccatcaactgtagatatctctaaatctttcaacttggcatctttgtttctcatcatcttcaagcaggttacctgtgcagcgtaaggcgtaattattccaatatcagaagcattaacgccactctcaacaagcaacttggcatgagcaatggatactgctgcctcgccctcattcatggtgctctcctcttcatcttttacttcttccatatcacaccctgtagtgtcaatgagtacaatagttggttctgttgaagaagatctagtgacttcttctagatcatagagcatatgcccagcaacactagaatgtgctttgatcttattattgtaaagttctttagatgaccagctcataatgtgcttgtgcattctgtactgcacagtgagcatggatgtgatttcctctccataagcttcagtaaggcgttcaaagagtgtctttcccatccccttcttttcagcctcaacactttgaattgttggaggaagttgaagatggtctccagcaagaatacatcttggccctttcaacaaggctatccagcatgccacctcaagtgcctgggcagcttcatcaataacaaccaaatcaaatgtaattccgtttaactttttcgaagatgcaccagtcagagtggtcagcacaacatctgcatttttcagtacatcagtgactgcaagctgctgtcgttttctctcctcttttgcaagcgttttgagctctttcctgatgtcccgtttagtgttcctatctttagccttcagcaatttgctattgagcaccttcatttccttgcgaatgtctcctgccaagctactattatcagctcgtaaaacctgtgcatcaagagcgctgtcgagcacttgaggcagtaaacgagcagggtgccctaacctcaccaattttgttctgtatcgtgcaagtcgctcaacaatattatccacagcaatattggaagcagcacaggcaagaatctttgatccacgcttgacctcctgcaatattatctcaataatagttgttgttttcccagttccaggaggtccgtgaagcaagaaaacatcccttgatccaagagccttcgaaatagcctctttctgtgaatcatccaagttcttgttgaatggactgaatttcatagcatccttggagcgcatgggtgccttctctccaaataaaacaggaacaaggtttgcacaaggtcctgtttggacagccttgctaagttcaattagtgcatccttcatcctgcgataagtgacctcatttgcaagcttctcaagacgcagagggctgtttaagcttttcgattaggatgttctaggtaatggtctcgtgc

SEQ ID NO: 23549 - DNA, 3327 bp, Zea mays
  misc_feature (1204)..(1204): n is a, c, g, or t
catcatcatcatccggatcctgccgccggcctcttcactcaatgaagatggagagctcgctcgctagccttgagctcgacggacgccatgcagcgcagcgcagagcgcgcggatccggatgactcacctgatgtccgcctccgcggcctgcacactggcgccgtggccggcggtctctggccgcccggcgccagcatgcatctaatctagctttcccttcactcagctctctcggtcgaccgccagtatagtgctagtatatatgtcgtcgtccaagatcgcgatcgaccttctccgggaacggcaaagcgcacacgagcaggcggcgcagcagcctgccgctcgatccgcgcgcgtccatcacacagcatgcagcacagtgcgtctgcgtgcacacagccacacacacacattctctctctctctctctctctcttcatgatccgtccatcggtccatgcatgcatcgcgcgctctctctctagactctagggtagtagagtcatgaccggaagcatatcaagcatcctgcatgcatgcatgcatgcaatgatggttagttccacttcctcgcgcagagggcagagcaatccaatccaaccacaccacaatggcacaatggcatacgcaacacatcgcatgtgtactcctcctacgtactgcagctacgacaaccattgccgcgcctgcctgctgggtgctggcttgcaccctagcttgccattgccacggagatgggtgcatcatatggcacgctgggtacaaggaagcgtcacagaaaggcgctggcatgcatggcagaagagaatctgcttccttgccctgcccccctcgcttactttcctttctcctttttctctttcttttccggctggctagcccccgccccgcctgatagatctgctgccctgctgcccccacgacaccttttgtcgcaatcatatctctctctttcaaaacgagtatctgctacttcaataaacttttatctaattcatcgtcgtcccggttagcgagttatactattcacacgggattagaatgcacatgctattggataatgcgcaaaacatgtgtttggatcatgcgcagcataggaatgcaagacacaaaggaaagtaaacacggcatcatgcttattttcttccaaaattgctatggagaatgctattccataggaattttaaaggaattgataggatcnaatcctttgttccaaaggctcttataggaaaacttcccataggaattgaatcctataaaattcctttgtttttccttccttctaaaggaggaggctatagtgtccaaaattattccgtttctttgcaacttaaagtctctaaatattatatatatgatacttataagatgatgaaattatactcgactcaccgaccaggccatgacaccttttatactatagtactccagtagactgtagtacgcaaaaaggagcaagagaatttgacagcagcagcaccggttgctgctgtgctgggacacagagagagtacgcagtacggtaccattcaaatccaatcactcactgacacccattagtggtgtcacttaatgatgagatacctacggggcaaagcaacaacacgggcgtccatcagcgagcatccgcccagtgccccaagccctctgctgcaccaggccaatgtcgtcacagccagctcgcagcagcaaatttacatgcacacaagatagtgatccctaccaactatatggccatggaatggtacgagtcgctagacacaatcataccagggggcacgggcaggtgcagagccgcatctatcagtagtcagtagaggcgaggcagcagctcttttgtctcctcactggtgccaccagttcaagatccaccacacgtcgtcttgccatgcatcacacacacaaacacgcacacgcacacacttttcttttttcctttttatataggagtagtacttgctaccaacctgtcaaggtgaattcattgttgtgaatattcccgggccgggccttctcgcctttcaaggattcgaattatggcagcctcaaatgatagcagcgtagacactgtgcggccctgccgatcccacacaatggagccaaagtccccagtctgtcttaagaaggaatcattgcaggctacaaataaaaggtgctcatacagaagttttcaccaaatccacatacgcgggaagacagtacaccaagtacacagctacaggcagcagtctaaccatatcaccagagctgcgagagccatacgcagccatcgcagcagcagccaccggcggagagaaaacctctacattacctgtcatatccgccgccacccacccggcggcctccaccgtagcccctttctggcatccgatacggtgaaaccgatcggtccctccttgacctaccaccaccataaggaggcggcgagtagccccggccacccctgctttcgtagtagtcccgagggtccctgtggggaggagagtagtccctgccgtccctgtagggagggtagtcccggctgtccttgtaggagggataataatcccgactctccctgtatgaagagtacatgggaggcggagacctgcggtagccatacccgccgccgccattgccgtaatactcatcacgcccaccaccatagcctctatggaacctcccacgctccctacgctcgtaccgatggccaagatagcttccaggagttggtgtccttgggcgaccacggcgtgacttttcaactgtgatgtttcgaccttccattacagaaccattaagatactttatgcaacgctccgcttcttcaacagtgtccatgctgacaaaggcaaatccacgggaaacacgtgtatggggttcaagaacaacatggcaaccaaccacccttccatgcttagaaaaataatccttaacatccctttcagtaaccctcgaagagagcccagtcacatacagagtattcccacggttaacagcatcctcctccctctcttggcttctagatcttgacctcgcctgagatctaggatcagggacaggtgacctagactgagaccgagctggagattgtgatcttgacctcccttttgggtgccccctgctgtatgaaggggaccttgagtacctcctgcgcggggaatcggccatgtcgcgaaacggggacggggggcggcgcggcggagtggagctcccccagcggtcgcttgcgcggggctagggtttggcggcgcggtcgcttctcccccttccctcttcggctctccctttcggttgtggttggcgtgcacagcacagcactgggctctccgcaacaaattgttg

SEQ ID NO: 23550 - DNA, 4769 bp, Zea mays
caattctgagtgaatatcggaatcccctggcaactgaagggctcccctgtgaatatctggcgtccctaaattgctcatggccacaagtggatgttgcaacttctatgtgtcaggtgatcctataagggtggaaatctgagcccaaaggtgcctccgtggaggctattatctctctgaacctagaccccttgagttggactcctcgcgccatactattcaccatactactcgtgaggtccagcgaccagtctactttgttagtgatgaagccttctataatgtcaaaactaggtattgagagaaccagaattttctctctgcacggtgcttggtatatctctttccgttcggcaaacctagatcaaagccaggtcaggaagccagtcagcctaggatcgagtggaacaatcattcttggcctggaatcgatccacgtgagagaacacttggatttgttctaggtagagcagtgagaatgggaagtcaaaatcagatggatttattctcgatccgggtcaaaacaaataactagatcggattccaatccaggccaatttgtacaacctggaaggaggttagaaacataccaatccggccgatacgaacgaaaggccttaggcacattaaatcttagtgattacgtcatttccattgagagtgttgttgcgacaacgatatgttattggacgtattgcaaagtggacgacaaaattactgcagttaactttggttttgtccctaccactaagtgaagagcccgtcattcacatactttgtcgcatagcagatcatgttacgatataatctaatttattttaaactaccatctagttcaaaataagttggattatataatttaagtagattataatgacctttaacttagtttgaactaaatattagtttaaataacttacattatacaatatagacatattataatccgggtatgttgtgtgtttgtgtctacaacaatgtttttcccaaaacaaaccatttaatctcatttctataatcacgaatttatcttccgaatttcgcagaccaaataaagcagcaatgcgagagccatttcttgaattttccgtcgtctttattgaggtgaataaaaaaatcccagatcttcgaacagaaatccagtatagtacttaattcgaacccctctccgggtgttcttctgttccgcttctcttccaagcttccaccgcatgaaattagacaaacagtttgcacacaaccactgacagaaacatgtataaccatcagtactacttgctgagtcgctgtcactgtacataactacagactgaattcctgacgggcagggtcgtaaaacaaccaacagatcgctggcgtcgcctaaaacagccactccagtggcaagcagcaatcactagtcagatcacatcagatgcacctagcagttctcccttgacaccatggcgaatgccagccaattctcatggaagcaagccctaccattggcgaggaattcagaagggcatggaaaccgagcaacggaagcagaattgcctagtcttgctgacacagtgaacacaattcaggagctgcgggttctggtaagatggaaataacaaaacagcaacgaagccaagactaattgctagatgttgggccatctgagttgagataacccatcttctcagacagcacattcatatcatcctcgattacagggctatcgttctcctcgccaagtccttcgttcagcaactgctcccagaagttgtcattcagatcctcctggggcatgtcttgctgctgctcagaggtactgccaatatcaatatcaatatcaatatcatgtggcccaatcaggccgtggccatcgaaagctgggctctcgaggtcagctgggattccgtcgacaaggaattcaactgggtcctgggcattaaacaggaccggtgaaccttgctccaagctgctactagcccccaagtcatcagcttcaggcccttggtcgatgcgccgtcttcttttctttgaaatagcatcttgaagctccttcctcatctcattctgggaaaccaggtgcttcaagaattcaggattccgcatgacacgtgccaagaacgccatcatctgctgctgcttctgttcagtcccttgtagcctatcctccatcgctttgagatttgcctttgtgttctgctgctcctgccttagcttcaccacttctgccatcagtaactgcttgtctctcttcaacatgtcaatctctgcatcatatccaaaatgtcccacctcaaggtaaggcccaatggactgctggtttgtggcattctgagcaggaggttttcgacgcctgatgttcttcaggaggtgtctctgtccccgtaaaaagccctcattcgcgaattcccaccgatcaggatccaccttcctgaaaccctggatagacgagcaaacagcatcaggcaatggttagcttcaaaagacctcaaggcaagaagatatgactggtatattgcagtaaaaaatggttaatttttcatcagatcagcagtaagagctaaagtgaaatcaaacaaaaaggtgacctgcattacctctttaggatacgttccagttaacttttgcacagtttcagtttgcattgttttcagttacttcttcattcaatttgttatctttcttctttaataaatcaatactcatccttttctactgtttcaaggacctgtcatgtactgcctcattcaaaagaaaataagaaaacaatgaaggataaaaaattagagatcattattgcaaaaatattgtttcgctccagaaatatcgacttcattgagagagaagaatccatgagaggaacaacacaaagtgcaagaacagcatgaagtttagcatctgacagtgacacatgacctaagatgttactattcaactatgcacatcattataaatagctccaaagagtgggcattcagaagtattccagctgctattaattcaagaaaaggagccctggcatcaaaacagagaagtacagcacacgaagggtgatgctgctgttgaatagcttaaggaaaatgacaattcaaaaatatattatcctttatagatggttgtttgctaaaaacacagcagtaatattttccaaaatgccaacaaggttatcttcttcatttccttcctttaaggacaacatgagcagatgtggcgaagcacattcctcatgataactaaaatcaacttgtctggggtttctatgtgcttgtacacaaagactatgtaatatgcaactgtagtattaacttccattatacattcatgcctgaatacgctgtcaattaaacttatttgtttaattaattatatatggtgctgtttggttcagcaccctgaacggtaacggggatggagtcacatgccgccacgatcactcactgctatagctctgggaatggatagcgctgatagttctgtgaatcaacacaaactgttctaaccaaacacaaaacaacacaatcgatttactctgtgaatcgataacggacaaaaaggaccaaaccaaacagcacgtatatgtttacaaatgttcttatcaccaaaaacaagagaggaggttctcacaacccaatcagaatagttagatagtgcacagcaaacttcaatgcctatatgtgccactttgctgttccaatgctgaccacaaaacataacaaggcaatttcgaggattgcaccaactacttgcaaaatagtcaacagtgttgtgtttgggagctgaacattcaaccctgttaacacctcagcatcatgaaccattccatgctgaactgcaggggccaccctcccgcttccataggtgttgagctgccggacgaagctggagaagttgttgtgcttgaagtgcctgggcagcagcaccgtggcgaaggcgtgcggatcccacaccacgaagctgttgttggtggcgctccacgacacaatcaggtcggtgtccgagtcgtcgaccatgtcatatgtcttggtgaggaacggcggcggcccagggtcatgcagaccctccatcggctttggtgccgcggcgacggccgcggacggcccatccgcggcctccaccgtgcctgccatcaaatctcctccctccccatggctctcctccttcacctggttcagcgttgagtccatagccggatcctaccctcctaatccgagtaacgatgctaaaatctctgctctgacaccggaatggaatagtctgttggacaatgtcagtaaaactccgttgtaaaagagcagcaacgagcagctgcccctagcacacggccacacaggagtacaaggcacgcatcgacgttaaggcatacacacacacggcggccggcgcgcatctagcacggggatagggaacatgataaggtgtcatcctggcaagaccacctcaccatgtttacccccacctacagctctgcaagtacaggtagaaagcagccgacaaactgggggccagagcaccacgccagacgccaggggcggagaggaaatcaaagccgccgggtgcctcgtggtggcaccagggcgggatcttcttccctgttgcccggaaccacggcgggggtgggtgagccgtcacgagcgcggggagggtgggtagctcagcagcctactagatgcagtggctctggaatggtgggtagggggatagggtatggatttggctatttcgggaaaggaaggttctggaaggcgaggggacgggggatggggatcccgccccgccgcgcggggcccggaact

SEQ ID NO: 23551 - DNA, 1591 bp, Zea mays
  misc_feature (12)..(81): n is a, c, g, or t
taaggcgaatgnnnnnnnnnnnnnnnnnnnnnnnnnnnnnnnnnnnnnnnnnnnnnnnnnnnnnnnnnnnnnnnnnnnnnntttttttttttttttttatcctctctaattattattacactaaatcaggaaccatgagggcctagggaattcatcacgttagtctcattcaatcatcttacacttgctaccacacatctaacaacaggacgtgaaacatacatagagcattctggtctgctactgctaacagctccacaaccatctgggcattatttatgctaagagcatgctggtgacatacacgtactaacgtattactgggggtgaagttgcttcgtctgctgcttcatctcttgcagcagttccgggcagcattgagctgctccatcagatcctgaatggtggaagaggcctccgtgagcttccgcttcaggttttccacctcttggtcgtggcacttcctttcttctgcaaagagttctaccgttgcttcttgctctttaattgccaactcgagttgcctctccacatcctcaaacctctcggtcagagacttgttcttatcccgctcgatttgcagttcccttgataatgattcctgcaccatcaagattctctcctttagcgatgaattttcttccttcaacttcttgatgatagcttcagggtcaacaatggattccctgtctccattagttgttgcatttacttgcttcgattggtatttggcagcaatcctctcacttcgttttccttcattgggagttggtggcaaactagtccttaggataggggaagttgatttggatggggcgttggcagtctcagtctttccaccatctgtatttgacaagccatgcaaaactgatctttcagatcttatggtatttgcagacttttcagctctgtgctggcacactgttgttgaagagaactctctattgggaccactaagcttggaagtttctggggatgacatgcttgcattcataatattatttgttgtattagaacatgatctgccatcacttctgatcgtttgcagataccctgacttccaggaaccttggccaaatggacgcaacgacagtcctgttttcctttttacagaatctgtgctagcatcattggttccatagccaattcgatggcgattatcagaccaatatttcttctgcattcggtttaatcgtgcttcgagtcttgcaaggcaatttgtgcgttcaaagtcctgcttgtcatgagctggttctacaaaatttacttccagtacacctatgataccacggccagcaactccagcagaagtccatactctccaaaaaggctttattaggcgattcttgtggtaaacattaaacccttgaatatcaatatgttgtctcgcatccttaacaaaaccaattgtcaccttagctgccacatgcatatcctttggaagtccatcgcccactgttggattataagtaagttgcttctttagcatgagatcattgataatgttatggtggtcaatcttttttccccgtaaaatcatttggaagttatccgggagcataagatataaaattgatgcataactccttag

SEQ ID NO: 23552 - DNA, 3876 bp, Zea mays
ttactcactatagaaaaatacatatatcttttattctaattatacaattactttaaatagccatacacctaagtgtactagtctatatcgcaggtgcttgtccactggtttgtaggggaaacaaaagaacagatttgcttgcactcaaatatagtagtagtaatagtaggctggagtgtactgtagacggagaaagctgaacgaatggtcccactctatccaatccatacgaagagaatatgcttggcctgaacagtggacatccgtcacgtttgaacggagcgaaaaaatcggagcaatggaggcggcatcttcggccacggatccaccgcccatggcggcgcgtttcgtttctccgttaccttgtcaaaatatatcaaccggtacagccgtgcaggcgcagtgcgttgacctggtggatctttgatctgtccatttaaatttggcaggtgtaattgtcattttaaaatttggcgtgcggcatgcatgattactgatcacataaacaggtttgaccctccgattcgagttcacttgcacacgacttcacactctccctcatagttgggctgacgataccagccatgccctcctccctccatcgccgccggctcctcctcctcgtcgtcgctgccgccgcgctgcggggggcgccgttggcggacgccggcgcggacacctgcaaggcgtggttggtgcagtccatccccacggacatgccgcacctgagccgcatccccggggtcctatccacgggttcgtctctctctctctctctctctctctctcgtctatgggggtttgccagtttggggaatggggagtaggcgtatgctgaattggtgatacatagctggtgatggtggtagtgggtttgtgaaattactaatgcttcttgcagccgtcactacgtatatccatccattgggctgctgatttctgtgggtcctgacctcaggagatgtgctccagtggctctcggggaatgcaacgaagagtctggacatccttgcgcagtactggcagttcttgccccagccgaacaatccgaaatcgggggactacgggttttccgagagtgacatgaggagattcggggccgatgagggccgccgggtttacaaggcaccgggcatgcctgcagaccgtaagatcaaaatcaggcaagtatcgagtatcatacttgaactgtcagtttctataatgttggtgattattacttaaccataggatgattggaatagtagtagagtatgttggaacattgacatatagttatcggccaacagaaaaactggtgtcacaattgaatcacaaagaagagaagtgataaagcaaacaagcaaaacatttataaataactaaacagtgtgtccatgtagagatttcgtttctctattgacaagctgtggtatcatttcaggattgtccagcactctggatttgctcctgattttgaccaagagagcgcagacctggctgcaggaagaccaaatgttgagaacgcaaccgttcttttcgaggactggtggggatctggtgttgtgcacgcaaaggtctggatatcagataagaaggatgtgtatataggttccgcaaacaacgactggaaatcccttactcaggtatatccgacaaaaaaaaacaggctctgctaaatttgcagtatggtgttgagaaaaaaaaaaatttggtaaacctgtgtggcactacttttacatgcattgcaggtcaaggagcttgggatttattttgctggttgcccacagatagcaaaaactgtggaggtctattttcaaaacctgtggacgctttcaaccctcaactcaactttttacaccaaacaagcctgggatacgcagtggcaagtttctagaaaggttccatgctggtctcatttcctacagcccaaagaaagatgcaggtttgcatctccctctgcaggtcacatgcagcgatctactacttagtgcacaaatttgaaggggaaaaatggctggtacatagatggcaataaattatgtacaatctaagcacacaattttgaaggaaaaaaaatggctggtacatagatgggaaataaattatgtacaacctatccattaacctatattgtctgcatttatcttagtgctgatccatcttcgattctgaaaatgctcggtacatacgatcctttatacctttgtcactcatctttataatgattcagtggctgctaattacttattaaatcctgtcttgtggctccgtcaaatgccttaaaaatattcaagcatggtattttccttttagactttttttgctagatcaaataaagagatttattcttaatgtgcgaacaggtcacccataccactttcagttgacatcccatatgtagatggatatccagctcttgcaaatcctgaaatgattgatgtttcgtttgaaacccctgggtacaagaaacctactcaggagcactacttgagctacctttcctttgcgccacctgaggtaactttgtagcacattatagacatctaggtattgctagtccgtagtcttcagtgtatcgatgcttttgtaaactaacttttagtgtaaactcattgatattcatggtgatatgtacttatgcagtgcatattcaatggaatttttcagtgtgcgaggatgccaagtttgtttgtctacatcatctggttggcctaagaaaaaagtcatctgactgaccttgtactttcacccatacatcaacatttttcatatacatacattaagtattcatgtttcattaccttaacttatatgacataatttttcgtaaacattgaattaagacatgcaatataataaggtgttgtttggtttataatttgtaacgtaaatggtaatgggtaataggtttgaatagaccggtatcagtttttagtgtggtctctgattacggttggacttaaacaaacatgatttaacgttattggttactcatcatattacaattatgtgcagcacctaaaagataactggtcccggggactaattaatctagtaagtagtgcatttcgggacgttggtttcatcttttcttgtttcacaggtgacatttggcagattccaagcagatgagcaggggtgggttgacaccatcaagtctgttaagcttgggggaattgtaagaatgaataccatggattggcttgggcagtcacagtatgctacccaaacagtctactggtcatctttatcgtcagcaatctcagaggtattcacaactggatccaacatttgaccctggcaaaaaaaaacccagatttgctctcttttctgaaggtttttcttcaatctacctctaattagcaacaaggcagtgctctgacaccaagggtaaactgactctcgccaggtagtattctcaaagaacgcgaccgtgaggctactcgtcgcctactgggcgcatctcatcccaaacaccgagaaatacctgaagagcctactgtactccaacgttctctgcgcgtcttcggcgtacaaccactgtggcggcaaggtcgagatcaagtactacgtggttcctgggcacaacgagaccggacctgctctgtcccagggcggcgccgcgacggggaaccgttaccctggcttcaccagggtgaaccacggcaagtacgccgtcagcgacgtgagggcgaacgtcggcaccagcaacctcatctgggactacttctacaccacggctggagtcagcttcgggacatacaaccccagcattgtcgcgcagctgcaggatgtctttgatgcggactggtattctccttatgccgtgccggttgaaccgctggaagagtctgtgtaggatcagctgagagtccaatcctcttttgcgtgtgt

SEQ ID NO: 23553 - DNA, 1095 bp, Zea mays
gcatcccatccatcgagctgcccgcgcgcggcagttaagctcacacatcagctagctcaccttggacggccgaccaggtacgttgcgagcgatggcgggatacaaagcgtcgggcggcacggcgctcggcgtcgtcctggctgttgccgcgctcctcgccgcggcggcgatggcggtggacgacgagcacatgtaccactggaagtgcttcaactcgtgcacggggaagtgccgcgacgaggacgcctttgacgacggccaccgttccggggattcgaacgtctcttccgtcgtctctggcggcaagtgcaacaacaggtgcctcagcgagtgcttcgaggacctgccggccatctgctaccaccagtgcgtcgtcagcaagtgcctctgcttcccaccctttagcaaagagaaaacgatgtgcatgaagagctgctgcaacaagtgcttccaccacggcccgccagcgcctggtcctggcccgaagccgaggccgccaatgcctggtcctccgaagccgcctgccccgaagccgaagccgaggccgccggcgccaaagccaccgacgcccaaggcgccgccaccgccaaagaagccgtgtccctgcccgcccggcagcgacgaggcaaaggccgacagcaaaaactgattcatacgatgggatggatcggccagtcatcatcagaagcactcatatagtcatatagatagtatacttcacatcgtaagtacgcgtgtacgtgtaacgtacgtactcggcaagtaggccccactatatacgacgactcgtatgtgtacgcagtgggagtcccaaataattgttgctagcaagaaaggcgatgatgtctccgttgctgtaaactggcatatgcgtattatatatgatgatgagctgaaatttatctccgattctatgtactgcgcagagtgcgcagaggcacaatgcgcatattgttatattcaacaggatctctagagtagatcagtggggtaatctatgttctatgaagtaatttcgggttcgtaagactatctccattagtttatccatcctcatacccatattcaaacttcactctgcgaataatacaaaaa

SEQ ID NO: 23554 - DNA, 1063 bp, Zea mays
ccggccgggacccgccgctctgcctcccccgcggcgaatcccgcccgcgcctcccccgccatagaacccgcctccaaccgtgaatcgcccgccgtgccttcacccgccgctcctccatctcctcctcctcgtcgtcgccgccgccgcgctgcggggggcgccgttggcggacgccggcgcggacacctgcaaggcgtggttggtgcagtccatccccacggacatgccgcacctgagccgcatccccggggtcctatccacgggagatgtgctccagtggctctcggggaatgcaacgaagagtctggacatccttgcgcagtactggcagttcttgccccagccgaacaatccgaaatcgggggactacgggttctccaagagtgacatgaggagattcggggccgacgagggccgccgggtttacaaggcactggaaaatgctgcagaccgtaagatcaaaatcaggattgtccagcactctggatttgctcctgattttgaccaagagagcgcagatctggctgcaggaagaccaaatgttgagaacgcaaccgttcttttcgaggactggtggggatctgggtgttgtgcacgcaaaggtctggatatcagataagaaggatgtgtatataggttccgcaaacaacgactggaaatcccttacttaggtcaaggagcttgggatttattttgctggttgcccacagatagcaaaaactgtggaggtctattttcaaaacctgtggacgctttcaaccctcaactcaactttttacaccaaacaagcctgggatacgcagtggcaaatttctaggaaggttccatgctggtctcatttcctacagcccaaagaaagatgcaggtttgcatccccctctgcaggtcacagcgatctactacttagtgcacaaatttgaaggggaaaaatggctggtacatagatggcaataaattatgtacaatctaagcacacaaatttgaaggaaaaaatggctggtacatagatgggaaataaattatgtacaatctatccattaaaaaaaaaaaaaaaaaagcggcc

SEQ ID NO: 23555 - DNA, 1608 bp, Zea mays
cataaaaattgtacttgtactcgataatttgggacgatagccctgaaccatatagagcttccaaagttaacaacacatcatcatgcaagttgtacacgatattttgggccaagacgacatcctgttcctgtacggatatagtgaaattgttgtagaggtctttaacgcctaaacctactcgaccatagtcagaattagttatatttactaaatctagaatgttgggtagtaaaagggaggcaaccggagctatccagcaatgatttacagatttacatgtaccgcagtctccgccttttccccccgtgttcagaaagaaacgactacattagcaccacggattcgaacgggagcagccagttgtcaatgagtcacctgccccacctaagctcggatgatggcgtttcagcagaagctgtgataatcgacagcggctctggtctgaaatctccaggagtctgggtcctggtatggttacctctcagcatccaattccaaatgacggttagctggttcttgtaagcgtttatttcaggcagcgtgagtcaaaagaggctggtatttggtgtaatctatcccattcaacctaacacagcataagatttgttccggcagttcttcagctttatttccctgaatagttagcccaacatctagaacacatgcttttagcctgtccaaaaatgttgcaaaacctttccttgagatgtagctaaatctgtgcatgtcaatgtcgatctcgaagtagttatcacccaggtaaaactcatgctgtggtctagaaaggacaggcttctcgttatacgcatgcattagcttcctctccgctgcactcaaaggaagatcctccagattagccaccctgccaagtatcttcagccgctctcggaatggtatagtcgtttccattggaaatgcttttatcttctctacatggtcgtcaatcaaccttctaatactttcaatgaatgaaggtggaagctctttcgagtaaccatcagaaagcctaaagtacaaaacaaagctcatcccttccccatcagtctcattctgaaataatgaagctggatacaatggcacctgtacattgaccaccaaaagaggtgggagcttgctggagagttgaatatcaggaagttcaacaaatcgagatatatgattgagtttctgtggcgataagtacacatcaactccaaatggataatatgcagcataatttggagcaagctcttttttcttatccctaaaatagtttgctccacggactcggaatgtaccaggatcaatatgagtccaactgttgggcatatttgtttccagcaagcacaactgtacttgagaacctgctagaggcctttccaggaaatccttcgtagatagtagtgtggaagatggatgagcttcccctgacttcttcttgaaggaaagcttcaaagaaggcatcctcattgaatgagtagggctcgaggaaagagttctcttcttctcgcttaccccaacagcagaggcaatgcagggtagacaattatttggcagaagcccgcaaacttccagtatcctctctccaccgtgagtgttgtccgcaccagaaaaactcaccgcatcctc

SEQ ID NO: 23556 - DNA, 1087 bp, Zea mays
gctatataacattttttatatttttgcatcggattaatccagtcaaccaaacatcacatcgttccctgtcagtctggcttatcgcatacggccaaaccaatcagtcaatcacatatgcttgtaccaaatcaatgtgtcctggctccacatcgcagccgagcaaagcgatcaatcacgctgtactgtttttgttcagctcctaattttttccctgaatttgccgccggaggcaaccgaagctatccagcaatgatttacacatttacatgtaccgcagtctcccacctttttttctccacgtttgcagaaagaaacggctatactagcacagcaccacggattcaactatattagccaatggtcactgagtgattgaccctctgttaatgttacctgtgtgaactaagctcggacgatggcgtttcggcagaagctgtgatagtcgacagcggctctggtctgaaatttccaggagtctggtccagttatggttacctcacagcatccaaatgaaaggttaggtgattcctgtaagccttgatttcaggcaccgtgagtcaaaagaggctgatatttggtgtaatctatcccatttaacctaacacagcataagatctgctcgggcagctcttcagctttatttccctgaattgtcagcccaacatctaaaacgcatgcttttagcctgtccaaaaatgtttcaaaacctttccttgagatgtagctaaatctgtgcatgtcaatgtcgatctcgaagtagttatcactcaggtaaaactcatgctgtggtctagaaaggacaggcttctcattataggcatgcattagcttcctctccgctgcactcaaaggaagatcctccagattagccacccggccaagtatcttcagccgctctcggaatggtatagttgtttccattgggaatgcttttatcttctctacatgatcatcaaccagccttctgatactttcaatgaatgaatgcggccgccctcgcgggtccccatcagaaagcctaaagtacaaaacaaagctcatcccttccccatctgtttcattctgaaataatgaagccggatatacc

SEQ ID NO: 23557 - DNA, 926 bp, Zea mays
cccacgcgtccgcccacgcgtccgcccacgcgtccgcccacgcgtccgcccacgcgtgcgcccacgcgtccgcccacgcgtccgcccacgcgtccgtaggcgcctgcttccgtcccacgctccgtctttatttgtaatctgaagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcagggacgacccgatgggggacgcggagatcgacgtggcgccgctggtggaggcggcgaacgcgagcccggtaggcgagcctgaggaacggcgccatcatcctgtcggtgcggccgagcgccacgaactgcctcgccgacgagagccacgtgtgctggaggaacggcaagttcgcgcaggacatgatcctccggctcaggaacgtggagagcggggagattcagctgcagctgcagtggctcagcatccctcctgctgcagccagcaggtgaaggaaggaagaacaggcgaaacgaagcaatcgcattttcacctctctgtgaatgtcggattgtaaacttaaaccagcaattaatggggtcagggtcagtcagggtagttcatgtgttgccatattaatgtacaaagttggggacagcatgaaatccaagccaagtcactcaagtgttgtaggatccttcctgttcctgtttgtgtctggtggtatacaacaataaatggtgcaaaaaaaaaaagtcgacgcgg

SEQ ID NO: 23558 - DNA, 1107 bp, Zea mays
tagcggtctgatcgtatccgggccgccccacgggacacatctctagtagcgaaaggcaagggacgtaagaagtcgtctaattcttggatcgaattagacgacttcttcgtccctctcttcattagcacgctaacttgtaatctgcaggatctaagcaaagacttgatttagttatggacggattggtaggcctcttgaaagttcgcgtggtccggggtatcaaccttgcctaccgcgacgcaagaggcagcgatccgtatgtcgtcctacggcttggcaagaagaaactgaagacaagcgtgaagaagagatccgtgaaccccatatggcaagaggagctaactctgaccgtcacagatcccagccaaccactgaagctggaggtgttcgacaaggacaccttcagcagagacgaccccatgggagacgcggaggtggacgtggcgccactgatggaggcggtgagcatgaacccgcgggaggagagtctgaggaacggcgccatcatcaggtccgagcggccgagcgccaggaactgcctcgccgacgagagccacgtgtgctggaggaacggcaagttcgcgcaggacatgatcctccggctcaggaacgtcgagagcggggagatacagctgcagctgcagtgggtgaacttccctcctggtcctgctcctgctgctgcaacaaccaggtgacctgatcgatggtagctgctgttcctgtcgccattgcctcctgctggcaggaacaggaactctctgaagcacggggtcagggtagttcatgttgcttcgattcgatcgtaggggagataatgccggatggctttgtaaagtttgggaggacatgcatcataattgaagtcaagtgataggatcctgttttttaagtacacgatacaacacaatcttaacatactccctttgttttaaaaaaaaaaaaaacatttaaatataattcaaaaaaaaaattacatataaaataactaattctataagctactaagtgctgagcctttatcttaaacatatactataaaaaaagggcgggcctctttaagggaaccatgcttcgtaccccgggcatgctaagtcaaatctttttttt

SEQ ID NO: 23559 - DNA, 1497 bp, Zea mays
cccacgcgtccgcccacgcccccgcccccgaaagaagtcgcctaattctttcgatcgaattaggcgccttcttcgtcccacgctccgtctttatttgtaatctgaagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcagggacgacccgatgggggacgcggagatcgacgtggcgccgctggtggaggcggcgaacgcgagcccggaggcgagcctgaggaacggcgccatcatcctgtcggtgcggccgagcgccacgaactgcctcgccgacgagagccacgtgtgctggaggaacggcaagttcgcgcaggacatgatcctccgcctcaggaacgtggagagcggggagattcagctgcagctgcagtgggtcagcatccctcctgctgcagccagcaggtgaaggaaggaagaacaggcgacacgaagcaatcgcattttcacctcttgtgaatgtcggattgtaaacttaatggggtctgggtcagtcagggtagttcatgtgttgcctattaatgtacagttggggacagcatgaaatccaagccaagtcactcaagtgttgtaggatccttcatgttcctgtttgtgtctggtctacaacaaaaatggtgctgcgccctgcagccgtgcaggggataaaaaggccctccagatccagacaaaaggctggaggagtggtaggataccataccatgtggcacaatggaatgcatgcaatgcaagctgagctgagtatagaacaagcttcgttctcgtcagtgccagtgcacgctgatggggcgggcagttcaggttcagtgctgaatgaattgcaaaagctgcatgatctggcacgggtcgtcgtcgtctcgtcgccggccgccgggggcttctccaccgcaggcgcggcgatatcccaaaccagtggccgttgatccgcgtctcctcttatcctctcccacccaaaattctccacggtcgcaacgcgacaagttcacattatttattccaaacctttctgcctccagccagcagtcagcacagcagcggtagagtacaaatcctcacctgcccccctgcttcctgcttttcgtcctcatccacccacaggccacagtccactcacaactcccccggaacggcggcggcggcgacggcggagtaacgcggccgcgacgcaagatggcgaggaaacctctcgactacgaggagctgaacgagaacgtcaagagggtgcagtacgcggtgcgcggggagctgtacctccgcgcctccgagctgca

SEQ ID NO: 23560 - DNA, 1000 bp, Zea mays
  misc_feature (16)..(16): n is a, c, g, or t
cctatgggcgattggngttctcgagggcggccggggacttcttcttccctctctccggccgcggcccgacctaactgtaatctgcaggatctaagcaaagacttgattcagttatggacggattggtaggcctcttgaaagttcgtgtggtccggggtatcaaccttgcctaccgcgacgcaagaggcagcgatccgtatgtcgtcctacggcttggcaagaagaaactgaagacaagcgtgaagaagagatccgtgaaccccatatggcaagaggagctaactctgaccgtcacagatcccagccaaccactgaagctggaggtgttcgacaaggacaccttcagcagagacgaccccatgggagacgcggaggtggacgtggcgccactgatggaggcggtgagcatgaacccgcgggaggagagtctgaggaacggcgccatcatcaggtccgagcggccgagcgccaggaactgcctcgccgacgagagccacgtgtgctggaggaacggcaagttcgcgcaggacatgatcctccggctcaggaacgtcgagagcggggagatacagctgcagctgcagtgggtgaacttccctcctggtcctggtcctgctgctgcaacaaccaggtgacctgatcgatggtagctgctgttcctgtcgccattgcctcctgctggcaggaacaggaactctctgaagcacggggtcagggtagttcatgttgcttcgattcgatcgtaggggagataatgccggatggcgctgctcatgctttgtaaagtttgggaggacatgcatcataattgaagtcaagtgataggatcctgttttttaagtacacgatacaacacaaattttaaaaaaaaaaaaaaaaaacaaaaaaagacataaaaaggggcggccaaagaaaataaaaaaaaaaaatataactaaaaaaaaaagaaaaaaaaaaaaaaaaaaaataaaaaaaaaaaaaggggcgcccctttaaaaga

SEQ ID NO: 23561 - DNA, 865 bp, Zea mays
  misc_feature (1)..(1): n is a, c, g, or t
  misc_feature (10)..(10): n is a, c, g, or t
nccacgcgtncccccccgcgcccgcccacccgtccgcccacgcgtccacgaaagaagtcgcctaattctttcgatcgaattaggcgccttcttcgtcccacgctccgtctttatttgtaatctgaagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcagggacgacccgatgggggacgcggagatcgacgtggcgccgctggtggaggcggcgaacgcgagcccggaggcgagcctgaggaacggcgccatcatcctgtcggtgcggccgagcgccacgaactgcctcgccgacgagagccacgtgtgctggaggaacggcaagttcgcgcaggacatgatcctccggctcaggaacgtggagagcggggagattcagctgcagctgcagtggctcagcatccctcctgctgcagccagcaggtgaaggaaacgaagcaatcgcattttcaacctctttgtgaatgtcggattgtaacaacttaaaccagcaattaatggggtcagggtcagtcagggtagttcatgtgttgccctattaatgtacagttggggacagcatgaaattcaagccaagtcactcaagtgttgtaggatcctaaaaaaaaaaaaaaagagggcgcccgctctagtggac

SEQ ID NO: 23562 - DNA, 1090 bp, Zea mays
acccacgcgtccgcttgcgatcgggcctcccggggccggccgggaacacacacttctagtagcgagaggcaagggacgtaagaagtcgtctaattcgattggatcgaattagacgccttcttcgtccctctcttcattagcacgctaaccagcttgtaatctgcaggatctaagcaaagacttgattcagttatggacggattggtaggcctcttgaaagttcgtgtggtccggggtatcaaccttgcctaccgcgacgcaagaggcagcgatccgtatgtcgtcctacggcttggcaagaagaaactgaagacaagcgtgaagaagagatccgtgaaccccatatggcaagaggagctaactctgaccgtcacagatcccagccaaccactgaagctggaggtgttcgacaaggacaccttcagcagagacgaccccatgggagacgcggaggtggacgtggcgccactgatggaggcggtgagcatgaacccgcgggaggagagtctgaggaacggcgccatcatcaggtccgagcggccgagcgccaggaactgcctcgccgacgagagccacgtgtgctggaggaacggcaagttcgcgcaggacatgatcctccggctcaggaacgtcgagagcggggagatacagctgcagctgcagtgggtgaacttccctcctggtcctgctcctgctgctgcaacaaccaggtgacctgatcgatggtagctgctgttcctgtcgccattgcctcctgctggcaggaacaggaactctctgaagcacggggtcagggtagttcatgttgcttcgattcgatcgtaggggagataatgccggatggcgctgctcatgctttgcaaagtttgggaggacatgcatcataattgaagtcaagtgataggatcctgttttttaagtacacgatacatccctttttttatttgtcgctctcatcagtggacgactgttgatggggtaggttgagtgctgtgaatcgtggtgcagcgatcgcagttgcaaaagttgcagggtcaggctgccgcggcaacgagttggtcgtctactcacctcgccggggctttactta

SEQ ID NO: 23563 - DNA, 780 bp, Zea mays
gccggcccggccggggcaaaagcacttcaccagttcacccactaggactaggagcaggagaggggagagaaaacctcgccgtcaatgtcagcgttcgttcccaagggcgctagggtttaaccccccaactgttcggtctctctctctccccgaatccaattcagcgtcatctagtccgggagcctgcgacatggggtacctccaggaggcccgggagaatcacgtcaagaagaaggtcgaggaagctttgcggagcaaaatgaaacaaaaggctcttcaggaatgtgatttctattgttcaaaatatgctgagtgtgcacggggaagaacattttctgtggtatggcaatgccgcaaacaagcaaaagagttgaatgagtgccttcatcaatacacaaatgatgcaatcctggaagaaatgaagaaggcttatatgattgagcaaaagagcaaggagataaatcaataagcaaaaatccattgcacaatgtgcatcacgatcaccctgcttgtatgtatactgttgcctttgatagatactattcatgggtagtgttgcaaacattgttctccccacatgcataacctgatactagtattgggtggcaaactggcaatcttgctgtttctgtcgaacatgcgatataagttgttttcttctgttgcaattttcatcccaaatagattttgtttggatgcagataacacaattgtatttttgttgccctgctaccattagctctagttccaccaagattacatattttgcttcaaacggcc

SEQ ID NO: 23564 - DNA, 818 bp, Zea mays
ggggaggggggagagaaaacctcgccgtcaatgtcagcgttcgttcccaagggcgctagggtttaaccccccaactgttcggtctctctctctccccgaatccaattcagcgtcatctagtccgggagcctgcgacatggggtacctccaggaggcccgggagaatcacgtcaagaagaaggtcgaggaagctctgcggagcaaaatgaaacaaaaggctcttcaggaatgtgatttctattgttcaaaatatgctgagtgtgcacggggaagaacattttctgtggtatggcaatgccgcaaacaagcaaaagagttgaatgagtgccttcatcaataaataataggagatgtgtgtatcattgcattaaggagataaatatgtaaattagaagacatccaccatgttcaccccctcatccccacccacccagtccacacactttcagcacaaatgatgcaatcctggaagaaatgaagaaggcttatatgattgagcaaaagagcaaggagataaatcaataagcaaaaatccaatgcgcaatgtgcatcacaatcaccctgcttgtatgtatactgttgcctttgatagatactattcatgggtagtgttgcaaacattgttctccccacatgcataacctgatactagtattgggtggcaaactggcaatcttgctgtttctgtcgaacatgcgatataagttgttttcttctgctgcaattttcatcccaaatagattttgtttggatgcaaaaaaaaaaaaaaaatttttgttgccctgctaccattagctctagttccaccaagattacat

SEQ ID NO: 23565 - DNA, 1612 bp, Zea mays
gcacgagaccattacctacaagacccgccccgccggatcacccctcgttgtcatctcatatccgatcctgagccagagatcaaacaaaccagagggagcgaggcatggcggcaggcttgcaggtgtttggccagccggcgtctactgatgtctccagggttctgacatgcctgtttgagaagaaactggagttcgatcttgtccgcatcgatacgttcaagacgcatcacaagcttcccgagttcatcaggcttcgggatcctaatgggcaagtgaccttgaagcacggcgacaaaactctcgttgattcgagggacatctgccggtacgtctgcacccagtttccaaacgatggaaacaagagcctttacggatccggcgctctagaacgggcgtcgatagaacagtggcttcaggcggaggctcagaacttcgggccccccagctccgcgctcgtcttccagctggcgttcgtccctcacctcacccacctgggcgttcgtcaggaccctgccgtgatcgccgagaacgaggataagctgaagcaggtccttgatgtctacgacgagatactctcgaggaacgagtacctggctggcgacgagttcaccctggccgacctctcccacctcccgaactcgcactacatcgtgaacaccgagagaggaaggaagctcttcactaacaagaagaacgtggccaagtggtacgagaagctctcgaagcgcgagacgtggaagcaggtcgctaagatgcagaaggaacatcctggtgcgttcgagtgattgcttgtcttggggggagctgcgagtgcaccatcatgaatggcttcatcgtctgtgtcggtctggctctacagttcattttgtttttgagtgatccattgtttaatttctcctatcagtgttgtcgtgtgaaccaaaaataatgtgaagcccagctgtgatgtatatgatccttttgctctaatctatcatgacgtataagctcgatctctgaccttgtacgcacagtattttttttactgatgatttcgatcgagacatacagtagaaagtcttttctgttctgccagtttcgatgaaccaaacccctggtttgatgcgtcgcctttggttaactgtatgccgtaaagccaaaatttgacgccttttgatgattcgaagtacatgaacggtttcgaactcgaatgtactagtataggcaagatatcagagtgccaggctccagaaagagcgtactgtccgctcgactaaaggctatcggttagcttttgctgatgtttgcgaaactttgaagcgcgtccaaaccagttgtctagattgtttttattctacttctgaagtccagaatagttgatctaaatgagttttagatctgactcgctggcccatgcaagcatcaggcatttcaagtcagatggtgcggatctgccaccgtgctggtatgctgtggccaagtaggttatctgtaatcacaaccgagtgagttcagtgctcaccacaatgccatagattctgagaaaagaaaagcaatgtacttcacttgtgcaacgaacgagtttccagaacggacaaccaaaggcaccgaaacatgaaggcaggggtaccga

SEQ ID NO: 23566 - DNA, 1330 bp, Zea mays
gctgtaaaaatctggctttctattgaaggcagcagacatatgggctctcctagattttagcctaatgtaccattttccccactaataaccacattaaaatttgacagtgtacccaggcttcaagcacgcactgcagcaactgtcccttcatataaaaacccatgcgcagccaatccaccggcgtcacctcttcctcccagagacggttttcttgacagcgccaacggagaccaggaactcgtccagagacgagagcgtcttcatgtcatccggagggaagtagctggccgccttccccatgaaggaggcgaggagcagcgagaggccgggagccggggcggcgcgctcggggaggaactcgtcgaggaaggcaaaggcagccagaaagtctgaccggctcgcgtttattggggctgcgaagtggcaagggattatccgtcggaatcgccagtcggcagcgatcctgtcaacccagtccctcaccttctctggaactttgctgaaaacgagcgtcttgacaataggtgagacgatcaatttttgcgacatttgagcaaaacttgcatttggctcaagtagatttgacggaccaagaaatagtatttgaagtaccattctctcccaccctttctgacggtttagcttattgtcaacaactggttcatcgggaacctccttccctttgctcaatagcttcactgccagtccattcttcgcagatgccaacagagattctttgctgatacactccggtggctgttgaggaacaaagatgacagcatcggtcaccagtagtgtccgtgaaggcttatggtagaacgccacctccacatatggcccaatcccaacttccggagagctgagcaccttctgctcgatttcggcgacccagggcgtggcgtcatcctcatctttgagcggcttggcccggaagatcccgaagaactcgagcggcaggttgattggccagctccactgcctgggcgccacccatatctgagccttggggaacttcctggagaagggcccgacgaagattttgtgctcgtatgcgaaggtcggcagcacgatgtgctccaccggcgcgtccagctccttgagcatctggatgcactccttcgtgggcgcgatgggcgcgtgcacccagagcccaccggacttgagcttgatgaccgtcatgcggatgttggtggagacgctgctgaagcccagcgcctgctcctgctcgaacagccatatgctgcccttcaccgcctcggtgcggatggtgcggcggttgaggaacgggccgagcgggaaggggaacccggtgaagttgaagtagaaccgc

SEQ ID NO: 23567 - DNA, 3479 bp, Zea mays
ctaaggtatgatggtacatgaatcgtcccatgactagggatgaaaatagatacttattcgaatatcatttttccctttgattgcaaataaatatgatatataatatgctatgtaaatttatattcttgtttttagcattgaccttgtaaatatttatgaaagataaacctcaaatctatcatatatcttctcaaatgatagatataaaattcggatatgaatactgatatttttcaatttttttgttgttggagcaaataacgtataaaacaatttatataaaattttattgatatttataatatgtacttaataatataagaaaagatcaacattaaattaatacatatttattttaaaatatttttttcataatacccactttcatccataatccggacattaacagttcaggtgtaggagtgagctttttcatcgtttgatataataacacattattgccattttttcaggctactgttcaatacaagctctcagaaatgtctgtttaactcgaattctgggttgcgtactcgttaattgactttcacttgtttaaaatagttccgttttctcaatttagcgttacacttttgtcccagctccagagctcctcatgcgcctcacgccacagcttttaaagcccaccgccctcctaatttcgctctcacgtcggtccctcgtccacctctgccctccctcccaaatcccactcatcctccgtctccctcgcgcgtcctcgtcgacttgactccttctctccaagaaccagaccagagaaacggacgggccacctgatcgatcaggagcgcgcggccgcagccatggagctgtcatggtgccggggccttcgcctcctgctcgtggcgtccctgctcgtcctctccgccgcggcggtgccgccctcgcgacgcgtggggagccagcctccgcccgagccgtccgccgccgacgcgctcttcggccgcatgtgcgaccctcgcggcgcgcacccggcgccgcccacctggtgccacacagtgcaccccaggcgccacgttggggccgcggggcaccgccgccaccaccggcccgtgccgatgccgcctccgggccgcgacggcggcggggaggaggagatcgacgtgcgcttcggcgtctccaagcggctcgtgccgacggggccgaacccgctgcacaactgaggcgcacgcgtgccgcacgccacggcgcggcggcggtcagttcaccgtttcttggacgccgaggtcctgatgggccagcgcatgcaagcaccgctcctcggcctctcttgttcctgctttccggccgggcacgcgccacggcgccggaaaggacttacaatggaggaccgatcgacgcctgggcgtgcatgacaataacagagatactggtagagagtagatacgtgtgccatgtataggctcgtgcttcgtcttcgttcccgttccggtccataacttggccttgtcccttcgctctgtttcttgctggggtcctcctgtagggtagttgtagccttcttggcttccattgttcactagaaactgaaggttctttttttttctctctcgcggtgacgtccgcagaatttgtcgtttcgcccgtgtctttctcggcttctcgcccggccccggccgccggctccggcggaaaacgggagcccagacgcgccatcttttcggttccgtttggattcttttcagagttcggcggctgcagatggcgtcatgcgcgcgttactctcctcgctgtggtcggcgtcgcgtcggcgttgttgcggagcagcagcaccgcgccgcaagtaaatgcgctctgcttcctcctgtgagaggctgtgactgcaaaaggaggatgcagaaattaatggcgcgctccacggcctcgcctgccttccgcattgatgccatggcaattggcatcgacgacgcgccttcttcgtcacagcgggcggccgcgccggtagagcaggagttgcacggtcatggtgcggtaactaattccgcgactgacgacggcgttgttgtaacgaactttaaccgacggtgcctgacgaatgcgtcagtactaggagtaaactctgatgagtccagagttccaactgacagcgacaagctgacacctgaccgcactgcaccgtcgtcttcgtcatcgccgatgtgagatcacccccgttccccgccgccctccgcgcaacggccaaggtgaatcgggtcgggtgaacgtgcgccagcgggggtcgggcctcaacgaaatccacgaggctcggctggtttcgagacgtccgcccgtgcaatatggaacttctgtcagtgtcagacaatagtaagcgacgcagcaggcgtttcggcctgtgaagtgttgaactgcgatgcctgtggtcataatgagcttgctgttcgacgccctgccgcgtgaagcaaaccttggcgtgcgcctgctcgtggaggcagccctacagcaataactgaaacagagcatgcccggatcggaccgagaagtaatgaggtgtttggtttgatgaatcactctatccaaaatgaagtggtgcatcatgaatctattcctcaaatttggtgggatgactccattccacatattagtactaaacaactagctatgaggaataaggtggtgatggattaactcacttcattccacaaaccaaacaaaaaagtgaggagagagaagatgatgaactacatcattcctcaaaccaaacactccataactccttgccgatggccctcaccctcagtcttgtgcacactgcactgcagcctgaattatgaggaacacagaattcaccatcccgtggtaaacgaacacgttataggctagtttgatagccacaaaaccggaggggacacacgttataggctagtttgatagccacaaaaccggaggggactggaggtgctaaaatctctttcttatccaattttttaataagacagagattttagcccctacaatcatcaatcatctccagttttgtggcttccagactagcctcaaacacgacagaatatacctactccggtatgctccaagctggtaaattccatatgctgtaaaaatctggctttctattgaaggcagcaagacatatgggctctcctagattttagcctaatgtaccatttcccccactattttttttttgaagtgaatgtactgtagggagggcctacagtaatttattgtttcaaaaagctaagtcaaagagtgcaacttatagaaaaaaagaaaggaaaaaaggattacagtacaatattctgcaaccaaatactaattttctccttcagagaaggcttaactcgatgaaggcttaactcgatggcgcatcagactcatttcttttttaaacatttccttgtactcattggttgtggtggagtctagttgaaaatccaattgtttttgcttttccaaatgcaccaagtcataatgatgatgctttccaatcgccatggaac

SEQ ID NO: 23568 - DNA, 2120 bp, Zea mays
gtaaataacatttgctcctgcggaggagctattactttaaaggagccggagctagagctgtttttaaaggagtcgtagccctctcaatcggtccttaattatacaaaacgcttggttttacccatagatcttacaaactgaacttataacaatgtgctttgcgtgtaatcaccaccttgtacgagaaaatacttttatgggtaccgaaagtaaacgcttgacatcaaaacacaaaggatttgaatcgattggagtgccagacgcgaagacacatgactgctaggatgctcaccagtgctcaatctaggctaggagcacctcttcgatgagcctgtctacgttgcgcatagaccgtccgtcaggccctgcagcggccacggcgctgtccctgagttcagtcacgcgccggagcatctcttgccctttctccccctccatggcctcccgtatgagcgactctacctcgccccgctgtacatcgtcaccgatctcttttccgatgccccactcggtgcacttgtatcggcagttggtctgctgctcggcgaagaagggccagcacagcatgggaacgccgccgcaaatactctccagcgtggagttccacccggagtgcgtcaggaacacccccacggcatcatgctccagcacagctgcctgcgggcaccacgtagacagcatgcttcgtccctctgtcgcagctgagaactctggcggcagcccggcggagtcgccactcttgacgaggtccgggcgtacgttccataggaagtagtagccggtgttggccagcccccacgcgaactcgaccagctgctcgttggacatcaccgtgatgctcccgaagttgacatacacaacggagcgcggcgcacggccgttgagccaccggagcggcgcctcctgctccttccacaggttggacccaatagcagcgacaggactgttcgcctgcacgttgttccgcaccgtcagctggagcgggcccacggtgtagatgggcggcaggagcttcgccatggcagcgagcagcgtcgcgtcgagctcgtcgaaggtgttgatgaccaccgccgacgcctgcgacatgccctccgtctcgtggatgaagaagttgagcatgacgtcgttcggatccgtggtgcgcacgaagctcgggaagtcccggagccgcaggtccttgggcgcgcccgggatccagtcgacgatggtgtctaggtacccgtccgtgagctgctcctcgttcttgagggggaccataccacgctcgacgaggtggcggtagtggaagtagccgatgaagccgcaggcgctggcggtccagagtgtagcgcagcggaggccgagctctcgcgcggcgcggagcgcgaaggtcatggtgctgtcgccgacgacgcatgtcacggtgggttgtccctcggcctcagcctcggcgttaatcctggcgatgagatccttaaaccggggcaggcaggtggtcaaggtggagtggcagagcgcggggatgtcctgggtggcgtccgcttcaaagagcgggagaccgtcgtcgatggcggcgaagcgaaacccatccgtgccgtcgagcgcgttgggccctcgcgcacgcaggtggcgtcgatgattgaactcgttgttgacgaaggtgacgtggaagccgcgagtatggaggagcttggcaaactgcagcatcggcgtgatgtggccctgcgccgggtacgggatcatcacaacgtgtggggggcgtctctgcccgtccaccggcggcagcgaacccatggttatgactgctttagctacttcctagtgcctatagtgcctacttgctactcgtggtggctaggctaccactactactcatttcaaggctccaagaagctcgctacaaaagctgctgagctgccttgctagaattggtgatttgccccccccgccgcggcgggcccaccgtttgataaagggattttcataagcgtgcccctagtctgaacgctttgctcacttctaccccgtccaaattctctgctcaattttcccctccccgttcacttggtcctcagaattcacatcacgggagtctttccgtccgttagtgtcggggaccataattaagggtaccctcaaga

SEQ ID NO: 23569 - DNA, 2461 bp, Zea mays
  misc_feature (1687)..(1687): n is a, c, g, or t
  misc_feature (2282)..(2282): n is a, c, g, or t
  misc_feature (2331)..(2331): n is a, c, g, or t
ttttttttttttttttgaaggatacaatacgataatataatacatatggcgcggacgcaggttccacaactgtctataaaagacagtgtacatgcagttacgaaacggtgatcagtacaacattacataactctaacagtctgcagctccatagactatacatgtacggtgcaacaagcagatgatcattgtatacaaaagcgtattgtaagcgttggtttgttgcgtagttcttaaaaagtctttggcacaagcacatcaagctgcttaggcttaaacatgaagggagcgaaacacgttcacgtcaacaagcatagaaatccagcgtggcctatgcataacatcgatggcgaacactgatttagtaataaccttgttaagtctgctctgggccaacctgtatcgagcgtgtggacatgaacgtgtatcatatatccttccgaaagcatatgtacatagcagcttggatacaaaagcagtagacaacgatcatccaaaagagcgaacaactgcaactgtgagcccaaaagacatgtgcccctctgtgactaagcatctttggtagggctaggggcagcagcgctatccgcggcatccttggagctagtgattcctccatctacgtcggtgaacaacctctttgtaactgtctttgatggcgaagaccttgtcctgggtttacgaagccgctgacaatgcgcaagtcgtggcgggcagcagcagcacaccaaatgctcccatggcgacggtgggtggcaaaaccgaagtgatgagcagcgaggaagacgaagtccacaaactctcagtgcagggctaaataagatggccaggagccagggagaggaaatattaaagtgatgaaagtactcaccgccgtaccgcacagagcgtggcgctgtttcggccatgcctggaactgctgacgcataggaacgatggagacgaatgacagcgtgtggacgacggctacgtgcccatccgctcctctccctgcagcggctgcacgtggacccgcgcggcggcagggaccacccagtagtgtcatccaacccgtggccgcttatattattttactcttcatcgtatgcaaaatcgaaatgggcagctccacgatgaagtggcggaagtggaaggcgcctgggtgaattggtggcacgggacgccaccacttcatcgtacgacagagcgtggcgcctgggtgagttggtggcacaggacgccaccgcacctcctttggctgccctcgatgcactgcgcccgctgcccgccggcgacgatgaactggtggagcgagacgggctgatcgtccagagaggaagagcggcgtctcgaatcagtgaggaagaccggcggcgcgaatcagagaggaagagcggcgtcgcgacggcagatctgggaggaagagcggcgcctggaatcagagaggaacagcggcgccgcgacggcagctcaccctgcctgctcccaccccgcgcgtgcctccaacggatctaaggacctaacggagaacaggaagtcgtcggggcggctgcgattgggaagaggaagacgcctggttgcgagcggaacaggaaaccgctcgcgagcggagcgggacagaaaaccgcgtcgcgagcggaacaggaagcggtcggtgtacgctgggactcacggaacgcgtcgcgagcggaacagaggaaacacttgntgggacccgtggatgacgcgtcacgcagtggatccacgcgaacctggcgaacgcgggaaagcgtccaaaaggcttcaagttttaataacttagatatcgtatatgcagcctactaggctaggcacgtagttagctggggggccaacttgcgtttggttggcgcgtgcacacttggggtggggccggggcctcagctcgttcataccaatgtgccatagtaggcacagtacgcgcccctgcgcggtggtggtctcgttgatggctatatggagcagggacagtagagatagtgcagcatctgatcctctggttgctgggacagtggcatgtatccatgtatatattacgtaccacgcaattcgaatcatctcaagctagcgtctgcgtatccgccggtatgctctcagggcctgtttagtgctgggaattggtctaagctcatcgtgtttcgtgtcaaatgggtttggatcaagaaagtccaaaaaaaaaaattggatcgtgcggtgtcagcccaaagtgcaaaaaccgtggctcagcccggttctaaaccacgtcgtgacttcgttggtgaccacataaaatcataatattacanccaaataaaatccatagcttactaaattaaatatattaaacaattgtancatcgtttgatcacataaacttcaaatatcacaacaatataaagtcggtagcctactaaattaaataaattaaacaacttgagcttaattgggccgtgccgggggcccgacgggccagaatttgaggcct

SEQ ID NO: 23570 - DNA, 1208 bp, Zea mays
ccccttatattttttttttgtttttttttttttttttttttttttttttttttttttttttttttggaccaaaatgaggcagacattatggagaacaaaactttgacgatgaagaaattaaaacaaacccctatttgtgttggagagaaaaactatatgtacaaggtatgtacgggcactaaaaaccaatgtcagattgcctatgtaagcttcggttgggtgatcctctgtggcatggagcacatgcaaccacaccagaagcagtaagtcaccacattatttaccttgcagttccatccaccagcaatggccaaccgcagtttattgcatcttcatcaacgaatttgactggttaaggaagggggagaagggggagggggtccattactagattttaagcttcatcttttcagctatgaatgcctttacatccctgcatctaggaaccgcgcagtctccgtcgttgcaatcttttgagtggcggaacaggagtttccacataaagagacactttttgcaaccgccgctattgcaggcacggacatggcatcgtgcaccatgggcgaacagtttcttcagggttaaacagagtggatgggtgcagttacgtggatcatagcacctcgatgcatgcacaaggccatcaatgtagtcctgtagagtgtgcttctgtgaagtttctctagtgtcaatctgccttaattcatgaatatgcaagccttgaccattttgtttatagcattgaccacaaaaggtgcagcctaggcactctaggcaccgccacaccaagcattggtccacggcacgatggcaagcagagcaggttgaattgtgtaggtaatacagaatcatcattgtagagtgctttgcccgccggatggtatcaaactggaattgattgtcttggcagtgcttcaagaaatcgatcctgctgtcaaaatacttactttccattgtcggatctccatcatcagtctctggaagaggttgtacctccattctttcgaatgcatgcttctgttttgtggtggccggatgcctgtccttctgtgctgtattctgctcctctgcatgacacttgtcacatagatggaaatttttacagctagtgcaaacccaacttttgccagataggataggatggtggcagtgcttgcaaaactgttgcagacaaagcataatgaagtcttctttcattgtgcgcatcc

SEQ ID NO: 23571 - DNA, 1367 bp, Zea mays
tttttttttttttttttttaagtttttttttttgcttttacgagaaagttttttttcttccttaaggaaatgtcgtcgttgtgatgtttgagaaaatatttacgaatacagaaattgtattgttctgagacttttctgtagcgatcttgagaaattttcctaagtgtcaacttcatccatcgagacaaaatgctgcctcaatggtagctgctgaagaggcaacaactactgtgagctctgctgaacaggcaactactattgtgagctctggctctgcactttggctttcagcgcttcaataaccgccgagaagtcgtggtcactaaggccgagcgattttgcagccttgtacagctcgttcgcagctgcaactgtaggaatggactgggacaccgattccgccagggccaatgcgagcctcaagtccttctgttgatgcttcagaggaaatgcaggaggatatgcagctttaaccatggatgggcccttgagagagaacatgggggcactgatagcaccctgggaaataacctcgacgagagtattcgggtctaaaccgactttttcactcaggagcaacccttctgagaaggaaaccatcatgctccccatgaccatgttaaccacgagcttcattgcagcaccattgcctacatcgccaagataaaaccttgacttccccatgacatcaaggaggggcgccactctcttgtacaaggactcatcacctgcagtaagaaagatgagcagcccatcttctgctggttttttcgagcctgaaactggagcctcaaggaaagatgctccagtacttgtaatgcgttcaccaatcagcttggatgtagcaccatcaaccgtcgacacatcgacatagcctttcccaggggccaacccttcagcagctccactggacccacatgcaacctcagccgcgctttgtggatcagcgagcatcgcgaatgtcacgtcacaagatgaagcgacttgggccggtgtaggctcgtacttggcaccgagactgaggaggggatcgcacttgctcttggtcctgttccaaaccgtgacgtcgcagcctgccttgatgaggttggatgccatgggcgcgcccatgatcccgagccccaggaaccccaccttgccctggaactccactcccccgccaccttgccacccggaggacgaggatgctgatgctgaggccgcggccgcagccgcgcgggacacgacgaggcggcgggacagcgtacgcgagggagggggcagcgcggcggagaagaaggccgccgcgggcatggctgacggctgctgttccggcctgcgggtgatgggatgcggggcgagagggataagggcatgtacgagacggt

SEQ ID NO: 23572 - DNA, 1171 bp, Zea mays
taccctcgaggccgccaaatccaacgaactgaccacaaccacctaagctaaaagctaaccaccagacccccggccatggcgctcgcgcccacttccgctgccgtgctcaagaccccgttcctcggggccaggcgcgcgctcgccaatgccgccgccaagcccgcgcctcgccgcgcgctggtcgtcgccgccgcggccgccgccaagaagtcgtggatcccggccatcaagagcgacgccgagatcgtgaacccgccctggctcgacggctcgctccccggcgacttcgggttcgacccgctggggctgggcaaggacccggcgttcctcaagtggtaccgggaggcggagctgatccacgggcggtgggcgatggcggccgtgctgggcatcttcgtggggcaggcgtggagcggcatcccgtggttcgaggccggcgcggacccgagcgccatcgcgcccttctccttcgggtcgctgctgggcacgcagctgctgctgatggggtgggtggagtcgaagcggtgggtggacttcttcaacccggactcccaggccgtggagtgggccacgccgtggtcccgcaccgccgagaacttcgccaacttcaccggcgagcagggctacccgggcggcaagttcttcgacccgctcggcctcgccggcaccgtcaaggacggcgtctacatccccgacgtcgacaagctcgagcggctcaagctggccgagatcaagcacgcccgcatcgccatgcttgccatgctcgccttctacttcgaggctgggcagggcaagacgccgctcggcgcgctcggcctatgatttgcatgctgccggcgaccgagtcagttatcgattgcgcggggtgggtgagctcctagggacgtacggctgcaggggatcagacgccttgcctcgcagattggaggcgaaagaagagcgtagcagcaatctactgtctgtgttggtggtttagcgtgcgtgaaccagatggggtgttcctctctgttttttctttctttcttttctgtgtatgtatcaaatgtatgtaccatgtaatgtatagtatggatcgatttcattgcattaaaaaaaaaaaaaaaaaacagataaaaaaaaaaaaaaaaaacgggccgctccgatctagaactagtctgaccgaattcgagct

SEQ ID NO: 23573 - DNA, 1198 bp, Zea mays
gctattaataaaaaatctgccggcccggctcccgtctcctgctccctggctgcaacggacttgaccactgaaagctaagcacacccctcggccatggcgctcgcgtccacctccgccaccgcgcccgctgccgtgctcaagaccccgttcctcggcgccaggcgcgcgctcgccaatgccgccgcgcccaagcccgcgccgcgccgcgcgctcctcgccgtcgccgcggccgccgccaagaagtcgtggatccccgccttcaagagcgacgccgagttcatcaacccgccctggctcgacggatcgctccctggcgacttcgggttcgatccgctggggctgggcaaggacccggcgttcctcaagtggtaccgggaggcggagctgatccacgggcggtgggcgatggccgccgtgctgggcatcttcgtggggcaggcctggagcggcatcccgtggttcgaggccggcgccgacccgggcgccatcgcgcccttctccttcggctcgctgctgggcacgcagctgctgctcatggggtgggtggagtcgaagcggtgggtggacttcttcaacccggactcgcagtccgtcgagtgggccacgccctggtcccgcactgccgagaacttcgccaacttcaccggcgaccagggctacccgggcggcaagttcttcgacccgctcggcctcgccggcaccgtcaaggacggcgtctacgtccccgacgtcgagaagctcgagcggcttaagctggccgagatcaaacacgcccgcatcgccatgcttgccatgctcgttttctacttcgaggccggacagggcaagacgccgctcggcgcgcttggcctatgatctgcatgctgccggccacgacgggtgtcgtgtcatcagtcatccctgtgtgcttgtgctcatcggtcgatcgaatccaccgagctggttctcgattgcgagcgtcgtggtacggctgcatcggatcagacgcatgcaacaaaatgggggattttttttcttcttcttccgtgtatgtaccatgtagtgtatagtagtctggtcatggaaccaattaaggcagaatgagtgagcgagggacatttcgttacattaatctctcattccgccttgctgaattgctatcgtctttcagaaacatagcgatattcctccgaagaccaaaataaaaaaaaaaaaaaaa

SEQ ID NO: 23574 - DNA, 992 bp, Zea mays
tgtgccgcgcgcccggccgctgcgcccggcaatccaacgaactgaccacaaccacctaagctaaaagctaaccaccagacccccggccatggcgctcgcgcccacttccgctgccgtgctcaagaccccgttcctcggggccaggcgcgcgctcgccaatgccgccgccaagcccgcgcctcgccgcgcgctggtcgtcgccgccgcggccgccgccaagaagtcgtggatcccggccatcaagagcgacgccgagatcgtgaacccgccctggctcgacggctcgctccccggcgacttcgggttcgacccgctggggctgggcaaggacccggcgttcctcaagtggtaccgggaggcggagctgatccacgggcggtgggcgatggcggccgtgctgggcatcttcgtggggcaggcgtggagcggcatcccgtggttcgaggccggcgcggacccgagcgccatcgcgcccttctccttcgggtcgctgctgggcacgcagctgctgctgatggggtgggtggagtcgaagcggtgggtggacttcttcaacccggactcccaggccgtggagtgggccacgccctggtcccgcactgccgagaacttcgctaacttcaccggcgagcagggctacccgggcggcaagttcttcgacccgctcggcctcgccggcaccgtcaaggacggcgtctacatccccgacgtcgacaagctcgagcggctcaagctggccgagatcaagcacgcccgcatcgccatgcttgccatgctcgccttctacttcgaggccgggcagggcaagacgccgctcggcgcgctcggcctatgatttgcatgctgccatgtgaaccagatggggtgttcctctctgtttttctttctttcttttctgtgtatgtatgtaccatgtaatgtatagtatagatcgatttcattgcattaaggcatgtttggttcccaaaaaaaaaaaaaaaaaaggcccccta

SEQ ID NO: 23575 - DNA, 1172 bp, Zea mays
cgaggccggccgggccgggaatccaacgaactgaccacaccacctaagctaaaagctaaccacgccagacccccggccatggcgctcgcgcccacctctgctgccgtgctcaagaccccgttcctcggggccaggcgcctgcttgccaatgccgccgccaagcccgcgcctcgccgcccgcgcgtacctcgcggccgcgccggccgccaagaagtcgtggatcccggccatcaagagcgacgccgagatcgtcaacccgccctggctcgacggctcgctccccggcgacttcgggttcgacccgctggggctgggcaaggacccggcgttcctcaagtgctaccgggaggcggagcctgatccacgggcggtgcgcgggggcccccgtgcccggccgcgtcgtggggcaggcgtggagcggcatcccgtggttcgaggccggcgcggacccgagcgccatcgcgcccttctccttcgggtcgctgctgggcacgcagctgctgctgatggggtgggtggagtcgaagcggtgggtggacttcttcaacccggactcccaggccgtggagtgggccacgccctggtcccgcactgccgagaacttcgctaacttcaccggcgagcagggctacccgggcggcaagttcttcgacccgctcggcctcgccggcaccgtcaaggacggcgtctacatccccgacgtcgacaagctcgagcggctcaagctggccgagatcaagcacgcccgcatcgccatgcttgccatgctcgccttctacttcgaggccgggcagggcaagacgccgctcggcgcgctcggcctatgatttgcatgctgccggcgaacgagtcagttctcgattgcgtggggtgggtgagctcctagggacgtacggctgcagcggatcagacgccttgcctcgcagattggaggcgaaagaagagcgtagcagcaatctactgtctgtgttggtggtttcttctgggtaacgtgcgtgaaccagatggggtgttcctctctgttttttttctttcttttctgtgtatgtatgtaccatgtaatgtatagtatggatcgatttcattgcattaatttggacgccacgcctttgccgctcggttccctccgagtgggacgtgttagctgcaaaaaaaaaaaaaaaaaaaaagag

SEQ ID NO: 23576 - DNA, 1281 bp, Zea mays
  misc_feature (1137)..(1137): n is a, c, g, or t
  misc_feature (1143)..(1144): n is a, c, g, or t
  misc_feature (1146)..(1146): n is a, c, g, or t
  misc_feature (1148)..(1149): n is a, c, g, or t
  misc_feature (1164)..(1164): n is a, c, g, or t
  misc_feature (1177)..(1177): n is a, c, g, or t
  misc_feature (1187)..(1187): n is a, c, g, or t
  misc_feature (1201)..(1201): n is a, c, g, or t
  misc_feature (1206)..(1206): n is a, c, g, or t
  misc_feature (1209)..(1210): n is a, c, g, or t
  misc_feature (1218)..(1218): n is a, c, g, or t
  misc_feature (1222)..(1222): n is a, c, g, or t
  misc_feature (1229)..(1230): n is a, c, g, or t
  misc_feature (1233)..(1234): n is a, c, g, or t
  misc_feature (1236)..(1236): n is a, c, g, or t
  misc_feature (1240)..(1241): n is a, c, g, or t
  misc_feature (1246)..(1248): n is a, c, g, or t
  misc_feature (1252)..(1252): n is a, c, g, or t
  misc_feature (1254)..(1254): n is a, c, g, or t
  misc_feature (1264)..(1264): n is a, c, g, or t
  misc_feature (1271)..(1271): n is a, c, g, or t
  misc_feature (1277)..(1278): n is a, c, g, or t
attaatctgacgccccccggcggcgccctccaatccaacgaactgaccacaactacctaagctaaaagctaaccaccgtacccccggccatggcgctcgcgcccacctccgctgccgtgctcaagaccccgttcctcggggccaggcgcgcgctcgccaagcccgcgcctcgccgcgcgctcgtcatcgccgccgcggccgccgccaagaagtcgtggatcccggccatcaagagcgacgccgagatcgtcaacccgccctggctcgacggctcgctccccggcgacttcgggttcgacccgctggggctgggcaaggacccggcgttcctcaagtggtaccgggaggcggagctgatccacgggcggtgggcgatggcggccgtgctgggcatcttcgtggggcaggcgtggagcggcatcccgtggttcgaggccggcgcggacccgagcgccatcgcgcccttctccttcgggtcgctgctgggcacgcagctgctgctgatggggtgggtggagtcgaagcggtgggtggacttcttcaacccggactcccaggccgtggagtgggccacgccgtggtcgcgcaccgctgagaacttcgccaacttcaccggcgagcagggctacccgggcggcaagttcttcgacccgctcggcctcgccggcaccgtcaaggacggcgtctacatccccgacgtcgacaagctcgagcggctcaagctggccgagatcaagcacgcccgcatcgccatgcttgccatgctcgccttctacttcgaggccgggcagggcaagacgccgctcggcgcgctcggcctatgatttgcatgctgccggcgaccgagtcagttctcgattgcgcggggtgggtgagctcctagggacgtacggctgcagcggatcagacgccttgcctcgcagattggaggcgaaagaagagcgtagcagcaatctactgtctgtgttggtggtttagcgtgcgtgaaccagatggggtgttcctctctgttttttctttctttcttttctgtgtatgtatgtaccatgtaatgtatagtatggatcgattttcattgcattaaaaaaaaaaaaaaaaaaaaaaacagacgcgggggaaagggcgaccgctcgcgtnctaaanntntnnaataggaaaaacaanaaaaaaaacactncggggggggncccggaccccaatnccccntanngggagccntatnacaattnnacnngnccgnngtttnnnaacngnggggacgggnaaaaccntgcctnnccc

SEQ ID NO: 23577 - DNA, 1774 bp, Zea mays
  misc_feature (780)..(780): n is a, c, g, or t
  misc_feature (801)..(802): n is a, c, g, or t
  misc_feature (805)..(805): n is a, c, g, or t
  misc_feature (841)..(841): n is a, c, g, or t
  misc_feature (849)..(849): n is a, c, g, or t
  misc_feature (851)..(852): n is a, c, g, or t
  misc_feature (864)..(864): n is a, c, g, or t
  misc_feature (937)..(937): n is a, c, g, or t
  misc_feature (959)..(959): n is a, c, g, or t
  misc_feature (961)..(961): n is a, c, g, or t
  misc_feature (1055)..(1055): n is a, c, g, or t
tttttttttttttttcccgcacaatatagctagctactttattatcaataaataaatatcttttgaccactgctgtatatgtgttgtgggtgggtgactgacaccagaaattaaagagaatcagatccagggcgaggcgcggagcggggtgacgacggacttgacggccaggtacttgtcgagcgcgtgcatgccctcgtccttgccgaagccgctcatcttgcggccgccgaaggggcagtcgctgcccatggcgaagtagcagttcacccacaccaccccggcgcgcaccgacctcaccacccggttcgccacgtccaggtcccgcgtcaccacccccgcccccagcccgtaccgcgtgtcgttcgccctcgcgatcgcctcctccaccgtcttgaacttcatcaggcacatgacgggtccgaagatctcctccttcgctatgatcatgtcctccttgacgttggtgaaaactgtgggctcaatgtagtagcctttcccttccggaccgcatggccttcctccagtcagaagagtggccccttctcgcttgccatggtcaatgtagctcagaaccctctcatactgagccttgtccacctgcgggccctggtcggcgctagggtcgctgaacgggtcgcccacgacccagctcctcatcctctccggcaacctctcctcgaacctgtcgtagacgcgttcctgcacgtagacgcggctcgcggcgacgcaggcctctcccttgttaaagaagctggcgccgacggcgagctccacggncatgtcgaggtcggcgtcgtnnaanacgatgagcggggacttgccgcccagctccaggtanacgggctncnngttgctctccgnggaggccttcattataaggcgcccgacctccgtggatccggtgaaactcaccatgtcaacgtccatgtgagangccagcgcggctcctgccgtcngnccgaagcctggcacgacgttgatcacgccgtctgggacccctgcctgcttggcgagctgcgcgaggtacagggcgctgagcggcgtctgctcgngcgggcttgacgaccagggcgcagccgtgcggccagcgccggcgccaccttgacggcgaacatggtggacgggaagttccaggggatgatgacgccggcgacgccgagcggctcgcgcagggtgtggccctggaactggcccggcatcttgagcgtctcgccgtggatcttgtcggccgcgccggcgaagtagcgcaggctgccggcggcgttgccgacgtccaccgcccgggtcacggccgggtgcttgccggcgtccaggctctccagggccgccagctcgtccgcgcgctcctccaccaggtcggccagcctcgccatgatccgcccccgttcggatccagacatgcgtggccactcgccgtggtcgaaagcggccctggctgccctcactgccaagtccacgtcttctttgtcagcttctgccacgctggcgatgacgccccccgtgcgcgggtccctcgtctcgaacgtccggctctgagacggcgtcgacgaaggatccgttgatgaagagcttggtgaacctgatctccggcacgtcgaacagcagctgcccgcgctcctcccccgccgccgtcgtccggtccgcaccgccgcggttgctctcgctcaccatggccggccgcgcgccgtcgccacccgcttgctcacggtcacgggtcgagggagagtgttcgtcgtttggtgagcctgtgcggagagaggaggcggcggac

SEQ ID NO: 23578 - DNA, 1982 bp, Zea mays
  misc_feature (1668)..(1668): n is a, c, g, or t
agggttcttggggctttgccaaaacagtatggtattacaagacctgaatcgctgcaagcgtgcaaaataatgaatgccatttttctatgcatctaagatctattttttttgaaacattacgaacgcatgaccagaaaatgaatatcaatcagcaattcgtacagctttgacatgctatcattggtagcaagaacaattgccagtgaagttaaaccctagtaacagaaatgctaacccctgaaggtacatatataagtagtagcttgttttcccatggaacaccaggttgtatgatgcacagaggaagagaaacaccgaaaatccaatctcggggagattgactctgtctctcagccttttccgggttttctgaagcaaaggaacttcagtgtcctcgagatcattccccaccttctttgtcacaatccactggttgaatccttctagctccagcagtccagtcatcgcagccctcatccgatgcaatgtcatcacactctcaaacaaaatccaaaatggcagtatgtgtagattttttggatgtcttatagctgtgaccacggtaagcaccatgggaatataggcaacaccccacactggtaggtaaagctccgggattgtgactgagatggggatgatgacattgtagagaatacaggcagccgtcggcgctacaactctcctcacaaagaagaagctatagagcatatagaacttcttgacgagtgatatatccttggcaaacaaaacatcctttgccatcttacggaataagtttgcaccaccactagaccaccggaattgctgccgacagtaggccttgtaagtggacggcagttcactcttgactctaacgtctccaacatatacgaatttccagccctttagtgttgctcgaaccgccaagtccatgtcttcaactgtagttcggtccttccaacctcctgcatctcttatggctcctgtacgccacactccagcagttccgttgaaactgaagaaggcaaaggtcgctgatcctgcttcttgttcaactttgaagtggtagtcgtaaaacatcttttgtacccttgtcagcaggcttgtcgtgtcattcacgaaggaccaccgagcttgaacaagtgcaacttctggattgtgcagaaggaatgggacagtttggagcagaaaatctggttcaggttggaaatcagcatcaaatatagcaatgtattcgctttgccatgcatagtcacattccattcctttcttcagagctcctgccttgaatcccttgcggctggttcttgtggcatacttaatattgacacctttgttcacccagtgctcacattcaagctccaccaaattcttgataaaggggtcagtagaatcgtccaacacttgaattactatcctgtcctttggccactgcagctcacatgctgccgctattgacagcttgtacacctccagctcgttgtacatgggtatctgaaccaggaccatagggaagtgggcggtccccttctcctcgtcggcgctgtcgaggggcttccacttgaacctccactcaggcctccacccaatggccttgacgccgaggctgatgacgctgttgtaccacggcctccaccaccagcatcaccgacatcaccatgcacgcccacaccgccacctgcagcaccnggcgcgatcaccccggcccgcaccgccacccacgccccgtccacgtccgccgctgccgaggacgtgccgtcgaggatgccgatgagccaggacaccgccgcctggaagtcgaacggcgcccccgcggtgagcgggcggctgaagtcgaccgcgccgacggacacggcggccgcgacgacggcggcggcggcgaggatgaagacaagggccccgccgatttccccggcctccattgggtggtggtgtggtggttgcggccgctgacggaaaggggtggggcggagtcgcggacggagccgagcccgagcacgagt

SEQ ID NO: 23579 - DNA, 3339 bp, Zea mays
  misc_feature (1254)..(1254): n is a, c, g, or t
taattttacagtctaaagtataaaaatggatataacaaatctatattcagagtagtttttagataacactgttagaaactatagagaaaagaatcttctatatatttatgatagaggagcatatagagtctatccatagaaacggtaaaaagttaaatcaattatattttgaaacagctggagtacaattttcatgagcggctactttgtacagccgtacaggatagtttggccagatatatacatagaaattatctatacgatctaataagatggataatggtttaaatttgggtattgggtgcccaagcagtcctagcttcagttctcgggtcttgttttttttttttttttgatttgcaacaatctattgaaagacttcaagtttgaaacaaaacatcccactcggtaatccaatccaattcgcaaagcaacgttccagctcatatcaacaaactggtaacttattcccactcatggtcctacatgcagctgaggtaaaggtaagataatggtgatctgtgtagcacaacgcaagtacacaacacaacacagcagaccccagatccagatcactacaaatgcgaagcatggggttaaaagacagaaaaagttgtaacgccttcggatcgtcacttattttttcgcttctttccgggcttcagcttgataacctcgtcaatgtacaggatccccttccccttgtacacctctggagccttagagctccggatggcgccggcgaactggtgcaccctgtccttatcgatgccggtgcagcagattatgttgggtttgaagcagaagacacggacagctggaggagcggtgaactgcacctcatggctgaagcccagtttaaggaacaactcacggccttggctctctgacctcgctttgaagccgaccccaacgagcttcaggaaacggaaaaacttggcttccattgagattaaatggcgagctcttcaaacagcctttgacgggctccggcggaaaagcgcaagtttctcatcagaacagtggaaattcaagtgcaattaagagtaaatttcaagtgtaaattatcttagataataccacagcaaattgaatatcagatcagttacgccatcacatagcagttatcccactttgtgggttattatcaatgttttcagatcggctgatcgctcctgatcgcccgattaaccgggctctgatcggttaaccagacatcctgatcgtccagggtttagaatgaatttggttttntgttcactttgtatttgtatcaagtaaaatccttggaatgacatgtacctgaaaaagtactacgcctgaccggcttcccggtaagccctgaaaaatgtttggcctgtctgatatttgtgcgtaaaccataaatccaaatcggttctagactgtcttccaatctacatgcttgactgagtgaggatgtggcagcttttgttcacatcatattccattagatagaaagagctacaaaaggtgtaccagatagattcatatactaggcttaggctcaaatagcgctttgactgatataggtaaaaaaaattccaatttacatccaggtcttatctacttagttgtaaatttccgatttacatccaggtcttatctacttagttgtgggcattgccctcgagaagccaagccagccccagaaggaacagaagcaattgagtctggctcaacttttaaaaaaaaagtgtgcttcaatcgtatcgagttgtgtaggttcctttcctggttttgtccttcattcgctaggcgtattcctcatcccgtttgtttaaattcttcattcgaagatggatcggcgtaaactttatcgcgttctgaaacaggcatggcccttcgctataggaaccgatcaaccttcatatatataactacacgcccatgggcatggcttcaggttcaggctttcaacaaggcaaacagccatacgtgatacgcctatggacatgggcagcaacaggctaacagctatagtgccatactacaacatgaagcaaataatcactggaaggtttcaggctttcagcatcaaagtaaaactgaaaacaaacaaacatggacatgggaagcaacaggccaacagccatacgcagagcacaccagaaaacagggacaagctctgaatctggattctggagactggagaccgtacctgcaggccggctgctggcgccgccgcgccggggatggaggaggggacgatgccgccgtatcccccgtcaccggtagcgcgccgccgtcacctgttccgctagggttcctccctccgcagctgcctggttcgtgtcgtgtgtgcctgggcgttgctctgttggctcttggttgtgcagcttctgctcaagtggtgggaattgggaaaaaggaagctgggctgggcctctgggcaagtgaagtgggccactgggccgaaatttcaatcaccgctcttctctggtacagcgggtactactactagatcaccgatgaactgatggagctctttcactttacctttccctttctgttgcagaacagctggaagatttaccctagctagctgctagtcctcgaatgagtgacgatggggtgaagtatttccgtggatcacgtgcaaatgtggaaatataccagtaaagatgcaggcaaaatcacccgcaacaccactgtaacaaacagtgcctgaaacgaacatggagccgtgctgtgctgttaaagaaggaaaggtggggcggggaaaagcattcgtcagagtgccgtgaacattgttcactgaacatccagggaagtactagctttcttttgctcagtcatgtcactgtgtgaccaactcccgggccatttcaccgtgcattagaaatgcgagcctgcggcatgtccaggataattaagcaccaaagaaacacggccgggcatgatggtggaacggttggctgctgaaatgatgtatgctcgtgttcgtgttcgtgtcagtagtgatcctgatccagattctgaaaagcgttctgaaaatgacagatggctgctgaaaagcgttcgtgtcagtagtgatccagattctgaaacacggccgagcattcactaactagttttgttgatattttcattaaggacacatcaagcagtagtgatcctgatccagattattgttgaaaggtttgagttctaaattctctgaagaaacatttcatatgttgaatcggaatcgcttcatgaaaccgtttgactgttagactagattctactatatcgtgaataattttttaatatatatatatatatatatatatatatatatatatatatatatatatatatataaatatatatatatac

SEQ ID NO: 23580 - DNA, 937 bp, Zea mays
  misc_feature (900)..(902): n is a, c, g, or t
  misc_feature (904)..(911): n is a, c, g, or t
gattggggtatggggtgccaaagcagtccccgcttctgtctcggggtcttgttcacagttcacacttgatttgcaacaatctattgaaagacttcaagtttgaaacaaaacatcccactcggtaatccaatccaattcgcaaagcaacgttccagctcatatcaacaaactggtaacttattcccactcatggtcctacatgcagctgaggtaaaggtaagataatggtgatctgtgtagcacaacgcaagtacacaacacaacacagcagaccccagatccagatcactacaaatgcgaagcatggggttaaaagacagagacaaagttgtaacgccttcggatcgtcacttattttttcgcttctttccgggcttcagcttgataacctcgtcaatgtacaggatccccttccccttgtacacctctggagccttagagctccggatggcgccggcgaactggtgcaccctgtccttatcgatgccggtgcagcagattatgttgggtttgaagcagaagacacggacagctggaggagcggtgaactgcacctcatggctgaagcccagtttaaggaacaactcacggccttggctctctgacctcgctttgaagccgaccccaacgagcttcaggaaacggaaaaacttggcttccattgagattaaatggcgagctcttcaaacagcctgcaggccggctgctggcgccgccgcgccggggatggaggaggggacgatgccgccgtatcccccgtcaccggtagcgcgccgccgtcacctgttccgctagggttcctccctccgcggctggctgcctggttcgtgtcgtgtgtgcctgggcgttgctctgttggctcttggcgtcgcggtccccggtctcccccgcgtgggtacnnnannnnnnnncccggccggcctcgaggtacccaatg

SEQ ID NO: 23581 - DNA, 1029 bp, Zea mays
tttttttttttttttttttgacgtactgctagaacaaacatgattaaaaatttgatgctctgatcgtgaaagatacatcgacagtagcatcttacgggatgcacaagaaatgcgacgaagccaaaaaaaagttccaaggatcgaaggaactattattgacttctcgggatatctggaaatggagatgtagcaatgaactatctcatgtactcatgcaacggtgatattatgtacaaatgtgcaagtccctgctgcgaagccgatcgaagattcaacatgtgacctcaattgatgtggacaacgccacaacggcacccatattcagttcgtatgaacacagcccgactcaccagctaagctgatggtatagcggagatgtagcgactgcgcaagccatcaatagccctctccatggacttcgtcatctcagggacagtcaccttgcacacacgggatgtggacgcctgcacttcagccacgaacttcttgtaagaggtcttcaccagctcggcgcgctcggcgatcttgtcggctatcttctgctgctccttgtccacttcctctgctagctgcaggcagccatgggactgcatcttgacgcgcttggagatgcgggagtgggaggcctcaaggtcgcggacatagtcgccgtggagcaagtccaagcggcgcttcagggagtcgaggtgcgacgcggcaaggctcctcaggtctccgatggtggacttggtagtgggggcggcgaggggcgaagaattcctggttccgggttccgccggcggggacgagggcgagaggaagctgaggtcggcggcagcaggggacggcgtgcggcacgcgtaaggagaggagatgccggagagcagggagacggggctaggcgtcgccctaggcttggccctggacctgggcttgggcttcggcttcggcttcggcttggaagaggctgcggtggtggtagctctcggtctccccatggccgactggactcccttgtgagcctgtgatgggatcctgtctcttcgtggt

SEQ ID NO: 23582 - DNA, 2195 bp, Zea mays
gctgggggagtatagattagatagagaatatccagggttagcatagtagtaaaatagagggttttaaacaaccgacacgaaaggacaaagaagtctacactattgcaggagctaaccagtttttgtacaaacttgataaaaccacagcttatcgacgcaaggtcttcctttgttctaacaaaaaaaaggaattggtacaataacaaatgcaaagtaaattcaaatgctgtcaaacacagtactaaaaatgctgaaaaataattgcgcctcattaactcgctaaccaatgtttcctaattttgctgaccgcttcacgtatacgcctcagcatccaaatgtctgtacaagaagcatagatggatcagaatggcttgttaaaatccgcatgtccaacatctctgcaactttttatcaccctctgctgagtccacgcgtagagaatgctgaaccctcagcggcagcattaaatgcatggaataacgaattggtcttcataaatcctctagaagaaatgaagtaaggcagtttcgtgaggcacgtgcatctcttcaaatgttcctctacaatccagggccacaatgctccttttatcgtcgtcaattgccaacttaagatgacctcaaccgtgtctgcccttttccctttctccttttcgttttttcagttttccagcatgggaacagcccatggcaaccgggtgctccggactcagaaacaacgctctcattgtcacaatttgccaaatggttatttctatgcaaaaggcttggtgaaatggcataaccactctccatctgtacatcttgaccattatggggtccatgactgtcactgatctttaaggctttcagttcattagatagatccttgtcaacatgccttgacggaacaacggtggccattgaggacctaccatgatgctgaccaccattttgtggaagaatttgatttctctcaggtctaccttgatttaacataccaggcatgggtttttcagcagcctggagccatgcactctctaacctttgttcatcaaaagctgataccttcaactgttcaatagaaacatcctgccctcttgttctatgcattcctgaagtttcctcagagatgatcatgggaacattgtttggctgcactccaccagcacctgatagattcagaacaccctttcgacgttcactgttcgttgaacaactcaagacatcagattcagctgtctcatctgggtatgtctcatgctttagtcccccagcaagaaattcttgcatcaaacaaatcctgacttccacattgcatttcagtacagtttccattgaatttctgatgctgctaataaatctttgggctcgaaactttatatcattgtcctcaaatgctataaaagcaacaatggtaccttcacattctttgacagatgttaatttcccatgatcatagagaagttgccgcaatgtcttgcccgggcaattctctatgcacttcatccaaattcgggtaaggttatctgagattccactatgcatacccttttgctcagaagaaatacttgtttgagcagaatccaataatgctctatcaacagacatatgctcggcataaatcatgttttcattgtgtctcatcctggaggacagtgaagcatgaggactggagtgcccactggttgttttcagatccactattttctttgaatcaggaaaagtggataaatgatgagctgtactcctgcttgcagaagattctctcattgcttccatcatggtttcgctggttgccttagcgctttgcttactgctgcttcttgattgagttatttctgaattgtgaccggaaccaagctggagtaaagcagcagtgaaccatgtcgaacgctcgcttgaaagtcttatctgtttttcagcatcagaaagaatcctcaacgcttgttgtaatctttccaattcagcatcagttatatttcgaccaccactatttcgaccaccaattccatctccaccgcatgtagggtctgccaatctataggtcccagcaatgatgtccattatgagcccagctaattgtgacattaatgccattggatcaacaccagaatccatcagctctctcgacttttgactgtttcagcagtgtttgatgacatggctatctccaataggtcaaggagttctcctcagacacaaccccaaccagat

SEQ ID NO: 23583 - DNA, 1863 bp, Zea mays
ctcaccaacaaccaacgactcggatgatggaaattcttcaaaatcagatgacgaccgagacagcgacggtgaacaagaacatgaggcacttgatcgcagcaaccggcggacgaaaagatctcagagatacacacaagactttgttgaggctgtctcagatgttgatcctaactttgacagtgacgacgatatcatgggagaggcagtgtatgatgacgaatacctgagaagtcgcaaacagaataagccatcaagtgcttctgaagaggatgaagagttccggttggaagaagatgccgaagatgatgatgaagaggaatattcattgagtaccagtgaagatctagaggagccacaacggcataaaaagctggaaactcgtggccggcgaggtacgaagctgagatcagttggtgaaatccaagcaggtcttagacgcagcaagcgttcttctcgtcctcgtattaactatcgccaatatgatttttcggactcggatacggagcctcgaaaggcaaggaaatctgacgcatcagatcctgatgctggctccgatgccgagaatgatatggagctctcgacatcgagtcaagagcaagaggaggaagaggatgatagtcatgatgaagaaaatggtaataatgcgaatgataaaatggaggaggaccacactgcagaagaaaataaaatagaaccagagggggagaaggagcagccacagcagcagcctgtagagaagatggatgctcccagcagggaaagtaaaagtgtaggaagaacattcctagatctaaacgagcttgcacctggaggtggctttgatgatggcccaagcttgacagtgagagatgacatggacaacatctagggaataaagttttgttttgatacatttcgggtgctgttggccagttttctgacttccaggcaagggcagatccatggtcctgatggcctgtgatgaatggtgcaactatggtttggcggtgtgagcttatggttatggctgcttcactgatttgcagcagcaggacaggcgatgttccacttgaagcgactttgagcttctccggtgcttatgttatacgtggagaccatgaggaggtagttttatgtatactacatgaaggtcgcaatcgatcatagctgtattgcggccaggctgctgctgcgttgcggccggtctctaggatataaatttattgcctccatttatttagtcttaggcattgtgatgtcaatgagaacatggagggaaacctgtacaccgagtgcggtccgtcggcattcgcccgaccttttccacttgtagattgtaggttttttaaagtccgggcgggattagttctgtatctatacctgacagtctgtttttttctgtcacacctgtgtagctgacattgagcttgtccctgaatgcacaccggcaatgcctctcgttcgctctatatggagaagatgctgcatgtattcagctgatgttgtagcctatggacatgtccattactcagagtggctggcctggtgattgctaatttgatgtatggtttataaaaccaaattcctgtgtgcgtattggttagttgcaaaactttgcaaagataaataatttgggggtgttctgttccattaaacattgcaaaattatgtgaaatgtttggtgaattgggcttcatgtccccagttgtgcttcggagaggctactcatttcttacaaagtagcctcatggtggatgtttgatgacttgtagtgttcctgtaaaataaaagggaaagtaccaacattttataacgatatatacgtattttggtgaaatttactcccaactcaaatagctgtagttttgtggaatttgctcccag

SEQ ID NO: 23584 - DNA, 2581 bp, Zea mays
  misc_feature (2544)..(2544): n is a, c, g, or t
gctcctacggatccccttgagcctgttgctactactgccaatagaagggtgcttcctccaagagcggaggcagcacgcaatggtaagctaaataatggcccctcaccaacaaccaacgactcggatgatggaaattcttcaaaatcagatgacgaccgagacagcgacggtgaacaagaaaatgaggcacttgatcgcaggtactcttagcatgtggtttttatcattaccctactcaaggtagcaggtggctaatgtgcatttgtgttgtgtcacagcaaccggaggaggaaaagatctcagagatacacacaggactttgttgaggctgtctcggatattgatcctaactttgacagtgacgacgatatcatgggagaagcagtgtatgatgaggaatatctgagaagtcgcaaacagaataagacatcaagcgcttctgaagaggatgaggagttccggttggaagaagatggtgaagatgatgatgaagaagaggaatattcattgagtaccagtgaagatctagaggagccgcaacggcataaaaaattggaaactcgtggccggcgaggtaccaagctgaggtcagttgatgaaatccaaacaggtctcagacgcagcaagcgttcttctcgtcctcgtattaactatcaccaatatgatttttctgactcggatacggggcctggaaaggcaaagaaatctgatgcatcagattctgaagctggctctgatgccgagaatgatatggagctctcgacatcgagtcaagaggaagaggaagaagaggatgatagtcatgatgaagaaaatggtaataatgtgaatgataaaatggatgaggaccacaccgtggcaaaaaataaagtagaaccagaggagcagaaggagcagccgcctatagagaagatggatgctcccagcacggaaagtagacgtgtaggaagaacattcctagatctcaacgagcttgcacctggaggtggctttgatgagagcccaagcttgacagtgaaagatgacatagacaacatttagggaataaagtttttttctttgatacatttgagtgctgttggtcagttttctgacttcgaagcaagggcggcagatcaatgggtttgagcttatggctgtttcattgatttgcagtaacaggacaagcgaggttccacttgaagtgactttgagcttctccggtgcttatgtcatactcggaggtgcttatgttatacttggaggccatgaggagggtagttttgcttttgattatgtatactacatgaaggtcgcaatcgatcacagctgtattgtggccaggctgatgctgcattgaggccggtctgtaggatataaatttattgcctccacttatttagtcttaggcatggtgatgtcaatgagatcatggagggaaacctgtactccgagtgcagtgcagttcgtccgtcggcattcgcgagaccttttccacttgtagattgtaggttttgagaccgagcaggattagttctgtatctaaatctgacagtctgatttttttttcccccgtcacacctgtgacctgtgtagctgacattgagctgtccttgatggagaagatgctgcatgtattcagctgatgttgtagcctatggacatgtccattacactgactgagagtggctggcctggactggagattgctaatttgctgtatggttcataaaatccgtatcctctctgcatatttggttagtcacaaaactatgcaagataaatgatctaggtgctctgttccattaagcactgcaaaattatgtcaaatgtttggtgaatctaggtgcgcttcatgttcccagtgatgattcgtggaggctactcattactggacaaagaagcctgcttgatgactgagttgtagtgtccccaaacccaaaaccgatgatgattcgtggcggcccgtgatccatatatctccattaatatctgttatttttatatcaaaatgtattgaaaaaaaatcaaaatgtattgaaaaaatattatattcaatagatcggtcaggttgtgatcggatctggatccgcccctgtgatggcgtagttcccgcagccagccgtggtcgcctctcttgtcagagtcagagcttgccaccatatcattcacggcaatgcacagcgttctgaattctgattctgatcatgatatttttaattatttatcatattttagtttaaaaataaactagtggccgacaaatattccagaatggaggtagtatatagtttagttgatcgatcctaccaaagttgatttttgtactttcattcagttttggttaagtagcaaacaagtcggttttcagagtgaaccgaagcttttcgagctactctgcctaagttgctcgttgttagtgatattctcatacacacgttaagacgatgatgttccaactggaacaaattcgtcgacgattccttcaaaagacgtggaggcctgaacctgcccaggctttcgtagattcggtgcgactcacgtacaaagatggtcagatggggncactttgcaggcatatttgtatcatattttacacagc

SEQ ID NO: 23585 - DNA, 1600 bp, Zea mays
tttcttttccctccatattaactagtatttaaagatatgagaaagggctcgacattagaaacgaaaccgggatgtgattttgtagctactgttgccaccttgatacagtcaacgaaatatacggtttaggctactcacctaggatcttaggatatcccaaatcctcaatgacaactcagaatgtgttagtaaacgcatgactctggttttccttgtaacaaagaacaaagctagaccaatctgtaacttacaaaaatagatgcctaaattcacctcgaaaactagatggtctcccacatcctcaactgagttatcacccgtttcttttttcttgctcataacatattaggccatgtaaaccacggccaaaattaattgacgtctcagcactccgcgttacagtacgaaggcaagtataaaatgatccaacatacatcagaagtggctgcctgccggcatctgacatcatataaccgtcgttgcagttgcacatctcgcactcacgccctttgcctttgcctcgtatttatctcctcgtcttcttccacctcagtcataaccttcctagaccttttcccgacattttgcttcgaataagaagaggatcccttggatttccttgatacgggatcatccaaaacatcatcgtcatccgtgcctccatcactgaggccttcaaagtcttccatgtcatccatctcttccatgtcatcgccttcaacatatacctcaccttcttcttcctcctcttcttcaagaaccacttcatctctttccatatcaagaacctcatcaaacgctttgaagggaacattatagatgtcagcataaacacctttgttcaggcgttccttcaattcattttcaatattcctttctagttgagcagccctttcagctttctccattctccggagatcacgctgtgtttgcttcctgggcattgtcatgaccttctccctcactttcagttgaagtttcctcattcttatacgatattgagtcatttttgtcagccgctgtttgatcttgtgcacaagtagcttaggccaaaattcaagatgtttgtttatgacttccattgctttctcataattcttcggcagtttgactctctcccataatttgtttggcagatgagctctttcggcggttttcatatacagatagaaaataccttcatgatcccggatggtggcatagcggctgttggcaagcgggcaggagctccggttgcagatgcccgtcgcgttgtaggggttgcgacagaagatccccgttgtgatcttggacatgaagctgcagtggttgtggcggatgcagtgccataccacgtcgtcactcattttggactccgccgctcagggccggctcctcccctgcttaattaccgcgccgtaaccggactcgtcggagcgcacgagtctcccagccgcctctgatcaccccgcgaggcctgagagagggagcgcggcggggagtccgcgtcgtcgacagcgaagaagaagggagccggcagacggggaggagaggagcggggtatagtagggtttgggaatgcggcgcgcgggcgggcagtggcttcccggccggcctcgag

SEQ ID NO: 23586 - DNA, 2671 bp, Zea mays
cccgccgggtaacctcggggcaagaagcgatttacgcatatgccccctccagccatcagtagccacgggctatcctgcgcccaccacctgccctcctgccttcgtcctgcccggcgcctctgccctcctccgggctccacagagtgaaaaagtctcctcttttcctcttcctctcccgttgccaggcatggggttggcctagttgtgcccgttgagcactagcagcctccttgaaacctccagatctgtgcctccaaggcccccgttcctcggcaacaagccgtccagatggacaccgccgcgcccctgcaactgaaagcctgcgccggcgacgccgcggagaagctgctgctcgccgtcgcagccgagggtcctatctgtggtgtgccagacttcaagatgaggggaaagaagagtgatgagctcgaacctgtcgatgctggcgatgaagatgatgatggtggtgacgatggggacgaggatggtgactttggggaggagggtgaagaggacgtctcagaaggggagggatatgacaacccaaagggcaatgagaccaagaagcaaagaggtgatcctgaggaaaatggtgaggaagatgaggaagaaccagaagatcaggagggtggcggcgacgacgatgatgacgacgatgacgatgatgagaacggggatgacgaggacgacgacaatggggatgacgatgaggagggtgtagatgaagaagacgatgaccaggacgaggatgaggaggaagatgatgatgaagactcgctccagcccccaaagaagaggaagaagtgaagatcttctgccgctttagttaccgtgcgctgagttctgcctggcttttcgtcatatcctcgcatttcaactttcccatagagagttaagaaggatccacacgttcagcagcacgtgtgggcttgtaggagctttatgatttgaggcaattagggacaactcttatgtcattgttgcttgcttctgtggagtcgaacagatgtttcgctaacataattcgacttgagtgatgaaagcctccagattgaatatgccttctcttttatctcgtatggaatcattgatgcagccctggttgatagcgttccttcaataaatgaattatattggcatcatgacagcttcatgtgaattgcacgtttatactgtgcgttcaaatctcaactaatgtatgactgatcggaacaaatattattgcattatttgtagcattttgaaatagaatggttatgatggtcgatgtgaacttcgcctatggtgcctcgatattgcaggtctcttagtgtctgttggaagtaccggtttttatgaaagtggtttgtaaaaactgaggtgctcgtgcgttgctacggtttctatatattagatagaaagactatttaaatgcaatacatgttaaaacacatctaaatctttataatgagcttccaaaaagttccgagcgacttgccaggatggtgatggcatggtgcacgagtcctcacgccttaaggccttgcatgcatgatagaaggtggtgccacgatatgtgcatgtgccagcatatctctccgcctcaatcaaacatccacattcttcgatctaacctaactaatcccaatgctcaacgaatatacaactttatgagatagcaaactgtgtgatatgtgcgataaataaagttcgtacaggtaacagattcaccaacagatgtctgttataagggcttctctttctttgaatgaacgatgtaattgcatgagatcatactcatctatttctttgttttgtctgccatggtttcttttttctggttttttattaactgcacaatttaaagttcagtatggaatggcgaaagattaaaggtgagctcgtagaggtataagctcatttcgagcctagtgattgtgtagtctctgagaaaatcaacccaagagaccctccaatcatggacacccggaagtagaacactgcaacccttatgaaggccatggcgatatgtgacaactctaaaaataagctaaagtaataactccggcaattaaacaacacaatgttttttttcttaattcaggtatgattcaaatggcaaaattaatcatcatctcagtgtgaagttatttacaaattttaacacaagcaaagtatagtttaaactttaaaggaacaacactgatccagggcattactacattgactacagagcatccaccacaactcacatatatttttgttttcttaggatatggcacaaacaaatcaacatctattctttccattacccaacagagaactttgcatttgggaatacaaaagataagatatgtgatgcaatctaactctatctacgagagggtagaaatatataaattatagctaaacatactttcaatgagtacacttttctaacaattagttgcacatgtcaatagctttattgctgctacatcatatgccaacttttaagaaccttctcccatcctggccatcatcacaaaaataataatcaagcacaattttgttatgaaattgattgctgaaaatagaggggactacaaatctaacttcaatgtaaacaaaccaagctaacccacacaaaaaccacaaaaactgtaggtatgtcggcgacaactaaaccaataccatggagtccctgaagtgggtg

SEQ ID NO: 23587 - DNA, 992 bp, Zea mays
atggggttggcctagttgtgcccgttgagcactagcagcctccttgaaacctccagatctgtgcctccaaggcccccgttcctcggcaacaagtcccatctgacggaccttgttccctgtgcccgcccacgtggcctcctctgcagccgtccagatggacaccgccgcgcccctgcaactgaaagcctgcgccggcgacgccgcggagaagctgctgctcgccgtcgcagccgagggtcctatctgtggtgtgccagacttcaagatgaggggaaagaagagtgatgagctcgaacctgtcgatgctggcgatgaagatgatgatggtggtgacgatggggacgaggatggtgactttggggaggagggtgaagaggacgtctcagaaggggagggatatgacaacccaaagggcaatgagaccaagaagcaaagaggtgatcctgaggaaaatggtgaggaagatgaggaagaaccagaagatcaggagggtggcggcgacgacgatgatgacgacgatgacgatgatgagaacggggatgacgaggacgacgacaatggggatgacgatgaggagggtgtagatgaagaagacgatgaccaggacgaggatgaggaggaagatgatgatgaagactcgctccagcccccaaagaagaggaagaagtgaagatcttctgccgctttagttaccgtgcgctgagttctgcctggcttttcgtcatatcctcgcatttcaactttcccatagagagttaagaaggatccacacgttcagcagcacgtgtgggcttgtaggagctttatgatttgaggcaattagggacaactcttatgtcattgttgcttgcttctgtggagtcgaacagatgtttcgctaacataattcgacttgagtgatgaaagcctccagattgaataaaaaaaaaaaaaaaaaaggcgacgccgaaaaataaatattataattataataaaaaatatattatttattg

SEQ ID NO: 23588 - DNA, 885 bp, Zea mays
ggccgctttttttttttttttttggaactaaggatgagccggtccagcaccagcagccatcatatttcattgagttcaactcagtcagatacatggtcctgaaaaactgtcacataccagcccaacataatatatgcaaaaacctaacagacatatatagttgctatcaaaactgttactgcagagagaccggtaaatctgtttacaacggagtcatgccgatggcggcttccgggcggtggtagtagatccgcgccttggagaagcagtagtagtaggccgaggtgagcacgcaggtgaaaagggcaaacgcagcgccggctccgaacgtgcccctccgcaccgtctcgcagtccggcgggttctggaaaaacaccttccggtagccagtgtggtaggcggattgcaaaagaccagctagcaagcacgcctcagcgatgacgaatgtcacccaggaggagatgaagaggacgagcgcgcaggccctggcgccgccgggccgcagcacggacccgcagcagaagcagcgactggcggcggcggccaccgcctgtcccacgaacaccagcgcgagcgcggcgccacccagcgccgtggcggcgtccgtgcggtacacgcagtaggtccactcctgcctctcgtccgtctccagcctcgccgaggggcggctctgcaccgcgccgatggcgaggccgaaggcgacgaggtcgacgagcaggatggcggccagcaccttggttgagccggccattgggtgcggtctccgaaaaggcggagaccgggcaaggcgcaagactttgggttggtgatggtcttggatttcagacgtgcggagcgcgtgttctccccggcctgcccccgcgggtgcttttttttcccggcagg

SEQ ID NO: 23589 - DNA, 1933 bp, Zea mays
ttttttttttttttttttaccttttttttttttttttggcactaggaaaccaaacaggccacggcagatgcttatcaaatgtctagcgaccgacaaaatcagctccaaatctaaatttacagtgtaaaggatgagctgggcgtaattctactacaaaagctgaacaatcagagtggtgatcctaactgtttctttggttaggaccaatcagaagtacctacggctaaatctagagagagaaaaattagcgtcaagattttacaacaggcaaaaaataagctaatgaaggaattttgtgtacacattggcaggtttacatggcatctgcatctccagccatgtggccgtccatggtcatatcatccgcatatcttcctccatgttggttcctccatccacggttatactccaaagatcgcacacgatcatcatcagacgcctcagcaagccttgcaatcgcatcaattaatgattgttcgtgctcctttagcgctttcttagccctctccatctcaagggggtcagggttggctgaactgaaaacccgctccacctcctttatgagtgtctctgtatggagaatttctatgtagtcaacactcttcttcccaataccgttttgtgatggataatctttcttgaatgagttcttttggggacctctgtctcttccggtacctgacatggggccaccacgactgcttgacttcataccatggacgggagcaccacgacctataaggtttaaatcaggctcctcgccatcccatcttatatcctcaggtgccatctccttgaagtcaacccattcccatgtctcgtctgctgtatttatgtcataaaccagtgtatagatatcctttgatgcatcatagtcagttatttcagcttcataaaagctattatcgtcaggccaccgagtcatgactttacgaccaattaatggatttaattgtgaactttcaggtggaaggccagcagacatattcctattgataatagttcctcgcccaccaggaccagcagaagatggcatagatttgactgcagagccaccaggtatcttctggcctggtttggtcttcttcacttttgtgccgggttgagctcccttttttgctcctgaagatgatggttgcatcggtgcagttaaaggctgtgaatgcatagcagatggtgcaggtacacatgcagagagaatgggttgagacatcttttgcctcttgcgagcagatgtcgtagggctgggaatagggtcatgtgtacgctgagaattattcaccaaattaatcataagcccaccagttgactctctccatttccttattcttcgaataatatcatcgccattaactttgtttagcaactccctgtgttccttgtcagatacttgtagctccttcctaagctcagtaatgagactttctttttcccatgttatagcatcagattgagccttgaatgctctaagaactgaacaatatgcttcttgctcaagctcatgtatttgtgtttccatgtctgtctgaggttgaactctagtatacagagaagcaccaacactatctcttccattaccagtgatgcgtccactgcctttcatgcctctgctgttctgatatgattgtggaagatcatcatcggttcctcactcatacacagtggcaccgtagtccatgtgagaacgaccgcgaccagagagcaccaagagaccgctgctgtccacagctccgacgcagtccatgccgtactcacaaatgccttctaaatcacacctcgtcgatgcctgccaccgacagaaacgctacacgatgctcttcctccgataacacccagatccgccactttccgggatggcctacccctcctgcctctctgccccgatggagccctggttccggagcaaaaatcaagacgagacgcggcaaaccct

SEQ ID NO: 23590 - DNA, 657 bp, Zea mays
gagacgtgatagcctattgggacctattttcttctggtcaacatttcaggatctgctgcaggatcagtttggtaactatgttgtacagaaagtccttaagacatgtgatgaaagatacctagagatgatcctctcgagcatcaagttacacttgaatgaactaaagaattacacgtacggaaagcacattgtgacacgcgtcgagaagctaatcgttacaggagaggaacgagcaaggatggcctccctgagcggccagcgtcagcagcagccaccaaactgtacagctgtcgacgcacactaatccttttttttatgcattggcgtcaaatgcgacggcacattggttccttttaacgcattgtggcgtcaaatacgagtagctagatgagagctaggtttttgggcactgtaaattcttttggccatgtgcaagttcatttacagtggataatagatgtacattgtgctggagcgttcgttagctttggtatggtaggtgatcgagagcagtgctgtgtaatataaatatactcttgttgttcaccgtacgacgtacagttgctcttttgtagcactgatctcgtttttcattcatatgtaatctctaattcattcgtaaggctgctttcaagttctaaaaaaaaaaaaaaaaaa

SEQ ID NO: 23591 - DNA, 1212 bp, Zea mays
taggggccttttttttttttttttttcggaacttaaaatatctgctatgttagagatagcgatacaatttatgacatgtatgtgacataggattactggagtcaattatttttccacacaacatgcaacttttttttttttttttgctacgtaccccaagctttacttgggagaaaaggctagaaaacagtaaaagaaaaggcccaagaacatactccgtcgtcgtcataagtgtggttctacttatgttctttggaatctaaatgaaaactacgcagatcccacgtaaacaacctgatcaagcgaccgatctgaatcagctacttagccgatcgattaatcagccaccgacgtcgtactgcaggatctgtgtagttttctttaggagacagcgctgtaatcacactcctcgcttgaagggattagcttgagcttgatcgattggacacactagagctagaaggggtaatccatgggggcggcatcgagcaagctggcgctctggacagccatggtgcaagtggctgtcgtcgtcgaacagccacgactcgatcgccgacagcggcatctgctgatgggacgtcggcacgcccggcttcgcctcgtattcgaagaccggcccaccacaagcgggcgccggcgcggccgatgcgacggcggcgccaccgtacgacacctccgacgcgtccgaggatcccgtggacgcgctctcggcaccgccgggggtgcccggggtcccgccgccgcggaccttccggccagcccacccgtccagcatccgcgagatgttctccgcggtgagaacgtacggccccgcggcggcggcggcgaaggccgctggcgccaaaggggaggactgcgacgcgcccgacgagctcgaagccggagctgtcaccgccgcccgtgcccgcgccagcggccggcgcgtcggcggcggcgtcgcgctgcagctgcggcttgaggtcgtcgagcggggtgagggcctcgcgaagcgcgcggcgcgccaggttgatgtccgtctgcagcctcctctcccactggcccttggacgacgacggcggcctgtgcgccggcggcttggccgccccgtcgccgccgctctgcagcttgcgcttgaggtgcgtgttccagtagttcttgatgtcgttgtccgtccgctccggcaggtacgacgcgatggccgcccacctacgccgcaccacgcgaagccat

SEQ ID NO: 23592 - DNA, 1345 bp, Zea mays
ggaaaaactatctgctatatatatgtggtctcaagcaagagctatatatgttattttcccatgcaacatgcagcttgcacaaggggaagtacgcactcaacttttacccacctagaaaagaaaaggctaaatataatgaaaactaacaactttagaaacaggtagctagctagccgactaatcagccaccgacttccttgcttgaacggattagcttggtctggatcagctgctggacacgctagctacaacaggtaataatccatgggggcggcgtccagcaagctggcgctctggacaggacggtggaagtgggtgtcgtcgtcgaacagccacgactcgatcgcagacagcggcatcatcagctggaacggcgcggccggcggcttcgtctcgtactcgaacaccgggccaccagcggccggcgcgacgacggcggtgccaccgccgtacgacacctccgaggaggacccggtggacgcggtctcggcgccgccgggcgtgcccggagccccgccgcggcgcttcccgttcaagccggcccatccgtccagcatccgggagacgttgtccgcggtgagaacgtacgtccccaaggcggcaggcgctggcggcggggagcactgcgacgacaagctcgaggccgccgggctgtcaccgccgacgatgcccacgccagcgccgtcgcgctgcggctgcggctgcggctgcggctgcggctgcggcgtgaggtcgccgagcggggtgagcgcctcgcggagcgcgcggcgcgccaggttgatgtccgtctgcagcctcctctcccactgccccttggagttggacggcggcggcctgtgcgccggcggcttggccgccccgtcgccgtcgccgtcgccgccgccggcctgcagcttgcgcttgaggtgcgtgttccagtagttcttgacgtcattgtccgtccgctccggcaggtacgacgcgatggccgcccacctgttgccgaggagggcctggaggtggacgatgagcttctcctcctgctccgtgaagttgccgcgcctgatgcccggccggaggtagttggtccaccgaagccggcagctcttgctgcaccgcatcagcccggttctggtggggacggcgcgccagttgccggggccgtggtcctggatgtaggagacgaggacgaggtcctcctccggcgtccacgggcccttcttgacgccctccttgtcgcagcacggcggcctcgccatggtgtgttcacgtttccctcagcctgcagaggggttattgatggttcgtgtgtgtttgatgtgagtactgagtactggtggtggaagttacagctgctagctagctt

SEQ ID NO: 23593 - DNA, 1803 bp, Zea mays
ttgaggggcatgcatgggaacttaaaatatctgctatgttagagatagcgatacaatttatgacatgtatgtgacataggattactggagtcaattatttttccacacaacatgcaacttgcacaagcggatctactacgtaccccaagctttacttgggagaaaaggctagaaaacagtaaaagaaaaggcccaagaacatactccgtcgtcgtcataagtgtggttctacttatgttctttggaatctaaatgaaaactacgcagatcccacgtaaacaacctgatcaagcgaccgatctgaaccagcttagctagccgattaatcagccaccgacgtcgtactgcaggatctgtgtagttttctttaggagacagcgccgtaatcacagtcgtccttgcttgaagggattagcttgagcttgatcgcttggacacactagagcgagaaggggtaatccatgggggcggcatcgagcaagctggcgctctggacagcatggtggaagtggctgtcgtcgtcgaacagccacgactcgatcgccgacagcggcatctgctgatgggacgtcggcacgcccggcttcgcctcgtactcgaagaccggcccaccacaagcgggcgccggcgcggccgatgcgacggcggcgccaccgtacgacacctccgacgcgtccgaggatcccgtggacgcgctctcggcaccgccgggggtgcccggggtcccgccgccgcggaccttccggccagcccacccgtccagcatccgcgagatgttctccgcggtgaggacgtacggccccgcggcgacggcggccgctggcgccaaaggggagcactgcgacgcgccagacgagctcgaagccgggctgtcaccgccgcccgtgcccgcgccagcgcccggcgcgtcggcggcggcgtcgcgctgcagctgcggcttgaggtcgtcgagcggggtgagggcctcgcgaagcgcgcggcgcgccaggttgatgtccgtctgcagcctcctctcccactgccccttggacgacgacggcggcctgtgcgccggcggcttggccgccccgtcgccgccgctctgcagcttgcgcttgaggtgcgtgttccagtagttcttgatgtcgttgtccgtccgctccggcaggtacgacgcgatggccgcccacctgttgccgaggagggcctggaggtgcacgatgagcttctcctcctgctcggtgaagttgccgcgcttgatgccaggccgcaggtagttggtccaccgcagacggcagctcttgctgcaccgcatcagcccggttctggccgggacggcgcgccagttgccggggccgtgctcctggatgtaggagacgaggacgaggtcctcctccggcgtccagggccccttcttgacgccctccttgtcgcagcacggcggcctcaccatggtgtgtccgtgctgatcaacgactagctagaacctctttctccgtgagcaaaacagctggcccctcagcttgcaggttatcgcttgcggattgctcgtgtactcgtgcggtgacgcgggtgaactgcggctgagcttggttggtggtggtggtggggagagatatgggcgaaaaaacacacacacaaaaaggctacagacgctaggcaccggcgccgtacgagaacaagagcagagtcgtcaggtcaccagagctcttgctctgacgatccgcgtcttgttgcgagcgagcaaccgaggttgaagaagccagcgcgcgtgtgttggtggtgcgtggcggcttgaggttgaggacaggggtccaaggtatt

SEQ ID NO: 23594 - DNA, 1210 bp, Zea mays
gcacgagaccattacctagaacctcctgcccggccggtacgtcgcctctcatcccggctctcgcctctcgctccccagccatccatggcgatgccaccgagccgttcgtgggcggagctgcagcacgacctcctggtgtcgatcatgacccgcgtgggcgcgccggacctcctctggggcggcgcttcccgcgcctgctcttcgtggcgggccgcggcgagggacccactcgcgtggcgacgcgtcgacctccgcgactgggtcgccctcacctccggccggcgcgccgcgagacctggacactccagctctcgcgtacccgtccacgccgcgctcgtcggcatcctggaggtcgccgccaagttggccgaagggcggatcgaggccgtgctgctccccgagtttgctgatgaggaccatctcttgttcctcgctgagaggtgcccaaacctgcactatttcagccttcctagcacctgtatgacttacgatcagttctgcaaggcgataggtggacttcaatcgcttaaaggcatggcagtggatgagagtctgattaattatgatgtcctcctgcatgtgcaccagtgctgcccagactttgtggagctgaaggtgtctgcactgtacgtggatgaagacatggcctcagtcatctgcaactctcttcctcgtctgaaaaagttggagataccaagttgtgacatgtcttccgctgcgattataaggttccttgattgcctagagcagctcgagcacctggacatctcaggttacgagacatcagccatctcaagcccggttcttgagaaagcttcgcggctcaaggtcttcctctggaactcgaaatttgagcttggggagttcatggactgctccaattgtggagagcacaacattaaccctcaagaaccctgcaagtgcatgatggagcacaaggtcatggactggctggctggaccttcataagcttcctgaaccaaaggcgtctcttcttgtgtcttgttaaatcatgacgttttactggctgtaaaattccaacctctgtcaaagttggtgtctgagctgtatgtacaaggaaatatgccacttcaaatgtttagcgcgccttcatgcatgatacttagagaggtctgcaactttttaatgtaacaaattgttgtatcaagtgttaatggaacctcttctttacaccaaaaaaaaaaaaaaa

SEQ ID NO: 23595 - DNA, 3262 bp, Zea mays
cggggcggaggaataaattcttcgaccctgccgcaaggaaggcacctcccttccccctctcttcaccgccgccgggaaggccgcagcttccactccaatccttgtctccacttgcccgcgattcctctcaccctcgactcactcactcacccttttctccacttgtgtatccgcggcggcggcggcggcctccactccactccgtccggtccactccctgtccctgggcccgacgtttcgtcggtgaatcctcgagctgctgccgtcacgtatgaggaactggagcgtcggggccgttgcggccttcgaatttgcgctctggagctccgtctggtgcttcctggtcgtctccgtcaccagtttctgagccgggatcctactcctcttctcgcgctactatcagtgcagtgcagtaggccactggactgctgtcgtgcggggtagttgcggccaaaggaacaagccaccttctccgagttggaattaggtgcggccctccgcatcaaaagggctcgtttggtgggaactttcgcttgcctactcgctgctgcctgcttcggtggtcctccgtgacggggattgctggaattggggttggaaggacattctgactgaattgctcgagtgaggggtggggtttcggcacccgttgcttgaggatggaggagaggccatcgtccgaggcaggcgcgggcaactcgagggccgaggacgacttcaggagctgctgcggggacgaggaagagtgggaggacacggaggagtcgttcacggccggtgtcgccaagggggagctggacgaggcctcggtgcgtctcttcttcaagggcgtgtcgagccctgaggcggaggggaagaagctgtctgggatcggagtcgtcatggagaggtcgcccggggtgcctgttcttaaggtgcagaagaagctggatttctatgtggaggagctcgtggctgatcacctcgccctcatggatgggctgcttgtcgctctgcagaatgggatcacgaagatcttcgcctttactaattcggagaagctctactttcaggtagcagttgctgaagctaatgcagacttgttcttcttcaagcatatcaacaaaatcatgcacttcatatctgcagatttcataggatcaactgtaactttaagtcactggtaaatatgctctttaaaaatattgattccatattgtttacctgtggagagtggctgtgaaccgaggcctcaatatctcattcagatttcaagtgtgcataccattttgctaagctcttgctttttggcagggaatagaaacattactctgaaggttgttgaattgttgttacctatagtagttgcattttgattttcttacctctcagtgaatacaaattggtcatttaaccattcatgtaggcataacagataactaccccagctggcacgtttaatttgtaattggttatatgtacacatattgcatgttgctggttcaatactgtctgttgagtctttacactggaaaacaaactgaactgaaatgagacagtcaaatgctcgaataaatgtgcagggacttgcagctttacacattccatatattgctgtatatgtctggtcataaagcatagattgctcactgataatcatgctatttcagttcagttgcctcatcttcttcttcttgtgtttctgtatcaaaatggaatctgttcatcctttgataactcaccatgtcctttttcttgtttttttttcggtgctgacagatagcagaagctgaaattcttgaagaccagcttttggtagctctaggacacaggattcttgaactggtggataagttggaagactttgatttgatattgcttcctagctttgaactagagaggcccttgcagttggctaaagaagctataggcatcagatatctgtctccctacgaggttggtacctgcccgatttgccgtgaggagaaactaggttctcagatgatcaaggcaggttgttctcacacatattgctataattgcctgactgggtatgttgaagagaagctgctgacctcgaagctgcctataaggtgtccacaattaaggtgtaaatacattatttccgctagtgagtgcaagtcgttccttccagttagcagctatgattccctggagagagcatttgcagaagctggcacctcaggaatggaaagattttattgtccctttccaaactgttcagtgctgttagaccttagtcagcacttctctagggcaagttcatcaagccagtcagatctcagttgtgtcgagtgcccagaatgccatagagatatatgtatcaactgtggagtgccgtggcacatcatgatgggctgtgatgagtaccagagcttgcccgctgaggaaagagatgctggagacctatctttgcatcggcttgcacagaacaataggtggaggcgttgccagagatgtcgacgtatgattgaactgacacagggctgcttccatatgacttgctggtgtgggcacgagttctgctactcctgcggtgctgactacgctagcggcgttcaaacatgccaatgcgtgttctgggacgacgaagccatggagccctcctccgccgcacggtccacccaagcagcgtccgagatctgggcgtgggacacatttgactgcatgccgaccgccgtggagggatactcggagcaggagagagcgcagctggcactcatccagaggttcctcgccggggggttcagcctgggtgagaacccctgccagtcgccgccccgctgcgccgactcctacatcgtcgacaccatgaaggacctccaccagctcccatggctcgagcggttcgtgtcggtgatcagcgacacgtacaacgatgactacatgcagtgaagagagggagggagggagagacagttatagatagcagtaaaagaaacggcacatactgagtcctccattcagaataatttgtttccatgcccctgtaggcaattggcgcagggaaaaatgatatgctttcatcatgaatacactggtgttgtttcctccattgtatggtaaccttcggcttcggtgctagttgtgcatgggcacaagagttctccattttatatgattatgtccttatttctttaaagtgagtgtaatctctctctctatatgtatatcttcagagctttctgaaattactcgttttgaatcaaatcagcagcatgagcaactgcctggatgatgccaaaaaaaaaaaaaaaaaaaa

SEQ ID NO: 23596 - DNA, 1531 bp, Zea mays
ccccccctcgagttttttttttttttttttccgtctttcacttactcctttctattattccattacatttcataatttgataggggcatcagacaatgggtttttgatgagcacaactatggatacaagatgaacagagcaacatgtgcacctgtgcttgctacaatttccatcaaacacacaagtctcagtttttttctggctaaaaaaattgagtcttgagccaacatcactagatcagcgtgatgtgacaacactacagcaatcacctggtggcctctgacagactactcccccttcccttcacttgagaagataaattatatcagtggcaggtgcaactccacaagaagtgtgacgacctgagaatcctaacattctgcacttatacaccaaataagagaactgattccaagctcttcacgtcagcaagacactgcatatttctcaaggagagagtggaaaggtaaagccagttgtccaactagcagttgagttattcagttcactctacacatgcatcttacaaatccagtggcattccaaacatatcgtttatctctgtcatgacatcacgagtggtgattgtgggttcaaatagaccattctcatccccaaatttgaaagaattgctctgactcgctttactggtgcagccctcttttaggtcatcatcagctaatatagagaaaccagaaatcggagctgcttttccatctgagtgtgcattagttttcctctttgttttttcgcccttgaagtttagtggttttccaaacatgctgtttatatcatccattgcttcctttagattaacagttgggtcgactaacccatggtgccatgcattttccaccttgggctcatcatcaatagaggatgcaacaaacctacgaatgacagtgtcttcttgaagtccagaagtcacagaatgaggaccttcacgattccttgttcctgaatcatcttgaactggacagagcaaattattagtattatgagtaggctgcacagttctgcaatttatattagcaccaccataacttttctcacatggttcttcatcatctggcaatatcgcaaaccctccaacaaatggcttctggaagtcactttcgccttgatgcctagatgaatcagataataatggccttggacctcgccccttactcttgtggcatagagcattctggacagtgtcattagcctcatcttctttaacaaagagttcagacttatttctttcctgatttaacttcgtgttttctttcctacaattcctgttttgccccgcattttgattgttgccattagcgcaatcctcatcaacaaagatctcaaacccactctgttcctttgaagaagtcctgttttgcgttccattttggtagctgccattaggaacatcctcatcaacaaagatctcaaatccacttgtttgctgactcaattttgtatggccctgcttcatactggttgtctggagcatgctagtattattgccactaggtttcatctcatcaacaaagat
